United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 38

SEQ ID NO: 1359099 - RNA, 23 nt, Mycobacterium tuberculosis H37Rv
gcacccaauccggcgccagcagu

SEQ ID NO: 1359100 - RNA, 15 nt, Mycobacterium tuberculosis H37Rv
gcacccaaugccacc

SEQ ID NO: 1359101 - RNA, 21 nt, Mycobacterium tuberculosis H37Rv
gcacccaaugccaccgcggcc

SEQ ID NO: 1359102 - RNA, 12 nt, Mycobacterium tuberculosis H37Rv
gcacccagaccg

SEQ ID NO: 1359103 - RNA, 21 nt, Mycobacterium tuberculosis H37Rv
gcacccacccguucggcugcg

SEQ ID NO: 1359104 - RNA, 20 nt, Mycobacterium tuberculosis H37Rv
gcaccauccggucccgccgu

SEQ ID NO: 1359105 - RNA, 14 nt, Mycobacterium tuberculosis H37Rv
gcaccaucgcggcc

SEQ ID NO: 1359106 - RNA, 23 nt, Mycobacterium tuberculosis H37Rv
gcaccaguuugugccgccgcggc

SEQ ID NO: 1359107 - RNA, 17 nt, Mycobacterium tuberculosis H37Rv
gcaccagguugcaaccu

SEQ ID NO: 1359108 - RNA, 14 nt, Mycobacterium tuberculosis H37Rv
gcaccagggccucg

SEQ ID NO: 1359109 - RNA, 22 nt, Mycobacterium tuberculosis H37Rv
gcaccagguguccccgcccggc

SEQ ID NO: 1359110 - RNA, 19 nt, Mycobacterium tuberculosis H37Rv
gcaccagcucacccggagc

SEQ ID NO: 1359111 - RNA, 23 nt, Mycobacterium tuberculosis H37Rv
gcaccagcucacccggagcaccc

SEQ ID NO: 1359112 - RNA, 20 nt, Mycobacterium tuberculosis H37Rv
gcaccagcugucgggcagcu

SEQ ID NO: 1359113 - RNA, 19 nt, Mycobacterium tuberculosis H37Rv
gcaccagcugucgggcagc

SEQ ID NO: 1359114 - RNA, 23 nt, Mycobacterium tuberculosis H37Rv
gcaccagcgccuugaccagcagc

SEQ ID NO: 1359115 - RNA, 20 nt, Mycobacterium tuberculosis H37Rv
gcaccagcgaauccagccgc

SEQ ID NO: 1359116 - RNA, 16 nt, Mycobacterium tuberculosis H37Rv
gcaccagcggcugacc

SEQ ID NO: 1359117 - RNA, 22 nt, Mycobacterium tuberculosis H37Rv
gcaccagcggcugaccgggcag

SEQ ID NO: 1359118 - RNA, 13 nt, Mycobacterium tuberculosis H37Rv
gcaccagccagcc

SEQ ID NO: 1359119 - RNA, 12 nt, Mycobacterium tuberculosis H37Rv
gcaccagccggu

SEQ ID NO: 1359120 - RNA, 17 nt, Mycobacterium tuberculosis H37Rv
gcaccacggcggccacc

SEQ ID NO: 1359121 - RNA, 14 nt, Mycobacterium tuberculosis H37Rv
gcaccacggccagc

SEQ ID NO: 1359122 - RNA, 18 nt, Mycobacterium tuberculosis H37Rv
gcaccagcagccagccca

SEQ ID NO: 1359123 - RNA, 20 nt, Mycobacterium tuberculosis H37Rv
gcaccagccaaaucagccag

SEQ ID NO: 1359124 - RNA, 15 nt, Mycobacterium tuberculosis H37Rv
gcaccagcagcacca

SEQ ID NO: 1359125 - RNA, 17 nt, Mycobacterium tuberculosis H37Rv
gcaccacgagcagccga

SEQ ID NO: 1359126 - RNA, 14 nt, Mycobacterium tuberculosis H37Rv
gcaccaccggcccc

SEQ ID NO: 1359127 - RNA, 19 nt, Mycobacterium tuberculosis H37Rv
gcaccacccuugccgauga

SEQ ID NO: 1359128 - RNA, 19 nt, Mycobacterium tuberculosis H37Rv
gcaccaccacccgauccac

SEQ ID NO: 1359129 - RNA, 20 nt, Mycobacterium tuberculosis H37Rv
gcaccaccccagcggccacc

SEQ ID NO: 1359130 - RNA, 21 nt, Mycobacterium tuberculosis H37Rv
gcaccaccccgaggccgaccu

SEQ ID NO: 1359131 - RNA, 16 nt, Mycobacterium tuberculosis H37Rv
gcaccaagacgccacc

SEQ ID NO: 1359132 - RNA, 21 nt, Mycobacterium tuberculosis H37Rv
gcaccaaggccgccugcaaca

SEQ ID NO: 1359133 - RNA, 19 nt, Mycobacterium tuberculosis H37Rv
gcaccaagcagcgaccagc

SEQ ID NO: 1359134 - RNA, 14 nt, Mycobacterium tuberculosis H37Rv
gcaccaacgccacc

SEQ ID NO: 1359135 - RNA, 16 nt, Mycobacterium tuberculosis H37Rv
gcaccaacaccagcgc

SEQ ID NO: 1359136 - RNA, 18 nt, Mycobacterium tuberculosis H37Rv
gcaccacaccacgguggc

SEQ ID NO: 1359137 - RNA, 19 nt, Mycobacterium tuberculosis H37Rv
gcaccacaauccacgcacu

SEQ ID NO: 1359138 - RNA, 14 nt, Mycobacterium tuberculosis H37Rv
gcaccacaauccac

SEQ ID NO: 1359139 - RNA, 22 nt, Mycobacterium tuberculosis H37Rv
gcaccacaaacaccccacacag

SEQ ID NO: 1359140 - RNA, 20 nt, Mycobacterium tuberculosis H37Rv
gcaccacaaacaccccacac

SEQ ID NO: 1359141 - RNA, 21 nt, Mycobacterium tuberculosis H37Rv
gcaccacaccgugggcgacgg

SEQ ID NO: 1359142 - RNA, 14 nt, Mycobacterium tuberculosis H37Rv
gcaccacagugcca

SEQ ID NO: 1359143 - RNA, 23 nt, Mycobacterium tuberculosis H37Rv
gcaccacauuggcgaucagcagc

SEQ ID NO: 1359144 - RNA, 16 nt, Mycobacterium tuberculosis H37Rv
gcacgccaccgggacg

SEQ ID NO: 1359145 - RNA, 15 nt, Mycobacterium tuberculosis H37Rv
gcacgcccacagcug

SEQ ID NO: 1359146 - RNA, 14 nt, Mycobacterium tuberculosis H37Rv
gcacgcagagccaa

SEQ ID NO: 1359147 - RNA, 17 nt, Mycobacterium tuberculosis H37Rv
gcacgcaccacaaucca

SEQ ID NO: 1359148 - RNA, 19 nt, Mycobacterium tuberculosis H37Rv
gcacgcaguucggucagcg

SEQ ID NO: 1359149 - RNA, 12 nt, Mycobacterium tuberculosis H37Rv
gcacgcaugccg

SEQ ID NO: 1359150 - RNA, 23 nt, Mycobacterium tuberculosis H37Rv
gcacgcccucgacgcgcucgggc

SEQ ID NO: 1359151 - RNA, 15 nt, Mycobacterium tuberculosis H37Rv
gcacgcccgccugca

SEQ ID NO: 1359152 - RNA, 14 nt, Mycobacterium tuberculosis H37Rv
gcacgccgccggcc

SEQ ID NO: 1359153 - RNA, 13 nt, Mycobacterium tuberculosis H37Rv
gcacgccggccgc

SEQ ID NO: 1359154 - RNA, 16 nt, Mycobacterium tuberculosis H37Rv
gcacgccggcaugcca

SEQ ID NO: 1359155 - RNA, 19 nt, Mycobacterium tuberculosis H37Rv
gcacgccgaccggcccgca

SEQ ID NO: 1359156 - RNA, 20 nt, Mycobacterium tuberculosis H37Rv
gcacgcaaugucggcagggc

SEQ ID NO: 1359157 - RNA, 16 nt, Mycobacterium tuberculosis H37Rv
gcacgagugcggcgac

SEQ ID NO: 1359158 - RNA, 14 nt, Mycobacterium tuberculosis H37Rv
gcacgauccagcug

SEQ ID NO: 1359159 - RNA, 14 nt, Mycobacterium tuberculosis H37Rv
gcacgauacucacc

SEQ ID NO: 1359160 - RNA, 15 nt, Mycobacterium tuberculosis H37Rv
gcacgauccagcugu

SEQ ID NO: 1359161 - RNA, 13 nt, Mycobacterium tuberculosis H37Rv
gcacgaucgcggu

SEQ ID NO: 1359162 - RNA, 21 nt, Mycobacterium tuberculosis H37Rv
gcacgaucgcccgugagcgcc

SEQ ID NO: 1359163 - RNA, 21 nt, Mycobacterium tuberculosis H37Rv
gcaccuggucggccgcaaggc

SEQ ID NO: 1359164 - RNA, 22 nt, Mycobacterium tuberculosis H37Rv
gcacgacgccggccuggccgcc

SEQ ID NO: 1359165 - RNA, 16 nt, Mycobacterium tuberculosis H37Rv
gcacgacgccggccug

SEQ ID NO: 1359166 - RNA, 15 nt, Mycobacterium tuberculosis H37Rv
gcacgacgccggccu

SEQ ID NO: 1359167 - RNA, 16 nt, Mycobacterium tuberculosis H37Rv
gcacgacgggggagca

SEQ ID NO: 1359168 - RNA, 23 nt, Mycobacterium tuberculosis H37Rv
gcacgacaucgucgcgacgacgu

SEQ ID NO: 1359169 - RNA, 16 nt, Mycobacterium tuberculosis H37Rv
gcacgacccgcugguc

SEQ ID NO: 1359170 - RNA, 17 nt, Mycobacterium tuberculosis H37Rv
gcacgacccgggaagga

SEQ ID NO: 1359171 - RNA, 12 nt, Mycobacterium tuberculosis H37Rv
gcacgacccggg

SEQ ID NO: 1359172 - RNA, 20 nt, Mycobacterium tuberculosis H37Rv
gcacgacccgggaaggaacc

SEQ ID NO: 1359173 - RNA, 19 nt, Mycobacterium tuberculosis H37Rv
gcacgaccucgcgcggggc

SEQ ID NO: 1359174 - RNA, 23 nt, Mycobacterium tuberculosis H37Rv
gcacgaaauugggcgauucugcg

SEQ ID NO: 1359175 - RNA, 20 nt, Mycobacterium tuberculosis H37Rv
gcacgaaucccccggacggc

SEQ ID NO: 1359176 - RNA, 18 nt, Mycobacterium tuberculosis H37Rv
gcacgaagcuggcgugca

SEQ ID NO: 1359177 - RNA, 18 nt, Mycobacterium tuberculosis H37Rv
gcacgaacgccugcucgu

SEQ ID NO: 1359178 - RNA, 20 nt, Mycobacterium tuberculosis H37Rv
gcacggaaggucgacauggg

SEQ ID NO: 1359179 - RNA, 20 nt, Mycobacterium tuberculosis H37Rv
gcacggacaguuccccgggc

SEQ ID NO: 1359180 - RNA, 20 nt, Mycobacterium tuberculosis H37Rv
gcacggaccaucgccaggcc

SEQ ID NO: 1359181 - RNA, 23 nt, Mycobacterium tuberculosis H37Rv
gcacgcugaguccccaggugggc

SEQ ID NO: 1359182 - RNA, 14 nt, Mycobacterium tuberculosis H37Rv
gcacgcucugcgcc

SEQ ID NO: 1359183 - RNA, 18 nt, Mycobacterium tuberculosis H37Rv
gcacgcucugcgccacag

SEQ ID NO: 1359184 - RNA, 14 nt, Mycobacterium tuberculosis H37Rv
gcacgcucguuugg

SEQ ID NO: 1359185 - RNA, 17 nt, Mycobacterium tuberculosis H37Rv
gcacgcugagccggucg

SEQ ID NO: 1359186 - RNA, 15 nt, Mycobacterium tuberculosis H37Rv
gcacgcuagccgaca

SEQ ID NO: 1359187 - RNA, 19 nt, Mycobacterium tuberculosis H37Rv
gcacgcggaaaggcuuccg

SEQ ID NO: 1359188 - RNA, 20 nt, Mycobacterium tuberculosis H37Rv
gcacgccuugagccgaggcg

SEQ ID NO: 1359189 - RNA, 14 nt, Mycobacterium tuberculosis H37Rv
gcacgcgcgcgacc

SEQ ID NO: 1359190 - RNA, 19 nt, Mycobacterium tuberculosis H37Rv
gcacgcggcaauggugcgg

SEQ ID NO: 1359191 - RNA, 16 nt, Mycobacterium tuberculosis H37Rv
gcacgccggcggcgga

SEQ ID NO: 1359192 - RNA, 12 nt, Mycobacterium tuberculosis H37Rv
gcacgccgggca

SEQ ID NO: 1359193 - RNA, 21 nt, Mycobacterium tuberculosis H37Rv
gcacgccgguggucacgccgu

SEQ ID NO: 1359194 - RNA, 22 nt, Mycobacterium tuberculosis H37Rv
gcacgccguagcaucgggcgag

SEQ ID NO: 1359195 - RNA, 13 nt, Mycobacterium tuberculosis H37Rv
gcacgccggcgcu

SEQ ID NO: 1359196 - RNA, 13 nt, Mycobacterium tuberculosis H37Rv
gcacggcacccac

SEQ ID NO: 1359197 - RNA, 18 nt, Mycobacterium tuberculosis H37Rv
gcacggcaaccagcgagc

SEQ ID NO: 1359198 - RNA, 14 nt, Mycobacterium tuberculosis H37Rv
gcacggccgggucg

SEQ ID NO: 1359199 - RNA, 18 nt, Mycobacterium tuberculosis H37Rv
gcacggccccugccacga

SEQ ID NO: 1359200 - RNA, 13 nt, Mycobacterium tuberculosis H37Rv
gcacggccgagca

SEQ ID NO: 1359201 - RNA, 22 nt, Mycobacterium tuberculosis H37Rv
gcacggccaccgcgcaacccgg

SEQ ID NO: 1359202 - RNA, 13 nt, Mycobacterium tuberculosis H37Rv
gcacggcgcggcg

SEQ ID NO: 1359203 - RNA, 15 nt, Mycobacterium tuberculosis H37Rv
gcacggcgcggcgga

SEQ ID NO: 1359204 - RNA, 14 nt, Mycobacterium tuberculosis H37Rv
gcacggcgccgcca

SEQ ID NO: 1359205 - RNA, 23 nt, Mycobacterium tuberculosis H37Rv
gcacggccaugaucacaccgcug

SEQ ID NO: 1359206 - RNA, 15 nt, Mycobacterium tuberculosis H37Rv
gcacggcgacgccag

SEQ ID NO: 1359207 - RNA, 20 nt, Mycobacterium tuberculosis H37Rv
gcacggcuucggcgagcgca

SEQ ID NO: 1359208 - RNA, 17 nt, Mycobacterium tuberculosis H37Rv
gcacggcgaggugcucg

SEQ ID NO: 1359209 - RNA, 17 nt, Mycobacterium tuberculosis H37Rv
gcacggcgucggccacc

SEQ ID NO: 1359210 - RNA, 19 nt, Mycobacterium tuberculosis H37Rv
gcacgggaaucgcucgcgc

SEQ ID NO: 1359211 - RNA, 18 nt, Mycobacterium tuberculosis H37Rv
gcacggugaucagcagca

SEQ ID NO: 1359212 - RNA, 15 nt, Mycobacterium tuberculosis H37Rv
gcacggugcccaggg

SEQ ID NO: 1359213 - RNA, 16 nt, Mycobacterium tuberculosis H37Rv
gcacggugcccagggc

SEQ ID NO: 1359214 - RNA, 20 nt, Mycobacterium tuberculosis H37Rv
gcacgguguugcgcacccgc

SEQ ID NO: 1359215 - RNA, 17 nt, Mycobacterium tuberculosis H37Rv
gcacgguugccgucagg

SEQ ID NO: 1359216 - RNA, 18 nt, Mycobacterium tuberculosis H37Rv
gcacguacucggccagcu

SEQ ID NO: 1359217 - RNA, 18 nt, Mycobacterium tuberculosis H37Rv
gcacguagacggugucac

SEQ ID NO: 1359218 - RNA, 13 nt, Mycobacterium tuberculosis H37Rv
gcacgguggcuuc

SEQ ID NO: 1359219 - RNA, 12 nt, Mycobacterium tuberculosis H37Rv
gcacgguggcaa

SEQ ID NO: 1359220 - RNA, 14 nt, Mycobacterium tuberculosis H37Rv
gcacgguggcaaug

SEQ ID NO: 1359221 - RNA, 21 nt, Mycobacterium tuberculosis H37Rv
gcacucgcccaagcgcagccu

SEQ ID NO: 1359222 - RNA, 17 nt, Mycobacterium tuberculosis H37Rv
gcacucccggaguggcc

SEQ ID NO: 1359223 - RNA, 20 nt, Mycobacterium tuberculosis H37Rv
gcacucccggcucggccagc

SEQ ID NO: 1359224 - RNA, 16 nt, Mycobacterium tuberculosis H37Rv
gcacuccagcggcggg

SEQ ID NO: 1359225 - RNA, 13 nt, Mycobacterium tuberculosis H37Rv
gcacuccagcggc

SEQ ID NO: 1359226 - RNA, 17 nt, Mycobacterium tuberculosis H37Rv
gcacucaugaugccgga

SEQ ID NO: 1359227 - RNA, 23 nt, Mycobacterium tuberculosis H37Rv
gcacucaugaugccggacgccau

SEQ ID NO: 1359228 - RNA, 17 nt, Mycobacterium tuberculosis H37Rv
gcacuccaccgcuggcc

SEQ ID NO: 1359229 - RNA, 19 nt, Mycobacterium tuberculosis H37Rv
gcacuccaagucacagcuc

SEQ ID NO: 1359230 - RNA, 20 nt, Mycobacterium tuberculosis H37Rv
gcacugaugucacccgcccg

SEQ ID NO: 1359231 - RNA, 21 nt, Mycobacterium tuberculosis H37Rv
gcacucguugccgaccaugca

SEQ ID NO: 1359232 - RNA, 19 nt, Mycobacterium tuberculosis H37Rv
gcacucgggauucggcagc

SEQ ID NO: 1359233 - RNA, 19 nt, Mycobacterium tuberculosis H37Rv
gcacguuguucagcccgcc

SEQ ID NO: 1359234 - RNA, 17 nt, Mycobacterium tuberculosis H37Rv
gcacguucagccaggcg

SEQ ID NO: 1359235 - RNA, 21 nt, Mycobacterium tuberculosis H37Rv
gcacguucagccaggcgugca

SEQ ID NO: 1359236 - RNA, 23 nt, Mycobacterium tuberculosis H37Rv
gcacuaccccacaagcgauggca

SEQ ID NO: 1359237 - RNA, 21 nt, Mycobacterium tuberculosis H37Rv
gcacuagcccgaccgguccag

SEQ ID NO: 1359238 - RNA, 13 nt, Mycobacterium tuberculosis H37Rv
gcacguggcgacc

SEQ ID NO: 1359239 - RNA, 18 nt, Mycobacterium tuberculosis H37Rv
gcacguucacgcgcggau

SEQ ID NO: 1359240 - RNA, 16 nt, Mycobacterium tuberculosis H37Rv
gcacgucgcauugugc

SEQ ID NO: 1359241 - RNA, 15 nt, Mycobacterium tuberculosis H37Rv
gcacguggccacggc

SEQ ID NO: 1359242 - RNA, 13 nt, Mycobacterium tuberculosis H37Rv
gcacgucgagcag

SEQ ID NO: 1359243 - RNA, 18 nt, Mycobacterium tuberculosis H37Rv
gcacgucgacccccugcc

SEQ ID NO: 1359244 - RNA, 17 nt, Mycobacterium tuberculosis H37Rv
gcacuuccagcccggca

SEQ ID NO: 1359245 - RNA, 16 nt, Mycobacterium tuberculosis H37Rv
gcacuuccagcccggc

SEQ ID NO: 1359246 - RNA, 18 nt, Mycobacterium tuberculosis H37Rv
gcacuuggacccggccgg

SEQ ID NO: 1359247 - RNA, 16 nt, Mycobacterium tuberculosis H37Rv
gcacuugaucgacggc

SEQ ID NO: 1359248 - RNA, 18 nt, Mycobacterium tuberculosis H37Rv
gcacuuggcccccgacgg

SEQ ID NO: 1359249 - RNA, 16 nt, Mycobacterium tuberculosis H37Rv
gcacuuggcccccgac

SEQ ID NO: 1359250 - RNA, 21 nt, Mycobacterium tuberculosis H37Rv
gcagaaacaacgucgccgcgg

SEQ ID NO: 1359251 - RNA, 22 nt, Mycobacterium tuberculosis H37Rv
gcagaaacaacgucgccgcggc

SEQ ID NO: 1359252 - RNA, 22 nt, Mycobacterium tuberculosis H37Rv
gcagaaaaucugcuagcuuggc

SEQ ID NO: 1359253 - RNA, 12 nt, Mycobacterium tuberculosis H37Rv
gcacuggccccg

SEQ ID NO: 1359254 - RNA, 13 nt, Mycobacterium tuberculosis H37Rv
gcacuggccccgg

SEQ ID NO: 1359255 - RNA, 15 nt, Mycobacterium tuberculosis H37Rv
gcacugcggcagcga

SEQ ID NO: 1359256 - RNA, 17 nt, Mycobacterium tuberculosis H37Rv
gcacugcccagcagacc

SEQ ID NO: 1359257 - RNA, 16 nt, Mycobacterium tuberculosis H37Rv
gcacugccgggugggc

SEQ ID NO: 1359258 - RNA, 20 nt, Mycobacterium tuberculosis H37Rv
gcacuguugcguagcgcgcu

SEQ ID NO: 1359259 - RNA, 16 nt, Mycobacterium tuberculosis H37Rv
gcacuguggaagaacc

SEQ ID NO: 1359260 - RNA, 21 nt, Mycobacterium tuberculosis H37Rv
gcacugguugggcgagaccgc

SEQ ID NO: 1359261 - RNA, 23 nt, Mycobacterium tuberculosis H37Rv
gcacugggugcgucgacccagcu

SEQ ID NO: 1359262 - RNA, 21 nt, Mycobacterium tuberculosis H37Rv
gcagagucgcacugcgccggc

SEQ ID NO: 1359263 - RNA, 16 nt, Mycobacterium tuberculosis H37Rv
gcagagucaacagaua

SEQ ID NO: 1359264 - RNA, 18 nt, Mycobacterium tuberculosis H37Rv
gcagagccccggcaagcg

SEQ ID NO: 1359265 - RNA, 13 nt, Mycobacterium tuberculosis H37Rv
gcagagccccggc

SEQ ID NO: 1359266 - RNA, 17 nt, Mycobacterium tuberculosis H37Rv
gcagagcacgcgcggcg

SEQ ID NO: 1359267 - RNA, 13 nt, Mycobacterium tuberculosis H37Rv
gcagagccaacgc

SEQ ID NO: 1359268 - RNA, 17 nt, Mycobacterium tuberculosis H37Rv
gcagagccaacgcgcga

SEQ ID NO: 1359269 - RNA, 23 nt, Mycobacterium tuberculosis H37Rv
gcagagucgcacugcgccggccg

SEQ ID NO: 1359270 - RNA, 20 nt, Mycobacterium tuberculosis H37Rv
gcagauggcauugcgcccac

SEQ ID NO: 1359271 - RNA, 13 nt, Mycobacterium tuberculosis H37Rv
gcagaugggccuc

SEQ ID NO: 1359272 - RNA, 15 nt, Mycobacterium tuberculosis H37Rv
gcagauuccucuuca

SEQ ID NO: 1359273 - RNA, 23 nt, Mycobacterium tuberculosis H37Rv
gcagauggugaacgugccuuccu

SEQ ID NO: 1359274 - RNA, 13 nt, Mycobacterium tuberculosis H37Rv
gcagauggugguc

SEQ ID NO: 1359275 - RNA, 17 nt, Mycobacterium tuberculosis H37Rv
gcagaugggccuccacc

SEQ ID NO: 1359276 - RNA, 20 nt, Mycobacterium tuberculosis H37Rv
gcagaucgaaaucagcccgc

SEQ ID NO: 1359277 - RNA, 22 nt, Mycobacterium tuberculosis H37Rv
gcagaucgaaaucagcccgcgc

SEQ ID NO: 1359278 - RNA, 19 nt, Mycobacterium tuberculosis H37Rv
gcagaucgccccagccaug

SEQ ID NO: 1359279 - RNA, 12 nt, Mycobacterium tuberculosis H37Rv
gcagauccaggc

SEQ ID NO: 1359280 - RNA, 14 nt, Mycobacterium tuberculosis H37Rv
gcagauccccgcca

SEQ ID NO: 1359281 - RNA, 15 nt, Mycobacterium tuberculosis H37Rv
gcagauccccgccac

SEQ ID NO: 1359282 - RNA, 15 nt, Mycobacterium tuberculosis H37Rv
gcagaucaccgccag

SEQ ID NO: 1359283 - RNA, 16 nt, Mycobacterium tuberculosis H37Rv
gcagaucaccgccagc

SEQ ID NO: 1359284 - RNA, 16 nt, Mycobacterium tuberculosis H37Rv
gcagaucacgggugug

SEQ ID NO: 1359285 - RNA, 19 nt, Mycobacterium tuberculosis H37Rv
gcagacgcauaagcccccg

SEQ ID NO: 1359286 - RNA, 20 nt, Mycobacterium tuberculosis H37Rv
gcagacgcauaagcccccgc

SEQ ID NO: 1359287 - RNA, 20 nt, Mycobacterium tuberculosis H37Rv
gcagacgaaguagccgacca

SEQ ID NO: 1359288 - RNA, 14 nt, Mycobacterium tuberculosis H37Rv
gcagacgccgcguu

SEQ ID NO: 1359289 - RNA, 19 nt, Mycobacterium tuberculosis H37Rv
gcagacgcaaaaucgcccg

SEQ ID NO: 1359290 - RNA, 24 nt, Mycobacterium tuberculosis H37Rv
gcagacgcguuucgucgaccgcgc

SEQ ID NO: 1359291 - RNA, 16 nt, Mycobacterium tuberculosis H37Rv
gcagacggcugccacg

SEQ ID NO: 1359292 - RNA, 16 nt, Mycobacterium tuberculosis H37Rv
gcagacaggcggcggc

SEQ ID NO: 1359293 - RNA, 15 nt, Mycobacterium tuberculosis H37Rv
gcagacccgggccag

SEQ ID NO: 1359294 - RNA, 19 nt, Mycobacterium tuberculosis H37Rv
gcagacgugguagccggcg

SEQ ID NO: 1359295 - RNA, 15 nt, Mycobacterium tuberculosis H37Rv
gcagacgucaugcgg

SEQ ID NO: 1359296 - RNA, 19 nt, Mycobacterium tuberculosis H37Rv
gcagacucgccaccgcggc

SEQ ID NO: 1359297 - RNA, 17 nt, Mycobacterium tuberculosis H37Rv
gcagacggcugccacgc

SEQ ID NO: 1359298 - RNA, 20 nt, Mycobacterium tuberculosis H37Rv
gcagacguaaaagcccccgc

SEQ ID NO: 1359299 - RNA, 15 nt, Mycobacterium tuberculosis H37Rv
gcagacacugcugcg

SEQ ID NO: 1359300 - RNA, 20 nt, Mycobacterium tuberculosis H37Rv
gcagacacgagucgccagac

SEQ ID NO: 1359301 - RNA, 22 nt, Mycobacterium tuberculosis H37Rv
gcagaagucguugcgcggucuc

SEQ ID NO: 1359302 - RNA, 20 nt, Mycobacterium tuberculosis H37Rv
gcagaagucguugcgcgguc

SEQ ID NO: 1359303 - RNA, 15 nt, Mycobacterium tuberculosis H37Rv
gcagaauccugcgcu

SEQ ID NO: 1359304 - RNA, 22 nt, Mycobacterium tuberculosis H37Rv
gcagaaucgcauugggcgggcu

SEQ ID NO: 1359305 - RNA, 18 nt, Mycobacterium tuberculosis H37Rv
gcagcaucgccagcagga

SEQ ID NO: 1359306 - RNA, 19 nt, Mycobacterium tuberculosis H37Rv
gcagcaucggcaccccggc

SEQ ID NO: 1359307 - RNA, 18 nt, Mycobacterium tuberculosis H37Rv
gcagcaucgucgccacga

SEQ ID NO: 1359308 - RNA, 21 nt, Mycobacterium tuberculosis H37Rv
gcagcaucuccgucggccagg

SEQ ID NO: 1359309 - RNA, 22 nt, Mycobacterium tuberculosis H37Rv
gcagcaucuccgucggccaggc

SEQ ID NO: 1359310 - RNA, 15 nt, Mycobacterium tuberculosis H37Rv
gcagcaucuccgccg

SEQ ID NO: 1359311 - RNA, 16 nt, Mycobacterium tuberculosis H37Rv
gcagcaggugagccag

SEQ ID NO: 1359312 - RNA, 22 nt, Mycobacterium tuberculosis H37Rv
gcagcagggcgcgcaucugcuc

SEQ ID NO: 1359313 - RNA, 21 nt, Mycobacterium tuberculosis H37Rv
gcagcaggucgaugcugccag

SEQ ID NO: 1359314 - RNA, 17 nt, Mycobacterium tuberculosis H37Rv
gcagcagcgggcgcgcu

SEQ ID NO: 1359315 - RNA, 12 nt, Mycobacterium tuberculosis H37Rv
gcagcaggacac

SEQ ID NO: 1359316 - RNA, 20 nt, Mycobacterium tuberculosis H37Rv
gcagcaggggacgaccaugc

SEQ ID NO: 1359317 - RNA, 13 nt, Mycobacterium tuberculosis H37Rv
gcagcagcgggcg

SEQ ID NO: 1359318 - RNA, 12 nt, Mycobacterium tuberculosis H37Rv
gcagcagcggca

SEQ ID NO: 1359319 - RNA, 17 nt, Mycobacterium tuberculosis H37Rv
gcagcagcggugcagcc

SEQ ID NO: 1359320 - RNA, 16 nt, Mycobacterium tuberculosis H37Rv
gcagcagcgcgcggau

SEQ ID NO: 1359321 - RNA, 19 nt, Mycobacterium tuberculosis H37Rv
gcagcagcgccgcguggcu

SEQ ID NO: 1359322 - RNA, 19 nt, Mycobacterium tuberculosis H37Rv
gcagcagauugaugucagg

SEQ ID NO: 1359323 - RNA, 22 nt, Mycobacterium tuberculosis H37Rv
gcagcccaaagcgccagcagcc

SEQ ID NO: 1359324 - RNA, 21 nt, Mycobacterium tuberculosis H37Rv
gcagcccaaaucccagagcau

SEQ ID NO: 1359325 - RNA, 16 nt, Mycobacterium tuberculosis H37Rv
gcagccaugcggcugc

SEQ ID NO: 1359326 - RNA, 15 nt, Mycobacterium tuberculosis H37Rv
gcagccagggcgccg

SEQ ID NO: 1359327 - RNA, 14 nt, Mycobacterium tuberculosis H37Rv
gcagccaggcugcg

SEQ ID NO: 1359328 - RNA, 13 nt, Mycobacterium tuberculosis H37Rv
gcagccaggcacg

SEQ ID NO: 1359329 - RNA, 17 nt, Mycobacterium tuberculosis H37Rv
gcagccagcugaacacg

SEQ ID NO: 1359330 - RNA, 14 nt, Mycobacterium tuberculosis H37Rv
gcagccagcccagc

SEQ ID NO: 1359331 - RNA, 23 nt, Mycobacterium tuberculosis H37Rv
gcagccagauucauuggccuggc

SEQ ID NO: 1359332 - RNA, 12 nt, Mycobacterium tuberculosis H37Rv
gcagccagcaag

SEQ ID NO: 1359333 - RNA, 14 nt, Mycobacterium tuberculosis H37Rv
gcagccacccgaca

SEQ ID NO: 1359334 - RNA, 21 nt, Mycobacterium tuberculosis H37Rv
gcagccacauacaggcccgcc

SEQ ID NO: 1359335 - RNA, 18 nt, Mycobacterium tuberculosis H37Rv
gcagccaagcgagcggcg

SEQ ID NO: 1359336 - RNA, 19 nt, Mycobacterium tuberculosis H37Rv
gcagccacgcgggcgcggu

SEQ ID NO: 1359337 - RNA, 16 nt, Mycobacterium tuberculosis H37Rv
gcagcacggucugggu

SEQ ID NO: 1359338 - RNA, 21 nt, Mycobacterium tuberculosis H37Rv
gcagcacgggugagcaccacg

SEQ ID NO: 1359339 - RNA, 23 nt, Mycobacterium tuberculosis H37Rv
gcagcacucgcccaagcgcagcc

SEQ ID NO: 1359340 - RNA, 16 nt, Mycobacterium tuberculosis H37Rv
gcagcacugcggcagc

SEQ ID NO: 1359341 - RNA, 21 nt, Mycobacterium tuberculosis H37Rv
gcagcacuuggacccggccgg

SEQ ID NO: 1359342 - RNA, 17 nt, Mycobacterium tuberculosis H37Rv
gcagcacgucugcgucc

SEQ ID NO: 1359343 - RNA, 15 nt, Mycobacterium tuberculosis H37Rv
gcagcagcagcuucg

SEQ ID NO: 1359344 - RNA, 13 nt, Mycobacterium tuberculosis H37Rv
gcagcacccgggc

SEQ ID NO: 1359345 - RNA, 13 nt, Mycobacterium tuberculosis H37Rv
gcagcacccccuc

SEQ ID NO: 1359346 - RNA, 16 nt, Mycobacterium tuberculosis H37Rv
gcagcacccccucggc

SEQ ID NO: 1359347 - RNA, 20 nt, Mycobacterium tuberculosis H37Rv
gcagcaccgacgugauggug

SEQ ID NO: 1359348 - RNA, 20 nt, Mycobacterium tuberculosis H37Rv
gcagcaccgucgggcccagc

SEQ ID NO: 1359349 - RNA, 21 nt, Mycobacterium tuberculosis H37Rv
gcagcaccgucgggcccagcc

SEQ ID NO: 1359350 - RNA, 14 nt, Mycobacterium tuberculosis H37Rv
gcagcacgauccag

SEQ ID NO: 1359351 - RNA, 16 nt, Mycobacterium tuberculosis H37Rv
gcagcacgauccagcu

SEQ ID NO: 1359352 - RNA, 21 nt, Mycobacterium tuberculosis H37Rv
gcagcaauccaaggcucagca

SEQ ID NO: 1359353 - RNA, 16 nt, Mycobacterium tuberculosis H37Rv
gcagcaccagcgccuu

SEQ ID NO: 1359354 - RNA, 21 nt, Mycobacterium tuberculosis H37Rv
gcagcaccagcgccuugacca

SEQ ID NO: 1359355 - RNA, 13 nt, Mycobacterium tuberculosis H37Rv
gcagcaccagcca

SEQ ID NO: 1359356 - RNA, 22 nt, Mycobacterium tuberculosis H37Rv
gcagcacauacgauuucgacga

SEQ ID NO: 1359357 - RNA, 23 nt, Mycobacterium tuberculosis H37Rv
gcagcacauccugcagcucgggc

SEQ ID NO: 1359358 - RNA, 12 nt, Mycobacterium tuberculosis H37Rv
gcagcaacaccu

SEQ ID NO: 1359359 - RNA, 22 nt, Mycobacterium tuberculosis H37Rv
gcagcaaaaacgcugccgccgu

SEQ ID NO: 1359360 - RNA, 14 nt, Mycobacterium tuberculosis H37Rv
gcagcaagccgccg

SEQ ID NO: 1359361 - RNA, 21 nt, Mycobacterium tuberculosis H37Rv
gcagcaacugggcggccuggu

SEQ ID NO: 1359362 - RNA, 18 nt, Mycobacterium tuberculosis H37Rv
gcagcaacgcggugccgg

SEQ ID NO: 1359363 - RNA, 15 nt, Mycobacterium tuberculosis H37Rv
gcagcgugggcagcg

SEQ ID NO: 1359364 - RNA, 22 nt, Mycobacterium tuberculosis H37Rv
gcagcguugacggucagccgcg

SEQ ID NO: 1359365 - RNA, 20 nt, Mycobacterium tuberculosis H37Rv
gcagcgugcagcggcgggcg

SEQ ID NO: 1359366 - RNA, 18 nt, Mycobacterium tuberculosis H37Rv
gcagcgugcagcggcggg

SEQ ID NO: 1359367 - RNA, 21 nt, Mycobacterium tuberculosis H37Rv
gcagcgugcacacccgcaaug

SEQ ID NO: 1359368 - RNA, 19 nt, Mycobacterium tuberculosis H37Rv
gcagcgggccacugagcca

SEQ ID NO: 1359369 - RNA, 15 nt, Mycobacterium tuberculosis H37Rv
gcagcgggcgguguc

SEQ ID NO: 1359370 - RNA, 21 nt, Mycobacterium tuberculosis H37Rv
gcagcgucggugccaccacgc

SEQ ID NO: 1359371 - RNA, 18 nt, Mycobacterium tuberculosis H37Rv
gcagcggcgggcgaugac

SEQ ID NO: 1359372 - RNA, 14 nt, Mycobacterium tuberculosis H37Rv
gcagcggcgccgcc

SEQ ID NO: 1359373 - RNA, 14 nt, Mycobacterium tuberculosis H37Rv
gcagcggcggaagg

SEQ ID NO: 1359374 - RNA, 16 nt, Mycobacterium tuberculosis H37Rv
gcagcggcgcgcugca

SEQ ID NO: 1359375 - RNA, 20 nt, Mycobacterium tuberculosis H37Rv
gcagcgcggcuggggccccg

SEQ ID NO: 1359376 - RNA, 20 nt, Mycobacterium tuberculosis H37Rv
gcagcggaccgcugccugcc

SEQ ID NO: 1359377 - RNA, 21 nt, Mycobacterium tuberculosis H37Rv
gcagcgcuucggcggucgccg

SEQ ID NO: 1359378 - RNA, 18 nt, Mycobacterium tuberculosis H37Rv
gcagcggaccgcugccug

SEQ ID NO: 1359379 - RNA, 18 nt, Mycobacterium tuberculosis H37Rv
gcagcggccagcccagcc

SEQ ID NO: 1359380 - RNA, 23 nt, Mycobacterium tuberculosis H37Rv
gcagcggccagcccagccgggag

SEQ ID NO: 1359381 - RNA, 20 nt, Mycobacterium tuberculosis H37Rv
gcagcgcggccacccgcgac

SEQ ID NO: 1359382 - RNA, 15 nt, Mycobacterium tuberculosis H37Rv
gcagcgcgcggaugg

SEQ ID NO: 1359383 - RNA, 17 nt, Mycobacterium tuberculosis H37Rv
gcagcgcuucggcgguc

SEQ ID NO: 1359384 - RNA, 19 nt, Mycobacterium tuberculosis H37Rv
gcagcgcgcccgacacccg

SEQ ID NO: 1359385 - RNA, 16 nt, Mycobacterium tuberculosis H37Rv
gcagcgccucgauccg

SEQ ID NO: 1359386 - RNA, 15 nt, Mycobacterium tuberculosis H37Rv
gcagcgccagcagcu

SEQ ID NO: 1359387 - RNA, 18 nt, Mycobacterium tuberculosis H37Rv
gcagcgccagcgggauga

SEQ ID NO: 1359388 - RNA, 22 nt, Mycobacterium tuberculosis H37Rv
gcagcgcccuuggacgcgauga

SEQ ID NO: 1359389 - RNA, 13 nt, Mycobacterium tuberculosis H37Rv
gcagcgccgcgcg

SEQ ID NO: 1359390 - RNA, 15 nt, Mycobacterium tuberculosis H37Rv
gcagcgccggcaccg

SEQ ID NO: 1359391 - RNA, 21 nt, Mycobacterium tuberculosis H37Rv
gcagccgauacaggccacgca

SEQ ID NO: 1359392 - RNA, 19 nt, Mycobacterium tuberculosis H37Rv
gcagccgaugcugcgggcg

SEQ ID NO: 1359393 - RNA, 21 nt, Mycobacterium tuberculosis H37Rv
gcagcccugcgcagccgccuc

SEQ ID NO: 1359394 - RNA, 14 nt, Mycobacterium tuberculosis H37Rv
gcagcccgcuggcc

SEQ ID NO: 1359395 - RNA, 17 nt, Mycobacterium tuberculosis H37Rv
gcagcccgggcagcacc

SEQ ID NO: 1359396 - RNA, 16 nt, Mycobacterium tuberculosis H37Rv
gcagcccgggcagccc

SEQ ID NO: 1359397 - RNA, 19 nt, Mycobacterium tuberculosis H37Rv
gcagcccgguggugcuguc

SEQ ID NO: 1359398 - RNA, 17 nt, Mycobacterium tuberculosis H37Rv
gcagcccgucggcgccg

SEQ ID NO: 1359399 - RNA, 18 nt, Mycobacterium tuberculosis H37Rv
gcagcccgcgaguauggg

SEQ ID NO: 1359400 - RNA, 15 nt, Mycobacterium tuberculosis H37Rv
gcagcccgccgggcu

SEQ ID NO: 1359401 - RNA, 17 nt, Mycobacterium tuberculosis H37Rv
gcagccgcccgccagga

SEQ ID NO: 1359402 - RNA, 18 nt, Mycobacterium tuberculosis H37Rv
gcagccgcccgccaggaa

SEQ ID NO: 1359403 - RNA, 21 nt, Mycobacterium tuberculosis H37Rv
gcagccgcgcgguacugcgca

SEQ ID NO: 1359404 - RNA, 11 nt, Mycobacterium tuberculosis H37Rv
gcagccgggca

SEQ ID NO: 1359405 - RNA, 13 nt, Mycobacterium tuberculosis H37Rv
gcagccggcgggc

SEQ ID NO: 1359406 - RNA, 18 nt, Mycobacterium tuberculosis H37Rv
gcagccgcugaucugccg

SEQ ID NO: 1359407 - RNA, 21 nt, Mycobacterium tuberculosis H37Rv
gcagccgcucgacggcccgcc

SEQ ID NO: 1359408 - RNA, 20 nt, Mycobacterium tuberculosis H37Rv
gcagcgaaagcgucgagcug

SEQ ID NO: 1359409 - RNA, 12 nt, Mycobacterium tuberculosis H37Rv
gcagcgaccagc

SEQ ID NO: 1359410 - RNA, 23 nt, Mycobacterium tuberculosis H37Rv
gcagcgcaaugcaucgcggcggc

SEQ ID NO: 1359411 - RNA, 19 nt, Mycobacterium tuberculosis H37Rv
gcagcgcaacggccagcgc

SEQ ID NO: 1359412 - RNA, 21 nt, Mycobacterium tuberculosis H37Rv
gcagcgaucuugguggccuca

SEQ ID NO: 1359413 - RNA, 23 nt, Mycobacterium tuberculosis H37Rv
gcagcgcacugcccggggugcug

SEQ ID NO: 1359414 - RNA, 13 nt, Mycobacterium tuberculosis H37Rv
gcagcgaugacga

SEQ ID NO: 1359415 - RNA, 22 nt, Mycobacterium tuberculosis H37Rv
gcagcgaggagcccggucccuu

SEQ ID NO: 1359416 - RNA, 15 nt, Mycobacterium tuberculosis H37Rv
gcagcgacggucagg

SEQ ID NO: 1359417 - RNA, 20 nt, Mycobacterium tuberculosis H37Rv
gcagcgacuccagcgcccgg

SEQ ID NO: 1359418 - RNA, 13 nt, Mycobacterium tuberculosis H37Rv
gcagccugcugca

SEQ ID NO: 1359419 - RNA, 14 nt, Mycobacterium tuberculosis H37Rv
gcagccugcugcac

SEQ ID NO: 1359420 - RNA, 21 nt, Mycobacterium tuberculosis H37Rv
gcagcgaaacgagccggugcg

SEQ ID NO: 1359421 - RNA, 16 nt, Mycobacterium tuberculosis H37Rv
gcagccgguccagcgc

SEQ ID NO: 1359422 - RNA, 17 nt, Mycobacterium tuberculosis H37Rv
gcagccgguccagcgcc

SEQ ID NO: 1359423 - RNA, 20 nt, Mycobacterium tuberculosis H37Rv
gcagccgguccagcgccggc

SEQ ID NO: 1359424 - RNA, 15 nt, Mycobacterium tuberculosis H37Rv
gcagccguagcuggg

SEQ ID NO: 1359425 - RNA, 20 nt, Mycobacterium tuberculosis H37Rv
gcagccguagcugggcaccc

SEQ ID NO: 1359426 - RNA, 15 nt, Mycobacterium tuberculosis H37Rv
gcagcucgcuguaga

SEQ ID NO: 1359427 - RNA, 22 nt, Mycobacterium tuberculosis H37Rv
gcagcucggugacaagcggccc

SEQ ID NO: 1359428 - RNA, 16 nt, Mycobacterium tuberculosis H37Rv
gcaggaucuccggguc

SEQ ID NO: 1359429 - RNA, 10 nt, Mycobacterium tuberculosis H37Rv
gcagcugacg

SEQ ID NO: 1359430 - RNA, 12 nt, Mycobacterium tuberculosis H37Rv
gcagcugagccg

SEQ ID NO: 1359431 - RNA, 21 nt, Mycobacterium tuberculosis H37Rv
gcaggaucggcuugggaaacc

SEQ ID NO: 1359432 - RNA, 22 nt, Mycobacterium tuberculosis H37Rv
gcagcugaaaauaggccgggca

SEQ ID NO: 1359433 - RNA, 22 nt, Mycobacterium tuberculosis H37Rv
gcaggcagguuggccaccgccc

SEQ ID NO: 1359434 - RNA, 23 nt, Mycobacterium tuberculosis H37Rv
gcaggcagugagggucccacggc

SEQ ID NO: 1359435 - RNA, 17 nt, Mycobacterium tuberculosis H37Rv
gcaggauucccagucca

SEQ ID NO: 1359436 - RNA, 22 nt, Mycobacterium tuberculosis H37Rv
gcaggauucccagucgcggcgc

SEQ ID NO: 1359437 - RNA, 22 nt, Mycobacterium tuberculosis H37Rv
gcaggauguucaaucccuccgc

SEQ ID NO: 1359438 - RNA, 15 nt, Mycobacterium tuberculosis H37Rv
gcaggcggccgccag

SEQ ID NO: 1359439 - RNA, 15 nt, Mycobacterium tuberculosis H37Rv
gcaggcggccuugcc

SEQ ID NO: 1359440 - RNA, 15 nt, Mycobacterium tuberculosis H37Rv
gcaggcggccgccgg

SEQ ID NO: 1359441 - RNA, 12 nt, Mycobacterium tuberculosis H37Rv
gcaggcccuuca

SEQ ID NO: 1359442 - RNA, 19 nt, Mycobacterium tuberculosis H37Rv
gcaggcccuggccacccag

SEQ ID NO: 1359443 - RNA, 17 nt, Mycobacterium tuberculosis H37Rv
gcaggcauucccgcggc

SEQ ID NO: 1359444 - RNA, 18 nt, Mycobacterium tuberculosis H37Rv
gcaggcauggcgccguug

SEQ ID NO: 1359445 - RNA, 17 nt, Mycobacterium tuberculosis H37Rv
gcagggugaccaggauc

SEQ ID NO: 1359446 - RNA, 18 nt, Mycobacterium tuberculosis H37Rv
gcagggugccggcgccgc

SEQ ID NO: 1359447 - RNA, 17 nt, Mycobacterium tuberculosis H37Rv
gcaggguggccagcagg

SEQ ID NO: 1359448 - RNA, 18 nt, Mycobacterium tuberculosis H37Rv
gcaggguggccagcaggc

SEQ ID NO: 1359449 - RNA, 19 nt, Mycobacterium tuberculosis H37Rv
gcaggcuuucauugacacu

SEQ ID NO: 1359450 - RNA, 16 nt, Mycobacterium tuberculosis H37Rv
gcaggcuuccagccac

SEQ ID NO: 1359451 - RNA, 22 nt, Mycobacterium tuberculosis H37Rv
gcaggcugucgagucgguccug

SEQ ID NO: 1359452 - RNA, 17 nt, Mycobacterium tuberculosis H37Rv
gcaggcuuucauugaca

SEQ ID NO: 1359453 - RNA, 22 nt, Mycobacterium tuberculosis H37Rv
gcaggcuucugggguuggcucg

SEQ ID NO: 1359454 - RNA, 21 nt, Mycobacterium tuberculosis H37Rv
gcaggguggggcgguggccgg

SEQ ID NO: 1359455 - RNA, 20 nt, Mycobacterium tuberculosis H37Rv
gcaggucauagccccgcaga

SEQ ID NO: 1359456 - RNA, 23 nt, Mycobacterium tuberculosis H37Rv
gcaggucgaugcugccagccaug

SEQ ID NO: 1359457 - RNA, 22 nt, Mycobacterium tuberculosis H37Rv
gcaggucgaucugcgccaucac

SEQ ID NO: 1359458 - RNA, 16 nt, Mycobacterium tuberculosis H37Rv
gcaggucgacggccac

SEQ ID NO: 1359459 - RNA, 12 nt, Mycobacterium tuberculosis H37Rv
gcaggugcccau

SEQ ID NO: 1359460 - RNA, 15 nt, Mycobacterium tuberculosis H37Rv
gcaggugcugguugc

SEQ ID NO: 1359461 - RNA, 15 nt, Mycobacterium tuberculosis H37Rv
gcaggugacauguug

SEQ ID NO: 1359462 - RNA, 16 nt, Mycobacterium tuberculosis H37Rv
gcaggugacgaucagg

SEQ ID NO: 1359463 - RNA, 18 nt, Mycobacterium tuberculosis H37Rv
gcaggugaacgccggugc

SEQ ID NO: 1359464 - RNA, 16 nt, Mycobacterium tuberculosis H37Rv
gcaggucuucaagcuc

SEQ ID NO: 1359465 - RNA, 17 nt, Mycobacterium tuberculosis H37Rv
gcagguguugcacgagc

SEQ ID NO: 1359466 - RNA, 12 nt, Mycobacterium tuberculosis H37Rv
gcagguucaacc

SEQ ID NO: 1359467 - RNA, 13 nt, Mycobacterium tuberculosis H37Rv
gcaggugcugggc

SEQ ID NO: 1359468 - RNA, 18 nt, Mycobacterium tuberculosis H37Rv
gcaguacaccgcccggcc

SEQ ID NO: 1359469 - RNA, 17 nt, Mycobacterium tuberculosis H37Rv
gcagguuggccaccgcc

SEQ ID NO: 1359470 - RNA, 22 nt, Mycobacterium tuberculosis H37Rv
gcaugggcccugcacagcagcg

SEQ ID NO: 1359471 - RNA, 16 nt, Mycobacterium tuberculosis H37Rv
gcaugggucgugcagg

SEQ ID NO: 1359472 - RNA, 20 nt, Mycobacterium tuberculosis H37Rv
gcaugcuaggcaugccacac

SEQ ID NO: 1359473 - RNA, 16 nt, Mycobacterium tuberculosis H37Rv
gcauggcggcuggugc

SEQ ID NO: 1359474 - RNA, 23 nt, Mycobacterium tuberculosis H37Rv
gcaugauccccguugacccagac

SEQ ID NO: 1359475 - RNA, 15 nt, Mycobacterium tuberculosis H37Rv
gcaugauccgcuggg

SEQ ID NO: 1359476 - RNA, 18 nt, Mycobacterium tuberculosis H37Rv
gcaugagucgaaccaggu

SEQ ID NO: 1359477 - RNA, 17 nt, Mycobacterium tuberculosis H37Rv
gcaugcgaggggcggca

SEQ ID NO: 1359478 - RNA, 22 nt, Mycobacterium tuberculosis H37Rv
gcaugcgcagaaacgccgagcg

SEQ ID NO: 1359479 - RNA, 21 nt, Mycobacterium tuberculosis H37Rv
gcaugccggucuucgcgggac

SEQ ID NO: 1359480 - RNA, 16 nt, Mycobacterium tuberculosis H37Rv
gcaugccggcgaagcc

SEQ ID NO: 1359481 - RNA, 13 nt, Mycobacterium tuberculosis H37Rv
gcaugccgcccgc

SEQ ID NO: 1359482 - RNA, 16 nt, Mycobacterium tuberculosis H37Rv
gcaugccgcccgcgcc

SEQ ID NO: 1359483 - RNA, 16 nt, Mycobacterium tuberculosis H37Rv
gcaucgucgccgagcg

SEQ ID NO: 1359484 - RNA, 22 nt, Mycobacterium tuberculosis H37Rv
gcaucgucgaaagccuggaaaa

SEQ ID NO: 1359485 - RNA, 24 nt, Mycobacterium tuberculosis H37Rv
gcaucgucgccaagcccaggcgau

SEQ ID NO: 1359486 - RNA, 16 nt, Mycobacterium tuberculosis H37Rv
gcaucgucgccgaccg

SEQ ID NO: 1359487 - RNA, 15 nt, Mycobacterium tuberculosis H37Rv
gcaucgucgccgagc

SEQ ID NO: 1359488 - RNA, 19 nt, Mycobacterium tuberculosis H37Rv
gcaucgucgccaagcccag

SEQ ID NO: 1359489 - RNA, 15 nt, Mycobacterium tuberculosis H37Rv
gcaucggugcagccc

SEQ ID NO: 1359490 - RNA, 21 nt, Mycobacterium tuberculosis H37Rv
gcaucgguucguagcgggcaa

SEQ ID NO: 1359491 - RNA, 16 nt, Mycobacterium tuberculosis H37Rv
gcaucgguccaaagca

SEQ ID NO: 1359492 - RNA, 14 nt, Mycobacterium tuberculosis H37Rv
gcaucgguccaaag

SEQ ID NO: 1359493 - RNA, 18 nt, Mycobacterium tuberculosis H37Rv
gcaugacauacagcgggc

SEQ ID NO: 1359494 - RNA, 19 nt, Mycobacterium tuberculosis H37Rv
gcaugacauacagcgggcg

SEQ ID NO: 1359495 - RNA, 20 nt, Mycobacterium tuberculosis H37Rv
gcauuggugaguagauugcu

SEQ ID NO: 1359496 - RNA, 13 nt, Mycobacterium tuberculosis H37Rv
gcauugucgccgg

SEQ ID NO: 1359497 - RNA, 20 nt, Mycobacterium tuberculosis H37Rv
gcauugaccaauccacugau

SEQ ID NO: 1359498 - RNA, 14 nt, Mycobacterium tuberculosis H37Rv
gcauugaagaagcc

SEQ ID NO: 1359499 - RNA, 12 nt, Mycobacterium tuberculosis H37Rv
gcauugaagaag

SEQ ID NO: 1359500 - RNA, 17 nt, Mycobacterium tuberculosis H37Rv
gccaaaaacgccccggc

SEQ ID NO: 1359501 - RNA, 22 nt, Mycobacterium tuberculosis H37Rv
gcauguuccuugcggccgcuga

SEQ ID NO: 1359502 - RNA, 15 nt, Mycobacterium tuberculosis H37Rv
gcauguuccuugcgg

SEQ ID NO: 1359503 - RNA, 19 nt, Mycobacterium tuberculosis H37Rv
gcaugugggaacuggacca

SEQ ID NO: 1359504 - RNA, 21 nt, Mycobacterium tuberculosis H37Rv
gcaucgggcuugcgcagcagc

SEQ ID NO: 1359505 - RNA, 17 nt, Mycobacterium tuberculosis H37Rv
gcaucggucaaugccac

SEQ ID NO: 1359506 - RNA, 22 nt, Mycobacterium tuberculosis H37Rv
gcaucgggcuugcgcagcagcg

SEQ ID NO: 1359507 - RNA, 21 nt, Mycobacterium tuberculosis H37Rv
gcaucggcgguuccauacagc

SEQ ID NO: 1359508 - RNA, 12 nt, Mycobacterium tuberculosis H37Rv
gcaucggcggcc

SEQ ID NO: 1359509 - RNA, 14 nt, Mycobacterium tuberculosis H37Rv
gcaucggcaaggcg

SEQ ID NO: 1359510 - RNA, 18 nt, Mycobacterium tuberculosis H37Rv
gcaucggcaaggcggauc

SEQ ID NO: 1359511 - RNA, 14 nt, Mycobacterium tuberculosis H37Rv
gcaucggcccccaa

SEQ ID NO: 1359512 - RNA, 23 nt, Mycobacterium tuberculosis H37Rv
gcaucgccgucaacgccucugcu

SEQ ID NO: 1359513 - RNA, 20 nt, Mycobacterium tuberculosis H37Rv
gcaucgcgagccagcugcuc

SEQ ID NO: 1359514 - RNA, 15 nt, Mycobacterium tuberculosis H37Rv
gcaucgcggcggcgc

SEQ ID NO: 1359515 - RNA, 17 nt, Mycobacterium tuberculosis H37Rv
gcaucgcgagccagcug

SEQ ID NO: 1359516 - RNA, 16 nt, Mycobacterium tuberculosis H37Rv
gcaucgccugcgccuu

SEQ ID NO: 1359517 - RNA, 15 nt, Mycobacterium tuberculosis H37Rv
gcaucgccuccucga

SEQ ID NO: 1359518 - RNA, 16 nt, Mycobacterium tuberculosis H37Rv
gcaucgccuccaggcg

SEQ ID NO: 1359519 - RNA, 20 nt, Mycobacterium tuberculosis H37Rv
gcaucagauucgcgcuggcc

SEQ ID NO: 1359520 - RNA, 19 nt, Mycobacterium tuberculosis H37Rv
gcauccccagcacaaccag

SEQ ID NO: 1359521 - RNA, 18 nt, Mycobacterium tuberculosis H37Rv
gcaucagcgccagcgagc

SEQ ID NO: 1359522 - RNA, 15 nt, Mycobacterium tuberculosis H37Rv
gcauccgcgguuggc

SEQ ID NO: 1359523 - RNA, 17 nt, Mycobacterium tuberculosis H37Rv
gcaucaccgccgcggcc

SEQ ID NO: 1359524 - RNA, 13 nt, Mycobacterium tuberculosis H37Rv
gcauaggcuuccg

SEQ ID NO: 1359525 - RNA, 18 nt, Mycobacterium tuberculosis H37Rv
gcauacgguugaugcauc

SEQ ID NO: 1359526 - RNA, 14 nt, Mycobacterium tuberculosis H37Rv
gcauacgcggcuuu

SEQ ID NO: 1359527 - RNA, 19 nt, Mycobacterium tuberculosis H37Rv
gcauacgcccacuccagca

SEQ ID NO: 1359528 - RNA, 21 nt, Mycobacterium tuberculosis H37Rv
gcaguacuaacaacaccacca

SEQ ID NO: 1359529 - RNA, 21 nt, Mycobacterium tuberculosis H37Rv
gcaguacugguagaggcggcg

SEQ ID NO: 1359530 - RNA, 13 nt, Mycobacterium tuberculosis H37Rv
gcaguagccgacc

SEQ ID NO: 1359531 - RNA, 13 nt, Mycobacterium tuberculosis H37Rv
gcaguagcugcuc

SEQ ID NO: 1359532 - RNA, 16 nt, Mycobacterium tuberculosis H37Rv
gccaagcucggccacc

SEQ ID NO: 1359533 - RNA, 14 nt, Mycobacterium tuberculosis H37Rv
gccaagcucggccc

SEQ ID NO: 1359534 - RNA, 13 nt, Mycobacterium tuberculosis H37Rv
gccaagccgcggc

SEQ ID NO: 1359535 - RNA, 21 nt, Mycobacterium tuberculosis H37Rv
gccaagccgugccgcacagcg

SEQ ID NO: 1359536 - RNA, 18 nt, Mycobacterium tuberculosis H37Rv
gccaagcucggcccagcg

SEQ ID NO: 1359537 - RNA, 19 nt, Mycobacterium tuberculosis H37Rv
gccaagcucggcccagcgc

SEQ ID NO: 1359538 - RNA, 22 nt, Mycobacterium tuberculosis H37Rv
gccaaucaccguaauuucuuca

SEQ ID NO: 1359539 - RNA, 21 nt, Mycobacterium tuberculosis H37Rv
gccaagugagcgaucgggugc

SEQ ID NO: 1359540 - RNA, 18 nt, Mycobacterium tuberculosis H37Rv
gccaagugcagggcugcu

SEQ ID NO: 1359541 - RNA, 15 nt, Mycobacterium tuberculosis H37Rv
gccaaguccgcccgc

SEQ ID NO: 1359542 - RNA, 17 nt, Mycobacterium tuberculosis H37Rv
gccaauggccugcagcg

SEQ ID NO: 1359543 - RNA, 12 nt, Mycobacterium tuberculosis H37Rv
gccacaaagaag

SEQ ID NO: 1359544 - RNA, 21 nt, Mycobacterium tuberculosis H37Rv
gccaauugugcugaccugucc

SEQ ID NO: 1359545 - RNA, 23 nt, Mycobacterium tuberculosis H37Rv
gccaaugcccuuggccagcaggg

SEQ ID NO: 1359546 - RNA, 17 nt, Mycobacterium tuberculosis H37Rv
gccaaugccgcggaggc

SEQ ID NO: 1359547 - RNA, 19 nt, Mycobacterium tuberculosis H37Rv
gccaaugcccuuggccagc

SEQ ID NO: 1359548 - RNA, 22 nt, Mycobacterium tuberculosis H37Rv
gccaaugcccuuggccagcagg

SEQ ID NO: 1359549 - RNA, 15 nt, Mycobacterium tuberculosis H37Rv
gccaaugcugcaggu

SEQ ID NO: 1359550 - RNA, 12 nt, Mycobacterium tuberculosis H37Rv
gccaauggccug

SEQ ID NO: 1359551 - RNA, 14 nt, Mycobacterium tuberculosis H37Rv
gccaauccggcggc

SEQ ID NO: 1359552 - RNA, 16 nt, Mycobacterium tuberculosis H37Rv
gccaaucgcccagugu

SEQ ID NO: 1359553 - RNA, 12 nt, Mycobacterium tuberculosis H37Rv
gccaaucauggu

SEQ ID NO: 1359554 - RNA, 19 nt, Mycobacterium tuberculosis H37Rv
gccaaugacuuggccagca

SEQ ID NO: 1359555 - RNA, 18 nt, Mycobacterium tuberculosis H37Rv
gccaaucgccgucagcac

SEQ ID NO: 1359556 - RNA, 23 nt, Mycobacterium tuberculosis H37Rv
gccaaacccaugucggcgcgccg

SEQ ID NO: 1359557 - RNA, 15 nt, Mycobacterium tuberculosis H37Rv
gccaaaacgagcaga

SEQ ID NO: 1359558 - RNA, 15 nt, Mycobacterium tuberculosis H37Rv
gccaaaagggcggca

SEQ ID NO: 1359559 - RNA, 16 nt, Mycobacterium tuberculosis H37Rv
gccaaaauccgcccac

SEQ ID NO: 1359560 - RNA, 16 nt, Mycobacterium tuberculosis H37Rv
gccaacagaugccacc

SEQ ID NO: 1359561 - RNA, 14 nt, Mycobacterium tuberculosis H37Rv
gccaacagaugcca

SEQ ID NO: 1359562 - RNA, 23 nt, Mycobacterium tuberculosis H37Rv
gccaacaccgccagcaugacacc

SEQ ID NO: 1359563 - RNA, 22 nt, Mycobacterium tuberculosis H37Rv
gccaacaccggcgaucaccguu

SEQ ID NO: 1359564 - RNA, 15 nt, Mycobacterium tuberculosis H37Rv
gccaacaccgccagc

SEQ ID NO: 1359565 - RNA, 15 nt, Mycobacterium tuberculosis H37Rv
gccaacagguccacc

SEQ ID NO: 1359566 - RNA, 17 nt, Mycobacterium tuberculosis H37Rv
gccaacccgggccgcca

SEQ ID NO: 1359567 - RNA, 18 nt, Mycobacterium tuberculosis H37Rv
gccaacccggcgggcccg

SEQ ID NO: 1359568 - RNA, 23 nt, Mycobacterium tuberculosis H37Rv
gccaacccggcgggcccgccggc

SEQ ID NO: 1359569 - RNA, 16 nt, Mycobacterium tuberculosis H37Rv
gccaacccaauuggga

SEQ ID NO: 1359570 - RNA, 16 nt, Mycobacterium tuberculosis H37Rv
gccaaccagcccggcc

SEQ ID NO: 1359571 - RNA, 12 nt, Mycobacterium tuberculosis H37Rv
gccaacaucucc

SEQ ID NO: 1359572 - RNA, 14 nt, Mycobacterium tuberculosis H37Rv
gccaaccaaccggu

SEQ ID NO: 1359573 - RNA, 19 nt, Mycobacterium tuberculosis H37Rv
gccaacggcacccugcggc

SEQ ID NO: 1359574 - RNA, 17 nt, Mycobacterium tuberculosis H37Rv
gccaacggcuccgggcg

SEQ ID NO: 1359575 - RNA, 15 nt, Mycobacterium tuberculosis H37Rv
gccaacgggcugccc

SEQ ID NO: 1359576 - RNA, 20 nt, Mycobacterium tuberculosis H37Rv
gccaacccgucuuaucggcg

SEQ ID NO: 1359577 - RNA, 14 nt, Mycobacterium tuberculosis H37Rv
gccaaccgcgugcg

SEQ ID NO: 1359578 - RNA, 20 nt, Mycobacterium tuberculosis H37Rv
gccaaccucugcugagcugc

SEQ ID NO: 1359579 - RNA, 18 nt, Mycobacterium tuberculosis H37Rv
gccaaccguguaggccau

SEQ ID NO: 1359580 - RNA, 21 nt, Mycobacterium tuberculosis H37Rv
gccaacgaaccgcucagcgca

SEQ ID NO: 1359581 - RNA, 17 nt, Mycobacterium tuberculosis H37Rv
gccaacuccucagccgc

SEQ ID NO: 1359582 - RNA, 20 nt, Mycobacterium tuberculosis H37Rv
gccaacguugcgccagcggu

SEQ ID NO: 1359583 - RNA, 15 nt, Mycobacterium tuberculosis H37Rv
gccaacguugcgcca

SEQ ID NO: 1359584 - RNA, 18 nt, Mycobacterium tuberculosis H37Rv
gccaacugggccgagcgc

SEQ ID NO: 1359585 - RNA, 18 nt, Mycobacterium tuberculosis H37Rv
gccaacgugacgccggcc

SEQ ID NO: 1359586 - RNA, 20 nt, Mycobacterium tuberculosis H37Rv
gccaacugggccgagcgcgc

SEQ ID NO: 1359587 - RNA, 19 nt, Mycobacterium tuberculosis H37Rv
gccaacucguccaacugaa

SEQ ID NO: 1359588 - RNA, 19 nt, Mycobacterium tuberculosis H37Rv
gccaacuuggcggccagcc

SEQ ID NO: 1359589 - RNA, 18 nt, Mycobacterium tuberculosis H37Rv
gccaagaaugugggcgac

SEQ ID NO: 1359590 - RNA, 15 nt, Mycobacterium tuberculosis H37Rv
gccaacuugcucagc

SEQ ID NO: 1359591 - RNA, 22 nt, Mycobacterium tuberculosis H37Rv
gccaagaccgcggcccgcacgg

SEQ ID NO: 1359592 - RNA, 15 nt, Mycobacterium tuberculosis H37Rv
gccaccgaccccgga

SEQ ID NO: 1359593 - RNA, 20 nt, Mycobacterium tuberculosis H37Rv
gccaccgaagccgccgggug

SEQ ID NO: 1359594 - RNA, 23 nt, Mycobacterium tuberculosis H37Rv
gccaccgaacuugcggaccuggc

SEQ ID NO: 1359595 - RNA, 16 nt, Mycobacterium tuberculosis H37Rv
gccaccgaacgcggcc

SEQ ID NO: 1359596 - RNA, 17 nt, Mycobacterium tuberculosis H37Rv
gccaccgaacgcggcca

SEQ ID NO: 1359597 - RNA, 15 nt, Mycobacterium tuberculosis H37Rv
gccacccuugccgcc

SEQ ID NO: 1359598 - RNA, 17 nt, Mycobacterium tuberculosis H37Rv
gccacccuugccgccgg

SEQ ID NO: 1359599 - RNA, 12 nt, Mycobacterium tuberculosis H37Rv
gccacccuugcc

SEQ ID NO: 1359600 - RNA, 20 nt, Mycobacterium tuberculosis H37Rv
gccacccuuggcccggugca

SEQ ID NO: 1359601 - RNA, 20 nt, Mycobacterium tuberculosis H37Rv
gccaccgccaccgcggccug

SEQ ID NO: 1359602 - RNA, 18 nt, Mycobacterium tuberculosis H37Rv
gccaccgccaccacccag

SEQ ID NO: 1359603 - RNA, 20 nt, Mycobacterium tuberculosis H37Rv
gccaccgagaucaugccggc

SEQ ID NO: 1359604 - RNA, 23 nt, Mycobacterium tuberculosis H37Rv
gccaccgaguagaacuucgccag

SEQ ID NO: 1359605 - RNA, 14 nt, Mycobacterium tuberculosis H37Rv
gccaccgagcccuc

SEQ ID NO: 1359606 - RNA, 14 nt, Mycobacterium tuberculosis H37Rv
gccaccgcacgcug

SEQ ID NO: 1359607 - RNA, 23 nt, Mycobacterium tuberculosis H37Rv
gccaccggcgccgccgucgccgc

SEQ ID NO: 1359608 - RNA, 18 nt, Mycobacterium tuberculosis H37Rv
gccaccggcgccgccguc

SEQ ID NO: 1359609 - RNA, 20 nt, Mycobacterium tuberculosis H37Rv
gccaccggcgccgcccgcgc

SEQ ID NO: 1359610 - RNA, 17 nt, Mycobacterium tuberculosis H37Rv
gccaccggcugcaacca

SEQ ID NO: 1359611 - RNA, 22 nt, Mycobacterium tuberculosis H37Rv
gccaccggcugcaaccagcggc

SEQ ID NO: 1359612 - RNA, 18 nt, Mycobacterium tuberculosis H37Rv
gccaccggcgccaccggc

SEQ ID NO: 1359613 - RNA, 13 nt, Mycobacterium tuberculosis H37Rv
gccaccggcgcca

SEQ ID NO: 1359614 - RNA, 20 nt, Mycobacterium tuberculosis H37Rv
gccaccggcaccgccugcgc

SEQ ID NO: 1359615 - RNA, 18 nt, Mycobacterium tuberculosis H37Rv
gccaccggugagcgcagc

SEQ ID NO: 1359616 - RNA, 18 nt, Mycobacterium tuberculosis H37Rv
gccaccuuagcgcuugcc

SEQ ID NO: 1359617 - RNA, 21 nt, Mycobacterium tuberculosis H37Rv
gccaccuuagcgcuugccgcu

SEQ ID NO: 1359618 - RNA, 15 nt, Mycobacterium tuberculosis H37Rv
gccaccggggucacc

SEQ ID NO: 1359619 - RNA, 20 nt, Mycobacterium tuberculosis H37Rv
gccaccggugagcgcagcuu

SEQ ID NO: 1359620 - RNA, 20 nt, Mycobacterium tuberculosis H37Rv
gccaccgggcgugcggcggc

SEQ ID NO: 1359621 - RNA, 20 nt, Mycobacterium tuberculosis H37Rv
gccaccgguaccgccggcuc

SEQ ID NO: 1359622 - RNA, 21 nt, Mycobacterium tuberculosis H37Rv
gccacccggacauagccgcgc

SEQ ID NO: 1359623 - RNA, 15 nt, Mycobacterium tuberculosis H37Rv
gccacccggccaggu

SEQ ID NO: 1359624 - RNA, 13 nt, Mycobacterium tuberculosis H37Rv
gccacccggccgc

SEQ ID NO: 1359625 - RNA, 15 nt, Mycobacterium tuberculosis H37Rv
gccacccggccgcgc

SEQ ID NO: 1359626 - RNA, 16 nt, Mycobacterium tuberculosis H37Rv
gccacccgcgccgccc

SEQ ID NO: 1359627 - RNA, 16 nt, Mycobacterium tuberculosis H37Rv
gccacccgcgccgcca

SEQ ID NO: 1359628 - RNA, 22 nt, Mycobacterium tuberculosis H37Rv
gccacccgcgcgaugcuggcga

SEQ ID NO: 1359629 - RNA, 22 nt, Mycobacterium tuberculosis H37Rv
gccacccagaugcagcggucca

SEQ ID NO: 1359630 - RNA, 18 nt, Mycobacterium tuberculosis H37Rv
gccacaggcguuuccgcu

SEQ ID NO: 1359631 - RNA, 19 nt, Mycobacterium tuberculosis H37Rv
gccaccccgcguaugccag

SEQ ID NO: 1359632 - RNA, 16 nt, Mycobacterium tuberculosis H37Rv
gccaccccgagcucac

SEQ ID NO: 1359633 - RNA, 19 nt, Mycobacterium tuberculosis H37Rv
gccacaccgccgccaagcu

SEQ ID NO: 1359634 - RNA, 14 nt, Mycobacterium tuberculosis H37Rv
gccacaaccucguc

SEQ ID NO: 1359635 - RNA, 21 nt, Mycobacterium tuberculosis H37Rv
gccacaccgucacgccaccgc

SEQ ID NO: 1359636 - RNA, 16 nt, Mycobacterium tuberculosis H37Rv
gccacaccggggcggc

SEQ ID NO: 1359637 - RNA, 19 nt, Mycobacterium tuberculosis H37Rv
gccacacucgccagggcca

SEQ ID NO: 1359638 - RNA, 15 nt, Mycobacterium tuberculosis H37Rv
gccacacucccgcgc

SEQ ID NO: 1359639 - RNA, 22 nt, Mycobacterium tuberculosis H37Rv
gccacagcucgccgugaccagg

SEQ ID NO: 1359640 - RNA, 15 nt, Mycobacterium tuberculosis H37Rv
gccacggcagcgccc

SEQ ID NO: 1359641 - RNA, 14 nt, Mycobacterium tuberculosis H37Rv
gccacgauccuugg

SEQ ID NO: 1359642 - RNA, 13 nt, Mycobacterium tuberculosis H37Rv
gccacgaacugau

SEQ ID NO: 1359643 - RNA, 19 nt, Mycobacterium tuberculosis H37Rv
gccacgacgaacaccagcg

SEQ ID NO: 1359644 - RNA, 16 nt, Mycobacterium tuberculosis H37Rv
gccacgacccagcaug

SEQ ID NO: 1359645 - RNA, 22 nt, Mycobacterium tuberculosis H37Rv
gccaccuuggacaccacgagcg

SEQ ID NO: 1359646 - RNA, 14 nt, Mycobacterium tuberculosis H37Rv
gccacgaccgcggc

SEQ ID NO: 1359647 - RNA, 21 nt, Mycobacterium tuberculosis H37Rv
gccaccuuggcguugaccagc

SEQ ID NO: 1359648 - RNA, 22 nt, Mycobacterium tuberculosis H37Rv
gccacggcuuugcggcgcgacc

SEQ ID NO: 1359649 - RNA, 18 nt, Mycobacterium tuberculosis H37Rv
gccacggcuucgccgcgg

SEQ ID NO: 1359650 - RNA, 13 nt, Mycobacterium tuberculosis H37Rv
gccacggcugccc

SEQ ID NO: 1359651 - RNA, 12 nt, Mycobacterium tuberculosis H37Rv
gccacggcggcu

SEQ ID NO: 1359652 - RNA, 20 nt, Mycobacterium tuberculosis H37Rv
gccacggcgucggccacccg

SEQ ID NO: 1359653 - RNA, 19 nt, Mycobacterium tuberculosis H37Rv
gccacguagcagcgccggc

SEQ ID NO: 1359654 - RNA, 21 nt, Mycobacterium tuberculosis H37Rv
gccacguagcagcgccggcac

SEQ ID NO: 1359655 - RNA, 18 nt, Mycobacterium tuberculosis H37Rv
gccacgguucgggcagca

SEQ ID NO: 1359656 - RNA, 19 nt, Mycobacterium tuberculosis H37Rv
gccacgguucgggcagcac

SEQ ID NO: 1359657 - RNA, 21 nt, Mycobacterium tuberculosis H37Rv
gccacgguucgggcagcaccc

SEQ ID NO: 1359658 - RNA, 17 nt, Mycobacterium tuberculosis H37Rv
gccacgguucgggcagc

SEQ ID NO: 1359659 - RNA, 19 nt, Mycobacterium tuberculosis H37Rv
gccacgguggagcgcgccu

SEQ ID NO: 1359660 - RNA, 22 nt, Mycobacterium tuberculosis H37Rv
gccacgguggagcgcgccucgc

SEQ ID NO: 1359661 - RNA, 20 nt, Mycobacterium tuberculosis H37Rv
gccacgguggagcgcgccuc

SEQ ID NO: 1359662 - RNA, 15 nt, Mycobacterium tuberculosis H37Rv
gccacuccgguggcc

SEQ ID NO: 1359663 - RNA, 15 nt, Mycobacterium tuberculosis H37Rv
gccacuccaggagcc

SEQ ID NO: 1359664 - RNA, 14 nt, Mycobacterium tuberculosis H37Rv
gccacucccagcca

SEQ ID NO: 1359665 - RNA, 18 nt, Mycobacterium tuberculosis H37Rv
gccacuacggccuggcca

SEQ ID NO: 1359666 - RNA, 20 nt, Mycobacterium tuberculosis H37Rv
gccacuacggccuggccacc

SEQ ID NO: 1359667 - RNA, 14 nt, Mycobacterium tuberculosis H37Rv
gccacuagcccuga

SEQ ID NO: 1359668 - RNA, 21 nt, Mycobacterium tuberculosis H37Rv
gccacguccucagccgugccc

SEQ ID NO: 1359669 - RNA, 16 nt, Mycobacterium tuberculosis H37Rv
gccacgucgagcaccc

SEQ ID NO: 1359670 - RNA, 13 nt, Mycobacterium tuberculosis H37Rv
gccacgucgccgg

SEQ ID NO: 1359671 - RNA, 17 nt, Mycobacterium tuberculosis H37Rv
gccacugauucgcaggc

SEQ ID NO: 1359672 - RNA, 12 nt, Mycobacterium tuberculosis H37Rv
gccacugagcca

SEQ ID NO: 1359673 - RNA, 14 nt, Mycobacterium tuberculosis H37Rv
gccacucuggucac

SEQ ID NO: 1359674 - RNA, 13 nt, Mycobacterium tuberculosis H37Rv
gccacugccagcc

SEQ ID NO: 1359675 - RNA, 22 nt, Mycobacterium tuberculosis H37Rv
gccacuccgguggccaacaccg

SEQ ID NO: 1359676 - RNA, 13 nt, Mycobacterium tuberculosis H37Rv
gccacucgcccga

SEQ ID NO: 1359677 - RNA, 13 nt, Mycobacterium tuberculosis H37Rv
gccacucgcgcac

SEQ ID NO: 1359678 - RNA, 18 nt, Mycobacterium tuberculosis H37Rv
gccacugccguugccgcc

SEQ ID NO: 1359679 - RNA, 16 nt, Mycobacterium tuberculosis H37Rv
gccacugccggugggc

SEQ ID NO: 1359680 - RNA, 15 nt, Mycobacterium tuberculosis H37Rv
gccacugccagccgu

SEQ ID NO: 1359681 - RNA, 18 nt, Mycobacterium tuberculosis H37Rv
gccacugcuuccggaaca

SEQ ID NO: 1359682 - RNA, 14 nt, Mycobacterium tuberculosis H37Rv
gccacuggccgguu

SEQ ID NO: 1359683 - RNA, 15 nt, Mycobacterium tuberculosis H37Rv
gccccaguccgaagc

SEQ ID NO: 1359684 - RNA, 18 nt, Mycobacterium tuberculosis H37Rv
gccccauacuugcgccga

SEQ ID NO: 1359685 - RNA, 16 nt, Mycobacterium tuberculosis H37Rv
gccccaucaccaccgg

SEQ ID NO: 1359686 - RNA, 14 nt, Mycobacterium tuberculosis H37Rv
gccccagugugcgu

SEQ ID NO: 1359687 - RNA, 19 nt, Mycobacterium tuberculosis H37Rv
gccccaggugguucaaccg

SEQ ID NO: 1359688 - RNA, 22 nt, Mycobacterium tuberculosis H37Rv
gccccagggggcgugccgccgc

SEQ ID NO: 1359689 - RNA, 12 nt, Mycobacterium tuberculosis H37Rv
gccccagggugc

SEQ ID NO: 1359690 - RNA, 13 nt, Mycobacterium tuberculosis H37Rv
gccccagggugcg

SEQ ID NO: 1359691 - RNA, 22 nt, Mycobacterium tuberculosis H37Rv
gccccagcugcggucgcggcug

SEQ ID NO: 1359692 - RNA, 20 nt, Mycobacterium tuberculosis H37Rv
gccccagcguucccgccggc

SEQ ID NO: 1359693 - RNA, 14 nt, Mycobacterium tuberculosis H37Rv
gccccgcggcgccg

SEQ ID NO: 1359694 - RNA, 14 nt, Mycobacterium tuberculosis H37Rv
gccccgcggccagc

SEQ ID NO: 1359695 - RNA, 15 nt, Mycobacterium tuberculosis H37Rv
gccccgcgcguucgg

SEQ ID NO: 1359696 - RNA, 15 nt, Mycobacterium tuberculosis H37Rv
gccccgcggcgccgc

SEQ ID NO: 1359697 - RNA, 23 nt, Mycobacterium tuberculosis H37Rv
gccccgcucgguuugcguccugg

SEQ ID NO: 1359698 - RNA, 23 nt, Mycobacterium tuberculosis H37Rv
gccccgauaaaaaccacccccac

SEQ ID NO: 1359699 - RNA, 20 nt, Mycobacterium tuberculosis H37Rv
gccccgauaaaaaccacccc

SEQ ID NO: 1359700 - RNA, 19 nt, Mycobacterium tuberculosis H37Rv
gccccgcaggggguggugu

SEQ ID NO: 1359701 - RNA, 20 nt, Mycobacterium tuberculosis H37Rv
gccccgccaccucgccggcc

SEQ ID NO: 1359702 - RNA, 14 nt, Mycobacterium tuberculosis H37Rv
gccccgcgccggcc

SEQ ID NO: 1359703 - RNA, 15 nt, Mycobacterium tuberculosis H37Rv
gccccgcgccggccg

SEQ ID NO: 1359704 - RNA, 12 nt, Mycobacterium tuberculosis H37Rv
gccccccggcga

SEQ ID NO: 1359705 - RNA, 16 nt, Mycobacterium tuberculosis H37Rv
gccccccggcgacggc

SEQ ID NO: 1359706 - RNA, 22 nt, Mycobacterium tuberculosis H37Rv
gccccccgacuccggcaggccc

SEQ ID NO: 1359707 - RNA, 15 nt, Mycobacterium tuberculosis H37Rv
gcccccgacgacggc

SEQ ID NO: 1359708 - RNA, 23 nt, Mycobacterium tuberculosis H37Rv
gccccccagacaauccgccgccg

SEQ ID NO: 1359709 - RNA, 17 nt, Mycobacterium tuberculosis H37Rv
gcccccauugccgccgu

SEQ ID NO: 1359710 - RNA, 23 nt, Mycobacterium tuberculosis H37Rv
gccccccagugcagacaggcggc

SEQ ID NO: 1359711 - RNA, 20 nt, Mycobacterium tuberculosis H37Rv
gcccccgccauugccgccgg

SEQ ID NO: 1359712 - RNA, 22 nt, Mycobacterium tuberculosis H37Rv
gccccgacauacgucggggccg

SEQ ID NO: 1359713 - RNA, 23 nt, Mycobacterium tuberculosis H37Rv
gccccgaccgcguacaggccggc

SEQ ID NO: 1359714 - RNA, 12 nt, Mycobacterium tuberculosis H37Rv
gccccgagcugc

SEQ ID NO: 1359715 - RNA, 15 nt, Mycobacterium tuberculosis H37Rv
gccccgacugcgccc

SEQ ID NO: 1359716 - RNA, 14 nt, Mycobacterium tuberculosis H37Rv
gcccgcaccagcug

SEQ ID NO: 1359717 - RNA, 19 nt, Mycobacterium tuberculosis H37Rv
gcccgcacccguccggccg

SEQ ID NO: 1359718 - RNA, 18 nt, Mycobacterium tuberculosis H37Rv
gcccgcaccgcguucugg

SEQ ID NO: 1359719 - RNA, 13 nt, Mycobacterium tuberculosis H37Rv
gcccgcaccaccg

SEQ ID NO: 1359720 - RNA, 15 nt, Mycobacterium tuberculosis H37Rv
gcccgcaccaccggc

SEQ ID NO: 1359721 - RNA, 19 nt, Mycobacterium tuberculosis H37Rv
gcccgcagccaaguccgcc

SEQ ID NO: 1359722 - RNA, 17 nt, Mycobacterium tuberculosis H37Rv
gcccgcacugccgccgg

SEQ ID NO: 1359723 - RNA, 23 nt, Mycobacterium tuberculosis H37Rv
gcccgcaccgcugaccccggcag

SEQ ID NO: 1359724 - RNA, 17 nt, Mycobacterium tuberculosis H37Rv
gcccgcacggccgcagc

SEQ ID NO: 1359725 - RNA, 13 nt, Mycobacterium tuberculosis H37Rv
gcccgcagcccgc

SEQ ID NO: 1359726 - RNA, 18 nt, Mycobacterium tuberculosis H37Rv
gcccgcaggacgcugccg

SEQ ID NO: 1359727 - RNA, 14 nt, Mycobacterium tuberculosis H37Rv
gcccgcauccgcac

SEQ ID NO: 1359728 - RNA, 13 nt, Mycobacterium tuberculosis H37Rv
gcccgccaccggc

SEQ ID NO: 1359729 - RNA, 15 nt, Mycobacterium tuberculosis H37Rv
gcccgccaccggcgc

SEQ ID NO: 1359730 - RNA, 14 nt, Mycobacterium tuberculosis H37Rv
gcccgacccgccga

SEQ ID NO: 1359731 - RNA, 15 nt, Mycobacterium tuberculosis H37Rv
gcccgacccggccga

SEQ ID NO: 1359732 - RNA, 21 nt, Mycobacterium tuberculosis H37Rv
gcccgacccaucaccagcggc

SEQ ID NO: 1359733 - RNA, 22 nt, Mycobacterium tuberculosis H37Rv
gcccgacccaucaccagcggcu

SEQ ID NO: 1359734 - RNA, 19 nt, Mycobacterium tuberculosis H37Rv
gcccgacccaucaccagcg

SEQ ID NO: 1359735 - RNA, 16 nt, Mycobacterium tuberculosis H37Rv
gcccgacccggccgau

SEQ ID NO: 1359736 - RNA, 19 nt, Mycobacterium tuberculosis H37Rv
gcccgaccgggaaccacgg

SEQ ID NO: 1359737 - RNA, 21 nt, Mycobacterium tuberculosis H37Rv
gcccgcaauuguucgcggccg

SEQ ID NO: 1359738 - RNA, 21 nt, Mycobacterium tuberculosis H37Rv
gcccgauggugccgacccgcc

SEQ ID NO: 1359739 - RNA, 21 nt, Mycobacterium tuberculosis H37Rv
gcccgaugguacccgcgccgc

SEQ ID NO: 1359740 - RNA, 12 nt, Mycobacterium tuberculosis H37Rv
gcccgauggugc

SEQ ID NO: 1359741 - RNA, 18 nt, Mycobacterium tuberculosis H37Rv
gcccgaugguggugccga

SEQ ID NO: 1359742 - RNA, 20 nt, Mycobacterium tuberculosis H37Rv
gcccgauugaguucggcggc

SEQ ID NO: 1359743 - RNA, 18 nt, Mycobacterium tuberculosis H37Rv
gccccggacuccaaagcc

SEQ ID NO: 1359744 - RNA, 18 nt, Mycobacterium tuberculosis H37Rv
gccccggcaagcgcagac

SEQ ID NO: 1359745 - RNA, 17 nt, Mycobacterium tuberculosis H37Rv
gccccugaaggccagcc

SEQ ID NO: 1359746 - RNA, 18 nt, Mycobacterium tuberculosis H37Rv
gccccugaaggccagcca

SEQ ID NO: 1359747 - RNA, 15 nt, Mycobacterium tuberculosis H37Rv
gccccuccgcgccga

SEQ ID NO: 1359748 - RNA, 14 nt, Mycobacterium tuberculosis H37Rv
gccccuccggccgu

SEQ ID NO: 1359749 - RNA, 20 nt, Mycobacterium tuberculosis H37Rv
gccccuccaggggcuggugc

SEQ ID NO: 1359750 - RNA, 14 nt, Mycobacterium tuberculosis H37Rv
gccccuccgcgccg

SEQ ID NO: 1359751 - RNA, 18 nt, Mycobacterium tuberculosis H37Rv
gccccugcacagcaggcu

SEQ ID NO: 1359752 - RNA, 19 nt, Mycobacterium tuberculosis H37Rv
gccccugucaacgccgcgg

SEQ ID NO: 1359753 - RNA, 20 nt, Mycobacterium tuberculosis H37Rv
gcccgaaggcggcuccaccg

SEQ ID NO: 1359754 - RNA, 15 nt, Mycobacterium tuberculosis H37Rv
gcccgaaucgccggc

SEQ ID NO: 1359755 - RNA, 18 nt, Mycobacterium tuberculosis H37Rv
gcccgaaucgccggcggc

SEQ ID NO: 1359756 - RNA, 17 nt, Mycobacterium tuberculosis H37Rv
gcccgaaucgccugcca

SEQ ID NO: 1359757 - RNA, 21 nt, Mycobacterium tuberculosis H37Rv
gcccgaaugcggugaguccgc

SEQ ID NO: 1359758 - RNA, 17 nt, Mycobacterium tuberculosis H37Rv
gcccgacaccgccccgc

SEQ ID NO: 1359759 - RNA, 12 nt, Mycobacterium tuberculosis H37Rv
gcccgacacccg

SEQ ID NO: 1359760 - RNA, 16 nt, Mycobacterium tuberculosis H37Rv
gcccagauccagcaac

SEQ ID NO: 1359761 - RNA, 22 nt, Mycobacterium tuberculosis H37Rv
gcccagcaccaccgcggugugc

SEQ ID NO: 1359762 - RNA, 18 nt, Mycobacterium tuberculosis H37Rv
gcccagcacguaacccag

SEQ ID NO: 1359763 - RNA, 21 nt, Mycobacterium tuberculosis H37Rv
gcccagcacguaacccagucc

SEQ ID NO: 1359764 - RNA, 16 nt, Mycobacterium tuberculosis H37Rv
gcccagcagaccaagu

SEQ ID NO: 1359765 - RNA, 13 nt, Mycobacterium tuberculosis H37Rv
gcccagaugucuu

SEQ ID NO: 1359766 - RNA, 15 nt, Mycobacterium tuberculosis H37Rv
gcccagcacgcuggc

SEQ ID NO: 1359767 - RNA, 16 nt, Mycobacterium tuberculosis H37Rv
gcccagcacgcuggcg

SEQ ID NO: 1359768 - RNA, 19 nt, Mycobacterium tuberculosis H37Rv
gcccagauagagcuggugc

SEQ ID NO: 1359769 - RNA, 17 nt, Mycobacterium tuberculosis H37Rv
gcccagaccgccgacgc

SEQ ID NO: 1359770 - RNA, 19 nt, Mycobacterium tuberculosis H37Rv
gcccaagguggcggccagu

SEQ ID NO: 1359771 - RNA, 15 nt, Mycobacterium tuberculosis H37Rv
gcccaagccgccggc

SEQ ID NO: 1359772 - RNA, 15 nt, Mycobacterium tuberculosis H37Rv
gcccagcgcuagccg

SEQ ID NO: 1359773 - RNA, 16 nt, Mycobacterium tuberculosis H37Rv
gcccagcgcgccagcu

SEQ ID NO: 1359774 - RNA, 13 nt, Mycobacterium tuberculosis H37Rv
gcccagcgcgcgc

SEQ ID NO: 1359775 - RNA, 14 nt, Mycobacterium tuberculosis H37Rv
gcccagcgccucca

SEQ ID NO: 1359776 - RNA, 16 nt, Mycobacterium tuberculosis H37Rv
gcccagcgccuccagc

SEQ ID NO: 1359777 - RNA, 17 nt, Mycobacterium tuberculosis H37Rv
gcccagcgccuccagca

SEQ ID NO: 1359778 - RNA, 15 nt, Mycobacterium tuberculosis H37Rv
gcccagcggccgcga

SEQ ID NO: 1359779 - RNA, 14 nt, Mycobacterium tuberculosis H37Rv
gcccagcggcuggu

SEQ ID NO: 1359780 - RNA, 18 nt, Mycobacterium tuberculosis H37Rv
gcccaggccaagguggcc

SEQ ID NO: 1359781 - RNA, 14 nt, Mycobacterium tuberculosis H37Rv
gcccagccgccagc

SEQ ID NO: 1359782 - RNA, 20 nt, Mycobacterium tuberculosis H37Rv
gcccagccgagcguggcguu

SEQ ID NO: 1359783 - RNA, 22 nt, Mycobacterium tuberculosis H37Rv
gcccagcgcccgcgcggccacu

SEQ ID NO: 1359784 - RNA, 18 nt, Mycobacterium tuberculosis H37Rv
gcccagcgaccaguggug

SEQ ID NO: 1359785 - RNA, 22 nt, Mycobacterium tuberculosis H37Rv
gcccagcgacccggccagcggc

SEQ ID NO: 1359786 - RNA, 15 nt, Mycobacterium tuberculosis H37Rv
gcccagcgacaacac

SEQ ID NO: 1359787 - RNA, 19 nt, Mycobacterium tuberculosis H37Rv
gcccagcgacaacaccacg

SEQ ID NO: 1359788 - RNA, 13 nt, Mycobacterium tuberculosis H37Rv
gcccaguucugca

SEQ ID NO: 1359789 - RNA, 17 nt, Mycobacterium tuberculosis H37Rv
gcccaucucaugcaucu

SEQ ID NO: 1359790 - RNA, 20 nt, Mycobacterium tuberculosis H37Rv
gcccaugccgggauugccgu

SEQ ID NO: 1359791 - RNA, 13 nt, Mycobacterium tuberculosis H37Rv
gcccagucgccgc

SEQ ID NO: 1359792 - RNA, 23 nt, Mycobacterium tuberculosis H37Rv
gcccaguacggugguaagacgcc

SEQ ID NO: 1359793 - RNA, 22 nt, Mycobacterium tuberculosis H37Rv
gcccagugcgcaacccagccgc

SEQ ID NO: 1359794 - RNA, 15 nt, Mycobacterium tuberculosis H37Rv
gcccaggcauggccu

SEQ ID NO: 1359795 - RNA, 19 nt, Mycobacterium tuberculosis H37Rv
gcccaggcgaucgcccggc

SEQ ID NO: 1359796 - RNA, 21 nt, Mycobacterium tuberculosis H37Rv
gcccaggcgaucgcccggccc

SEQ ID NO: 1359797 - RNA, 14 nt, Mycobacterium tuberculosis H37Rv
gccccaccgacagc

SEQ ID NO: 1359798 - RNA, 12 nt, Mycobacterium tuberculosis H37Rv
gccccaccggua

SEQ ID NO: 1359799 - RNA, 13 nt, Mycobacterium tuberculosis H37Rv
gccccaccggccg

SEQ ID NO: 1359800 - RNA, 14 nt, Mycobacterium tuberculosis H37Rv
gccccaccgcgccg

SEQ ID NO: 1359801 - RNA, 16 nt, Mycobacterium tuberculosis H37Rv
gccccacccgcggcgc

SEQ ID NO: 1359802 - RNA, 17 nt, Mycobacterium tuberculosis H37Rv
gccccacccgcaugccc

SEQ ID NO: 1359803 - RNA, 18 nt, Mycobacterium tuberculosis H37Rv
gccccacccgcaugcccu

SEQ ID NO: 1359804 - RNA, 23 nt, Mycobacterium tuberculosis H37Rv
gccccacaccuuggcggucggca

SEQ ID NO: 1359805 - RNA, 15 nt, Mycobacterium tuberculosis H37Rv
gcccauuucgagcuc

SEQ ID NO: 1359806 - RNA, 14 nt, Mycobacterium tuberculosis H37Rv
gcccauggccacca

SEQ ID NO: 1359807 - RNA, 15 nt, Mycobacterium tuberculosis H37Rv
gccccacaacaugcu

SEQ ID NO: 1359808 - RNA, 19 nt, Mycobacterium tuberculosis H37Rv
gccccacaacaugcuggag

SEQ ID NO: 1359809 - RNA, 19 nt, Mycobacterium tuberculosis H37Rv
gccccaagcgugcugccgc

SEQ ID NO: 1359810 - RNA, 18 nt, Mycobacterium tuberculosis H37Rv
gccagugaacgcgcgugc

SEQ ID NO: 1359811 - RNA, 17 nt, Mycobacterium tuberculosis H37Rv
gccagucgaucgcggcc

SEQ ID NO: 1359812 - RNA, 23 nt, Mycobacterium tuberculosis H37Rv
gccagucgaucgcggcccgcagc

SEQ ID NO: 1359813 - RNA, 16 nt, Mycobacterium tuberculosis H37Rv
gccagugcgcgcguca

SEQ ID NO: 1359814 - RNA, 16 nt, Mycobacterium tuberculosis H37Rv
gccagugcggucucga

SEQ ID NO: 1359815 - RNA, 13 nt, Mycobacterium tuberculosis H37Rv
gccagugccaccu

SEQ ID NO: 1359816 - RNA, 18 nt, Mycobacterium tuberculosis H37Rv
gccaguucggcggccgcc

SEQ ID NO: 1359817 - RNA, 20 nt, Mycobacterium tuberculosis H37Rv
gccaguucggcggccgccgc

SEQ ID NO: 1359818 - RNA, 15 nt, Mycobacterium tuberculosis H37Rv
gccaguucggcgggc

SEQ ID NO: 1359819 - RNA, 21 nt, Mycobacterium tuberculosis H37Rv
gccaguucggcgggcgcgggu

SEQ ID NO: 1359820 - RNA, 15 nt, Mycobacterium tuberculosis H37Rv
gccaguucggugagc

SEQ ID NO: 1359821 - RNA, 21 nt, Mycobacterium tuberculosis H37Rv
gccaguguugcgcugcggcca

SEQ ID NO: 1359822 - RNA, 19 nt, Mycobacterium tuberculosis H37Rv
gccagugucccgcgcggau

SEQ ID NO: 1359823 - RNA, 21 nt, Mycobacterium tuberculosis H37Rv
gccaguaugcggugcccgccc

SEQ ID NO: 1359824 - RNA, 22 nt, Mycobacterium tuberculosis H37Rv
gccaguccagcgcgccacccag

SEQ ID NO: 1359825 - RNA, 20 nt, Mycobacterium tuberculosis H37Rv
gccaguccgcagcguccagc

SEQ ID NO: 1359826 - RNA, 14 nt, Mycobacterium tuberculosis H37Rv
gccaguccgcagcg

SEQ ID NO: 1359827 - RNA, 14 nt, Mycobacterium tuberculosis H37Rv
gccaguccgcgcgc

SEQ ID NO: 1359828 - RNA, 19 nt, Mycobacterium tuberculosis H37Rv
gccaguccgaaagccgccg

SEQ ID NO: 1359829 - RNA, 16 nt, Mycobacterium tuberculosis H37Rv
gccagguuuugccgcg

SEQ ID NO: 1359830 - RNA, 14 nt, Mycobacterium tuberculosis H37Rv
gccaguacucggcc

SEQ ID NO: 1359831 - RNA, 15 nt, Mycobacterium tuberculosis H37Rv
gccaggugcaggcuu

SEQ ID NO: 1359832 - RNA, 19 nt, Mycobacterium tuberculosis H37Rv
gccaggugcccaagcaguc

SEQ ID NO: 1359833 - RNA, 19 nt, Mycobacterium tuberculosis H37Rv
gccaggucuccuugggcga

SEQ ID NO: 1359834 - RNA, 19 nt, Mycobacterium tuberculosis H37Rv
gccaggucggugggcggcg

SEQ ID NO: 1359835 - RNA, 14 nt, Mycobacterium tuberculosis H37Rv
gccaggugcagcac

SEQ ID NO: 1359836 - RNA, 17 nt, Mycobacterium tuberculosis H37Rv
gccaguaacgcccacaa

SEQ ID NO: 1359837 - RNA, 17 nt, Mycobacterium tuberculosis H37Rv
gccagguuuugccgcgu

SEQ ID NO: 1359838 - RNA, 14 nt, Mycobacterium tuberculosis H37Rv
gccagguggcgagc

SEQ ID NO: 1359839 - RNA, 20 nt, Mycobacterium tuberculosis H37Rv
gccagggucacaaacccagc

SEQ ID NO: 1359840 - RNA, 17 nt, Mycobacterium tuberculosis H37Rv
gccagggucgcgagccc

SEQ ID NO: 1359841 - RNA, 17 nt, Mycobacterium tuberculosis H37Rv
gccagggugcccucggc

SEQ ID NO: 1359842 - RNA, 18 nt, Mycobacterium tuberculosis H37Rv
gccagggugcccucggcc

SEQ ID NO: 1359843 - RNA, 15 nt, Mycobacterium tuberculosis H37Rv
gccaggucggcggac

SEQ ID NO: 1359844 - RNA, 17 nt, Mycobacterium tuberculosis H37Rv
gccaggucggccaccgu

SEQ ID NO: 1359845 - RNA, 15 nt, Mycobacterium tuberculosis H37Rv
gccaggucggcgggc

SEQ ID NO: 1359846 - RNA, 16 nt, Mycobacterium tuberculosis H37Rv
gccaggucggcgggcg

SEQ ID NO: 1359847 - RNA, 21 nt, Mycobacterium tuberculosis H37Rv
gccaggucggcgggcgcgggu

SEQ ID NO: 1359848 - RNA, 16 nt, Mycobacterium tuberculosis H37Rv
gccaggucagccgcgc

SEQ ID NO: 1359849 - RNA, 14 nt, Mycobacterium tuberculosis H37Rv
gccagguccgccgg

SEQ ID NO: 1359850 - RNA, 16 nt, Mycobacterium tuberculosis H37Rv
gccaggggcgcagcgc

SEQ ID NO: 1359851 - RNA, 14 nt, Mycobacterium tuberculosis H37Rv
gccagggcuugccg

SEQ ID NO: 1359852 - RNA, 18 nt, Mycobacterium tuberculosis H37Rv
gccaggggacccggggcc

SEQ ID NO: 1359853 - RNA, 15 nt, Mycobacterium tuberculosis H37Rv
gccagggcgggcguc

SEQ ID NO: 1359854 - RNA, 22 nt, Mycobacterium tuberculosis H37Rv
gccagggcccuagccggcgcgc

SEQ ID NO: 1359855 - RNA, 14 nt, Mycobacterium tuberculosis H37Rv
gccagggccgccga

SEQ ID NO: 1359856 - RNA, 19 nt, Mycobacterium tuberculosis H37Rv
gccagggcccuagccggcg

SEQ ID NO: 1359857 - RNA, 16 nt, Mycobacterium tuberculosis H37Rv
gccaggcugcgcagug

SEQ ID NO: 1359858 - RNA, 17 nt, Mycobacterium tuberculosis H37Rv
gccaggcuugcggcacc

SEQ ID NO: 1359859 - RNA, 16 nt, Mycobacterium tuberculosis H37Rv
gccagggagcgcagcg

SEQ ID NO: 1359860 - RNA, 17 nt, Mycobacterium tuberculosis H37Rv
gccagggagcgcagcgc

SEQ ID NO: 1359861 - RNA, 15 nt, Mycobacterium tuberculosis H37Rv
gccaucccgccgccc

SEQ ID NO: 1359862 - RNA, 21 nt, Mycobacterium tuberculosis H37Rv
gccaucccgaucccggccagc

SEQ ID NO: 1359863 - RNA, 16 nt, Mycobacterium tuberculosis H37Rv
gccaucgccuccagcc

SEQ ID NO: 1359864 - RNA, 18 nt, Mycobacterium tuberculosis H37Rv
gccaucgccuccagccgg

SEQ ID NO: 1359865 - RNA, 20 nt, Mycobacterium tuberculosis H37Rv
gccaucgccuccagccggcg

SEQ ID NO: 1359866 - RNA, 23 nt, Mycobacterium tuberculosis H37Rv
gccaucacggcggggaucgcugg

SEQ ID NO: 1359867 - RNA, 18 nt, Mycobacterium tuberculosis H37Rv
gccaucacaucggccucu

SEQ ID NO: 1359868 - RNA, 14 nt, Mycobacterium tuberculosis H37Rv
gccauccaccgcag

SEQ ID NO: 1359869 - RNA, 15 nt, Mycobacterium tuberculosis H37Rv
gccaucauggcggcc

SEQ ID NO: 1359870 - RNA, 18 nt, Mycobacterium tuberculosis H37Rv
gccauagugaggccgacc

SEQ ID NO: 1359871 - RNA, 15 nt, Mycobacterium tuberculosis H37Rv
gccaucaaggccacc

SEQ ID NO: 1359872 - RNA, 19 nt, Mycobacterium tuberculosis H37Rv
gccaucaacaaggggcagc

SEQ ID NO: 1359873 - RNA, 21 nt, Mycobacterium tuberculosis H37Rv
gccaucaacaaggggcagcac

SEQ ID NO: 1359874 - RNA, 21 nt, Mycobacterium tuberculosis H37Rv
gccaucaacgacuucgggaac

SEQ ID NO: 1359875 - RNA, 16 nt, Mycobacterium tuberculosis H37Rv
gccauagcgggcggua

SEQ ID NO: 1359876 - RNA, 16 nt, Mycobacterium tuberculosis H37Rv
gccauaggcccacggc

SEQ ID NO: 1359877 - RNA, 15 nt, Mycobacterium tuberculosis H37Rv
gccauagcccgagcg

SEQ ID NO: 1359878 - RNA, 16 nt, Mycobacterium tuberculosis H37Rv
gccauaccggccgcca

SEQ ID NO: 1359879 - RNA, 13 nt, Mycobacterium tuberculosis H37Rv
gccauacuccgag

SEQ ID NO: 1359880 - RNA, 19 nt, Mycobacterium tuberculosis H37Rv
gccaguugcguuguccacc

SEQ ID NO: 1359881 - RNA, 15 nt, Mycobacterium tuberculosis H37Rv
gccauggaucccacg

SEQ ID NO: 1359882 - RNA, 20 nt, Mycobacterium tuberculosis H37Rv
gccaugccaagcuccaacca

SEQ ID NO: 1359883 - RNA, 11 nt, Mycobacterium tuberculosis H37Rv
gccauggucag

SEQ ID NO: 1359884 - RNA, 17 nt, Mycobacterium tuberculosis H37Rv
gccauggguagccgccc

SEQ ID NO: 1359885 - RNA, 19 nt, Mycobacterium tuberculosis H37Rv
gccauggacgccaugguga

SEQ ID NO: 1359886 - RNA, 13 nt, Mycobacterium tuberculosis H37Rv
gccaucgggcgcg

SEQ ID NO: 1359887 - RNA, 17 nt, Mycobacterium tuberculosis H37Rv
gccaucguccagcagga

SEQ ID NO: 1359888 - RNA, 18 nt, Mycobacterium tuberculosis H37Rv
gccaucgucgaagaccuc

SEQ ID NO: 1359889 - RNA, 16 nt, Mycobacterium tuberculosis H37Rv
gccaucgucgcgccgc

SEQ ID NO: 1359890 - RNA, 22 nt, Mycobacterium tuberculosis H37Rv
gccaugaagccgggcgcuugca

SEQ ID NO: 1359891 - RNA, 19 nt, Mycobacterium tuberculosis H37Rv
gccaugaucacaccgcugc

SEQ ID NO: 1359892 - RNA, 13 nt, Mycobacterium tuberculosis H37Rv
gccaugaucacac

SEQ ID NO: 1359893 - RNA, 21 nt, Mycobacterium tuberculosis H37Rv
gccauugacgccguugccgcc

SEQ ID NO: 1359894 - RNA, 19 nt, Mycobacterium tuberculosis H37Rv
gccauuucgucgucgcuga

SEQ ID NO: 1359895 - RNA, 14 nt, Mycobacterium tuberculosis H37Rv
gccauuccagccgg

SEQ ID NO: 1359896 - RNA, 15 nt, Mycobacterium tuberculosis H37Rv
gccauuccagccggu

SEQ ID NO: 1359897 - RNA, 15 nt, Mycobacterium tuberculosis H37Rv
gccauguccaccagc

SEQ ID NO: 1359898 - RNA, 19 nt, Mycobacterium tuberculosis H37Rv
gcccaagaucucgcgggcc

SEQ ID NO: 1359899 - RNA, 19 nt, Mycobacterium tuberculosis H37Rv
gcccaagcaguccacgagc

SEQ ID NO: 1359900 - RNA, 23 nt, Mycobacterium tuberculosis H37Rv
gcccaagcccucgacguccaucc

SEQ ID NO: 1359901 - RNA, 18 nt, Mycobacterium tuberculosis H37Rv
gcccaaaaggaagaccuc

SEQ ID NO: 1359902 - RNA, 16 nt, Mycobacterium tuberculosis H37Rv
gcccaaaagcgcggca

SEQ ID NO: 1359903 - RNA, 17 nt, Mycobacterium tuberculosis H37Rv
gcccaaaaggaagaccu

SEQ ID NO: 1359904 - RNA, 23 nt, Mycobacterium tuberculosis H37Rv
gccauuugggcccauggcgccug

SEQ ID NO: 1359905 - RNA, 21 nt, Mycobacterium tuberculosis H37Rv
gcccggguuggccgaacagcu

SEQ ID NO: 1359906 - RNA, 18 nt, Mycobacterium tuberculosis H37Rv
gcccggggcgcacagcug

SEQ ID NO: 1359907 - RNA, 23 nt, Mycobacterium tuberculosis H37Rv
gcccggguaucgccaguggugca

SEQ ID NO: 1359908 - RNA, 18 nt, Mycobacterium tuberculosis H37Rv
gcccgggugagacaaagg

SEQ ID NO: 1359909 - RNA, 18 nt, Mycobacterium tuberculosis H37Rv
gcccgggucuccggcgca

SEQ ID NO: 1359910 - RNA, 18 nt, Mycobacterium tuberculosis H37Rv
gcccgccucgcagcgaca

SEQ ID NO: 1359911 - RNA, 22 nt, Mycobacterium tuberculosis H37Rv
gcccgccguuacggagggcacg

SEQ ID NO: 1359912 - RNA, 17 nt, Mycobacterium tuberculosis H37Rv
gcccgccgucuuggccc

SEQ ID NO: 1359913 - RNA, 18 nt, Mycobacterium tuberculosis H37Rv
gcccgccguccccgccgc

SEQ ID NO: 1359914 - RNA, 13 nt, Mycobacterium tuberculosis H37Rv
gcccgcccaccuc

SEQ ID NO: 1359915 - RNA, 19 nt, Mycobacterium tuberculosis H37Rv
gcccgccaucauggcggcc

SEQ ID NO: 1359916 - RNA, 22 nt, Mycobacterium tuberculosis H37Rv
gcccgccauccgauggcccggc

SEQ ID NO: 1359917 - RNA, 15 nt, Mycobacterium tuberculosis H37Rv
gcccgccggccccgc

SEQ ID NO: 1359918 - RNA, 16 nt, Mycobacterium tuberculosis H37Rv
gcccgccggcagugag

SEQ ID NO: 1359919 - RNA, 16 nt, Mycobacterium tuberculosis H37Rv
gcccgccggacccgcc

SEQ ID NO: 1359920 - RNA, 18 nt, Mycobacterium tuberculosis H37Rv
gcccgccaucagcccggc

SEQ ID NO: 1359921 - RNA, 17 nt, Mycobacterium tuberculosis H37Rv
gcccgccaucagcccgg

SEQ ID NO: 1359922 - RNA, 12 nt, Mycobacterium tuberculosis H37Rv
gcccgccaggcc

SEQ ID NO: 1359923 - RNA, 18 nt, Mycobacterium tuberculosis H37Rv
gcccgccacagccccagg

SEQ ID NO: 1359924 - RNA, 13 nt, Mycobacterium tuberculosis H37Rv
gcccgccaggaac

SEQ ID NO: 1359925 - RNA, 12 nt, Mycobacterium tuberculosis H37Rv
gcccgccagcgc

SEQ ID NO: 1359926 - RNA, 16 nt, Mycobacterium tuberculosis H37Rv
gcccgccagcgccgcu

SEQ ID NO: 1359927 - RNA, 17 nt, Mycobacterium tuberculosis H37Rv
gcccgccagcagggcca

SEQ ID NO: 1359928 - RNA, 17 nt, Mycobacterium tuberculosis H37Rv
gcccgccaccggcgcga

SEQ ID NO: 1359929 - RNA, 22 nt, Mycobacterium tuberculosis H37Rv
gcccgguucgaggaucccgcug

SEQ ID NO: 1359930 - RNA, 21 nt, Mycobacterium tuberculosis H37Rv
gcccgguugggugugcccggg

SEQ ID NO: 1359931 - RNA, 17 nt, Mycobacterium tuberculosis H37Rv
gcccguagacgccgagc

SEQ ID NO: 1359932 - RNA, 18 nt, Mycobacterium tuberculosis H37Rv
gcccguagacgccgagca

SEQ ID NO: 1359933 - RNA, 17 nt, Mycobacterium tuberculosis H37Rv
gcccguagcugcgcagc

SEQ ID NO: 1359934 - RNA, 13 nt, Mycobacterium tuberculosis H37Rv
gcccgucacgccc

SEQ ID NO: 1359935 - RNA, 16 nt, Mycobacterium tuberculosis H37Rv
gcccgucacaaugccc

SEQ ID NO: 1359936 - RNA, 15 nt, Mycobacterium tuberculosis H37Rv
gcccgucccgccggc

SEQ ID NO: 1359937 - RNA, 18 nt, Mycobacterium tuberculosis H37Rv
gcccgucccgccggcccc

SEQ ID NO: 1359938 - RNA, 18 nt, Mycobacterium tuberculosis H37Rv
gcccgguucagcgcuggc

SEQ ID NO: 1359939 - RNA, 23 nt, Mycobacterium tuberculosis H37Rv
gcccgguguucaucacgccgccg

SEQ ID NO: 1359940 - RNA, 13 nt, Mycobacterium tuberculosis H37Rv
gcccgguggugcu

SEQ ID NO: 1359941 - RNA, 19 nt, Mycobacterium tuberculosis H37Rv
gcccggugugcugcacggc

SEQ ID NO: 1359942 - RNA, 23 nt, Mycobacterium tuberculosis H37Rv
gcccggugagcuuagcgcauggg

SEQ ID NO: 1359943 - RNA, 15 nt, Mycobacterium tuberculosis H37Rv
gcccggugauggugc

SEQ ID NO: 1359944 - RNA, 22 nt, Mycobacterium tuberculosis H37Rv
gcccggucucgacggcggccgc

SEQ ID NO: 1359945 - RNA, 15 nt, Mycobacterium tuberculosis H37Rv
gcccggugcggugca

SEQ ID NO: 1359946 - RNA, 20 nt, Mycobacterium tuberculosis H37Rv
gcccgguaucgucccggcga

SEQ ID NO: 1359947 - RNA, 12 nt, Mycobacterium tuberculosis H37Rv
gcccgguccagc

SEQ ID NO: 1359948 - RNA, 14 nt, Mycobacterium tuberculosis H37Rv
gcccgguccagccc

SEQ ID NO: 1359949 - RNA, 21 nt, Mycobacterium tuberculosis H37Rv
gcccggucucgacggcggccg

SEQ ID NO: 1359950 - RNA, 21 nt, Mycobacterium tuberculosis H37Rv
gcccggucgcugauccgggcg

SEQ ID NO: 1359951 - RNA, 17 nt, Mycobacterium tuberculosis H37Rv
gcccuacgcagcgcggc

SEQ ID NO: 1359952 - RNA, 18 nt, Mycobacterium tuberculosis H37Rv
gcccuagccggcgcgccc

SEQ ID NO: 1359953 - RNA, 21 nt, Mycobacterium tuberculosis H37Rv
gcccuauacgcaacaggccaa

SEQ ID NO: 1359954 - RNA, 23 nt, Mycobacterium tuberculosis H37Rv
gcccuccagggcccugcuggccc

SEQ ID NO: 1359955 - RNA, 12 nt, Mycobacterium tuberculosis H37Rv
gcccucagccgc

SEQ ID NO: 1359956 - RNA, 15 nt, Mycobacterium tuberculosis H37Rv
gcccucacgccaagu

SEQ ID NO: 1359957 - RNA, 17 nt, Mycobacterium tuberculosis H37Rv
gcccucagccgcggcca

SEQ ID NO: 1359958 - RNA, 12 nt, Mycobacterium tuberculosis H37Rv
gcccuccgacgg

SEQ ID NO: 1359959 - RNA, 20 nt, Mycobacterium tuberculosis H37Rv
gcccuccggguauggcggcg

SEQ ID NO: 1359960 - RNA, 15 nt, Mycobacterium tuberculosis H37Rv
gcccuccggcgcagc

SEQ ID NO: 1359961 - RNA, 23 nt, Mycobacterium tuberculosis H37Rv
gcccuccgugggcagcgcgcccg

SEQ ID NO: 1359962 - RNA, 21 nt, Mycobacterium tuberculosis H37Rv
gcccucgacguccaucccggc

SEQ ID NO: 1359963 - RNA, 21 nt, Mycobacterium tuberculosis H37Rv
gcccucgacgccgcgcagccg

SEQ ID NO: 1359964 - RNA, 23 nt, Mycobacterium tuberculosis H37Rv
gcccucgacgccgcgcagccggc

SEQ ID NO: 1359965 - RNA, 19 nt, Mycobacterium tuberculosis H37Rv
gcccucgaauucggccggc

SEQ ID NO: 1359966 - RNA, 14 nt, Mycobacterium tuberculosis H37Rv
gcccucgacgccgc

SEQ ID NO: 1359967 - RNA, 16 nt, Mycobacterium tuberculosis H37Rv
gcccucgacgccgcgc

SEQ ID NO: 1359968 - RNA, 19 nt, Mycobacterium tuberculosis H37Rv
gcccucgacgccgcgcagc

SEQ ID NO: 1359969 - RNA, 13 nt, Mycobacterium tuberculosis H37Rv
gcccucggccgcc

SEQ ID NO: 1359970 - RNA, 18 nt, Mycobacterium tuberculosis H37Rv
gcccucggccgccugacg

SEQ ID NO: 1359971 - RNA, 19 nt, Mycobacterium tuberculosis H37Rv
gcccucgcgcgcgucgagu

SEQ ID NO: 1359972 - RNA, 15 nt, Mycobacterium tuberculosis H37Rv
gcccucgauggccag

SEQ ID NO: 1359973 - RNA, 18 nt, Mycobacterium tuberculosis H37Rv
gcccucgaucgccacgac

SEQ ID NO: 1359974 - RNA, 16 nt, Mycobacterium tuberculosis H37Rv
gcccguguugaagaag

SEQ ID NO: 1359975 - RNA, 18 nt, Mycobacterium tuberculosis H37Rv
gcccguguugaagaagcc

SEQ ID NO: 1359976 - RNA, 23 nt, Mycobacterium tuberculosis H37Rv
gcccguguugaagaagcccgagu

SEQ ID NO: 1359977 - RNA, 15 nt, Mycobacterium tuberculosis H37Rv
gcccguguugaagaa

SEQ ID NO: 1359978 - RNA, 21 nt, Mycobacterium tuberculosis H37Rv
gcccguucaugcggcggcgcu

SEQ ID NO: 1359979 - RNA, 16 nt, Mycobacterium tuberculosis H37Rv
gcccguucgaccgugu

SEQ ID NO: 1359980 - RNA, 17 nt, Mycobacterium tuberculosis H37Rv
gcccguucucgcggccg

SEQ ID NO: 1359981 - RNA, 18 nt, Mycobacterium tuberculosis H37Rv
gcccguucucgcggccga

SEQ ID NO: 1359982 - RNA, 19 nt, Mycobacterium tuberculosis H37Rv
gcccguucucgcggccgau

SEQ ID NO: 1359983 - RNA, 16 nt, Mycobacterium tuberculosis H37Rv
gcccguugaccugcgc

SEQ ID NO: 1359984 - RNA, 17 nt, Mycobacterium tuberculosis H37Rv
gcccuaacccugcccua

SEQ ID NO: 1359985 - RNA, 20 nt, Mycobacterium tuberculosis H37Rv
gcccguuggcagcacaggcu

SEQ ID NO: 1359986 - RNA, 20 nt, Mycobacterium tuberculosis H37Rv
gcccguuggccaagaaugug

SEQ ID NO: 1359987 - RNA, 21 nt, Mycobacterium tuberculosis H37Rv
gcccguuggccaagaaugugg

SEQ ID NO: 1359988 - RNA, 14 nt, Mycobacterium tuberculosis H37Rv
gcccgugccgcccu

SEQ ID NO: 1359989 - RNA, 15 nt, Mycobacterium tuberculosis H37Rv
gcccgugccgcccuc

SEQ ID NO: 1359990 - RNA, 14 nt, Mycobacterium tuberculosis H37Rv
gcccgugcgaugca

SEQ ID NO: 1359991 - RNA, 15 nt, Mycobacterium tuberculosis H37Rv
gcccgucuuccagcc

SEQ ID NO: 1359992 - RNA, 13 nt, Mycobacterium tuberculosis H37Rv
gcccgucuuccag

SEQ ID NO: 1359993 - RNA, 15 nt, Mycobacterium tuberculosis H37Rv
gcccgugacugguga

SEQ ID NO: 1359994 - RNA, 14 nt, Mycobacterium tuberculosis H37Rv
gcccgucgcggccg

SEQ ID NO: 1359995 - RNA, 22 nt, Mycobacterium tuberculosis H37Rv
gcccgucguagguggccggcuu

SEQ ID NO: 1359996 - RNA, 13 nt, Mycobacterium tuberculosis H37Rv
gcccgucgggccg

SEQ ID NO: 1359997 - RNA, 21 nt, Mycobacterium tuberculosis H37Rv
gcccgucgugcgggggugguc

SEQ ID NO: 1359998 - RNA, 14 nt, Mycobacterium tuberculosis H37Rv
gcccuggcggcccg

SEQ ID NO: 1359999 - RNA, 17 nt, Mycobacterium tuberculosis H37Rv
gcccuuagggucgccgc

SEQ ID NO: 1360000 - RNA, 17 nt, Mycobacterium tuberculosis H37Rv
gcccuucagcacgguga

SEQ ID NO: 1360001 - RNA, 13 nt, Mycobacterium tuberculosis H37Rv
gcccuguucuccg

SEQ ID NO: 1360002 - RNA, 14 nt, Mycobacterium tuberculosis H37Rv
gcccuuccggccga

SEQ ID NO: 1360003 - RNA, 23 nt, Mycobacterium tuberculosis H37Rv
gcccucguuaucgaccgccgcga

SEQ ID NO: 1360004 - RNA, 19 nt, Mycobacterium tuberculosis H37Rv
gcccucgucgcgggccacc

SEQ ID NO: 1360005 - RNA, 14 nt, Mycobacterium tuberculosis H37Rv
gcccucgggacugc

SEQ ID NO: 1360006 - RNA, 17 nt, Mycobacterium tuberculosis H37Rv
gcccucuaugcgggcag

SEQ ID NO: 1360007 - RNA, 22 nt, Mycobacterium tuberculosis H37Rv
gcccugacccggagccgccagg

SEQ ID NO: 1360008 - RNA, 19 nt, Mycobacterium tuberculosis H37Rv
gcccugacacaacaccggc

SEQ ID NO: 1360009 - RNA, 18 nt, Mycobacterium tuberculosis H37Rv
gcccugaagggccgccuc

SEQ ID NO: 1360010 - RNA, 17 nt, Mycobacterium tuberculosis H37Rv
gcccugcccgaaggugg

SEQ ID NO: 1360011 - RNA, 20 nt, Mycobacterium tuberculosis H37Rv
gcccugccccggacuccaaa

SEQ ID NO: 1360012 - RNA, 20 nt, Mycobacterium tuberculosis H37Rv
gcccuggcaacgacacgccg

SEQ ID NO: 1360013 - RNA, 23 nt, Mycobacterium tuberculosis H37Rv
gcccuggcaacgacacgccgcuc

SEQ ID NO: 1360014 - RNA, 15 nt, Mycobacterium tuberculosis H37Rv
gcccuggccgcccug

SEQ ID NO: 1360015 - RNA, 18 nt, Mycobacterium tuberculosis H37Rv
gcccuggccgcccagacc

SEQ ID NO: 1360016 - RNA, 15 nt, Mycobacterium tuberculosis H37Rv
gcccugcacagcagc

SEQ ID NO: 1360017 - RNA, 16 nt, Mycobacterium tuberculosis H37Rv
gccgacauugcugcuc

SEQ ID NO: 1360018 - RNA, 14 nt, Mycobacterium tuberculosis H37Rv
gccgaccuagucac

SEQ ID NO: 1360019 - RNA, 12 nt, Mycobacterium tuberculosis H37Rv
gccgaccucgag

SEQ ID NO: 1360020 - RNA, 22 nt, Mycobacterium tuberculosis H37Rv
gccgaccugcgcgacggcgcug

SEQ ID NO: 1360021 - RNA, 20 nt, Mycobacterium tuberculosis H37Rv
gccgaccuuuugcggcaagc

SEQ ID NO: 1360022 - RNA, 18 nt, Mycobacterium tuberculosis H37Rv
gccgacgaucgacgccgc

SEQ ID NO: 1360023 - RNA, 17 nt, Mycobacterium tuberculosis H37Rv
gccgaauaacagcaggc

SEQ ID NO: 1360024 - RNA, 13 nt, Mycobacterium tuberculosis H37Rv
gccgaaucggcag

SEQ ID NO: 1360025 - RNA, 13 nt, Mycobacterium tuberculosis H37Rv
gccgaaucgcggg

SEQ ID NO: 1360026 - RNA, 14 nt, Mycobacterium tuberculosis H37Rv
gccgacagccaccg

SEQ ID NO: 1360027 - RNA, 16 nt, Mycobacterium tuberculosis H37Rv
gccgacagcacgccag

SEQ ID NO: 1360028 - RNA, 23 nt, Mycobacterium tuberculosis H37Rv
gccgacaguuuaccgugccgccc

SEQ ID NO: 1360029 - RNA, 16 nt, Mycobacterium tuberculosis H37Rv
gccgaaaagggcgaca

SEQ ID NO: 1360030 - RNA, 16 nt, Mycobacterium tuberculosis H37Rv
gccgaagcugcccaac

SEQ ID NO: 1360031 - RNA, 21 nt, Mycobacterium tuberculosis H37Rv
gccgaagcggccaccgccgcc

SEQ ID NO: 1360032 - RNA, 13 nt, Mycobacterium tuberculosis H37Rv
gccgaagcgggcc

SEQ ID NO: 1360033 - RNA, 21 nt, Mycobacterium tuberculosis H37Rv
gccgaaggauuuggagcuuuu

SEQ ID NO: 1360034 - RNA, 18 nt, Mycobacterium tuberculosis H37Rv
gccgaaggcaaagcgagc

SEQ ID NO: 1360035 - RNA, 14 nt, Mycobacterium tuberculosis H37Rv
gccgaagcggccac

SEQ ID NO: 1360036 - RNA, 15 nt, Mycobacterium tuberculosis H37Rv
gccgaagcggccacc

SEQ ID NO: 1360037 - RNA, 13 nt, Mycobacterium tuberculosis H37Rv
gccgaagcccggc

SEQ ID NO: 1360038 - RNA, 12 nt, Mycobacterium tuberculosis H37Rv
gccgaagcccga

SEQ ID NO: 1360039 - RNA, 14 nt, Mycobacterium tuberculosis H37Rv
gccgaaggccuuau

SEQ ID NO: 1360040 - RNA, 15 nt, Mycobacterium tuberculosis H37Rv
gccgaaggcggggga

SEQ ID NO: 1360041 - RNA, 21 nt, Mycobacterium tuberculosis H37Rv
gccgaggcggucuuguccagg

SEQ ID NO: 1360042 - RNA, 17 nt, Mycobacterium tuberculosis H37Rv
gccgacgggacaacccg

SEQ ID NO: 1360043 - RNA, 17 nt, Mycobacterium tuberculosis H37Rv
gccgacggccagcagga

SEQ ID NO: 1360044 - RNA, 18 nt, Mycobacterium tuberculosis H37Rv
gccgacggccagcaggau

SEQ ID NO: 1360045 - RNA, 14 nt, Mycobacterium tuberculosis H37Rv
gccgacggccagca

SEQ ID NO: 1360046 - RNA, 16 nt, Mycobacterium tuberculosis H37Rv
gccgacgcgaacccau

SEQ ID NO: 1360047 - RNA, 18 nt, Mycobacterium tuberculosis H37Rv
gccgacgccgccggcccc

SEQ ID NO: 1360048 - RNA, 16 nt, Mycobacterium tuberculosis H37Rv
gccgacgccuuccagc

SEQ ID NO: 1360049 - RNA, 14 nt, Mycobacterium tuberculosis H37Rv
gccgacgcggcggg

SEQ ID NO: 1360050 - RNA, 12 nt, Mycobacterium tuberculosis H37Rv
gccgacgccgcc

SEQ ID NO: 1360051 - RNA, 16 nt, Mycobacterium tuberculosis H37Rv
gccgacgccgccggcc

SEQ ID NO: 1360052 - RNA, 14 nt, Mycobacterium tuberculosis H37Rv
gccgacgccaacgc

SEQ ID NO: 1360053 - RNA, 23 nt, Mycobacterium tuberculosis H37Rv
gccgaguaccggccagccgcggc

SEQ ID NO: 1360054 - RNA, 20 nt, Mycobacterium tuberculosis H37Rv
gccgaggucgaaccgccggc

SEQ ID NO: 1360055 - RNA, 23 nt, Mycobacterium tuberculosis H37Rv
gccgaggguagacggggcgagca

SEQ ID NO: 1360056 - RNA, 19 nt, Mycobacterium tuberculosis H37Rv
gccgaggguagacggggcg

SEQ ID NO: 1360057 - RNA, 14 nt, Mycobacterium tuberculosis H37Rv
gccgaucagcgaac

SEQ ID NO: 1360058 - RNA, 21 nt, Mycobacterium tuberculosis H37Rv
gccgaucagcgaaccaccggc

SEQ ID NO: 1360059 - RNA, 15 nt, Mycobacterium tuberculosis H37Rv
gccgaucaccaccgg

SEQ ID NO: 1360060 - RNA, 16 nt, Mycobacterium tuberculosis H37Rv
gccgaucaccaccggc

SEQ ID NO: 1360061 - RNA, 16 nt, Mycobacterium tuberculosis H37Rv
gccgaucaauggcaac

SEQ ID NO: 1360062 - RNA, 19 nt, Mycobacterium tuberculosis H37Rv
gccgaucaaccccccgggc

SEQ ID NO: 1360063 - RNA, 20 nt, Mycobacterium tuberculosis H37Rv
gccgaucccggcgagcaccc

SEQ ID NO: 1360064 - RNA, 14 nt, Mycobacterium tuberculosis H37Rv
gccgauccagcagg

SEQ ID NO: 1360065 - RNA, 15 nt, Mycobacterium tuberculosis H37Rv
gccgauccagcaggc

SEQ ID NO: 1360066 - RNA, 19 nt, Mycobacterium tuberculosis H37Rv
gccgaugaugcggcgcagc

SEQ ID NO: 1360067 - RNA, 16 nt, Mycobacterium tuberculosis H37Rv
gccgaucagcugcgca

SEQ ID NO: 1360068 - RNA, 15 nt, Mycobacterium tuberculosis H37Rv
gccgaugccgccggc

SEQ ID NO: 1360069 - RNA, 18 nt, Mycobacterium tuberculosis H37Rv
gccgaugccggcgagggc

SEQ ID NO: 1360070 - RNA, 18 nt, Mycobacterium tuberculosis H37Rv
gccgaugcgacccgcaga

SEQ ID NO: 1360071 - RNA, 14 nt, Mycobacterium tuberculosis H37Rv
gccgauuggccugc

SEQ ID NO: 1360072 - RNA, 16 nt, Mycobacterium tuberculosis H37Rv
gccgauuggccugcca

SEQ ID NO: 1360073 - RNA, 20 nt, Mycobacterium tuberculosis H37Rv
gccgauguagacgguggcgc

SEQ ID NO: 1360074 - RNA, 17 nt, Mycobacterium tuberculosis H37Rv
gccgauguuggcagggc

SEQ ID NO: 1360075 - RNA, 15 nt, Mycobacterium tuberculosis H37Rv
gccgauggugauggg

SEQ ID NO: 1360076 - RNA, 17 nt, Mycobacterium tuberculosis H37Rv
gccgauggugauggggg

SEQ ID NO: 1360077 - RNA, 21 nt, Mycobacterium tuberculosis H37Rv
gccgauggcuaccccagggag

SEQ ID NO: 1360078 - RNA, 23 nt, Mycobacterium tuberculosis H37Rv
gccgccauccccuggccagcaga

SEQ ID NO: 1360079 - RNA, 17 nt, Mycobacterium tuberculosis H37Rv
gccgccaucagcccuuc

SEQ ID NO: 1360080 - RNA, 19 nt, Mycobacterium tuberculosis H37Rv
gccgccauccccuggccag

SEQ ID NO: 1360081 - RNA, 17 nt, Mycobacterium tuberculosis H37Rv
gccgccaucaccgccgu

SEQ ID NO: 1360082 - RNA, 15 nt, Mycobacterium tuberculosis H37Rv
gccgccaucagcccu

SEQ ID NO: 1360083 - RNA, 20 nt, Mycobacterium tuberculosis H37Rv
gccgccauccccuggccagc

SEQ ID NO: 1360084 - RNA, 23 nt, Mycobacterium tuberculosis H37Rv
gccgccaucaacaaggggcagca

SEQ ID NO: 1360085 - RNA, 15 nt, Mycobacterium tuberculosis H37Rv
gccgccaggcggccg

SEQ ID NO: 1360086 - RNA, 21 nt, Mycobacterium tuberculosis H37Rv
gccgccagggcccuagccggc

SEQ ID NO: 1360087 - RNA, 16 nt, Mycobacterium tuberculosis H37Rv
gccgccauuccagccg

SEQ ID NO: 1360088 - RNA, 22 nt, Mycobacterium tuberculosis H37Rv
gccgccaucgcccgauccccgg

SEQ ID NO: 1360089 - RNA, 17 nt, Mycobacterium tuberculosis H37Rv
gccgccauggccgccgu

SEQ ID NO: 1360090 - RNA, 21 nt, Mycobacterium tuberculosis H37Rv
gccgccagcgcggccauuagc

SEQ ID NO: 1360091 - RNA, 18 nt, Mycobacterium tuberculosis H37Rv
gccgccagcgccgccggc

SEQ ID NO: 1360092 - RNA, 17 nt, Mycobacterium tuberculosis H37Rv
gccgccagcgccgccgg

SEQ ID NO: 1360093 - RNA, 22 nt, Mycobacterium tuberculosis H37Rv
gccgccagcgccgccggcgccg

SEQ ID NO: 1360094 - RNA, 13 nt, Mycobacterium tuberculosis H37Rv
gccgccagcgcgc

SEQ ID NO: 1360095 - RNA, 17 nt, Mycobacterium tuberculosis H37Rv
gccgccagcgccaccgu

SEQ ID NO: 1360096 - RNA, 16 nt, Mycobacterium tuberculosis H37Rv
gccgccagcgccgccg

SEQ ID NO: 1360097 - RNA, 12 nt, Mycobacterium tuberculosis H37Rv
gccgccagcccc

SEQ ID NO: 1360098 - RNA, 12 nt, Mycobacterium tuberculosis H37Rv
gccgccagcauu

SEQ ID NO: 1360099 - RNA, 15 nt, Mycobacterium tuberculosis H37Rv
gccgccaccaccggc

SEQ ID NO: 1360100 - RNA, 13 nt, Mycobacterium tuberculosis H37Rv
gccgccaccgcga

SEQ ID NO: 1360101 - RNA, 19 nt, Mycobacterium tuberculosis H37Rv
gccgccaccagcgcgagcc

SEQ ID NO: 1360102 - RNA, 12 nt, Mycobacterium tuberculosis H37Rv
gccgccaccagc

SEQ ID NO: 1360103 - RNA, 18 nt, Mycobacterium tuberculosis H37Rv
gccgccacccggcgggcg

SEQ ID NO: 1360104 - RNA, 19 nt, Mycobacterium tuberculosis H37Rv
gccgccacagcacccacgc

SEQ ID NO: 1360105 - RNA, 20 nt, Mycobacterium tuberculosis H37Rv
gccgccaacuucaccacccu

SEQ ID NO: 1360106 - RNA, 21 nt, Mycobacterium tuberculosis H37Rv
gccgccaacuucaccacccug

SEQ ID NO: 1360107 - RNA, 17 nt, Mycobacterium tuberculosis H37Rv
gccgcagggccgcgcgc

SEQ ID NO: 1360108 - RNA, 17 nt, Mycobacterium tuberculosis H37Rv
gccgcaguacugguaga

SEQ ID NO: 1360109 - RNA, 18 nt, Mycobacterium tuberculosis H37Rv
gccgcaccaagcagcgac

SEQ ID NO: 1360110 - RNA, 18 nt, Mycobacterium tuberculosis H37Rv
gccgcaccaaggccgccu

SEQ ID NO: 1360111 - RNA, 16 nt, Mycobacterium tuberculosis H37Rv
gccgcacccgcucccg

SEQ ID NO: 1360112 - RNA, 13 nt, Mycobacterium tuberculosis H37Rv
gccgcaccgcugu

SEQ ID NO: 1360113 - RNA, 22 nt, Mycobacterium tuberculosis H37Rv
gccgcagcuuuaaucguggcac

SEQ ID NO: 1360114 - RNA, 14 nt, Mycobacterium tuberculosis H37Rv
gccgcaaggcgccg

SEQ ID NO: 1360115 - RNA, 12 nt, Mycobacterium tuberculosis H37Rv
gccgcacacucu

SEQ ID NO: 1360116 - RNA, 15 nt, Mycobacterium tuberculosis H37Rv
gccgcacagcggccc

SEQ ID NO: 1360117 - RNA, 17 nt, Mycobacterium tuberculosis H37Rv
gccgccauugccgccgg

SEQ ID NO: 1360118 - RNA, 20 nt, Mycobacterium tuberculosis H37Rv
gccgccauuggacagcgcga

SEQ ID NO: 1360119 - RNA, 14 nt, Mycobacterium tuberculosis H37Rv
gccgcccaaagaaa

SEQ ID NO: 1360120 - RNA, 17 nt, Mycobacterium tuberculosis H37Rv
gccgcccaagccgccgg

SEQ ID NO: 1360121 - RNA, 20 nt, Mycobacterium tuberculosis H37Rv
gccgcccaauugccuccgcu

SEQ ID NO: 1360122 - RNA, 11 nt, Mycobacterium tuberculosis H37Rv
gccgcccagcg

SEQ ID NO: 1360123 - RNA, 13 nt, Mycobacterium tuberculosis H37Rv
gccgcccagcgac

SEQ ID NO: 1360124 - RNA, 13 nt, Mycobacterium tuberculosis H37Rv
gccgcccaggagc

SEQ ID NO: 1360125 - RNA, 12 nt, Mycobacterium tuberculosis H37Rv
gccgcccaucac

SEQ ID NO: 1360126 - RNA, 17 nt, Mycobacterium tuberculosis H37Rv
gccgcccgugccgcccu

SEQ ID NO: 1360127 - RNA, 20 nt, Mycobacterium tuberculosis H37Rv
gccgcccgguugaccgccga

SEQ ID NO: 1360128 - RNA, 16 nt, Mycobacterium tuberculosis H37Rv
gccgcccccgccggcc

SEQ ID NO: 1360129 - RNA, 18 nt, Mycobacterium tuberculosis H37Rv
gccgcccggucgggcgcg

SEQ ID NO: 1360130 - RNA, 22 nt, Mycobacterium tuberculosis H37Rv
gccgcccggucgggcgcggggc

SEQ ID NO: 1360131 - RNA, 17 nt, Mycobacterium tuberculosis H37Rv
gccgcccgucccgccgg

SEQ ID NO: 1360132 - RNA, 18 nt, Mycobacterium tuberculosis H37Rv
gccgcccgucccgccggc

SEQ ID NO: 1360133 - RNA, 19 nt, Mycobacterium tuberculosis H37Rv
gccgcccgucccgccggcc

SEQ ID NO: 1360134 - RNA, 18 nt, Mycobacterium tuberculosis H37Rv
gccgccgagcuggcgcgc

SEQ ID NO: 1360135 - RNA, 15 nt, Mycobacterium tuberculosis H37Rv
gccgccgagcuggcg

SEQ ID NO: 1360136 - RNA, 19 nt, Mycobacterium tuberculosis H37Rv
gccgccgaucuugagccgg

SEQ ID NO: 1360137 - RNA, 17 nt, Mycobacterium tuberculosis H37Rv
gccgccgagggcgccgg

SEQ ID NO: 1360138 - RNA, 18 nt, Mycobacterium tuberculosis H37Rv
gccgccgauaccgccggc

SEQ ID NO: 1360139 - RNA, 19 nt, Mycobacterium tuberculosis H37Rv
gccgccgauaccgccggcc

SEQ ID NO: 1360140 - RNA, 16 nt, Mycobacterium tuberculosis H37Rv
gccgccgagggcgccg

SEQ ID NO: 1360141 - RNA, 16 nt, Mycobacterium tuberculosis H37Rv
gccgccgaugccgccg

SEQ ID NO: 1360142 - RNA, 17 nt, Mycobacterium tuberculosis H37Rv
gccgccgaugccgccgg

SEQ ID NO: 1360143 - RNA, 13 nt, Mycobacterium tuberculosis H37Rv
gccgccgcugccg

SEQ ID NO: 1360144 - RNA, 16 nt, Mycobacterium tuberculosis H37Rv
gccgccgcugccgccc

SEQ ID NO: 1360145 - RNA, 17 nt, Mycobacterium tuberculosis H37Rv
gccgccgcugccgcccu

SEQ ID NO: 1360146 - RNA, 16 nt, Mycobacterium tuberculosis H37Rv
gccgccgcugccgccu

SEQ ID NO: 1360147 - RNA, 13 nt, Mycobacterium tuberculosis H37Rv
gccgccgcuggug

SEQ ID NO: 1360148 - RNA, 21 nt, Mycobacterium tuberculosis H37Rv
gccgccggacccgucgagcag

SEQ ID NO: 1360149 - RNA, 18 nt, Mycobacterium tuberculosis H37Rv
gccgccggaagcgccggc

SEQ ID NO: 1360150 - RNA, 15 nt, Mycobacterium tuberculosis H37Rv
gccgccggcaccgcc

SEQ ID NO: 1360151 - RNA, 17 nt, Mycobacterium tuberculosis H37Rv
gccgccggaaucgagac

SEQ ID NO: 1360152 - RNA, 13 nt, Mycobacterium tuberculosis H37Rv
gccgccggcaccg

SEQ ID NO: 1360153 - RNA, 15 nt, Mycobacterium tuberculosis H37Rv
gccgccgacaacccc

SEQ ID NO: 1360154 - RNA, 21 nt, Mycobacterium tuberculosis H37Rv
gccgccgaccggagccgccgg

SEQ ID NO: 1360155 - RNA, 18 nt, Mycobacterium tuberculosis H37Rv
gccgccgacgccgccggc

SEQ ID NO: 1360156 - RNA, 19 nt, Mycobacterium tuberculosis H37Rv
gccgccgacgccgccggcg

SEQ ID NO: 1360157 - RNA, 22 nt, Mycobacterium tuberculosis H37Rv
gccgccgacggaucgcccugac

SEQ ID NO: 1360158 - RNA, 17 nt, Mycobacterium tuberculosis H37Rv
gccgccgacgccgccgg

SEQ ID NO: 1360159 - RNA, 22 nt, Mycobacterium tuberculosis H37Rv
gccgccgacaaccccgccagga

SEQ ID NO: 1360160 - RNA, 18 nt, Mycobacterium tuberculosis H37Rv
gccgccgacaccaccggc

SEQ ID NO: 1360161 - RNA, 22 nt, Mycobacterium tuberculosis H37Rv
gccgccgacaccaccggcgccg

SEQ ID NO: 1360162 - RNA, 21 nt, Mycobacterium tuberculosis H37Rv
gccgcccuugccgccggcccc

SEQ ID NO: 1360163 - RNA, 22 nt, Mycobacterium tuberculosis H37Rv
gccgcccuugccuccggcgccg

SEQ ID NO: 1360164 - RNA, 16 nt, Mycobacterium tuberculosis H37Rv
gccgcccuugccgccg

SEQ ID NO: 1360165 - RNA, 21 nt, Mycobacterium tuberculosis H37Rv
gccgcccuugauguccgcgac

SEQ ID NO: 1360166 - RNA, 20 nt, Mycobacterium tuberculosis H37Rv
gccgcccuugccgccggccc

SEQ ID NO: 1360167 - RNA, 17 nt, Mycobacterium tuberculosis H37Rv
gccgccgaaacucacca

SEQ ID NO: 1360168 - RNA, 18 nt, Mycobacterium tuberculosis H37Rv
gccgccgaaacucaccag

SEQ ID NO: 1360169 - RNA, 19 nt, Mycobacterium tuberculosis H37Rv
gccgccgaaacucaccagc

SEQ ID NO: 1360170 - RNA, 18 nt, Mycobacterium tuberculosis H37Rv
gccgcccugguccaggcc

SEQ ID NO: 1360171 - RNA, 13 nt, Mycobacterium tuberculosis H37Rv
gccgcgcgcccgc

SEQ ID NO: 1360172 - RNA, 19 nt, Mycobacterium tuberculosis H37Rv
gccgcgccccagacgcgca

SEQ ID NO: 1360173 - RNA, 15 nt, Mycobacterium tuberculosis H37Rv
gccgcgccggugugc

SEQ ID NO: 1360174 - RNA, 13 nt, Mycobacterium tuberculosis H37Rv
gccgcgccguaga

SEQ ID NO: 1360175 - RNA, 18 nt, Mycobacterium tuberculosis H37Rv
gccgcgccggcgggcgag

SEQ ID NO: 1360176 - RNA, 20 nt, Mycobacterium tuberculosis H37Rv
gccgcgacgcacugccccgc

SEQ ID NO: 1360177 - RNA, 14 nt, Mycobacterium tuberculosis H37Rv
gccgcgacgcggcg

SEQ ID NO: 1360178 - RNA, 15 nt, Mycobacterium tuberculosis H37Rv
gccgcgagcgccggc

SEQ ID NO: 1360179 - RNA, 15 nt, Mycobacterium tuberculosis H37Rv
gccgcgagcgcgcga

SEQ ID NO: 1360180 - RNA, 14 nt, Mycobacterium tuberculosis H37Rv
gccgcgcauccgca

SEQ ID NO: 1360181 - RNA, 17 nt, Mycobacterium tuberculosis H37Rv
gccgcgcaucgcggccg

SEQ ID NO: 1360182 - RNA, 13 nt, Mycobacterium tuberculosis H37Rv
gccgcgaggaugc

SEQ ID NO: 1360183 - RNA, 16 nt, Mycobacterium tuberculosis H37Rv
gccgcgcagcugccgc

SEQ ID NO: 1360184 - RNA, 12 nt, Mycobacterium tuberculosis H37Rv
gccgcgcagcug

SEQ ID NO: 1360185 - RNA, 16 nt, Mycobacterium tuberculosis H37Rv
gccgccguccagcgcc

SEQ ID NO: 1360186 - RNA, 12 nt, Mycobacterium tuberculosis H37Rv
gccgccgucccc

SEQ ID NO: 1360187 - RNA, 16 nt, Mycobacterium tuberculosis H37Rv
gccgccucgggcaccu

SEQ ID NO: 1360188 - RNA, 17 nt, Mycobacterium tuberculosis H37Rv
gccgccucgggcaccug

SEQ ID NO: 1360189 - RNA, 17 nt, Mycobacterium tuberculosis H37Rv
gccgccuccgccgaggc

SEQ ID NO: 1360190 - RNA, 22 nt, Mycobacterium tuberculosis H37Rv
gccgccuccgccgaggccgccg

SEQ ID NO: 1360191 - RNA, 14 nt, Mycobacterium tuberculosis H37Rv
gccgccuccgccug

SEQ ID NO: 1360192 - RNA, 13 nt, Mycobacterium tuberculosis H37Rv
gccgccuccgcgg

SEQ ID NO: 1360193 - RNA, 14 nt, Mycobacterium tuberculosis H37Rv
gccgcgacccgcgc

SEQ ID NO: 1360194 - RNA, 14 nt, Mycobacterium tuberculosis H37Rv
gccgccuggagcug

SEQ ID NO: 1360195 - RNA, 22 nt, Mycobacterium tuberculosis H37Rv
gccgccuggagcuguggcgggc

SEQ ID NO: 1360196 - RNA, 18 nt, Mycobacterium tuberculosis H37Rv
gccgccugcuccucggcc

SEQ ID NO: 1360197 - RNA, 21 nt, Mycobacterium tuberculosis H37Rv
gccgcgaccgcgagcaucugg

SEQ ID NO: 1360198 - RNA, 16 nt, Mycobacterium tuberculosis H37Rv
gccgccugcgccgcca

SEQ ID NO: 1360199 - RNA, 16 nt, Mycobacterium tuberculosis H37Rv
gccgccggugccgccg

SEQ ID NO: 1360200 - RNA, 17 nt, Mycobacterium tuberculosis H37Rv
gccgccggugccgccgc

SEQ ID NO: 1360201 - RNA, 16 nt, Mycobacterium tuberculosis H37Rv
gccgccggugccgcca

SEQ ID NO: 1360202 - RNA, 16 nt, Mycobacterium tuberculosis H37Rv
gccgccggugccaccc

SEQ ID NO: 1360203 - RNA, 16 nt, Mycobacterium tuberculosis H37Rv
gccgccgguuccgccg

SEQ ID NO: 1360204 - RNA, 19 nt, Mycobacterium tuberculosis H37Rv
gccgccgguuccgccggcc

SEQ ID NO: 1360205 - RNA, 20 nt, Mycobacterium tuberculosis H37Rv
gccgccgguuccgccggccc

SEQ ID NO: 1360206 - RNA, 20 nt, Mycobacterium tuberculosis H37Rv
gccgccggucaucccaagcg

SEQ ID NO: 1360207 - RNA, 18 nt, Mycobacterium tuberculosis H37Rv
gccgccggguuuauccag

SEQ ID NO: 1360208 - RNA, 15 nt, Mycobacterium tuberculosis H37Rv
gccgccgguccccuc

SEQ ID NO: 1360209 - RNA, 15 nt, Mycobacterium tuberculosis H37Rv
gccgccgggggacga

SEQ ID NO: 1360210 - RNA, 21 nt, Mycobacterium tuberculosis H37Rv
gccgccggguccuugcggccg

SEQ ID NO: 1360211 - RNA, 22 nt, Mycobacterium tuberculosis H37Rv
gccgccggguccuugcggccgg

SEQ ID NO: 1360212 - RNA, 16 nt, Mycobacterium tuberculosis H37Rv
gccgccggccgccagc

SEQ ID NO: 1360213 - RNA, 13 nt, Mycobacterium tuberculosis H37Rv
gccgccggccgcg

SEQ ID NO: 1360214 - RNA, 14 nt, Mycobacterium tuberculosis H37Rv
gccgccggccccgc

SEQ ID NO: 1360215 - RNA, 15 nt, Mycobacterium tuberculosis H37Rv
gccgccggaucgccg

SEQ ID NO: 1360216 - RNA, 18 nt, Mycobacterium tuberculosis H37Rv
gccgccggcaccgccggc

SEQ ID NO: 1360217 - RNA, 15 nt, Mycobacterium tuberculosis H37Rv
gccggugcgguggug

SEQ ID NO: 1360218 - RNA, 20 nt, Mycobacterium tuberculosis H37Rv
gccggugcgucacagccggg

SEQ ID NO: 1360219 - RNA, 13 nt, Mycobacterium tuberculosis H37Rv
gccggugcuccuc

SEQ ID NO: 1360220 - RNA, 15 nt, Mycobacterium tuberculosis H37Rv
gccggugcgcccugc

SEQ ID NO: 1360221 - RNA, 14 nt, Mycobacterium tuberculosis H37Rv
gccggugcgcgcug

SEQ ID NO: 1360222 - RNA, 14 nt, Mycobacterium tuberculosis H37Rv
gccggugcgcugga

SEQ ID NO: 1360223 - RNA, 21 nt, Mycobacterium tuberculosis H37Rv
gccggugccggcguugccgcc

SEQ ID NO: 1360224 - RNA, 17 nt, Mycobacterium tuberculosis H37Rv
gccggugccgccguucc

SEQ ID NO: 1360225 - RNA, 18 nt, Mycobacterium tuberculosis H37Rv
gccggugccgccuccgcc

SEQ ID NO: 1360226 - RNA, 17 nt, Mycobacterium tuberculosis H37Rv
gccggugccgccgggug

SEQ ID NO: 1360227 - RNA, 23 nt, Mycobacterium tuberculosis H37Rv
gccgguggcacccgcgucgagug

SEQ ID NO: 1360228 - RNA, 14 nt, Mycobacterium tuberculosis H37Rv
gccgguggccgcgc

SEQ ID NO: 1360229 - RNA, 14 nt, Mycobacterium tuberculosis H37Rv
gccggugucggcug

SEQ ID NO: 1360230 - RNA, 14 nt, Mycobacterium tuberculosis H37Rv
gccgguggcguggg

SEQ ID NO: 1360231 - RNA, 18 nt, Mycobacterium tuberculosis H37Rv
gccgguggcgccgccgcc

SEQ ID NO: 1360232 - RNA, 23 nt, Mycobacterium tuberculosis H37Rv
gccggugccgccgccugcuccuc

SEQ ID NO: 1360233 - RNA, 16 nt, Mycobacterium tuberculosis H37Rv
gccggugccgccgcgg

SEQ ID NO: 1360234 - RNA, 12 nt, Mycobacterium tuberculosis H37Rv
gccggugccacc

SEQ ID NO: 1360235 - RNA, 14 nt, Mycobacterium tuberculosis H37Rv
gccggugccgccgc

SEQ ID NO: 1360236 - RNA, 19 nt, Mycobacterium tuberculosis H37Rv
gccggugccacugccguug

SEQ ID NO: 1360237 - RNA, 18 nt, Mycobacterium tuberculosis H37Rv
gccggugauguccgcaca

SEQ ID NO: 1360238 - RNA, 19 nt, Mycobacterium tuberculosis H37Rv
gccggugaugaucgcgccg

SEQ ID NO: 1360239 - RNA, 14 nt, Mycobacterium tuberculosis H37Rv
gccggugagcgagc

SEQ ID NO: 1360240 - RNA, 14 nt, Mycobacterium tuberculosis H37Rv
gccggucggcgucg

SEQ ID NO: 1360241 - RNA, 13 nt, Mycobacterium tuberculosis H37Rv
gccggucgggcag

SEQ ID NO: 1360242 - RNA, 14 nt, Mycobacterium tuberculosis H37Rv
gccggucgggcaga

SEQ ID NO: 1360243 - RNA, 22 nt, Mycobacterium tuberculosis H37Rv
gccggucgugccggggcugccg

SEQ ID NO: 1360244 - RNA, 17 nt, Mycobacterium tuberculosis H37Rv
gccgguccucgucggcg

SEQ ID NO: 1360245 - RNA, 18 nt, Mycobacterium tuberculosis H37Rv
gccgguacacguccagug

SEQ ID NO: 1360246 - RNA, 16 nt, Mycobacterium tuberculosis H37Rv
gccgguagcacagcag

SEQ ID NO: 1360247 - RNA, 15 nt, Mycobacterium tuberculosis H37Rv
gccgguagcacagca

SEQ ID NO: 1360248 - RNA, 16 nt, Mycobacterium tuberculosis H37Rv
gccgguagcgcgggug

SEQ ID NO: 1360249 - RNA, 20 nt, Mycobacterium tuberculosis H37Rv
gccggguuggccggcgcugc

SEQ ID NO: 1360250 - RNA, 16 nt, Mycobacterium tuberculosis H37Rv
gccggguugguaccca

SEQ ID NO: 1360251 - RNA, 17 nt, Mycobacterium tuberculosis H37Rv
gccgggugggagcagcc

SEQ ID NO: 1360252 - RNA, 19 nt, Mycobacterium tuberculosis H37Rv
gccgguccagacccagcuc

SEQ ID NO: 1360253 - RNA, 14 nt, Mycobacterium tuberculosis H37Rv
gccgguccagaccc

SEQ ID NO: 1360254 - RNA, 16 nt, Mycobacterium tuberculosis H37Rv
gccgguccccgccggc

SEQ ID NO: 1360255 - RNA, 17 nt, Mycobacterium tuberculosis H37Rv
gccgguccagcgccggc

SEQ ID NO: 1360256 - RNA, 18 nt, Mycobacterium tuberculosis H37Rv
gccggucaguauggcgac

SEQ ID NO: 1360257 - RNA, 14 nt, Mycobacterium tuberculosis H37Rv
gccggucaggccgc

SEQ ID NO: 1360258 - RNA, 15 nt, Mycobacterium tuberculosis H37Rv
gccggucaggccgcc

SEQ ID NO: 1360259 - RNA, 14 nt, Mycobacterium tuberculosis H37Rv
gccgguccggggca

SEQ ID NO: 1360260 - RNA, 14 nt, Mycobacterium tuberculosis H37Rv
gccggucgcauggu

SEQ ID NO: 1360261 - RNA, 17 nt, Mycobacterium tuberculosis H37Rv
gccggucgcauggucga

SEQ ID NO: 1360262 - RNA, 15 nt, Mycobacterium tuberculosis H37Rv
gccggucacgacguc

SEQ ID NO: 1360263 - RNA, 19 nt, Mycobacterium tuberculosis H37Rv
gccggucaccucgccggcg

SEQ ID NO: 1360264 - RNA, 15 nt, Mycobacterium tuberculosis H37Rv
gccggucaccucgcc

SEQ ID NO: 1360265 - RNA, 23 nt, Mycobacterium tuberculosis H37Rv
gccgguaggcggccagcgcgcgc

SEQ ID NO: 1360266 - RNA, 21 nt, Mycobacterium tuberculosis H37Rv
gccgggcucgcgaucgucacg

SEQ ID NO: 1360267 - RNA, 17 nt, Mycobacterium tuberculosis H37Rv
gccgggcgucgcuggug

SEQ ID NO: 1360268 - RNA, 13 nt, Mycobacterium tuberculosis H37Rv
gccgggcguccgc

SEQ ID NO: 1360269 - RNA, 19 nt, Mycobacterium tuberculosis H37Rv
gccgggcgcgccggccaug

SEQ ID NO: 1360270 - RNA, 18 nt, Mycobacterium tuberculosis H37Rv
gccgggcgcgcguagccg

SEQ ID NO: 1360271 - RNA, 14 nt, Mycobacterium tuberculosis H37Rv
gccgggcgccgugc

SEQ ID NO: 1360272 - RNA, 21 nt, Mycobacterium tuberculosis H37Rv
gccgggcgccgugccccgggc

SEQ ID NO: 1360273 - RNA, 16 nt, Mycobacterium tuberculosis H37Rv
gccgggcgaugcuggg

SEQ ID NO: 1360274 - RNA, 13 nt, Mycobacterium tuberculosis H37Rv
gccgggcggccgc

SEQ ID NO: 1360275 - RNA, 16 nt, Mycobacterium tuberculosis H37Rv
gccgggcggccgcggc

SEQ ID NO: 1360276 - RNA, 14 nt, Mycobacterium tuberculosis H37Rv
gccgggcggcggug

SEQ ID NO: 1360277 - RNA, 19 nt, Mycobacterium tuberculosis H37Rv
gccgggcggcggugcguca

SEQ ID NO: 1360278 - RNA, 20 nt, Mycobacterium tuberculosis H37Rv
gccgggcacgcgaggcgcuc

SEQ ID NO: 1360279 - RNA, 19 nt, Mycobacterium tuberculosis H37Rv
gccgggcaguuuggcggca

SEQ ID NO: 1360280 - RNA, 22 nt, Mycobacterium tuberculosis H37Rv
gccgggcgaguacaggcgcagc

SEQ ID NO: 1360281 - RNA, 16 nt, Mycobacterium tuberculosis H37Rv
gccgggccggccacgu

SEQ ID NO: 1360282 - RNA, 17 nt, Mycobacterium tuberculosis H37Rv
gccgggccguguccgcc

SEQ ID NO: 1360283 - RNA, 19 nt, Mycobacterium tuberculosis H37Rv
gccgggccauucaccgcgc

SEQ ID NO: 1360284 - RNA, 11 nt, Mycobacterium tuberculosis H37Rv
gccgggcccag

SEQ ID NO: 1360285 - RNA, 13 nt, Mycobacterium tuberculosis H37Rv
gccgggggcaccg

SEQ ID NO: 1360286 - RNA, 16 nt, Mycobacterium tuberculosis H37Rv
gccggggcggaaccug

SEQ ID NO: 1360287 - RNA, 18 nt, Mycobacterium tuberculosis H37Rv
gccggggcggaaccuguc

SEQ ID NO: 1360288 - RNA, 16 nt, Mycobacterium tuberculosis H37Rv
gccggggccgccgaug

SEQ ID NO: 1360289 - RNA, 17 nt, Mycobacterium tuberculosis H37Rv
gccggggcgcagguugg

SEQ ID NO: 1360290 - RNA, 21 nt, Mycobacterium tuberculosis H37Rv
gccggggcgaugucggcuggu

SEQ ID NO: 1360291 - RNA, 13 nt, Mycobacterium tuberculosis H37Rv
gccggggccccau

SEQ ID NO: 1360292 - RNA, 21 nt, Mycobacterium tuberculosis H37Rv
gccggggccccaugccgaccg

SEQ ID NO: 1360293 - RNA, 16 nt, Mycobacterium tuberculosis H37Rv
gccggggacgccgcgg

SEQ ID NO: 1360294 - RNA, 18 nt, Mycobacterium tuberculosis H37Rv
gccggggacgccgcggcg

SEQ ID NO: 1360295 - RNA, 21 nt, Mycobacterium tuberculosis H37Rv
gccgggugccacaacccgcuu

SEQ ID NO: 1360296 - RNA, 21 nt, Mycobacterium tuberculosis H37Rv
gccgggugcgccguugccgcc

SEQ ID NO: 1360297 - RNA, 18 nt, Mycobacterium tuberculosis H37Rv
gccggguccuugcggccg

SEQ ID NO: 1360298 - RNA, 16 nt, Mycobacterium tuberculosis H37Rv
gccggggucggcccgc

SEQ ID NO: 1360299 - RNA, 13 nt, Mycobacterium tuberculosis H37Rv
gccggggugugca

SEQ ID NO: 1360300 - RNA, 15 nt, Mycobacterium tuberculosis H37Rv
gccggggugugcggg

SEQ ID NO: 1360301 - RNA, 16 nt, Mycobacterium tuberculosis H37Rv
gccgggguggcgcgcc

SEQ ID NO: 1360302 - RNA, 14 nt, Mycobacterium tuberculosis H37Rv
gccgggggcgccgc

SEQ ID NO: 1360303 - RNA, 20 nt, Mycobacterium tuberculosis H37Rv
gccgggguacccgguggcac

SEQ ID NO: 1360304 - RNA, 20 nt, Mycobacterium tuberculosis H37Rv
gccgggguagacgccccgga

SEQ ID NO: 1360305 - RNA, 22 nt, Mycobacterium tuberculosis H37Rv
gccgugcccaggccaccggcug

SEQ ID NO: 1360306 - RNA, 17 nt, Mycobacterium tuberculosis H37Rv
gccgugccgaaguggag

SEQ ID NO: 1360307 - RNA, 13 nt, Mycobacterium tuberculosis H37Rv
gccgugccgcaca

SEQ ID NO: 1360308 - RNA, 15 nt, Mycobacterium tuberculosis H37Rv
gccgugccgccagca

SEQ ID NO: 1360309 - RNA, 21 nt, Mycobacterium tuberculosis H37Rv
gccgugccgccgacaccaccg

SEQ ID NO: 1360310 - RNA, 16 nt, Mycobacterium tuberculosis H37Rv
gccgugccguggugaa

SEQ ID NO: 1360311 - RNA, 14 nt, Mycobacterium tuberculosis H37Rv
gccgucucgcggug

SEQ ID NO: 1360312 - RNA, 16 nt, Mycobacterium tuberculosis H37Rv
gccgucucggcaugcu

SEQ ID NO: 1360313 - RNA, 17 nt, Mycobacterium tuberculosis H37Rv
gccgucuagcacacgcu

SEQ ID NO: 1360314 - RNA, 21 nt, Mycobacterium tuberculosis H37Rv
gccgugcaauagcucgggcgc

SEQ ID NO: 1360315 - RNA, 15 nt, Mycobacterium tuberculosis H37Rv
gccgugccgugguga

SEQ ID NO: 1360316 - RNA, 20 nt, Mycobacterium tuberculosis H37Rv
gccgugugugcgauccaggg

SEQ ID NO: 1360317 - RNA, 17 nt, Mycobacterium tuberculosis H37Rv
gccgugugugcggcggu

SEQ ID NO: 1360318 - RNA, 20 nt, Mycobacterium tuberculosis H37Rv
gccguguucagcacccaccg

SEQ ID NO: 1360319 - RNA, 17 nt, Mycobacterium tuberculosis H37Rv
gccguguacgugcucgu

SEQ ID NO: 1360320 - RNA, 22 nt, Mycobacterium tuberculosis H37Rv
gccguggguguugaugggcagc

SEQ ID NO: 1360321 - RNA, 20 nt, Mycobacterium tuberculosis H37Rv
gccguggugaaaugccgaga

SEQ ID NO: 1360322 - RNA, 18 nt, Mycobacterium tuberculosis H37Rv
gccgugccucgaggacgg

SEQ ID NO: 1360323 - RNA, 16 nt, Mycobacterium tuberculosis H37Rv
gccguggccgcacugc

SEQ ID NO: 1360324 - RNA, 14 nt, Mycobacterium tuberculosis H37Rv
gccuaacagccggc

SEQ ID NO: 1360325 - RNA, 23 nt, Mycobacterium tuberculosis H37Rv
gccuaccggccuuuccagcaccc

SEQ ID NO: 1360326 - RNA, 14 nt, Mycobacterium tuberculosis H37Rv
gccuaccaggcgcg

SEQ ID NO: 1360327 - RNA, 18 nt, Mycobacterium tuberculosis H37Rv
gccuaccaggcgcggccc

SEQ ID NO: 1360328 - RNA, 15 nt, Mycobacterium tuberculosis H37Rv
gccguucucgcccac

SEQ ID NO: 1360329 - RNA, 17 nt, Mycobacterium tuberculosis H37Rv
gccguucgcgucgccga

SEQ ID NO: 1360330 - RNA, 19 nt, Mycobacterium tuberculosis H37Rv
gccguugccgccauuggca

SEQ ID NO: 1360331 - RNA, 15 nt, Mycobacterium tuberculosis H37Rv
gccguugccgccauc

SEQ ID NO: 1360332 - RNA, 14 nt, Mycobacterium tuberculosis H37Rv
gccguugccgccag

SEQ ID NO: 1360333 - RNA, 22 nt, Mycobacterium tuberculosis H37Rv
gccguugccgaucagcccggcc

SEQ ID NO: 1360334 - RNA, 16 nt, Mycobacterium tuberculosis H37Rv
gccguugccauugccu

SEQ ID NO: 1360335 - RNA, 20 nt, Mycobacterium tuberculosis H37Rv
gccguugccgccgucgccgc

SEQ ID NO: 1360336 - RNA, 17 nt, Mycobacterium tuberculosis H37Rv
gccguugccgccgacgc

SEQ ID NO: 1360337 - RNA, 17 nt, Mycobacterium tuberculosis H37Rv
gccguugccgccgucgc

SEQ ID NO: 1360338 - RNA, 15 nt, Mycobacterium tuberculosis H37Rv
gccguugccgccggc

SEQ ID NO: 1360339 - RNA, 14 nt, Mycobacterium tuberculosis H37Rv
gccguccagcaaua

SEQ ID NO: 1360340 - RNA, 22 nt, Mycobacterium tuberculosis H37Rv
gccguccaccgauacccccggc

SEQ ID NO: 1360341 - RNA, 21 nt, Mycobacterium tuberculosis H37Rv
gccgucgaaccaguccucggg

SEQ ID NO: 1360342 - RNA, 18 nt, Mycobacterium tuberculosis H37Rv
gccguccaauuccgcaga

SEQ ID NO: 1360343 - RNA, 19 nt, Mycobacterium tuberculosis H37Rv
gccgucauagcaggccucc

SEQ ID NO: 1360344 - RNA, 16 nt, Mycobacterium tuberculosis H37Rv
gccgucagcccaggug

SEQ ID NO: 1360345 - RNA, 17 nt, Mycobacterium tuberculosis H37Rv
gccgucauagcaggccu

SEQ ID NO: 1360346 - RNA, 14 nt, Mycobacterium tuberculosis H37Rv
gccgucagccaggu

SEQ ID NO: 1360347 - RNA, 19 nt, Mycobacterium tuberculosis H37Rv
gccguaggcggcgacccgc

SEQ ID NO: 1360348 - RNA, 18 nt, Mycobacterium tuberculosis H37Rv
gccgucgauguggcgcuc

SEQ ID NO: 1360349 - RNA, 19 nt, Mycobacterium tuberculosis H37Rv
gccgucgauguugccgaga

SEQ ID NO: 1360350 - RNA, 19 nt, Mycobacterium tuberculosis H37Rv
gccgucggguccgcggccc

SEQ ID NO: 1360351 - RNA, 18 nt, Mycobacterium tuberculosis H37Rv
gccgucggugccgccgcc

SEQ ID NO: 1360352 - RNA, 16 nt, Mycobacterium tuberculosis H37Rv
gccgucgccaccggua

SEQ ID NO: 1360353 - RNA, 14 nt, Mycobacterium tuberculosis H37Rv
gccgucgcccagcg

SEQ ID NO: 1360354 - RNA, 17 nt, Mycobacterium tuberculosis H37Rv
gccgucggugccgcgga

SEQ ID NO: 1360355 - RNA, 21 nt, Mycobacterium tuberculosis H37Rv
gccgucggugccgccgccggc

SEQ ID NO: 1360356 - RNA, 23 nt, Mycobacterium tuberculosis H37Rv
gccgucggugggugccagccggu

SEQ ID NO: 1360357 - RNA, 20 nt, Mycobacterium tuberculosis H37Rv
gccgucguccgcugacccgc

SEQ ID NO: 1360358 - RNA, 20 nt, Mycobacterium tuberculosis H37Rv
gccgucgucgagccggaaca

SEQ ID NO: 1360359 - RNA, 23 nt, Mycobacterium tuberculosis H37Rv
gccgucguacucgaccgcgagca

SEQ ID NO: 1360360 - RNA, 17 nt, Mycobacterium tuberculosis H37Rv
gccgucgagcacgguga

SEQ ID NO: 1360361 - RNA, 18 nt, Mycobacterium tuberculosis H37Rv
gccgucgagcacggugag

SEQ ID NO: 1360362 - RNA, 20 nt, Mycobacterium tuberculosis H37Rv
gccgucgaucccggucggug

SEQ ID NO: 1360363 - RNA, 16 nt, Mycobacterium tuberculosis H37Rv
gccgucgacgcggccg

SEQ ID NO: 1360364 - RNA, 18 nt, Mycobacterium tuberculosis H37Rv
gccgucgacgcggccggc

SEQ ID NO: 1360365 - RNA, 19 nt, Mycobacterium tuberculosis H37Rv
gccgucgacgucgauggug

SEQ ID NO: 1360366 - RNA, 12 nt, Mycobacterium tuberculosis H37Rv
gccgucgagcaa

SEQ ID NO: 1360367 - RNA, 16 nt, Mycobacterium tuberculosis H37Rv
gccgucgacgcauggg

SEQ ID NO: 1360368 - RNA, 23 nt, Mycobacterium tuberculosis H37Rv
gccgguuugucgugucaugcuca

SEQ ID NO: 1360369 - RNA, 18 nt, Mycobacterium tuberculosis H37Rv
gccgguuugggggcuucu

SEQ ID NO: 1360370 - RNA, 17 nt, Mycobacterium tuberculosis H37Rv
gccgguugucgcagcgc

SEQ ID NO: 1360371 - RNA, 19 nt, Mycobacterium tuberculosis H37Rv
gccgguguuagugaggccc

SEQ ID NO: 1360372 - RNA, 21 nt, Mycobacterium tuberculosis H37Rv
gccgguguuagugaggcccga

SEQ ID NO: 1360373 - RNA, 16 nt, Mycobacterium tuberculosis H37Rv
gccgguucgcccagca

SEQ ID NO: 1360374 - RNA, 16 nt, Mycobacterium tuberculosis H37Rv
gccgguucgcccgagg

SEQ ID NO: 1360375 - RNA, 15 nt, Mycobacterium tuberculosis H37Rv
gccgguuccgccggc

SEQ ID NO: 1360376 - RNA, 21 nt, Mycobacterium tuberculosis H37Rv
gccgguuccucagcggcccgc

SEQ ID NO: 1360377 - RNA, 16 nt, Mycobacterium tuberculosis H37Rv
gccgguugcggcugcg

SEQ ID NO: 1360378 - RNA, 17 nt, Mycobacterium tuberculosis H37Rv
gccgguuggccagccac

SEQ ID NO: 1360379 - RNA, 14 nt, Mycobacterium tuberculosis H37Rv
gccgguuggccagu

SEQ ID NO: 1360380 - RNA, 18 nt, Mycobacterium tuberculosis H37Rv
gccggugucucccuugcc

SEQ ID NO: 1360381 - RNA, 21 nt, Mycobacterium tuberculosis H37Rv
gccggugucucccuugccgcc

SEQ ID NO: 1360382 - RNA, 15 nt, Mycobacterium tuberculosis H37Rv
gccggugucgggcug

SEQ ID NO: 1360383 - RNA, 16 nt, Mycobacterium tuberculosis H37Rv
gccggugucggcuggu

SEQ ID NO: 1360384 - RNA, 20 nt, Mycobacterium tuberculosis H37Rv
gccgguggugccggcgccgc

SEQ ID NO: 1360385 - RNA, 17 nt, Mycobacterium tuberculosis H37Rv
gccgguggugggcggga

SEQ ID NO: 1360386 - RNA, 19 nt, Mycobacterium tuberculosis H37Rv
gccguagaccaggcccagg

SEQ ID NO: 1360387 - RNA, 15 nt, Mycobacterium tuberculosis H37Rv
gccguagagccgcuc

SEQ ID NO: 1360388 - RNA, 19 nt, Mycobacterium tuberculosis H37Rv
gccguagagccgcucggcg

SEQ ID NO: 1360389 - RNA, 11 nt, Mycobacterium tuberculosis H37Rv
gccguagaaau

SEQ ID NO: 1360390 - RNA, 15 nt, Mycobacterium tuberculosis H37Rv
gccguagcgcagcgc

SEQ ID NO: 1360391 - RNA, 15 nt, Mycobacterium tuberculosis H37Rv
gccguagaccagcag

SEQ ID NO: 1360392 - RNA, 15 nt, Mycobacterium tuberculosis H37Rv
gccguaacagccggc

SEQ ID NO: 1360393 - RNA, 21 nt, Mycobacterium tuberculosis H37Rv
gccguacagcgcaaagcccuc

SEQ ID NO: 1360394 - RNA, 19 nt, Mycobacterium tuberculosis H37Rv
gccguaagcaccagccagc

SEQ ID NO: 1360395 - RNA, 14 nt, Mycobacterium tuberculosis H37Rv
gccguacaacagcg

SEQ ID NO: 1360396 - RNA, 17 nt, Mycobacterium tuberculosis H37Rv
gccguacaacagcgcgc

SEQ ID NO: 1360397 - RNA, 20 nt, Mycobacterium tuberculosis H37Rv
gccguacaacagcgcgcgcu

SEQ ID NO: 1360398 - RNA, 17 nt, Mycobacterium tuberculosis H37Rv
gccggcggggugcgccc

SEQ ID NO: 1360399 - RNA, 18 nt, Mycobacterium tuberculosis H37Rv
gccggcgggcucgcccgc

SEQ ID NO: 1360400 - RNA, 18 nt, Mycobacterium tuberculosis H37Rv
gccggcggcuggucucug

SEQ ID NO: 1360401 - RNA, 16 nt, Mycobacterium tuberculosis H37Rv
gccggcgggcucgccc

SEQ ID NO: 1360402 - RNA, 15 nt, Mycobacterium tuberculosis H37Rv
gccggcggcggcgcu

SEQ ID NO: 1360403 - RNA, 13 nt, Mycobacterium tuberculosis H37Rv
gccggcggcggcc

SEQ ID NO: 1360404 - RNA, 15 nt, Mycobacterium tuberculosis H37Rv
gccggcggcggccgc

SEQ ID NO: 1360405 - RNA, 16 nt, Mycobacterium tuberculosis H37Rv
gccggcgggccugccc

SEQ ID NO: 1360406 - RNA, 23 nt, Mycobacterium tuberculosis H37Rv
gccggcgggcgagugucagcaga

SEQ ID NO: 1360407 - RNA, 22 nt, Mycobacterium tuberculosis H37Rv
gccggcggcggugguaccggcg

SEQ ID NO: 1360408 - RNA, 16 nt, Mycobacterium tuberculosis H37Rv
gccggcgucggcgccc

SEQ ID NO: 1360409 - RNA, 17 nt, Mycobacterium tuberculosis H37Rv
gccggcgucgacccugc

SEQ ID NO: 1360410 - RNA, 21 nt, Mycobacterium tuberculosis H37Rv
gccggcgucagccccgacugc

SEQ ID NO: 1360411 - RNA, 22 nt, Mycobacterium tuberculosis H37Rv
gccggcguagaucaucagcgac

SEQ ID NO: 1360412 - RNA, 21 nt, Mycobacterium tuberculosis H37Rv
gccggcgguguuggcgccagc

SEQ ID NO: 1360413 - RNA, 15 nt, Mycobacterium tuberculosis H37Rv
gccggcggucgccag

SEQ ID NO: 1360414 - RNA, 20 nt, Mycobacterium tuberculosis H37Rv
gccggcgguagucggccagc

SEQ ID NO: 1360415 - RNA, 21 nt, Mycobacterium tuberculosis H37Rv
gccggcggucccaugugcccg

SEQ ID NO: 1360416 - RNA, 22 nt, Mycobacterium tuberculosis H37Rv
gccggcggucccaugugcccgc

SEQ ID NO: 1360417 - RNA, 20 nt, Mycobacterium tuberculosis H37Rv
gccggcggccuugcgggcuc

SEQ ID NO: 1360418 - RNA, 15 nt, Mycobacterium tuberculosis H37Rv
gccggcggccaccuc

SEQ ID NO: 1360419 - RNA, 18 nt, Mycobacterium tuberculosis H37Rv
gccggcggccgcccagau

SEQ ID NO: 1360420 - RNA, 12 nt, Mycobacterium tuberculosis H37Rv
gccggcgcuggc

SEQ ID NO: 1360421 - RNA, 21 nt, Mycobacterium tuberculosis H37Rv
gccggcggacgcccggcgcac

SEQ ID NO: 1360422 - RNA, 17 nt, Mycobacterium tuberculosis H37Rv
gccggcgcugccaaacu

SEQ ID NO: 1360423 - RNA, 16 nt, Mycobacterium tuberculosis H37Rv
gccggcugcggaggcg

SEQ ID NO: 1360424 - RNA, 16 nt, Mycobacterium tuberculosis H37Rv
gccggcuccgccguug

SEQ ID NO: 1360425 - RNA, 21 nt, Mycobacterium tuberculosis H37Rv
gccggcuccgccacuggcgcc

SEQ ID NO: 1360426 - RNA, 18 nt, Mycobacterium tuberculosis H37Rv
gccggcucaucgcagccg

SEQ ID NO: 1360427 - RNA, 19 nt, Mycobacterium tuberculosis H37Rv
gccggcucaucgcagccgg

SEQ ID NO: 1360428 - RNA, 19 nt, Mycobacterium tuberculosis H37Rv
gccggcgugcacucccuua

SEQ ID NO: 1360429 - RNA, 23 nt, Mycobacterium tuberculosis H37Rv
gccggcguuagcguagcccgagu

SEQ ID NO: 1360430 - RNA, 16 nt, Mycobacterium tuberculosis H37Rv
gccggcguugccgccg

SEQ ID NO: 1360431 - RNA, 22 nt, Mycobacterium tuberculosis H37Rv
gccggcuagggcccuggcggcc

SEQ ID NO: 1360432 - RNA, 23 nt, Mycobacterium tuberculosis H37Rv
gccggcuagauaacccaaccgcg

SEQ ID NO: 1360433 - RNA, 18 nt, Mycobacterium tuberculosis H37Rv
gccggcuaccgcgcuccc

SEQ ID NO: 1360434 - RNA, 20 nt, Mycobacterium tuberculosis H37Rv
gccggcguugccgccguucc

SEQ ID NO: 1360435 - RNA, 17 nt, Mycobacterium tuberculosis H37Rv
gccggcguugccgccgu

SEQ ID NO: 1360436 - RNA, 17 nt, Mycobacterium tuberculosis H37Rv
gccggcuucgcccagag

SEQ ID NO: 1360437 - RNA, 16 nt, Mycobacterium tuberculosis H37Rv
gccggcuucggcgagc

SEQ ID NO: 1360438 - RNA, 20 nt, Mycobacterium tuberculosis H37Rv
gccgggaaacaccggcuugg

SEQ ID NO: 1360439 - RNA, 12 nt, Mycobacterium tuberculosis H37Rv
gccgggaagccg

SEQ ID NO: 1360440 - RNA, 16 nt, Mycobacterium tuberculosis H37Rv
gccggcuugggcggua

SEQ ID NO: 1360441 - RNA, 15 nt, Mycobacterium tuberculosis H37Rv
gccggcuuugagccg

SEQ ID NO: 1360442 - RNA, 13 nt, Mycobacterium tuberculosis H37Rv
gccgggcaccacc

SEQ ID NO: 1360443 - RNA, 19 nt, Mycobacterium tuberculosis H37Rv
gccgggcaaccagcagcag

SEQ ID NO: 1360444 - RNA, 16 nt, Mycobacterium tuberculosis H37Rv
gccgggauaacccagc

SEQ ID NO: 1360445 - RNA, 22 nt, Mycobacterium tuberculosis H37Rv
gccgggauaacccagcaccaca

SEQ ID NO: 1360446 - RNA, 17 nt, Mycobacterium tuberculosis H37Rv
gccgggaccgccccggc

SEQ ID NO: 1360447 - RNA, 19 nt, Mycobacterium tuberculosis H37Rv
gccggcgaaccccagcgca

SEQ ID NO: 1360448 - RNA, 14 nt, Mycobacterium tuberculosis H37Rv
gccggccgggugua

SEQ ID NO: 1360449 - RNA, 16 nt, Mycobacterium tuberculosis H37Rv
gccggccuagccgaug

SEQ ID NO: 1360450 - RNA, 21 nt, Mycobacterium tuberculosis H37Rv
gccggccuagccgauggcuac

SEQ ID NO: 1360451 - RNA, 20 nt, Mycobacterium tuberculosis H37Rv
gccggccgcuuggccgcugc

SEQ ID NO: 1360452 - RNA, 14 nt, Mycobacterium tuberculosis H37Rv
gccggccgcgggcg

SEQ ID NO: 1360453 - RNA, 14 nt, Mycobacterium tuberculosis H37Rv
gccggccgcggggc

SEQ ID NO: 1360454 - RNA, 13 nt, Mycobacterium tuberculosis H37Rv
gccggccgcgggc

SEQ ID NO: 1360455 - RNA, 14 nt, Mycobacterium tuberculosis H37Rv
gccggccgcgcaga

SEQ ID NO: 1360456 - RNA, 15 nt, Mycobacterium tuberculosis H37Rv
gccggccgcgcuggu

SEQ ID NO: 1360457 - RNA, 12 nt, Mycobacterium tuberculosis H37Rv
gccggccgcggg

SEQ ID NO: 1360458 - RNA, 15 nt, Mycobacterium tuberculosis H37Rv
gccggccgcgccggc

SEQ ID NO: 1360459 - RNA, 14 nt, Mycobacterium tuberculosis H37Rv
gccggccgcgaccg

SEQ ID NO: 1360460 - RNA, 14 nt, Mycobacterium tuberculosis H37Rv
gccggccgccgcgg

SEQ ID NO: 1360461 - RNA, 17 nt, Mycobacterium tuberculosis H37Rv
gccggccgccagccggu

SEQ ID NO: 1360462 - RNA, 17 nt, Mycobacterium tuberculosis H37Rv
gccggccgaucggccgg

SEQ ID NO: 1360463 - RNA, 23 nt, Mycobacterium tuberculosis H37Rv
gccggccgagcgcacuggggagg

SEQ ID NO: 1360464 - RNA, 19 nt, Mycobacterium tuberculosis H37Rv
gccggcccugcggccaaug

SEQ ID NO: 1360465 - RNA, 18 nt, Mycobacterium tuberculosis H37Rv
gccggcccugcucgccgu

SEQ ID NO: 1360466 - RNA, 22 nt, Mycobacterium tuberculosis H37Rv
gccggcccugcucgccgucucg

SEQ ID NO: 1360467 - RNA, 15 nt, Mycobacterium tuberculosis H37Rv
gccggcccgcgggcg

SEQ ID NO: 1360468 - RNA, 22 nt, Mycobacterium tuberculosis H37Rv
gccggccccgccgaugccgccg

SEQ ID NO: 1360469 - RNA, 18 nt, Mycobacterium tuberculosis H37Rv
gccggcgcgcaccccggc

SEQ ID NO: 1360470 - RNA, 16 nt, Mycobacterium tuberculosis H37Rv
gccggcgcgccgggcg

SEQ ID NO: 1360471 - RNA, 12 nt, Mycobacterium tuberculosis H37Rv
gccggcgcggcg

SEQ ID NO: 1360472 - RNA, 16 nt, Mycobacterium tuberculosis H37Rv
gccggcgccgccggug

SEQ ID NO: 1360473 - RNA, 14 nt, Mycobacterium tuberculosis H37Rv
gccggcgccgccgu

SEQ ID NO: 1360474 - RNA, 14 nt, Mycobacterium tuberculosis H37Rv
gccggcgccggccc

SEQ ID NO: 1360475 - RNA, 19 nt, Mycobacterium tuberculosis H37Rv
gccggcgccggcgcugcug

SEQ ID NO: 1360476 - RNA, 17 nt, Mycobacterium tuberculosis H37Rv
gccggcgccggcgcguc

SEQ ID NO: 1360477 - RNA, 17 nt, Mycobacterium tuberculosis H37Rv
gccggcgccgcccgcgc

SEQ ID NO: 1360478 - RNA, 15 nt, Mycobacterium tuberculosis H37Rv
gccggcgccgccagc

SEQ ID NO: 1360479 - RNA, 18 nt, Mycobacterium tuberculosis H37Rv
gccggcgccgccagcacc

SEQ ID NO: 1360480 - RNA, 12 nt, Mycobacterium tuberculosis H37Rv
gccggcgccgcc

SEQ ID NO: 1360481 - RNA, 14 nt, Mycobacterium tuberculosis H37Rv
gccggcgcccccgu

SEQ ID NO: 1360482 - RNA, 12 nt, Mycobacterium tuberculosis H37Rv
gccggcgcccgc

SEQ ID NO: 1360483 - RNA, 15 nt, Mycobacterium tuberculosis H37Rv
gccggcgcccgccgc

SEQ ID NO: 1360484 - RNA, 13 nt, Mycobacterium tuberculosis H37Rv
gccggcgccaagu

SEQ ID NO: 1360485 - RNA, 16 nt, Mycobacterium tuberculosis H37Rv
gccggcgagggugagc

SEQ ID NO: 1360486 - RNA, 16 nt, Mycobacterium tuberculosis H37Rv
gccggcgagggccacg

SEQ ID NO: 1360487 - RNA, 14 nt, Mycobacterium tuberculosis H37Rv
gccggcgagggcca

SEQ ID NO: 1360488 - RNA, 15 nt, Mycobacterium tuberculosis H37Rv
gccggcgagggccac

SEQ ID NO: 1360489 - RNA, 20 nt, Mycobacterium tuberculosis H37Rv
gccggcgaagugcuccaccu

SEQ ID NO: 1360490 - RNA, 21 nt, Mycobacterium tuberculosis H37Rv
gccggcgaagugcuccaccuc

SEQ ID NO: 1360491 - RNA, 13 nt, Mycobacterium tuberculosis H37Rv
gccggccccgccg

SEQ ID NO: 1360492 - RNA, 14 nt, Mycobacterium tuberculosis H37Rv
gccggccccgccgg

SEQ ID NO: 1360493 - RNA, 15 nt, Mycobacterium tuberculosis H37Rv
gccggccccgccggc

SEQ ID NO: 1360494 - RNA, 16 nt, Mycobacterium tuberculosis H37Rv
gccggccccgccggcg

SEQ ID NO: 1360495 - RNA, 17 nt, Mycobacterium tuberculosis H37Rv
gccggcccaccaggccc

SEQ ID NO: 1360496 - RNA, 22 nt, Mycobacterium tuberculosis H37Rv
gccggcccaccaggcccaucuc

SEQ ID NO: 1360497 - RNA, 22 nt, Mycobacterium tuberculosis H37Rv
gccggccccaccggugccgccg

SEQ ID NO: 1360498 - RNA, 21 nt, Mycobacterium tuberculosis H37Rv
gccggccauaccgcucgccgu

SEQ ID NO: 1360499 - RNA, 16 nt, Mycobacterium tuberculosis H37Rv
gccggcauagcggccc

SEQ ID NO: 1360500 - RNA, 15 nt, Mycobacterium tuberculosis H37Rv
gccggcaugccagcc

SEQ ID NO: 1360501 - RNA, 14 nt, Mycobacterium tuberculosis H37Rv
gccggcaugccagc

SEQ ID NO: 1360502 - RNA, 15 nt, Mycobacterium tuberculosis H37Rv
gccggccacccgcgc

SEQ ID NO: 1360503 - RNA, 17 nt, Mycobacterium tuberculosis H37Rv
gccggccaccucggugc

SEQ ID NO: 1360504 - RNA, 20 nt, Mycobacterium tuberculosis H37Rv
gccggccaccaccgcgccgu

SEQ ID NO: 1360505 - RNA, 17 nt, Mycobacterium tuberculosis H37Rv
gccggccaccaccgcgc

SEQ ID NO: 1360506 - RNA, 13 nt, Mycobacterium tuberculosis H37Rv
gccggccaacuuc

SEQ ID NO: 1360507 - RNA, 20 nt, Mycobacterium tuberculosis H37Rv
gccggccaagaccgcggccc

SEQ ID NO: 1360508 - RNA, 19 nt, Mycobacterium tuberculosis H37Rv
gccggccaacugggccgag

SEQ ID NO: 1360509 - RNA, 15 nt, Mycobacterium tuberculosis H37Rv
gccggccaacugggc

SEQ ID NO: 1360510 - RNA, 15 nt, Mycobacterium tuberculosis H37Rv
gccggcauggcggca

SEQ ID NO: 1360511 - RNA, 14 nt, Mycobacterium tuberculosis H37Rv
gccggcagugaguc

SEQ ID NO: 1360512 - RNA, 16 nt, Mycobacterium tuberculosis H37Rv
gccggcaacaucgagc

SEQ ID NO: 1360513 - RNA, 13 nt, Mycobacterium tuberculosis H37Rv
gccggcagugagu

SEQ ID NO: 1360514 - RNA, 15 nt, Mycobacterium tuberculosis H37Rv
gccggcagcgccccc

SEQ ID NO: 1360515 - RNA, 18 nt, Mycobacterium tuberculosis H37Rv
gccggcagcggcgcgcug

SEQ ID NO: 1360516 - RNA, 16 nt, Mycobacterium tuberculosis H37Rv
gccggcagcagcgggc

SEQ ID NO: 1360517 - RNA, 13 nt, Mycobacterium tuberculosis H37Rv
gccggcagcagcg

SEQ ID NO: 1360518 - RNA, 14 nt, Mycobacterium tuberculosis H37Rv
gccggcagcgcccc

SEQ ID NO: 1360519 - RNA, 15 nt, Mycobacterium tuberculosis H37Rv
gccggcaccgccgcc

SEQ ID NO: 1360520 - RNA, 20 nt, Mycobacterium tuberculosis H37Rv
gccggcacccgucgggugcu

SEQ ID NO: 1360521 - RNA, 21 nt, Mycobacterium tuberculosis H37Rv
gccggcaccgccagugcccgc

SEQ ID NO: 1360522 - RNA, 17 nt, Mycobacterium tuberculosis H37Rv
gccggcacccaccagug

SEQ ID NO: 1360523 - RNA, 16 nt, Mycobacterium tuberculosis H37Rv
gccggcaccccacggc

SEQ ID NO: 1360524 - RNA, 16 nt, Mycobacterium tuberculosis H37Rv
gccggcaccuccggca

SEQ ID NO: 1360525 - RNA, 16 nt, Mycobacterium tuberculosis H37Rv
gccggcaccgccggcg

SEQ ID NO: 1360526 - RNA, 20 nt, Mycobacterium tuberculosis H37Rv
gccggcaccgccggcgccgc

SEQ ID NO: 1360527 - RNA, 16 nt, Mycobacterium tuberculosis H37Rv
gccggauucggcugcc

SEQ ID NO: 1360528 - RNA, 20 nt, Mycobacterium tuberculosis H37Rv
gccggauucggcugccaccg

SEQ ID NO: 1360529 - RNA, 20 nt, Mycobacterium tuberculosis H37Rv
gccggauucuccgcccucag

SEQ ID NO: 1360530 - RNA, 21 nt, Mycobacterium tuberculosis H37Rv
gccggaugucgacgagcaccg

SEQ ID NO: 1360531 - RNA, 16 nt, Mycobacterium tuberculosis H37Rv
gccggcaacggcgcgc

SEQ ID NO: 1360532 - RNA, 17 nt, Mycobacterium tuberculosis H37Rv
gccggcaacgugcggug

SEQ ID NO: 1360533 - RNA, 12 nt, Mycobacterium tuberculosis H37Rv
gccggcaacagc

SEQ ID NO: 1360534 - RNA, 21 nt, Mycobacterium tuberculosis H37Rv
gccggcaauaccgccagcgcc

SEQ ID NO: 1360535 - RNA, 20 nt, Mycobacterium tuberculosis H37Rv
gccggcaauaccgccagcgc

SEQ ID NO: 1360536 - RNA, 22 nt, Mycobacterium tuberculosis H37Rv
gccggcaaccgggaggccaccg

SEQ ID NO: 1360537 - RNA, 13 nt, Mycobacterium tuberculosis H37Rv
gccggcaagcagu

SEQ ID NO: 1360538 - RNA, 21 nt, Mycobacterium tuberculosis H37Rv
gccggcacacccaucagcccu

SEQ ID NO: 1360539 - RNA, 22 nt, Mycobacterium tuberculosis H37Rv
gccggcacacccaucagcccuc

SEQ ID NO: 1360540 - RNA, 22 nt, Mycobacterium tuberculosis H37Rv
gccgcggagaaggcgcgggcga

SEQ ID NO: 1360541 - RNA, 18 nt, Mycobacterium tuberculosis H37Rv
gccgcggaggcggccagc

SEQ ID NO: 1360542 - RNA, 17 nt, Mycobacterium tuberculosis H37Rv
gccgcggaguaggccgc

SEQ ID NO: 1360543 - RNA, 18 nt, Mycobacterium tuberculosis H37Rv
gccgcggccaccgccgcc

SEQ ID NO: 1360544 - RNA, 14 nt, Mycobacterium tuberculosis H37Rv
gccgcggccaccac

SEQ ID NO: 1360545 - RNA, 21 nt, Mycobacterium tuberculosis H37Rv
gccggacuaccgccggcggcg

SEQ ID NO: 1360546 - RNA, 16 nt, Mycobacterium tuberculosis H37Rv
gccggacgggugcggg

SEQ ID NO: 1360547 - RNA, 20 nt, Mycobacterium tuberculosis H37Rv
gccggaccgcgacggcgccg

SEQ ID NO: 1360548 - RNA, 13 nt, Mycobacterium tuberculosis H37Rv
gccggacccgccg

SEQ ID NO: 1360549 - RNA, 16 nt, Mycobacterium tuberculosis H37Rv
gccggacaaccugggg

SEQ ID NO: 1360550 - RNA, 19 nt, Mycobacterium tuberculosis H37Rv
gccggacaaccuggggcca

SEQ ID NO: 1360551 - RNA, 17 nt, Mycobacterium tuberculosis H37Rv
gccggaccagcuccugc

SEQ ID NO: 1360552 - RNA, 20 nt, Mycobacterium tuberculosis H37Rv
gccggacagcucgcgcucgc

SEQ ID NO: 1360553 - RNA, 18 nt, Mycobacterium tuberculosis H37Rv
gccggacuaccgccggcg

SEQ ID NO: 1360554 - RNA, 18 nt, Mycobacterium tuberculosis H37Rv
gccggacugaagccgcga

SEQ ID NO: 1360555 - RNA, 15 nt, Mycobacterium tuberculosis H37Rv
gccggagccgccggc

SEQ ID NO: 1360556 - RNA, 14 nt, Mycobacterium tuberculosis H37Rv
gccggagaguagga

SEQ ID NO: 1360557 - RNA, 21 nt, Mycobacterium tuberculosis H37Rv
gccggagccgccggccccgcc

SEQ ID NO: 1360558 - RNA, 19 nt, Mycobacterium tuberculosis H37Rv
gccggagucggggggccgg

SEQ ID NO: 1360559 - RNA, 18 nt, Mycobacterium tuberculosis H37Rv
gccggaggucgggcggcg

SEQ ID NO: 1360560 - RNA, 18 nt, Mycobacterium tuberculosis H37Rv
gccggaguugaagaagcc

SEQ ID NO: 1360561 - RNA, 20 nt, Mycobacterium tuberculosis H37Rv
gccggaggaucgcugguugg

SEQ ID NO: 1360562 - RNA, 17 nt, Mycobacterium tuberculosis H37Rv
gccggauagcaccggca

SEQ ID NO: 1360563 - RNA, 13 nt, Mycobacterium tuberculosis H37Rv
gccggaucccagu

SEQ ID NO: 1360564 - RNA, 22 nt, Mycobacterium tuberculosis H37Rv
gccggaucccugugccagcagc

SEQ ID NO: 1360565 - RNA, 18 nt, Mycobacterium tuberculosis H37Rv
gccggaucgaaacucagc

SEQ ID NO: 1360566 - RNA, 13 nt, Mycobacterium tuberculosis H37Rv
gccggaugcggcc

SEQ ID NO: 1360567 - RNA, 21 nt, Mycobacterium tuberculosis H37Rv
gcgacacucacgggugcuggc

SEQ ID NO: 1360568 - RNA, 20 nt, Mycobacterium tuberculosis H37Rv
gcgacagacagcaccgccgg

SEQ ID NO: 1360569 - RNA, 24 nt, Mycobacterium tuberculosis H37Rv
gcgacagacagcaccgccggugcg

SEQ ID NO: 1360570 - RNA, 12 nt, Mycobacterium tuberculosis H37Rv
gcgacacgccag

SEQ ID NO: 1360571 - RNA, 21 nt, Mycobacterium tuberculosis H37Rv
gcgacaccggaaacggucagg

SEQ ID NO: 1360572 - RNA, 18 nt, Mycobacterium tuberculosis H37Rv
gcgacacauagugcggca

SEQ ID NO: 1360573 - RNA, 21 nt, Mycobacterium tuberculosis H37Rv
gcgacacauagugcggcaccg

SEQ ID NO: 1360574 - RNA, 19 nt, Mycobacterium tuberculosis H37Rv
gcgacaauggugcccagga

SEQ ID NO: 1360575 - RNA, 23 nt, Mycobacterium tuberculosis H37Rv
gcgacacccugggugccggcagc

SEQ ID NO: 1360576 - RNA, 16 nt, Mycobacterium tuberculosis H37Rv
gcgacaccacgaaucc

SEQ ID NO: 1360577 - RNA, 12 nt, Mycobacterium tuberculosis H37Rv
gcgacagcagcg

SEQ ID NO: 1360578 - RNA, 21 nt, Mycobacterium tuberculosis H37Rv
gcgacagcggcgacaugaucu

SEQ ID NO: 1360579 - RNA, 14 nt, Mycobacterium tuberculosis H37Rv
gcgacagcggcguc

SEQ ID NO: 1360580 - RNA, 15 nt, Mycobacterium tuberculosis H37Rv
gcgacagcgcggcgg

SEQ ID NO: 1360581 - RNA, 13 nt, Mycobacterium tuberculosis H37Rv
gcgacagcgcggc

SEQ ID NO: 1360582 - RNA, 18 nt, Mycobacterium tuberculosis H37Rv
gcgacagcgcugggccca

SEQ ID NO: 1360583 - RNA, 18 nt, Mycobacterium tuberculosis H37Rv
gcgacaggccgagcagau

SEQ ID NO: 1360584 - RNA, 22 nt, Mycobacterium tuberculosis H37Rv
gcgacauccacaccgcggcggc

SEQ ID NO: 1360585 - RNA, 22 nt, Mycobacterium tuberculosis H37Rv
gcgaaugaucuugccacuccag

SEQ ID NO: 1360586 - RNA, 23 nt, Mycobacterium tuberculosis H37Rv
gcgaauccggcgggugccgagcu

SEQ ID NO: 1360587 - RNA, 19 nt, Mycobacterium tuberculosis H37Rv
gcgaaucaacaggaccggg

SEQ ID NO: 1360588 - RNA, 13 nt, Mycobacterium tuberculosis H37Rv
gcgaauagccacc

SEQ ID NO: 1360589 - RNA, 22 nt, Mycobacterium tuberculosis H37Rv
gcgaauacgaggacgacgauca

SEQ ID NO: 1360590 - RNA, 23 nt, Mycobacterium tuberculosis H37Rv
gcgaauccagccgcgcgccggcc

SEQ ID NO: 1360591 - RNA, 22 nt, Mycobacterium tuberculosis H37Rv
gcgaaacaccggccagcggccc

SEQ ID NO: 1360592 - RNA, 20 nt, Mycobacterium tuberculosis H37Rv
gcgaaacaucucggcgcagc

SEQ ID NO: 1360593 - RNA, 20 nt, Mycobacterium tuberculosis H37Rv
gcgaaacaccggccagcggc

SEQ ID NO: 1360594 - RNA, 18 nt, Mycobacterium tuberculosis H37Rv
gcgaaaauugcuccacca

SEQ ID NO: 1360595 - RNA, 13 nt, Mycobacterium tuberculosis H37Rv
gcgaccaugcucc

SEQ ID NO: 1360596 - RNA, 18 nt, Mycobacterium tuberculosis H37Rv
gcgaccaucugaucgggc

SEQ ID NO: 1360597 - RNA, 21 nt, Mycobacterium tuberculosis H37Rv
gcgaccaucugaucgggcccg

SEQ ID NO: 1360598 - RNA, 15 nt, Mycobacterium tuberculosis H37Rv
gcgaccagccgagcg

SEQ ID NO: 1360599 - RNA, 20 nt, Mycobacterium tuberculosis H37Rv
gcgacccgucccccgcacgc

SEQ ID NO: 1360600 - RNA, 21 nt, Mycobacterium tuberculosis H37Rv
gcgaccccaggcgcucaucac

SEQ ID NO: 1360601 - RNA, 16 nt, Mycobacterium tuberculosis H37Rv
gcgaccccgccgagcg

SEQ ID NO: 1360602 - RNA, 15 nt, Mycobacterium tuberculosis H37Rv
gcgaccccggcugcg

SEQ ID NO: 1360603 - RNA, 22 nt, Mycobacterium tuberculosis H37Rv
gcgaccauacccgcgcgcacca

SEQ ID NO: 1360604 - RNA, 20 nt, Mycobacterium tuberculosis H37Rv
gcgaccaacacgguacugug

SEQ ID NO: 1360605 - RNA, 21 nt, Mycobacterium tuberculosis H37Rv
gcgaccaacacgucgagcagc

SEQ ID NO: 1360606 - RNA, 22 nt, Mycobacterium tuberculosis H37Rv
gcgaccacaucaugccagccgu

SEQ ID NO: 1360607 - RNA, 18 nt, Mycobacterium tuberculosis H37Rv
gcgacaugaucugccacc

SEQ ID NO: 1360608 - RNA, 23 nt, Mycobacterium tuberculosis H37Rv
gcgacaugucgaacgccccccac

SEQ ID NO: 1360609 - RNA, 14 nt, Mycobacterium tuberculosis H37Rv
gcgaccaccagcgc

SEQ ID NO: 1360610 - RNA, 19 nt, Mycobacterium tuberculosis H37Rv
gcgaccaccgcgucgggcc

SEQ ID NO: 1360611 - RNA, 20 nt, Mycobacterium tuberculosis H37Rv
gcgaccaccguuugagcggc

SEQ ID NO: 1360612 - RNA, 18 nt, Mycobacterium tuberculosis H37Rv
gcgaccacgccgccggcg

SEQ ID NO: 1360613 - RNA, 15 nt, Mycobacterium tuberculosis H37Rv
gcgacgaaccgccag

SEQ ID NO: 1360614 - RNA, 22 nt, Mycobacterium tuberculosis H37Rv
gcgaccucggguugcagcagca

SEQ ID NO: 1360615 - RNA, 19 nt, Mycobacterium tuberculosis H37Rv
gcgacgacccgggucggca

SEQ ID NO: 1360616 - RNA, 14 nt, Mycobacterium tuberculosis H37Rv
gcgacgagcagcaa

SEQ ID NO: 1360617 - RNA, 13 nt, Mycobacterium tuberculosis H37Rv
gcgaccgcggccc

SEQ ID NO: 1360618 - RNA, 18 nt, Mycobacterium tuberculosis H37Rv
gcgaccgcggccccgccg

SEQ ID NO: 1360619 - RNA, 20 nt, Mycobacterium tuberculosis H37Rv
gcgaccgccugcgcggcugc

SEQ ID NO: 1360620 - RNA, 15 nt, Mycobacterium tuberculosis H37Rv
gcgaccgcagcuggg

SEQ ID NO: 1360621 - RNA, 12 nt, Mycobacterium tuberculosis H37Rv
gcgaccgccauu

SEQ ID NO: 1360622 - RNA, 15 nt, Mycobacterium tuberculosis H37Rv
gcgaccgccugcgcg

SEQ ID NO: 1360623 - RNA, 21 nt, Mycobacterium tuberculosis H37Rv
gcgaccgaugaucucacccag

SEQ ID NO: 1360624 - RNA, 19 nt, Mycobacterium tuberculosis H37Rv
gcgaccggugccugcaacg

SEQ ID NO: 1360625 - RNA, 21 nt, Mycobacterium tuberculosis H37Rv
gcgaccggcguaaccggcagc

SEQ ID NO: 1360626 - RNA, 14 nt, Mycobacterium tuberculosis H37Rv
gcgaccgucccagc

SEQ ID NO: 1360627 - RNA, 15 nt, Mycobacterium tuberculosis H37Rv
gcgaccgucccggcc

SEQ ID NO: 1360628 - RNA, 19 nt, Mycobacterium tuberculosis H37Rv
gcgaccgucccagcgccgc

SEQ ID NO: 1360629 - RNA, 17 nt, Mycobacterium tuberculosis H37Rv
gcgaccgucccggccuc

SEQ ID NO: 1360630 - RNA, 16 nt, Mycobacterium tuberculosis H37Rv
gcgaccgucgggacgg

SEQ ID NO: 1360631 - RNA, 23 nt, Mycobacterium tuberculosis H37Rv
gcgagaucggauggugugucggg

SEQ ID NO: 1360632 - RNA, 18 nt, Mycobacterium tuberculosis H37Rv
gcgagcaauuccucagcc

SEQ ID NO: 1360633 - RNA, 17 nt, Mycobacterium tuberculosis H37Rv
gcgagcaccaccccagc

SEQ ID NO: 1360634 - RNA, 20 nt, Mycobacterium tuberculosis H37Rv
gcgagcaccaccccagcggc

SEQ ID NO: 1360635 - RNA, 22 nt, Mycobacterium tuberculosis H37Rv
gcgagcaccaccccagcggcca

SEQ ID NO: 1360636 - RNA, 17 nt, Mycobacterium tuberculosis H37Rv
gcgagcacccgcugguc

SEQ ID NO: 1360637 - RNA, 21 nt, Mycobacterium tuberculosis H37Rv
gcgagcaacucguccagcagu

SEQ ID NO: 1360638 - RNA, 15 nt, Mycobacterium tuberculosis H37Rv
gcgagcaacacgagc

SEQ ID NO: 1360639 - RNA, 23 nt, Mycobacterium tuberculosis H37Rv
gcgagcaccgcgguagccgagcu

SEQ ID NO: 1360640 - RNA, 15 nt, Mycobacterium tuberculosis H37Rv
gcgagcagacgcaga

SEQ ID NO: 1360641 - RNA, 15 nt, Mycobacterium tuberculosis H37Rv
gcgagcagcccggcg

SEQ ID NO: 1360642 - RNA, 19 nt, Mycobacterium tuberculosis H37Rv
gcgacgucaggguauccac

SEQ ID NO: 1360643 - RNA, 22 nt, Mycobacterium tuberculosis H37Rv
gcgacguauuucgcccccugga

SEQ ID NO: 1360644 - RNA, 18 nt, Mycobacterium tuberculosis H37Rv
gcgacgucaaacgcaaag

SEQ ID NO: 1360645 - RNA, 16 nt, Mycobacterium tuberculosis H37Rv
gcgacgucggcgguga

SEQ ID NO: 1360646 - RNA, 17 nt, Mycobacterium tuberculosis H37Rv
gcgacgucugccaggcg

SEQ ID NO: 1360647 - RNA, 19 nt, Mycobacterium tuberculosis H37Rv
gcgacgugaaugguggugu

SEQ ID NO: 1360648 - RNA, 15 nt, Mycobacterium tuberculosis H37Rv
gcgacugcucgccgg

SEQ ID NO: 1360649 - RNA, 17 nt, Mycobacterium tuberculosis H37Rv
gcgacgcucgcugcagc

SEQ ID NO: 1360650 - RNA, 19 nt, Mycobacterium tuberculosis H37Rv
gcgacgguucccagcuucc

SEQ ID NO: 1360651 - RNA, 20 nt, Mycobacterium tuberculosis H37Rv
gcgacgguucccagcuuccg

SEQ ID NO: 1360652 - RNA, 15 nt, Mycobacterium tuberculosis H37Rv
gcgacgcgaccgcga

SEQ ID NO: 1360653 - RNA, 17 nt, Mycobacterium tuberculosis H37Rv
gcgacgccggccuuggc

SEQ ID NO: 1360654 - RNA, 20 nt, Mycobacterium tuberculosis H37Rv
gcgacgcgcgagaacacccg

SEQ ID NO: 1360655 - RNA, 17 nt, Mycobacterium tuberculosis H37Rv
gcgacgcggccagcggc

SEQ ID NO: 1360656 - RNA, 18 nt, Mycobacterium tuberculosis H37Rv
gcgacgcucgcugcagca

SEQ ID NO: 1360657 - RNA, 21 nt, Mycobacterium tuberculosis H37Rv
gcgacgcucgcugcagcaggg

SEQ ID NO: 1360658 - RNA, 19 nt, Mycobacterium tuberculosis H37Rv
gcgacgcguagcacggcga

SEQ ID NO: 1360659 - RNA, 21 nt, Mycobacterium tuberculosis H37Rv
gcgacgcaaagcagcgcaaug

SEQ ID NO: 1360660 - RNA, 19 nt, Mycobacterium tuberculosis H37Rv
gcgacgaugucgagcgcga

SEQ ID NO: 1360661 - RNA, 20 nt, Mycobacterium tuberculosis H37Rv
gcgacgcauaaccggcgcgc

SEQ ID NO: 1360662 - RNA, 21 nt, Mycobacterium tuberculosis H37Rv
gcgacgccgaaaaugccgccc

SEQ ID NO: 1360663 - RNA, 22 nt, Mycobacterium tuberculosis H37Rv
gcgacgauaucgggagcggcug

SEQ ID NO: 1360664 - RNA, 22 nt, Mycobacterium tuberculosis H37Rv
gcgacgaugaucucgcccaccu

SEQ ID NO: 1360665 - RNA, 14 nt, Mycobacterium tuberculosis H37Rv
gcgacgaugcaggu

SEQ ID NO: 1360666 - RNA, 13 nt, Mycobacterium tuberculosis H37Rv
gcgacgauccgca

SEQ ID NO: 1360667 - RNA, 23 nt, Mycobacterium tuberculosis H37Rv
gcgacgauaucgggagcggcugc

SEQ ID NO: 1360668 - RNA, 12 nt, Mycobacterium tuberculosis H37Rv
gcgaggccagcg

SEQ ID NO: 1360669 - RNA, 20 nt, Mycobacterium tuberculosis H37Rv
gcgaggcguaaucaagcagc

SEQ ID NO: 1360670 - RNA, 19 nt, Mycobacterium tuberculosis H37Rv
gcgaggcucccccaccagg

SEQ ID NO: 1360671 - RNA, 14 nt, Mycobacterium tuberculosis H37Rv
gcgaggggccggcu

SEQ ID NO: 1360672 - RNA, 22 nt, Mycobacterium tuberculosis H37Rv
gcgaggggauuuugcgucugcu

SEQ ID NO: 1360673 - RNA, 21 nt, Mycobacterium tuberculosis H37Rv
gcgagggugagcauggcuagg

SEQ ID NO: 1360674 - RNA, 20 nt, Mycobacterium tuberculosis H37Rv
gcgagguauaaacgcggcgc

SEQ ID NO: 1360675 - RNA, 13 nt, Mycobacterium tuberculosis H37Rv
gcgaggucagaga

SEQ ID NO: 1360676 - RNA, 20 nt, Mycobacterium tuberculosis H37Rv
gcgagggcuaccggcgccgc

SEQ ID NO: 1360677 - RNA, 22 nt, Mycobacterium tuberculosis H37Rv
gcgagggcuaccggcgccgcgc

SEQ ID NO: 1360678 - RNA, 17 nt, Mycobacterium tuberculosis H37Rv
gcgaggcucgcguggcc

SEQ ID NO: 1360679 - RNA, 21 nt, Mycobacterium tuberculosis H37Rv
gcgaggauccauuggaaccug

SEQ ID NO: 1360680 - RNA, 20 nt, Mycobacterium tuberculosis H37Rv
gcgagcguuucaccagucca

SEQ ID NO: 1360681 - RNA, 16 nt, Mycobacterium tuberculosis H37Rv
gcgaggaugcugagcg

SEQ ID NO: 1360682 - RNA, 18 nt, Mycobacterium tuberculosis H37Rv
gcgaggaugcugagcgcc

SEQ ID NO: 1360683 - RNA, 12 nt, Mycobacterium tuberculosis H37Rv
gcgagcgccggc

SEQ ID NO: 1360684 - RNA, 18 nt, Mycobacterium tuberculosis H37Rv
gcgagcgccggccgcggc

SEQ ID NO: 1360685 - RNA, 14 nt, Mycobacterium tuberculosis H37Rv
gcgagcgccggcuu

SEQ ID NO: 1360686 - RNA, 13 nt, Mycobacterium tuberculosis H37Rv
gcgagcgcagcgc

SEQ ID NO: 1360687 - RNA, 14 nt, Mycobacterium tuberculosis H37Rv
gcgagcgccuuucg

SEQ ID NO: 1360688 - RNA, 14 nt, Mycobacterium tuberculosis H37Rv
gcgagcgcggccug

SEQ ID NO: 1360689 - RNA, 12 nt, Mycobacterium tuberculosis H37Rv
gcgagcgcggcg

SEQ ID NO: 1360690 - RNA, 22 nt, Mycobacterium tuberculosis H37Rv
gcgagccugauaaagcccggcg

SEQ ID NO: 1360691 - RNA, 15 nt, Mycobacterium tuberculosis H37Rv
gcgagugucagcaga

SEQ ID NO: 1360692 - RNA, 21 nt, Mycobacterium tuberculosis H37Rv
gcgagguugaccaccagcgug

SEQ ID NO: 1360693 - RNA, 15 nt, Mycobacterium tuberculosis H37Rv
gcgaggucggcggcg

SEQ ID NO: 1360694 - RNA, 19 nt, Mycobacterium tuberculosis H37Rv
gcgaguaacccguccggug

SEQ ID NO: 1360695 - RNA, 15 nt, Mycobacterium tuberculosis H37Rv
gcgagguccagcaug

SEQ ID NO: 1360696 - RNA, 20 nt, Mycobacterium tuberculosis H37Rv
gcgaggugcccaaggccagg

SEQ ID NO: 1360697 - RNA, 20 nt, Mycobacterium tuberculosis H37Rv
gcgaguacggccugccgcuc

SEQ ID NO: 1360698 - RNA, 19 nt, Mycobacterium tuberculosis H37Rv
gcgaguagcugacccgcgg

SEQ ID NO: 1360699 - RNA, 13 nt, Mycobacterium tuberculosis H37Rv
gcgaguccagcgc

SEQ ID NO: 1360700 - RNA, 14 nt, Mycobacterium tuberculosis H37Rv
gcgagucccggcgg

SEQ ID NO: 1360701 - RNA, 16 nt, Mycobacterium tuberculosis H37Rv
gcgagucggcggggcg

SEQ ID NO: 1360702 - RNA, 21 nt, Mycobacterium tuberculosis H37Rv
gcgaguccucgagugccgccg

SEQ ID NO: 1360703 - RNA, 19 nt, Mycobacterium tuberculosis H37Rv
gcgagucgaacccgcgagc

SEQ ID NO: 1360704 - RNA, 16 nt, Mycobacterium tuberculosis H37Rv
gccuaugcugcccggc

SEQ ID NO: 1360705 - RNA, 16 nt, Mycobacterium tuberculosis H37Rv
gccugaaacgauugcu

SEQ ID NO: 1360706 - RNA, 18 nt, Mycobacterium tuberculosis H37Rv
gccucaaugaccaccggg

SEQ ID NO: 1360707 - RNA, 23 nt, Mycobacterium tuberculosis H37Rv
gccugaccgaagucugcagacgg

SEQ ID NO: 1360708 - RNA, 14 nt, Mycobacterium tuberculosis H37Rv
gccugaaccgcccc

SEQ ID NO: 1360709 - RNA, 19 nt, Mycobacterium tuberculosis H37Rv
gccugauaaagcccggcgg

SEQ ID NO: 1360710 - RNA, 21 nt, Mycobacterium tuberculosis H37Rv
gccugauaaagcccggcggca

SEQ ID NO: 1360711 - RNA, 23 nt, Mycobacterium tuberculosis H37Rv
gccugauaaagcccggcggcaug

SEQ ID NO: 1360712 - RNA, 17 nt, Mycobacterium tuberculosis H37Rv
gccugauaaagcccggc

SEQ ID NO: 1360713 - RNA, 14 nt, Mycobacterium tuberculosis H37Rv
gccugauaaagccc

SEQ ID NO: 1360714 - RNA, 18 nt, Mycobacterium tuberculosis H37Rv
gccugagcgccgcggcgg

SEQ ID NO: 1360715 - RNA, 14 nt, Mycobacterium tuberculosis H37Rv
gccugagcggccuc

SEQ ID NO: 1360716 - RNA, 13 nt, Mycobacterium tuberculosis H37Rv
gccugagccacca

SEQ ID NO: 1360717 - RNA, 15 nt, Mycobacterium tuberculosis H37Rv
gccugagcgccgcgg

SEQ ID NO: 1360718 - RNA, 18 nt, Mycobacterium tuberculosis H37Rv
gccugacgcgucagcggc

SEQ ID NO: 1360719 - RNA, 15 nt, Mycobacterium tuberculosis H37Rv
gccugcaagacaaag

SEQ ID NO: 1360720 - RNA, 14 nt, Mycobacterium tuberculosis H37Rv
gccugaugcggccg

SEQ ID NO: 1360721 - RNA, 22 nt, Mycobacterium tuberculosis H37Rv
gccugcgccuuggucgccggcg

SEQ ID NO: 1360722 - RNA, 22 nt, Mycobacterium tuberculosis H37Rv
gccugcgccuugaagcggugga

SEQ ID NO: 1360723 - RNA, 15 nt, Mycobacterium tuberculosis H37Rv
gccugcgccgcccgc

SEQ ID NO: 1360724 - RNA, 19 nt, Mycobacterium tuberculosis H37Rv
gccugcgccggcgcugcca

SEQ ID NO: 1360725 - RNA, 17 nt, Mycobacterium tuberculosis H37Rv
gccugcucaaccagcag

SEQ ID NO: 1360726 - RNA, 18 nt, Mycobacterium tuberculosis H37Rv
gccugcgaaacgcuggcc

SEQ ID NO: 1360727 - RNA, 14 nt, Mycobacterium tuberculosis H37Rv
gccugcccagcacc

SEQ ID NO: 1360728 - RNA, 17 nt, Mycobacterium tuberculosis H37Rv
gccugccccacccgcgg

SEQ ID NO: 1360729 - RNA, 20 nt, Mycobacterium tuberculosis H37Rv
gccugcccccggcgcggcgg

SEQ ID NO: 1360730 - RNA, 18 nt, Mycobacterium tuberculosis H37Rv
gccugcgccgccagcgcc

SEQ ID NO: 1360731 - RNA, 13 nt, Mycobacterium tuberculosis H37Rv
gccugcgccgagu

SEQ ID NO: 1360732 - RNA, 14 nt, Mycobacterium tuberculosis H37Rv
gccugcgcccagcc

SEQ ID NO: 1360733 - RNA, 16 nt, Mycobacterium tuberculosis H37Rv
gccugccacccggcca

SEQ ID NO: 1360734 - RNA, 16 nt, Mycobacterium tuberculosis H37Rv
gccugccaccggcgcu

SEQ ID NO: 1360735 - RNA, 14 nt, Mycobacterium tuberculosis H37Rv
gccugccacccggc

SEQ ID NO: 1360736 - RNA, 14 nt, Mycobacterium tuberculosis H37Rv
gccugcccaccuuc

SEQ ID NO: 1360737 - RNA, 17 nt, Mycobacterium tuberculosis H37Rv
gccugcaggccgccggc

SEQ ID NO: 1360738 - RNA, 19 nt, Mycobacterium tuberculosis H37Rv
gccugcaggccgccggcca

SEQ ID NO: 1360739 - RNA, 14 nt, Mycobacterium tuberculosis H37Rv
gccugcacggcgcu

SEQ ID NO: 1360740 - RNA, 13 nt, Mycobacterium tuberculosis H37Rv
gccugcacgccgg

SEQ ID NO: 1360741 - RNA, 16 nt, Mycobacterium tuberculosis H37Rv
gccugcaccgccgccg

SEQ ID NO: 1360742 - RNA, 15 nt, Mycobacterium tuberculosis H37Rv
gccugcagcgcgacc

SEQ ID NO: 1360743 - RNA, 14 nt, Mycobacterium tuberculosis H37Rv
gccuugccgccggc

SEQ ID NO: 1360744 - RNA, 21 nt, Mycobacterium tuberculosis H37Rv
gccuucuuggcaggugccuuc

SEQ ID NO: 1360745 - RNA, 22 nt, Mycobacterium tuberculosis H37Rv
gccuucuuggcaggugccuucu

SEQ ID NO: 1360746 - RNA, 15 nt, Mycobacterium tuberculosis H37Rv
gccuucccagccgac

SEQ ID NO: 1360747 - RNA, 21 nt, Mycobacterium tuberculosis H37Rv
gccuuccaggcgggcggcacc

SEQ ID NO: 1360748 - RNA, 16 nt, Mycobacterium tuberculosis H37Rv
gccuuccuggcgggcg

SEQ ID NO: 1360749 - RNA, 23 nt, Mycobacterium tuberculosis H37Rv
gccuuguggaaccaucccugaaa

SEQ ID NO: 1360750 - RNA, 18 nt, Mycobacterium tuberculosis H37Rv
gccuuguuguccuucagc

SEQ ID NO: 1360751 - RNA, 13 nt, Mycobacterium tuberculosis H37Rv
gccuuguuguccu

SEQ ID NO: 1360752 - RNA, 16 nt, Mycobacterium tuberculosis H37Rv
gccuuguugccgccgg

SEQ ID NO: 1360753 - RNA, 14 nt, Mycobacterium tuberculosis H37Rv
gccuuggucgccgg

SEQ ID NO: 1360754 - RNA, 13 nt, Mycobacterium tuberculosis H37Rv
gccuugugcucga

SEQ ID NO: 1360755 - RNA, 15 nt, Mycobacterium tuberculosis H37Rv
gccuugcgcgcgcag

SEQ ID NO: 1360756 - RNA, 17 nt, Mycobacterium tuberculosis H37Rv
gccuugcgucaucggcu

SEQ ID NO: 1360757 - RNA, 20 nt, Mycobacterium tuberculosis H37Rv
gccuugcguguaccagccca

SEQ ID NO: 1360758 - RNA, 21 nt, Mycobacterium tuberculosis H37Rv
gccuuacacgccuggcuacgc

SEQ ID NO: 1360759 - RNA, 20 nt, Mycobacterium tuberculosis H37Rv
gccuuaggugaccaggguga

SEQ ID NO: 1360760 - RNA, 20 nt, Mycobacterium tuberculosis H37Rv
gccuuagcccggccgcggcc

SEQ ID NO: 1360761 - RNA, 14 nt, Mycobacterium tuberculosis H37Rv
gccugugccgccgg

SEQ ID NO: 1360762 - RNA, 13 nt, Mycobacterium tuberculosis H37Rv
gccugugccgccg

SEQ ID NO: 1360763 - RNA, 14 nt, Mycobacterium tuberculosis H37Rv
gccugugcggcggg

SEQ ID NO: 1360764 - RNA, 16 nt, Mycobacterium tuberculosis H37Rv
gccuggacgccgccgg

SEQ ID NO: 1360765 - RNA, 14 nt, Mycobacterium tuberculosis H37Rv
gccuggcacccggg

SEQ ID NO: 1360766 - RNA, 14 nt, Mycobacterium tuberculosis H37Rv
gccuggcagggugg

SEQ ID NO: 1360767 - RNA, 17 nt, Mycobacterium tuberculosis H37Rv
gccugcuccucggccag

SEQ ID NO: 1360768 - RNA, 16 nt, Mycobacterium tuberculosis H37Rv
gcgcgcucgcucaccg

SEQ ID NO: 1360769 - RNA, 21 nt, Mycobacterium tuberculosis H37Rv
gcgcgcucggagagguagggc

SEQ ID NO: 1360770 - RNA, 21 nt, Mycobacterium tuberculosis H37Rv
gcgcgcucaucgaccgcggcc

SEQ ID NO: 1360771 - RNA, 21 nt, Mycobacterium tuberculosis H37Rv
gcgcgcggucgagguggcggg

SEQ ID NO: 1360772 - RNA, 18 nt, Mycobacterium tuberculosis H37Rv
gcgcgcguagcgggggag

SEQ ID NO: 1360773 - RNA, 14 nt, Mycobacterium tuberculosis H37Rv
gcgcggagagccug

SEQ ID NO: 1360774 - RNA, 19 nt, Mycobacterium tuberculosis H37Rv
gcgcggagagccugcucgc

SEQ ID NO: 1360775 - RNA, 14 nt, Mycobacterium tuberculosis H37Rv
gcgcggacccagca

SEQ ID NO: 1360776 - RNA, 15 nt, Mycobacterium tuberculosis H37Rv
gcgcggacccgccgu

SEQ ID NO: 1360777 - RNA, 17 nt, Mycobacterium tuberculosis H37Rv
gcgcggaucggcggccg

SEQ ID NO: 1360778 - RNA, 14 nt, Mycobacterium tuberculosis H37Rv
gcgcggccagcagc

SEQ ID NO: 1360779 - RNA, 13 nt, Mycobacterium tuberculosis H37Rv
gcgcggcccgccg

SEQ ID NO: 1360780 - RNA, 13 nt, Mycobacterium tuberculosis H37Rv
gcgcggccgcagc

SEQ ID NO: 1360781 - RNA, 13 nt, Mycobacterium tuberculosis H37Rv
gcgcggcccgcau

SEQ ID NO: 1360782 - RNA, 13 nt, Mycobacterium tuberculosis H37Rv
gcgcggccggccg

SEQ ID NO: 1360783 - RNA, 20 nt, Mycobacterium tuberculosis H37Rv
gcgcggccguagugcacguc

SEQ ID NO: 1360784 - RNA, 15 nt, Mycobacterium tuberculosis H37Rv
gcgcggccggccgcu

SEQ ID NO: 1360785 - RNA, 19 nt, Mycobacterium tuberculosis H37Rv
gcgcgccuucacgcuggcc

SEQ ID NO: 1360786 - RNA, 17 nt, Mycobacterium tuberculosis H37Rv
gcgcgccuucacgcugg

SEQ ID NO: 1360787 - RNA, 15 nt, Mycobacterium tuberculosis H37Rv
gcgcgccguucaccc

SEQ ID NO: 1360788 - RNA, 23 nt, Mycobacterium tuberculosis H37Rv
gcgcgcggucgagguggcgggcg

SEQ ID NO: 1360789 - RNA, 20 nt, Mycobacterium tuberculosis H37Rv
gcgcgcccacagcccgggcg

SEQ ID NO: 1360790 - RNA, 22 nt, Mycobacterium tuberculosis H37Rv
gcgcgccguagaccagcaggcc

SEQ ID NO: 1360791 - RNA, 13 nt, Mycobacterium tuberculosis H37Rv
gcgcgccggugcu

SEQ ID NO: 1360792 - RNA, 17 nt, Mycobacterium tuberculosis H37Rv
gcgcgccgaaggcggcc

SEQ ID NO: 1360793 - RNA, 18 nt, Mycobacterium tuberculosis H37Rv
gcgaucaguucgugacgu

SEQ ID NO: 1360794 - RNA, 14 nt, Mycobacterium tuberculosis H37Rv
gcgaucaggcgcuc

SEQ ID NO: 1360795 - RNA, 15 nt, Mycobacterium tuberculosis H37Rv
gcgaucagcgcgcac

SEQ ID NO: 1360796 - RNA, 20 nt, Mycobacterium tuberculosis H37Rv
gcgauccggucggccaggcc

SEQ ID NO: 1360797 - RNA, 20 nt, Mycobacterium tuberculosis H37Rv
gcgauccgagaccgcgugcu

SEQ ID NO: 1360798 - RNA, 14 nt, Mycobacterium tuberculosis H37Rv
gcgauccagggccg

SEQ ID NO: 1360799 - RNA, 15 nt, Mycobacterium tuberculosis H37Rv
gcgauccagggccga

SEQ ID NO: 1360800 - RNA, 20 nt, Mycobacterium tuberculosis H37Rv
gcgcgaacgucaaccgggcg

SEQ ID NO: 1360801 - RNA, 15 nt, Mycobacterium tuberculosis H37Rv
gcgcgaacgccugcu

SEQ ID NO: 1360802 - RNA, 14 nt, Mycobacterium tuberculosis H37Rv
gcgcgaaggggacg

SEQ ID NO: 1360803 - RNA, 14 nt, Mycobacterium tuberculosis H37Rv
gcgauccucgccgg

SEQ ID NO: 1360804 - RNA, 19 nt, Mycobacterium tuberculosis H37Rv
gcgauccugaccagccagg

SEQ ID NO: 1360805 - RNA, 16 nt, Mycobacterium tuberculosis H37Rv
gcgaucgacgauccac

SEQ ID NO: 1360806 - RNA, 14 nt, Mycobacterium tuberculosis H37Rv
gcgaucgcgagcga

SEQ ID NO: 1360807 - RNA, 14 nt, Mycobacterium tuberculosis H37Rv
gcgaucgccggccg

SEQ ID NO: 1360808 - RNA, 19 nt, Mycobacterium tuberculosis H37Rv
gcgcgcagaugagcgcggc

SEQ ID NO: 1360809 - RNA, 19 nt, Mycobacterium tuberculosis H37Rv
gcgcgaucgacgcucggcu

SEQ ID NO: 1360810 - RNA, 18 nt, Mycobacterium tuberculosis H37Rv
gcgcgaucgacgcucggc

SEQ ID NO: 1360811 - RNA, 17 nt, Mycobacterium tuberculosis H37Rv
gcgcgcacggcgucggc

SEQ ID NO: 1360812 - RNA, 13 nt, Mycobacterium tuberculosis H37Rv
gcgcgcacacggc

SEQ ID NO: 1360813 - RNA, 18 nt, Mycobacterium tuberculosis H37Rv
gcgcgcaccaccgcggcg

SEQ ID NO: 1360814 - RNA, 19 nt, Mycobacterium tuberculosis H37Rv
gcgcgcaccaccgcggcgg

SEQ ID NO: 1360815 - RNA, 18 nt, Mycobacterium tuberculosis H37Rv
gcgcgauaggugcucgcg

SEQ ID NO: 1360816 - RNA, 11 nt, Mycobacterium tuberculosis H37Rv
gcgcgagauca

SEQ ID NO: 1360817 - RNA, 16 nt, Mycobacterium tuberculosis H37Rv
gcgcgaggucggcggc

SEQ ID NO: 1360818 - RNA, 17 nt, Mycobacterium tuberculosis H37Rv
gcgcgagaucagccggc

SEQ ID NO: 1360819 - RNA, 15 nt, Mycobacterium tuberculosis H37Rv
gcgcgagcagcuaca

SEQ ID NO: 1360820 - RNA, 15 nt, Mycobacterium tuberculosis H37Rv
gcgcgagccgcucca

SEQ ID NO: 1360821 - RNA, 22 nt, Mycobacterium tuberculosis H37Rv
gcgcgaauuccucuguacccca

SEQ ID NO: 1360822 - RNA, 16 nt, Mycobacterium tuberculosis H37Rv
gcgcgguagcucgucg

SEQ ID NO: 1360823 - RNA, 19 nt, Mycobacterium tuberculosis H37Rv
gcgcgguaccgcucgggcg

SEQ ID NO: 1360824 - RNA, 18 nt, Mycobacterium tuberculosis H37Rv
gcgcggguggcgccaggu

SEQ ID NO: 1360825 - RNA, 14 nt, Mycobacterium tuberculosis H37Rv
gcgcggguggcucg

SEQ ID NO: 1360826 - RNA, 17 nt, Mycobacterium tuberculosis H37Rv
gcgcgguacugcgcagc

SEQ ID NO: 1360827 - RNA, 15 nt, Mycobacterium tuberculosis H37Rv
gcgcgguacugcgca

SEQ ID NO: 1360828 - RNA, 22 nt, Mycobacterium tuberculosis H37Rv
gcgcgguccuuguuagccucca

SEQ ID NO: 1360829 - RNA, 14 nt, Mycobacterium tuberculosis H37Rv
gcgcggucgcgcga

SEQ ID NO: 1360830 - RNA, 15 nt, Mycobacterium tuberculosis H37Rv
gcgcggugcgcguga

SEQ ID NO: 1360831 - RNA, 23 nt, Mycobacterium tuberculosis H37Rv
gcgcggugcggccacucgcccga

SEQ ID NO: 1360832 - RNA, 16 nt, Mycobacterium tuberculosis H37Rv
gcgcgguggggcgcgc

SEQ ID NO: 1360833 - RNA, 17 nt, Mycobacterium tuberculosis H37Rv
gcgcgguggggcgcgcc

SEQ ID NO: 1360834 - RNA, 14 nt, Mycobacterium tuberculosis H37Rv
gcgcggugcccugc

SEQ ID NO: 1360835 - RNA, 17 nt, Mycobacterium tuberculosis H37Rv
gcgcggugcccugccgg

SEQ ID NO: 1360836 - RNA, 22 nt, Mycobacterium tuberculosis H37Rv
gcgcggugcccugccggcagcg

SEQ ID NO: 1360837 - RNA, 19 nt, Mycobacterium tuberculosis H37Rv
gcgcggugcccgcgaacga

SEQ ID NO: 1360838 - RNA, 22 nt, Mycobacterium tuberculosis H37Rv
gcgcggucugaccgcgucggcg

SEQ ID NO: 1360839 - RNA, 15 nt, Mycobacterium tuberculosis H37Rv
gcgcgguggucgcga

SEQ ID NO: 1360840 - RNA, 21 nt, Mycobacterium tuberculosis H37Rv
gcgcguaauccgagcgcggcg

SEQ ID NO: 1360841 - RNA, 23 nt, Mycobacterium tuberculosis H37Rv
gcgcguaauccgagcgcggcggc

SEQ ID NO: 1360842 - RNA, 19 nt, Mycobacterium tuberculosis H37Rv
gcgcgguuuucggcugccg

SEQ ID NO: 1360843 - RNA, 14 nt, Mycobacterium tuberculosis H37Rv
gcgcguagcucagc

SEQ ID NO: 1360844 - RNA, 14 nt, Mycobacterium tuberculosis H37Rv
gcgcguccaaccaa

SEQ ID NO: 1360845 - RNA, 15 nt, Mycobacterium tuberculosis H37Rv
gcgcguccccagcgc

SEQ ID NO: 1360846 - RNA, 16 nt, Mycobacterium tuberculosis H37Rv
gcgcggcugugcccga

SEQ ID NO: 1360847 - RNA, 13 nt, Mycobacterium tuberculosis H37Rv
gcgcgggccggcg

SEQ ID NO: 1360848 - RNA, 12 nt, Mycobacterium tuberculosis H37Rv
gcgcgggccacc

SEQ ID NO: 1360849 - RNA, 13 nt, Mycobacterium tuberculosis H37Rv
gcgcggccgggcg

SEQ ID NO: 1360850 - RNA, 15 nt, Mycobacterium tuberculosis H37Rv
gcgcggcgucuagcc

SEQ ID NO: 1360851 - RNA, 22 nt, Mycobacterium tuberculosis H37Rv
gcgcggggaucacaccccaggc

SEQ ID NO: 1360852 - RNA, 20 nt, Mycobacterium tuberculosis H37Rv
gcgcggggccgccgcggccg

SEQ ID NO: 1360853 - RNA, 15 nt, Mycobacterium tuberculosis H37Rv
gcgcggggcggccug

SEQ ID NO: 1360854 - RNA, 19 nt, Mycobacterium tuberculosis H37Rv
gcgcgggguggcggcgcug

SEQ ID NO: 1360855 - RNA, 17 nt, Mycobacterium tuberculosis H37Rv
gcgcggggcggccugcc

SEQ ID NO: 1360856 - RNA, 14 nt, Mycobacterium tuberculosis H37Rv
gcgcggggcggcug

SEQ ID NO: 1360857 - RNA, 23 nt, Mycobacterium tuberculosis H37Rv
gcgcgggcucgguggcggacggc

SEQ ID NO: 1360858 - RNA, 17 nt, Mycobacterium tuberculosis H37Rv
gcgcgggcucgguggcg

SEQ ID NO: 1360859 - RNA, 16 nt, Mycobacterium tuberculosis H37Rv
gcgcgggcgccgggaa

SEQ ID NO: 1360860 - RNA, 15 nt, Mycobacterium tuberculosis H37Rv
gcgcgggcucggugg

SEQ ID NO: 1360861 - RNA, 21 nt, Mycobacterium tuberculosis H37Rv
gcgcucaaugaucgcggcggc

SEQ ID NO: 1360862 - RNA, 20 nt, Mycobacterium tuberculosis H37Rv
gcgcucaaugaucgcggcgg

SEQ ID NO: 1360863 - RNA, 18 nt, Mycobacterium tuberculosis H37Rv
gcgcuagccgggcgcgcc

SEQ ID NO: 1360864 - RNA, 20 nt, Mycobacterium tuberculosis H37Rv
gcgcuagccgggcgcgccgg

SEQ ID NO: 1360865 - RNA, 21 nt, Mycobacterium tuberculosis H37Rv
gcgcuagccgggcgcgccggc

SEQ ID NO: 1360866 - RNA, 17 nt, Mycobacterium tuberculosis H37Rv
gcgcuagccgggcgcgc

SEQ ID NO: 1360867 - RNA, 16 nt, Mycobacterium tuberculosis H37Rv
gcgcuagccgggcgcg

SEQ ID NO: 1360868 - RNA, 14 nt, Mycobacterium tuberculosis H37Rv
gcgcuacgcggccg

SEQ ID NO: 1360869 - RNA, 20 nt, Mycobacterium tuberculosis H37Rv
gcgcucaggucaucggcggc

SEQ ID NO: 1360870 - RNA, 17 nt, Mycobacterium tuberculosis H37Rv
gcgcucaucgaccgggg

SEQ ID NO: 1360871 - RNA, 19 nt, Mycobacterium tuberculosis H37Rv
gcgcucaucugcgcgcgga

SEQ ID NO: 1360872 - RNA, 13 nt, Mycobacterium tuberculosis H37Rv
gcgcucagccggg

SEQ ID NO: 1360873 - RNA, 15 nt, Mycobacterium tuberculosis H37Rv
gcgcucagcgcggcc

SEQ ID NO: 1360874 - RNA, 17 nt, Mycobacterium tuberculosis H37Rv
gcgcguugaagucgccg

SEQ ID NO: 1360875 - RNA, 14 nt, Mycobacterium tuberculosis H37Rv
gcgcguuccagcac

SEQ ID NO: 1360876 - RNA, 18 nt, Mycobacterium tuberculosis H37Rv
gcgcguucggcgagcagc

SEQ ID NO: 1360877 - RNA, 18 nt, Mycobacterium tuberculosis H37Rv
gcgcgugggcgugcaggc

SEQ ID NO: 1360878 - RNA, 15 nt, Mycobacterium tuberculosis H37Rv
gcgcguggucgggaa

SEQ ID NO: 1360879 - RNA, 18 nt, Mycobacterium tuberculosis H37Rv
gcgcguggcagugcaggc

SEQ ID NO: 1360880 - RNA, 22 nt, Mycobacterium tuberculosis H37Rv
gcgcgucgcgggauugcgcgcu

SEQ ID NO: 1360881 - RNA, 12 nt, Mycobacterium tuberculosis H37Rv
gcgcgucggcac

SEQ ID NO: 1360882 - RNA, 14 nt, Mycobacterium tuberculosis H37Rv
gcgcgucgagcagc

SEQ ID NO: 1360883 - RNA, 14 nt, Mycobacterium tuberculosis H37Rv
gcgcgucgcccagu

SEQ ID NO: 1360884 - RNA, 18 nt, Mycobacterium tuberculosis H37Rv
gcgcgucgcgaguagcug

SEQ ID NO: 1360885 - RNA, 20 nt, Mycobacterium tuberculosis H37Rv
gcggcgagaaucccgggccg

SEQ ID NO: 1360886 - RNA, 17 nt, Mycobacterium tuberculosis H37Rv
gcggcgacgacggccug

SEQ ID NO: 1360887 - RNA, 16 nt, Mycobacterium tuberculosis H37Rv
gcggcgacgacggccu

SEQ ID NO: 1360888 - RNA, 17 nt, Mycobacterium tuberculosis H37Rv
gcggcgacggccgcucg

SEQ ID NO: 1360889 - RNA, 16 nt, Mycobacterium tuberculosis H37Rv
gcggcgacgccgcugg

SEQ ID NO: 1360890 - RNA, 15 nt, Mycobacterium tuberculosis H37Rv
gcggcgagcagagaa

SEQ ID NO: 1360891 - RNA, 17 nt, Mycobacterium tuberculosis H37Rv
gcggcgaagaagccggc

SEQ ID NO: 1360892 - RNA, 19 nt, Mycobacterium tuberculosis H37Rv
gcggcgaaccagcgcgucu

SEQ ID NO: 1360893 - RNA, 19 nt, Mycobacterium tuberculosis H37Rv
gcggcgaagauaucggcac

SEQ ID NO: 1360894 - RNA, 16 nt, Mycobacterium tuberculosis H37Rv
gcggcgaagccgggug

SEQ ID NO: 1360895 - RNA, 23 nt, Mycobacterium tuberculosis H37Rv
gcggcgaccgucgauuucgacga

SEQ ID NO: 1360896 - RNA, 17 nt, Mycobacterium tuberculosis H37Rv
gcggcgaccgcauccgg

SEQ ID NO: 1360897 - RNA, 20 nt, Mycobacterium tuberculosis H37Rv
gcggcgaucaacucgggcag

SEQ ID NO: 1360898 - RNA, 20 nt, Mycobacterium tuberculosis H37Rv
gcggcgaguuggccguggcg

SEQ ID NO: 1360899 - RNA, 18 nt, Mycobacterium tuberculosis H37Rv
gcggcgauccggucgggg

SEQ ID NO: 1360900 - RNA, 17 nt, Mycobacterium tuberculosis H37Rv
gcggcgcccggucgagc

SEQ ID NO: 1360901 - RNA, 16 nt, Mycobacterium tuberculosis H37Rv
gcggccuggcacccgg

SEQ ID NO: 1360902 - RNA, 15 nt, Mycobacterium tuberculosis H37Rv
gcggccugcucgacc

SEQ ID NO: 1360903 - RNA, 16 nt, Mycobacterium tuberculosis H37Rv
gcggccugcucgcaga

SEQ ID NO: 1360904 - RNA, 16 nt, Mycobacterium tuberculosis H37Rv
gcggccugggccagcc

SEQ ID NO: 1360905 - RNA, 17 nt, Mycobacterium tuberculosis H37Rv
gcggccuucggccggcg

SEQ ID NO: 1360906 - RNA, 15 nt, Mycobacterium tuberculosis H37Rv
gcggccuucggccgg

SEQ ID NO: 1360907 - RNA, 21 nt, Mycobacterium tuberculosis H37Rv
gcggccuugcgggcucucggc

SEQ ID NO: 1360908 - RNA, 17 nt, Mycobacterium tuberculosis H37Rv
gcggccuugcucagcac

SEQ ID NO: 1360909 - RNA, 17 nt, Mycobacterium tuberculosis H37Rv
gcggccuuugucgccuu

SEQ ID NO: 1360910 - RNA, 15 nt, Mycobacterium tuberculosis H37Rv
gcggccuuggugggc

SEQ ID NO: 1360911 - RNA, 15 nt, Mycobacterium tuberculosis H37Rv
gcggccuuggcggcc

SEQ ID NO: 1360912 - RNA, 15 nt, Mycobacterium tuberculosis H37Rv
gcggcgaacagcccc

SEQ ID NO: 1360913 - RNA, 18 nt, Mycobacterium tuberculosis H37Rv
gcggcgaacagccccagg

SEQ ID NO: 1360914 - RNA, 19 nt, Mycobacterium tuberculosis H37Rv
gcggcgaacagccccaggg

SEQ ID NO: 1360915 - RNA, 20 nt, Mycobacterium tuberculosis H37Rv
gcggcgaacagccccagggu

SEQ ID NO: 1360916 - RNA, 20 nt, Mycobacterium tuberculosis H37Rv
gcggccugcccgccguuacg

SEQ ID NO: 1360917 - RNA, 16 nt, Mycobacterium tuberculosis H37Rv
gcggccucgcugcuca

SEQ ID NO: 1360918 - RNA, 23 nt, Mycobacterium tuberculosis H37Rv
gcggccucccgcaaugcgagcgc

SEQ ID NO: 1360919 - RNA, 14 nt, Mycobacterium tuberculosis H37Rv
gcggccuccgggcc

SEQ ID NO: 1360920 - RNA, 19 nt, Mycobacterium tuberculosis H37Rv
gcggccuaggacgccgccc

SEQ ID NO: 1360921 - RNA, 15 nt, Mycobacterium tuberculosis H37Rv
gcggccgugucgggc

SEQ ID NO: 1360922 - RNA, 16 nt, Mycobacterium tuberculosis H37Rv
gcggccgugucgggcg

SEQ ID NO: 1360923 - RNA, 18 nt, Mycobacterium tuberculosis H37Rv
gcggccgugucgggcgcg

SEQ ID NO: 1360924 - RNA, 22 nt, Mycobacterium tuberculosis H37Rv
gcggccgugaacggcgcgggcc

SEQ ID NO: 1360925 - RNA, 17 nt, Mycobacterium tuberculosis H37Rv
gcggccguggcguggcu

SEQ ID NO: 1360926 - RNA, 20 nt, Mycobacterium tuberculosis H37Rv
gcggccgguacacguccagu

SEQ ID NO: 1360927 - RNA, 16 nt, Mycobacterium tuberculosis H37Rv
gcggccguagugcacg

SEQ ID NO: 1360928 - RNA, 19 nt, Mycobacterium tuberculosis H37Rv
gcggccgucaccggucggc

SEQ ID NO: 1360929 - RNA, 16 nt, Mycobacterium tuberculosis H37Rv
gcggccgucgcgggac

SEQ ID NO: 1360930 - RNA, 16 nt, Mycobacterium tuberculosis H37Rv
gcggccaggucgccuu

SEQ ID NO: 1360931 - RNA, 13 nt, Mycobacterium tuberculosis H37Rv
gcggccagggagc

SEQ ID NO: 1360932 - RNA, 20 nt, Mycobacterium tuberculosis H37Rv
gcggccagggagcggcuugc

SEQ ID NO: 1360933 - RNA, 21 nt, Mycobacterium tuberculosis H37Rv
gcggccaguucggcggccgcc

SEQ ID NO: 1360934 - RNA, 17 nt, Mycobacterium tuberculosis H37Rv
gcggccaggcgguacgg

SEQ ID NO: 1360935 - RNA, 20 nt, Mycobacterium tuberculosis H37Rv
gcggccagcgcgcgcgggug

SEQ ID NO: 1360936 - RNA, 18 nt, Mycobacterium tuberculosis H37Rv
gcggccagcccagccggg

SEQ ID NO: 1360937 - RNA, 15 nt, Mycobacterium tuberculosis H37Rv
gcggccagccguuug

SEQ ID NO: 1360938 - RNA, 16 nt, Mycobacterium tuberculosis H37Rv
gcggcaggugcggcgg

SEQ ID NO: 1360939 - RNA, 22 nt, Mycobacterium tuberculosis H37Rv
gcggcagucauuauucgcgcaa

SEQ ID NO: 1360940 - RNA, 16 nt, Mycobacterium tuberculosis H37Rv
gcggcauacauccagg

SEQ ID NO: 1360941 - RNA, 14 nt, Mycobacterium tuberculosis H37Rv
gcggccagcccacu

SEQ ID NO: 1360942 - RNA, 18 nt, Mycobacterium tuberculosis H37Rv
gcggccgggcuccccaag

SEQ ID NO: 1360943 - RNA, 17 nt, Mycobacterium tuberculosis H37Rv
gcggccgggcggccagg

SEQ ID NO: 1360944 - RNA, 17 nt, Mycobacterium tuberculosis H37Rv
gcggccgggcgggcggc

SEQ ID NO: 1360945 - RNA, 19 nt, Mycobacterium tuberculosis H37Rv
gcggccgggcgggcggccg

SEQ ID NO: 1360946 - RNA, 22 nt, Mycobacterium tuberculosis H37Rv
gcggccggcgcucgcggcggcg

SEQ ID NO: 1360947 - RNA, 14 nt, Mycobacterium tuberculosis H37Rv
gcggccggcggccg

SEQ ID NO: 1360948 - RNA, 13 nt, Mycobacterium tuberculosis H37Rv
gcggccgcugggc

SEQ ID NO: 1360949 - RNA, 15 nt, Mycobacterium tuberculosis H37Rv
gcggccggcaugcug

SEQ ID NO: 1360950 - RNA, 18 nt, Mycobacterium tuberculosis H37Rv
gcggccgcggugacggcg

SEQ ID NO: 1360951 - RNA, 23 nt, Mycobacterium tuberculosis H37Rv
gcggccgccuacccguucuucgc

SEQ ID NO: 1360952 - RNA, 12 nt, Mycobacterium tuberculosis H37Rv
gcggccgcggug

SEQ ID NO: 1360953 - RNA, 20 nt, Mycobacterium tuberculosis H37Rv
gcggccgcgcugcagcacgg

SEQ ID NO: 1360954 - RNA, 14 nt, Mycobacterium tuberculosis H37Rv
gcggccgcggcagc

SEQ ID NO: 1360955 - RNA, 12 nt, Mycobacterium tuberculosis H37Rv
gcggccgcggcc

SEQ ID NO: 1360956 - RNA, 22 nt, Mycobacterium tuberculosis H37Rv
gcggccgcggcgcggcgggcag

SEQ ID NO: 1360957 - RNA, 22 nt, Mycobacterium tuberculosis H37Rv
gcggccgccguccccgccgucg

SEQ ID NO: 1360958 - RNA, 20 nt, Mycobacterium tuberculosis H37Rv
gcggccaucgggauggacac

SEQ ID NO: 1360959 - RNA, 18 nt, Mycobacterium tuberculosis H37Rv
gcggccauaucgcccacc

SEQ ID NO: 1360960 - RNA, 15 nt, Mycobacterium tuberculosis H37Rv
gcggccaggucgguc

SEQ ID NO: 1360961 - RNA, 15 nt, Mycobacterium tuberculosis H37Rv
gcggccagggcgucg

SEQ ID NO: 1360962 - RNA, 18 nt, Mycobacterium tuberculosis H37Rv
gcggccaucccgcguucg

SEQ ID NO: 1360963 - RNA, 18 nt, Mycobacterium tuberculosis H37Rv
gcggagcucacgccgggu

SEQ ID NO: 1360964 - RNA, 13 nt, Mycobacterium tuberculosis H37Rv
gcggaggccgccu

SEQ ID NO: 1360965 - RNA, 17 nt, Mycobacterium tuberculosis H37Rv
gcggagccgggugaggc

SEQ ID NO: 1360966 - RNA, 12 nt, Mycobacterium tuberculosis H37Rv
gcggagccggcg

SEQ ID NO: 1360967 - RNA, 17 nt, Mycobacterium tuberculosis H37Rv
gcggagagggcgaccaa

SEQ ID NO: 1360968 - RNA, 16 nt, Mycobacterium tuberculosis H37Rv
gcggagaaggcgcggg

SEQ ID NO: 1360969 - RNA, 17 nt, Mycobacterium tuberculosis H37Rv
gcggaggcugggcugag

SEQ ID NO: 1360970 - RNA, 13 nt, Mycobacterium tuberculosis H37Rv
gcggagggcgccu

SEQ ID NO: 1360971 - RNA, 13 nt, Mycobacterium tuberculosis H37Rv
gcggaggcugggc

SEQ ID NO: 1360972 - RNA, 20 nt, Mycobacterium tuberculosis H37Rv
gcggaguuuuucgggguggc

SEQ ID NO: 1360973 - RNA, 13 nt, Mycobacterium tuberculosis H37Rv
gcggagucaagca

SEQ ID NO: 1360974 - RNA, 16 nt, Mycobacterium tuberculosis H37Rv
gcggaguagccgcagc

SEQ ID NO: 1360975 - RNA, 20 nt, Mycobacterium tuberculosis H37Rv
gcggauagcggcaaagccgg

SEQ ID NO: 1360976 - RNA, 21 nt, Mycobacterium tuberculosis H37Rv
gcggauagcggcaaagccggg

SEQ ID NO: 1360977 - RNA, 19 nt, Mycobacterium tuberculosis H37Rv
gcggauagcaacggugcuc

SEQ ID NO: 1360978 - RNA, 16 nt, Mycobacterium tuberculosis H37Rv
gcggaucugguccagu

SEQ ID NO: 1360979 - RNA, 20 nt, Mycobacterium tuberculosis H37Rv
gcggaucugguccaguggga

SEQ ID NO: 1360980 - RNA, 10 nt, Mycobacterium tuberculosis H37Rv
gcggaucugu

SEQ ID NO: 1360981 - RNA, 16 nt, Mycobacterium tuberculosis H37Rv
gcggaucuugguguug

SEQ ID NO: 1360982 - RNA, 14 nt, Mycobacterium tuberculosis H37Rv
gcggaucaacaggc

SEQ ID NO: 1360983 - RNA, 17 nt, Mycobacterium tuberculosis H37Rv
gcggaucagcccgcgca

SEQ ID NO: 1360984 - RNA, 23 nt, Mycobacterium tuberculosis H37Rv
gcggauccaccacgcuggccucg

SEQ ID NO: 1360985 - RNA, 16 nt, Mycobacterium tuberculosis H37Rv
gcggaucaggucuggc

SEQ ID NO: 1360986 - RNA, 20 nt, Mycobacterium tuberculosis H37Rv
gcggauuaagucggcggccu

SEQ ID NO: 1360987 - RNA, 20 nt, Mycobacterium tuberculosis H37Rv
gcggaugcguuggccccagg

SEQ ID NO: 1360988 - RNA, 14 nt, Mycobacterium tuberculosis H37Rv
gcggauggccgccu

SEQ ID NO: 1360989 - RNA, 20 nt, Mycobacterium tuberculosis H37Rv
gcggcagcacccacaucagc

SEQ ID NO: 1360990 - RNA, 17 nt, Mycobacterium tuberculosis H37Rv
gcggcagccaagcgagc

SEQ ID NO: 1360991 - RNA, 13 nt, Mycobacterium tuberculosis H37Rv
gcggcaccagcac

SEQ ID NO: 1360992 - RNA, 13 nt, Mycobacterium tuberculosis H37Rv
gcggcacacccau

SEQ ID NO: 1360993 - RNA, 14 nt, Mycobacterium tuberculosis H37Rv
gcgcucccgccggc

SEQ ID NO: 1360994 - RNA, 19 nt, Mycobacterium tuberculosis H37Rv
gcgcucccguacgccggcg

SEQ ID NO: 1360995 - RNA, 19 nt, Mycobacterium tuberculosis H37Rv
gcgcuccggcgcgacgccc

SEQ ID NO: 1360996 - RNA, 22 nt, Mycobacterium tuberculosis H37Rv
gcgcugaaucaccccggcggcc

SEQ ID NO: 1360997 - RNA, 17 nt, Mycobacterium tuberculosis H37Rv
gcgcugaagcccauggc

SEQ ID NO: 1360998 - RNA, 21 nt, Mycobacterium tuberculosis H37Rv
gcgcugaaucaccccggcggc

SEQ ID NO: 1360999 - RNA, 16 nt, Mycobacterium tuberculosis H37Rv
gcgcuuccaucgccac

SEQ ID NO: 1361000 - RNA, 16 nt, Mycobacterium tuberculosis H37Rv
gcgcuugaccccgccg

SEQ ID NO: 1361001 - RNA, 22 nt, Mycobacterium tuberculosis H37Rv
gcgcuugaccccgccgaacggc

SEQ ID NO: 1361002 - RNA, 16 nt, Mycobacterium tuberculosis H37Rv
gcgcuugcgaucgccg

SEQ ID NO: 1361003 - RNA, 13 nt, Mycobacterium tuberculosis H37Rv
gcgcuugcggccg

SEQ ID NO: 1361004 - RNA, 23 nt, Mycobacterium tuberculosis H37Rv
gcggacauccgggccgagcgcac

SEQ ID NO: 1361005 - RNA, 13 nt, Mycobacterium tuberculosis H37Rv
gcggacaguuccc

SEQ ID NO: 1361006 - RNA, 13 nt, Mycobacterium tuberculosis H37Rv
gcggacagguagu

SEQ ID NO: 1361007 - RNA, 17 nt, Mycobacterium tuberculosis H37Rv
gcggacuuggcggucgg

SEQ ID NO: 1361008 - RNA, 18 nt, Mycobacterium tuberculosis H37Rv
gcggagacgaucgccagg

SEQ ID NO: 1361009 - RNA, 18 nt, Mycobacterium tuberculosis H37Rv
gcggagacggcggccaug

SEQ ID NO: 1361010 - RNA, 22 nt, Mycobacterium tuberculosis H37Rv
gcggacugagagauggucgggc

SEQ ID NO: 1361011 - RNA, 21 nt, Mycobacterium tuberculosis H37Rv
gcggacucgagucugcgcaga

SEQ ID NO: 1361012 - RNA, 15 nt, Mycobacterium tuberculosis H37Rv
gcggacucgggcagg

SEQ ID NO: 1361013 - RNA, 16 nt, Mycobacterium tuberculosis H37Rv
gcggagaaaagcgcgc

SEQ ID NO: 1361014 - RNA, 18 nt, Mycobacterium tuberculosis H37Rv
gcggagaacaucccccgg

SEQ ID NO: 1361015 - RNA, 21 nt, Mycobacterium tuberculosis H37Rv
gcggagaacgcgucgcgcgcc

SEQ ID NO: 1361016 - RNA, 22 nt, Mycobacterium tuberculosis H37Rv
gcggagaacgcgucgcgcgccu

SEQ ID NO: 1361017 - RNA, 23 nt, Mycobacterium tuberculosis H37Rv
gcggacaaaagaacgccaguucg

SEQ ID NO: 1361018 - RNA, 22 nt, Mycobacterium tuberculosis H37Rv
gcgcuugcugcauguccucccc

SEQ ID NO: 1361019 - RNA, 19 nt, Mycobacterium tuberculosis H37Rv
gcgcuuguugaccucacgg

SEQ ID NO: 1361020 - RNA, 20 nt, Mycobacterium tuberculosis H37Rv
gcguccaacccaggguggcg

SEQ ID NO: 1361021 - RNA, 21 nt, Mycobacterium tuberculosis H37Rv
gcgucauucaccgcguugaug

SEQ ID NO: 1361022 - RNA, 22 nt, Mycobacterium tuberculosis H37Rv
gcguccaggccagggcgguggc

SEQ ID NO: 1361023 - RNA, 16 nt, Mycobacterium tuberculosis H37Rv
gcguccaggugcgccg

SEQ ID NO: 1361024 - RNA, 20 nt, Mycobacterium tuberculosis H37Rv
gcguccagcaaaugcggcgc

SEQ ID NO: 1361025 - RNA, 15 nt, Mycobacterium tuberculosis H37Rv
gcguccagcgcggcc

SEQ ID NO: 1361026 - RNA, 16 nt, Mycobacterium tuberculosis H37Rv
gcguccgcccagcacc

SEQ ID NO: 1361027 - RNA, 16 nt, Mycobacterium tuberculosis H37Rv
gcguccgcccagccgc

SEQ ID NO: 1361028 - RNA, 14 nt, Mycobacterium tuberculosis H37Rv
gcguccccagcgcc

SEQ ID NO: 1361029 - RNA, 15 nt, Mycobacterium tuberculosis H37Rv
gcguccccaugcagc

SEQ ID NO: 1361030 - RNA, 14 nt, Mycobacterium tuberculosis H37Rv
gcgucccgccgcac

SEQ ID NO: 1361031 - RNA, 20 nt, Mycobacterium tuberculosis H37Rv
gcgucccggcggucagcggc

SEQ ID NO: 1361032 - RNA, 14 nt, Mycobacterium tuberculosis H37Rv
gcguccaucgccac

SEQ ID NO: 1361033 - RNA, 15 nt, Mycobacterium tuberculosis H37Rv
gcguccucgccgcac

SEQ ID NO: 1361034 - RNA, 12 nt, Mycobacterium tuberculosis H37Rv
gcguccuccucg

SEQ ID NO: 1361035 - RNA, 15 nt, Mycobacterium tuberculosis H37Rv
gcguccgggcagccg

SEQ ID NO: 1361036 - RNA, 16 nt, Mycobacterium tuberculosis H37Rv
gcguccgggcagccgc

SEQ ID NO: 1361037 - RNA, 13 nt, Mycobacterium tuberculosis H37Rv
gcguccggugcug

SEQ ID NO: 1361038 - RNA, 15 nt, Mycobacterium tuberculosis H37Rv
gcguccggugcuggu

SEQ ID NO: 1361039 - RNA, 15 nt, Mycobacterium tuberculosis H37Rv
gcgucgaagccgggg

SEQ ID NO: 1361040 - RNA, 13 nt, Mycobacterium tuberculosis H37Rv
gcgucgaacacgu

SEQ ID NO: 1361041 - RNA, 19 nt, Mycobacterium tuberculosis H37Rv
gcgucgaacugggcgcccg

SEQ ID NO: 1361042 - RNA, 16 nt, Mycobacterium tuberculosis H37Rv
gcguccuugcgcagca

SEQ ID NO: 1361043 - RNA, 20 nt, Mycobacterium tuberculosis H37Rv
gcguccuuuuccgccgggcu

SEQ ID NO: 1361044 - RNA, 15 nt, Mycobacterium tuberculosis H37Rv
gcgucgacgagcggc

SEQ ID NO: 1361045 - RNA, 14 nt, Mycobacterium tuberculosis H37Rv
gcgucgacacaccc

SEQ ID NO: 1361046 - RNA, 12 nt, Mycobacterium tuberculosis H37Rv
gcgucgccgccg

SEQ ID NO: 1361047 - RNA, 16 nt, Mycobacterium tuberculosis H37Rv
gcgucgccgccgggca

SEQ ID NO: 1361048 - RNA, 20 nt, Mycobacterium tuberculosis H37Rv
gcgucgcaacccggccugga

SEQ ID NO: 1361049 - RNA, 23 nt, Mycobacterium tuberculosis H37Rv
gcgucgaguuuugcggccagggc

SEQ ID NO: 1361050 - RNA, 24 nt, Mycobacterium tuberculosis H37Rv
gcgucgaguuuugcggccagggcg

SEQ ID NO: 1361051 - RNA, 22 nt, Mycobacterium tuberculosis H37Rv
gcgucgaugagguucaucgccg

SEQ ID NO: 1361052 - RNA, 12 nt, Mycobacterium tuberculosis H37Rv
gcgucgaugccg

SEQ ID NO: 1361053 - RNA, 22 nt, Mycobacterium tuberculosis H37Rv
gcgucgagccggauucggcugc

SEQ ID NO: 1361054 - RNA, 21 nt, Mycobacterium tuberculosis H37Rv
gcgucgagcgacccccagcgc

SEQ ID NO: 1361055 - RNA, 16 nt, Mycobacterium tuberculosis H37Rv
gcgucgacaacacgcc

SEQ ID NO: 1361056 - RNA, 23 nt, Mycobacterium tuberculosis H37Rv
gcgucgagcaccuuggggugggc

SEQ ID NO: 1361057 - RNA, 15 nt, Mycobacterium tuberculosis H37Rv
gcgucaggccagcgc

SEQ ID NO: 1361058 - RNA, 13 nt, Mycobacterium tuberculosis H37Rv
gcgucagcgcggc

SEQ ID NO: 1361059 - RNA, 16 nt, Mycobacterium tuberculosis H37Rv
gcgucagugcagaaga

SEQ ID NO: 1361060 - RNA, 19 nt, Mycobacterium tuberculosis H37Rv
gcgucacguaauuccccag

SEQ ID NO: 1361061 - RNA, 15 nt, Mycobacterium tuberculosis H37Rv
gcgucaacgcuguug

SEQ ID NO: 1361062 - RNA, 20 nt, Mycobacterium tuberculosis H37Rv
gcguacuucgcuggaaaccu

SEQ ID NO: 1361063 - RNA, 15 nt, Mycobacterium tuberculosis H37Rv
gcguagagcagcagc

SEQ ID NO: 1361064 - RNA, 22 nt, Mycobacterium tuberculosis H37Rv
gcguagcgggggagcgaacggc

SEQ ID NO: 1361065 - RNA, 21 nt, Mycobacterium tuberculosis H37Rv
gcguagcccacccgggugggc

SEQ ID NO: 1361066 - RNA, 13 nt, Mycobacterium tuberculosis H37Rv
gcguagcaggucg

SEQ ID NO: 1361067 - RNA, 15 nt, Mycobacterium tuberculosis H37Rv
gcguagcaacccagg

SEQ ID NO: 1361068 - RNA, 18 nt, Mycobacterium tuberculosis H37Rv
gcguagucggcggugcag

SEQ ID NO: 1361069 - RNA, 12 nt, Mycobacterium tuberculosis H37Rv
gcguagggccag

SEQ ID NO: 1361070 - RNA, 15 nt, Mycobacterium tuberculosis H37Rv
gcguagggccagcgc

SEQ ID NO: 1361071 - RNA, 13 nt, Mycobacterium tuberculosis H37Rv
gcguaggccagcg

SEQ ID NO: 1361072 - RNA, 22 nt, Mycobacterium tuberculosis H37Rv
gcguauagcaugccgcggcgga

SEQ ID NO: 1361073 - RNA, 17 nt, Mycobacterium tuberculosis H37Rv
gcguaucccgugugcgg

SEQ ID NO: 1361074 - RNA, 17 nt, Mycobacterium tuberculosis H37Rv
gcguaugcccacgaacc

SEQ ID NO: 1361075 - RNA, 23 nt, Mycobacterium tuberculosis H37Rv
gcgugcucgccguaagcaccagc

SEQ ID NO: 1361076 - RNA, 16 nt, Mycobacterium tuberculosis H37Rv
gcgugcugcggcuggu

SEQ ID NO: 1361077 - RNA, 15 nt, Mycobacterium tuberculosis H37Rv
gcgugcugccgccuu

SEQ ID NO: 1361078 - RNA, 15 nt, Mycobacterium tuberculosis H37Rv
gcguggaaaccggug

SEQ ID NO: 1361079 - RNA, 14 nt, Mycobacterium tuberculosis H37Rv
gcgugcugugcuca

SEQ ID NO: 1361080 - RNA, 13 nt, Mycobacterium tuberculosis H37Rv
gcgugcuugagca

SEQ ID NO: 1361081 - RNA, 15 nt, Mycobacterium tuberculosis H37Rv
gcguggaucuuggcc

SEQ ID NO: 1361082 - RNA, 13 nt, Mycobacterium tuberculosis H37Rv
gcgugcgccgggg

SEQ ID NO: 1361083 - RNA, 14 nt, Mycobacterium tuberculosis H37Rv
gcgugcggcugcca

SEQ ID NO: 1361084 - RNA, 15 nt, Mycobacterium tuberculosis H37Rv
gcgugcgggggacgg

SEQ ID NO: 1361085 - RNA, 15 nt, Mycobacterium tuberculosis H37Rv
gcgugccgcagcggc

SEQ ID NO: 1361086 - RNA, 13 nt, Mycobacterium tuberculosis H37Rv
gcgugccgcagcg

SEQ ID NO: 1361087 - RNA, 21 nt, Mycobacterium tuberculosis H37Rv
gcgugcgauucugcgucugcu

SEQ ID NO: 1361088 - RNA, 13 nt, Mycobacterium tuberculosis H37Rv
gcgugcgcaaggc

SEQ ID NO: 1361089 - RNA, 16 nt, Mycobacterium tuberculosis H37Rv
gcgugcacaggucagc

SEQ ID NO: 1361090 - RNA, 18 nt, Mycobacterium tuberculosis H37Rv
gcgugaucuggccacggc

SEQ ID NO: 1361091 - RNA, 17 nt, Mycobacterium tuberculosis H37Rv
gcgugagcugcucgagc

SEQ ID NO: 1361092 - RNA, 21 nt, Mycobacterium tuberculosis H37Rv
gcgugaucuggccgaagcccg

SEQ ID NO: 1361093 - RNA, 14 nt, Mycobacterium tuberculosis H37Rv
gcgugcccgccggc

SEQ ID NO: 1361094 - RNA, 22 nt, Mycobacterium tuberculosis H37Rv
gcgugccgacccgcuucgcccg

SEQ ID NO: 1361095 - RNA, 21 nt, Mycobacterium tuberculosis H37Rv
gcgugcagaucacgggugugc

SEQ ID NO: 1361096 - RNA, 17 nt, Mycobacterium tuberculosis H37Rv
gcgugacguaccacggc

SEQ ID NO: 1361097 - RNA, 17 nt, Mycobacterium tuberculosis H37Rv
gcgugacgaccagcccc

SEQ ID NO: 1361098 - RNA, 22 nt, Mycobacterium tuberculosis H37Rv
gcgucguaaacgucggucgggg

SEQ ID NO: 1361099 - RNA, 16 nt, Mycobacterium tuberculosis H37Rv
gcgucggugagcgcgu

SEQ ID NO: 1361100 - RNA, 14 nt, Mycobacterium tuberculosis H37Rv
gcgucgggccgcaa

SEQ ID NO: 1361101 - RNA, 17 nt, Mycobacterium tuberculosis H37Rv
gcgucguagcgcucgug

SEQ ID NO: 1361102 - RNA, 15 nt, Mycobacterium tuberculosis H37Rv
gcgucgucgccggcg

SEQ ID NO: 1361103 - RNA, 21 nt, Mycobacterium tuberculosis H37Rv
gcgucgucggcgggcugcagu

SEQ ID NO: 1361104 - RNA, 21 nt, Mycobacterium tuberculosis H37Rv
gcgucgccggccccgccggcg

SEQ ID NO: 1361105 - RNA, 15 nt, Mycobacterium tuberculosis H37Rv
gcgucgcuacgcaac

SEQ ID NO: 1361106 - RNA, 17 nt, Mycobacterium tuberculosis H37Rv
gcgucggcgcccagcuc

SEQ ID NO: 1361107 - RNA, 18 nt, Mycobacterium tuberculosis H37Rv
gcgucggcgcccagcucg

SEQ ID NO: 1361108 - RNA, 16 nt, Mycobacterium tuberculosis H37Rv
gcgucggcccggugcu

SEQ ID NO: 1361109 - RNA, 13 nt, Mycobacterium tuberculosis H37Rv
gcgucggccaccg

SEQ ID NO: 1361110 - RNA, 21 nt, Mycobacterium tuberculosis H37Rv
gcgucuuccucggccacccgc

SEQ ID NO: 1361111 - RNA, 20 nt, Mycobacterium tuberculosis H37Rv
gcgucuucggucgcggccuc

SEQ ID NO: 1361112 - RNA, 19 nt, Mycobacterium tuberculosis H37Rv
gcgucuuccucggccaccc

SEQ ID NO: 1361113 - RNA, 18 nt, Mycobacterium tuberculosis H37Rv
gcgucuuccucggccacc

SEQ ID NO: 1361114 - RNA, 15 nt, Mycobacterium tuberculosis H37Rv
gcgucugagcgagcu

SEQ ID NO: 1361115 - RNA, 22 nt, Mycobacterium tuberculosis H37Rv
gcgucugcgaucccgaucgcgc

SEQ ID NO: 1361116 - RNA, 14 nt, Mycobacterium tuberculosis H37Rv
gcgucugcucgcca

SEQ ID NO: 1361117 - RNA, 16 nt, Mycobacterium tuberculosis H37Rv
gcgucugcucgccagg

SEQ ID NO: 1361118 - RNA, 18 nt, Mycobacterium tuberculosis H37Rv
gcgucugcucgccaggcc

SEQ ID NO: 1361119 - RNA, 15 nt, Mycobacterium tuberculosis H37Rv
gcgucugcucgccgg

SEQ ID NO: 1361120 - RNA, 20 nt, Mycobacterium tuberculosis H37Rv
gcgucugcucgcgcagccgg

SEQ ID NO: 1361121 - RNA, 22 nt, Mycobacterium tuberculosis H37Rv
gcgucugcucgcgcagccgggu

SEQ ID NO: 1361122 - RNA, 16 nt, Mycobacterium tuberculosis H37Rv
gcgucugcucgcgccc

SEQ ID NO: 1361123 - RNA, 22 nt, Mycobacterium tuberculosis H37Rv
gcgucugcucgcgccggugagg

SEQ ID NO: 1361124 - RNA, 17 nt, Mycobacterium tuberculosis H37Rv
gcgucuccacuuucugc

SEQ ID NO: 1361125 - RNA, 16 nt, Mycobacterium tuberculosis H37Rv
gcgucuccagcugggu

SEQ ID NO: 1361126 - RNA, 19 nt, Mycobacterium tuberculosis H37Rv
gcgucguucggagcccuga

SEQ ID NO: 1361127 - RNA, 22 nt, Mycobacterium tuberculosis H37Rv
gcgucgucgguaaugccgggcc

SEQ ID NO: 1361128 - RNA, 16 nt, Mycobacterium tuberculosis H37Rv
gcgucguuugggugcg

SEQ ID NO: 1361129 - RNA, 20 nt, Mycobacterium tuberculosis H37Rv
gcgucguugucgucgccggc

SEQ ID NO: 1361130 - RNA, 14 nt, Mycobacterium tuberculosis H37Rv
gcgucuccuugagc

SEQ ID NO: 1361131 - RNA, 13 nt, Mycobacterium tuberculosis H37Rv
gcgucugagcgcc

SEQ ID NO: 1361132 - RNA, 16 nt, Mycobacterium tuberculosis H37Rv
gcgucugagcgccggc

SEQ ID NO: 1361133 - RNA, 18 nt, Mycobacterium tuberculosis H37Rv
gcgucucgccgggaaaca

SEQ ID NO: 1361134 - RNA, 17 nt, Mycobacterium tuberculosis H37Rv
gcgggcccgcgcggcgg

SEQ ID NO: 1361135 - RNA, 18 nt, Mycobacterium tuberculosis H37Rv
gcgggcccggcggccagc

SEQ ID NO: 1361136 - RNA, 23 nt, Mycobacterium tuberculosis H37Rv
gcgggccgagaucacgccgggcg

SEQ ID NO: 1361137 - RNA, 21 nt, Mycobacterium tuberculosis H37Rv
gcgggccgcgucgaacugggc

SEQ ID NO: 1361138 - RNA, 11 nt, Mycobacterium tuberculosis H37Rv
gcgggccgcga

SEQ ID NO: 1361139 - RNA, 22 nt, Mycobacterium tuberculosis H37Rv
gcgggcccucuaugcgggcagc

SEQ ID NO: 1361140 - RNA, 21 nt, Mycobacterium tuberculosis H37Rv
gcgggccgaacacaccgggcg

SEQ ID NO: 1361141 - RNA, 14 nt, Mycobacterium tuberculosis H37Rv
gcgggccgccgcaa

SEQ ID NO: 1361142 - RNA, 14 nt, Mycobacterium tuberculosis H37Rv
gcgggccuccugcu

SEQ ID NO: 1361143 - RNA, 13 nt, Mycobacterium tuberculosis H37Rv
gcgggcgcgggug

SEQ ID NO: 1361144 - RNA, 24 nt, Mycobacterium tuberculosis H37Rv
gcgggcgcggguggcgccaguucg

SEQ ID NO: 1361145 - RNA, 14 nt, Mycobacterium tuberculosis H37Rv
gcgggcagccgccc

SEQ ID NO: 1361146 - RNA, 17 nt, Mycobacterium tuberculosis H37Rv
gcgggcacucagcaggg

SEQ ID NO: 1361147 - RNA, 13 nt, Mycobacterium tuberculosis H37Rv
gcgggcagcaggc

SEQ ID NO: 1361148 - RNA, 18 nt, Mycobacterium tuberculosis H37Rv
gcgggcaguagcuguggc

SEQ ID NO: 1361149 - RNA, 19 nt, Mycobacterium tuberculosis H37Rv
gcgggcaguagcuguggcc

SEQ ID NO: 1361150 - RNA, 23 nt, Mycobacterium tuberculosis H37Rv
gcgggcaguagcuguggcccgcg

SEQ ID NO: 1361151 - RNA, 19 nt, Mycobacterium tuberculosis H37Rv
gcgggcagccgcccgccag

SEQ ID NO: 1361152 - RNA, 18 nt, Mycobacterium tuberculosis H37Rv
gcgggcaaccacaucacc

SEQ ID NO: 1361153 - RNA, 15 nt, Mycobacterium tuberculosis H37Rv
gcgggcaacgcagca

SEQ ID NO: 1361154 - RNA, 16 nt, Mycobacterium tuberculosis H37Rv
gcgggcaaucaccgcc

SEQ ID NO: 1361155 - RNA, 19 nt, Mycobacterium tuberculosis H37Rv
gcgggcaaucaccgccggc

SEQ ID NO: 1361156 - RNA, 20 nt, Mycobacterium tuberculosis H37Rv
gcgggcaaucaccgccggcg

SEQ ID NO: 1361157 - RNA, 22 nt, Mycobacterium tuberculosis H37Rv
gcgggcaaucaccgccggcggc

SEQ ID NO: 1361158 - RNA, 15 nt, Mycobacterium tuberculosis H37Rv
gcgggauugcgcgcu

SEQ ID NO: 1361159 - RNA, 20 nt, Mycobacterium tuberculosis H37Rv
gcgggcaacugcagcauggc

SEQ ID NO: 1361160 - RNA, 15 nt, Mycobacterium tuberculosis H37Rv
gcgggauugccgaga

SEQ ID NO: 1361161 - RNA, 15 nt, Mycobacterium tuberculosis H37Rv
gcggcuggucucugg

SEQ ID NO: 1361162 - RNA, 18 nt, Mycobacterium tuberculosis H37Rv
gcggcgcgaagucuugac

SEQ ID NO: 1361163 - RNA, 15 nt, Mycobacterium tuberculosis H37Rv
gcggcgccggugggc

SEQ ID NO: 1361164 - RNA, 15 nt, Mycobacterium tuberculosis H37Rv
gcggcgccggggggc

SEQ ID NO: 1361165 - RNA, 22 nt, Mycobacterium tuberculosis H37Rv
gcggcgccggggggcugcugcu

SEQ ID NO: 1361166 - RNA, 17 nt, Mycobacterium tuberculosis H37Rv
gcggcgccggugggcgg

SEQ ID NO: 1361167 - RNA, 12 nt, Mycobacterium tuberculosis H37Rv
gcggcgccguug

SEQ ID NO: 1361168 - RNA, 15 nt, Mycobacterium tuberculosis H37Rv
gcggcgcacaacccg

SEQ ID NO: 1361169 - RNA, 18 nt, Mycobacterium tuberculosis H37Rv
gcggcgccgcagaucacc

SEQ ID NO: 1361170 - RNA, 17 nt, Mycobacterium tuberculosis H37Rv
gcggcuguugcggcggc

SEQ ID NO: 1361171 - RNA, 19 nt, Mycobacterium tuberculosis H37Rv
gcggcuguugcggcggcgc

SEQ ID NO: 1361172 - RNA, 16 nt, Mycobacterium tuberculosis H37Rv
gcggcuguugcggcgg

SEQ ID NO: 1361173 - RNA, 17 nt, Mycobacterium tuberculosis H37Rv
gcggcugguguccagcc

SEQ ID NO: 1361174 - RNA, 22 nt, Mycobacterium tuberculosis H37Rv
gcggcugguguccagccaggcg

SEQ ID NO: 1361175 - RNA, 12 nt, Mycobacterium tuberculosis H37Rv
gcgggaugacgg

SEQ ID NO: 1361176 - RNA, 15 nt, Mycobacterium tuberculosis H37Rv
gcgggaugcgcgccc

SEQ ID NO: 1361177 - RNA, 15 nt, Mycobacterium tuberculosis H37Rv
gcgggaucgguggcg

SEQ ID NO: 1361178 - RNA, 22 nt, Mycobacterium tuberculosis H37Rv
gcgggauccucgaaggcguucg

SEQ ID NO: 1361179 - RNA, 19 nt, Mycobacterium tuberculosis H37Rv
gcgggaguucggggugcgc

SEQ ID NO: 1361180 - RNA, 21 nt, Mycobacterium tuberculosis H37Rv
gcgggguaggcccagcaaccg

SEQ ID NO: 1361181 - RNA, 12 nt, Mycobacterium tuberculosis H37Rv
gcgggggugggc

SEQ ID NO: 1361182 - RNA, 12 nt, Mycobacterium tuberculosis H37Rv
gcgggggcggcg

SEQ ID NO: 1361183 - RNA, 15 nt, Mycobacterium tuberculosis H37Rv
gcgggggaccccgcc

SEQ ID NO: 1361184 - RNA, 20 nt, Mycobacterium tuberculosis H37Rv
gcgggggaguaguggugggc

SEQ ID NO: 1361185 - RNA, 18 nt, Mycobacterium tuberculosis H37Rv
gcggggugugcgguugcu

SEQ ID NO: 1361186 - RNA, 15 nt, Mycobacterium tuberculosis H37Rv
gcggggugcgcccac

SEQ ID NO: 1361187 - RNA, 14 nt, Mycobacterium tuberculosis H37Rv
gcggggugcucagc

SEQ ID NO: 1361188 - RNA, 21 nt, Mycobacterium tuberculosis H37Rv
gcgggcgggucugggugguga

SEQ ID NO: 1361189 - RNA, 16 nt, Mycobacterium tuberculosis H37Rv
gcgggcgggucugggu

SEQ ID NO: 1361190 - RNA, 18 nt, Mycobacterium tuberculosis H37Rv
gcgggcggaucgccgggg

SEQ ID NO: 1361191 - RNA, 13 nt, Mycobacterium tuberculosis H37Rv
gcgggcggcaccg

SEQ ID NO: 1361192 - RNA, 22 nt, Mycobacterium tuberculosis H37Rv
gcgggcgcuugccggggugugc

SEQ ID NO: 1361193 - RNA, 13 nt, Mycobacterium tuberculosis H37Rv
gcggggccggccg

SEQ ID NO: 1361194 - RNA, 15 nt, Mycobacterium tuberculosis H37Rv
gcggggcgaucccca

SEQ ID NO: 1361195 - RNA, 22 nt, Mycobacterium tuberculosis H37Rv
gcgggcgguccaaaacaccgcc

SEQ ID NO: 1361196 - RNA, 21 nt, Mycobacterium tuberculosis H37Rv
gcggggccgccgcggccggcg

SEQ ID NO: 1361197 - RNA, 13 nt, Mycobacterium tuberculosis H37Rv
gcggggccggucg

SEQ ID NO: 1361198 - RNA, 17 nt, Mycobacterium tuberculosis H37Rv
gcgguaccuagccgcag

SEQ ID NO: 1361199 - RNA, 23 nt, Mycobacterium tuberculosis H37Rv
gcgguaccggaaucggcggcgga

SEQ ID NO: 1361200 - RNA, 16 nt, Mycobacterium tuberculosis H37Rv
gcgguaccgcucgggc

SEQ ID NO: 1361201 - RNA, 19 nt, Mycobacterium tuberculosis H37Rv
gcgguaccgccgcggucgg

SEQ ID NO: 1361202 - RNA, 18 nt, Mycobacterium tuberculosis H37Rv
gcggguucggacgagguc

SEQ ID NO: 1361203 - RNA, 18 nt, Mycobacterium tuberculosis H37Rv
gcggguggcgccaguucg

SEQ ID NO: 1361204 - RNA, 23 nt, Mycobacterium tuberculosis H37Rv
gcgggugggacaccaucuccgcc

SEQ ID NO: 1361205 - RNA, 13 nt, Mycobacterium tuberculosis H37Rv
gcggguggccggg

SEQ ID NO: 1361206 - RNA, 20 nt, Mycobacterium tuberculosis H37Rv
gcggguguuccacaccaggc

SEQ ID NO: 1361207 - RNA, 12 nt, Mycobacterium tuberculosis H37Rv
gcggguggugcc

SEQ ID NO: 1361208 - RNA, 15 nt, Mycobacterium tuberculosis H37Rv
gcggguggugccagg

SEQ ID NO: 1361209 - RNA, 18 nt, Mycobacterium tuberculosis H37Rv
gcggguggugccaggucg

SEQ ID NO: 1361210 - RNA, 19 nt, Mycobacterium tuberculosis H37Rv
gcgggugguuugcgcccug

SEQ ID NO: 1361211 - RNA, 17 nt, Mycobacterium tuberculosis H37Rv
gcgguagcugcccagcg

SEQ ID NO: 1361212 - RNA, 21 nt, Mycobacterium tuberculosis H37Rv
gcgguagcuuccgcgacgcuc

SEQ ID NO: 1361213 - RNA, 18 nt, Mycobacterium tuberculosis H37Rv
gcgguaggagcggguggc

SEQ ID NO: 1361214 - RNA, 21 nt, Mycobacterium tuberculosis H37Rv
gcgguaggcuugcaaggucgc

SEQ ID NO: 1361215 - RNA, 19 nt, Mycobacterium tuberculosis H37Rv
gcgguagcggaccugcgag

SEQ ID NO: 1361216 - RNA, 20 nt, Mycobacterium tuberculosis H37Rv
gcgguagcgauuccaggaug

SEQ ID NO: 1361217 - RNA, 23 nt, Mycobacterium tuberculosis H37Rv
gcgguagcggaccugcgagaucg

SEQ ID NO: 1361218 - RNA, 17 nt, Mycobacterium tuberculosis H37Rv
gcgguagcucauugccg

SEQ ID NO: 1361219 - RNA, 14 nt, Mycobacterium tuberculosis H37Rv
gcgguagccgagcu

SEQ ID NO: 1361220 - RNA, 18 nt, Mycobacterium tuberculosis H37Rv
gcgguacgccggucggug

SEQ ID NO: 1361221 - RNA, 22 nt, Mycobacterium tuberculosis H37Rv
gcggucagcagcgccgucagca

SEQ ID NO: 1361222 - RNA, 16 nt, Mycobacterium tuberculosis H37Rv
gcgguagucggccagc

SEQ ID NO: 1361223 - RNA, 18 nt, Mycobacterium tuberculosis H37Rv
gcggucaucgcguccaug

SEQ ID NO: 1361224 - RNA, 19 nt, Mycobacterium tuberculosis H37Rv
gcggucaucgagcugaccu

SEQ ID NO: 1361225 - RNA, 20 nt, Mycobacterium tuberculosis H37Rv
gcgguccaacagcgccagua

SEQ ID NO: 1361226 - RNA, 15 nt, Mycobacterium tuberculosis H37Rv
gcggucgcccaggcc

SEQ ID NO: 1361227 - RNA, 22 nt, Mycobacterium tuberculosis H37Rv
gcggucggcagcgacgccggcc

SEQ ID NO: 1361228 - RNA, 13 nt, Mycobacterium tuberculosis H37Rv
gcggucgcugaug

SEQ ID NO: 1361229 - RNA, 17 nt, Mycobacterium tuberculosis H37Rv
gcggucggccaccaacu

SEQ ID NO: 1361230 - RNA, 15 nt, Mycobacterium tuberculosis H37Rv
gcggucgugaucagc

SEQ ID NO: 1361231 - RNA, 18 nt, Mycobacterium tuberculosis H37Rv
gcggucugcgccuucgcc

SEQ ID NO: 1361232 - RNA, 17 nt, Mycobacterium tuberculosis H37Rv
gcggucccaugugcccg

SEQ ID NO: 1361233 - RNA, 16 nt, Mycobacterium tuberculosis H37Rv
gcggucccgcggaccg

SEQ ID NO: 1361234 - RNA, 18 nt, Mycobacterium tuberculosis H37Rv
gcgguccaggccggcacc

SEQ ID NO: 1361235 - RNA, 17 nt, Mycobacterium tuberculosis H37Rv
gcgguccagccaccgcc

SEQ ID NO: 1361236 - RNA, 22 nt, Mycobacterium tuberculosis H37Rv
gcgguccagaaugucgcgggug

SEQ ID NO: 1361237 - RNA, 13 nt, Mycobacterium tuberculosis H37Rv
gcgguccagaaug

SEQ ID NO: 1361238 - RNA, 17 nt, Mycobacterium tuberculosis H37Rv
gcggucgagccacccac

SEQ ID NO: 1361239 - RNA, 14 nt, Mycobacterium tuberculosis H37Rv
gcggucgagauguc

SEQ ID NO: 1361240 - RNA, 19 nt, Mycobacterium tuberculosis H37Rv
gcggucgaagaccaagagc

SEQ ID NO: 1361241 - RNA, 16 nt, Mycobacterium tuberculosis H37Rv
gcggucgccaagaucg

SEQ ID NO: 1361242 - RNA, 18 nt, Mycobacterium tuberculosis H37Rv
gcggucgcccgcuaccaa

SEQ ID NO: 1361243 - RNA, 19 nt, Mycobacterium tuberculosis H37Rv
gcggucgauguccgcagca

SEQ ID NO: 1361244 - RNA, 17 nt, Mycobacterium tuberculosis H37Rv
gcggucgcagcagacca

SEQ ID NO: 1361245 - RNA, 21 nt, Mycobacterium tuberculosis H37Rv
gcgguggccacccggccgcgc

SEQ ID NO: 1361246 - RNA, 19 nt, Mycobacterium tuberculosis H37Rv
gcggugcugguggcggcac

SEQ ID NO: 1361247 - RNA, 19 nt, Mycobacterium tuberculosis H37Rv
gcggugcgggcuucaacac

SEQ ID NO: 1361248 - RNA, 23 nt, Mycobacterium tuberculosis H37Rv
gcggugcggcacgccggccgcgc

SEQ ID NO: 1361249 - RNA, 12 nt, Mycobacterium tuberculosis H37Rv
gcggugcggcca

SEQ ID NO: 1361250 - RNA, 17 nt, Mycobacterium tuberculosis H37Rv
gcggugcccgcaccaga

SEQ ID NO: 1361251 - RNA, 22 nt, Mycobacterium tuberculosis H37Rv
gcggugccaccagugagcccgc

SEQ ID NO: 1361252 - RNA, 23 nt, Mycobacterium tuberculosis H37Rv
gcggugccacggugacccuggug

SEQ ID NO: 1361253 - RNA, 16 nt, Mycobacterium tuberculosis H37Rv
gcggugaugggccagg

SEQ ID NO: 1361254 - RNA, 17 nt, Mycobacterium tuberculosis H37Rv
gcggugauugacaacaa

SEQ ID NO: 1361255 - RNA, 15 nt, Mycobacterium tuberculosis H37Rv
gcggugaggucggug

SEQ ID NO: 1361256 - RNA, 16 nt, Mycobacterium tuberculosis H37Rv
gcggugaucggggucg

SEQ ID NO: 1361257 - RNA, 19 nt, Mycobacterium tuberculosis H37Rv
gcggugaauccgugcaggg

SEQ ID NO: 1361258 - RNA, 18 nt, Mycobacterium tuberculosis H37Rv
gcggugaacaccgccagc

SEQ ID NO: 1361259 - RNA, 21 nt, Mycobacterium tuberculosis H37Rv
gcggugaacuucuccaccagc

SEQ ID NO: 1361260 - RNA, 14 nt, Mycobacterium tuberculosis H37Rv
gcggugacguggug

SEQ ID NO: 1361261 - RNA, 17 nt, Mycobacterium tuberculosis H37Rv
gcggugacguggugggc

SEQ ID NO: 1361262 - RNA, 14 nt, Mycobacterium tuberculosis H37Rv
gcggugaccggguu

SEQ ID NO: 1361263 - RNA, 18 nt, Mycobacterium tuberculosis H37Rv
gcggugacgccagccugg

SEQ ID NO: 1361264 - RNA, 14 nt, Mycobacterium tuberculosis H37Rv
gcgguuggcggcga

SEQ ID NO: 1361265 - RNA, 13 nt, Mycobacterium tuberculosis H37Rv
gcgguuggugguu

SEQ ID NO: 1361266 - RNA, 21 nt, Mycobacterium tuberculosis H37Rv
gcggugugcacgucacgcgga

SEQ ID NO: 1361267 - RNA, 19 nt, Mycobacterium tuberculosis H37Rv
gcggugugcggcagcccgc

SEQ ID NO: 1361268 - RNA, 16 nt, Mycobacterium tuberculosis H37Rv
gcgguucgcauugggg

SEQ ID NO: 1361269 - RNA, 17 nt, Mycobacterium tuberculosis H37Rv
gcgguucgcugcggcgg

SEQ ID NO: 1361270 - RNA, 16 nt, Mycobacterium tuberculosis H37Rv
gcgguggucggcgcgc

SEQ ID NO: 1361271 - RNA, 18 nt, Mycobacterium tuberculosis H37Rv
gcgguggggcgcgccggc

SEQ ID NO: 1361272 - RNA, 22 nt, Mycobacterium tuberculosis H37Rv
gcgguggccagaucgaacgcag

SEQ ID NO: 1361273 - RNA, 18 nt, Mycobacterium tuberculosis H37Rv
gcgguggcuugccccgcc

SEQ ID NO: 1361274 - RNA, 17 nt, Mycobacterium tuberculosis H37Rv
gcgguggggcgcgccgg

SEQ ID NO: 1361275 - RNA, 13 nt, Mycobacterium tuberculosis H37Rv
gcgguggcggcgg

SEQ ID NO: 1361276 - RNA, 21 nt, Mycobacterium tuberculosis H37Rv
gcgguggcgucgucggcgggc

SEQ ID NO: 1361277 - RNA, 19 nt, Mycobacterium tuberculosis H37Rv
gcgguggcggugucggcgc

SEQ ID NO: 1361278 - RNA, 15 nt, Mycobacterium tuberculosis H37Rv
gcgguguugccggag

SEQ ID NO: 1361279 - RNA, 18 nt, Mycobacterium tuberculosis H37Rv
gcggugucgucgagguca

SEQ ID NO: 1361280 - RNA, 18 nt, Mycobacterium tuberculosis H37Rv
gcggugugcgcauggugg

SEQ ID NO: 1361281 - RNA, 22 nt, Mycobacterium tuberculosis H37Rv
gcgguggugguguaggaguaca

SEQ ID NO: 1361282 - RNA, 19 nt, Mycobacterium tuberculosis H37Rv
gcggugucacaacgcguga

SEQ ID NO: 1361283 - RNA, 20 nt, Mycobacterium tuberculosis H37Rv
gcgguguccuacuuuuccac

SEQ ID NO: 1361284 - RNA, 23 nt, Mycobacterium tuberculosis H37Rv
gcgguuuggaucacccgccgcgu

SEQ ID NO: 1361285 - RNA, 21 nt, Mycobacterium tuberculosis H37Rv
gcguaaaggccuugggcggca

SEQ ID NO: 1361286 - RNA, 20 nt, Mycobacterium tuberculosis H37Rv
gcguacaggccggccaccac

SEQ ID NO: 1361287 - RNA, 16 nt, Mycobacterium tuberculosis H37Rv
gcuaauaccugcggau

SEQ ID NO: 1361288 - RNA, 21 nt, Mycobacterium tuberculosis H37Rv
gcuaacgcaccugcgcgcggc

SEQ ID NO: 1361289 - RNA, 14 nt, Mycobacterium tuberculosis H37Rv
gcuaacuggcccgg

SEQ ID NO: 1361290 - RNA, 13 nt, Mycobacterium tuberculosis H37Rv
gcuaaacccccac

SEQ ID NO: 1361291 - RNA, 12 nt, Mycobacterium tuberculosis H37Rv
gcuaaccaugcu

SEQ ID NO: 1361292 - RNA, 13 nt, Mycobacterium tuberculosis H37Rv
gcuacuaugccaa

SEQ ID NO: 1361293 - RNA, 20 nt, Mycobacterium tuberculosis H37Rv
gcuacucacggugaucguuc

SEQ ID NO: 1361294 - RNA, 17 nt, Mycobacterium tuberculosis H37Rv
gcuacuaggcccagcac

SEQ ID NO: 1361295 - RNA, 18 nt, Mycobacterium tuberculosis H37Rv
gcuacggcgacacgccag

SEQ ID NO: 1361296 - RNA, 17 nt, Mycobacterium tuberculosis H37Rv
gcuacgcggccgagguc

SEQ ID NO: 1361297 - RNA, 13 nt, Mycobacterium tuberculosis H37Rv
gcuacgcgcgccc

SEQ ID NO: 1361298 - RNA, 19 nt, Mycobacterium tuberculosis H37Rv
gcuaccgcgcucccggcgu

SEQ ID NO: 1361299 - RNA, 17 nt, Mycobacterium tuberculosis H37Rv
gcuaccgcgcucccggc

SEQ ID NO: 1361300 - RNA, 16 nt, Mycobacterium tuberculosis H37Rv
gcuaccggcagcugcu

SEQ ID NO: 1361301 - RNA, 16 nt, Mycobacterium tuberculosis H37Rv
gcuaccggcgccgcgc

SEQ ID NO: 1361302 - RNA, 21 nt, Mycobacterium tuberculosis H37Rv
gcuaccgaacaguaggccucc

SEQ ID NO: 1361303 - RNA, 13 nt, Mycobacterium tuberculosis H37Rv
gcuaccgccgacc

SEQ ID NO: 1361304 - RNA, 20 nt, Mycobacterium tuberculosis H37Rv
gcuacccggacagggcggcg

SEQ ID NO: 1361305 - RNA, 13 nt, Mycobacterium tuberculosis H37Rv
gcuaccuuggacu

SEQ ID NO: 1361306 - RNA, 13 nt, Mycobacterium tuberculosis H37Rv
gcuacgccccacu

SEQ ID NO: 1361307 - RNA, 17 nt, Mycobacterium tuberculosis H37Rv
gcuaccccagccggcag

SEQ ID NO: 1361308 - RNA, 22 nt, Mycobacterium tuberculosis H37Rv
gcuaccccagccggcagcagcg

SEQ ID NO: 1361309 - RNA, 18 nt, Mycobacterium tuberculosis H37Rv
gcuacccauucggcggcg

SEQ ID NO: 1361310 - RNA, 23 nt, Mycobacterium tuberculosis H37Rv
gcuaccagccauagugcggcagc

SEQ ID NO: 1361311 - RNA, 13 nt, Mycobacterium tuberculosis H37Rv
gcuaauugcggcc

SEQ ID NO: 1361312 - RNA, 16 nt, Mycobacterium tuberculosis H37Rv
gcguugguagccaggg

SEQ ID NO: 1361313 - RNA, 18 nt, Mycobacterium tuberculosis H37Rv
gcguugguggucugccaa

SEQ ID NO: 1361314 - RNA, 17 nt, Mycobacterium tuberculosis H37Rv
gcguugccgaaacccga

SEQ ID NO: 1361315 - RNA, 22 nt, Mycobacterium tuberculosis H37Rv
gcguugcggaaucagcacccca

SEQ ID NO: 1361316 - RNA, 18 nt, Mycobacterium tuberculosis H37Rv
gcguuggaucccagcccg

SEQ ID NO: 1361317 - RNA, 15 nt, Mycobacterium tuberculosis H37Rv
gcguuggaucccagc

SEQ ID NO: 1361318 - RNA, 16 nt, Mycobacterium tuberculosis H37Rv
gcguuggccauggcca

SEQ ID NO: 1361319 - RNA, 16 nt, Mycobacterium tuberculosis H37Rv
gcguuggccccaggau

SEQ ID NO: 1361320 - RNA, 13 nt, Mycobacterium tuberculosis H37Rv
gcguuggcccgcc

SEQ ID NO: 1361321 - RNA, 20 nt, Mycobacterium tuberculosis H37Rv
gcguugaugaccgccgccgg

SEQ ID NO: 1361322 - RNA, 17 nt, Mycobacterium tuberculosis H37Rv
gcguugaucgccgggcc

SEQ ID NO: 1361323 - RNA, 18 nt, Mycobacterium tuberculosis H37Rv
gcguugacggcggggcgg

SEQ ID NO: 1361324 - RNA, 15 nt, Mycobacterium tuberculosis H37Rv
gcguugacucugcgu

SEQ ID NO: 1361325 - RNA, 20 nt, Mycobacterium tuberculosis H37Rv
gcguugaccagcacgacggc

SEQ ID NO: 1361326 - RNA, 22 nt, Mycobacterium tuberculosis H37Rv
gcguugcaccauucgcaccggc

SEQ ID NO: 1361327 - RNA, 14 nt, Mycobacterium tuberculosis H37Rv
gcguugcacugcug

SEQ ID NO: 1361328 - RNA, 19 nt, Mycobacterium tuberculosis H37Rv
gcguugcacugcugguuga

SEQ ID NO: 1361329 - RNA, 16 nt, Mycobacterium tuberculosis H37Rv
gcguugcccuccuucu

SEQ ID NO: 1361330 - RNA, 18 nt, Mycobacterium tuberculosis H37Rv
gcguucggucagugggac

SEQ ID NO: 1361331 - RNA, 23 nt, Mycobacterium tuberculosis H37Rv
gcguucggcgcugaucgcgcgca

SEQ ID NO: 1361332 - RNA, 15 nt, Mycobacterium tuberculosis H37Rv
gcguucggcgagcag

SEQ ID NO: 1361333 - RNA, 12 nt, Mycobacterium tuberculosis H37Rv
gcguuguugacc

SEQ ID NO: 1361334 - RNA, 18 nt, Mycobacterium tuberculosis H37Rv
gcguugucggcuggacgg

SEQ ID NO: 1361335 - RNA, 21 nt, Mycobacterium tuberculosis H37Rv
gcguuuaucagcaagagccgc

SEQ ID NO: 1361336 - RNA, 14 nt, Mycobacterium tuberculosis H37Rv
gcguuugccggccg

SEQ ID NO: 1361337 - RNA, 18 nt, Mycobacterium tuberculosis H37Rv
gcguuucggcgggcgccu

SEQ ID NO: 1361338 - RNA, 24 nt, Mycobacterium tuberculosis H37Rv
gcguggucaccccuucgccagcgc

SEQ ID NO: 1361339 - RNA, 17 nt, Mycobacterium tuberculosis H37Rv
gcguggugaagucggug

SEQ ID NO: 1361340 - RNA, 16 nt, Mycobacterium tuberculosis H37Rv
gcguggucgcgcggca

SEQ ID NO: 1361341 - RNA, 18 nt, Mycobacterium tuberculosis H37Rv
gcgugggcgugagcgcgc

SEQ ID NO: 1361342 - RNA, 14 nt, Mycobacterium tuberculosis H37Rv
gcgugggcgcggcg

SEQ ID NO: 1361343 - RNA, 17 nt, Mycobacterium tuberculosis H37Rv
gcgugguaaccagggca

SEQ ID NO: 1361344 - RNA, 15 nt, Mycobacterium tuberculosis H37Rv
gcguggcuggcggcg

SEQ ID NO: 1361345 - RNA, 16 nt, Mycobacterium tuberculosis H37Rv
gcguggcguugguggu

SEQ ID NO: 1361346 - RNA, 22 nt, Mycobacterium tuberculosis H37Rv
gcguggcgcaccaccgccccgc

SEQ ID NO: 1361347 - RNA, 22 nt, Mycobacterium tuberculosis H37Rv
gcguggcgcccgugccgcccgc

SEQ ID NO: 1361348 - RNA, 13 nt, Mycobacterium tuberculosis H37Rv
gcguggcgccggc

SEQ ID NO: 1361349 - RNA, 18 nt, Mycobacterium tuberculosis H37Rv
gcgugucgaugcgggcug

SEQ ID NO: 1361350 - RNA, 19 nt, Mycobacterium tuberculosis H37Rv
gcguguagccugcggcggu

SEQ ID NO: 1361351 - RNA, 15 nt, Mycobacterium tuberculosis H37Rv
gcguguaaccccagg

SEQ ID NO: 1361352 - RNA, 15 nt, Mycobacterium tuberculosis H37Rv
gcguguaccagccca

SEQ ID NO: 1361353 - RNA, 17 nt, Mycobacterium tuberculosis H37Rv
gcguguaccagcccagc

SEQ ID NO: 1361354 - RNA, 22 nt, Mycobacterium tuberculosis H37Rv
gcguguaccagcccagcggcug

SEQ ID NO: 1361355 - RNA, 16 nt, Mycobacterium tuberculosis H37Rv
gcguguacggcggcua

SEQ ID NO: 1361356 - RNA, 23 nt, Mycobacterium tuberculosis H37Rv
gcguuaagguacccggucggguc

SEQ ID NO: 1361357 - RNA, 17 nt, Mycobacterium tuberculosis H37Rv
gcguuagggccgccauc

SEQ ID NO: 1361358 - RNA, 21 nt, Mycobacterium tuberculosis H37Rv
gcguucaccacgaucgcgagc

SEQ ID NO: 1361359 - RNA, 19 nt, Mycobacterium tuberculosis H37Rv
gcguucgggcuccagcagc

SEQ ID NO: 1361360 - RNA, 23 nt, Mycobacterium tuberculosis H37Rv
gcguucccccacucggacccgca

SEQ ID NO: 1361361 - RNA, 22 nt, Mycobacterium tuberculosis H37Rv
gcguuccugaucgagcgccagc

SEQ ID NO: 1361362 - RNA, 18 nt, Mycobacterium tuberculosis H37Rv
gcucaccgacgcugacca

SEQ ID NO: 1361363 - RNA, 20 nt, Mycobacterium tuberculosis H37Rv
gcucacccuuggaauugaag

SEQ ID NO: 1361364 - RNA, 14 nt, Mycobacterium tuberculosis H37Rv
gcucaccggggucg

SEQ ID NO: 1361365 - RNA, 16 nt, Mycobacterium tuberculosis H37Rv
gcucaccucaugaucu

SEQ ID NO: 1361366 - RNA, 21 nt, Mycobacterium tuberculosis H37Rv
gcucaccucaugaucucacca

SEQ ID NO: 1361367 - RNA, 20 nt, Mycobacterium tuberculosis H37Rv
gcucaccgcgcaucaucgcc

SEQ ID NO: 1361368 - RNA, 14 nt, Mycobacterium tuberculosis H37Rv
gcucaccggcuggu

SEQ ID NO: 1361369 - RNA, 21 nt, Mycobacterium tuberculosis H37Rv
gcucacgcgggucguuaccag

SEQ ID NO: 1361370 - RNA, 22 nt, Mycobacterium tuberculosis H37Rv
gcucacgccggguguggcuuga

SEQ ID NO: 1361371 - RNA, 19 nt, Mycobacterium tuberculosis H37Rv
gcucaaugaucgcggcggc

SEQ ID NO: 1361372 - RNA, 19 nt, Mycobacterium tuberculosis H37Rv
gcucaccaaucugcgggcc

SEQ ID NO: 1361373 - RNA, 13 nt, Mycobacterium tuberculosis H37Rv
gcucacacuggcu

SEQ ID NO: 1361374 - RNA, 19 nt, Mycobacterium tuberculosis H37Rv
gcucacagcacagcgcagc

SEQ ID NO: 1361375 - RNA, 13 nt, Mycobacterium tuberculosis H37Rv
gcucacccggcgu

SEQ ID NO: 1361376 - RNA, 13 nt, Mycobacterium tuberculosis H37Rv
gcucagcgcggcc

SEQ ID NO: 1361377 - RNA, 15 nt, Mycobacterium tuberculosis H37Rv
gcucagcgcgcgccg

SEQ ID NO: 1361378 - RNA, 13 nt, Mycobacterium tuberculosis H37Rv
gcucagcgguggc

SEQ ID NO: 1361379 - RNA, 17 nt, Mycobacterium tuberculosis H37Rv
gcucagcuccggcgacu

SEQ ID NO: 1361380 - RNA, 20 nt, Mycobacterium tuberculosis H37Rv
gcucagcugguggcggcggu

SEQ ID NO: 1361381 - RNA, 17 nt, Mycobacterium tuberculosis H37Rv
gcucagcgaugcggccc

SEQ ID NO: 1361382 - RNA, 19 nt, Mycobacterium tuberculosis H37Rv
gcucaggacgaacgcuggc

SEQ ID NO: 1361383 - RNA, 20 nt, Mycobacterium tuberculosis H37Rv
gcucagccguccgggcggcc

SEQ ID NO: 1361384 - RNA, 17 nt, Mycobacterium tuberculosis H37Rv
gcucacuacccgcaacg

SEQ ID NO: 1361385 - RNA, 17 nt, Mycobacterium tuberculosis H37Rv
gcucagugaugcgcccc

SEQ ID NO: 1361386 - RNA, 12 nt, Mycobacterium tuberculosis H37Rv
gcucagggcagu

SEQ ID NO: 1361387 - RNA, 17 nt, Mycobacterium tuberculosis H37Rv
gcucagggugcgccgca

SEQ ID NO: 1361388 - RNA, 23 nt, Mycobacterium tuberculosis H37Rv
gcucaggggcuacuaggcccagc

SEQ ID NO: 1361389 - RNA, 16 nt, Mycobacterium tuberculosis H37Rv
gcucagggugcgccgc

SEQ ID NO: 1361390 - RNA, 17 nt, Mycobacterium tuberculosis H37Rv
gcucauucgugcccggg

SEQ ID NO: 1361391 - RNA, 19 nt, Mycobacterium tuberculosis H37Rv
gcuccaccgggcccgccgu

SEQ ID NO: 1361392 - RNA, 13 nt, Mycobacterium tuberculosis H37Rv
gcuccacccccac

SEQ ID NO: 1361393 - RNA, 17 nt, Mycobacterium tuberculosis H37Rv
gcucccaugaucgccga

SEQ ID NO: 1361394 - RNA, 21 nt, Mycobacterium tuberculosis H37Rv
gcucccccgcuacgcgcgcuc

SEQ ID NO: 1361395 - RNA, 22 nt, Mycobacterium tuberculosis H37Rv
gcuccaggucgacauaggccac

SEQ ID NO: 1361396 - RNA, 18 nt, Mycobacterium tuberculosis H37Rv
gcuccaguggcgccaggg

SEQ ID NO: 1361397 - RNA, 20 nt, Mycobacterium tuberculosis H37Rv
gcuccaguggcgccagggcc

SEQ ID NO: 1361398 - RNA, 15 nt, Mycobacterium tuberculosis H37Rv
gcuccagcucggcca

SEQ ID NO: 1361399 - RNA, 17 nt, Mycobacterium tuberculosis H37Rv
gcuccagcucggcgggc

SEQ ID NO: 1361400 - RNA, 16 nt, Mycobacterium tuberculosis H37Rv
gcuccaggcgcgccgc

SEQ ID NO: 1361401 - RNA, 21 nt, Mycobacterium tuberculosis H37Rv
gcuccacuuggggcgccaggg

SEQ ID NO: 1361402 - RNA, 14 nt, Mycobacterium tuberculosis H37Rv
gcuccaccgggccc

SEQ ID NO: 1361403 - RNA, 19 nt, Mycobacterium tuberculosis H37Rv
gcuccacguacgcggcugc

SEQ ID NO: 1361404 - RNA, 20 nt, Mycobacterium tuberculosis H37Rv
gcuauucggcggcauguuca

SEQ ID NO: 1361405 - RNA, 15 nt, Mycobacterium tuberculosis H37Rv
gcuauucgccagcgc

SEQ ID NO: 1361406 - RNA, 18 nt, Mycobacterium tuberculosis H37Rv
gcuaugcaggucacuggg

SEQ ID NO: 1361407 - RNA, 18 nt, Mycobacterium tuberculosis H37Rv
gcuaugcuggcagcucgg

SEQ ID NO: 1361408 - RNA, 18 nt, Mycobacterium tuberculosis H37Rv
gcucaaggcuucggcggc

SEQ ID NO: 1361409 - RNA, 15 nt, Mycobacterium tuberculosis H37Rv
gcucaagcgcgucgu

SEQ ID NO: 1361410 - RNA, 22 nt, Mycobacterium tuberculosis H37Rv
gcucaacaccgaguuccucugc

SEQ ID NO: 1361411 - RNA, 14 nt, Mycobacterium tuberculosis H37Rv
gcuaucaugaccac

SEQ ID NO: 1361412 - RNA, 16 nt, Mycobacterium tuberculosis H37Rv
gcuaucccaggggcac

SEQ ID NO: 1361413 - RNA, 12 nt, Mycobacterium tuberculosis H37Rv
gcuaucgcagaa

SEQ ID NO: 1361414 - RNA, 18 nt, Mycobacterium tuberculosis H37Rv
gcuaucgguucagcugcg

SEQ ID NO: 1361415 - RNA, 16 nt, Mycobacterium tuberculosis H37Rv
gcuauccggcggccag

SEQ ID NO: 1361416 - RNA, 16 nt, Mycobacterium tuberculosis H37Rv
gcuagagccaguuucu

SEQ ID NO: 1361417 - RNA, 16 nt, Mycobacterium tuberculosis H37Rv
gcuagcgccgcgcuug

SEQ ID NO: 1361418 - RNA, 19 nt, Mycobacterium tuberculosis H37Rv
gcuagaccgcuacccgcgc

SEQ ID NO: 1361419 - RNA, 20 nt, Mycobacterium tuberculosis H37Rv
gcuagucggggugggacagg

SEQ ID NO: 1361420 - RNA, 16 nt, Mycobacterium tuberculosis H37Rv
gcuaggugacgccgcc

SEQ ID NO: 1361421 - RNA, 17 nt, Mycobacterium tuberculosis H37Rv
gcuaggugacgccgcca

SEQ ID NO: 1361422 - RNA, 21 nt, Mycobacterium tuberculosis H37Rv
gcuaggucaguucccagacca

SEQ ID NO: 1361423 - RNA, 17 nt, Mycobacterium tuberculosis H37Rv
gcuaggucaguucccag

SEQ ID NO: 1361424 - RNA, 21 nt, Mycobacterium tuberculosis H37Rv
gcuaggaucggauggcggcca

SEQ ID NO: 1361425 - RNA, 22 nt, Mycobacterium tuberculosis H37Rv
gcuagcucaacacuuccgggcg

SEQ ID NO: 1361426 - RNA, 15 nt, Mycobacterium tuberculosis H37Rv
gcuagcuuggcggcc

SEQ ID NO: 1361427 - RNA, 17 nt, Mycobacterium tuberculosis H37Rv
gcucggcccagcgcgcc

SEQ ID NO: 1361428 - RNA, 21 nt, Mycobacterium tuberculosis H37Rv
gcucggccgucaggguguugc

SEQ ID NO: 1361429 - RNA, 18 nt, Mycobacterium tuberculosis H37Rv
gcucggcgcagcacaucc

SEQ ID NO: 1361430 - RNA, 12 nt, Mycobacterium tuberculosis H37Rv
gcucggcgcagc

SEQ ID NO: 1361431 - RNA, 15 nt, Mycobacterium tuberculosis H37Rv
gcucgcggggcgcac

SEQ ID NO: 1361432 - RNA, 16 nt, Mycobacterium tuberculosis H37Rv
gcucgcgcgcugggcg

SEQ ID NO: 1361433 - RNA, 20 nt, Mycobacterium tuberculosis H37Rv
gcucgcgcucguuagcggcg

SEQ ID NO: 1361434 - RNA, 15 nt, Mycobacterium tuberculosis H37Rv
gcucgcgcgcugggc

SEQ ID NO: 1361435 - RNA, 14 nt, Mycobacterium tuberculosis H37Rv
gcucgcgcccgcua

SEQ ID NO: 1361436 - RNA, 17 nt, Mycobacterium tuberculosis H37Rv
gcucgcgcaaggcgccg

SEQ ID NO: 1361437 - RNA, 15 nt, Mycobacterium tuberculosis H37Rv
gcucgggcgcacggu

SEQ ID NO: 1361438 - RNA, 14 nt, Mycobacterium tuberculosis H37Rv
gcucggcguccgcc

SEQ ID NO: 1361439 - RNA, 17 nt, Mycobacterium tuberculosis H37Rv
gcucgggcccagcgcgc

SEQ ID NO: 1361440 - RNA, 17 nt, Mycobacterium tuberculosis H37Rv
gcucgggccgcacuuuc

SEQ ID NO: 1361441 - RNA, 12 nt, Mycobacterium tuberculosis H37Rv
gcucguugcguu

SEQ ID NO: 1361442 - RNA, 17 nt, Mycobacterium tuberculosis H37Rv
gcucguucgugcagccc

SEQ ID NO: 1361443 - RNA, 18 nt, Mycobacterium tuberculosis H37Rv
gcucguuugcgagcaggg

SEQ ID NO: 1361444 - RNA, 12 nt, Mycobacterium tuberculosis H37Rv
gcucguccagca

SEQ ID NO: 1361445 - RNA, 20 nt, Mycobacterium tuberculosis H37Rv
gcucguccaagccggccacg

SEQ ID NO: 1361446 - RNA, 23 nt, Mycobacterium tuberculosis H37Rv
gcucgucacgugucccgcaugca

SEQ ID NO: 1361447 - RNA, 16 nt, Mycobacterium tuberculosis H37Rv
gcucguuccggcgguc

SEQ ID NO: 1361448 - RNA, 19 nt, Mycobacterium tuberculosis H37Rv
gcucguuagcggcgggcac

SEQ ID NO: 1361449 - RNA, 17 nt, Mycobacterium tuberculosis H37Rv
gcucguucaccgcagcg

SEQ ID NO: 1361450 - RNA, 21 nt, Mycobacterium tuberculosis H37Rv
gcucguucaccgcagcgggug

SEQ ID NO: 1361451 - RNA, 22 nt, Mycobacterium tuberculosis H37Rv
gcucuguagcgucgcacccagg

SEQ ID NO: 1361452 - RNA, 22 nt, Mycobacterium tuberculosis H37Rv
gcucuugcgggcagccgcccgc

SEQ ID NO: 1361453 - RNA, 20 nt, Mycobacterium tuberculosis H37Rv
gcucucuucgcgcgcugggc

SEQ ID NO: 1361454 - RNA, 15 nt, Mycobacterium tuberculosis H37Rv
gcucuccauggccga

SEQ ID NO: 1361455 - RNA, 16 nt, Mycobacterium tuberculosis H37Rv
gcucucacgagcggcg

SEQ ID NO: 1361456 - RNA, 15 nt, Mycobacterium tuberculosis H37Rv
gcucugcugccagcc

SEQ ID NO: 1361457 - RNA, 15 nt, Mycobacterium tuberculosis H37Rv
gcugacuccugcggc

SEQ ID NO: 1361458 - RNA, 16 nt, Mycobacterium tuberculosis H37Rv
gcugagcugcucgccg

SEQ ID NO: 1361459 - RNA, 15 nt, Mycobacterium tuberculosis H37Rv
gcugagcugcucgcc

SEQ ID NO: 1361460 - RNA, 16 nt, Mycobacterium tuberculosis H37Rv
gcugaggaacgccggc

SEQ ID NO: 1361461 - RNA, 16 nt, Mycobacterium tuberculosis H37Rv
gcugagcggccggcau

SEQ ID NO: 1361462 - RNA, 23 nt, Mycobacterium tuberculosis H37Rv
gcugaguccccaggugggcagca

SEQ ID NO: 1361463 - RNA, 21 nt, Mycobacterium tuberculosis H37Rv
gcugaguccccaggugggcag

SEQ ID NO: 1361464 - RNA, 17 nt, Mycobacterium tuberculosis H37Rv
gcugacgggccgcugug

SEQ ID NO: 1361465 - RNA, 23 nt, Mycobacterium tuberculosis H37Rv
gcugaccggcuauuagcggcuug

SEQ ID NO: 1361466 - RNA, 16 nt, Mycobacterium tuberculosis H37Rv
gcugaccggggcgccc

SEQ ID NO: 1361467 - RNA, 21 nt, Mycobacterium tuberculosis H37Rv
gcugaccgcgccggacagcgc

SEQ ID NO: 1361468 - RNA, 18 nt, Mycobacterium tuberculosis H37Rv
gcugacccgggccgggcc

SEQ ID NO: 1361469 - RNA, 21 nt, Mycobacterium tuberculosis H37Rv
gcugaccgccagcggccgcuc

SEQ ID NO: 1361470 - RNA, 14 nt, Mycobacterium tuberculosis H37Rv
gcucuuugagugcc

SEQ ID NO: 1361471 - RNA, 13 nt, Mycobacterium tuberculosis H37Rv
gcugcccaugcgg

SEQ ID NO: 1361472 - RNA, 22 nt, Mycobacterium tuberculosis H37Rv
gcugcccaugguggcgaucugg

SEQ ID NO: 1361473 - RNA, 17 nt, Mycobacterium tuberculosis H37Rv
gcugcccacgggccggc

SEQ ID NO: 1361474 - RNA, 14 nt, Mycobacterium tuberculosis H37Rv
gcugcccaaaagcg

SEQ ID NO: 1361475 - RNA, 20 nt, Mycobacterium tuberculosis H37Rv
gcugcccaaaaggaagaccu

SEQ ID NO: 1361476 - RNA, 21 nt, Mycobacterium tuberculosis H37Rv
gcugcccaaaaggaagaccuc

SEQ ID NO: 1361477 - RNA, 19 nt, Mycobacterium tuberculosis H37Rv
gcugcccgggcugccgccc

SEQ ID NO: 1361478 - RNA, 14 nt, Mycobacterium tuberculosis H37Rv
gcugcccgccgccc

SEQ ID NO: 1361479 - RNA, 16 nt, Mycobacterium tuberculosis H37Rv
gcugcccgccagccca

SEQ ID NO: 1361480 - RNA, 18 nt, Mycobacterium tuberculosis H37Rv
gcugcccgccagcccaua

SEQ ID NO: 1361481 - RNA, 16 nt, Mycobacterium tuberculosis H37Rv
gcugccccgccaccuc

SEQ ID NO: 1361482 - RNA, 16 nt, Mycobacterium tuberculosis H37Rv
gcugccccgccgccau

SEQ ID NO: 1361483 - RNA, 14 nt, Mycobacterium tuberculosis H37Rv
gcugccccgccacc

SEQ ID NO: 1361484 - RNA, 19 nt, Mycobacterium tuberculosis H37Rv
gcugcauccgcagcaccaa

SEQ ID NO: 1361485 - RNA, 15 nt, Mycobacterium tuberculosis H37Rv
gcugcauccgcagca

SEQ ID NO: 1361486 - RNA, 14 nt, Mycobacterium tuberculosis H37Rv
gcugcauccgcagc

SEQ ID NO: 1361487 - RNA, 22 nt, Mycobacterium tuberculosis H37Rv
gcugccagugccgcccaccaca

SEQ ID NO: 1361488 - RNA, 17 nt, Mycobacterium tuberculosis H37Rv
gcugccagggugcgccg

SEQ ID NO: 1361489 - RNA, 16 nt, Mycobacterium tuberculosis H37Rv
gcugcauguuaugggu

SEQ ID NO: 1361490 - RNA, 12 nt, Mycobacterium tuberculosis H37Rv
gcugcccaaaag

SEQ ID NO: 1361491 - RNA, 14 nt, Mycobacterium tuberculosis H37Rv
gcugcacaacgugg

SEQ ID NO: 1361492 - RNA, 14 nt, Mycobacterium tuberculosis H37Rv
gcugcaccagcugc

SEQ ID NO: 1361493 - RNA, 22 nt, Mycobacterium tuberculosis H37Rv
gcugcaccuccgacggccgcgg

SEQ ID NO: 1361494 - RNA, 21 nt, Mycobacterium tuberculosis H37Rv
gcugcagugacucgaucacca

SEQ ID NO: 1361495 - RNA, 17 nt, Mycobacterium tuberculosis H37Rv
gcugcagugccgcaccc

SEQ ID NO: 1361496 - RNA, 14 nt, Mycobacterium tuberculosis H37Rv
gcugcagguccagg

SEQ ID NO: 1361497 - RNA, 21 nt, Mycobacterium tuberculosis H37Rv
gcugcaccggcuugggccagg

SEQ ID NO: 1361498 - RNA, 19 nt, Mycobacterium tuberculosis H37Rv
gcugaugaaacgccgucgc

SEQ ID NO: 1361499 - RNA, 15 nt, Mycobacterium tuberculosis H37Rv
gcugauggugcugcg

SEQ ID NO: 1361500 - RNA, 16 nt, Mycobacterium tuberculosis H37Rv
gcuguaacacccggcc

SEQ ID NO: 1361501 - RNA, 16 nt, Mycobacterium tuberculosis H37Rv
gcuguaauuccucgga

SEQ ID NO: 1361502 - RNA, 17 nt, Mycobacterium tuberculosis H37Rv
gcugguugaacaugucc

SEQ ID NO: 1361503 - RNA, 14 nt, Mycobacterium tuberculosis H37Rv
gcugguugugcugg

SEQ ID NO: 1361504 - RNA, 13 nt, Mycobacterium tuberculosis H37Rv
gcuggugugcggg

SEQ ID NO: 1361505 - RNA, 14 nt, Mycobacterium tuberculosis H37Rv
gcuggugugcgggc

SEQ ID NO: 1361506 - RNA, 15 nt, Mycobacterium tuberculosis H37Rv
gcuggugggccggac

SEQ ID NO: 1361507 - RNA, 13 nt, Mycobacterium tuberculosis H37Rv
gcugguggcgugc

SEQ ID NO: 1361508 - RNA, 18 nt, Mycobacterium tuberculosis H37Rv
gcugguggugcggccggg

SEQ ID NO: 1361509 - RNA, 19 nt, Mycobacterium tuberculosis H37Rv
gcuggucaacagcggcaag

SEQ ID NO: 1361510 - RNA, 12 nt, Mycobacterium tuberculosis H37Rv
gcugguggcggc

SEQ ID NO: 1361511 - RNA, 22 nt, Mycobacterium tuberculosis H37Rv
gcuggugcguagcccacccggg

SEQ ID NO: 1361512 - RNA, 19 nt, Mycobacterium tuberculosis H37Rv
aaagcuugggcgaucguca

SEQ ID NO: 1361513 - RNA, 21 nt, Mycobacterium tuberculosis H37Rv
gcugugagcuuggucgccaug

SEQ ID NO: 1361514 - RNA, 14 nt, Mycobacterium tuberculosis H37Rv
gcugucggcuuccu

SEQ ID NO: 1361515 - RNA, 18 nt, Mycobacterium tuberculosis H37Rv
gcugucgcgggccaccac

SEQ ID NO: 1361516 - RNA, 17 nt, Mycobacterium tuberculosis H37Rv
gcuguacugcggugcca

SEQ ID NO: 1361517 - RNA, 21 nt, Mycobacterium tuberculosis H37Rv
gcuguacucgcggcgcggccg

SEQ ID NO: 1361518 - RNA, 20 nt, Mycobacterium tuberculosis H37Rv
gcugucgacgucggcaaucu

SEQ ID NO: 1361519 - RNA, 18 nt, Mycobacterium tuberculosis H37Rv
gcugucgaucagcgaccc

SEQ ID NO: 1361520 - RNA, 15 nt, Mycobacterium tuberculosis H37Rv
gcugucgaaguuggu

SEQ ID NO: 1361521 - RNA, 15 nt, Mycobacterium tuberculosis H37Rv
gcuguccgcgggccg

SEQ ID NO: 1361522 - RNA, 14 nt, Mycobacterium tuberculosis H37Rv
gcuggcuacccacc

SEQ ID NO: 1361523 - RNA, 20 nt, Mycobacterium tuberculosis H37Rv
gcuggcucaccgacaugacg

SEQ ID NO: 1361524 - RNA, 19 nt, Mycobacterium tuberculosis H37Rv
gcugggcagccagaucucc

SEQ ID NO: 1361525 - RNA, 21 nt, Mycobacterium tuberculosis H37Rv
gcugggcccgagcgcgcgcug

SEQ ID NO: 1361526 - RNA, 14 nt, Mycobacterium tuberculosis H37Rv
gcugggcccgccag

SEQ ID NO: 1361527 - RNA, 18 nt, Mycobacterium tuberculosis H37Rv
gcugggcccgccagccca

SEQ ID NO: 1361528 - RNA, 19 nt, Mycobacterium tuberculosis H37Rv
gcugggcccgagcgcgcgc

SEQ ID NO: 1361529 - RNA, 16 nt, Mycobacterium tuberculosis H37Rv
gcuggcuguggcgcgc

SEQ ID NO: 1361530 - RNA, 16 nt, Mycobacterium tuberculosis H37Rv
gcuggcuguggcugaa

SEQ ID NO: 1361531 - RNA, 14 nt, Mycobacterium tuberculosis H37Rv
gcuggggcgcccga

SEQ ID NO: 1361532 - RNA, 22 nt, Mycobacterium tuberculosis H37Rv
gcugggggccggcagcggcugg

SEQ ID NO: 1361533 - RNA, 17 nt, Mycobacterium tuberculosis H37Rv
gcugggggucaaucggg

SEQ ID NO: 1361534 - RNA, 16 nt, Mycobacterium tuberculosis H37Rv
gcugggcgccaccauc

SEQ ID NO: 1361535 - RNA, 13 nt, Mycobacterium tuberculosis H37Rv
gcugggcgcgcuc

SEQ ID NO: 1361536 - RNA, 15 nt, Mycobacterium tuberculosis H37Rv
gcugggugaccagga

SEQ ID NO: 1361537 - RNA, 15 nt, Mycobacterium tuberculosis H37Rv
gcuggguggccccuu

SEQ ID NO: 1361538 - RNA, 16 nt, Mycobacterium tuberculosis H37Rv
gcugcggugccggccc

SEQ ID NO: 1361539 - RNA, 19 nt, Mycobacterium tuberculosis H37Rv
gcugcggugccggcccugc

SEQ ID NO: 1361540 - RNA, 20 nt, Mycobacterium tuberculosis H37Rv
gcugcggucgaacaucaucg

SEQ ID NO: 1361541 - RNA, 23 nt, Mycobacterium tuberculosis H37Rv
gcugcggggcgauccccagcacc

SEQ ID NO: 1361542 - RNA, 15 nt, Mycobacterium tuberculosis H37Rv
gcugcgggcccggcg

SEQ ID NO: 1361543 - RNA, 18 nt, Mycobacterium tuberculosis H37Rv
gcugcggcuuucagcgcu

SEQ ID NO: 1361544 - RNA, 14 nt, Mycobacterium tuberculosis H37Rv
gcugcguccggaac

SEQ ID NO: 1361545 - RNA, 13 nt, Mycobacterium tuberculosis H37Rv
gcugcguccugga

SEQ ID NO: 1361546 - RNA, 14 nt, Mycobacterium tuberculosis H37Rv
gcugcguccuggau

SEQ ID NO: 1361547 - RNA, 13 nt, Mycobacterium tuberculosis H37Rv
gcugcggcggcuu

SEQ ID NO: 1361548 - RNA, 19 nt, Mycobacterium tuberculosis H37Rv
gcugcggcuuggccaucac

SEQ ID NO: 1361549 - RNA, 18 nt, Mycobacterium tuberculosis H37Rv
gcugcggcgcuggccagc

SEQ ID NO: 1361550 - RNA, 20 nt, Mycobacterium tuberculosis H37Rv
gcugcggcgaucuggucgac

SEQ ID NO: 1361551 - RNA, 12 nt, Mycobacterium tuberculosis H37Rv
gcugcggccgcg

SEQ ID NO: 1361552 - RNA, 23 nt, Mycobacterium tuberculosis H37Rv
gcugcggcccacaccagcgcagc

SEQ ID NO: 1361553 - RNA, 21 nt, Mycobacterium tuberculosis H37Rv
gcugcggcccacaccagcgca

SEQ ID NO: 1361554 - RNA, 21 nt, Mycobacterium tuberculosis H37Rv
gcugcggauacagccgccgcc

SEQ ID NO: 1361555 - RNA, 15 nt, Mycobacterium tuberculosis H37Rv
gcugccccccagaca

SEQ ID NO: 1361556 - RNA, 23 nt, Mycobacterium tuberculosis H37Rv
gcugcucggucaggcggcuggcc

SEQ ID NO: 1361557 - RNA, 17 nt, Mycobacterium tuberculosis H37Rv
gcugcucgucggcgccg

SEQ ID NO: 1361558 - RNA, 22 nt, Mycobacterium tuberculosis H37Rv
gcugcucgugagccccagcgac

SEQ ID NO: 1361559 - RNA, 21 nt, Mycobacterium tuberculosis H37Rv
gcugcucgucuuggcggcggu

SEQ ID NO: 1361560 - RNA, 22 nt, Mycobacterium tuberculosis H37Rv
gcugcucugagcuuggucgccg

SEQ ID NO: 1361561 - RNA, 21 nt, Mycobacterium tuberculosis H37Rv
gcugcugaccugcaugggcag

SEQ ID NO: 1361562 - RNA, 22 nt, Mycobacterium tuberculosis H37Rv
gcugcuuggucgcccagccacu

SEQ ID NO: 1361563 - RNA, 22 nt, Mycobacterium tuberculosis H37Rv
gcuggacggcgggccgcgcggc

SEQ ID NO: 1361564 - RNA, 12 nt, Mycobacterium tuberculosis H37Rv
gcuggagauguu

SEQ ID NO: 1361565 - RNA, 17 nt, Mycobacterium tuberculosis H37Rv
gcuggcgcccccgccau

SEQ ID NO: 1361566 - RNA, 12 nt, Mycobacterium tuberculosis H37Rv
gcuggcgcccgg

SEQ ID NO: 1361567 - RNA, 19 nt, Mycobacterium tuberculosis H37Rv
gcuggcgcccuugccggcg

SEQ ID NO: 1361568 - RNA, 15 nt, Mycobacterium tuberculosis H37Rv
gcuggcgcgcggggu

SEQ ID NO: 1361569 - RNA, 16 nt, Mycobacterium tuberculosis H37Rv
gcuggccuccagcuug

SEQ ID NO: 1361570 - RNA, 20 nt, Mycobacterium tuberculosis H37Rv
gcuggccguauaggcccggg

SEQ ID NO: 1361571 - RNA, 22 nt, Mycobacterium tuberculosis H37Rv
gcuggcgaccuggucgcuggug

SEQ ID NO: 1361572 - RNA, 22 nt, Mycobacterium tuberculosis H37Rv
gcuggcgaacucgaggucgagc

SEQ ID NO: 1361573 - RNA, 12 nt, Mycobacterium tuberculosis H37Rv
gcuggcccgcau

SEQ ID NO: 1361574 - RNA, 14 nt, Mycobacterium tuberculosis H37Rv
gcuggccagcgcgc

SEQ ID NO: 1361575 - RNA, 18 nt, Mycobacterium tuberculosis H37Rv
gcuggccagcugcggcuc

SEQ ID NO: 1361576 - RNA, 18 nt, Mycobacterium tuberculosis H37Rv
gcuggcccagcgaccagu

SEQ ID NO: 1361577 - RNA, 19 nt, Mycobacterium tuberculosis H37Rv
gcuggccaugguggcgccg

SEQ ID NO: 1361578 - RNA, 16 nt, Mycobacterium tuberculosis H37Rv
gcuggccagcacgccc

SEQ ID NO: 1361579 - RNA, 19 nt, Mycobacterium tuberculosis H37Rv
gcuggcaggccgggcacca

SEQ ID NO: 1361580 - RNA, 15 nt, Mycobacterium tuberculosis H37Rv
gcuggcaggccgggc

SEQ ID NO: 1361581 - RNA, 13 nt, Mycobacterium tuberculosis H37Rv
gcuggcaggccgg

SEQ ID NO: 1361582 - RNA, 14 nt, Mycobacterium tuberculosis H37Rv
gcuggcaggccggg

SEQ ID NO: 1361583 - RNA, 18 nt, Mycobacterium tuberculosis H37Rv
gcuggauaugagccaacc

SEQ ID NO: 1361584 - RNA, 19 nt, Mycobacterium tuberculosis H37Rv
gcuggaguaggugugcggg

SEQ ID NO: 1361585 - RNA, 20 nt, Mycobacterium tuberculosis H37Rv
gcuggcagcgacuuaggcag

SEQ ID NO: 1361586 - RNA, 23 nt, Mycobacterium tuberculosis H37Rv
gcuuuuccggcguucccccacuc

SEQ ID NO: 1361587 - RNA, 16 nt, Mycobacterium tuberculosis H37Rv
gcuuuuacgucugcuc

SEQ ID NO: 1361588 - RNA, 15 nt, Mycobacterium tuberculosis H37Rv
gcuuuggccgccgug

SEQ ID NO: 1361589 - RNA, 16 nt, Mycobacterium tuberculosis H37Rv
gcuuuggguccgggcg

SEQ ID NO: 1361590 - RNA, 18 nt, Mycobacterium tuberculosis H37Rv
gcugugguaggccggugc

SEQ ID NO: 1361591 - RNA, 22 nt, Mycobacterium tuberculosis H37Rv
gcugugguaggccggugcguca

SEQ ID NO: 1361592 - RNA, 20 nt, Mycobacterium tuberculosis H37Rv
gcuuucgcgugcggcugcca

SEQ ID NO: 1361593 - RNA, 18 nt, Mycobacterium tuberculosis H37Rv
gcuuucgcgugcggcugc

SEQ ID NO: 1361594 - RNA, 19 nt, Mycobacterium tuberculosis H37Rv
gcuguggccagcaucauca

SEQ ID NO: 1361595 - RNA, 23 nt, Mycobacterium tuberculosis H37Rv
gcugugcucacgagcaaaccaga

SEQ ID NO: 1361596 - RNA, 12 nt, Mycobacterium tuberculosis H37Rv
gcuguggcucga

SEQ ID NO: 1361597 - RNA, 15 nt, Mycobacterium tuberculosis H37Rv
gcugugggauucggg

SEQ ID NO: 1361598 - RNA, 13 nt, Mycobacterium tuberculosis H37Rv
gcuguggccgcgu

SEQ ID NO: 1361599 - RNA, 19 nt, Mycobacterium tuberculosis H37Rv
gcugugccccagggcagug

SEQ ID NO: 1361600 - RNA, 11 nt, Mycobacterium tuberculosis H37Rv
gcugugcucga

SEQ ID NO: 1361601 - RNA, 17 nt, Mycobacterium tuberculosis H37Rv
gcugugccccagggcag

SEQ ID NO: 1361602 - RNA, 16 nt, Mycobacterium tuberculosis H37Rv
gcuuucuuggcgggcg

SEQ ID NO: 1361603 - RNA, 19 nt, Mycobacterium tuberculosis H37Rv
gcuuucugcacccgccagg

SEQ ID NO: 1361604 - RNA, 15 nt, Mycobacterium tuberculosis H37Rv
ggaaacaccggcuug

SEQ ID NO: 1361605 - RNA, 14 nt, Mycobacterium tuberculosis H37Rv
ggaaacaagcaagc

SEQ ID NO: 1361606 - RNA, 16 nt, Mycobacterium tuberculosis H37Rv
ggaaaagaacccggga

SEQ ID NO: 1361607 - RNA, 21 nt, Mycobacterium tuberculosis H37Rv
ggaaacggagccgagccgaua

SEQ ID NO: 1361608 - RNA, 19 nt, Mycobacterium tuberculosis H37Rv
ggaaacccggccgccgaga

SEQ ID NO: 1361609 - RNA, 16 nt, Mycobacterium tuberculosis H37Rv
ggaaacccggccagcu

SEQ ID NO: 1361610 - RNA, 22 nt, Mycobacterium tuberculosis H37Rv
ggaaaccucuucgggugcagcc

SEQ ID NO: 1361611 - RNA, 14 nt, Mycobacterium tuberculosis H37Rv
ggaaacccugcacc

SEQ ID NO: 1361612 - RNA, 17 nt, Mycobacterium tuberculosis H37Rv
ggaaaccgcugggggcg

SEQ ID NO: 1361613 - RNA, 11 nt, Mycobacterium tuberculosis H37Rv
ggaaagcucuc

SEQ ID NO: 1361614 - RNA, 16 nt, Mycobacterium tuberculosis H37Rv
ggaaaggccgcgguga

SEQ ID NO: 1361615 - RNA, 22 nt, Mycobacterium tuberculosis H37Rv
ggaaagccuaguacgccgagca

SEQ ID NO: 1361616 - RNA, 12 nt, Mycobacterium tuberculosis H37Rv
ggaaggagaucc

SEQ ID NO: 1361617 - RNA, 15 nt, Mycobacterium tuberculosis H37Rv
ggaaggaaccgggca

SEQ ID NO: 1361618 - RNA, 21 nt, Mycobacterium tuberculosis H37Rv
ggaacgaugccgccggcgggc

SEQ ID NO: 1361619 - RNA, 13 nt, Mycobacterium tuberculosis H37Rv
ggaacgccgagca

SEQ ID NO: 1361620 - RNA, 17 nt, Mycobacterium tuberculosis H37Rv
ggaaccgguaucgccaa

SEQ ID NO: 1361621 - RNA, 14 nt, Mycobacterium tuberculosis H37Rv
ggaacgccucaggg

SEQ ID NO: 1361622 - RNA, 16 nt, Mycobacterium tuberculosis H37Rv
ggaacuggaccacagc

SEQ ID NO: 1361623 - RNA, 14 nt, Mycobacterium tuberculosis H37Rv
ggaaauuccaagcg

SEQ ID NO: 1361624 - RNA, 19 nt, Mycobacterium tuberculosis H37Rv
ggaacccgagcuugggccg

SEQ ID NO: 1361625 - RNA, 18 nt, Mycobacterium tuberculosis H37Rv
ggaacccccagcugcagg

SEQ ID NO: 1361626 - RNA, 20 nt, Mycobacterium tuberculosis H37Rv
ggaaccgaucggucgaucga

SEQ ID NO: 1361627 - RNA, 16 nt, Mycobacterium tuberculosis H37Rv
ggaaccggcgugcagc

SEQ ID NO: 1361628 - RNA, 14 nt, Mycobacterium tuberculosis H37Rv
ggaacccccagcug

SEQ ID NO: 1361629 - RNA, 23 nt, Mycobacterium tuberculosis H37Rv
ggaagaucacgcgucgugccacu

SEQ ID NO: 1361630 - RNA, 17 nt, Mycobacterium tuberculosis H37Rv
ggaacuugugccgggcg

SEQ ID NO: 1361631 - RNA, 18 nt, Mycobacterium tuberculosis H37Rv
ggaagaaaccgcagucgc

SEQ ID NO: 1361632 - RNA, 21 nt, Mycobacterium tuberculosis H37Rv
ggaagaacucguugagcagcu

SEQ ID NO: 1361633 - RNA, 17 nt, Mycobacterium tuberculosis H37Rv
ggaagaagagguuggcg

SEQ ID NO: 1361634 - RNA, 17 nt, Mycobacterium tuberculosis H37Rv
ggacccagccagcugga

SEQ ID NO: 1361635 - RNA, 12 nt, Mycobacterium tuberculosis H37Rv
ggacccagcacc

SEQ ID NO: 1361636 - RNA, 16 nt, Mycobacterium tuberculosis H37Rv
ggacccagccagcugg

SEQ ID NO: 1361637 - RNA, 19 nt, Mycobacterium tuberculosis H37Rv
ggacccaccgucacccccg

SEQ ID NO: 1361638 - RNA, 11 nt, Mycobacterium tuberculosis H37Rv
ggaccagcgcc

SEQ ID NO: 1361639 - RNA, 22 nt, Mycobacterium tuberculosis H37Rv
ggaccaucccgccgaucacugu

SEQ ID NO: 1361640 - RNA, 16 nt, Mycobacterium tuberculosis H37Rv
ggaccauagucgccgu

SEQ ID NO: 1361641 - RNA, 17 nt, Mycobacterium tuberculosis H37Rv
ggaccagcguggggccg

SEQ ID NO: 1361642 - RNA, 12 nt, Mycobacterium tuberculosis H37Rv
ggaccagcuccu

SEQ ID NO: 1361643 - RNA, 24 nt, Mycobacterium tuberculosis H37Rv
ggaccaccgggccgacagcacgcc

SEQ ID NO: 1361644 - RNA, 22 nt, Mycobacterium tuberculosis H37Rv
ggaccaccagcgcuccagcacc

SEQ ID NO: 1361645 - RNA, 14 nt, Mycobacterium tuberculosis H37Rv
ggaccaccagcgcu

SEQ ID NO: 1361646 - RNA, 16 nt, Mycobacterium tuberculosis H37Rv
ggaccacagccgcgcc

SEQ ID NO: 1361647 - RNA, 16 nt, Mycobacterium tuberculosis H37Rv
ggaccagcgccccggc

SEQ ID NO: 1361648 - RNA, 14 nt, Mycobacterium tuberculosis H37Rv
ggaccagaggcgcu

SEQ ID NO: 1361649 - RNA, 12 nt, Mycobacterium tuberculosis H37Rv
ggaccacggcgu

SEQ ID NO: 1361650 - RNA, 11 nt, Mycobacterium tuberculosis H37Rv
ggacccgcggg

SEQ ID NO: 1361651 - RNA, 13 nt, Mycobacterium tuberculosis H37Rv
ggacccgcagcug

SEQ ID NO: 1361652 - RNA, 13 nt, Mycobacterium tuberculosis H37Rv
ggaccccgccagc

SEQ ID NO: 1361653 - RNA, 18 nt, Mycobacterium tuberculosis H37Rv
ggacccaugagcccguga

SEQ ID NO: 1361654 - RNA, 20 nt, Mycobacterium tuberculosis H37Rv
ggaccucgaagcccagcacc

SEQ ID NO: 1361655 - RNA, 20 nt, Mycobacterium tuberculosis H37Rv
ggaccucggcgaccugcucg

SEQ ID NO: 1361656 - RNA, 22 nt, Mycobacterium tuberculosis H37Rv
ggaccuccgacgugcccccgua

SEQ ID NO: 1361657 - RNA, 18 nt, Mycobacterium tuberculosis H37Rv
ggaaucgcggagccagga

SEQ ID NO: 1361658 - RNA, 16 nt, Mycobacterium tuberculosis H37Rv
ggacagggugcgcuug

SEQ ID NO: 1361659 - RNA, 14 nt, Mycobacterium tuberculosis H37Rv
ggaaucuccggcug

SEQ ID NO: 1361660 - RNA, 20 nt, Mycobacterium tuberculosis H37Rv
ggacauccgggccgagcgca

SEQ ID NO: 1361661 - RNA, 23 nt, Mycobacterium tuberculosis H37Rv
ggaccaacgccaacgccacggca

SEQ ID NO: 1361662 - RNA, 20 nt, Mycobacterium tuberculosis H37Rv
ggacaguuccccgggcucgg

SEQ ID NO: 1361663 - RNA, 21 nt, Mycobacterium tuberculosis H37Rv
ggacaggucgaaugggggcug

SEQ ID NO: 1361664 - RNA, 23 nt, Mycobacterium tuberculosis H37Rv
ggacaggucgggcccccggcagc

SEQ ID NO: 1361665 - RNA, 16 nt, Mycobacterium tuberculosis H37Rv
ggacagguagucgccg

SEQ ID NO: 1361666 - RNA, 16 nt, Mycobacterium tuberculosis H37Rv
ggacggccaacagggc

SEQ ID NO: 1361667 - RNA, 17 nt, Mycobacterium tuberculosis H37Rv
ggacgcgaaauccccug

SEQ ID NO: 1361668 - RNA, 21 nt, Mycobacterium tuberculosis H37Rv
ggacgccagcucaaccacaug

SEQ ID NO: 1361669 - RNA, 13 nt, Mycobacterium tuberculosis H37Rv
ggacgccagcaau

SEQ ID NO: 1361670 - RNA, 19 nt, Mycobacterium tuberculosis H37Rv
ggacgccagcucaaccaca

SEQ ID NO: 1361671 - RNA, 16 nt, Mycobacterium tuberculosis H37Rv
ggacgccgcgccggcg

SEQ ID NO: 1361672 - RNA, 20 nt, Mycobacterium tuberculosis H37Rv
ggacgcccgaguugaagaau

SEQ ID NO: 1361673 - RNA, 23 nt, Mycobacterium tuberculosis H37Rv
ggacgauggcgucggccaggauc

SEQ ID NO: 1361674 - RNA, 20 nt, Mycobacterium tuberculosis H37Rv
ggacgauggcgucggccagg

SEQ ID NO: 1361675 - RNA, 14 nt, Mycobacterium tuberculosis H37Rv
ggacguggacuuug

SEQ ID NO: 1361676 - RNA, 14 nt, Mycobacterium tuberculosis H37Rv
ggacguucuggauc

SEQ ID NO: 1361677 - RNA, 13 nt, Mycobacterium tuberculosis H37Rv
ggacgugucggug

SEQ ID NO: 1361678 - RNA, 16 nt, Mycobacterium tuberculosis H37Rv
ggacguuucagccggg

SEQ ID NO: 1361679 - RNA, 18 nt, Mycobacterium tuberculosis H37Rv
ggacguuucagccgggug

SEQ ID NO: 1361680 - RNA, 12 nt, Mycobacterium tuberculosis H37Rv
ggacgggcggcc

SEQ ID NO: 1361681 - RNA, 18 nt, Mycobacterium tuberculosis H37Rv
ggacgggaucgcccaggc

SEQ ID NO: 1361682 - RNA, 16 nt, Mycobacterium tuberculosis H37Rv
ggacggugggucucga

SEQ ID NO: 1361683 - RNA, 14 nt, Mycobacterium tuberculosis H37Rv
ggacgggucgccgc

SEQ ID NO: 1361684 - RNA, 14 nt, Mycobacterium tuberculosis H37Rv
ggacggucgccagg

SEQ ID NO: 1361685 - RNA, 14 nt, Mycobacterium tuberculosis H37Rv
ggacggucgcucgg

SEQ ID NO: 1361686 - RNA, 18 nt, Mycobacterium tuberculosis H37Rv
ggacggugaaaccggccu

SEQ ID NO: 1361687 - RNA, 21 nt, Mycobacterium tuberculosis H37Rv
ggacgggaugcuuggucucga

SEQ ID NO: 1361688 - RNA, 12 nt, Mycobacterium tuberculosis H37Rv
ggacggccucca

SEQ ID NO: 1361689 - RNA, 14 nt, Mycobacterium tuberculosis H37Rv
ggacucacgcagcg

SEQ ID NO: 1361690 - RNA, 16 nt, Mycobacterium tuberculosis H37Rv
ggacucgcguccucgg

SEQ ID NO: 1361691 - RNA, 23 nt, Mycobacterium tuberculosis H37Rv
ggagaauuaguuucguccccaga

SEQ ID NO: 1361692 - RNA, 17 nt, Mycobacterium tuberculosis H37Rv
ggagaacgcccgcagga

SEQ ID NO: 1361693 - RNA, 17 nt, Mycobacterium tuberculosis H37Rv
ggaggcguugcacugcu

SEQ ID NO: 1361694 - RNA, 17 nt, Mycobacterium tuberculosis H37Rv
ggagggccgcgaucgac

SEQ ID NO: 1361695 - RNA, 18 nt, Mycobacterium tuberculosis H37Rv
ggagggcccggccggacg

SEQ ID NO: 1361696 - RNA, 12 nt, Mycobacterium tuberculosis H37Rv
ggagggcgagca

SEQ ID NO: 1361697 - RNA, 21 nt, Mycobacterium tuberculosis H37Rv
ggagggcgagcaacucgucca

SEQ ID NO: 1361698 - RNA, 21 nt, Mycobacterium tuberculosis H37Rv
ggagggguucacccagcggcg

SEQ ID NO: 1361699 - RNA, 14 nt, Mycobacterium tuberculosis H37Rv
ggaggcaagcaacc

SEQ ID NO: 1361700 - RNA, 20 nt, Mycobacterium tuberculosis H37Rv
ggaggccaacccugcggcgu

SEQ ID NO: 1361701 - RNA, 12 nt, Mycobacterium tuberculosis H37Rv
ggaggcaagcaa

SEQ ID NO: 1361702 - RNA, 13 nt, Mycobacterium tuberculosis H37Rv
ggaggccaucauc

SEQ ID NO: 1361703 - RNA, 15 nt, Mycobacterium tuberculosis H37Rv
ggaggaaccccgcgc

SEQ ID NO: 1361704 - RNA, 17 nt, Mycobacterium tuberculosis H37Rv
ggaggacaccagcugga

SEQ ID NO: 1361705 - RNA, 14 nt, Mycobacterium tuberculosis H37Rv
ggagcugccgggag

SEQ ID NO: 1361706 - RNA, 14 nt, Mycobacterium tuberculosis H37Rv
ggagcuguggcggg

SEQ ID NO: 1361707 - RNA, 19 nt, Mycobacterium tuberculosis H37Rv
ggagcucuugcgggcagcc

SEQ ID NO: 1361708 - RNA, 21 nt, Mycobacterium tuberculosis H37Rv
ggagcucuugcgggcagccgc

SEQ ID NO: 1361709 - RNA, 22 nt, Mycobacterium tuberculosis H37Rv
ggagcucuugcgggcagccgcc

SEQ ID NO: 1361710 - RNA, 16 nt, Mycobacterium tuberculosis H37Rv
ggagcggguggccggg

SEQ ID NO: 1361711 - RNA, 14 nt, Mycobacterium tuberculosis H37Rv
ggagcgggugcggg

SEQ ID NO: 1361712 - RNA, 16 nt, Mycobacterium tuberculosis H37Rv
ggagcgggugcgggcg

SEQ ID NO: 1361713 - RNA, 14 nt, Mycobacterium tuberculosis H37Rv
ggagcgggccagca

SEQ ID NO: 1361714 - RNA, 23 nt, Mycobacterium tuberculosis H37Rv
ggagcgguaggcguugaucgccg

SEQ ID NO: 1361715 - RNA, 19 nt, Mycobacterium tuberculosis H37Rv
ggagacaccgcaacgcgug

SEQ ID NO: 1361716 - RNA, 21 nt, Mycobacterium tuberculosis H37Rv
ggagauccaccgguccagggc

SEQ ID NO: 1361717 - RNA, 18 nt, Mycobacterium tuberculosis H37Rv
ggagauccaccgguccag

SEQ ID NO: 1361718 - RNA, 20 nt, Mycobacterium tuberculosis H37Rv
ggagccgugcggucgcgccc

SEQ ID NO: 1361719 - RNA, 13 nt, Mycobacterium tuberculosis H37Rv
ggagcggccgccg

SEQ ID NO: 1361720 - RNA, 13 nt, Mycobacterium tuberculosis H37Rv
ggagcggcucgcg

SEQ ID NO: 1361721 - RNA, 15 nt, Mycobacterium tuberculosis H37Rv
ggagcggcgcggggg

SEQ ID NO: 1361722 - RNA, 13 nt, Mycobacterium tuberculosis H37Rv
ggagcgggccagc

SEQ ID NO: 1361723 - RNA, 15 nt, Mycobacterium tuberculosis H37Rv
ggagcgccagccgcu

SEQ ID NO: 1361724 - RNA, 20 nt, Mycobacterium tuberculosis H37Rv
ggagcgcgccucgcccagca

SEQ ID NO: 1361725 - RNA, 13 nt, Mycobacterium tuberculosis H37Rv
ggagcgccgcagg

SEQ ID NO: 1361726 - RNA, 18 nt, Mycobacterium tuberculosis H37Rv
ggagcgcaggaccugacg

SEQ ID NO: 1361727 - RNA, 17 nt, Mycobacterium tuberculosis H37Rv
ggagcgcagcgccggca

SEQ ID NO: 1361728 - RNA, 22 nt, Mycobacterium tuberculosis H37Rv
ggagccgugcggucgcgcccuc

SEQ ID NO: 1361729 - RNA, 14 nt, Mycobacterium tuberculosis H37Rv
ggagcgaacggcgc

SEQ ID NO: 1361730 - RNA, 20 nt, Mycobacterium tuberculosis H37Rv
ggaucagcgaguggucccgu

SEQ ID NO: 1361731 - RNA, 12 nt, Mycobacterium tuberculosis H37Rv
ggaucccagccc

SEQ ID NO: 1361732 - RNA, 15 nt, Mycobacterium tuberculosis H37Rv
ggaucagcccgcgca

SEQ ID NO: 1361733 - RNA, 16 nt, Mycobacterium tuberculosis H37Rv
ggaucagaacgcggcc

SEQ ID NO: 1361734 - RNA, 15 nt, Mycobacterium tuberculosis H37Rv
ggaucccgcugcacg

SEQ ID NO: 1361735 - RNA, 15 nt, Mycobacterium tuberculosis H37Rv
ggaucccggccgggu

SEQ ID NO: 1361736 - RNA, 12 nt, Mycobacterium tuberculosis H37Rv
ggaucccgccgc

SEQ ID NO: 1361737 - RNA, 17 nt, Mycobacterium tuberculosis H37Rv
ggauccggaggcggcuc

SEQ ID NO: 1361738 - RNA, 21 nt, Mycobacterium tuberculosis H37Rv
ggauccucggccgccaucgcc

SEQ ID NO: 1361739 - RNA, 18 nt, Mycobacterium tuberculosis H37Rv
ggauccgaagagccagca

SEQ ID NO: 1361740 - RNA, 17 nt, Mycobacterium tuberculosis H37Rv
ggauccgaccccgcgcc

SEQ ID NO: 1361741 - RNA, 16 nt, Mycobacterium tuberculosis H37Rv
ggauccgauccgcaca

SEQ ID NO: 1361742 - RNA, 15 nt, Mycobacterium tuberculosis H37Rv
ggauccggaagcccu

SEQ ID NO: 1361743 - RNA, 16 nt, Mycobacterium tuberculosis H37Rv
ggauccgcaccacgcc

SEQ ID NO: 1361744 - RNA, 15 nt, Mycobacterium tuberculosis H37Rv
ggauaucacgacgcc

SEQ ID NO: 1361745 - RNA, 19 nt, Mycobacterium tuberculosis H37Rv
ggaucacaccccaggcacc

SEQ ID NO: 1361746 - RNA, 14 nt, Mycobacterium tuberculosis H37Rv
ggaucaccaucgcc

SEQ ID NO: 1361747 - RNA, 14 nt, Mycobacterium tuberculosis H37Rv
ggaucacccgccgc

SEQ ID NO: 1361748 - RNA, 13 nt, Mycobacterium tuberculosis H37Rv
ggaucaccgcgcc

SEQ ID NO: 1361749 - RNA, 23 nt, Mycobacterium tuberculosis H37Rv
ggaggguucgccgaagccggacc

SEQ ID NO: 1361750 - RNA, 21 nt, Mycobacterium tuberculosis H37Rv
ggaggucaaaaucagggugcc

SEQ ID NO: 1361751 - RNA, 21 nt, Mycobacterium tuberculosis H37Rv
ggagucaacuucgacaacgca

SEQ ID NO: 1361752 - RNA, 21 nt, Mycobacterium tuberculosis H37Rv
ggaguagccgcagcugagccg

SEQ ID NO: 1361753 - RNA, 18 nt, Mycobacterium tuberculosis H37Rv
ggauagcgucgucccagc

SEQ ID NO: 1361754 - RNA, 12 nt, Mycobacterium tuberculosis H37Rv
ggaguggccggg

SEQ ID NO: 1361755 - RNA, 18 nt, Mycobacterium tuberculosis H37Rv
ggauaguuuucggccgcc

SEQ ID NO: 1361756 - RNA, 22 nt, Mycobacterium tuberculosis H37Rv
ggagugcgccggcuggcggccu

SEQ ID NO: 1361757 - RNA, 21 nt, Mycobacterium tuberculosis H37Rv
ggagugaggcugugccccagg

SEQ ID NO: 1361758 - RNA, 21 nt, Mycobacterium tuberculosis H37Rv
ggagucuucggcgacaggccg

SEQ ID NO: 1361759 - RNA, 23 nt, Mycobacterium tuberculosis H37Rv
ggagucgucggcaugggccggcg

SEQ ID NO: 1361760 - RNA, 24 nt, Mycobacterium tuberculosis H37Rv
ggagucgucguguuggccgggucg

SEQ ID NO: 1361761 - RNA, 15 nt, Mycobacterium tuberculosis H37Rv
ggagucgucgagcug

SEQ ID NO: 1361762 - RNA, 11 nt, Mycobacterium tuberculosis H37Rv
ggccagcgcau

SEQ ID NO: 1361763 - RNA, 23 nt, Mycobacterium tuberculosis H37Rv
ggccagcgcaucuuugaacgcca

SEQ ID NO: 1361764 - RNA, 22 nt, Mycobacterium tuberculosis H37Rv
ggccagcgaugugaaccgggca

SEQ ID NO: 1361765 - RNA, 14 nt, Mycobacterium tuberculosis H37Rv
ggccagcgcaccgc

SEQ ID NO: 1361766 - RNA, 16 nt, Mycobacterium tuberculosis H37Rv
ggccagccuaccggcu

SEQ ID NO: 1361767 - RNA, 17 nt, Mycobacterium tuberculosis H37Rv
ggccagcgagaucagca

SEQ ID NO: 1361768 - RNA, 18 nt, Mycobacterium tuberculosis H37Rv
ggccagccacuccucggu

SEQ ID NO: 1361769 - RNA, 16 nt, Mycobacterium tuberculosis H37Rv
ggccagcaucgggugg

SEQ ID NO: 1361770 - RNA, 20 nt, Mycobacterium tuberculosis H37Rv
ggccagcaugucgggccgcu

SEQ ID NO: 1361771 - RNA, 17 nt, Mycobacterium tuberculosis H37Rv
ggccagccagcgggcga

SEQ ID NO: 1361772 - RNA, 17 nt, Mycobacterium tuberculosis H37Rv
ggccagccgacgcggcg

SEQ ID NO: 1361773 - RNA, 15 nt, Mycobacterium tuberculosis H37Rv
ggccagccgcacggu

SEQ ID NO: 1361774 - RNA, 13 nt, Mycobacterium tuberculosis H37Rv
ggccagcccgagc

SEQ ID NO: 1361775 - RNA, 14 nt, Mycobacterium tuberculosis H37Rv
ggccagccgcggcc

SEQ ID NO: 1361776 - RNA, 18 nt, Mycobacterium tuberculosis H37Rv
ggccacguccucagccgu

SEQ ID NO: 1361777 - RNA, 14 nt, Mycobacterium tuberculosis H37Rv
ggccacucccagcc

SEQ ID NO: 1361778 - RNA, 21 nt, Mycobacterium tuberculosis H37Rv
ggccacucacauuggccaggu

SEQ ID NO: 1361779 - RNA, 19 nt, Mycobacterium tuberculosis H37Rv
ggccacgguccggcccacc

SEQ ID NO: 1361780 - RNA, 22 nt, Mycobacterium tuberculosis H37Rv
ggccacgguccggcccaccagc

SEQ ID NO: 1361781 - RNA, 22 nt, Mycobacterium tuberculosis H37Rv
ggccacguagcagcagacgacg

SEQ ID NO: 1361782 - RNA, 17 nt, Mycobacterium tuberculosis H37Rv
ggccacggucagccagg

SEQ ID NO: 1361783 - RNA, 17 nt, Mycobacterium tuberculosis H37Rv
ggccacggggcugccgg

SEQ ID NO: 1361784 - RNA, 19 nt, Mycobacterium tuberculosis H37Rv
ggccacggcgucggccacc

SEQ ID NO: 1361785 - RNA, 17 nt, Mycobacterium tuberculosis H37Rv
ggccaccgaacgcggcc

SEQ ID NO: 1361786 - RNA, 20 nt, Mycobacterium tuberculosis H37Rv
ggccaccgaacgcggccacc

SEQ ID NO: 1361787 - RNA, 16 nt, Mycobacterium tuberculosis H37Rv
ggccaccaguccgaug

SEQ ID NO: 1361788 - RNA, 17 nt, Mycobacterium tuberculosis H37Rv
ggccaccaucgccgccg

SEQ ID NO: 1361789 - RNA, 14 nt, Mycobacterium tuberculosis H37Rv
ggccagcaucauca

SEQ ID NO: 1361790 - RNA, 20 nt, Mycobacterium tuberculosis H37Rv
ggccagcaucagcgccagcg

SEQ ID NO: 1361791 - RNA, 23 nt, Mycobacterium tuberculosis H37Rv
ggccagcaggaugaugaccgcca

SEQ ID NO: 1361792 - RNA, 15 nt, Mycobacterium tuberculosis H37Rv
ggccagcagcgcggg

SEQ ID NO: 1361793 - RNA, 14 nt, Mycobacterium tuberculosis H37Rv
ggccagcagccgcg

SEQ ID NO: 1361794 - RNA, 23 nt, Mycobacterium tuberculosis H37Rv
ggccacugagucugauggccucg

SEQ ID NO: 1361795 - RNA, 18 nt, Mycobacterium tuberculosis H37Rv
ggccacugauucgcaggc

SEQ ID NO: 1361796 - RNA, 15 nt, Mycobacterium tuberculosis H37Rv
ggccagcagcaacga

SEQ ID NO: 1361797 - RNA, 16 nt, Mycobacterium tuberculosis H37Rv
ggccacuccgguggcc

SEQ ID NO: 1361798 - RNA, 21 nt, Mycobacterium tuberculosis H37Rv
ggccacuccgguggccaacac

SEQ ID NO: 1361799 - RNA, 14 nt, Mycobacterium tuberculosis H37Rv
ggccaggugcaggc

SEQ ID NO: 1361800 - RNA, 15 nt, Mycobacterium tuberculosis H37Rv
ggccaggugcagggu

SEQ ID NO: 1361801 - RNA, 16 nt, Mycobacterium tuberculosis H37Rv
ggccagguggcgagcg

SEQ ID NO: 1361802 - RNA, 22 nt, Mycobacterium tuberculosis H37Rv
ggccaguaugcggugcccgccc

SEQ ID NO: 1361803 - RNA, 24 nt, Mycobacterium tuberculosis H37Rv
ggccagugaaaccaccggccgucc

SEQ ID NO: 1361804 - RNA, 14 nt, Mycobacterium tuberculosis H37Rv
ggccagucgugcuu

SEQ ID NO: 1361805 - RNA, 23 nt, Mycobacterium tuberculosis H37Rv
ggccaucgggauggacaccaccu

SEQ ID NO: 1361806 - RNA, 18 nt, Mycobacterium tuberculosis H37Rv
ggccaucgggauggacac

SEQ ID NO: 1361807 - RNA, 17 nt, Mycobacterium tuberculosis H37Rv
ggccaucgaguccacca

SEQ ID NO: 1361808 - RNA, 15 nt, Mycobacterium tuberculosis H37Rv
ggccaucgacgacac

SEQ ID NO: 1361809 - RNA, 16 nt, Mycobacterium tuberculosis H37Rv
ggccaucgagggcauc

SEQ ID NO: 1361810 - RNA, 17 nt, Mycobacterium tuberculosis H37Rv
ggccaugucagcggccu

SEQ ID NO: 1361811 - RNA, 16 nt, Mycobacterium tuberculosis H37Rv
ggccauguccaccagc

SEQ ID NO: 1361812 - RNA, 17 nt, Mycobacterium tuberculosis H37Rv
ggccauguuggggaugc

SEQ ID NO: 1361813 - RNA, 15 nt, Mycobacterium tuberculosis H37Rv
ggccaggccggcggc

SEQ ID NO: 1361814 - RNA, 16 nt, Mycobacterium tuberculosis H37Rv
ggccaggccgucggcg

SEQ ID NO: 1361815 - RNA, 16 nt, Mycobacterium tuberculosis H37Rv
ggccaggucggccacc

SEQ ID NO: 1361816 - RNA, 19 nt, Mycobacterium tuberculosis H37Rv
ggccaggauuucgcaguug

SEQ ID NO: 1361817 - RNA, 22 nt, Mycobacterium tuberculosis H37Rv
ggccagcucccgggcggcggcc

SEQ ID NO: 1361818 - RNA, 23 nt, Mycobacterium tuberculosis H37Rv
ggccagcucccgggcggcggccu

SEQ ID NO: 1361819 - RNA, 18 nt, Mycobacterium tuberculosis H37Rv
ggccagcucccgcgagcg

SEQ ID NO: 1361820 - RNA, 17 nt, Mycobacterium tuberculosis H37Rv
ggccagcguguccgcca

SEQ ID NO: 1361821 - RNA, 18 nt, Mycobacterium tuberculosis H37Rv
ggccagcggcagccuggc

SEQ ID NO: 1361822 - RNA, 13 nt, Mycobacterium tuberculosis H37Rv
ggccagcggcagc

SEQ ID NO: 1361823 - RNA, 14 nt, Mycobacterium tuberculosis H37Rv
ggccagcggcagcc

SEQ ID NO: 1361824 - RNA, 22 nt, Mycobacterium tuberculosis H37Rv
ggccagcgguaaugccagcggc

SEQ ID NO: 1361825 - RNA, 13 nt, Mycobacterium tuberculosis H37Rv
ggccagcggguga

SEQ ID NO: 1361826 - RNA, 20 nt, Mycobacterium tuberculosis H37Rv
ggccagcgucaacagcgugg

SEQ ID NO: 1361827 - RNA, 15 nt, Mycobacterium tuberculosis H37Rv
ggccagcuccagcgc

SEQ ID NO: 1361828 - RNA, 16 nt, Mycobacterium tuberculosis H37Rv
ggccagcuccagcgcc

SEQ ID NO: 1361829 - RNA, 22 nt, Mycobacterium tuberculosis H37Rv
ggccagcgcggcgcgcggggcc

SEQ ID NO: 1361830 - RNA, 17 nt, Mycobacterium tuberculosis H37Rv
ggccagcgcgucgccgu

SEQ ID NO: 1361831 - RNA, 19 nt, Mycobacterium tuberculosis H37Rv
ggccagcgcuucgucggcc

SEQ ID NO: 1361832 - RNA, 14 nt, Mycobacterium tuberculosis H37Rv
ggccagcgcugcug

SEQ ID NO: 1361833 - RNA, 12 nt, Mycobacterium tuberculosis H37Rv
ggccagcgcggc

SEQ ID NO: 1361834 - RNA, 13 nt, Mycobacterium tuberculosis H37Rv
ggccagcgcggcg

SEQ ID NO: 1361835 - RNA, 12 nt, Mycobacterium tuberculosis H37Rv
ggccaccagucc

SEQ ID NO: 1361836 - RNA, 17 nt, Mycobacterium tuberculosis H37Rv
ggccaccaccgagcgca

SEQ ID NO: 1361837 - RNA, 18 nt, Mycobacterium tuberculosis H37Rv
ggccaccagcgcccggcc

SEQ ID NO: 1361838 - RNA, 12 nt, Mycobacterium tuberculosis H37Rv
ggccaccacugc

SEQ ID NO: 1361839 - RNA, 14 nt, Mycobacterium tuberculosis H37Rv
ggccaccagaacca

SEQ ID NO: 1361840 - RNA, 14 nt, Mycobacterium tuberculosis H37Rv
ggccaccagcaugc

SEQ ID NO: 1361841 - RNA, 11 nt, Mycobacterium tuberculosis H37Rv
ggccaccagcg

SEQ ID NO: 1361842 - RNA, 16 nt, Mycobacterium tuberculosis H37Rv
ggccacauccagcgcu

SEQ ID NO: 1361843 - RNA, 18 nt, Mycobacterium tuberculosis H37Rv
ggccacaucgccagcagc

SEQ ID NO: 1361844 - RNA, 12 nt, Mycobacterium tuberculosis H37Rv
ggccacauccag

SEQ ID NO: 1361845 - RNA, 14 nt, Mycobacterium tuberculosis H37Rv
ggccacagcccggc

SEQ ID NO: 1361846 - RNA, 17 nt, Mycobacterium tuberculosis H37Rv
ggccaccaccgccgccg

SEQ ID NO: 1361847 - RNA, 21 nt, Mycobacterium tuberculosis H37Rv
ggccaccaccgcgccgucguc

SEQ ID NO: 1361848 - RNA, 14 nt, Mycobacterium tuberculosis H37Rv
ggccaaccccaugg

SEQ ID NO: 1361849 - RNA, 18 nt, Mycobacterium tuberculosis H37Rv
ggccaaccgggugugcgu

SEQ ID NO: 1361850 - RNA, 18 nt, Mycobacterium tuberculosis H37Rv
ggccaacugggccgagcg

SEQ ID NO: 1361851 - RNA, 20 nt, Mycobacterium tuberculosis H37Rv
ggccaacucuucagcaagcc

SEQ ID NO: 1361852 - RNA, 18 nt, Mycobacterium tuberculosis H37Rv
ggccacacagucacggac

SEQ ID NO: 1361853 - RNA, 23 nt, Mycobacterium tuberculosis H37Rv
ggccaagaaugugggcgacggcc

SEQ ID NO: 1361854 - RNA, 17 nt, Mycobacterium tuberculosis H37Rv
ggccaagaccgcggccc

SEQ ID NO: 1361855 - RNA, 21 nt, Mycobacterium tuberculosis H37Rv
ggccaagaaugugggcgacgg

SEQ ID NO: 1361856 - RNA, 15 nt, Mycobacterium tuberculosis H37Rv
ggccacaaccucguc

SEQ ID NO: 1361857 - RNA, 19 nt, Mycobacterium tuberculosis H37Rv
ggccaacuuggcggccagc

SEQ ID NO: 1361858 - RNA, 20 nt, Mycobacterium tuberculosis H37Rv
ggccaacuuggcggccagcc

SEQ ID NO: 1361859 - RNA, 22 nt, Mycobacterium tuberculosis H37Rv
ggccaacuuggcggccagccgc

SEQ ID NO: 1361860 - RNA, 16 nt, Mycobacterium tuberculosis H37Rv
ggccaacuucugcacg

SEQ ID NO: 1361861 - RNA, 14 nt, Mycobacterium tuberculosis H37Rv
ggccaagaucggcg

SEQ ID NO: 1361862 - RNA, 21 nt, Mycobacterium tuberculosis H37Rv
ggccaagaucggcgccccugc

SEQ ID NO: 1361863 - RNA, 14 nt, Mycobacterium tuberculosis H37Rv
ggcaugccacacac

SEQ ID NO: 1361864 - RNA, 16 nt, Mycobacterium tuberculosis H37Rv
ggcaugacgaauuggu

SEQ ID NO: 1361865 - RNA, 19 nt, Mycobacterium tuberculosis H37Rv
ggcaugacauacagcgggc

SEQ ID NO: 1361866 - RNA, 23 nt, Mycobacterium tuberculosis H37Rv
ggcaugauccccguugacccaga

SEQ ID NO: 1361867 - RNA, 22 nt, Mycobacterium tuberculosis H37Rv
ggcaugauuuuucgcagugacg

SEQ ID NO: 1361868 - RNA, 21 nt, Mycobacterium tuberculosis H37Rv
ggcaugcaaugcuggcggcgc

SEQ ID NO: 1361869 - RNA, 17 nt, Mycobacterium tuberculosis H37Rv
ggcaugggcccugcaca

SEQ ID NO: 1361870 - RNA, 15 nt, Mycobacterium tuberculosis H37Rv
ggcaugggccggcgc

SEQ ID NO: 1361871 - RNA, 17 nt, Mycobacterium tuberculosis H37Rv
ggcaugggccggcgccg

SEQ ID NO: 1361872 - RNA, 17 nt, Mycobacterium tuberculosis H37Rv
ggcauggucaggcggcc

SEQ ID NO: 1361873 - RNA, 21 nt, Mycobacterium tuberculosis H37Rv
ggcauggucaggcggccgucg

SEQ ID NO: 1361874 - RNA, 16 nt, Mycobacterium tuberculosis H37Rv
ggcauguaccgaccgc

SEQ ID NO: 1361875 - RNA, 13 nt, Mycobacterium tuberculosis H37Rv
ggcauggucaggc

SEQ ID NO: 1361876 - RNA, 21 nt, Mycobacterium tuberculosis H37Rv
ggccaacaccacuagcggcuc

SEQ ID NO: 1361877 - RNA, 15 nt, Mycobacterium tuberculosis H37Rv
ggccaacagguccac

SEQ ID NO: 1361878 - RNA, 23 nt, Mycobacterium tuberculosis H37Rv
ggcagugcgaaaaucgcgcgcga

SEQ ID NO: 1361879 - RNA, 14 nt, Mycobacterium tuberculosis H37Rv
ggcagugcgcggcg

SEQ ID NO: 1361880 - RNA, 20 nt, Mycobacterium tuberculosis H37Rv
ggcagugguuacagaugaag

SEQ ID NO: 1361881 - RNA, 23 nt, Mycobacterium tuberculosis H37Rv
ggcagucgcgguaccaucaccgc

SEQ ID NO: 1361882 - RNA, 18 nt, Mycobacterium tuberculosis H37Rv
ggcaguugacccaugccg

SEQ ID NO: 1361883 - RNA, 14 nt, Mycobacterium tuberculosis H37Rv
ggcaguucgcggcc

SEQ ID NO: 1361884 - RNA, 17 nt, Mycobacterium tuberculosis H37Rv
ggcagcguugacgguca

SEQ ID NO: 1361885 - RNA, 19 nt, Mycobacterium tuberculosis H37Rv
ggcaguccaccgcgcggcg

SEQ ID NO: 1361886 - RNA, 17 nt, Mycobacterium tuberculosis H37Rv
ggcagucaggccuagcg

SEQ ID NO: 1361887 - RNA, 15 nt, Mycobacterium tuberculosis H37Rv
ggcagcguccacaug

SEQ ID NO: 1361888 - RNA, 16 nt, Mycobacterium tuberculosis H37Rv
ggcagcgggcuccccg

SEQ ID NO: 1361889 - RNA, 13 nt, Mycobacterium tuberculosis H37Rv
ggcagcgggacug

SEQ ID NO: 1361890 - RNA, 19 nt, Mycobacterium tuberculosis H37Rv
ggcagcgggacugcggaag

SEQ ID NO: 1361891 - RNA, 16 nt, Mycobacterium tuberculosis H37Rv
ggcagcgguggcuugc

SEQ ID NO: 1361892 - RNA, 15 nt, Mycobacterium tuberculosis H37Rv
ggcagcgguggcuug

SEQ ID NO: 1361893 - RNA, 14 nt, Mycobacterium tuberculosis H37Rv
ggcauccuucacca

SEQ ID NO: 1361894 - RNA, 14 nt, Mycobacterium tuberculosis H37Rv
ggcaucgacugcca

SEQ ID NO: 1361895 - RNA, 17 nt, Mycobacterium tuberculosis H37Rv
ggcaucgacugccagcg

SEQ ID NO: 1361896 - RNA, 16 nt, Mycobacterium tuberculosis H37Rv
ggcaucgagacgagcc

SEQ ID NO: 1361897 - RNA, 17 nt, Mycobacterium tuberculosis H37Rv
ggcaucgagacgagcca

SEQ ID NO: 1361898 - RNA, 18 nt, Mycobacterium tuberculosis H37Rv
ggcaucgagacgagccac

SEQ ID NO: 1361899 - RNA, 20 nt, Mycobacterium tuberculosis H37Rv
ggcaucgauaauggccgagu

SEQ ID NO: 1361900 - RNA, 13 nt, Mycobacterium tuberculosis H37Rv
ggcauccugcacg

SEQ ID NO: 1361901 - RNA, 21 nt, Mycobacterium tuberculosis H37Rv
ggcaucucggcuacgccucgg

SEQ ID NO: 1361902 - RNA, 14 nt, Mycobacterium tuberculosis H37Rv
ggcaucgccgagcu

SEQ ID NO: 1361903 - RNA, 14 nt, Mycobacterium tuberculosis H37Rv
ggcauacaacuggu

SEQ ID NO: 1361904 - RNA, 16 nt, Mycobacterium tuberculosis H37Rv
ggcauacauccaggcu

SEQ ID NO: 1361905 - RNA, 22 nt, Mycobacterium tuberculosis H37Rv
ggcauccccaguugugcggcca

SEQ ID NO: 1361906 - RNA, 19 nt, Mycobacterium tuberculosis H37Rv
ggcauaccgaacagcaccu

SEQ ID NO: 1361907 - RNA, 23 nt, Mycobacterium tuberculosis H37Rv
ggcauacaucgccuugcccagcg

SEQ ID NO: 1361908 - RNA, 11 nt, Mycobacterium tuberculosis H37Rv
ggcaccagguu

SEQ ID NO: 1361909 - RNA, 19 nt, Mycobacterium tuberculosis H37Rv
ggcaccagcggcaccgcgg

SEQ ID NO: 1361910 - RNA, 16 nt, Mycobacterium tuberculosis H37Rv
ggcaccagcagccagc

SEQ ID NO: 1361911 - RNA, 23 nt, Mycobacterium tuberculosis H37Rv
ggcacccggugagaagaagccca

SEQ ID NO: 1361912 - RNA, 13 nt, Mycobacterium tuberculosis H37Rv
ggcacccuccgcc

SEQ ID NO: 1361913 - RNA, 19 nt, Mycobacterium tuberculosis H37Rv
ggcacccggucggccaucc

SEQ ID NO: 1361914 - RNA, 19 nt, Mycobacterium tuberculosis H37Rv
ggcacccggggugcccggc

SEQ ID NO: 1361915 - RNA, 20 nt, Mycobacterium tuberculosis H37Rv
ggcacccggggugcccggcc

SEQ ID NO: 1361916 - RNA, 22 nt, Mycobacterium tuberculosis H37Rv
ggcacccgcggcgaaccgucuc

SEQ ID NO: 1361917 - RNA, 11 nt, Mycobacterium tuberculosis H37Rv
ggcacccggcu

SEQ ID NO: 1361918 - RNA, 22 nt, Mycobacterium tuberculosis H37Rv
ggcaccccuuugacgccgagca

SEQ ID NO: 1361919 - RNA, 17 nt, Mycobacterium tuberculosis H37Rv
ggcacccgacucgucgg

SEQ ID NO: 1361920 - RNA, 18 nt, Mycobacterium tuberculosis H37Rv
ggcaccgccgcccccgcc

SEQ ID NO: 1361921 - RNA, 13 nt, Mycobacterium tuberculosis H37Rv
ggcaccgccgccc

SEQ ID NO: 1361922 - RNA, 16 nt, Mycobacterium tuberculosis H37Rv
ggcaccgccagccacc

SEQ ID NO: 1361923 - RNA, 19 nt, Mycobacterium tuberculosis H37Rv
ggcaccgcccccgucggcc

SEQ ID NO: 1361924 - RNA, 11 nt, Mycobacterium tuberculosis H37Rv
ggcaccgcccu

SEQ ID NO: 1361925 - RNA, 19 nt, Mycobacterium tuberculosis H37Rv
ggcaccgcccuugccgccg

SEQ ID NO: 1361926 - RNA, 13 nt, Mycobacterium tuberculosis H37Rv
ggcaccgccagcc

SEQ ID NO: 1361927 - RNA, 14 nt, Mycobacterium tuberculosis H37Rv
ggcaccgaugcacu

SEQ ID NO: 1361928 - RNA, 17 nt, Mycobacterium tuberculosis H37Rv
ggcaccgagucuaagga

SEQ ID NO: 1361929 - RNA, 24 nt, Mycobacterium tuberculosis H37Rv
ggcaccgaaaaacaccagcgaggc

SEQ ID NO: 1361930 - RNA, 17 nt, Mycobacterium tuberculosis H37Rv
ggcaccggugcccacca

SEQ ID NO: 1361931 - RNA, 12 nt, Mycobacterium tuberculosis H37Rv
ggcaccggccgg

SEQ ID NO: 1361932 - RNA, 15 nt, Mycobacterium tuberculosis H37Rv
ggcaccgugggcggg

SEQ ID NO: 1361933 - RNA, 16 nt, Mycobacterium tuberculosis H37Rv
ggcaccgcggccgcgg

SEQ ID NO: 1361934 - RNA, 19 nt, Mycobacterium tuberculosis H37Rv
ggcaccgcugccgcugccg

SEQ ID NO: 1361935 - RNA, 15 nt, Mycobacterium tuberculosis H37Rv
ggcaccgcuucaggc

SEQ ID NO: 1361936 - RNA, 19 nt, Mycobacterium tuberculosis H37Rv
ggcaccggauccggaggcg

SEQ ID NO: 1361937 - RNA, 18 nt, Mycobacterium tuberculosis H37Rv
ggcaccgcggccagcggg

SEQ ID NO: 1361938 - RNA, 15 nt, Mycobacterium tuberculosis H37Rv
ggcaccgcggccgcg

SEQ ID NO: 1361939 - RNA, 16 nt, Mycobacterium tuberculosis H37Rv
ggcaccgcggccagcg

SEQ ID NO: 1361940 - RNA, 16 nt, Mycobacterium tuberculosis H37Rv
ggcaccgcgcgcucca

SEQ ID NO: 1361941 - RNA, 19 nt, Mycobacterium tuberculosis H37Rv
ggcaccgccgcccccgccg

SEQ ID NO: 1361942 - RNA, 22 nt, Mycobacterium tuberculosis H37Rv
ggcaccgccgcccccgccggcc

SEQ ID NO: 1361943 - RNA, 24 nt, Mycobacterium tuberculosis H37Rv
ggcacggaugcgauggccgacgcu

SEQ ID NO: 1361944 - RNA, 18 nt, Mycobacterium tuberculosis H37Rv
ggcacggucacacgccag

SEQ ID NO: 1361945 - RNA, 22 nt, Mycobacterium tuberculosis H37Rv
ggcacggucacacgccagccgg

SEQ ID NO: 1361946 - RNA, 21 nt, Mycobacterium tuberculosis H37Rv
ggcacggugucgcgcgaccug

SEQ ID NO: 1361947 - RNA, 19 nt, Mycobacterium tuberculosis H37Rv
ggcacgccgggcaucggcg

SEQ ID NO: 1361948 - RNA, 14 nt, Mycobacterium tuberculosis H37Rv
ggcacgccggcggc

SEQ ID NO: 1361949 - RNA, 15 nt, Mycobacterium tuberculosis H37Rv
ggcacgcgaggcgcu

SEQ ID NO: 1361950 - RNA, 22 nt, Mycobacterium tuberculosis H37Rv
ggcacgccauaccggcuggcca

SEQ ID NO: 1361951 - RNA, 21 nt, Mycobacterium tuberculosis H37Rv
ggcaccuccgccggcaccucc

SEQ ID NO: 1361952 - RNA, 13 nt, Mycobacterium tuberculosis H37Rv
ggcaccucggccu

SEQ ID NO: 1361953 - RNA, 12 nt, Mycobacterium tuberculosis H37Rv
ggcaccgugucg

SEQ ID NO: 1361954 - RNA, 18 nt, Mycobacterium tuberculosis H37Rv
ggcaccguuaccgccguc

SEQ ID NO: 1361955 - RNA, 22 nt, Mycobacterium tuberculosis H37Rv
ggcaccguagagcaugccgccc

SEQ ID NO: 1361956 - RNA, 19 nt, Mycobacterium tuberculosis H37Rv
ggcaccgggugcgacggcg

SEQ ID NO: 1361957 - RNA, 15 nt, Mycobacterium tuberculosis H37Rv
ggcaccuauagggac

SEQ ID NO: 1361958 - RNA, 15 nt, Mycobacterium tuberculosis H37Rv
ggcaccucgcccucc

SEQ ID NO: 1361959 - RNA, 14 nt, Mycobacterium tuberculosis H37Rv
ggcacgacccggga

SEQ ID NO: 1361960 - RNA, 17 nt, Mycobacterium tuberculosis H37Rv
ggcacgaccgcucccgg

SEQ ID NO: 1361961 - RNA, 21 nt, Mycobacterium tuberculosis H37Rv
ggcacgacgccggccuggccg

SEQ ID NO: 1361962 - RNA, 18 nt, Mycobacterium tuberculosis H37Rv
ggcacguucagccaggcg

SEQ ID NO: 1361963 - RNA, 14 nt, Mycobacterium tuberculosis H37Rv
ggcacgucggcgcc

SEQ ID NO: 1361964 - RNA, 21 nt, Mycobacterium tuberculosis H37Rv
ggcacucccggaguggccagu

SEQ ID NO: 1361965 - RNA, 17 nt, Mycobacterium tuberculosis H37Rv
ggcacuccagcggcggg

SEQ ID NO: 1361966 - RNA, 20 nt, Mycobacterium tuberculosis H37Rv
ggcacuccagcggcgggggc

SEQ ID NO: 1361967 - RNA, 19 nt, Mycobacterium tuberculosis H37Rv
ggcacguugugaucgucag

SEQ ID NO: 1361968 - RNA, 20 nt, Mycobacterium tuberculosis H37Rv
ggcacuaacggcgugucggg

SEQ ID NO: 1361969 - RNA, 14 nt, Mycobacterium tuberculosis H37Rv
ggcacugcggccag

SEQ ID NO: 1361970 - RNA, 20 nt, Mycobacterium tuberculosis H37Rv
ggcacuggguccacgcgcuc

SEQ ID NO: 1361971 - RNA, 15 nt, Mycobacterium tuberculosis H37Rv
ggcacugacgcgccc

SEQ ID NO: 1361972 - RNA, 19 nt, Mycobacterium tuberculosis H37Rv
ggcacuugcccgucggcgc

SEQ ID NO: 1361973 - RNA, 16 nt, Mycobacterium tuberculosis H37Rv
ggcagcacccgcacgg

SEQ ID NO: 1361974 - RNA, 12 nt, Mycobacterium tuberculosis H37Rv
ggcagcacaggc

SEQ ID NO: 1361975 - RNA, 22 nt, Mycobacterium tuberculosis H37Rv
ggcagcagcgcaacggccagcg

SEQ ID NO: 1361976 - RNA, 14 nt, Mycobacterium tuberculosis H37Rv
ggcagcagcgggcg

SEQ ID NO: 1361977 - RNA, 18 nt, Mycobacterium tuberculosis H37Rv
ggcagccaccagcgacga

SEQ ID NO: 1361978 - RNA, 14 nt, Mycobacterium tuberculosis H37Rv
ggcagccaccagcg

SEQ ID NO: 1361979 - RNA, 17 nt, Mycobacterium tuberculosis H37Rv
ggcagccaagcgagcgg

SEQ ID NO: 1361980 - RNA, 13 nt, Mycobacterium tuberculosis H37Rv
ggcagcauggcca

SEQ ID NO: 1361981 - RNA, 19 nt, Mycobacterium tuberculosis H37Rv
ggcagcaucuccgucggcc

SEQ ID NO: 1361982 - RNA, 14 nt, Mycobacterium tuberculosis H37Rv
ggcagcagcgccgu

SEQ ID NO: 1361983 - RNA, 16 nt, Mycobacterium tuberculosis H37Rv
ggcagcagccggcggg

SEQ ID NO: 1361984 - RNA, 24 nt, Mycobacterium tuberculosis H37Rv
ggcagcacuuggacccggccggcc

SEQ ID NO: 1361985 - RNA, 20 nt, Mycobacterium tuberculosis H37Rv
ggcagcacggucugggucuu

SEQ ID NO: 1361986 - RNA, 11 nt, Mycobacterium tuberculosis H37Rv
ggcagcacguc

SEQ ID NO: 1361987 - RNA, 15 nt, Mycobacterium tuberculosis H37Rv
ggcagcggcgcgcug

SEQ ID NO: 1361988 - RNA, 14 nt, Mycobacterium tuberculosis H37Rv
ggcagcggcuggga

SEQ ID NO: 1361989 - RNA, 15 nt, Mycobacterium tuberculosis H37Rv
ggcagcgcggccggg

SEQ ID NO: 1361990 - RNA, 17 nt, Mycobacterium tuberculosis H37Rv
ggcagcgcggccgggcg

SEQ ID NO: 1361991 - RNA, 15 nt, Mycobacterium tuberculosis H37Rv
ggcagcgcggccaau

SEQ ID NO: 1361992 - RNA, 12 nt, Mycobacterium tuberculosis H37Rv
ggcagcgcuggc

SEQ ID NO: 1361993 - RNA, 22 nt, Mycobacterium tuberculosis H37Rv
ggcagccaccgucaugccgacg

SEQ ID NO: 1361994 - RNA, 19 nt, Mycobacterium tuberculosis H37Rv
ggcacaaccaacgacaggu

SEQ ID NO: 1361995 - RNA, 17 nt, Mycobacterium tuberculosis H37Rv
ggcacaaucaccgccgc

SEQ ID NO: 1361996 - RNA, 22 nt, Mycobacterium tuberculosis H37Rv
ggcaauuacccgacuucaagac

SEQ ID NO: 1361997 - RNA, 14 nt, Mycobacterium tuberculosis H37Rv
ggcaauuccgccga

SEQ ID NO: 1361998 - RNA, 17 nt, Mycobacterium tuberculosis H37Rv
ggcaauuccgccgagcg

SEQ ID NO: 1361999 - RNA, 15 nt, Mycobacterium tuberculosis H37Rv
ggcacacccuccaca

SEQ ID NO: 1362000 - RNA, 21 nt, Mycobacterium tuberculosis H37Rv
ggcacacccuccacagcggcc

SEQ ID NO: 1362001 - RNA, 21 nt, Mycobacterium tuberculosis H37Rv
ggcacacccaucaccgccagc

SEQ ID NO: 1362002 - RNA, 18 nt, Mycobacterium tuberculosis H37Rv
ggcacacccaucagcccu

SEQ ID NO: 1362003 - RNA, 18 nt, Mycobacterium tuberculosis H37Rv
ggcacacccaucaccgcc

SEQ ID NO: 1362004 - RNA, 18 nt, Mycobacterium tuberculosis H37Rv
ggcacagccaguaaaaag

SEQ ID NO: 1362005 - RNA, 20 nt, Mycobacterium tuberculosis H37Rv
ggcacauugaucgacggcca

SEQ ID NO: 1362006 - RNA, 22 nt, Mycobacterium tuberculosis H37Rv
ggcacauugaucgacggccagc

SEQ ID NO: 1362007 - RNA, 21 nt, Mycobacterium tuberculosis H37Rv
ggcaccaauaccgcacccgcu

SEQ ID NO: 1362008 - RNA, 16 nt, Mycobacterium tuberculosis H37Rv
ggcacaggcggccagc

SEQ ID NO: 1362009 - RNA, 19 nt, Mycobacterium tuberculosis H37Rv
ggcaccacccgauuggcca

SEQ ID NO: 1362010 - RNA, 14 nt, Mycobacterium tuberculosis H37Rv
ggcaccacgccagc

SEQ ID NO: 1362011 - RNA, 20 nt, Mycobacterium tuberculosis H37Rv
ggcaccaccaagcucggcca

SEQ ID NO: 1362012 - RNA, 23 nt, Mycobacterium tuberculosis H37Rv
ggcaccaccaagcucggccagca

SEQ ID NO: 1362013 - RNA, 13 nt, Mycobacterium tuberculosis H37Rv
ggcaauggccagc

SEQ ID NO: 1362014 - RNA, 23 nt, Mycobacterium tuberculosis H37Rv
ggcaauaccgaaccgguguagca

SEQ ID NO: 1362015 - RNA, 12 nt, Mycobacterium tuberculosis H37Rv
ggcaacugcagc

SEQ ID NO: 1362016 - RNA, 19 nt, Mycobacterium tuberculosis H37Rv
ggcaaucaucucccgaccg

SEQ ID NO: 1362017 - RNA, 20 nt, Mycobacterium tuberculosis H37Rv
ggcaaucaccgccggcggcg

SEQ ID NO: 1362018 - RNA, 23 nt, Mycobacterium tuberculosis H37Rv
ggaucgcguggcgcaccaccgcc

SEQ ID NO: 1362019 - RNA, 13 nt, Mycobacterium tuberculosis H37Rv
ggaucgcggcggc

SEQ ID NO: 1362020 - RNA, 15 nt, Mycobacterium tuberculosis H37Rv
ggaucgcggcggcgu

SEQ ID NO: 1362021 - RNA, 17 nt, Mycobacterium tuberculosis H37Rv
ggaucgaccgccagcgc

SEQ ID NO: 1362022 - RNA, 19 nt, Mycobacterium tuberculosis H37Rv
ggaucgaccauggucgauu

SEQ ID NO: 1362023 - RNA, 13 nt, Mycobacterium tuberculosis H37Rv
ggaucgcagcgcc

SEQ ID NO: 1362024 - RNA, 22 nt, Mycobacterium tuberculosis H37Rv
ggaucgccugagcgccgcggcg

SEQ ID NO: 1362025 - RNA, 14 nt, Mycobacterium tuberculosis H37Rv
ggaucgccugagcg

SEQ ID NO: 1362026 - RNA, 16 nt, Mycobacterium tuberculosis H37Rv
ggaucgccggggacgc

SEQ ID NO: 1362027 - RNA, 13 nt, Mycobacterium tuberculosis H37Rv
ggaucgccaggcc

SEQ ID NO: 1362028 - RNA, 16 nt, Mycobacterium tuberculosis H37Rv
ggauuggcgucagcag

SEQ ID NO: 1362029 - RNA, 23 nt, Mycobacterium tuberculosis H37Rv
ggcaaaccgaucaauccgcccuu

SEQ ID NO: 1362030 - RNA, 18 nt, Mycobacterium tuberculosis H37Rv
ggcaaacgcgcaggucag

SEQ ID NO: 1362031 - RNA, 12 nt, Mycobacterium tuberculosis H37Rv
ggcaacgccucc

SEQ ID NO: 1362032 - RNA, 14 nt, Mycobacterium tuberculosis H37Rv
ggcaacgcggccuu

SEQ ID NO: 1362033 - RNA, 21 nt, Mycobacterium tuberculosis H37Rv
ggcaacgcagcacguucaggu

SEQ ID NO: 1362034 - RNA, 17 nt, Mycobacterium tuberculosis H37Rv
ggcaacgaggucugcgg

SEQ ID NO: 1362035 - RNA, 16 nt, Mycobacterium tuberculosis H37Rv
ggcaacgacccgccgc

SEQ ID NO: 1362036 - RNA, 13 nt, Mycobacterium tuberculosis H37Rv
ggcaacggccgcu

SEQ ID NO: 1362037 - RNA, 13 nt, Mycobacterium tuberculosis H37Rv
ggcaacggcggcg

SEQ ID NO: 1362038 - RNA, 13 nt, Mycobacterium tuberculosis H37Rv
ggcaaacugggca

SEQ ID NO: 1362039 - RNA, 13 nt, Mycobacterium tuberculosis H37Rv
ggcaaaucaagca

SEQ ID NO: 1362040 - RNA, 18 nt, Mycobacterium tuberculosis H37Rv
ggcaaaucaagcacagcc

SEQ ID NO: 1362041 - RNA, 19 nt, Mycobacterium tuberculosis H37Rv
ggcaaaguuggccgcccga

SEQ ID NO: 1362042 - RNA, 12 nt, Mycobacterium tuberculosis H37Rv
ggccggccgccg

SEQ ID NO: 1362043 - RNA, 11 nt, Mycobacterium tuberculosis H37Rv
ggccggccgcg

SEQ ID NO: 1362044 - RNA, 15 nt, Mycobacterium tuberculosis H37Rv
ggccggccgguggcc

SEQ ID NO: 1362045 - RNA, 16 nt, Mycobacterium tuberculosis H37Rv
ggccggcgggccugcc

SEQ ID NO: 1362046 - RNA, 14 nt, Mycobacterium tuberculosis H37Rv
ggccggcggcggcg

SEQ ID NO: 1362047 - RNA, 13 nt, Mycobacterium tuberculosis H37Rv
ggccggcgcucgc

SEQ ID NO: 1362048 - RNA, 14 nt, Mycobacterium tuberculosis H37Rv
ggccggcgccggcg

SEQ ID NO: 1362049 - RNA, 17 nt, Mycobacterium tuberculosis H37Rv
ggccggcgccggcgcgu

SEQ ID NO: 1362050 - RNA, 19 nt, Mycobacterium tuberculosis H37Rv
ggccggcucguccgggcag

SEQ ID NO: 1362051 - RNA, 18 nt, Mycobacterium tuberculosis H37Rv
ggccggcgggccugcccg

SEQ ID NO: 1362052 - RNA, 20 nt, Mycobacterium tuberculosis H37Rv
ggccggcgguaagcccagac

SEQ ID NO: 1362053 - RNA, 17 nt, Mycobacterium tuberculosis H37Rv
ggccggcggucagcagc

SEQ ID NO: 1362054 - RNA, 17 nt, Mycobacterium tuberculosis H37Rv
ggccggcggucgccagu

SEQ ID NO: 1362055 - RNA, 22 nt, Mycobacterium tuberculosis H37Rv
ggccgggaucucgaaggccgcc

SEQ ID NO: 1362056 - RNA, 16 nt, Mycobacterium tuberculosis H37Rv
ggccgggcgggcggcc

SEQ ID NO: 1362057 - RNA, 14 nt, Mycobacterium tuberculosis H37Rv
ggccgggcucccca

SEQ ID NO: 1362058 - RNA, 12 nt, Mycobacterium tuberculosis H37Rv
ggccgggcggcc

SEQ ID NO: 1362059 - RNA, 16 nt, Mycobacterium tuberculosis H37Rv
ggccgggcggccaggc

SEQ ID NO: 1362060 - RNA, 14 nt, Mycobacterium tuberculosis H37Rv
ggccgggccgagug

SEQ ID NO: 1362061 - RNA, 23 nt, Mycobacterium tuberculosis H37Rv
ggccgggcgaucgccugggcuug

SEQ ID NO: 1362062 - RNA, 19 nt, Mycobacterium tuberculosis H37Rv
ggccgggcagugcgcggcg

SEQ ID NO: 1362063 - RNA, 13 nt, Mycobacterium tuberculosis H37Rv
ggccgggcagugc

SEQ ID NO: 1362064 - RNA, 22 nt, Mycobacterium tuberculosis H37Rv
ggccggcaaugccgcggccagu

SEQ ID NO: 1362065 - RNA, 15 nt, Mycobacterium tuberculosis H37Rv
ggccggcaccgcagc

SEQ ID NO: 1362066 - RNA, 15 nt, Mycobacterium tuberculosis H37Rv
ggccggcacccacca

SEQ ID NO: 1362067 - RNA, 14 nt, Mycobacterium tuberculosis H37Rv
ggccggcaccccac

SEQ ID NO: 1362068 - RNA, 17 nt, Mycobacterium tuberculosis H37Rv
ggccggcaccccacggc

SEQ ID NO: 1362069 - RNA, 18 nt, Mycobacterium tuberculosis H37Rv
ggccggagggguuagguu

SEQ ID NO: 1362070 - RNA, 20 nt, Mycobacterium tuberculosis H37Rv
ggccggccgagcgcacuggg

SEQ ID NO: 1362071 - RNA, 13 nt, Mycobacterium tuberculosis H37Rv
ggccgcugggccg

SEQ ID NO: 1362072 - RNA, 17 nt, Mycobacterium tuberculosis H37Rv
ggccgcuugccccgccu

SEQ ID NO: 1362073 - RNA, 16 nt, Mycobacterium tuberculosis H37Rv
ggccggaacgcccggc

SEQ ID NO: 1362074 - RNA, 20 nt, Mycobacterium tuberculosis H37Rv
ggccggaccuuguuggccau

SEQ ID NO: 1362075 - RNA, 19 nt, Mycobacterium tuberculosis H37Rv
ggccggacgggugcgggcc

SEQ ID NO: 1362076 - RNA, 19 nt, Mycobacterium tuberculosis H37Rv
ggccggaagauccgggccu

SEQ ID NO: 1362077 - RNA, 16 nt, Mycobacterium tuberculosis H37Rv
ggccggagccgccggc

SEQ ID NO: 1362078 - RNA, 18 nt, Mycobacterium tuberculosis H37Rv
ggccggagccggugccga

SEQ ID NO: 1362079 - RNA, 22 nt, Mycobacterium tuberculosis H37Rv
ggccgcucagcgauuccacggc

SEQ ID NO: 1362080 - RNA, 20 nt, Mycobacterium tuberculosis H37Rv
ggccgcgucacggaccugga

SEQ ID NO: 1362081 - RNA, 18 nt, Mycobacterium tuberculosis H37Rv
ggccgcggucggccacca

SEQ ID NO: 1362082 - RNA, 14 nt, Mycobacterium tuberculosis H37Rv
ggccgcggucggcc

SEQ ID NO: 1362083 - RNA, 19 nt, Mycobacterium tuberculosis H37Rv
ggccgcggcggccccgcgc

SEQ ID NO: 1362084 - RNA, 14 nt, Mycobacterium tuberculosis H37Rv
ggccgcggcggccc

SEQ ID NO: 1362085 - RNA, 17 nt, Mycobacterium tuberculosis H37Rv
ggccgcggcgcgacggc

SEQ ID NO: 1362086 - RNA, 13 nt, Mycobacterium tuberculosis H37Rv
ggccgcggcggcc

SEQ ID NO: 1362087 - RNA, 12 nt, Mycobacterium tuberculosis H37Rv
ggccgcggccuc

SEQ ID NO: 1362088 - RNA, 19 nt, Mycobacterium tuberculosis H37Rv
ggccgcgcugcagcacggc

SEQ ID NO: 1362089 - RNA, 14 nt, Mycobacterium tuberculosis H37Rv
ggccgcgcgcucga

SEQ ID NO: 1362090 - RNA, 18 nt, Mycobacterium tuberculosis H37Rv
ggccgcgcgcagggcguc

SEQ ID NO: 1362091 - RNA, 16 nt, Mycobacterium tuberculosis H37Rv
ggccgcgccggccccg

SEQ ID NO: 1362092 - RNA, 13 nt, Mycobacterium tuberculosis H37Rv
ggccgcggagaag

SEQ ID NO: 1362093 - RNA, 15 nt, Mycobacterium tuberculosis H37Rv
ggccgcggcacccgg

SEQ ID NO: 1362094 - RNA, 12 nt, Mycobacterium tuberculosis H37Rv
ggccgcgcaggc

SEQ ID NO: 1362095 - RNA, 11 nt, Mycobacterium tuberculosis H37Rv
ggccgcgcagg

SEQ ID NO: 1362096 - RNA, 19 nt, Mycobacterium tuberculosis H37Rv
ggccgcgcaggggcggcgu

SEQ ID NO: 1362097 - RNA, 15 nt, Mycobacterium tuberculosis H37Rv
ggccgcgccggcccc

SEQ ID NO: 1362098 - RNA, 22 nt, Mycobacterium tuberculosis H37Rv
ggccgcgcgacaacccggcguc

SEQ ID NO: 1362099 - RNA, 14 nt, Mycobacterium tuberculosis H37Rv
ggccgcgagacgca

SEQ ID NO: 1362100 - RNA, 14 nt, Mycobacterium tuberculosis H37Rv
ggccgcgauccagc

SEQ ID NO: 1362101 - RNA, 19 nt, Mycobacterium tuberculosis H37Rv
ggccgcgaccagcgccgca

SEQ ID NO: 1362102 - RNA, 15 nt, Mycobacterium tuberculosis H37Rv
ggccgcgagguaccc

SEQ ID NO: 1362103 - RNA, 15 nt, Mycobacterium tuberculosis H37Rv
ggccgagccgcccgc

SEQ ID NO: 1362104 - RNA, 22 nt, Mycobacterium tuberculosis H37Rv
ggccgagcgcaccacggcgguc

SEQ ID NO: 1362105 - RNA, 14 nt, Mycobacterium tuberculosis H37Rv
ggccgagcgcgccg

SEQ ID NO: 1362106 - RNA, 19 nt, Mycobacterium tuberculosis H37Rv
ggccgaucucuccggcggc

SEQ ID NO: 1362107 - RNA, 20 nt, Mycobacterium tuberculosis H37Rv
ggccgaucucuccggcggcg

SEQ ID NO: 1362108 - RNA, 17 nt, Mycobacterium tuberculosis H37Rv
ggccgaucagcgcggcg

SEQ ID NO: 1362109 - RNA, 20 nt, Mycobacterium tuberculosis H37Rv
ggccgaguucgucagcggcc

SEQ ID NO: 1362110 - RNA, 13 nt, Mycobacterium tuberculosis H37Rv
ggccgcaccagca

SEQ ID NO: 1362111 - RNA, 21 nt, Mycobacterium tuberculosis H37Rv
ggccgcaaucaugucagcgcu

SEQ ID NO: 1362112 - RNA, 18 nt, Mycobacterium tuberculosis H37Rv
ggccgcacgccggccagc

SEQ ID NO: 1362113 - RNA, 15 nt, Mycobacterium tuberculosis H37Rv
ggccgcaccagcauu

SEQ ID NO: 1362114 - RNA, 21 nt, Mycobacterium tuberculosis H37Rv
ggccgcaccgauuuccucugg

SEQ ID NO: 1362115 - RNA, 21 nt, Mycobacterium tuberculosis H37Rv
ggccgcacgggcgaccugcgg

SEQ ID NO: 1362116 - RNA, 19 nt, Mycobacterium tuberculosis H37Rv
ggccgcacggucagcgcgc

SEQ ID NO: 1362117 - RNA, 17 nt, Mycobacterium tuberculosis H37Rv
ggccgcagcggccagcc

SEQ ID NO: 1362118 - RNA, 21 nt, Mycobacterium tuberculosis H37Rv
ggccgcagcggccagcccagc

SEQ ID NO: 1362119 - RNA, 14 nt, Mycobacterium tuberculosis H37Rv
ggccgcaggccagc

SEQ ID NO: 1362120 - RNA, 19 nt, Mycobacterium tuberculosis H37Rv
ggccgccauccccuggcca

SEQ ID NO: 1362121 - RNA, 14 nt, Mycobacterium tuberculosis H37Rv
ggccgcccagaugu

SEQ ID NO: 1362122 - RNA, 13 nt, Mycobacterium tuberculosis H37Rv
aaaguuccacgac

SEQ ID NO: 1362123 - RNA, 16 nt, Mycobacterium tuberculosis H37Rv
ggccgcccggcgagca

SEQ ID NO: 1362124 - RNA, 18 nt, Mycobacterium tuberculosis H37Rv
ggccgccgaaacucacca

SEQ ID NO: 1362125 - RNA, 12 nt, Mycobacterium tuberculosis H37Rv
ggccgccgaccg

SEQ ID NO: 1362126 - RNA, 19 nt, Mycobacterium tuberculosis H37Rv
ggccgccgaccggagccgc

SEQ ID NO: 1362127 - RNA, 23 nt, Mycobacterium tuberculosis H37Rv
ggccgccgacuccccgccgggca

SEQ ID NO: 1362128 - RNA, 16 nt, Mycobacterium tuberculosis H37Rv
ggccgcccgcucgaug

SEQ ID NO: 1362129 - RNA, 16 nt, Mycobacterium tuberculosis H37Rv
ggccgccccaggcugg

SEQ ID NO: 1362130 - RNA, 22 nt, Mycobacterium tuberculosis H37Rv
ggccgccccaggcugguccggg

SEQ ID NO: 1362131 - RNA, 16 nt, Mycobacterium tuberculosis H37Rv
ggccgccccggccgcu

SEQ ID NO: 1362132 - RNA, 14 nt, Mycobacterium tuberculosis H37Rv
ggccgccggcgccg

SEQ ID NO: 1362133 - RNA, 15 nt, Mycobacterium tuberculosis H37Rv
ggccgccuccgcggc

SEQ ID NO: 1362134 - RNA, 16 nt, Mycobacterium tuberculosis H37Rv
ggccgccuugaggccc

SEQ ID NO: 1362135 - RNA, 20 nt, Mycobacterium tuberculosis H37Rv
ggccgccugacccggcgccg

SEQ ID NO: 1362136 - RNA, 16 nt, Mycobacterium tuberculosis H37Rv
ggccgccggguccgga

SEQ ID NO: 1362137 - RNA, 13 nt, Mycobacterium tuberculosis H37Rv
ggccgccgucccc

SEQ ID NO: 1362138 - RNA, 13 nt, Mycobacterium tuberculosis H37Rv
ggccgccggcgcc

SEQ ID NO: 1362139 - RNA, 15 nt, Mycobacterium tuberculosis H37Rv
ggccgccggacccgu

SEQ ID NO: 1362140 - RNA, 14 nt, Mycobacterium tuberculosis H37Rv
ggccgccggccgcg

SEQ ID NO: 1362141 - RNA, 13 nt, Mycobacterium tuberculosis H37Rv
ggccgccgcggcc

SEQ ID NO: 1362142 - RNA, 13 nt, Mycobacterium tuberculosis H37Rv
ggccgccgcgccg

SEQ ID NO: 1362143 - RNA, 15 nt, Mycobacterium tuberculosis H37Rv
ggccgccgccccggc

SEQ ID NO: 1362144 - RNA, 14 nt, Mycobacterium tuberculosis H37Rv
ggccgccgcagcuc

SEQ ID NO: 1362145 - RNA, 23 nt, Mycobacterium tuberculosis H37Rv
ggccgccgaggacacauugacca

SEQ ID NO: 1362146 - RNA, 14 nt, Mycobacterium tuberculosis H37Rv
ggccgccaccagcg

SEQ ID NO: 1362147 - RNA, 13 nt, Mycobacterium tuberculosis H37Rv
ggccgccaccagc

SEQ ID NO: 1362148 - RNA, 19 nt, Mycobacterium tuberculosis H37Rv
ggccgcauauugcggcgcc

SEQ ID NO: 1362149 - RNA, 20 nt, Mycobacterium tuberculosis H37Rv
ggccgcauauugcggcgccg

SEQ ID NO: 1362150 - RNA, 13 nt, Mycobacterium tuberculosis H37Rv
ggccgccagcugc

SEQ ID NO: 1362151 - RNA, 17 nt, Mycobacterium tuberculosis H37Rv
ggccucguuguagccga

SEQ ID NO: 1362152 - RNA, 12 nt, Mycobacterium tuberculosis H37Rv
ggccucguccag

SEQ ID NO: 1362153 - RNA, 21 nt, Mycobacterium tuberculosis H37Rv
ggccucgucgauguucgccgc

SEQ ID NO: 1362154 - RNA, 20 nt, Mycobacterium tuberculosis H37Rv
ggccugaccggcucgccggc

SEQ ID NO: 1362155 - RNA, 16 nt, Mycobacterium tuberculosis H37Rv
ggccugaaccacgcgu

SEQ ID NO: 1362156 - RNA, 12 nt, Mycobacterium tuberculosis H37Rv
ggccucgaucag

SEQ ID NO: 1362157 - RNA, 17 nt, Mycobacterium tuberculosis H37Rv
ggccucgaccucuucgg

SEQ ID NO: 1362158 - RNA, 23 nt, Mycobacterium tuberculosis H37Rv
ggccucgaagggcuugucgccgg

SEQ ID NO: 1362159 - RNA, 13 nt, Mycobacterium tuberculosis H37Rv
ggccucggcagca

SEQ ID NO: 1362160 - RNA, 14 nt, Mycobacterium tuberculosis H37Rv
ggccucggccagcg

SEQ ID NO: 1362161 - RNA, 15 nt, Mycobacterium tuberculosis H37Rv
ggccucggccagcgu

SEQ ID NO: 1362162 - RNA, 16 nt, Mycobacterium tuberculosis H37Rv
ggccucggcgagcacg

SEQ ID NO: 1362163 - RNA, 14 nt, Mycobacterium tuberculosis H37Rv
ggccuaggccgagg

SEQ ID NO: 1362164 - RNA, 18 nt, Mycobacterium tuberculosis H37Rv
ggccuaggucgacgccga

SEQ ID NO: 1362165 - RNA, 13 nt, Mycobacterium tuberculosis H37Rv
ggccuagccgcgg

SEQ ID NO: 1362166 - RNA, 17 nt, Mycobacterium tuberculosis H37Rv
ggccuaccaggcgcggc

SEQ ID NO: 1362167 - RNA, 18 nt, Mycobacterium tuberculosis H37Rv
ggccucauccaccgaugg

SEQ ID NO: 1362168 - RNA, 18 nt, Mycobacterium tuberculosis H37Rv
ggccucccacucacccag

SEQ ID NO: 1362169 - RNA, 19 nt, Mycobacterium tuberculosis H37Rv
ggccucagcccggccagcc

SEQ ID NO: 1362170 - RNA, 18 nt, Mycobacterium tuberculosis H37Rv
ggccucagcccggccagc

SEQ ID NO: 1362171 - RNA, 18 nt, Mycobacterium tuberculosis H37Rv
ggccguggaaagccggcg

SEQ ID NO: 1362172 - RNA, 15 nt, Mycobacterium tuberculosis H37Rv
ggccguuucggcgcc

SEQ ID NO: 1362173 - RNA, 20 nt, Mycobacterium tuberculosis H37Rv
ggccguuggcggcgguggcc

SEQ ID NO: 1362174 - RNA, 23 nt, Mycobacterium tuberculosis H37Rv
ggccguuggugaggccccccgcg

SEQ ID NO: 1362175 - RNA, 18 nt, Mycobacterium tuberculosis H37Rv
ggccgugaccgagccgcg

SEQ ID NO: 1362176 - RNA, 21 nt, Mycobacterium tuberculosis H37Rv
ggccgugaugccacggcgucg

SEQ ID NO: 1362177 - RNA, 13 nt, Mycobacterium tuberculosis H37Rv
ggccgugccgccg

SEQ ID NO: 1362178 - RNA, 14 nt, Mycobacterium tuberculosis H37Rv
ggccgugccgccga

SEQ ID NO: 1362179 - RNA, 16 nt, Mycobacterium tuberculosis H37Rv
ggccgugaccgagccg

SEQ ID NO: 1362180 - RNA, 17 nt, Mycobacterium tuberculosis H37Rv
ggccgucucggcaugcu

SEQ ID NO: 1362181 - RNA, 19 nt, Mycobacterium tuberculosis H37Rv
ggccgucgucggucaccga

SEQ ID NO: 1362182 - RNA, 12 nt, Mycobacterium tuberculosis H37Rv
ggccgucgccga

SEQ ID NO: 1362183 - RNA, 15 nt, Mycobacterium tuberculosis H37Rv
ggccgucgggugugc

SEQ ID NO: 1362184 - RNA, 21 nt, Mycobacterium tuberculosis H37Rv
ggccgucgacgaucagcgagu

SEQ ID NO: 1362185 - RNA, 15 nt, Mycobacterium tuberculosis H37Rv
ggccgucgacccagc

SEQ ID NO: 1362186 - RNA, 19 nt, Mycobacterium tuberculosis H37Rv
ggccgucgaacgguagcac

SEQ ID NO: 1362187 - RNA, 16 nt, Mycobacterium tuberculosis H37Rv
ggccguccgcaccggc

SEQ ID NO: 1362188 - RNA, 19 nt, Mycobacterium tuberculosis H37Rv
ggccguccgcaccggcggc

SEQ ID NO: 1362189 - RNA, 18 nt, Mycobacterium tuberculosis H37Rv
ggccgucccgcgagcagc

SEQ ID NO: 1362190 - RNA, 18 nt, Mycobacterium tuberculosis H37Rv
ggccguccucggucagcu

SEQ ID NO: 1362191 - RNA, 14 nt, Mycobacterium tuberculosis H37Rv
ggccguaggcggcg

SEQ ID NO: 1362192 - RNA, 17 nt, Mycobacterium tuberculosis H37Rv
ggccguaggcggcgacc

SEQ ID NO: 1362193 - RNA, 22 nt, Mycobacterium tuberculosis H37Rv
ggccguauaggcccgggcggcc

SEQ ID NO: 1362194 - RNA, 23 nt, Mycobacterium tuberculosis H37Rv
ggccgucagccaggugcccaagc

SEQ ID NO: 1362195 - RNA, 14 nt, Mycobacterium tuberculosis H37Rv
ggccgucagggugu

SEQ ID NO: 1362196 - RNA, 15 nt, Mycobacterium tuberculosis H37Rv
ggccgguuccucagc

SEQ ID NO: 1362197 - RNA, 20 nt, Mycobacterium tuberculosis H37Rv
ggccgguuccucagcggccc

SEQ ID NO: 1362198 - RNA, 19 nt, Mycobacterium tuberculosis H37Rv
ggccgguggguagccagcg

SEQ ID NO: 1362199 - RNA, 20 nt, Mycobacterium tuberculosis H37Rv
ggccgguuagcaccaguucc

SEQ ID NO: 1362200 - RNA, 20 nt, Mycobacterium tuberculosis H37Rv
ggccggugcgaauggugcaa

SEQ ID NO: 1362201 - RNA, 13 nt, Mycobacterium tuberculosis H37Rv
ggccggugcgccc

SEQ ID NO: 1362202 - RNA, 14 nt, Mycobacterium tuberculosis H37Rv
ggccgguaguagcu

SEQ ID NO: 1362203 - RNA, 16 nt, Mycobacterium tuberculosis H37Rv
ggccggguggcccggc

SEQ ID NO: 1362204 - RNA, 17 nt, Mycobacterium tuberculosis H37Rv
ggccggguuccagcggc

SEQ ID NO: 1362205 - RNA, 16 nt, Mycobacterium tuberculosis H37Rv
ggccgguaguagcuga

SEQ ID NO: 1362206 - RNA, 16 nt, Mycobacterium tuberculosis H37Rv
ggccgguaccgggacg

SEQ ID NO: 1362207 - RNA, 20 nt, Mycobacterium tuberculosis H37Rv
ggccgguaccgggacgaauc

SEQ ID NO: 1362208 - RNA, 16 nt, Mycobacterium tuberculosis H37Rv
ggccggugcagcacgu

SEQ ID NO: 1362209 - RNA, 19 nt, Mycobacterium tuberculosis H37Rv
ggccggucgaggcccucgc

SEQ ID NO: 1362210 - RNA, 16 nt, Mycobacterium tuberculosis H37Rv
ggccugccgcucgccg

SEQ ID NO: 1362211 - RNA, 23 nt, Mycobacterium tuberculosis H37Rv
ggccugcccccggcgcggcggac

SEQ ID NO: 1362212 - RNA, 13 nt, Mycobacterium tuberculosis H37Rv
ggccugcccagca

SEQ ID NO: 1362213 - RNA, 14 nt, Mycobacterium tuberculosis H37Rv
ggccugcccagcac

SEQ ID NO: 1362214 - RNA, 18 nt, Mycobacterium tuberculosis H37Rv
ggccugcagccgaugcuc

SEQ ID NO: 1362215 - RNA, 15 nt, Mycobacterium tuberculosis H37Rv
ggccugcaccacggc

SEQ ID NO: 1362216 - RNA, 18 nt, Mycobacterium tuberculosis H37Rv
ggccugcaccacggcggc

SEQ ID NO: 1362217 - RNA, 19 nt, Mycobacterium tuberculosis H37Rv
ggccugcaccacggcggcc

SEQ ID NO: 1362218 - RNA, 16 nt, Mycobacterium tuberculosis H37Rv
ggccugcacgccggcg

SEQ ID NO: 1362219 - RNA, 20 nt, Mycobacterium tuberculosis H37Rv
ggccugagcgucgucgccgg

SEQ ID NO: 1362220 - RNA, 18 nt, Mycobacterium tuberculosis H37Rv
ggccugcgcuucguccag

SEQ ID NO: 1362221 - RNA, 13 nt, Mycobacterium tuberculosis H37Rv
ggccugcgccggc

SEQ ID NO: 1362222 - RNA, 19 nt, Mycobacterium tuberculosis H37Rv
ggccugcgcgaccgaccag

SEQ ID NO: 1362223 - RNA, 20 nt, Mycobacterium tuberculosis H37Rv
ggccugcgcgaccgaccagc

SEQ ID NO: 1362224 - RNA, 17 nt, Mycobacterium tuberculosis H37Rv
ggccugcgacgagccca

SEQ ID NO: 1362225 - RNA, 14 nt, Mycobacterium tuberculosis H37Rv
ggccugcucgacca

SEQ ID NO: 1362226 - RNA, 22 nt, Mycobacterium tuberculosis H37Rv
ggccugcucgggggccgaccag

SEQ ID NO: 1362227 - RNA, 17 nt, Mycobacterium tuberculosis H37Rv
ggccugggacggcggca

SEQ ID NO: 1362228 - RNA, 12 nt, Mycobacterium tuberculosis H37Rv
ggccuggccggu

SEQ ID NO: 1362229 - RNA, 13 nt, Mycobacterium tuberculosis H37Rv
ggccuggcagggu

SEQ ID NO: 1362230 - RNA, 16 nt, Mycobacterium tuberculosis H37Rv
ggccuggccaccuggu

SEQ ID NO: 1362231 - RNA, 16 nt, Mycobacterium tuberculosis H37Rv
ggccugggacggcggc

SEQ ID NO: 1362232 - RNA, 16 nt, Mycobacterium tuberculosis H37Rv
ggccugggccagccgc

SEQ ID NO: 1362233 - RNA, 13 nt, Mycobacterium tuberculosis H37Rv
ggccugggccgca

SEQ ID NO: 1362234 - RNA, 17 nt, Mycobacterium tuberculosis H37Rv
ggccugucaggcggcgg

SEQ ID NO: 1362235 - RNA, 16 nt, Mycobacterium tuberculosis H37Rv
ggccugguacucccgc

SEQ ID NO: 1362236 - RNA, 18 nt, Mycobacterium tuberculosis H37Rv
ggccugucaggcggcgga

SEQ ID NO: 1362237 - RNA, 16 nt, Mycobacterium tuberculosis H37Rv
ggccugugcgggcagg

SEQ ID NO: 1362238 - RNA, 22 nt, Mycobacterium tuberculosis H37Rv
ggccuucaaggaagccgcggcc

SEQ ID NO: 1362239 - RNA, 23 nt, Mycobacterium tuberculosis H37Rv
ggccuguuuaccuuccucgcccu

SEQ ID NO: 1362240 - RNA, 22 nt, Mycobacterium tuberculosis H37Rv
ggccuugcucagcacgccgggu

SEQ ID NO: 1362241 - RNA, 16 nt, Mycobacterium tuberculosis H37Rv
ggccuugcguguacca

SEQ ID NO: 1362242 - RNA, 15 nt, Mycobacterium tuberculosis H37Rv
ggccuuggcggcggc

SEQ ID NO: 1362243 - RNA, 14 nt, Mycobacterium tuberculosis H37Rv
ggccuugggcggca

SEQ ID NO: 1362244 - RNA, 17 nt, Mycobacterium tuberculosis H37Rv
ggcgaaccuugguugcc

SEQ ID NO: 1362245 - RNA, 15 nt, Mycobacterium tuberculosis H37Rv
ggcgaacugggugcg

SEQ ID NO: 1362246 - RNA, 20 nt, Mycobacterium tuberculosis H37Rv
ggcgaacucgaggucgagcg

SEQ ID NO: 1362247 - RNA, 12 nt, Mycobacterium tuberculosis H37Rv
ggcgaagcccga

SEQ ID NO: 1362248 - RNA, 18 nt, Mycobacterium tuberculosis H37Rv
ggcgaagguguccuccag

SEQ ID NO: 1362249 - RNA, 16 nt, Mycobacterium tuberculosis H37Rv
ggcgccguugccgccg

SEQ ID NO: 1362250 - RNA, 20 nt, Mycobacterium tuberculosis H37Rv
ggcgccgugaucagcucgcg

SEQ ID NO: 1362251 - RNA, 19 nt, Mycobacterium tuberculosis H37Rv
ggcgccgucggccgagucg

SEQ ID NO: 1362252 - RNA, 17 nt, Mycobacterium tuberculosis H37Rv
ggcgccggcggccgcgg

SEQ ID NO: 1362253 - RNA, 18 nt, Mycobacterium tuberculosis H37Rv
ggcgccgucggagccggc

SEQ ID NO: 1362254 - RNA, 21 nt, Mycobacterium tuberculosis H37Rv
ggcgccucgugcgugggcgcg

SEQ ID NO: 1362255 - RNA, 20 nt, Mycobacterium tuberculosis H37Rv
ggcgccugaugcggccggcg

SEQ ID NO: 1362256 - RNA, 22 nt, Mycobacterium tuberculosis H37Rv
ggcgccuuccaggcgggcggca

SEQ ID NO: 1362257 - RNA, 23 nt, Mycobacterium tuberculosis H37Rv
ggcgccuguccugcgggaggcag

SEQ ID NO: 1362258 - RNA, 17 nt, Mycobacterium tuberculosis H37Rv
ggcgcgaucgcgcccgc

SEQ ID NO: 1362259 - RNA, 22 nt, Mycobacterium tuberculosis H37Rv
ggcgcgaucggugccgaagcug

SEQ ID NO: 1362260 - RNA, 22 nt, Mycobacterium tuberculosis H37Rv
ggcgcgcaccaccgcggcggcg

SEQ ID NO: 1362261 - RNA, 21 nt, Mycobacterium tuberculosis H37Rv
ggcgcgcaccaccgcggcggc

SEQ ID NO: 1362262 - RNA, 19 nt, Mycobacterium tuberculosis H37Rv
ggcgcgcaagugcuggccg

SEQ ID NO: 1362263 - RNA, 16 nt, Mycobacterium tuberculosis H37Rv
ggcgcgccgggcggcg

SEQ ID NO: 1362264 - RNA, 21 nt, Mycobacterium tuberculosis H37Rv
ggcgcgccguugccggccacc

SEQ ID NO: 1362265 - RNA, 15 nt, Mycobacterium tuberculosis H37Rv
ggcgcgccggccaug

SEQ ID NO: 1362266 - RNA, 12 nt, Mycobacterium tuberculosis H37Rv
ggcgcgcagcuc

SEQ ID NO: 1362267 - RNA, 19 nt, Mycobacterium tuberculosis H37Rv
ggcgccgaugccggccaag

SEQ ID NO: 1362268 - RNA, 21 nt, Mycobacterium tuberculosis H37Rv
ggcgccgaugaccgcaaccgg

SEQ ID NO: 1362269 - RNA, 13 nt, Mycobacterium tuberculosis H37Rv
ggcgccgcagggc

SEQ ID NO: 1362270 - RNA, 15 nt, Mycobacterium tuberculosis H37Rv
ggcgccgaaccagcg

SEQ ID NO: 1362271 - RNA, 14 nt, Mycobacterium tuberculosis H37Rv
ggcgcccugcgcca

SEQ ID NO: 1362272 - RNA, 12 nt, Mycobacterium tuberculosis H37Rv
ggcgcccugcgc

SEQ ID NO: 1362273 - RNA, 17 nt, Mycobacterium tuberculosis H37Rv
ggcgcccgucuccagca

SEQ ID NO: 1362274 - RNA, 13 nt, Mycobacterium tuberculosis H37Rv
ggcgccggccagu

SEQ ID NO: 1362275 - RNA, 17 nt, Mycobacterium tuberculosis H37Rv
ggcgccgccaagggccc

SEQ ID NO: 1362276 - RNA, 21 nt, Mycobacterium tuberculosis H37Rv
ggcgccgccacugccggcagc

SEQ ID NO: 1362277 - RNA, 22 nt, Mycobacterium tuberculosis H37Rv
ggcgccgccacugccggcagcg

SEQ ID NO: 1362278 - RNA, 17 nt, Mycobacterium tuberculosis H37Rv
ggcgccgcagggccgcg

SEQ ID NO: 1362279 - RNA, 14 nt, Mycobacterium tuberculosis H37Rv
ggcgccgcccgcgc

SEQ ID NO: 1362280 - RNA, 19 nt, Mycobacterium tuberculosis H37Rv
ggcgccgcccgcgccgccg

SEQ ID NO: 1362281 - RNA, 14 nt, Mycobacterium tuberculosis H37Rv
ggcgccgcccagca

SEQ ID NO: 1362282 - RNA, 15 nt, Mycobacterium tuberculosis H37Rv
ggcgccgcccgaggc

SEQ ID NO: 1362283 - RNA, 12 nt, Mycobacterium tuberculosis H37Rv
ggcgccgcccgc

SEQ ID NO: 1362284 - RNA, 20 nt, Mycobacterium tuberculosis H37Rv
ggcgccgcccuugccgccgg

SEQ ID NO: 1362285 - RNA, 22 nt, Mycobacterium tuberculosis H37Rv
ggcgccgcccuugccgccggcc

SEQ ID NO: 1362286 - RNA, 22 nt, Mycobacterium tuberculosis H37Rv
ggcgccggaacgagcggccgcg

SEQ ID NO: 1362287 - RNA, 23 nt, Mycobacterium tuberculosis H37Rv
ggcgccggacaaaccgggcggcc

SEQ ID NO: 1362288 - RNA, 15 nt, Mycobacterium tuberculosis H37Rv
ggcgccggagccgcc

SEQ ID NO: 1362289 - RNA, 14 nt, Mycobacterium tuberculosis H37Rv
ggcgccggagccgc

SEQ ID NO: 1362290 - RNA, 23 nt, Mycobacterium tuberculosis H37Rv
ggcgcguugcguaucgacccgcg

SEQ ID NO: 1362291 - RNA, 16 nt, Mycobacterium tuberculosis H37Rv
ggcgcgggugcgccgg

SEQ ID NO: 1362292 - RNA, 19 nt, Mycobacterium tuberculosis H37Rv
ggcgcggguggcgccaggu

SEQ ID NO: 1362293 - RNA, 21 nt, Mycobacterium tuberculosis H37Rv
ggcgcggguggcgccaguucg

SEQ ID NO: 1362294 - RNA, 16 nt, Mycobacterium tuberculosis H37Rv
ggcgcggucgaagcug

SEQ ID NO: 1362295 - RNA, 13 nt, Mycobacterium tuberculosis H37Rv
ggcgcgguccucc

SEQ ID NO: 1362296 - RNA, 16 nt, Mycobacterium tuberculosis H37Rv
ggcgcuaggaacgcca

SEQ ID NO: 1362297 - RNA, 14 nt, Mycobacterium tuberculosis H37Rv
ggcgcuagcugcug

SEQ ID NO: 1362298 - RNA, 18 nt, Mycobacterium tuberculosis H37Rv
ggcgcucgcgcgcugggc

SEQ ID NO: 1362299 - RNA, 21 nt, Mycobacterium tuberculosis H37Rv
ggcgcucgcgcgcugggcgcg

SEQ ID NO: 1362300 - RNA, 13 nt, Mycobacterium tuberculosis H37Rv
ggcgcuccuucag

SEQ ID NO: 1362301 - RNA, 18 nt, Mycobacterium tuberculosis H37Rv
ggcgcucacccgccgcgg

SEQ ID NO: 1362302 - RNA, 19 nt, Mycobacterium tuberculosis H37Rv
ggcgcucccgccggcagcg

SEQ ID NO: 1362303 - RNA, 22 nt, Mycobacterium tuberculosis H37Rv
ggcgcugaaugcuugcgcagca

SEQ ID NO: 1362304 - RNA, 16 nt, Mycobacterium tuberculosis H37Rv
ggcgcugaacgcgagc

SEQ ID NO: 1362305 - RNA, 22 nt, Mycobacterium tuberculosis H37Rv
ggcgcugaagccgacgauccac

SEQ ID NO: 1362306 - RNA, 22 nt, Mycobacterium tuberculosis H37Rv
aaauacuccgcgagcccggccu

SEQ ID NO: 1362307 - RNA, 19 nt, Mycobacterium tuberculosis H37Rv
ggcgcgcgcgccggcugcc

SEQ ID NO: 1362308 - RNA, 13 nt, Mycobacterium tuberculosis H37Rv
ggcgcggcggcgu

SEQ ID NO: 1362309 - RNA, 14 nt, Mycobacterium tuberculosis H37Rv
ggcgcgggcgccgg

SEQ ID NO: 1362310 - RNA, 14 nt, Mycobacterium tuberculosis H37Rv
ggcgcgggccggcg

SEQ ID NO: 1362311 - RNA, 17 nt, Mycobacterium tuberculosis H37Rv
ggcgcggcugccgcggu

SEQ ID NO: 1362312 - RNA, 15 nt, Mycobacterium tuberculosis H37Rv
ggcgcgggcgccggg

SEQ ID NO: 1362313 - RNA, 24 nt, Mycobacterium tuberculosis H37Rv
ggcgcggggccgccgcggccggcg

SEQ ID NO: 1362314 - RNA, 17 nt, Mycobacterium tuberculosis H37Rv
ggcgcgggugaccaggc

SEQ ID NO: 1362315 - RNA, 14 nt, Mycobacterium tuberculosis H37Rv
ggcgcggggcggcc

SEQ ID NO: 1362316 - RNA, 23 nt, Mycobacterium tuberculosis H37Rv
ggcgcggggcggccugcccgccg

SEQ ID NO: 1362317 - RNA, 23 nt, Mycobacterium tuberculosis H37Rv
ggcgaucgcauccgcgguuggca

SEQ ID NO: 1362318 - RNA, 19 nt, Mycobacterium tuberculosis H37Rv
ggcgauccggucggccagg

SEQ ID NO: 1362319 - RNA, 15 nt, Mycobacterium tuberculosis H37Rv
ggcgauccgauacag

SEQ ID NO: 1362320 - RNA, 22 nt, Mycobacterium tuberculosis H37Rv
ggcgaucgcgaucgcguccucc

SEQ ID NO: 1362321 - RNA, 20 nt, Mycobacterium tuberculosis H37Rv
ggcgaucgucaagccgggca

SEQ ID NO: 1362322 - RNA, 17 nt, Mycobacterium tuberculosis H37Rv
ggcgaucaugagcagca

SEQ ID NO: 1362323 - RNA, 19 nt, Mycobacterium tuberculosis H37Rv
ggcgaugcguccgcccagc

SEQ ID NO: 1362324 - RNA, 13 nt, Mycobacterium tuberculosis H37Rv
ggcgaugcugggc

SEQ ID NO: 1362325 - RNA, 17 nt, Mycobacterium tuberculosis H37Rv
ggcgaugcgggccgcca

SEQ ID NO: 1362326 - RNA, 15 nt, Mycobacterium tuberculosis H37Rv
ggcgaugcggcgucg

SEQ ID NO: 1362327 - RNA, 14 nt, Mycobacterium tuberculosis H37Rv
ggcgauggccagca

SEQ ID NO: 1362328 - RNA, 20 nt, Mycobacterium tuberculosis H37Rv
ggcgcaacgagagcggcucc

SEQ ID NO: 1362329 - RNA, 18 nt, Mycobacterium tuberculosis H37Rv
ggcgcaacucgaccacuu

SEQ ID NO: 1362330 - RNA, 15 nt, Mycobacterium tuberculosis H37Rv
ggcgagucgggggcc

SEQ ID NO: 1362331 - RNA, 23 nt, Mycobacterium tuberculosis H37Rv
ggcgaguuaggccgccagccggc

SEQ ID NO: 1362332 - RNA, 24 nt, Mycobacterium tuberculosis H37Rv
ggcgagguauaaacgcggcgcgcu

SEQ ID NO: 1362333 - RNA, 23 nt, Mycobacterium tuberculosis H37Rv
ggcgaggucagagaaagccaaua

SEQ ID NO: 1362334 - RNA, 20 nt, Mycobacterium tuberculosis H37Rv
ggcgagggcuaccggcgccg

SEQ ID NO: 1362335 - RNA, 18 nt, Mycobacterium tuberculosis H37Rv
ggcgaguuaggccgccag

SEQ ID NO: 1362336 - RNA, 19 nt, Mycobacterium tuberculosis H37Rv
ggcgaguuaggccgccagc

SEQ ID NO: 1362337 - RNA, 18 nt, Mycobacterium tuberculosis H37Rv
ggcgauaaagccgcugaa

SEQ ID NO: 1362338 - RNA, 17 nt, Mycobacterium tuberculosis H37Rv
ggcgaaugcgggccucc

SEQ ID NO: 1362339 - RNA, 14 nt, Mycobacterium tuberculosis H37Rv
ggcgaaugcggucc

SEQ ID NO: 1362340 - RNA, 17 nt, Mycobacterium tuberculosis H37Rv
ggcgaaugacggccagu

SEQ ID NO: 1362341 - RNA, 22 nt, Mycobacterium tuberculosis H37Rv
ggcgaauugcaggacgcgggcu

SEQ ID NO: 1362342 - RNA, 15 nt, Mycobacterium tuberculosis H37Rv
ggcgaaugcgggccu

SEQ ID NO: 1362343 - RNA, 15 nt, Mycobacterium tuberculosis H37Rv
ggcgaggcagcaccc

SEQ ID NO: 1362344 - RNA, 19 nt, Mycobacterium tuberculosis H37Rv
ggcgagggccacggcugcg

SEQ ID NO: 1362345 - RNA, 15 nt, Mycobacterium tuberculosis H37Rv
ggcgaggacggcggc

SEQ ID NO: 1362346 - RNA, 19 nt, Mycobacterium tuberculosis H37Rv
ggcgaggacggcggccagg

SEQ ID NO: 1362347 - RNA, 12 nt, Mycobacterium tuberculosis H37Rv
ggcgcagguaua

SEQ ID NO: 1362348 - RNA, 15 nt, Mycobacterium tuberculosis H37Rv
ggcgcagcgccagcg

SEQ ID NO: 1362349 - RNA, 11 nt, Mycobacterium tuberculosis H37Rv
ggcgcagccgg

SEQ ID NO: 1362350 - RNA, 14 nt, Mycobacterium tuberculosis H37Rv
ggcgcagauagcgc

SEQ ID NO: 1362351 - RNA, 16 nt, Mycobacterium tuberculosis H37Rv
ggcgcauuccggcgcc

SEQ ID NO: 1362352 - RNA, 19 nt, Mycobacterium tuberculosis H37Rv
ggcgcaguuggcaccagcc

SEQ ID NO: 1362353 - RNA, 16 nt, Mycobacterium tuberculosis H37Rv
ggcgcaguagccgacc

SEQ ID NO: 1362354 - RNA, 19 nt, Mycobacterium tuberculosis H37Rv
ggcgccauggucgcugcgu

SEQ ID NO: 1362355 - RNA, 16 nt, Mycobacterium tuberculosis H37Rv
ggcgccauuugggccc

SEQ ID NO: 1362356 - RNA, 21 nt, Mycobacterium tuberculosis H37Rv
ggcgccacccgcgccgcccgc

SEQ ID NO: 1362357 - RNA, 19 nt, Mycobacterium tuberculosis H37Rv
ggcgcauuccggcgccagg

SEQ ID NO: 1362358 - RNA, 23 nt, Mycobacterium tuberculosis H37Rv
ggcgccacccgcgccgcccgcuc

SEQ ID NO: 1362359 - RNA, 13 nt, Mycobacterium tuberculosis H37Rv
ggcgcccgcccga

SEQ ID NO: 1362360 - RNA, 21 nt, Mycobacterium tuberculosis H37Rv
ggcgcccgaagccgggcccca

SEQ ID NO: 1362361 - RNA, 12 nt, Mycobacterium tuberculosis H37Rv
ggcgcccgccgg

SEQ ID NO: 1362362 - RNA, 21 nt, Mycobacterium tuberculosis H37Rv
ggcgcccggucgagccagcgg

SEQ ID NO: 1362363 - RNA, 20 nt, Mycobacterium tuberculosis H37Rv
ggcgcccgggucccggcagc

SEQ ID NO: 1362364 - RNA, 19 nt, Mycobacterium tuberculosis H37Rv
ggcgcccggucgagccagc

SEQ ID NO: 1362365 - RNA, 21 nt, Mycobacterium tuberculosis H37Rv
ggcgcccgcucggccgcagcc

SEQ ID NO: 1362366 - RNA, 15 nt, Mycobacterium tuberculosis H37Rv
ggcgcccgaagccgg

SEQ ID NO: 1362367 - RNA, 22 nt, Mycobacterium tuberculosis H37Rv
ggcgcccccgccauugccgccg

SEQ ID NO: 1362368 - RNA, 19 nt, Mycobacterium tuberculosis H37Rv
ggcgcccacaucgucggcg

SEQ ID NO: 1362369 - RNA, 23 nt, Mycobacterium tuberculosis H37Rv
ggcgcccacaucgucggcgggcg

SEQ ID NO: 1362370 - RNA, 13 nt, Mycobacterium tuberculosis H37Rv
ggcgcccagcgcu

SEQ ID NO: 1362371 - RNA, 18 nt, Mycobacterium tuberculosis H37Rv
ggcgucuguaccacgggc

SEQ ID NO: 1362372 - RNA, 11 nt, Mycobacterium tuberculosis H37Rv
ggcgucugcgg

SEQ ID NO: 1362373 - RNA, 18 nt, Mycobacterium tuberculosis H37Rv
ggcgucguucgcgggugc

SEQ ID NO: 1362374 - RNA, 22 nt, Mycobacterium tuberculosis H37Rv
ggcgucgugcgcggccggcacg

SEQ ID NO: 1362375 - RNA, 16 nt, Mycobacterium tuberculosis H37Rv
ggcgucgugcgcggcc

SEQ ID NO: 1362376 - RNA, 22 nt, Mycobacterium tuberculosis H37Rv
ggcgucgucgauggcugcgccg

SEQ ID NO: 1362377 - RNA, 14 nt, Mycobacterium tuberculosis H37Rv
ggcgucgucggcgg

SEQ ID NO: 1362378 - RNA, 21 nt, Mycobacterium tuberculosis H37Rv
ggcgugacagggcggcaaccu

SEQ ID NO: 1362379 - RNA, 22 nt, Mycobacterium tuberculosis H37Rv
ggcgugagcuaugcuggcagcu

SEQ ID NO: 1362380 - RNA, 14 nt, Mycobacterium tuberculosis H37Rv
ggcgucccgcccgg

SEQ ID NO: 1362381 - RNA, 20 nt, Mycobacterium tuberculosis H37Rv
ggcgucgacccugcccagca

SEQ ID NO: 1362382 - RNA, 23 nt, Mycobacterium tuberculosis H37Rv
ggcgucgacgauucccgcggaca

SEQ ID NO: 1362383 - RNA, 19 nt, Mycobacterium tuberculosis H37Rv
ggcgucgacgucgacggcg

SEQ ID NO: 1362384 - RNA, 16 nt, Mycobacterium tuberculosis H37Rv
ggcgucgaccgcggcc

SEQ ID NO: 1362385 - RNA, 23 nt, Mycobacterium tuberculosis H37Rv
ggcgucgaccuuauugccgagcu

SEQ ID NO: 1362386 - RNA, 16 nt, Mycobacterium tuberculosis H37Rv
ggcgucgaugcgggcc

SEQ ID NO: 1362387 - RNA, 23 nt, Mycobacterium tuberculosis H37Rv
ggcgucgaucaacaacagccgca

SEQ ID NO: 1362388 - RNA, 17 nt, Mycobacterium tuberculosis H37Rv
ggcgucgcaacccggcc

SEQ ID NO: 1362389 - RNA, 22 nt, Mycobacterium tuberculosis H37Rv
ggcgucggccaccgccugagcg

SEQ ID NO: 1362390 - RNA, 16 nt, Mycobacterium tuberculosis H37Rv
ggcgucggccaccgcc

SEQ ID NO: 1362391 - RNA, 16 nt, Mycobacterium tuberculosis H37Rv
ggcgugccgaccagca

SEQ ID NO: 1362392 - RNA, 11 nt, Mycobacterium tuberculosis H37Rv
ggcgugcuggc

SEQ ID NO: 1362393 - RNA, 21 nt, Mycobacterium tuberculosis H37Rv
ggcgugcucgccgggucagcc

SEQ ID NO: 1362394 - RNA, 14 nt, Mycobacterium tuberculosis H37Rv
ggcgugcggcggcc

SEQ ID NO: 1362395 - RNA, 14 nt, Mycobacterium tuberculosis H37Rv
ggcgugcaguacac

SEQ ID NO: 1362396 - RNA, 21 nt, Mycobacterium tuberculosis H37Rv
ggcgugcccgucgugcggggg

SEQ ID NO: 1362397 - RNA, 24 nt, Mycobacterium tuberculosis H37Rv
ggcgugcuugaccgccuggaagga

SEQ ID NO: 1362398 - RNA, 17 nt, Mycobacterium tuberculosis H37Rv
ggcgugcuugacgagga

SEQ ID NO: 1362399 - RNA, 12 nt, Mycobacterium tuberculosis H37Rv
ggcguggcuggu

SEQ ID NO: 1362400 - RNA, 15 nt, Mycobacterium tuberculosis H37Rv
ggcguggccccaccg

SEQ ID NO: 1362401 - RNA, 16 nt, Mycobacterium tuberculosis H37Rv
ggcguggucggcggug

SEQ ID NO: 1362402 - RNA, 16 nt, Mycobacterium tuberculosis H37Rv
ggcgugucgccgccac

SEQ ID NO: 1362403 - RNA, 18 nt, Mycobacterium tuberculosis H37Rv
ggcguguagccugcggcg

SEQ ID NO: 1362404 - RNA, 20 nt, Mycobacterium tuberculosis H37Rv
ggcguguucgacggcaagcg

SEQ ID NO: 1362405 - RNA, 16 nt, Mycobacterium tuberculosis H37Rv
ggcguuacguggugga

SEQ ID NO: 1362406 - RNA, 13 nt, Mycobacterium tuberculosis H37Rv
ggcguucaccugc

SEQ ID NO: 1362407 - RNA, 18 nt, Mycobacterium tuberculosis H37Rv
ggcucaccccguucgagg

SEQ ID NO: 1362408 - RNA, 13 nt, Mycobacterium tuberculosis H37Rv
ggcucacccuugg

SEQ ID NO: 1362409 - RNA, 22 nt, Mycobacterium tuberculosis H37Rv
ggcucaacaccgaguuccucug

SEQ ID NO: 1362410 - RNA, 15 nt, Mycobacterium tuberculosis H37Rv
ggcuaucugauccag

SEQ ID NO: 1362411 - RNA, 21 nt, Mycobacterium tuberculosis H37Rv
ggcucaaccucuggcggcggg

SEQ ID NO: 1362412 - RNA, 14 nt, Mycobacterium tuberculosis H37Rv
ggcucacccuugga

SEQ ID NO: 1362413 - RNA, 16 nt, Mycobacterium tuberculosis H37Rv
ggcucacgcuccgccg

SEQ ID NO: 1362414 - RNA, 21 nt, Mycobacterium tuberculosis H37Rv
ggcucagcagcgccgcgcggg

SEQ ID NO: 1362415 - RNA, 15 nt, Mycobacterium tuberculosis H37Rv
ggcucagcggcgacc

SEQ ID NO: 1362416 - RNA, 17 nt, Mycobacterium tuberculosis H37Rv
ggcuauggcgcagcugg

SEQ ID NO: 1362417 - RNA, 15 nt, Mycobacterium tuberculosis H37Rv
ggcuauccaccugcu

SEQ ID NO: 1362418 - RNA, 16 nt, Mycobacterium tuberculosis H37Rv
ggcuauaucccgcccc

SEQ ID NO: 1362419 - RNA, 20 nt, Mycobacterium tuberculosis H37Rv
ggcuacggcugcccguucug

SEQ ID NO: 1362420 - RNA, 22 nt, Mycobacterium tuberculosis H37Rv
ggcuacucgaaacccauguuug

SEQ ID NO: 1362421 - RNA, 13 nt, Mycobacterium tuberculosis H37Rv
ggcuacggccagu

SEQ ID NO: 1362422 - RNA, 22 nt, Mycobacterium tuberculosis H37Rv
ggcuaguugggugggugcagca

SEQ ID NO: 1362423 - RNA, 15 nt, Mycobacterium tuberculosis H37Rv
ggcuagggcagcagc

SEQ ID NO: 1362424 - RNA, 19 nt, Mycobacterium tuberculosis H37Rv
ggcuaggcaccagcggauc

SEQ ID NO: 1362425 - RNA, 13 nt, Mycobacterium tuberculosis H37Rv
ggcuaggccagca

SEQ ID NO: 1362426 - RNA, 15 nt, Mycobacterium tuberculosis H37Rv
ggcuacaucggcggc

SEQ ID NO: 1362427 - RNA, 18 nt, Mycobacterium tuberculosis H37Rv
ggcuacccaauaggcgaa

SEQ ID NO: 1362428 - RNA, 18 nt, Mycobacterium tuberculosis H37Rv
ggcuaccuaacccgcgcc

SEQ ID NO: 1362429 - RNA, 14 nt, Mycobacterium tuberculosis H37Rv
ggcuaccggcagcu

SEQ ID NO: 1362430 - RNA, 15 nt, Mycobacterium tuberculosis H37Rv
ggcuacgccccacug

SEQ ID NO: 1362431 - RNA, 22 nt, Mycobacterium tuberculosis H37Rv
ggcuaagccuucggugucgccg

SEQ ID NO: 1362432 - RNA, 13 nt, Mycobacterium tuberculosis H37Rv
ggcguuggcggcu

SEQ ID NO: 1362433 - RNA, 14 nt, Mycobacterium tuberculosis H37Rv
ggcguuggccagca

SEQ ID NO: 1362434 - RNA, 17 nt, Mycobacterium tuberculosis H37Rv
ggcguugaucgccgggc

SEQ ID NO: 1362435 - RNA, 16 nt, Mycobacterium tuberculosis H37Rv
ggcguugaccagcacg

SEQ ID NO: 1362436 - RNA, 19 nt, Mycobacterium tuberculosis H37Rv
ggcguuguugaccagcacg

SEQ ID NO: 1362437 - RNA, 16 nt, Mycobacterium tuberculosis H37Rv
ggcguuucggcgggcg

SEQ ID NO: 1362438 - RNA, 22 nt, Mycobacterium tuberculosis H37Rv
ggcggaaacggcaccggauccg

SEQ ID NO: 1362439 - RNA, 16 nt, Mycobacterium tuberculosis H37Rv
ggcggaaaaucggcug

SEQ ID NO: 1362440 - RNA, 17 nt, Mycobacterium tuberculosis H37Rv
ggcgcuuugggcugccg

SEQ ID NO: 1362441 - RNA, 13 nt, Mycobacterium tuberculosis H37Rv
ggcgcuugccggg

SEQ ID NO: 1362442 - RNA, 19 nt, Mycobacterium tuberculosis H37Rv
ggcggaacaccgacgacac

SEQ ID NO: 1362443 - RNA, 17 nt, Mycobacterium tuberculosis H37Rv
ggcggcccccggcagcg

SEQ ID NO: 1362444 - RNA, 22 nt, Mycobacterium tuberculosis H37Rv
ggcggccccaggggcaccagcg

SEQ ID NO: 1362445 - RNA, 14 nt, Mycobacterium tuberculosis H37Rv
ggcggccgagcgca

SEQ ID NO: 1362446 - RNA, 12 nt, Mycobacterium tuberculosis H37Rv
ggcggcccgcuc

SEQ ID NO: 1362447 - RNA, 14 nt, Mycobacterium tuberculosis H37Rv
ggcgcuugccgggg

SEQ ID NO: 1362448 - RNA, 16 nt, Mycobacterium tuberculosis H37Rv
ggcgcuggacggcggg

SEQ ID NO: 1362449 - RNA, 18 nt, Mycobacterium tuberculosis H37Rv
ggcgcuggacggcgggcc

SEQ ID NO: 1362450 - RNA, 15 nt, Mycobacterium tuberculosis H37Rv
ggcgcuggugcgcca

SEQ ID NO: 1362451 - RNA, 22 nt, Mycobacterium tuberculosis H37Rv
ggcgcuggucgcgguggcggcg

SEQ ID NO: 1362452 - RNA, 22 nt, Mycobacterium tuberculosis H37Rv
ggcggcgucgagggagcgccgc

SEQ ID NO: 1362453 - RNA, 22 nt, Mycobacterium tuberculosis H37Rv
ggcggcucaaccucuggcggcg

SEQ ID NO: 1362454 - RNA, 22 nt, Mycobacterium tuberculosis H37Rv
ggcggcuccaccgggcccgccg

SEQ ID NO: 1362455 - RNA, 14 nt, Mycobacterium tuberculosis H37Rv
ggcggcggugggcg

SEQ ID NO: 1362456 - RNA, 12 nt, Mycobacterium tuberculosis H37Rv
ggcggcgcgccg

SEQ ID NO: 1362457 - RNA, 14 nt, Mycobacterium tuberculosis H37Rv
ggcggcgcgcgcug

SEQ ID NO: 1362458 - RNA, 18 nt, Mycobacterium tuberculosis H37Rv
ggcggcgggggcggcggc

SEQ ID NO: 1362459 - RNA, 19 nt, Mycobacterium tuberculosis H37Rv
ggcggcgucgagcaccucc

SEQ ID NO: 1362460 - RNA, 17 nt, Mycobacterium tuberculosis H37Rv
ggcggcgucgacggcuc

SEQ ID NO: 1362461 - RNA, 18 nt, Mycobacterium tuberculosis H37Rv
ggcggcgucgacggcucc

SEQ ID NO: 1362462 - RNA, 22 nt, Mycobacterium tuberculosis H37Rv
ggcggcgucgacggcuccuccg

SEQ ID NO: 1362463 - RNA, 15 nt, Mycobacterium tuberculosis H37Rv
ggcggcggugggcgc

SEQ ID NO: 1362464 - RNA, 21 nt, Mycobacterium tuberculosis H37Rv
ggcggcgacacgccaggugau

SEQ ID NO: 1362465 - RNA, 23 nt, Mycobacterium tuberculosis H37Rv
ggcggccgcgaccagcgccgcac

SEQ ID NO: 1362466 - RNA, 20 nt, Mycobacterium tuberculosis H37Rv
ggcggccgccaucagccgcu

SEQ ID NO: 1362467 - RNA, 15 nt, Mycobacterium tuberculosis H37Rv
ggcggccgcagcggc

SEQ ID NO: 1362468 - RNA, 14 nt, Mycobacterium tuberculosis H37Rv
ggcggcgccgcaga

SEQ ID NO: 1362469 - RNA, 22 nt, Mycobacterium tuberculosis H37Rv
ggcggcgauccggucgggggcg

SEQ ID NO: 1362470 - RNA, 16 nt, Mycobacterium tuberculosis H37Rv
ggcggcgacgagcgca

SEQ ID NO: 1362471 - RNA, 13 nt, Mycobacterium tuberculosis H37Rv
ggcggucggcaga

SEQ ID NO: 1362472 - RNA, 18 nt, Mycobacterium tuberculosis H37Rv
ggcggucugcagugcagc

SEQ ID NO: 1362473 - RNA, 13 nt, Mycobacterium tuberculosis H37Rv
ggcggucggcugg

SEQ ID NO: 1362474 - RNA, 23 nt, Mycobacterium tuberculosis H37Rv
ggcggucguugauuucggcggcg

SEQ ID NO: 1362475 - RNA, 20 nt, Mycobacterium tuberculosis H37Rv
ggcggucugcagugcagcga

SEQ ID NO: 1362476 - RNA, 18 nt, Mycobacterium tuberculosis H37Rv
ggcggucugcgccaaaau

SEQ ID NO: 1362477 - RNA, 16 nt, Mycobacterium tuberculosis H37Rv
ggcggucugggugagc

SEQ ID NO: 1362478 - RNA, 18 nt, Mycobacterium tuberculosis H37Rv
ggcggugagccgccagga

SEQ ID NO: 1362479 - RNA, 19 nt, Mycobacterium tuberculosis H37Rv
ggcggucuuuuugggcuug

SEQ ID NO: 1362480 - RNA, 13 nt, Mycobacterium tuberculosis H37Rv
ggcggugccgccg

SEQ ID NO: 1362481 - RNA, 13 nt, Mycobacterium tuberculosis H37Rv
ggcggugccggcg

SEQ ID NO: 1362482 - RNA, 15 nt, Mycobacterium tuberculosis H37Rv
ggcggugccggcggc

SEQ ID NO: 1362483 - RNA, 21 nt, Mycobacterium tuberculosis H37Rv
ggcggugccaucgggcgcggu

SEQ ID NO: 1362484 - RNA, 13 nt, Mycobacterium tuberculosis H37Rv
ggcggugccgacg

SEQ ID NO: 1362485 - RNA, 15 nt, Mycobacterium tuberculosis H37Rv
ggcggugcagcaggg

SEQ ID NO: 1362486 - RNA, 16 nt, Mycobacterium tuberculosis H37Rv
ggcggucagcggcugg

SEQ ID NO: 1362487 - RNA, 20 nt, Mycobacterium tuberculosis H37Rv
ggcggucagcggccaaccca

SEQ ID NO: 1362488 - RNA, 21 nt, Mycobacterium tuberculosis H37Rv
ggcggcuuggccgccccggcc

SEQ ID NO: 1362489 - RNA, 17 nt, Mycobacterium tuberculosis H37Rv
ggcggucccugaagcca

SEQ ID NO: 1362490 - RNA, 20 nt, Mycobacterium tuberculosis H37Rv
ggcggucccugaagccagcg

SEQ ID NO: 1362491 - RNA, 19 nt, Mycobacterium tuberculosis H37Rv
ggcggcuucgacgucggcg

SEQ ID NO: 1362492 - RNA, 20 nt, Mycobacterium tuberculosis H37Rv
ggcggcuuagaacgugcugg

SEQ ID NO: 1362493 - RNA, 13 nt, Mycobacterium tuberculosis H37Rv
ggcggcugcagcc

SEQ ID NO: 1362494 - RNA, 22 nt, Mycobacterium tuberculosis H37Rv
ggcggcucuagaucgccgagcg

SEQ ID NO: 1362495 - RNA, 18 nt, Mycobacterium tuberculosis H37Rv
ggcggcucuagaucgccg

SEQ ID NO: 1362496 - RNA, 15 nt, Mycobacterium tuberculosis H37Rv
ggcggcucgggugcg

SEQ ID NO: 1362497 - RNA, 12 nt, Mycobacterium tuberculosis H37Rv
ggcggcuaccca

SEQ ID NO: 1362498 - RNA, 14 nt, Mycobacterium tuberculosis H37Rv
ggcggcucgggugc

SEQ ID NO: 1362499 - RNA, 18 nt, Mycobacterium tuberculosis H37Rv
ggcggcugcagccgaccg

SEQ ID NO: 1362500 - RNA, 14 nt, Mycobacterium tuberculosis H37Rv
ggcggcugcgggcc

SEQ ID NO: 1362501 - RNA, 17 nt, Mycobacterium tuberculosis H37Rv
ggcggcugaacggcagc

SEQ ID NO: 1362502 - RNA, 17 nt, Mycobacterium tuberculosis H37Rv
ggcguccuugcgcagca

SEQ ID NO: 1362503 - RNA, 15 nt, Mycobacterium tuberculosis H37Rv
ggcguccgcccagca

SEQ ID NO: 1362504 - RNA, 16 nt, Mycobacterium tuberculosis H37Rv
ggcgucaugcccaggu

SEQ ID NO: 1362505 - RNA, 13 nt, Mycobacterium tuberculosis H37Rv
ggcgucagcagca

SEQ ID NO: 1362506 - RNA, 12 nt, Mycobacterium tuberculosis H37Rv
ggcguccagcag

SEQ ID NO: 1362507 - RNA, 16 nt, Mycobacterium tuberculosis H37Rv
ggcgucauccgcggca

SEQ ID NO: 1362508 - RNA, 15 nt, Mycobacterium tuberculosis H37Rv
ggcguaccagcuggc

SEQ ID NO: 1362509 - RNA, 15 nt, Mycobacterium tuberculosis H37Rv
ggcguacagcgccug

SEQ ID NO: 1362510 - RNA, 22 nt, Mycobacterium tuberculosis H37Rv
ggcgguugaucgccggccugcu

SEQ ID NO: 1362511 - RNA, 15 nt, Mycobacterium tuberculosis H37Rv
ggcgguugaucgccg

SEQ ID NO: 1362512 - RNA, 13 nt, Mycobacterium tuberculosis H37Rv
ggcgguggcccga

SEQ ID NO: 1362513 - RNA, 23 nt, Mycobacterium tuberculosis H37Rv
ggcgguggccacccggccgcgcg

SEQ ID NO: 1362514 - RNA, 17 nt, Mycobacterium tuberculosis H37Rv
gaagaccaggccgguga

SEQ ID NO: 1362515 - RNA, 18 nt, Mycobacterium tuberculosis H37Rv
gaagaccuggccugcggc

SEQ ID NO: 1362516 - RNA, 23 nt, Mycobacterium tuberculosis H37Rv
gaagaccucgucgcgucgccaga

SEQ ID NO: 1362517 - RNA, 14 nt, Mycobacterium tuberculosis H37Rv
gaagagcaggccca

SEQ ID NO: 1362518 - RNA, 13 nt, Mycobacterium tuberculosis H37Rv
gaagagcaccgcg

SEQ ID NO: 1362519 - RNA, 19 nt, Mycobacterium tuberculosis H37Rv
gaagaucaccucccgcggc

SEQ ID NO: 1362520 - RNA, 15 nt, Mycobacterium tuberculosis H37Rv
gaagaucaccucccg

SEQ ID NO: 1362521 - RNA, 15 nt, Mycobacterium tuberculosis H37Rv
gaagaucuccuccug

SEQ ID NO: 1362522 - RNA, 20 nt, Mycobacterium tuberculosis H37Rv
gaagaucgcgugccacagca

SEQ ID NO: 1362523 - RNA, 19 nt, Mycobacterium tuberculosis H37Rv
gaacaucgccagcgccggc

SEQ ID NO: 1362524 - RNA, 16 nt, Mycobacterium tuberculosis H37Rv
gaagaacuggcugcug

SEQ ID NO: 1362525 - RNA, 15 nt, Mycobacterium tuberculosis H37Rv
gaagaagccgaagca

SEQ ID NO: 1362526 - RNA, 23 nt, Mycobacterium tuberculosis H37Rv
gaagaauggacugaacaccaaau

SEQ ID NO: 1362527 - RNA, 16 nt, Mycobacterium tuberculosis H37Rv
gaagaccaccgcccac

SEQ ID NO: 1362528 - RNA, 23 nt, Mycobacterium tuberculosis H37Rv
gaagaccaccgcccacagcaacg

SEQ ID NO: 1362529 - RNA, 12 nt, Mycobacterium tuberculosis H37Rv
gaagccgcgcug

SEQ ID NO: 1362530 - RNA, 20 nt, Mycobacterium tuberculosis H37Rv
gaagccguugacuugugcca

SEQ ID NO: 1362531 - RNA, 18 nt, Mycobacterium tuberculosis H37Rv
gaagccguuugcgcuggc

SEQ ID NO: 1362532 - RNA, 19 nt, Mycobacterium tuberculosis H37Rv
gaagccggccacuacggcc

SEQ ID NO: 1362533 - RNA, 17 nt, Mycobacterium tuberculosis H37Rv
gaagccgcaucuggcug

SEQ ID NO: 1362534 - RNA, 17 nt, Mycobacterium tuberculosis H37Rv
gaagccgcgcaucuguc

SEQ ID NO: 1362535 - RNA, 22 nt, Mycobacterium tuberculosis H37Rv
gaagccgcaccgcuguugcauc

SEQ ID NO: 1362536 - RNA, 13 nt, Mycobacterium tuberculosis H37Rv
gaagccgagcauc

SEQ ID NO: 1362537 - RNA, 16 nt, Mycobacterium tuberculosis H37Rv
gaagccuugcagcgcc

SEQ ID NO: 1362538 - RNA, 20 nt, Mycobacterium tuberculosis H37Rv
gaagcgaugccgugcugggc

SEQ ID NO: 1362539 - RNA, 20 nt, Mycobacterium tuberculosis H37Rv
gaagcucaauuccaugcagu

SEQ ID NO: 1362540 - RNA, 14 nt, Mycobacterium tuberculosis H37Rv
gaagcuagagccag

SEQ ID NO: 1362541 - RNA, 18 nt, Mycobacterium tuberculosis H37Rv
gaagcagggauucuggau

SEQ ID NO: 1362542 - RNA, 20 nt, Mycobacterium tuberculosis H37Rv
gaagccaggauugccgccgu

SEQ ID NO: 1362543 - RNA, 19 nt, Mycobacterium tuberculosis H37Rv
gaagccgacgaccagcaga

SEQ ID NO: 1362544 - RNA, 18 nt, Mycobacterium tuberculosis H37Rv
gaagccgacgaccagcag

SEQ ID NO: 1362545 - RNA, 13 nt, Mycobacterium tuberculosis H37Rv
gaagaugccugcu

SEQ ID NO: 1362546 - RNA, 20 nt, Mycobacterium tuberculosis H37Rv
gaagaugccugcuagcagca

SEQ ID NO: 1362547 - RNA, 21 nt, Mycobacterium tuberculosis H37Rv
gaagaugccugcuagcagcag

SEQ ID NO: 1362548 - RNA, 22 nt, Mycobacterium tuberculosis H37Rv
gaagaugccugcuagcagcagc

SEQ ID NO: 1362549 - RNA, 17 nt, Mycobacterium tuberculosis H37Rv
gaagauggcaccgcccc

SEQ ID NO: 1362550 - RNA, 22 nt, Mycobacterium tuberculosis H37Rv
gaagaugucuuccugcgccggu

SEQ ID NO: 1362551 - RNA, 16 nt, Mycobacterium tuberculosis H37Rv
gaagcucgaccgcccg

SEQ ID NO: 1362552 - RNA, 16 nt, Mycobacterium tuberculosis H37Rv
gaagcugcugcugcuu

SEQ ID NO: 1362553 - RNA, 23 nt, Mycobacterium tuberculosis H37Rv
gaagcuggcacgcagagccaaca

SEQ ID NO: 1362554 - RNA, 16 nt, Mycobacterium tuberculosis H37Rv
gaagcuggcgugcagc

SEQ ID NO: 1362555 - RNA, 14 nt, Mycobacterium tuberculosis H37Rv
gaagcuggccaccg

SEQ ID NO: 1362556 - RNA, 21 nt, Mycobacterium tuberculosis H37Rv
gaagcuggcgccgcagguuca

SEQ ID NO: 1362557 - RNA, 19 nt, Mycobacterium tuberculosis H37Rv
gaagcuggcgugcagcagg

SEQ ID NO: 1362558 - RNA, 17 nt, Mycobacterium tuberculosis H37Rv
gaagcuguaggcgacca

SEQ ID NO: 1362559 - RNA, 20 nt, Mycobacterium tuberculosis H37Rv
gaaggcuucggugacccggg

SEQ ID NO: 1362560 - RNA, 17 nt, Mycobacterium tuberculosis H37Rv
gaaggucagcagggccg

SEQ ID NO: 1362561 - RNA, 22 nt, Mycobacterium tuberculosis H37Rv
gaaggcugucaguucccgcuug

SEQ ID NO: 1362562 - RNA, 19 nt, Mycobacterium tuberculosis H37Rv
gaagcuuaggcgugguucc

SEQ ID NO: 1362563 - RNA, 18 nt, Mycobacterium tuberculosis H37Rv
gaaguagugcucgcagcc

SEQ ID NO: 1362564 - RNA, 14 nt, Mycobacterium tuberculosis H37Rv
gaaguaggcggcga

SEQ ID NO: 1362565 - RNA, 20 nt, Mycobacterium tuberculosis H37Rv
gaaguagguuuucggcggcu

SEQ ID NO: 1362566 - RNA, 12 nt, Mycobacterium tuberculosis H37Rv
gaaggugcuggu

SEQ ID NO: 1362567 - RNA, 14 nt, Mycobacterium tuberculosis H37Rv
gaaggugacgacga

SEQ ID NO: 1362568 - RNA, 16 nt, Mycobacterium tuberculosis H37Rv
gaaggugaaucgacug

SEQ ID NO: 1362569 - RNA, 20 nt, Mycobacterium tuberculosis H37Rv
gaaggucuggccugccccag

SEQ ID NO: 1362570 - RNA, 18 nt, Mycobacterium tuberculosis H37Rv
gaagguguuggugcgggg

SEQ ID NO: 1362571 - RNA, 21 nt, Mycobacterium tuberculosis H37Rv
gaaggugggauugaagcuggc

SEQ ID NO: 1362572 - RNA, 15 nt, Mycobacterium tuberculosis H37Rv
gaagguguccuccag

SEQ ID NO: 1362573 - RNA, 17 nt, Mycobacterium tuberculosis H37Rv
gaaguccacgcaccacg

SEQ ID NO: 1362574 - RNA, 21 nt, Mycobacterium tuberculosis H37Rv
gaaguucuccucgugcagcac

SEQ ID NO: 1362575 - RNA, 14 nt, Mycobacterium tuberculosis H37Rv
gaaguucucggugc

SEQ ID NO: 1362576 - RNA, 16 nt, Mycobacterium tuberculosis H37Rv
gaaguugaagaagcca

SEQ ID NO: 1362577 - RNA, 18 nt, Mycobacterium tuberculosis H37Rv
gaaguugccggucaggca

SEQ ID NO: 1362578 - RNA, 22 nt, Mycobacterium tuberculosis H37Rv
gaaguugugcgcacucuuuccu

SEQ ID NO: 1362579 - RNA, 14 nt, Mycobacterium tuberculosis H37Rv
gaaguuggcugagc

SEQ ID NO: 1362580 - RNA, 14 nt, Mycobacterium tuberculosis H37Rv
gaaguuggcguggu

SEQ ID NO: 1362581 - RNA, 18 nt, Mycobacterium tuberculosis H37Rv
gaaguggcgucagugcag

SEQ ID NO: 1362582 - RNA, 21 nt, Mycobacterium tuberculosis H37Rv
gaaguguucgacacccucggg

SEQ ID NO: 1362583 - RNA, 16 nt, Mycobacterium tuberculosis H37Rv
gaauacaccugcugga

SEQ ID NO: 1362584 - RNA, 21 nt, Mycobacterium tuberculosis H37Rv
gaauacaccugcuggaagccg

SEQ ID NO: 1362585 - RNA, 17 nt, Mycobacterium tuberculosis H37Rv
gaauacgaggacgacga

SEQ ID NO: 1362586 - RNA, 16 nt, Mycobacterium tuberculosis H37Rv
gaauacgaccgucgcg

SEQ ID NO: 1362587 - RNA, 20 nt, Mycobacterium tuberculosis H37Rv
gaauccggcaaccaccggcc

SEQ ID NO: 1362588 - RNA, 15 nt, Mycobacterium tuberculosis H37Rv
gaauccgggaagccg

SEQ ID NO: 1362589 - RNA, 21 nt, Mycobacterium tuberculosis H37Rv
gaaucccgagucugcgagcag

SEQ ID NO: 1362590 - RNA, 20 nt, Mycobacterium tuberculosis H37Rv
gaaucccccggacggcaggc

SEQ ID NO: 1362591 - RNA, 23 nt, Mycobacterium tuberculosis H37Rv
gaaucccccggacggcaggcugg

SEQ ID NO: 1362592 - RNA, 17 nt, Mycobacterium tuberculosis H37Rv
gaaucgucggcgcggcu

SEQ ID NO: 1362593 - RNA, 13 nt, Mycobacterium tuberculosis H37Rv
gaaucgggauagc

SEQ ID NO: 1362594 - RNA, 14 nt, Mycobacterium tuberculosis H37Rv
gaaucgggucagca

SEQ ID NO: 1362595 - RNA, 17 nt, Mycobacterium tuberculosis H37Rv
gaaucgguuucgaccug

SEQ ID NO: 1362596 - RNA, 19 nt, Mycobacterium tuberculosis H37Rv
gaaucggcaccgugcgggg

SEQ ID NO: 1362597 - RNA, 19 nt, Mycobacterium tuberculosis H37Rv
gaaucggcggaugaugcaa

SEQ ID NO: 1362598 - RNA, 18 nt, Mycobacterium tuberculosis H37Rv
gaaucgcggagccaggac

SEQ ID NO: 1362599 - RNA, 16 nt, Mycobacterium tuberculosis H37Rv
gaaucgcugccgccga

SEQ ID NO: 1362600 - RNA, 17 nt, Mycobacterium tuberculosis H37Rv
gaaucugccggccggcg

SEQ ID NO: 1362601 - RNA, 15 nt, Mycobacterium tuberculosis H37Rv
gaaucucgcccccag

SEQ ID NO: 1362602 - RNA, 14 nt, Mycobacterium tuberculosis H37Rv
gaaugcugggcccg

SEQ ID NO: 1362603 - RNA, 16 nt, Mycobacterium tuberculosis H37Rv
gaaugcugggcccgcc

SEQ ID NO: 1362604 - RNA, 17 nt, Mycobacterium tuberculosis H37Rv
gaaugaucggcguccuu

SEQ ID NO: 1362605 - RNA, 15 nt, Mycobacterium tuberculosis H37Rv
gaaucaccccggcgg

SEQ ID NO: 1362606 - RNA, 17 nt, Mycobacterium tuberculosis H37Rv
gaaucaccccggcggcc

SEQ ID NO: 1362607 - RNA, 23 nt, Mycobacterium tuberculosis H37Rv
gacaacggguugucguugcuggu

SEQ ID NO: 1362608 - RNA, 21 nt, Mycobacterium tuberculosis H37Rv
gacacagcccacaggcggcgc

SEQ ID NO: 1362609 - RNA, 22 nt, Mycobacterium tuberculosis H37Rv
gacacagaaucgcacgaaauca

SEQ ID NO: 1362610 - RNA, 12 nt, Mycobacterium tuberculosis H37Rv
gacacacaggcg

SEQ ID NO: 1362611 - RNA, 22 nt, Mycobacterium tuberculosis H37Rv
gacacaccgcgucggccgaaca

SEQ ID NO: 1362612 - RNA, 16 nt, Mycobacterium tuberculosis H37Rv
gacaaagauugccggu

SEQ ID NO: 1362613 - RNA, 14 nt, Mycobacterium tuberculosis H37Rv
gacaaagcggcugc

SEQ ID NO: 1362614 - RNA, 20 nt, Mycobacterium tuberculosis H37Rv
gacaaagccgaacgacagca

SEQ ID NO: 1362615 - RNA, 13 nt, Mycobacterium tuberculosis H37Rv
gacaacagcuugg

SEQ ID NO: 1362616 - RNA, 12 nt, Mycobacterium tuberculosis H37Rv
gacaacagcaag

SEQ ID NO: 1362617 - RNA, 14 nt, Mycobacterium tuberculosis H37Rv
gacaacaccacggu

SEQ ID NO: 1362618 - RNA, 13 nt, Mycobacterium tuberculosis H37Rv
gaauggccgccuu

SEQ ID NO: 1362619 - RNA, 17 nt, Mycobacterium tuberculosis H37Rv
gaauggccgccgcagcu

SEQ ID NO: 1362620 - RNA, 15 nt, Mycobacterium tuberculosis H37Rv
gaauggccgccgcag

SEQ ID NO: 1362621 - RNA, 19 nt, Mycobacterium tuberculosis H37Rv
gaauggcccuugcucgucc

SEQ ID NO: 1362622 - RNA, 16 nt, Mycobacterium tuberculosis H37Rv
gaaugcuugcgcagca

SEQ ID NO: 1362623 - RNA, 15 nt, Mycobacterium tuberculosis H37Rv
gaauucacgaugcuc

SEQ ID NO: 1362624 - RNA, 19 nt, Mycobacterium tuberculosis H37Rv
gaauucccaugcugcgcaa

SEQ ID NO: 1362625 - RNA, 22 nt, Mycobacterium tuberculosis H37Rv
gaauuuggugaagccguagacg

SEQ ID NO: 1362626 - RNA, 16 nt, Mycobacterium tuberculosis H37Rv
gaauuuggugaaguga

SEQ ID NO: 1362627 - RNA, 15 nt, Mycobacterium tuberculosis H37Rv
gaccagguaauggug

SEQ ID NO: 1362628 - RNA, 22 nt, Mycobacterium tuberculosis H37Rv
gaccagguagaccaggugcagc

SEQ ID NO: 1362629 - RNA, 17 nt, Mycobacterium tuberculosis H37Rv
gaccaggcggcgcgggu

SEQ ID NO: 1362630 - RNA, 14 nt, Mycobacterium tuberculosis H37Rv
gaccagggccgccg

SEQ ID NO: 1362631 - RNA, 17 nt, Mycobacterium tuberculosis H37Rv
gaccaggugcagcacca

SEQ ID NO: 1362632 - RNA, 14 nt, Mycobacterium tuberculosis H37Rv
gaccaggucugcgg

SEQ ID NO: 1362633 - RNA, 23 nt, Mycobacterium tuberculosis H37Rv
gaccagugaucagcgcaucgccg

SEQ ID NO: 1362634 - RNA, 18 nt, Mycobacterium tuberculosis H37Rv
gacccaccgccccggcgg

SEQ ID NO: 1362635 - RNA, 22 nt, Mycobacterium tuberculosis H37Rv
gacccaccgccccggcggcggc

SEQ ID NO: 1362636 - RNA, 16 nt, Mycobacterium tuberculosis H37Rv
gacccacagucgccgg

SEQ ID NO: 1362637 - RNA, 12 nt, Mycobacterium tuberculosis H37Rv
gacccaaagcac

SEQ ID NO: 1362638 - RNA, 12 nt, Mycobacterium tuberculosis H37Rv
gacccagcaccc

SEQ ID NO: 1362639 - RNA, 21 nt, Mycobacterium tuberculosis H37Rv
gacccagauggcucgaagcug

SEQ ID NO: 1362640 - RNA, 12 nt, Mycobacterium tuberculosis H37Rv
gacccgccaggg

SEQ ID NO: 1362641 - RNA, 16 nt, Mycobacterium tuberculosis H37Rv
gacccgcagaccgcca

SEQ ID NO: 1362642 - RNA, 12 nt, Mycobacterium tuberculosis H37Rv
gacccggggccg

SEQ ID NO: 1362643 - RNA, 17 nt, Mycobacterium tuberculosis H37Rv
gacccuaacucccccgc

SEQ ID NO: 1362644 - RNA, 19 nt, Mycobacterium tuberculosis H37Rv
gacccugcccagcaccccc

SEQ ID NO: 1362645 - RNA, 19 nt, Mycobacterium tuberculosis H37Rv
gacccugcgccgccacagc

SEQ ID NO: 1362646 - RNA, 19 nt, Mycobacterium tuberculosis H37Rv
gacccugggguccagcguc

SEQ ID NO: 1362647 - RNA, 16 nt, Mycobacterium tuberculosis H37Rv
gacccugcccagcacc

SEQ ID NO: 1362648 - RNA, 16 nt, Mycobacterium tuberculosis H37Rv
gacccgcugggccgca

SEQ ID NO: 1362649 - RNA, 21 nt, Mycobacterium tuberculosis H37Rv
gacccgcuggucgaugccuuc

SEQ ID NO: 1362650 - RNA, 21 nt, Mycobacterium tuberculosis H37Rv
gacccggaccuucggcggugc

SEQ ID NO: 1362651 - RNA, 16 nt, Mycobacterium tuberculosis H37Rv
gacccggcccagcgcc

SEQ ID NO: 1362652 - RNA, 15 nt, Mycobacterium tuberculosis H37Rv
gacccggccagcggc

SEQ ID NO: 1362653 - RNA, 20 nt, Mycobacterium tuberculosis H37Rv
gacccggaccuucggcggug

SEQ ID NO: 1362654 - RNA, 14 nt, Mycobacterium tuberculosis H37Rv
gacccgggucggca

SEQ ID NO: 1362655 - RNA, 13 nt, Mycobacterium tuberculosis H37Rv
gacccgggugguc

SEQ ID NO: 1362656 - RNA, 12 nt, Mycobacterium tuberculosis H37Rv
gacccgggccgg

SEQ ID NO: 1362657 - RNA, 14 nt, Mycobacterium tuberculosis H37Rv
gacccgcugggccg

SEQ ID NO: 1362658 - RNA, 14 nt, Mycobacterium tuberculosis H37Rv
gacccgcucgcggc

SEQ ID NO: 1362659 - RNA, 21 nt, Mycobacterium tuberculosis H37Rv
gacccgcgcgucgcccagugc

SEQ ID NO: 1362660 - RNA, 19 nt, Mycobacterium tuberculosis H37Rv
gacccgcuauucggcggca

SEQ ID NO: 1362661 - RNA, 19 nt, Mycobacterium tuberculosis H37Rv
gacccgcccuugccgccga

SEQ ID NO: 1362662 - RNA, 13 nt, Mycobacterium tuberculosis H37Rv
gaccagcaaccac

SEQ ID NO: 1362663 - RNA, 13 nt, Mycobacterium tuberculosis H37Rv
gaccagcaccgcc

SEQ ID NO: 1362664 - RNA, 19 nt, Mycobacterium tuberculosis H37Rv
gaccagcagauccaggcgu

SEQ ID NO: 1362665 - RNA, 13 nt, Mycobacterium tuberculosis H37Rv
gaccagcacaccg

SEQ ID NO: 1362666 - RNA, 22 nt, Mycobacterium tuberculosis H37Rv
gaccagcacccgcucggccgcc

SEQ ID NO: 1362667 - RNA, 21 nt, Mycobacterium tuberculosis H37Rv
gaccagcaaccaccccagggc

SEQ ID NO: 1362668 - RNA, 23 nt, Mycobacterium tuberculosis H37Rv
gaccagcaaccaccccagggcaa

SEQ ID NO: 1362669 - RNA, 18 nt, Mycobacterium tuberculosis H37Rv
gaccagccguggugguug

SEQ ID NO: 1362670 - RNA, 23 nt, Mycobacterium tuberculosis H37Rv
gaccagcgccccggcgcguucca

SEQ ID NO: 1362671 - RNA, 17 nt, Mycobacterium tuberculosis H37Rv
gaccagggaucgauuug

SEQ ID NO: 1362672 - RNA, 14 nt, Mycobacterium tuberculosis H37Rv
gaccaggcgcggcg

SEQ ID NO: 1362673 - RNA, 15 nt, Mycobacterium tuberculosis H37Rv
gaccaggcggacgcc

SEQ ID NO: 1362674 - RNA, 19 nt, Mycobacterium tuberculosis H37Rv
gaccaggccagagccgccc

SEQ ID NO: 1362675 - RNA, 23 nt, Mycobacterium tuberculosis H37Rv
gaccacgggaugcaugucuugug

SEQ ID NO: 1362676 - RNA, 21 nt, Mycobacterium tuberculosis H37Rv
gaccacugcccgggguccauc

SEQ ID NO: 1362677 - RNA, 15 nt, Mycobacterium tuberculosis H37Rv
gaccacugaucggca

SEQ ID NO: 1362678 - RNA, 17 nt, Mycobacterium tuberculosis H37Rv
gaccacucgagcgcuca

SEQ ID NO: 1362679 - RNA, 16 nt, Mycobacterium tuberculosis H37Rv
gaccagagcuucgccg

SEQ ID NO: 1362680 - RNA, 21 nt, Mycobacterium tuberculosis H37Rv
gaccacuuagcuggcgggggu

SEQ ID NO: 1362681 - RNA, 16 nt, Mycobacterium tuberculosis H37Rv
gaccagaaccuggagc

SEQ ID NO: 1362682 - RNA, 23 nt, Mycobacterium tuberculosis H37Rv
gaccacuguuggugccgccacca

SEQ ID NO: 1362683 - RNA, 16 nt, Mycobacterium tuberculosis H37Rv
gaccaacgcgcaggcc

SEQ ID NO: 1362684 - RNA, 20 nt, Mycobacterium tuberculosis H37Rv
gaccaagguguccagcaccu

SEQ ID NO: 1362685 - RNA, 15 nt, Mycobacterium tuberculosis H37Rv
gacauuggagacgac

SEQ ID NO: 1362686 - RNA, 21 nt, Mycobacterium tuberculosis H37Rv
gacauucccgaguugcccucu

SEQ ID NO: 1362687 - RNA, 16 nt, Mycobacterium tuberculosis H37Rv
gacagcaggaaaaagg

SEQ ID NO: 1362688 - RNA, 19 nt, Mycobacterium tuberculosis H37Rv
gacagcacgccaggcaugc

SEQ ID NO: 1362689 - RNA, 14 nt, Mycobacterium tuberculosis H37Rv
gacagcacccggcc

SEQ ID NO: 1362690 - RNA, 14 nt, Mycobacterium tuberculosis H37Rv
gacacugcagugau

SEQ ID NO: 1362691 - RNA, 19 nt, Mycobacterium tuberculosis H37Rv
gacacgccgaugccgaacu

SEQ ID NO: 1362692 - RNA, 14 nt, Mycobacterium tuberculosis H37Rv
gacacauugaccag

SEQ ID NO: 1362693 - RNA, 17 nt, Mycobacterium tuberculosis H37Rv
gacaccgugaccgccgc

SEQ ID NO: 1362694 - RNA, 20 nt, Mycobacterium tuberculosis H37Rv
gacaccguggaucggcagcc

SEQ ID NO: 1362695 - RNA, 18 nt, Mycobacterium tuberculosis H37Rv
gacacgaaauugggcgcu

SEQ ID NO: 1362696 - RNA, 21 nt, Mycobacterium tuberculosis H37Rv
gacacauagugcggcaccgcc

SEQ ID NO: 1362697 - RNA, 19 nt, Mycobacterium tuberculosis H37Rv
gacacguuguucaccgacg

SEQ ID NO: 1362698 - RNA, 15 nt, Mycobacterium tuberculosis H37Rv
gacacgugcaucugu

SEQ ID NO: 1362699 - RNA, 22 nt, Mycobacterium tuberculosis H37Rv
gacacgaucgcgucggcuaccu

SEQ ID NO: 1362700 - RNA, 15 nt, Mycobacterium tuberculosis H37Rv
gacacggugaucuuc

SEQ ID NO: 1362701 - RNA, 13 nt, Mycobacterium tuberculosis H37Rv
gacaucaccaccg

SEQ ID NO: 1362702 - RNA, 15 nt, Mycobacterium tuberculosis H37Rv
gacaucaccaccgcc

SEQ ID NO: 1362703 - RNA, 23 nt, Mycobacterium tuberculosis H37Rv
gacaucgguggcggccuccgagg

SEQ ID NO: 1362704 - RNA, 15 nt, Mycobacterium tuberculosis H37Rv
gacaucgggcggcac

SEQ ID NO: 1362705 - RNA, 16 nt, Mycobacterium tuberculosis H37Rv
gacaucgguggcggcc

SEQ ID NO: 1362706 - RNA, 19 nt, Mycobacterium tuberculosis H37Rv
gacauaggccaccuccgag

SEQ ID NO: 1362707 - RNA, 15 nt, Mycobacterium tuberculosis H37Rv
gacaucgucgccagg

SEQ ID NO: 1362708 - RNA, 16 nt, Mycobacterium tuberculosis H37Rv
gacaucgucgccaggg

SEQ ID NO: 1362709 - RNA, 17 nt, Mycobacterium tuberculosis H37Rv
gacaucguaggccggca

SEQ ID NO: 1362710 - RNA, 13 nt, Mycobacterium tuberculosis H37Rv
gacaucugcccac

SEQ ID NO: 1362711 - RNA, 13 nt, Mycobacterium tuberculosis H37Rv
gacagcgcugggc

SEQ ID NO: 1362712 - RNA, 20 nt, Mycobacterium tuberculosis H37Rv
gacagcgccaugcccucggc

SEQ ID NO: 1362713 - RNA, 19 nt, Mycobacterium tuberculosis H37Rv
gacagcgcgggacacgucg

SEQ ID NO: 1362714 - RNA, 14 nt, Mycobacterium tuberculosis H37Rv
gacagcgccuggcc

SEQ ID NO: 1362715 - RNA, 15 nt, Mycobacterium tuberculosis H37Rv
gacagcgcggcgguc

SEQ ID NO: 1362716 - RNA, 22 nt, Mycobacterium tuberculosis H37Rv
gacagcucacgcugaagccgcu

SEQ ID NO: 1362717 - RNA, 20 nt, Mycobacterium tuberculosis H37Rv
gacagcuccuuggcuaacac

SEQ ID NO: 1362718 - RNA, 16 nt, Mycobacterium tuberculosis H37Rv
gacagcgugccgaaca

SEQ ID NO: 1362719 - RNA, 19 nt, Mycobacterium tuberculosis H37Rv
gacagcugguugugcuggg

SEQ ID NO: 1362720 - RNA, 21 nt, Mycobacterium tuberculosis H37Rv
gacagcugguugugcugggga

SEQ ID NO: 1362721 - RNA, 23 nt, Mycobacterium tuberculosis H37Rv
gacagcugcacacagaggucggu

SEQ ID NO: 1362722 - RNA, 17 nt, Mycobacterium tuberculosis H37Rv
gacagcugguugugcug

SEQ ID NO: 1362723 - RNA, 15 nt, Mycobacterium tuberculosis H37Rv
gacaggaccgguggg

SEQ ID NO: 1362724 - RNA, 18 nt, Mycobacterium tuberculosis H37Rv
gacauacgagcagugacc

SEQ ID NO: 1362725 - RNA, 18 nt, Mycobacterium tuberculosis H37Rv
gacauacccgaucaaugc

SEQ ID NO: 1362726 - RNA, 21 nt, Mycobacterium tuberculosis H37Rv
gacaggaucgugguagggcau

SEQ ID NO: 1362727 - RNA, 14 nt, Mycobacterium tuberculosis H37Rv
gacaguucccggcc

SEQ ID NO: 1362728 - RNA, 20 nt, Mycobacterium tuberculosis H37Rv
gacaguuggcagcgcuggcu

SEQ ID NO: 1362729 - RNA, 22 nt, Mycobacterium tuberculosis H37Rv
gacgggcgcguccucgccgcac

SEQ ID NO: 1362730 - RNA, 12 nt, Mycobacterium tuberculosis H37Rv
gacgggccgucg

SEQ ID NO: 1362731 - RNA, 17 nt, Mycobacterium tuberculosis H37Rv
gacgggauagccguucg

SEQ ID NO: 1362732 - RNA, 16 nt, Mycobacterium tuberculosis H37Rv
gacgggaucgucggca

SEQ ID NO: 1362733 - RNA, 22 nt, Mycobacterium tuberculosis H37Rv
gacggggucgcgaugcucaaug

SEQ ID NO: 1362734 - RNA, 22 nt, Mycobacterium tuberculosis H37Rv
gacggguagcguacucccccga

SEQ ID NO: 1362735 - RNA, 14 nt, Mycobacterium tuberculosis H37Rv
gacgggucgccgcc

SEQ ID NO: 1362736 - RNA, 21 nt, Mycobacterium tuberculosis H37Rv
gacgggucggcagaauguucu

SEQ ID NO: 1362737 - RNA, 15 nt, Mycobacterium tuberculosis H37Rv
gacgggucggcgccg

SEQ ID NO: 1362738 - RNA, 21 nt, Mycobacterium tuberculosis H37Rv
gacggggcgagcaugccguug

SEQ ID NO: 1362739 - RNA, 16 nt, Mycobacterium tuberculosis H37Rv
gacggggcaaaggagc

SEQ ID NO: 1362740 - RNA, 23 nt, Mycobacterium tuberculosis H37Rv
gacgggaaacuccgcggcgcgca

SEQ ID NO: 1362741 - RNA, 22 nt, Mycobacterium tuberculosis H37Rv
gacggcuuccaacucggcggcc

SEQ ID NO: 1362742 - RNA, 15 nt, Mycobacterium tuberculosis H37Rv
gacggcaggaaugau

SEQ ID NO: 1362743 - RNA, 14 nt, Mycobacterium tuberculosis H37Rv
gacggcagccagcc

SEQ ID NO: 1362744 - RNA, 14 nt, Mycobacterium tuberculosis H37Rv
gacggcaagggcau

SEQ ID NO: 1362745 - RNA, 11 nt, Mycobacterium tuberculosis H37Rv
gacggaucugg

SEQ ID NO: 1362746 - RNA, 22 nt, Mycobacterium tuberculosis H37Rv
gacgguugguccgccgucgacc

SEQ ID NO: 1362747 - RNA, 19 nt, Mycobacterium tuberculosis H37Rv
gacgggucguucuccgcgc

SEQ ID NO: 1362748 - RNA, 22 nt, Mycobacterium tuberculosis H37Rv
gacgggucguucuccgcgccgc

SEQ ID NO: 1362749 - RNA, 17 nt, Mycobacterium tuberculosis H37Rv
gacgggucucgcgagcg

SEQ ID NO: 1362750 - RNA, 14 nt, Mycobacterium tuberculosis H37Rv
gacggugguccuga

SEQ ID NO: 1362751 - RNA, 17 nt, Mycobacterium tuberculosis H37Rv
gacggugucagccgucg

SEQ ID NO: 1362752 - RNA, 19 nt, Mycobacterium tuberculosis H37Rv
gacgguggggucgccgucg

SEQ ID NO: 1362753 - RNA, 22 nt, Mycobacterium tuberculosis H37Rv
gacguccgcggucgcagcagac

SEQ ID NO: 1362754 - RNA, 18 nt, Mycobacterium tuberculosis H37Rv
gacguccaccagccgguu

SEQ ID NO: 1362755 - RNA, 14 nt, Mycobacterium tuberculosis H37Rv
gacguccaacagcg

SEQ ID NO: 1362756 - RNA, 15 nt, Mycobacterium tuberculosis H37Rv
gacgucgagcagcgc

SEQ ID NO: 1362757 - RNA, 18 nt, Mycobacterium tuberculosis H37Rv
gacgucgccgggcggcgg

SEQ ID NO: 1362758 - RNA, 22 nt, Mycobacterium tuberculosis H37Rv
gacgugagggucaugucgauca

SEQ ID NO: 1362759 - RNA, 14 nt, Mycobacterium tuberculosis H37Rv
gacgugaagcagac

SEQ ID NO: 1362760 - RNA, 20 nt, Mycobacterium tuberculosis H37Rv
gacgucguuacuggagauac

SEQ ID NO: 1362761 - RNA, 12 nt, Mycobacterium tuberculosis H37Rv
gacgucugccag

SEQ ID NO: 1362762 - RNA, 15 nt, Mycobacterium tuberculosis H37Rv
gacgucugccaggcg

SEQ ID NO: 1362763 - RNA, 17 nt, Mycobacterium tuberculosis H37Rv
gacgcuggucggcggcu

SEQ ID NO: 1362764 - RNA, 20 nt, Mycobacterium tuberculosis H37Rv
gacggagguguggucgagcg

SEQ ID NO: 1362765 - RNA, 14 nt, Mycobacterium tuberculosis H37Rv
gacgcugcgcgcca

SEQ ID NO: 1362766 - RNA, 18 nt, Mycobacterium tuberculosis H37Rv
gacgcugcgcgccagaca

SEQ ID NO: 1362767 - RNA, 18 nt, Mycobacterium tuberculosis H37Rv
gacgcugcauuggcggcg

SEQ ID NO: 1362768 - RNA, 19 nt, Mycobacterium tuberculosis H37Rv
gacgcugcauuggcggcgc

SEQ ID NO: 1362769 - RNA, 22 nt, Mycobacterium tuberculosis H37Rv
gacgcugcauuggcggcgcggu

SEQ ID NO: 1362770 - RNA, 16 nt, Mycobacterium tuberculosis H37Rv
gacgcucggucgccac

SEQ ID NO: 1362771 - RNA, 15 nt, Mycobacterium tuberculosis H37Rv
gacgcgucagcggcg

SEQ ID NO: 1362772 - RNA, 20 nt, Mycobacterium tuberculosis H37Rv
gacgcguagcucgcggggcg

SEQ ID NO: 1362773 - RNA, 15 nt, Mycobacterium tuberculosis H37Rv
gacgcgggugccaga

SEQ ID NO: 1362774 - RNA, 16 nt, Mycobacterium tuberculosis H37Rv
gacgcgugucugggac

SEQ ID NO: 1362775 - RNA, 19 nt, Mycobacterium tuberculosis H37Rv
gacgcucgccgagcagaca

SEQ ID NO: 1362776 - RNA, 15 nt, Mycobacterium tuberculosis H37Rv
gacgcgcgcgaugga

SEQ ID NO: 1362777 - RNA, 12 nt, Mycobacterium tuberculosis H37Rv
gacgcgccgguu

SEQ ID NO: 1362778 - RNA, 24 nt, Mycobacterium tuberculosis H37Rv
gacgcgcaggaagccggcgugcuc

SEQ ID NO: 1362779 - RNA, 21 nt, Mycobacterium tuberculosis H37Rv
gacgcgggagucaucgcggcg

SEQ ID NO: 1362780 - RNA, 19 nt, Mycobacterium tuberculosis H37Rv
gacgcggccggccgcccgc

SEQ ID NO: 1362781 - RNA, 14 nt, Mycobacterium tuberculosis H37Rv
gacgcggcgccgcc

SEQ ID NO: 1362782 - RNA, 19 nt, Mycobacterium tuberculosis H37Rv
gacgcacgacugugcgccg

SEQ ID NO: 1362783 - RNA, 21 nt, Mycobacterium tuberculosis H37Rv
gacgcacgacugugcgccgca

SEQ ID NO: 1362784 - RNA, 24 nt, Mycobacterium tuberculosis H37Rv
gacgcacgacugugcgccgcagcc

SEQ ID NO: 1362785 - RNA, 24 nt, Mycobacterium tuberculosis H37Rv
gacgcaaaagccaccgcacguucg

SEQ ID NO: 1362786 - RNA, 13 nt, Mycobacterium tuberculosis H37Rv
gacgcaacacccg

SEQ ID NO: 1362787 - RNA, 16 nt, Mycobacterium tuberculosis H37Rv
gacgcgaacgcggcca

SEQ ID NO: 1362788 - RNA, 20 nt, Mycobacterium tuberculosis H37Rv
gacgcgaaauccccugcgcu

SEQ ID NO: 1362789 - RNA, 13 nt, Mycobacterium tuberculosis H37Rv
gacgcgaacagcu

SEQ ID NO: 1362790 - RNA, 19 nt, Mycobacterium tuberculosis H37Rv
gacgcgacacacgccgccg

SEQ ID NO: 1362791 - RNA, 21 nt, Mycobacterium tuberculosis H37Rv
gacgcgaguaacggugaugac

SEQ ID NO: 1362792 - RNA, 13 nt, Mycobacterium tuberculosis H37Rv
gacgcagaagccc

SEQ ID NO: 1362793 - RNA, 23 nt, Mycobacterium tuberculosis H37Rv
gacgaccuugguguggggcggcu

SEQ ID NO: 1362794 - RNA, 18 nt, Mycobacterium tuberculosis H37Rv
gacgagaucugcgauggg

SEQ ID NO: 1362795 - RNA, 19 nt, Mycobacterium tuberculosis H37Rv
gacgacgaaccgguugccg

SEQ ID NO: 1362796 - RNA, 14 nt, Mycobacterium tuberculosis H37Rv
gacgagcggcuuca

SEQ ID NO: 1362797 - RNA, 17 nt, Mycobacterium tuberculosis H37Rv
gacgagccagaggugga

SEQ ID NO: 1362798 - RNA, 13 nt, Mycobacterium tuberculosis H37Rv
gacgagccgacca

SEQ ID NO: 1362799 - RNA, 14 nt, Mycobacterium tuberculosis H37Rv
gacgagcaccgcgc

SEQ ID NO: 1362800 - RNA, 19 nt, Mycobacterium tuberculosis H37Rv
gacgagcacaugcucgacg

SEQ ID NO: 1362801 - RNA, 20 nt, Mycobacterium tuberculosis H37Rv
gacgagccacggcuucgccg

SEQ ID NO: 1362802 - RNA, 21 nt, Mycobacterium tuberculosis H37Rv
gacgagauugccgggccgccg

SEQ ID NO: 1362803 - RNA, 15 nt, Mycobacterium tuberculosis H37Rv
gacgaugcaggugac

SEQ ID NO: 1362804 - RNA, 18 nt, Mycobacterium tuberculosis H37Rv
gacgaugccucggcggcc

SEQ ID NO: 1362805 - RNA, 23 nt, Mycobacterium tuberculosis H37Rv
gacgaugcggucaacgcugacgu

SEQ ID NO: 1362806 - RNA, 15 nt, Mycobacterium tuberculosis H37Rv
gacgauucggcggcc

SEQ ID NO: 1362807 - RNA, 13 nt, Mycobacterium tuberculosis H37Rv
gacgauucucgag

SEQ ID NO: 1362808 - RNA, 20 nt, Mycobacterium tuberculosis H37Rv
gacgauggccgccgcgagga

SEQ ID NO: 1362809 - RNA, 15 nt, Mycobacterium tuberculosis H37Rv
gacgaucggcggcgc

SEQ ID NO: 1362810 - RNA, 15 nt, Mycobacterium tuberculosis H37Rv
gacgaucgcggcggg

SEQ ID NO: 1362811 - RNA, 14 nt, Mycobacterium tuberculosis H37Rv
gacgaucggcggcg

SEQ ID NO: 1362812 - RNA, 18 nt, Mycobacterium tuberculosis H37Rv
gaccucguugcugccggc

SEQ ID NO: 1362813 - RNA, 20 nt, Mycobacterium tuberculosis H37Rv
gaccucucugcgccaggcgg

SEQ ID NO: 1362814 - RNA, 16 nt, Mycobacterium tuberculosis H37Rv
gaccucgucgaccggg

SEQ ID NO: 1362815 - RNA, 20 nt, Mycobacterium tuberculosis H37Rv
gaccucgugguucugcaggu

SEQ ID NO: 1362816 - RNA, 19 nt, Mycobacterium tuberculosis H37Rv
gaccucggcgugucugccc

SEQ ID NO: 1362817 - RNA, 15 nt, Mycobacterium tuberculosis H37Rv
gaccucggcgcgcuc

SEQ ID NO: 1362818 - RNA, 17 nt, Mycobacterium tuberculosis H37Rv
gaccucggcggcggcac

SEQ ID NO: 1362819 - RNA, 22 nt, Mycobacterium tuberculosis H37Rv
gaccucgccgcgcgugacagug

SEQ ID NO: 1362820 - RNA, 18 nt, Mycobacterium tuberculosis H37Rv
gaccucggcaaccaccuc

SEQ ID NO: 1362821 - RNA, 16 nt, Mycobacterium tuberculosis H37Rv
gacgaccagccccgcu

SEQ ID NO: 1362822 - RNA, 14 nt, Mycobacterium tuberculosis H37Rv
gacgacaacaggcc

SEQ ID NO: 1362823 - RNA, 18 nt, Mycobacterium tuberculosis H37Rv
gacgacaacaggccgucg

SEQ ID NO: 1362824 - RNA, 17 nt, Mycobacterium tuberculosis H37Rv
gacgacaaccggccaga

SEQ ID NO: 1362825 - RNA, 15 nt, Mycobacterium tuberculosis H37Rv
gaccuucgagccgca

SEQ ID NO: 1362826 - RNA, 20 nt, Mycobacterium tuberculosis H37Rv
gaccuucgcuauggcggcuu

SEQ ID NO: 1362827 - RNA, 17 nt, Mycobacterium tuberculosis H37Rv
gaccuuauugccgagcu

SEQ ID NO: 1362828 - RNA, 19 nt, Mycobacterium tuberculosis H37Rv
gaccuucucgucggccagu

SEQ ID NO: 1362829 - RNA, 13 nt, Mycobacterium tuberculosis H37Rv
gaccgaacaacag

SEQ ID NO: 1362830 - RNA, 14 nt, Mycobacterium tuberculosis H37Rv
gacccuuccgccgc

SEQ ID NO: 1362831 - RNA, 12 nt, Mycobacterium tuberculosis H37Rv
gaccgaaagccg

SEQ ID NO: 1362832 - RNA, 20 nt, Mycobacterium tuberculosis H37Rv
gaccgaucggcaggccgcuu

SEQ ID NO: 1362833 - RNA, 13 nt, Mycobacterium tuberculosis H37Rv
gaccgauaacacc

SEQ ID NO: 1362834 - RNA, 21 nt, Mycobacterium tuberculosis H37Rv
gaccgaugacgaucggcggcg

SEQ ID NO: 1362835 - RNA, 12 nt, Mycobacterium tuberculosis H37Rv
gaccgcagcacu

SEQ ID NO: 1362836 - RNA, 15 nt, Mycobacterium tuberculosis H37Rv
gaccgcagcuggggc

SEQ ID NO: 1362837 - RNA, 21 nt, Mycobacterium tuberculosis H37Rv
gaccggcggcuacggcugccc

SEQ ID NO: 1362838 - RNA, 23 nt, Mycobacterium tuberculosis H37Rv
gaccggcgggacgucgccgcagu

SEQ ID NO: 1362839 - RNA, 21 nt, Mycobacterium tuberculosis H37Rv
gaccgcacgaucgcaccgagg

SEQ ID NO: 1362840 - RNA, 16 nt, Mycobacterium tuberculosis H37Rv
gaccgcaccggccgcu

SEQ ID NO: 1362841 - RNA, 18 nt, Mycobacterium tuberculosis H37Rv
gaccgauuucgccugcgg

SEQ ID NO: 1362842 - RNA, 19 nt, Mycobacterium tuberculosis H37Rv
gaccgggccgcacggucag

SEQ ID NO: 1362843 - RNA, 17 nt, Mycobacterium tuberculosis H37Rv
gaccgggcucuggccag

SEQ ID NO: 1362844 - RNA, 19 nt, Mycobacterium tuberculosis H37Rv
gaccgggcuggccagcgcg

SEQ ID NO: 1362845 - RNA, 14 nt, Mycobacterium tuberculosis H37Rv
gaccgggcuggcca

SEQ ID NO: 1362846 - RNA, 19 nt, Mycobacterium tuberculosis H37Rv
gaccggggacagcccuucg

SEQ ID NO: 1362847 - RNA, 19 nt, Mycobacterium tuberculosis H37Rv
gaccggcuaccggcguguc

SEQ ID NO: 1362848 - RNA, 20 nt, Mycobacterium tuberculosis H37Rv
gaccgggaacaggguggugg

SEQ ID NO: 1362849 - RNA, 17 nt, Mycobacterium tuberculosis H37Rv
gaccggcuugccgccgu

SEQ ID NO: 1362850 - RNA, 15 nt, Mycobacterium tuberculosis H37Rv
gaccgggaggcggcg

SEQ ID NO: 1362851 - RNA, 19 nt, Mycobacterium tuberculosis H37Rv
gaccgguguuccgcccagc

SEQ ID NO: 1362852 - RNA, 17 nt, Mycobacterium tuberculosis H37Rv
gaccggugccugcaacg

SEQ ID NO: 1362853 - RNA, 15 nt, Mycobacterium tuberculosis H37Rv
gaccggugcugucga

SEQ ID NO: 1362854 - RNA, 15 nt, Mycobacterium tuberculosis H37Rv
gaccggugccagcag

SEQ ID NO: 1362855 - RNA, 16 nt, Mycobacterium tuberculosis H37Rv
gaccggugccagcagu

SEQ ID NO: 1362856 - RNA, 23 nt, Mycobacterium tuberculosis H37Rv
gaccggucgacagcgaaggcgcc

SEQ ID NO: 1362857 - RNA, 19 nt, Mycobacterium tuberculosis H37Rv
gaccgguccagccaacggg

SEQ ID NO: 1362858 - RNA, 17 nt, Mycobacterium tuberculosis H37Rv
gaccgggucgaugacgc

SEQ ID NO: 1362859 - RNA, 23 nt, Mycobacterium tuberculosis H37Rv
gaccgggucgucauacagcgccc

SEQ ID NO: 1362860 - RNA, 22 nt, Mycobacterium tuberculosis H37Rv
gaccgguaauccguugccguug

SEQ ID NO: 1362861 - RNA, 16 nt, Mycobacterium tuberculosis H37Rv
gaccggggcuuggguu

SEQ ID NO: 1362862 - RNA, 21 nt, Mycobacterium tuberculosis H37Rv
gaccucgaacggggugagcca

SEQ ID NO: 1362863 - RNA, 17 nt, Mycobacterium tuberculosis H37Rv
gaccucgaagcccagca

SEQ ID NO: 1362864 - RNA, 20 nt, Mycobacterium tuberculosis H37Rv
gaccucgaagcccagcacca

SEQ ID NO: 1362865 - RNA, 14 nt, Mycobacterium tuberculosis H37Rv
gaccuccaccaaug

SEQ ID NO: 1362866 - RNA, 16 nt, Mycobacterium tuberculosis H37Rv
gaccucccacccccgg

SEQ ID NO: 1362867 - RNA, 13 nt, Mycobacterium tuberculosis H37Rv
gaccucaccaacc

SEQ ID NO: 1362868 - RNA, 19 nt, Mycobacterium tuberculosis H37Rv
gaccucaccaaccgcccga

SEQ ID NO: 1362869 - RNA, 18 nt, Mycobacterium tuberculosis H37Rv
gaccucagccggcggcug

SEQ ID NO: 1362870 - RNA, 15 nt, Mycobacterium tuberculosis H37Rv
gaccguggcggccuc

SEQ ID NO: 1362871 - RNA, 22 nt, Mycobacterium tuberculosis H37Rv
gaccgugccgucggcgugcagc

SEQ ID NO: 1362872 - RNA, 19 nt, Mycobacterium tuberculosis H37Rv
gaccgugcgucgauggcgu

SEQ ID NO: 1362873 - RNA, 17 nt, Mycobacterium tuberculosis H37Rv
gaccguggcgccggucg

SEQ ID NO: 1362874 - RNA, 17 nt, Mycobacterium tuberculosis H37Rv
gaccgugaucagcgcgu

SEQ ID NO: 1362875 - RNA, 18 nt, Mycobacterium tuberculosis H37Rv
gaccgucccagcgccgca

SEQ ID NO: 1362876 - RNA, 20 nt, Mycobacterium tuberculosis H37Rv
gaccgucccggccucgaugu

SEQ ID NO: 1362877 - RNA, 15 nt, Mycobacterium tuberculosis H37Rv
gaccgucguggcggu

SEQ ID NO: 1362878 - RNA, 23 nt, Mycobacterium tuberculosis H37Rv
gaccgucacaagucgacacgccg

SEQ ID NO: 1362879 - RNA, 18 nt, Mycobacterium tuberculosis H37Rv
gaccgucacaagucgaca

SEQ ID NO: 1362880 - RNA, 21 nt, Mycobacterium tuberculosis H37Rv
gacuggguggugcucaccucc

SEQ ID NO: 1362881 - RNA, 18 nt, Mycobacterium tuberculosis H37Rv
gacuggggcgccaccacc

SEQ ID NO: 1362882 - RNA, 17 nt, Mycobacterium tuberculosis H37Rv
gacugggugcgcggccg

SEQ ID NO: 1362883 - RNA, 17 nt, Mycobacterium tuberculosis H37Rv
gacugugcgccgcagcc

SEQ ID NO: 1362884 - RNA, 12 nt, Mycobacterium tuberculosis H37Rv
gacuguggcgcc

SEQ ID NO: 1362885 - RNA, 20 nt, Mycobacterium tuberculosis H37Rv
gacuggaccgcggugacccg

SEQ ID NO: 1362886 - RNA, 16 nt, Mycobacterium tuberculosis H37Rv
gacuggcaggccggcg

SEQ ID NO: 1362887 - RNA, 23 nt, Mycobacterium tuberculosis H37Rv
gacuggccgcccggcgagcaggg

SEQ ID NO: 1362888 - RNA, 14 nt, Mycobacterium tuberculosis H37Rv
gacugcggucugga

SEQ ID NO: 1362889 - RNA, 13 nt, Mycobacterium tuberculosis H37Rv
gacugcgggccag

SEQ ID NO: 1362890 - RNA, 17 nt, Mycobacterium tuberculosis H37Rv
gacugcgggccagcgca

SEQ ID NO: 1362891 - RNA, 15 nt, Mycobacterium tuberculosis H37Rv
gacugcgggccgcuc

SEQ ID NO: 1362892 - RNA, 21 nt, Mycobacterium tuberculosis H37Rv
gacugcgggccgcucgguagg

SEQ ID NO: 1362893 - RNA, 16 nt, Mycobacterium tuberculosis H37Rv
gacugcgucggcggcu

SEQ ID NO: 1362894 - RNA, 14 nt, Mycobacterium tuberculosis H37Rv
gacugcuggggguc

SEQ ID NO: 1362895 - RNA, 14 nt, Mycobacterium tuberculosis H37Rv
gacugcgccgccgg

SEQ ID NO: 1362896 - RNA, 18 nt, Mycobacterium tuberculosis H37Rv
gacugcagaaacagccgc

SEQ ID NO: 1362897 - RNA, 21 nt, Mycobacterium tuberculosis H37Rv
gacugcagaaacagccgcagc

SEQ ID NO: 1362898 - RNA, 22 nt, Mycobacterium tuberculosis H37Rv
gacugcagaaacagccgcagcg

SEQ ID NO: 1362899 - RNA, 22 nt, Mycobacterium tuberculosis H37Rv
gacugcagcccugcgcagccgc

SEQ ID NO: 1362900 - RNA, 15 nt, Mycobacterium tuberculosis H37Rv
gacugcagcgaagcc

SEQ ID NO: 1362901 - RNA, 20 nt, Mycobacterium tuberculosis H37Rv
gacugaccgucugcgacccg

SEQ ID NO: 1362902 - RNA, 16 nt, Mycobacterium tuberculosis H37Rv
gacugaagccgcgagc

SEQ ID NO: 1362903 - RNA, 17 nt, Mycobacterium tuberculosis H37Rv
gacgugcaggaacaccc

SEQ ID NO: 1362904 - RNA, 15 nt, Mycobacterium tuberculosis H37Rv
gacgugcaggaacac

SEQ ID NO: 1362905 - RNA, 17 nt, Mycobacterium tuberculosis H37Rv
gacgugccggucccccc

SEQ ID NO: 1362906 - RNA, 23 nt, Mycobacterium tuberculosis H37Rv
gacgucgucggugcgccacgacc

SEQ ID NO: 1362907 - RNA, 21 nt, Mycobacterium tuberculosis H37Rv
gacguugccgaagccggaugc

SEQ ID NO: 1362908 - RNA, 23 nt, Mycobacterium tuberculosis H37Rv
gacguugagguucuucugcgcca

SEQ ID NO: 1362909 - RNA, 16 nt, Mycobacterium tuberculosis H37Rv
gacuccggcaagcaca

SEQ ID NO: 1362910 - RNA, 23 nt, Mycobacterium tuberculosis H37Rv
gacuccggcaagcacaccgccag

SEQ ID NO: 1362911 - RNA, 22 nt, Mycobacterium tuberculosis H37Rv
gacucccccucuaccuccgcca

SEQ ID NO: 1362912 - RNA, 13 nt, Mycobacterium tuberculosis H37Rv
gacuccggcaggc

SEQ ID NO: 1362913 - RNA, 16 nt, Mycobacterium tuberculosis H37Rv
gacuccggccgcacgc

SEQ ID NO: 1362914 - RNA, 12 nt, Mycobacterium tuberculosis H37Rv
gacuccugcggc

SEQ ID NO: 1362915 - RNA, 20 nt, Mycobacterium tuberculosis H37Rv
gacucgccacauuucaccac

SEQ ID NO: 1362916 - RNA, 23 nt, Mycobacterium tuberculosis H37Rv
gacucgacguaagugugcccugc

SEQ ID NO: 1362917 - RNA, 22 nt, Mycobacterium tuberculosis H37Rv
gacucgugucugccucggggcc

SEQ ID NO: 1362918 - RNA, 19 nt, Mycobacterium tuberculosis H37Rv
gacucgucgaugcgguggu

SEQ ID NO: 1362919 - RNA, 18 nt, Mycobacterium tuberculosis H37Rv
gacucgucgcaucaccag

SEQ ID NO: 1362920 - RNA, 18 nt, Mycobacterium tuberculosis H37Rv
gacucggacgcgccggcg

SEQ ID NO: 1362921 - RNA, 18 nt, Mycobacterium tuberculosis H37Rv
gacucugcgucugcucac

SEQ ID NO: 1362922 - RNA, 17 nt, Mycobacterium tuberculosis H37Rv
gacuugguugccgccuu

SEQ ID NO: 1362923 - RNA, 14 nt, Mycobacterium tuberculosis H37Rv
gacuugcuggcccg

SEQ ID NO: 1362924 - RNA, 18 nt, Mycobacterium tuberculosis H37Rv
gacuuguccaucacaucc

SEQ ID NO: 1362925 - RNA, 17 nt, Mycobacterium tuberculosis H37Rv
gacuuggccaugcuggu

SEQ ID NO: 1362926 - RNA, 14 nt, Mycobacterium tuberculosis H37Rv
gacuuggccagcag

SEQ ID NO: 1362927 - RNA, 14 nt, Mycobacterium tuberculosis H37Rv
gacuucagcaggcc

SEQ ID NO: 1362928 - RNA, 15 nt, Mycobacterium tuberculosis H37Rv
gacuucacucguuga

SEQ ID NO: 1362929 - RNA, 21 nt, Mycobacterium tuberculosis H37Rv
gacuucagcaggcccagcgga

SEQ ID NO: 1362930 - RNA, 21 nt, Mycobacterium tuberculosis H37Rv
gacuucgauggugugcccgca

SEQ ID NO: 1362931 - RNA, 16 nt, Mycobacterium tuberculosis H37Rv
gagaacacccgugccu

SEQ ID NO: 1362932 - RNA, 16 nt, Mycobacterium tuberculosis H37Rv
gagaacgcccgaguga

SEQ ID NO: 1362933 - RNA, 20 nt, Mycobacterium tuberculosis H37Rv
gagaacgcgucgcgcgccuu

SEQ ID NO: 1362934 - RNA, 21 nt, Mycobacterium tuberculosis H37Rv
gagacagcgccaugcccucgg

SEQ ID NO: 1362935 - RNA, 22 nt, Mycobacterium tuberculosis H37Rv
gagacgcaugucgggccaggcg

SEQ ID NO: 1362936 - RNA, 15 nt, Mycobacterium tuberculosis H37Rv
gagacgaucgccagg

SEQ ID NO: 1362937 - RNA, 21 nt, Mycobacterium tuberculosis H37Rv
gagacgcaugucgggccaggc

SEQ ID NO: 1362938 - RNA, 12 nt, Mycobacterium tuberculosis H37Rv
gagacgaucauc

SEQ ID NO: 1362939 - RNA, 13 nt, Mycobacterium tuberculosis H37Rv
gagacgaucgcca

SEQ ID NO: 1362940 - RNA, 23 nt, Mycobacterium tuberculosis H37Rv
gagaccgccgcugccgccgagcu

SEQ ID NO: 1362941 - RNA, 19 nt, Mycobacterium tuberculosis H37Rv
gagaccaacgcgcaggccg

SEQ ID NO: 1362942 - RNA, 17 nt, Mycobacterium tuberculosis H37Rv
gagaagguuucccgcuu

SEQ ID NO: 1362943 - RNA, 19 nt, Mycobacterium tuberculosis H37Rv
gagaaggugcugcgcgggu

SEQ ID NO: 1362944 - RNA, 23 nt, Mycobacterium tuberculosis H37Rv
gagaagcguugcacugcugguug

SEQ ID NO: 1362945 - RNA, 20 nt, Mycobacterium tuberculosis H37Rv
gagaacucaauaguguguuu

SEQ ID NO: 1362946 - RNA, 17 nt, Mycobacterium tuberculosis H37Rv
gagaacucugcgagaug

SEQ ID NO: 1362947 - RNA, 16 nt, Mycobacterium tuberculosis H37Rv
gagaacuugagcuccu

SEQ ID NO: 1362948 - RNA, 15 nt, Mycobacterium tuberculosis H37Rv
gagaagaagcccagg

SEQ ID NO: 1362949 - RNA, 17 nt, Mycobacterium tuberculosis H37Rv
gagaagucgcagcgagg

SEQ ID NO: 1362950 - RNA, 23 nt, Mycobacterium tuberculosis H37Rv
gagaaguuagccaccuuggacac

SEQ ID NO: 1362951 - RNA, 19 nt, Mycobacterium tuberculosis H37Rv
gagaaugcugacggugcag

SEQ ID NO: 1362952 - RNA, 21 nt, Mycobacterium tuberculosis H37Rv
gagaaugcugacggugcagga

SEQ ID NO: 1362953 - RNA, 24 nt, Mycobacterium tuberculosis H37Rv
gagacgucuucgggcucguccagc

SEQ ID NO: 1362954 - RNA, 12 nt, Mycobacterium tuberculosis H37Rv
gagacugccgcc

SEQ ID NO: 1362955 - RNA, 20 nt, Mycobacterium tuberculosis H37Rv
gagagccccgaccagcagac

SEQ ID NO: 1362956 - RNA, 19 nt, Mycobacterium tuberculosis H37Rv
gagagccccgaccagcaga

SEQ ID NO: 1362957 - RNA, 13 nt, Mycobacterium tuberculosis H37Rv
gagagccucggcc

SEQ ID NO: 1362958 - RNA, 22 nt, Mycobacterium tuberculosis H37Rv
gagagcgcggagacgaugccgu

SEQ ID NO: 1362959 - RNA, 22 nt, Mycobacterium tuberculosis H37Rv
gagagaucgucgacccaccaug

SEQ ID NO: 1362960 - RNA, 13 nt, Mycobacterium tuberculosis H37Rv
gagagcagccagc

SEQ ID NO: 1362961 - RNA, 17 nt, Mycobacterium tuberculosis H37Rv
gagaucaccgccaccac

SEQ ID NO: 1362962 - RNA, 24 nt, Mycobacterium tuberculosis H37Rv
gagaucaccuugccuagccgcagc

SEQ ID NO: 1362963 - RNA, 22 nt, Mycobacterium tuberculosis H37Rv
gagauagcaacgaagccggcgc

SEQ ID NO: 1362964 - RNA, 14 nt, Mycobacterium tuberculosis H37Rv
gagauccagggccu

SEQ ID NO: 1362965 - RNA, 15 nt, Mycobacterium tuberculosis H37Rv
gagauccagggccuu

SEQ ID NO: 1362966 - RNA, 22 nt, Mycobacterium tuberculosis H37Rv
gagauagucggccggcggucgc

SEQ ID NO: 1362967 - RNA, 15 nt, Mycobacterium tuberculosis H37Rv
gagauacgggccacc

SEQ ID NO: 1362968 - RNA, 18 nt, Mycobacterium tuberculosis H37Rv
gagauggucgggcggcgu

SEQ ID NO: 1362969 - RNA, 19 nt, Mycobacterium tuberculosis H37Rv
gagauggucgggcggcguc

SEQ ID NO: 1362970 - RNA, 21 nt, Mycobacterium tuberculosis H37Rv
gagaugccgcgaucgugcagg

SEQ ID NO: 1362971 - RNA, 20 nt, Mycobacterium tuberculosis H37Rv
gagaugccgcgaucgugcag

SEQ ID NO: 1362972 - RNA, 21 nt, Mycobacterium tuberculosis H37Rv
gagaugccaucggugaugagu

SEQ ID NO: 1362973 - RNA, 22 nt, Mycobacterium tuberculosis H37Rv
gagcacaugcucgacgcccgcc

SEQ ID NO: 1362974 - RNA, 12 nt, Mycobacterium tuberculosis H37Rv
gagcaccagcag

SEQ ID NO: 1362975 - RNA, 18 nt, Mycobacterium tuberculosis H37Rv
gagcacccggggggccuc

SEQ ID NO: 1362976 - RNA, 17 nt, Mycobacterium tuberculosis H37Rv
gagcaccgacaccggcc

SEQ ID NO: 1362977 - RNA, 14 nt, Mycobacterium tuberculosis H37Rv
gagcaccagcagca

SEQ ID NO: 1362978 - RNA, 16 nt, Mycobacterium tuberculosis H37Rv
gagcaccugggcgcgc

SEQ ID NO: 1362979 - RNA, 19 nt, Mycobacterium tuberculosis H37Rv
gagcaccuuggggugggcg

SEQ ID NO: 1362980 - RNA, 15 nt, Mycobacterium tuberculosis H37Rv
gagcaccugggcgcg

SEQ ID NO: 1362981 - RNA, 11 nt, Mycobacterium tuberculosis H37Rv
gagcaccugac

SEQ ID NO: 1362982 - RNA, 20 nt, Mycobacterium tuberculosis H37Rv
gagcaccgcgguagccgagc

SEQ ID NO: 1362983 - RNA, 15 nt, Mycobacterium tuberculosis H37Rv
gagcaccgcgcccuu

SEQ ID NO: 1362984 - RNA, 17 nt, Mycobacterium tuberculosis H37Rv
gagcacggcgcggcgga

SEQ ID NO: 1362985 - RNA, 14 nt, Mycobacterium tuberculosis H37Rv
gagcacuccggagc

SEQ ID NO: 1362986 - RNA, 16 nt, Mycobacterium tuberculosis H37Rv
gagcacgucaacagcc

SEQ ID NO: 1362987 - RNA, 18 nt, Mycobacterium tuberculosis H37Rv
gagcacgucaacagccag

SEQ ID NO: 1362988 - RNA, 21 nt, Mycobacterium tuberculosis H37Rv
gagcacggcgcggcggagugc

SEQ ID NO: 1362989 - RNA, 20 nt, Mycobacterium tuberculosis H37Rv
gagcacggguagcguccagg

SEQ ID NO: 1362990 - RNA, 14 nt, Mycobacterium tuberculosis H37Rv
gagcacgagcggcu

SEQ ID NO: 1362991 - RNA, 14 nt, Mycobacterium tuberculosis H37Rv
gagcagacugcccu

SEQ ID NO: 1362992 - RNA, 14 nt, Mycobacterium tuberculosis H37Rv
gagcagacguaaaa

SEQ ID NO: 1362993 - RNA, 17 nt, Mycobacterium tuberculosis H37Rv
gagcagacgcauaagcc

SEQ ID NO: 1362994 - RNA, 20 nt, Mycobacterium tuberculosis H37Rv
gagcagacgcauaagccccc

SEQ ID NO: 1362995 - RNA, 17 nt, Mycobacterium tuberculosis H37Rv
gagcagggcucguccau

SEQ ID NO: 1362996 - RNA, 23 nt, Mycobacterium tuberculosis H37Rv
gagcaggggaguugcuugcaggg

SEQ ID NO: 1362997 - RNA, 19 nt, Mycobacterium tuberculosis H37Rv
gagcagggugaccaggauc

SEQ ID NO: 1362998 - RNA, 12 nt, Mycobacterium tuberculosis H37Rv
gagcaggucucg

SEQ ID NO: 1362999 - RNA, 17 nt, Mycobacterium tuberculosis H37Rv
gagcagucgcaaaagcc

SEQ ID NO: 1363000 - RNA, 23 nt, Mycobacterium tuberculosis H37Rv
gagcagguuccgcacgaucaggg

SEQ ID NO: 1363001 - RNA, 13 nt, Mycobacterium tuberculosis H37Rv
gagcccaccuggg

SEQ ID NO: 1363002 - RNA, 16 nt, Mycobacterium tuberculosis H37Rv
gagcccgaaggcggcu

SEQ ID NO: 1363003 - RNA, 18 nt, Mycobacterium tuberculosis H37Rv
gagccccgaccagcagac

SEQ ID NO: 1363004 - RNA, 15 nt, Mycobacterium tuberculosis H37Rv
gagccccgacugcug

SEQ ID NO: 1363005 - RNA, 17 nt, Mycobacterium tuberculosis H37Rv
gagccccccgagcccgc

SEQ ID NO: 1363006 - RNA, 12 nt, Mycobacterium tuberculosis H37Rv
gagcccagcgcc

SEQ ID NO: 1363007 - RNA, 14 nt, Mycobacterium tuberculosis H37Rv
gagcccggcggccc

SEQ ID NO: 1363008 - RNA, 12 nt, Mycobacterium tuberculosis H37Rv
gagcccggugcu

SEQ ID NO: 1363009 - RNA, 15 nt, Mycobacterium tuberculosis H37Rv
gagcccuccagggcc

SEQ ID NO: 1363010 - RNA, 17 nt, Mycobacterium tuberculosis H37Rv
gagcccgacucuccggc

SEQ ID NO: 1363011 - RNA, 16 nt, Mycobacterium tuberculosis H37Rv
gagcccgcugcgccgg

SEQ ID NO: 1363012 - RNA, 15 nt, Mycobacterium tuberculosis H37Rv
gagcccgccagcgcc

SEQ ID NO: 1363013 - RNA, 19 nt, Mycobacterium tuberculosis H37Rv
gagcccggcgaucagcagc

SEQ ID NO: 1363014 - RNA, 23 nt, Mycobacterium tuberculosis H37Rv
gagcccggcgaucagcagcgcca

SEQ ID NO: 1363015 - RNA, 14 nt, Mycobacterium tuberculosis H37Rv
gagccggugccacu

SEQ ID NO: 1363016 - RNA, 18 nt, Mycobacterium tuberculosis H37Rv
gagccgguauacucggcc

SEQ ID NO: 1363017 - RNA, 10 nt, Mycobacterium tuberculosis H37Rv
gagccuuggu

SEQ ID NO: 1363018 - RNA, 17 nt, Mycobacterium tuberculosis H37Rv
gagccgggcaaccagca

SEQ ID NO: 1363019 - RNA, 12 nt, Mycobacterium tuberculosis H37Rv
gagccggcggcc

SEQ ID NO: 1363020 - RNA, 20 nt, Mycobacterium tuberculosis H37Rv
gagccgcgaaaucaccgcug

SEQ ID NO: 1363021 - RNA, 14 nt, Mycobacterium tuberculosis H37Rv
gagcaucucgucgg

SEQ ID NO: 1363022 - RNA, 18 nt, Mycobacterium tuberculosis H37Rv
gagcaucuccucgccugc

SEQ ID NO: 1363023 - RNA, 18 nt, Mycobacterium tuberculosis H37Rv
gagcaguuccagcucgcg

SEQ ID NO: 1363024 - RNA, 22 nt, Mycobacterium tuberculosis H37Rv
gagcaguucucggucccgccgg

SEQ ID NO: 1363025 - RNA, 15 nt, Mycobacterium tuberculosis H37Rv
gagcaugccgcccgc

SEQ ID NO: 1363026 - RNA, 18 nt, Mycobacterium tuberculosis H37Rv
gagcaugcgacgucaggg

SEQ ID NO: 1363027 - RNA, 10 nt, Mycobacterium tuberculosis H37Rv
gagccaggga

SEQ ID NO: 1363028 - RNA, 18 nt, Mycobacterium tuberculosis H37Rv
gaggugccgcgcagcugc

SEQ ID NO: 1363029 - RNA, 19 nt, Mycobacterium tuberculosis H37Rv
gaggugccgcgcagcugcc

SEQ ID NO: 1363030 - RNA, 17 nt, Mycobacterium tuberculosis H37Rv
gaggucggccagcagca

SEQ ID NO: 1363031 - RNA, 22 nt, Mycobacterium tuberculosis H37Rv
gaggucgaucaggggcccaccc

SEQ ID NO: 1363032 - RNA, 13 nt, Mycobacterium tuberculosis H37Rv
gagguccagcaug

SEQ ID NO: 1363033 - RNA, 12 nt, Mycobacterium tuberculosis H37Rv
gaggucccggcc

SEQ ID NO: 1363034 - RNA, 23 nt, Mycobacterium tuberculosis H37Rv
gaggucgcggucuuugagccggu

SEQ ID NO: 1363035 - RNA, 15 nt, Mycobacterium tuberculosis H37Rv
gagggcgggacccgu

SEQ ID NO: 1363036 - RNA, 14 nt, Mycobacterium tuberculosis H37Rv
gaggucacccggua

SEQ ID NO: 1363037 - RNA, 17 nt, Mycobacterium tuberculosis H37Rv
gaggucaaaaucagggu

SEQ ID NO: 1363038 - RNA, 15 nt, Mycobacterium tuberculosis H37Rv
gagggcaucgggccu

SEQ ID NO: 1363039 - RNA, 16 nt, Mycobacterium tuberculosis H37Rv
gagggauguagugcug

SEQ ID NO: 1363040 - RNA, 13 nt, Mycobacterium tuberculosis H37Rv
gagggcagccgcc

SEQ ID NO: 1363041 - RNA, 13 nt, Mycobacterium tuberculosis H37Rv
gagggccacggcu

SEQ ID NO: 1363042 - RNA, 21 nt, Mycobacterium tuberculosis H37Rv
gagggccacguagcagcagac

SEQ ID NO: 1363043 - RNA, 19 nt, Mycobacterium tuberculosis H37Rv
gaggcagucguugaugcuu

SEQ ID NO: 1363044 - RNA, 20 nt, Mycobacterium tuberculosis H37Rv
gaggcaggccucggcgccgc

SEQ ID NO: 1363045 - RNA, 20 nt, Mycobacterium tuberculosis H37Rv
gaggcuaggcguuuggugug

SEQ ID NO: 1363046 - RNA, 17 nt, Mycobacterium tuberculosis H37Rv
gaggcugggcugagggu

SEQ ID NO: 1363047 - RNA, 21 nt, Mycobacterium tuberculosis H37Rv
gaggcugugccccagggcagu

SEQ ID NO: 1363048 - RNA, 19 nt, Mycobacterium tuberculosis H37Rv
gaggcuggucugcaggcgg

SEQ ID NO: 1363049 - RNA, 19 nt, Mycobacterium tuberculosis H37Rv
gagggagcgccgcaggguc

SEQ ID NO: 1363050 - RNA, 21 nt, Mycobacterium tuberculosis H37Rv
gagggaacccacaguggcucg

SEQ ID NO: 1363051 - RNA, 14 nt, Mycobacterium tuberculosis H37Rv
gagggaucacgcca

SEQ ID NO: 1363052 - RNA, 18 nt, Mycobacterium tuberculosis H37Rv
gaggcuuuuggagcggcu

SEQ ID NO: 1363053 - RNA, 18 nt, Mycobacterium tuberculosis H37Rv
gaggaugcugagcgccag

SEQ ID NO: 1363054 - RNA, 12 nt, Mycobacterium tuberculosis H37Rv
gaggacgagguu

SEQ ID NO: 1363055 - RNA, 14 nt, Mycobacterium tuberculosis H37Rv
gaggacgccggcgc

SEQ ID NO: 1363056 - RNA, 16 nt, Mycobacterium tuberculosis H37Rv
gagcugcuggcgcgcc

SEQ ID NO: 1363057 - RNA, 19 nt, Mycobacterium tuberculosis H37Rv
gagcugcuggcgcgccugu

SEQ ID NO: 1363058 - RNA, 14 nt, Mycobacterium tuberculosis H37Rv
gagcugcucgccgg

SEQ ID NO: 1363059 - RNA, 15 nt, Mycobacterium tuberculosis H37Rv
gagcugcucgccggc

SEQ ID NO: 1363060 - RNA, 22 nt, Mycobacterium tuberculosis H37Rv
gagcuggcgaccuggucgcugg

SEQ ID NO: 1363061 - RNA, 13 nt, Mycobacterium tuberculosis H37Rv
gagcuggaaucga

SEQ ID NO: 1363062 - RNA, 15 nt, Mycobacterium tuberculosis H37Rv
gagcuggaccuccga

SEQ ID NO: 1363063 - RNA, 14 nt, Mycobacterium tuberculosis H37Rv
gagcuggcgaccug

SEQ ID NO: 1363064 - RNA, 14 nt, Mycobacterium tuberculosis H37Rv
gagcugugcgcaga

SEQ ID NO: 1363065 - RNA, 15 nt, Mycobacterium tuberculosis H37Rv
gagcuguggcgggcu

SEQ ID NO: 1363066 - RNA, 13 nt, Mycobacterium tuberculosis H37Rv
gagcuggugcaga

SEQ ID NO: 1363067 - RNA, 17 nt, Mycobacterium tuberculosis H37Rv
gagcuuccgcgcgcaga

SEQ ID NO: 1363068 - RNA, 13 nt, Mycobacterium tuberculosis H37Rv
gagcuuggucgcc

SEQ ID NO: 1363069 - RNA, 17 nt, Mycobacterium tuberculosis H37Rv
gagcuucaucccggagc

SEQ ID NO: 1363070 - RNA, 15 nt, Mycobacterium tuberculosis H37Rv
gagguguagcccucc

SEQ ID NO: 1363071 - RNA, 15 nt, Mycobacterium tuberculosis H37Rv
gaggugggguggugg

SEQ ID NO: 1363072 - RNA, 16 nt, Mycobacterium tuberculosis H37Rv
gagguggggugguggu

SEQ ID NO: 1363073 - RNA, 16 nt, Mycobacterium tuberculosis H37Rv
gaggugguucacgggg

SEQ ID NO: 1363074 - RNA, 19 nt, Mycobacterium tuberculosis H37Rv
gaggugcccaaggccagga

SEQ ID NO: 1363075 - RNA, 18 nt, Mycobacterium tuberculosis H37Rv
gagguuggagcgccagcc

SEQ ID NO: 1363076 - RNA, 15 nt, Mycobacterium tuberculosis H37Rv
gagguugggaacagc

SEQ ID NO: 1363077 - RNA, 22 nt, Mycobacterium tuberculosis H37Rv
gaguagccgcuaggaucggaug

SEQ ID NO: 1363078 - RNA, 19 nt, Mycobacterium tuberculosis H37Rv
gaguccgcugagcgggcaa

SEQ ID NO: 1363079 - RNA, 19 nt, Mycobacterium tuberculosis H37Rv
gagucguuggacggcaccg

SEQ ID NO: 1363080 - RNA, 21 nt, Mycobacterium tuberculosis H37Rv
gaguccccaggugggcagcag

SEQ ID NO: 1363081 - RNA, 21 nt, Mycobacterium tuberculosis H37Rv
gaguccgacaguccgcgccgg

SEQ ID NO: 1363082 - RNA, 23 nt, Mycobacterium tuberculosis H37Rv
gaguccccaggugggcagcaggc

SEQ ID NO: 1363083 - RNA, 16 nt, Mycobacterium tuberculosis H37Rv
gaguccaggccggcag

SEQ ID NO: 1363084 - RNA, 17 nt, Mycobacterium tuberculosis H37Rv
gaguccagccggcgcgc

SEQ ID NO: 1363085 - RNA, 18 nt, Mycobacterium tuberculosis H37Rv
gagucagaguugccgggu

SEQ ID NO: 1363086 - RNA, 22 nt, Mycobacterium tuberculosis H37Rv
gagucugcgcagaaauguauug

SEQ ID NO: 1363087 - RNA, 21 nt, Mycobacterium tuberculosis H37Rv
gagucuucggcgacaggccga

SEQ ID NO: 1363088 - RNA, 15 nt, Mycobacterium tuberculosis H37Rv
gagucucgucgggua

SEQ ID NO: 1363089 - RNA, 22 nt, Mycobacterium tuberculosis H37Rv
gagucucgucggguaccacgcu

SEQ ID NO: 1363090 - RNA, 13 nt, Mycobacterium tuberculosis H37Rv
gagugccaguccg

SEQ ID NO: 1363091 - RNA, 16 nt, Mycobacterium tuberculosis H37Rv
gagugcggacuucgcc

SEQ ID NO: 1363092 - RNA, 19 nt, Mycobacterium tuberculosis H37Rv
gagugcggacuucgccgcc

SEQ ID NO: 1363093 - RNA, 22 nt, Mycobacterium tuberculosis H37Rv
gagugcggacuucgccgcccgc

SEQ ID NO: 1363094 - RNA, 16 nt, Mycobacterium tuberculosis H37Rv
gagugccggcgugcgc

SEQ ID NO: 1363095 - RNA, 16 nt, Mycobacterium tuberculosis H37Rv
gagugcgaaccacgcc

SEQ ID NO: 1363096 - RNA, 18 nt, Mycobacterium tuberculosis H37Rv
gaguucccgaaacccgau

SEQ ID NO: 1363097 - RNA, 15 nt, Mycobacterium tuberculosis H37Rv
gaguugaagaagccc

SEQ ID NO: 1363098 - RNA, 21 nt, Mycobacterium tuberculosis H37Rv
gaguugaugaagauggcgcgc

SEQ ID NO: 1363099 - RNA, 13 nt, Mycobacterium tuberculosis H37Rv
gaguugcagaccg

SEQ ID NO: 1363100 - RNA, 17 nt, Mycobacterium tuberculosis H37Rv
gaguugccgggucgauu

SEQ ID NO: 1363101 - RNA, 22 nt, Mycobacterium tuberculosis H37Rv
gagugcgucucgguggcugcgc

SEQ ID NO: 1363102 - RNA, 22 nt, Mycobacterium tuberculosis H37Rv
gagugcggcguauugcggccug

SEQ ID NO: 1363103 - RNA, 13 nt, Mycobacterium tuberculosis H37Rv
gaguggaugcgcc

SEQ ID NO: 1363104 - RNA, 23 nt, Mycobacterium tuberculosis H37Rv
gaguuggccaagcaggcggggga

SEQ ID NO: 1363105 - RNA, 18 nt, Mycobacterium tuberculosis H37Rv
gauaaaaaccacccccac

SEQ ID NO: 1363106 - RNA, 15 nt, Mycobacterium tuberculosis H37Rv
aaagccaacucgacc

SEQ ID NO: 1363107 - RNA, 13 nt, Mycobacterium tuberculosis H37Rv
gauacccagcgcc

SEQ ID NO: 1363108 - RNA, 14 nt, Mycobacterium tuberculosis H37Rv
gauaccgccggccc

SEQ ID NO: 1363109 - RNA, 19 nt, Mycobacterium tuberculosis H37Rv
gauacagcgccaggggugu

SEQ ID NO: 1363110 - RNA, 14 nt, Mycobacterium tuberculosis H37Rv
gauacacggcggcg

SEQ ID NO: 1363111 - RNA, 16 nt, Mycobacterium tuberculosis H37Rv
gauacagcgccagggg

SEQ ID NO: 1363112 - RNA, 21 nt, Mycobacterium tuberculosis H37Rv
gauaaugcgugugagcugcuc

SEQ ID NO: 1363113 - RNA, 16 nt, Mycobacterium tuberculosis H37Rv
gauaauucaacagcac

SEQ ID NO: 1363114 - RNA, 16 nt, Mycobacterium tuberculosis H37Rv
gauaaucguuuucggc

SEQ ID NO: 1363115 - RNA, 23 nt, Mycobacterium tuberculosis H37Rv
gauaauccaugacacuggggugc

SEQ ID NO: 1363116 - RNA, 15 nt, Mycobacterium tuberculosis H37Rv
gauaaccaccaucug

SEQ ID NO: 1363117 - RNA, 13 nt, Mycobacterium tuberculosis H37Rv
gauaaggaucaga

SEQ ID NO: 1363118 - RNA, 14 nt, Mycobacterium tuberculosis H37Rv
gauaaccaccaucu

SEQ ID NO: 1363119 - RNA, 15 nt, Mycobacterium tuberculosis H37Rv
gauaccuagccccug

SEQ ID NO: 1363120 - RNA, 15 nt, Mycobacterium tuberculosis H37Rv
gauaccgucagcgcc

SEQ ID NO: 1363121 - RNA, 14 nt, Mycobacterium tuberculosis H37Rv
gauaccucgccauc

SEQ ID NO: 1363122 - RNA, 23 nt, Mycobacterium tuberculosis H37Rv
gauacgugaggucccggcuggga

SEQ ID NO: 1363123 - RNA, 19 nt, Mycobacterium tuberculosis H37Rv
gauagcaccggcacccgca

SEQ ID NO: 1363124 - RNA, 21 nt, Mycobacterium tuberculosis H37Rv
gauagcccagauagagcuggu

SEQ ID NO: 1363125 - RNA, 22 nt, Mycobacterium tuberculosis H37Rv
gauagcccagauagagcuggug

SEQ ID NO: 1363126 - RNA, 23 nt, Mycobacterium tuberculosis H37Rv
gauaucaauggcagcugaaucgu

SEQ ID NO: 1363127 - RNA, 16 nt, Mycobacterium tuberculosis H37Rv
gauaguuuagucccac

SEQ ID NO: 1363128 - RNA, 13 nt, Mycobacterium tuberculosis H37Rv
gauaguucaccac

SEQ ID NO: 1363129 - RNA, 14 nt, Mycobacterium tuberculosis H37Rv
gauauugccugcca

SEQ ID NO: 1363130 - RNA, 20 nt, Mycobacterium tuberculosis H37Rv
gaucaaugcugcguccugga

SEQ ID NO: 1363131 - RNA, 19 nt, Mycobacterium tuberculosis H37Rv
gauaucggcggcuuggccg

SEQ ID NO: 1363132 - RNA, 15 nt, Mycobacterium tuberculosis H37Rv
gauaucgucggugca

SEQ ID NO: 1363133 - RNA, 16 nt, Mycobacterium tuberculosis H37Rv
gauaucuauggaugac

SEQ ID NO: 1363134 - RNA, 23 nt, Mycobacterium tuberculosis H37Rv
gaaaugguucgcacaccuccucg

SEQ ID NO: 1363135 - RNA, 21 nt, Mycobacterium tuberculosis H37Rv
gaaaucgucggguaccagcac

SEQ ID NO: 1363136 - RNA, 18 nt, Mycobacterium tuberculosis H37Rv
gaaauugggcgauucugc

SEQ ID NO: 1363137 - RNA, 15 nt, Mycobacterium tuberculosis H37Rv
aaagagccagcggca

SEQ ID NO: 1363138 - RNA, 21 nt, Mycobacterium tuberculosis H37Rv
gaacaacggcguaaucgggaa

SEQ ID NO: 1363139 - RNA, 16 nt, Mycobacterium tuberculosis H37Rv
gaacaacggcgcggca

SEQ ID NO: 1363140 - RNA, 21 nt, Mycobacterium tuberculosis H37Rv
gaacacauccgcuugcggggc

SEQ ID NO: 1363141 - RNA, 16 nt, Mycobacterium tuberculosis H37Rv
gaacacaccgggcggg

SEQ ID NO: 1363142 - RNA, 15 nt, Mycobacterium tuberculosis H37Rv
gaacaccgaggcgac

SEQ ID NO: 1363143 - RNA, 15 nt, Mycobacterium tuberculosis H37Rv
gaacaccgcccggcc

SEQ ID NO: 1363144 - RNA, 13 nt, Mycobacterium tuberculosis H37Rv
gaacaccagcagg

SEQ ID NO: 1363145 - RNA, 13 nt, Mycobacterium tuberculosis H37Rv
gaacaccagcgcg

SEQ ID NO: 1363146 - RNA, 20 nt, Mycobacterium tuberculosis H37Rv
gaacagucgcagccaggcac

SEQ ID NO: 1363147 - RNA, 21 nt, Mycobacterium tuberculosis H37Rv
gaacagcgcgucggagccggg

SEQ ID NO: 1363148 - RNA, 23 nt, Mycobacterium tuberculosis H37Rv
gaacagcgcgucggagccgggca

SEQ ID NO: 1363149 - RNA, 14 nt, Mycobacterium tuberculosis H37Rv
gaacaggguggugg

SEQ ID NO: 1363150 - RNA, 19 nt, Mycobacterium tuberculosis H37Rv
gaacagacggggucgcccg

SEQ ID NO: 1363151 - RNA, 12 nt, Mycobacterium tuberculosis H37Rv
gaacagccccag

SEQ ID NO: 1363152 - RNA, 13 nt, Mycobacterium tuberculosis H37Rv
gaacagccccagg

SEQ ID NO: 1363153 - RNA, 18 nt, Mycobacterium tuberculosis H37Rv
gaacagcgaaccggcugg

SEQ ID NO: 1363154 - RNA, 19 nt, Mycobacterium tuberculosis H37Rv
gaacagcgaaccgccggca

SEQ ID NO: 1363155 - RNA, 22 nt, Mycobacterium tuberculosis H37Rv
gaacagcgacgccauggucaga

SEQ ID NO: 1363156 - RNA, 16 nt, Mycobacterium tuberculosis H37Rv
gaaagacgcuguccag

SEQ ID NO: 1363157 - RNA, 12 nt, Mycobacterium tuberculosis H37Rv
gaaagccgacca

SEQ ID NO: 1363158 - RNA, 12 nt, Mycobacterium tuberculosis H37Rv
gaaagccaggcg

SEQ ID NO: 1363159 - RNA, 21 nt, Mycobacterium tuberculosis H37Rv
gaaacgcgaugguggccgcca

SEQ ID NO: 1363160 - RNA, 20 nt, Mycobacterium tuberculosis H37Rv
gaaacgccggguucgccgga

SEQ ID NO: 1363161 - RNA, 22 nt, Mycobacterium tuberculosis H37Rv
gaaacgccaggggacccggggc

SEQ ID NO: 1363162 - RNA, 14 nt, Mycobacterium tuberculosis H37Rv
gaaacgagccggug

SEQ ID NO: 1363163 - RNA, 15 nt, Mycobacterium tuberculosis H37Rv
gaaacgaauccgcca

SEQ ID NO: 1363164 - RNA, 23 nt, Mycobacterium tuberculosis H37Rv
gaaacgcguaucccagauacauc

SEQ ID NO: 1363165 - RNA, 14 nt, Mycobacterium tuberculosis H37Rv
gaaacggccgggca

SEQ ID NO: 1363166 - RNA, 17 nt, Mycobacterium tuberculosis H37Rv
gaaacguaugacgccca

SEQ ID NO: 1363167 - RNA, 18 nt, Mycobacterium tuberculosis H37Rv
gaaacguaugacgcccac

SEQ ID NO: 1363168 - RNA, 21 nt, Mycobacterium tuberculosis H37Rv
gaaauccccugcgcugcagcu

SEQ ID NO: 1363169 - RNA, 18 nt, Mycobacterium tuberculosis H37Rv
gaaauccccugcgcugca

SEQ ID NO: 1363170 - RNA, 22 nt, Mycobacterium tuberculosis H37Rv
gaaaucggcggcguccagcagc

SEQ ID NO: 1363171 - RNA, 15 nt, Mycobacterium tuberculosis H37Rv
gaaauccgagccgcg

SEQ ID NO: 1363172 - RNA, 21 nt, Mycobacterium tuberculosis H37Rv
gaaauccagauaauccuggua

SEQ ID NO: 1363173 - RNA, 21 nt, Mycobacterium tuberculosis H37Rv
gaaaguuguaucgcagcauca

SEQ ID NO: 1363174 - RNA, 22 nt, Mycobacterium tuberculosis H37Rv
gaaaguguggaauggaccagcg

SEQ ID NO: 1363175 - RNA, 21 nt, Mycobacterium tuberculosis H37Rv
gaaaggucucuucggagauac

SEQ ID NO: 1363176 - RNA, 15 nt, Mycobacterium tuberculosis H37Rv
gaaaggccgcgguga

SEQ ID NO: 1363177 - RNA, 21 nt, Mycobacterium tuberculosis H37Rv
gaaaggccgcggugaugggcc

SEQ ID NO: 1363178 - RNA, 23 nt, Mycobacterium tuberculosis H37Rv
gaaaaguuggcuugcgcgcaggu

SEQ ID NO: 1363179 - RNA, 16 nt, Mycobacterium tuberculosis H37Rv
gaaaauugcuccacca

SEQ ID NO: 1363180 - RNA, 16 nt, Mycobacterium tuberculosis H37Rv
gaaacagccgcagcgg

SEQ ID NO: 1363181 - RNA, 17 nt, Mycobacterium tuberculosis H37Rv
gaaacacgacagccagu

SEQ ID NO: 1363182 - RNA, 17 nt, Mycobacterium tuberculosis H37Rv
gaaacagguaagcagcc

SEQ ID NO: 1363183 - RNA, 13 nt, Mycobacterium tuberculosis H37Rv
gaaacauccccga

SEQ ID NO: 1363184 - RNA, 17 nt, Mycobacterium tuberculosis H37Rv
gaaacaagcaagcgugu

SEQ ID NO: 1363185 - RNA, 14 nt, Mycobacterium tuberculosis H37Rv
gaaacacgacagcc

SEQ ID NO: 1363186 - RNA, 15 nt, Mycobacterium tuberculosis H37Rv
gaaaccaucgccagc

SEQ ID NO: 1363187 - RNA, 21 nt, Mycobacterium tuberculosis H37Rv
gaaaccaugccgccgaagccg

SEQ ID NO: 1363188 - RNA, 19 nt, Mycobacterium tuberculosis H37Rv
gaaaccgcugggggcgguc

SEQ ID NO: 1363189 - RNA, 15 nt, Mycobacterium tuberculosis H37Rv
gaaaccgcagucgcg

SEQ ID NO: 1363190 - RNA, 20 nt, Mycobacterium tuberculosis H37Rv
gaaacccugcacccgacccg

SEQ ID NO: 1363191 - RNA, 14 nt, Mycobacterium tuberculosis H37Rv
gaaaaagaccgaca

SEQ ID NO: 1363192 - RNA, 20 nt, Mycobacterium tuberculosis H37Rv
gaaaaagaccgacagcggca

SEQ ID NO: 1363193 - RNA, 15 nt, Mycobacterium tuberculosis H37Rv
gaaaaacaccagcga

SEQ ID NO: 1363194 - RNA, 15 nt, Mycobacterium tuberculosis H37Rv
cuuuugauugaccaa

SEQ ID NO: 1363195 - RNA, 16 nt, Mycobacterium tuberculosis H37Rv
cuuuugauugaccaac

SEQ ID NO: 1363196 - RNA, 18 nt, Mycobacterium tuberculosis H37Rv
cuuguugacgaacccacc

SEQ ID NO: 1363197 - RNA, 14 nt, Mycobacterium tuberculosis H37Rv
cuuguucuuggcca

SEQ ID NO: 1363198 - RNA, 14 nt, Mycobacterium tuberculosis H37Rv
cuuguuguggugga

SEQ ID NO: 1363199 - RNA, 13 nt, Mycobacterium tuberculosis H37Rv
cuuguuguggugg

SEQ ID NO: 1363200 - RNA, 24 nt, Mycobacterium tuberculosis H37Rv
cuuguuggcgaagucgucgagguc

SEQ ID NO: 1363201 - RNA, 23 nt, Mycobacterium tuberculosis H37Rv
cuugucgccggcauacaccguga

SEQ ID NO: 1363202 - RNA, 16 nt, Mycobacterium tuberculosis H37Rv
cuugucgccccaugcg

SEQ ID NO: 1363203 - RNA, 15 nt, Mycobacterium tuberculosis H37Rv
cuugucgaccccuga

SEQ ID NO: 1363204 - RNA, 24 nt, Mycobacterium tuberculosis H37Rv
cuuguccuuauuggacugcagcgu

SEQ ID NO: 1363205 - RNA, 14 nt, Mycobacterium tuberculosis H37Rv
cuuguccucacaug

SEQ ID NO: 1363206 - RNA, 22 nt, Mycobacterium tuberculosis H37Rv
cuuguccggugguggcgacccc

SEQ ID NO: 1363207 - RNA, 15 nt, Mycobacterium tuberculosis H37Rv
cuugucgcguucggc

SEQ ID NO: 1363208 - RNA, 23 nt, Mycobacterium tuberculosis H37Rv
cuugucgcggugcggcagauacu

SEQ ID NO: 1363209 - RNA, 20 nt, Mycobacterium tuberculosis H37Rv
cuuguuagccuccagauucg

SEQ ID NO: 1363210 - RNA, 16 nt, Mycobacterium tuberculosis H37Rv
cuuguucaucaucugg

SEQ ID NO: 1363211 - RNA, 15 nt, Mycobacterium tuberculosis H37Rv
cuugugccccgagcu

SEQ ID NO: 1363212 - RNA, 22 nt, Mycobacterium tuberculosis H37Rv
cuugugcugcaaggaauuccgg

SEQ ID NO: 1363213 - RNA, 14 nt, Mycobacterium tuberculosis H37Rv
cuuguggaaaucgg

SEQ ID NO: 1363214 - RNA, 15 nt, Mycobacterium tuberculosis H37Rv
cuuguggacccgcca

SEQ ID NO: 1363215 - RNA, 16 nt, Mycobacterium tuberculosis H37Rv
cuuggucaccuucuug

SEQ ID NO: 1363216 - RNA, 23 nt, Mycobacterium tuberculosis H37Rv
cuuggucaggcuggaggugaacu

SEQ ID NO: 1363217 - RNA, 22 nt, Mycobacterium tuberculosis H37Rv
cuuggggcguuucggcgggcgc

SEQ ID NO: 1363218 - RNA, 19 nt, Mycobacterium tuberculosis H37Rv
cuugggcucgaaaacaugu

SEQ ID NO: 1363219 - RNA, 21 nt, Mycobacterium tuberculosis H37Rv
cuuggguuccguggauggacc

SEQ ID NO: 1363220 - RNA, 17 nt, Mycobacterium tuberculosis H37Rv
cuuggucgccgccuucu

SEQ ID NO: 1363221 - RNA, 18 nt, Mycobacterium tuberculosis H37Rv
cuuggucgccgccuucuu

SEQ ID NO: 1363222 - RNA, 15 nt, Mycobacterium tuberculosis H37Rv
cuuggucgcccagcc

SEQ ID NO: 1363223 - RNA, 21 nt, Mycobacterium tuberculosis H37Rv
cuuggucgcccagccacugac

SEQ ID NO: 1363224 - RNA, 22 nt, Mycobacterium tuberculosis H37Rv
cuuggugcgcgucagccgcacc

SEQ ID NO: 1363225 - RNA, 15 nt, Mycobacterium tuberculosis H37Rv
cuuggugccauucga

SEQ ID NO: 1363226 - RNA, 19 nt, Mycobacterium tuberculosis H37Rv
cuuggugaaccgcgcggcg

SEQ ID NO: 1363227 - RNA, 17 nt, Mycobacterium tuberculosis H37Rv
cuuggucuugaacccga

SEQ ID NO: 1363228 - RNA, 18 nt, Mycobacterium tuberculosis H37Rv
cuugucaaaggugcacug

SEQ ID NO: 1363229 - RNA, 16 nt, Mycobacterium tuberculosis H37Rv
cuugucaaaggugcac

SEQ ID NO: 1363230 - RNA, 14 nt, Mycobacterium tuberculosis H37Rv
cuuguccaccgugc

SEQ ID NO: 1363231 - RNA, 18 nt, Mycobacterium tuberculosis H37Rv
cuuguccaucacauccac

SEQ ID NO: 1363232 - RNA, 24 nt, Mycobacterium tuberculosis H37Rv
cuuguccaucacauccacgcacuc

SEQ ID NO: 1363233 - RNA, 19 nt, Mycobacterium tuberculosis H37Rv
cuuguagcgcaucgccaau

SEQ ID NO: 1363234 - RNA, 19 nt, Mycobacterium tuberculosis H37Rv
cuuguacgaacugcugaug

SEQ ID NO: 1363235 - RNA, 23 nt, Mycobacterium tuberculosis H37Rv
cuuggcggccaacggcuccgggc

SEQ ID NO: 1363236 - RNA, 20 nt, Mycobacterium tuberculosis H37Rv
cuuggcgaucucaccuggag

SEQ ID NO: 1363237 - RNA, 18 nt, Mycobacterium tuberculosis H37Rv
cuuggccgcugccuucuu

SEQ ID NO: 1363238 - RNA, 22 nt, Mycobacterium tuberculosis H37Rv
cuuggccugcgcuucguccagc

SEQ ID NO: 1363239 - RNA, 21 nt, Mycobacterium tuberculosis H37Rv
cuuggcgaccuugacccgcaa

SEQ ID NO: 1363240 - RNA, 19 nt, Mycobacterium tuberculosis H37Rv
cuuggcgacaugcagcgcc

SEQ ID NO: 1363241 - RNA, 17 nt, Mycobacterium tuberculosis H37Rv
cuuggcgguggcccgau

SEQ ID NO: 1363242 - RNA, 21 nt, Mycobacterium tuberculosis H37Rv
cuuggcgggagccuugguagc

SEQ ID NO: 1363243 - RNA, 17 nt, Mycobacterium tuberculosis H37Rv
cuuggcgggagccuugg

SEQ ID NO: 1363244 - RNA, 17 nt, Mycobacterium tuberculosis H37Rv
cuuggcggccuuugucg

SEQ ID NO: 1363245 - RNA, 13 nt, Mycobacterium tuberculosis H37Rv
cuuggcggcggca

SEQ ID NO: 1363246 - RNA, 21 nt, Mycobacterium tuberculosis H37Rv
cuuggcgucgaucagggcccc

SEQ ID NO: 1363247 - RNA, 15 nt, Mycobacterium tuberculosis H37Rv
cuuggcguugaccag

SEQ ID NO: 1363248 - RNA, 17 nt, Mycobacterium tuberculosis H37Rv
cuuggcuaacaccgcag

SEQ ID NO: 1363249 - RNA, 13 nt, Mycobacterium tuberculosis H37Rv
cuugggcaccacc

SEQ ID NO: 1363250 - RNA, 23 nt, Mycobacterium tuberculosis H37Rv
cuugggcagauauugccugccac

SEQ ID NO: 1363251 - RNA, 17 nt, Mycobacterium tuberculosis H37Rv
cuugggaccgacuugcc

SEQ ID NO: 1363252 - RNA, 20 nt, Mycobacterium tuberculosis H37Rv
cuugggcgacgcggcgccgc

SEQ ID NO: 1363253 - RNA, 17 nt, Mycobacterium tuberculosis H37Rv
cuugggccaggcccagc

SEQ ID NO: 1363254 - RNA, 15 nt, Mycobacterium tuberculosis H37Rv
cuugggccaggccca

SEQ ID NO: 1363255 - RNA, 13 nt, Mycobacterium tuberculosis H37Rv
cuuggcagcccag

SEQ ID NO: 1363256 - RNA, 17 nt, Mycobacterium tuberculosis H37Rv
cuuggccaccaucgccg

SEQ ID NO: 1363257 - RNA, 15 nt, Mycobacterium tuberculosis H37Rv
cuuggccgccgccac

SEQ ID NO: 1363258 - RNA, 18 nt, Mycobacterium tuberculosis H37Rv
cuuggccgccccggccgc

SEQ ID NO: 1363259 - RNA, 14 nt, Mycobacterium tuberculosis H37Rv
cuuggccgcugccu

SEQ ID NO: 1363260 - RNA, 21 nt, Mycobacterium tuberculosis H37Rv
cuuggccggcgguaagcccag

SEQ ID NO: 1363261 - RNA, 16 nt, Mycobacterium tuberculosis H37Rv
cuuggccagcagcgcg

SEQ ID NO: 1363262 - RNA, 16 nt, Mycobacterium tuberculosis H37Rv
cuuggccagccacucc

SEQ ID NO: 1363263 - RNA, 22 nt, Mycobacterium tuberculosis H37Rv
cuuggaccagcguggggccgcc

SEQ ID NO: 1363264 - RNA, 12 nt, Mycobacterium tuberculosis H37Rv
cuuggaccagcg

SEQ ID NO: 1363265 - RNA, 12 nt, Mycobacterium tuberculosis H37Rv
cuuggacagcag

SEQ ID NO: 1363266 - RNA, 20 nt, Mycobacterium tuberculosis H37Rv
cuuggcaaucaucucccgac

SEQ ID NO: 1363267 - RNA, 16 nt, Mycobacterium tuberculosis H37Rv
cuuggauccggccgcc

SEQ ID NO: 1363268 - RNA, 21 nt, Mycobacterium tuberculosis H37Rv
cuuggaucgucgcuguggcuu

SEQ ID NO: 1363269 - RNA, 15 nt, Mycobacterium tuberculosis H37Rv
cuuugccgccggcac

SEQ ID NO: 1363270 - RNA, 18 nt, Mycobacterium tuberculosis H37Rv
cuuugagcgcggccacca

SEQ ID NO: 1363271 - RNA, 19 nt, Mycobacterium tuberculosis H37Rv
cuuuggguagcaaaccccg

SEQ ID NO: 1363272 - RNA, 17 nt, Mycobacterium tuberculosis H37Rv
cuuuggguccgggcggc

SEQ ID NO: 1363273 - RNA, 23 nt, Mycobacterium tuberculosis H37Rv
cuuuggacgaugaaccgggcagc

SEQ ID NO: 1363274 - RNA, 23 nt, Mycobacterium tuberculosis H37Rv
cuuugguuguuggugccagccgg

SEQ ID NO: 1363275 - RNA, 22 nt, Mycobacterium tuberculosis H37Rv
cuuugguuguuggugccagccg

SEQ ID NO: 1363276 - RNA, 21 nt, Mycobacterium tuberculosis H37Rv
cuuugguugcccgcauugcca

SEQ ID NO: 1363277 - RNA, 13 nt, Mycobacterium tuberculosis H37Rv
cuuugggcugccg

SEQ ID NO: 1363278 - RNA, 20 nt, Mycobacterium tuberculosis H37Rv
cuuugguacccagcgcggcc

SEQ ID NO: 1363279 - RNA, 20 nt, Mycobacterium tuberculosis H37Rv
cuuucgcgccgcgaggcacc

SEQ ID NO: 1363280 - RNA, 19 nt, Mycobacterium tuberculosis H37Rv
cuuucgcgugcggcugcca

SEQ ID NO: 1363281 - RNA, 19 nt, Mycobacterium tuberculosis H37Rv
cuuucggguccgacagccc

SEQ ID NO: 1363282 - RNA, 22 nt, Mycobacterium tuberculosis H37Rv
cuuucggcagacccgagcgcuc

SEQ ID NO: 1363283 - RNA, 17 nt, Mycobacterium tuberculosis H37Rv
cuuucugcgcgugggca

SEQ ID NO: 1363284 - RNA, 19 nt, Mycobacterium tuberculosis H37Rv
cuuuccaccugaacggcaa

SEQ ID NO: 1363285 - RNA, 23 nt, Mycobacterium tuberculosis H37Rv
cuuuccaauuuagggauaacgac

SEQ ID NO: 1363286 - RNA, 17 nt, Mycobacterium tuberculosis H37Rv
cuuuagugucugcucgc

SEQ ID NO: 1363287 - RNA, 15 nt, Mycobacterium tuberculosis H37Rv
cuucugccugcgcac

SEQ ID NO: 1363288 - RNA, 15 nt, Mycobacterium tuberculosis H37Rv
cuucugcgucugcuc

SEQ ID NO: 1363289 - RNA, 21 nt, Mycobacterium tuberculosis H37Rv
cuucugcacgaacgccugcuc

SEQ ID NO: 1363290 - RNA, 13 nt, Mycobacterium tuberculosis H37Rv
cuucugccgggag

SEQ ID NO: 1363291 - RNA, 22 nt, Mycobacterium tuberculosis H37Rv
cuucugccgggagacgcugcgc

SEQ ID NO: 1363292 - RNA, 15 nt, Mycobacterium tuberculosis H37Rv
cuucugacgcggccg

SEQ ID NO: 1363293 - RNA, 23 nt, Mycobacterium tuberculosis H37Rv
cuucuccguccccgcagcgccua

SEQ ID NO: 1363294 - RNA, 14 nt, Mycobacterium tuberculosis H37Rv
cuucuccuccagag

SEQ ID NO: 1363295 - RNA, 14 nt, Mycobacterium tuberculosis H37Rv
cuucucgagccgcc

SEQ ID NO: 1363296 - RNA, 20 nt, Mycobacterium tuberculosis H37Rv
cuucucggcgggucaggcca

SEQ ID NO: 1363297 - RNA, 22 nt, Mycobacterium tuberculosis H37Rv
cuucucgcggaccucggcgacc

SEQ ID NO: 1363298 - RNA, 22 nt, Mycobacterium tuberculosis H37Rv
cuucucgucggugcgcgcggcg

SEQ ID NO: 1363299 - RNA, 14 nt, Mycobacterium tuberculosis H37Rv
cuucuccaccaccg

SEQ ID NO: 1363300 - RNA, 17 nt, Mycobacterium tuberculosis H37Rv
cuucgucauggccggcc

SEQ ID NO: 1363301 - RNA, 21 nt, Mycobacterium tuberculosis H37Rv
cuucgucauggccggccaucg

SEQ ID NO: 1363302 - RNA, 18 nt, Mycobacterium tuberculosis H37Rv
cuucgucaaccaccagga

SEQ ID NO: 1363303 - RNA, 20 nt, Mycobacterium tuberculosis H37Rv
cuucgucggccggcacccca

SEQ ID NO: 1363304 - RNA, 12 nt, Mycobacterium tuberculosis H37Rv
cuucgucggccg

SEQ ID NO: 1363305 - RNA, 21 nt, Mycobacterium tuberculosis H37Rv
cuucgucggccggcaccccac

SEQ ID NO: 1363306 - RNA, 22 nt, Mycobacterium tuberculosis H37Rv
cuucgucggccggcaccccacg

SEQ ID NO: 1363307 - RNA, 12 nt, Mycobacterium tuberculosis H37Rv
cuucgucggcca

SEQ ID NO: 1363308 - RNA, 14 nt, Mycobacterium tuberculosis H37Rv
cuucuucacuggcg

SEQ ID NO: 1363309 - RNA, 16 nt, Mycobacterium tuberculosis H37Rv
cuucuucgcuaccuuc

SEQ ID NO: 1363310 - RNA, 17 nt, Mycobacterium tuberculosis H37Rv
cuucuucgcuaccuucu

SEQ ID NO: 1363311 - RNA, 19 nt, Mycobacterium tuberculosis H37Rv
cuucuucggacagcagccg

SEQ ID NO: 1363312 - RNA, 14 nt, Mycobacterium tuberculosis H37Rv
cuucuugaccacga

SEQ ID NO: 1363313 - RNA, 19 nt, Mycobacterium tuberculosis H37Rv
cuucuuggcggccuuuguc

SEQ ID NO: 1363314 - RNA, 17 nt, Mycobacterium tuberculosis H37Rv
cuugaccagcagcugaa

SEQ ID NO: 1363315 - RNA, 13 nt, Mycobacterium tuberculosis H37Rv
cuugaccacagcg

SEQ ID NO: 1363316 - RNA, 15 nt, Mycobacterium tuberculosis H37Rv
cuugaucgacggcca

SEQ ID NO: 1363317 - RNA, 15 nt, Mycobacterium tuberculosis H37Rv
cuugaucgagcaggg

SEQ ID NO: 1363318 - RNA, 20 nt, Mycobacterium tuberculosis H37Rv
cuugagcucgcugaucaggu

SEQ ID NO: 1363319 - RNA, 24 nt, Mycobacterium tuberculosis H37Rv
cuugagccggacguucuggaucgu

SEQ ID NO: 1363320 - RNA, 15 nt, Mycobacterium tuberculosis H37Rv
cuugacugcacacca

SEQ ID NO: 1363321 - RNA, 16 nt, Mycobacterium tuberculosis H37Rv
cuugacugcacaccac

SEQ ID NO: 1363322 - RNA, 23 nt, Mycobacterium tuberculosis H37Rv
cuugaccgcggucuucuucaccg

SEQ ID NO: 1363323 - RNA, 20 nt, Mycobacterium tuberculosis H37Rv
cuugacuccgcgcgcugggc

SEQ ID NO: 1363324 - RNA, 16 nt, Mycobacterium tuberculosis H37Rv
cuugccacuccaggag

SEQ ID NO: 1363325 - RNA, 15 nt, Mycobacterium tuberculosis H37Rv
cuugccacuccagga

SEQ ID NO: 1363326 - RNA, 18 nt, Mycobacterium tuberculosis H37Rv
cuugcaggcgucccagcc

SEQ ID NO: 1363327 - RNA, 15 nt, Mycobacterium tuberculosis H37Rv
cuugcagugagguca

SEQ ID NO: 1363328 - RNA, 17 nt, Mycobacterium tuberculosis H37Rv
cuugccggguuugauca

SEQ ID NO: 1363329 - RNA, 21 nt, Mycobacterium tuberculosis H37Rv
cuugccggguuugaucagcuc

SEQ ID NO: 1363330 - RNA, 16 nt, Mycobacterium tuberculosis H37Rv
cuugccguugggaacc

SEQ ID NO: 1363331 - RNA, 17 nt, Mycobacterium tuberculosis H37Rv
cuugccugcgccgaguu

SEQ ID NO: 1363332 - RNA, 18 nt, Mycobacterium tuberculosis H37Rv
cuugccuuccgacccaac

SEQ ID NO: 1363333 - RNA, 19 nt, Mycobacterium tuberculosis H37Rv
cuugccuccggcgccgccc

SEQ ID NO: 1363334 - RNA, 17 nt, Mycobacterium tuberculosis H37Rv
cuugccgccguugauga

SEQ ID NO: 1363335 - RNA, 15 nt, Mycobacterium tuberculosis H37Rv
cuugccgccgcgccg

SEQ ID NO: 1363336 - RNA, 17 nt, Mycobacterium tuberculosis H37Rv
cuugccgccuuggcccc

SEQ ID NO: 1363337 - RNA, 17 nt, Mycobacterium tuberculosis H37Rv
cuugccgcugagcccug

SEQ ID NO: 1363338 - RNA, 13 nt, Mycobacterium tuberculosis H37Rv
cuugccgaucagc

SEQ ID NO: 1363339 - RNA, 18 nt, Mycobacterium tuberculosis H37Rv
cuugccgccauuccagcc

SEQ ID NO: 1363340 - RNA, 14 nt, Mycobacterium tuberculosis H37Rv
cuugccgaccccgg

SEQ ID NO: 1363341 - RNA, 23 nt, Mycobacterium tuberculosis H37Rv
cuugcccgagcccagccgggcac

SEQ ID NO: 1363342 - RNA, 12 nt, Mycobacterium tuberculosis H37Rv
cuugccccgccg

SEQ ID NO: 1363343 - RNA, 20 nt, Mycobacterium tuberculosis H37Rv
cuugccccgccuuggccacc

SEQ ID NO: 1363344 - RNA, 14 nt, Mycobacterium tuberculosis H37Rv
cuugcccagcgaca

SEQ ID NO: 1363345 - RNA, 19 nt, Mycobacterium tuberculosis H37Rv
cuugcgucgcggacggugc

SEQ ID NO: 1363346 - RNA, 17 nt, Mycobacterium tuberculosis H37Rv
cuugcguguaccagccc

SEQ ID NO: 1363347 - RNA, 15 nt, Mycobacterium tuberculosis H37Rv
cuugcggagccgccg

SEQ ID NO: 1363348 - RNA, 22 nt, Mycobacterium tuberculosis H37Rv
cuugcggcacaacagaauucga

SEQ ID NO: 1363349 - RNA, 11 nt, Mycobacterium tuberculosis H37Rv
cuugcgcggcu

SEQ ID NO: 1363350 - RNA, 16 nt, Mycobacterium tuberculosis H37Rv
cuugcgcggcuugggc

SEQ ID NO: 1363351 - RNA, 14 nt, Mycobacterium tuberculosis H37Rv
cuugcgcagcaccg

SEQ ID NO: 1363352 - RNA, 18 nt, Mycobacterium tuberculosis H37Rv
cuugcgcaucgccgacag

SEQ ID NO: 1363353 - RNA, 14 nt, Mycobacterium tuberculosis H37Rv
cuugcgcagcagcg

SEQ ID NO: 1363354 - RNA, 19 nt, Mycobacterium tuberculosis H37Rv
cuugcgccgcccaugccuc

SEQ ID NO: 1363355 - RNA, 23 nt, Mycobacterium tuberculosis H37Rv
cuugcgccggaugacaccgaccg

SEQ ID NO: 1363356 - RNA, 13 nt, Mycobacterium tuberculosis H37Rv
cuugcugcuccuu

SEQ ID NO: 1363357 - RNA, 16 nt, Mycobacterium tuberculosis H37Rv
cuugcucggcgugcuc

SEQ ID NO: 1363358 - RNA, 16 nt, Mycobacterium tuberculosis H37Rv
cuugcucguccagguc

SEQ ID NO: 1363359 - RNA, 15 nt, Mycobacterium tuberculosis H37Rv
cuugcucagccggcc

SEQ ID NO: 1363360 - RNA, 16 nt, Mycobacterium tuberculosis H37Rv
cuugcucucgcagcau

SEQ ID NO: 1363361 - RNA, 22 nt, Mycobacterium tuberculosis H37Rv
cuggcccccgguaccgcccgca

SEQ ID NO: 1363362 - RNA, 20 nt, Mycobacterium tuberculosis H37Rv
cuggccccgccagcggcagc

SEQ ID NO: 1363363 - RNA, 22 nt, Mycobacterium tuberculosis H37Rv
cuggcccggacaugcgggcagc

SEQ ID NO: 1363364 - RNA, 23 nt, Mycobacterium tuberculosis H37Rv
cuggccccgguggugcugccgau

SEQ ID NO: 1363365 - RNA, 18 nt, Mycobacterium tuberculosis H37Rv
cuggcccgauaaaugccg

SEQ ID NO: 1363366 - RNA, 18 nt, Mycobacterium tuberculosis H37Rv
cuggcccgccacgauguc

SEQ ID NO: 1363367 - RNA, 23 nt, Mycobacterium tuberculosis H37Rv
cuggccgaacgacggguccgggc

SEQ ID NO: 1363368 - RNA, 14 nt, Mycobacterium tuberculosis H37Rv
cuggccgaaccggu

SEQ ID NO: 1363369 - RNA, 21 nt, Mycobacterium tuberculosis H37Rv
cuggccgaaccgguagucgcc

SEQ ID NO: 1363370 - RNA, 14 nt, Mycobacterium tuberculosis H37Rv
cuggccgaagaacu

SEQ ID NO: 1363371 - RNA, 21 nt, Mycobacterium tuberculosis H37Rv
cuguuacuccgacggcccggu

SEQ ID NO: 1363372 - RNA, 21 nt, Mycobacterium tuberculosis H37Rv
cuguucggccaacccgggccg

SEQ ID NO: 1363373 - RNA, 21 nt, Mycobacterium tuberculosis H37Rv
cuguugugagauuggcagacc

SEQ ID NO: 1363374 - RNA, 21 nt, Mycobacterium tuberculosis H37Rv
cuguucggcggcugccagcgc

SEQ ID NO: 1363375 - RNA, 19 nt, Mycobacterium tuberculosis H37Rv
cuuaaccgagccgaccggc

SEQ ID NO: 1363376 - RNA, 19 nt, Mycobacterium tuberculosis H37Rv
cuuaaccugaaccggccgc

SEQ ID NO: 1363377 - RNA, 22 nt, Mycobacterium tuberculosis H37Rv
cuuaaacgggcucuucgcagcg

SEQ ID NO: 1363378 - RNA, 15 nt, Mycobacterium tuberculosis H37Rv
cuuauguguccgcuc

SEQ ID NO: 1363379 - RNA, 20 nt, Mycobacterium tuberculosis H37Rv
cuuagccauuuccuuggcgc

SEQ ID NO: 1363380 - RNA, 14 nt, Mycobacterium tuberculosis H37Rv
cuuagcccgauggu

SEQ ID NO: 1363381 - RNA, 17 nt, Mycobacterium tuberculosis H37Rv
cuuagcggaaaacccag

SEQ ID NO: 1363382 - RNA, 18 nt, Mycobacterium tuberculosis H37Rv
cuuagggcgcccgccccg

SEQ ID NO: 1363383 - RNA, 15 nt, Mycobacterium tuberculosis H37Rv
cuuccggcguggccc

SEQ ID NO: 1363384 - RNA, 19 nt, Mycobacterium tuberculosis H37Rv
cuuccggaacaaaggcuug

SEQ ID NO: 1363385 - RNA, 12 nt, Mycobacterium tuberculosis H37Rv
cuucccuccaga

SEQ ID NO: 1363386 - RNA, 14 nt, Mycobacterium tuberculosis H37Rv
cuuccaacaggccg

SEQ ID NO: 1363387 - RNA, 22 nt, Mycobacterium tuberculosis H37Rv
cuuccacggcguggucggcaaa

SEQ ID NO: 1363388 - RNA, 14 nt, Mycobacterium tuberculosis H37Rv
cuucggucagggug

SEQ ID NO: 1363389 - RNA, 17 nt, Mycobacterium tuberculosis H37Rv
cuucggucaccucgaug

SEQ ID NO: 1363390 - RNA, 19 nt, Mycobacterium tuberculosis H37Rv
cuucggugacccgggcggc

SEQ ID NO: 1363391 - RNA, 16 nt, Mycobacterium tuberculosis H37Rv
cuucggucgcggccuc

SEQ ID NO: 1363392 - RNA, 14 nt, Mycobacterium tuberculosis H37Rv
cuucgguggcgggc

SEQ ID NO: 1363393 - RNA, 22 nt, Mycobacterium tuberculosis H37Rv
cuucggguccagcggccgccgc

SEQ ID NO: 1363394 - RNA, 19 nt, Mycobacterium tuberculosis H37Rv
cuucggguguucgcgcgcg

SEQ ID NO: 1363395 - RNA, 19 nt, Mycobacterium tuberculosis H37Rv
cuucgggguaaccggcgga

SEQ ID NO: 1363396 - RNA, 18 nt, Mycobacterium tuberculosis H37Rv
cuucgcgcagccggucag

SEQ ID NO: 1363397 - RNA, 21 nt, Mycobacterium tuberculosis H37Rv
cuucgcgcuguacugccccag

SEQ ID NO: 1363398 - RNA, 14 nt, Mycobacterium tuberculosis H37Rv
cuucggcuagguca

SEQ ID NO: 1363399 - RNA, 14 nt, Mycobacterium tuberculosis H37Rv
cuucggcugguagg

SEQ ID NO: 1363400 - RNA, 23 nt, Mycobacterium tuberculosis H37Rv
cuucgccggcgccagcagaucuc

SEQ ID NO: 1363401 - RNA, 20 nt, Mycobacterium tuberculosis H37Rv
cuucgccgcgcagccuucuc

SEQ ID NO: 1363402 - RNA, 21 nt, Mycobacterium tuberculosis H37Rv
cuucgacgcuuccuggguugg

SEQ ID NO: 1363403 - RNA, 14 nt, Mycobacterium tuberculosis H37Rv
cuucgacggcggcc

SEQ ID NO: 1363404 - RNA, 17 nt, Mycobacterium tuberculosis H37Rv
cuucgacgcggcgaccg

SEQ ID NO: 1363405 - RNA, 16 nt, Mycobacterium tuberculosis H37Rv
cuucgacgcuuccugg

SEQ ID NO: 1363406 - RNA, 14 nt, Mycobacterium tuberculosis H37Rv
cuucgaccucaccc

SEQ ID NO: 1363407 - RNA, 12 nt, Mycobacterium tuberculosis H37Rv
cuucgagcaccg

SEQ ID NO: 1363408 - RNA, 23 nt, Mycobacterium tuberculosis H37Rv
cuuccuggucgacgcgucucugg

SEQ ID NO: 1363409 - RNA, 17 nt, Mycobacterium tuberculosis H37Rv
cuucaucaacgacacca

SEQ ID NO: 1363410 - RNA, 19 nt, Mycobacterium tuberculosis H37Rv
cuucaucaacgacaccaga

SEQ ID NO: 1363411 - RNA, 17 nt, Mycobacterium tuberculosis H37Rv
cuucaguccggcccccc

SEQ ID NO: 1363412 - RNA, 13 nt, Mycobacterium tuberculosis H37Rv
cuucagcaggccc

SEQ ID NO: 1363413 - RNA, 24 nt, Mycobacterium tuberculosis H37Rv
cuucagcacgguguacgcccgcuc

SEQ ID NO: 1363414 - RNA, 22 nt, Mycobacterium tuberculosis H37Rv
cuucaggcaccggaugaugugg

SEQ ID NO: 1363415 - RNA, 14 nt, Mycobacterium tuberculosis H37Rv
cuucagguagcggc

SEQ ID NO: 1363416 - RNA, 16 nt, Mycobacterium tuberculosis H37Rv
cuucaggcgccacugc

SEQ ID NO: 1363417 - RNA, 21 nt, Mycobacterium tuberculosis H37Rv
cuucaacuuacgcgacgccgu

SEQ ID NO: 1363418 - RNA, 13 nt, Mycobacterium tuberculosis H37Rv
cuucaccacgccg

SEQ ID NO: 1363419 - RNA, 17 nt, Mycobacterium tuberculosis H37Rv
cuucacccaaccccgcc

SEQ ID NO: 1363420 - RNA, 15 nt, Mycobacterium tuberculosis H37Rv
cuucaccacccuguu

SEQ ID NO: 1363421 - RNA, 19 nt, Mycobacterium tuberculosis H37Rv
cuucacgggccguccagga

SEQ ID NO: 1363422 - RNA, 18 nt, Mycobacterium tuberculosis H37Rv
cuucacgggccguccagg

SEQ ID NO: 1363423 - RNA, 20 nt, Mycobacterium tuberculosis H37Rv
cuucacuaauaggcacuaga

SEQ ID NO: 1363424 - RNA, 22 nt, Mycobacterium tuberculosis H37Rv
cggcucgggaacuucgccgaag

SEQ ID NO: 1363425 - RNA, 15 nt, Mycobacterium tuberculosis H37Rv
cggcucgggugcgcc

SEQ ID NO: 1363426 - RNA, 19 nt, Mycobacterium tuberculosis H37Rv
cggcucgggugcgcccggc

SEQ ID NO: 1363427 - RNA, 15 nt, Mycobacterium tuberculosis H37Rv
cggcucggcccccga

SEQ ID NO: 1363428 - RNA, 17 nt, Mycobacterium tuberculosis H37Rv
cggcucuauccggcgca

SEQ ID NO: 1363429 - RNA, 16 nt, Mycobacterium tuberculosis H37Rv
cggcucguuggcaaag

SEQ ID NO: 1363430 - RNA, 24 nt, Mycobacterium tuberculosis H37Rv
cggcucgcugaucuggggcaccac

SEQ ID NO: 1363431 - RNA, 18 nt, Mycobacterium tuberculosis H37Rv
cggcugaccggggcgccc

SEQ ID NO: 1363432 - RNA, 13 nt, Mycobacterium tuberculosis H37Rv
cggcugaccuccc

SEQ ID NO: 1363433 - RNA, 16 nt, Mycobacterium tuberculosis H37Rv
cggcugagggcccuug

SEQ ID NO: 1363434 - RNA, 22 nt, Mycobacterium tuberculosis H37Rv
cggcugauuggcccaccgccgu

SEQ ID NO: 1363435 - RNA, 16 nt, Mycobacterium tuberculosis H37Rv
cggcugcauccuccuc

SEQ ID NO: 1363436 - RNA, 17 nt, Mycobacterium tuberculosis H37Rv
cggcugccacgcgucgg

SEQ ID NO: 1363437 - RNA, 14 nt, Mycobacterium tuberculosis H37Rv
cggcugccacacag

SEQ ID NO: 1363438 - RNA, 19 nt, Mycobacterium tuberculosis H37Rv
cggcugccagcgccgccgc

SEQ ID NO: 1363439 - RNA, 23 nt, Mycobacterium tuberculosis H37Rv
cggcugccaucccgaucccggcc

SEQ ID NO: 1363440 - RNA, 15 nt, Mycobacterium tuberculosis H37Rv
cggcugcccacccca

SEQ ID NO: 1363441 - RNA, 14 nt, Mycobacterium tuberculosis H37Rv
cggcugccgcacca

SEQ ID NO: 1363442 - RNA, 15 nt, Mycobacterium tuberculosis H37Rv
cggcugccuccauga

SEQ ID NO: 1363443 - RNA, 20 nt, Mycobacterium tuberculosis H37Rv
cggcugcuuggucgcccagc

SEQ ID NO: 1363444 - RNA, 17 nt, Mycobacterium tuberculosis H37Rv
cggcugcugcgcggugc

SEQ ID NO: 1363445 - RNA, 22 nt, Mycobacterium tuberculosis H37Rv
cggcugcggcgucguugaggaa

SEQ ID NO: 1363446 - RNA, 13 nt, Mycobacterium tuberculosis H37Rv
cggcugcgggccc

SEQ ID NO: 1363447 - RNA, 15 nt, Mycobacterium tuberculosis H37Rv
cggcugccgcgcgcu

SEQ ID NO: 1363448 - RNA, 21 nt, Mycobacterium tuberculosis H37Rv
cggcugccgcaaacgcggcgu

SEQ ID NO: 1363449 - RNA, 13 nt, Mycobacterium tuberculosis H37Rv
cggcugcgccggg

SEQ ID NO: 1363450 - RNA, 17 nt, Mycobacterium tuberculosis H37Rv
cggcugcgcgcucggcc

SEQ ID NO: 1363451 - RNA, 15 nt, Mycobacterium tuberculosis H37Rv
cggcugggcggucgg

SEQ ID NO: 1363452 - RNA, 15 nt, Mycobacterium tuberculosis H37Rv
cggcuggucacccgu

SEQ ID NO: 1363453 - RNA, 15 nt, Mycobacterium tuberculosis H37Rv
cggcuggugucgggc

SEQ ID NO: 1363454 - RNA, 17 nt, Mycobacterium tuberculosis H37Rv
cggcugguuacucacca

SEQ ID NO: 1363455 - RNA, 22 nt, Mycobacterium tuberculosis H37Rv
cggcuggugccaacugcgccgu

SEQ ID NO: 1363456 - RNA, 19 nt, Mycobacterium tuberculosis H37Rv
cggcuggugggacgcggcc

SEQ ID NO: 1363457 - RNA, 18 nt, Mycobacterium tuberculosis H37Rv
cggcuggccgcgccucgg

SEQ ID NO: 1363458 - RNA, 13 nt, Mycobacterium tuberculosis H37Rv
cggcuggcggccu

SEQ ID NO: 1363459 - RNA, 14 nt, Mycobacterium tuberculosis H37Rv
cggcuggcccaccu

SEQ ID NO: 1363460 - RNA, 18 nt, Mycobacterium tuberculosis H37Rv
cggcuguugcggcggcgc

SEQ ID NO: 1363461 - RNA, 19 nt, Mycobacterium tuberculosis H37Rv
cggcuguugcggcggcgcu

SEQ ID NO: 1363462 - RNA, 17 nt, Mycobacterium tuberculosis H37Rv
cggcuugagccgcagca

SEQ ID NO: 1363463 - RNA, 15 nt, Mycobacterium tuberculosis H37Rv
cggcuucguccaccg

SEQ ID NO: 1363464 - RNA, 16 nt, Mycobacterium tuberculosis H37Rv
cggcuucggguguucg

SEQ ID NO: 1363465 - RNA, 14 nt, Mycobacterium tuberculosis H37Rv
cggcuucggcagcc

SEQ ID NO: 1363466 - RNA, 15 nt, Mycobacterium tuberculosis H37Rv
cggcuucggcagacc

SEQ ID NO: 1363467 - RNA, 17 nt, Mycobacterium tuberculosis H37Rv
cggcuucgucggccagc

SEQ ID NO: 1363468 - RNA, 18 nt, Mycobacterium tuberculosis H37Rv
cggcuucgucggccagca

SEQ ID NO: 1363469 - RNA, 21 nt, Mycobacterium tuberculosis H37Rv
cggcuucgucggccagcagca

SEQ ID NO: 1363470 - RNA, 14 nt, Mycobacterium tuberculosis H37Rv
cggcuuccuccucg

SEQ ID NO: 1363471 - RNA, 16 nt, Mycobacterium tuberculosis H37Rv
cgggaaagccaccuac

SEQ ID NO: 1363472 - RNA, 17 nt, Mycobacterium tuberculosis H37Rv
cgggaaauaucucggug

SEQ ID NO: 1363473 - RNA, 22 nt, Mycobacterium tuberculosis H37Rv
cgggaacgagccacgccagcgu

SEQ ID NO: 1363474 - RNA, 13 nt, Mycobacterium tuberculosis H37Rv
cgggaaccccagc

SEQ ID NO: 1363475 - RNA, 16 nt, Mycobacterium tuberculosis H37Rv
cgggaaccaacaccag

SEQ ID NO: 1363476 - RNA, 12 nt, Mycobacterium tuberculosis H37Rv
cgggaaggaacc

SEQ ID NO: 1363477 - RNA, 13 nt, Mycobacterium tuberculosis H37Rv
cgggaagccgcau

SEQ ID NO: 1363478 - RNA, 21 nt, Mycobacterium tuberculosis H37Rv
cgggaagccgcaucuggcugu

SEQ ID NO: 1363479 - RNA, 19 nt, Mycobacterium tuberculosis H37Rv
cgggaaggaaccgggcaaa

SEQ ID NO: 1363480 - RNA, 22 nt, Mycobacterium tuberculosis H37Rv
cgggaaggaaccgggcaaauca

SEQ ID NO: 1363481 - RNA, 23 nt, Mycobacterium tuberculosis H37Rv
cggcuugggaaacccggccagcu

SEQ ID NO: 1363482 - RNA, 13 nt, Mycobacterium tuberculosis H37Rv
cggcuugggccag

SEQ ID NO: 1363483 - RNA, 23 nt, Mycobacterium tuberculosis H37Rv
cggcuuggugaaccgcgcggcga

SEQ ID NO: 1363484 - RNA, 20 nt, Mycobacterium tuberculosis H37Rv
cggcuugcugccccauaaac

SEQ ID NO: 1363485 - RNA, 22 nt, Mycobacterium tuberculosis H37Rv
cggcuuggccgccccggccgcu

SEQ ID NO: 1363486 - RNA, 15 nt, Mycobacterium tuberculosis H37Rv
cggcuuggccggcgg

SEQ ID NO: 1363487 - RNA, 18 nt, Mycobacterium tuberculosis H37Rv
cggcuuuggccgccgugg

SEQ ID NO: 1363488 - RNA, 16 nt, Mycobacterium tuberculosis H37Rv
cggcuuugagccgcuc

SEQ ID NO: 1363489 - RNA, 14 nt, Mycobacterium tuberculosis H37Rv
cggcgucggcgccc

SEQ ID NO: 1363490 - RNA, 20 nt, Mycobacterium tuberculosis H37Rv
cggcgucuuccucggccacc

SEQ ID NO: 1363491 - RNA, 22 nt, Mycobacterium tuberculosis H37Rv
cggcgucuugcaucagcggcgc

SEQ ID NO: 1363492 - RNA, 22 nt, Mycobacterium tuberculosis H37Rv
cggcgucuagcccgccauccgc

SEQ ID NO: 1363493 - RNA, 14 nt, Mycobacterium tuberculosis H37Rv
cggcgucucgcagc

SEQ ID NO: 1363494 - RNA, 19 nt, Mycobacterium tuberculosis H37Rv
cggcgucgugguggccacg

SEQ ID NO: 1363495 - RNA, 20 nt, Mycobacterium tuberculosis H37Rv
cggcgugacgucgucggugc

SEQ ID NO: 1363496 - RNA, 16 nt, Mycobacterium tuberculosis H37Rv
cggcgugcggacugac

SEQ ID NO: 1363497 - RNA, 15 nt, Mycobacterium tuberculosis H37Rv
cggcgugcagcaccc

SEQ ID NO: 1363498 - RNA, 12 nt, Mycobacterium tuberculosis H37Rv
cggcgugcagca

SEQ ID NO: 1363499 - RNA, 15 nt, Mycobacterium tuberculosis H37Rv
cggcgugcaggguca

SEQ ID NO: 1363500 - RNA, 15 nt, Mycobacterium tuberculosis H37Rv
cggcguggucggcgg

SEQ ID NO: 1363501 - RNA, 18 nt, Mycobacterium tuberculosis H37Rv
cggcgugguauccgccgu

SEQ ID NO: 1363502 - RNA, 17 nt, Mycobacterium tuberculosis H37Rv
cggcguggucgcgcggc

SEQ ID NO: 1363503 - RNA, 13 nt, Mycobacterium tuberculosis H37Rv
cggcgugucgggg

SEQ ID NO: 1363504 - RNA, 15 nt, Mycobacterium tuberculosis H37Rv
cggcgugucgggggc

SEQ ID NO: 1363505 - RNA, 16 nt, Mycobacterium tuberculosis H37Rv
cggcgugucgccgcca

SEQ ID NO: 1363506 - RNA, 15 nt, Mycobacterium tuberculosis H37Rv
cggcguguccgccga

SEQ ID NO: 1363507 - RNA, 23 nt, Mycobacterium tuberculosis H37Rv
cggcguuaagguacccggucggg

SEQ ID NO: 1363508 - RNA, 14 nt, Mycobacterium tuberculosis H37Rv
cggcgugggcaccu

SEQ ID NO: 1363509 - RNA, 23 nt, Mycobacterium tuberculosis H37Rv
cggcgugggagguggcgcggggc

SEQ ID NO: 1363510 - RNA, 18 nt, Mycobacterium tuberculosis H37Rv
cggcgugggagguggcgc

SEQ ID NO: 1363511 - RNA, 17 nt, Mycobacterium tuberculosis H37Rv
cggcguggcgccggcca

SEQ ID NO: 1363512 - RNA, 15 nt, Mycobacterium tuberculosis H37Rv
cggcguggcgggggc

SEQ ID NO: 1363513 - RNA, 13 nt, Mycobacterium tuberculosis H37Rv
cggcgugcucggc

SEQ ID NO: 1363514 - RNA, 16 nt, Mycobacterium tuberculosis H37Rv
cggcgucaggcacaac

SEQ ID NO: 1363515 - RNA, 21 nt, Mycobacterium tuberculosis H37Rv
cggcguaggcgauggcggcgc

SEQ ID NO: 1363516 - RNA, 18 nt, Mycobacterium tuberculosis H37Rv
cggcguaggcggucagau

SEQ ID NO: 1363517 - RNA, 20 nt, Mycobacterium tuberculosis H37Rv
cggcguagaugcgcccggcg

SEQ ID NO: 1363518 - RNA, 18 nt, Mycobacterium tuberculosis H37Rv
cggcguagcgagcgggug

SEQ ID NO: 1363519 - RNA, 13 nt, Mycobacterium tuberculosis H37Rv
cggcgccgcccgc

SEQ ID NO: 1363520 - RNA, 20 nt, Mycobacterium tuberculosis H37Rv
cggcgccgcccgcgccacca

SEQ ID NO: 1363521 - RNA, 14 nt, Mycobacterium tuberculosis H37Rv
cggcgccgcccagc

SEQ ID NO: 1363522 - RNA, 22 nt, Mycobacterium tuberculosis H37Rv
cggcgccgcccuugccgccggc

SEQ ID NO: 1363523 - RNA, 14 nt, Mycobacterium tuberculosis H37Rv
cggcgccgccggcg

SEQ ID NO: 1363524 - RNA, 15 nt, Mycobacterium tuberculosis H37Rv
cggcgccgccgugcg

SEQ ID NO: 1363525 - RNA, 19 nt, Mycobacterium tuberculosis H37Rv
cggcgccgccggcgccgcc

SEQ ID NO: 1363526 - RNA, 20 nt, Mycobacterium tuberculosis H37Rv
cggcgccgccggcgccgccc

SEQ ID NO: 1363527 - RNA, 11 nt, Mycobacterium tuberculosis H37Rv
cggcgccgcgc

SEQ ID NO: 1363528 - RNA, 16 nt, Mycobacterium tuberculosis H37Rv
cggcguccuugcgcag

SEQ ID NO: 1363529 - RNA, 19 nt, Mycobacterium tuberculosis H37Rv
cggcguccuugcgcagcac

SEQ ID NO: 1363530 - RNA, 15 nt, Mycobacterium tuberculosis H37Rv
cggcguccgcccagc

SEQ ID NO: 1363531 - RNA, 13 nt, Mycobacterium tuberculosis H37Rv
cggcguccaagaa

SEQ ID NO: 1363532 - RNA, 19 nt, Mycobacterium tuberculosis H37Rv
cggcguccaccugcuccgc

SEQ ID NO: 1363533 - RNA, 16 nt, Mycobacterium tuberculosis H37Rv
cggcgucauccaccgc

SEQ ID NO: 1363534 - RNA, 15 nt, Mycobacterium tuberculosis H37Rv
cggcgucggccaccc

SEQ ID NO: 1363535 - RNA, 14 nt, Mycobacterium tuberculosis H37Rv
cggcgucgaagcac

SEQ ID NO: 1363536 - RNA, 21 nt, Mycobacterium tuberculosis H37Rv
cggcgucgaaggugaccaggc

SEQ ID NO: 1363537 - RNA, 21 nt, Mycobacterium tuberculosis H37Rv
cggcguccuugcgcagcacca

SEQ ID NO: 1363538 - RNA, 14 nt, Mycobacterium tuberculosis H37Rv
cggcgucgacccag

SEQ ID NO: 1363539 - RNA, 20 nt, Mycobacterium tuberculosis H37Rv
cggcgucgacccugcccagc

SEQ ID NO: 1363540 - RNA, 15 nt, Mycobacterium tuberculosis H37Rv
cggcgucgagcaccu

SEQ ID NO: 1363541 - RNA, 19 nt, Mycobacterium tuberculosis H37Rv
cggcgucgagcucguccuc

SEQ ID NO: 1363542 - RNA, 24 nt, Mycobacterium tuberculosis H37Rv
cggcgucgagggagcgccgcaggg

SEQ ID NO: 1363543 - RNA, 19 nt, Mycobacterium tuberculosis H37Rv
cggcguucccacuggaggu

SEQ ID NO: 1363544 - RNA, 23 nt, Mycobacterium tuberculosis H37Rv
cggcguuccccgagaacggcggg

SEQ ID NO: 1363545 - RNA, 17 nt, Mycobacterium tuberculosis H37Rv
cggcguuacguggugga

SEQ ID NO: 1363546 - RNA, 23 nt, Mycobacterium tuberculosis H37Rv
cggcguuaccaccgucaccgccg

SEQ ID NO: 1363547 - RNA, 16 nt, Mycobacterium tuberculosis H37Rv
cggcguugucccccag

SEQ ID NO: 1363548 - RNA, 18 nt, Mycobacterium tuberculosis H37Rv
cggcguugccgaaacccg

SEQ ID NO: 1363549 - RNA, 21 nt, Mycobacterium tuberculosis H37Rv
cggcguuggugcagucggugc

SEQ ID NO: 1363550 - RNA, 23 nt, Mycobacterium tuberculosis H37Rv
cggcguuggaaaagucgggcacu

SEQ ID NO: 1363551 - RNA, 15 nt, Mycobacterium tuberculosis H37Rv
cggcuaggccggccg

SEQ ID NO: 1363552 - RNA, 19 nt, Mycobacterium tuberculosis H37Rv
cggcuaggccaagccgcgg

SEQ ID NO: 1363553 - RNA, 19 nt, Mycobacterium tuberculosis H37Rv
cggcuaggucagcgggcuu

SEQ ID NO: 1363554 - RNA, 14 nt, Mycobacterium tuberculosis H37Rv
cggcuagucaaguc

SEQ ID NO: 1363555 - RNA, 19 nt, Mycobacterium tuberculosis H37Rv
cggcuaccuaacccgcgcc

SEQ ID NO: 1363556 - RNA, 21 nt, Mycobacterium tuberculosis H37Rv
cggcuacggcgacacgccagc

SEQ ID NO: 1363557 - RNA, 15 nt, Mycobacterium tuberculosis H37Rv
cggcuaccgccuugu

SEQ ID NO: 1363558 - RNA, 14 nt, Mycobacterium tuberculosis H37Rv
cggcuaccgcgcuc

SEQ ID NO: 1363559 - RNA, 21 nt, Mycobacterium tuberculosis H37Rv
cggcuaccgcgcucccggcgu

SEQ ID NO: 1363560 - RNA, 17 nt, Mycobacterium tuberculosis H37Rv
cggcuaccaccgcaccu

SEQ ID NO: 1363561 - RNA, 18 nt, Mycobacterium tuberculosis H37Rv
cggcguuugagaacaacg

SEQ ID NO: 1363562 - RNA, 16 nt, Mycobacterium tuberculosis H37Rv
cggcuagugcauuguc

SEQ ID NO: 1363563 - RNA, 15 nt, Mycobacterium tuberculosis H37Rv
cggcucaaucuccuc

SEQ ID NO: 1363564 - RNA, 18 nt, Mycobacterium tuberculosis H37Rv
cggcucaaucuccuccgc

SEQ ID NO: 1363565 - RNA, 19 nt, Mycobacterium tuberculosis H37Rv
cggcucaaucuccuccgcg

SEQ ID NO: 1363566 - RNA, 13 nt, Mycobacterium tuberculosis H37Rv
cggcucacagcac

SEQ ID NO: 1363567 - RNA, 21 nt, Mycobacterium tuberculosis H37Rv
cggcucacguaaccagugacc

SEQ ID NO: 1363568 - RNA, 21 nt, Mycobacterium tuberculosis H37Rv
cggcucacagcacagcgcagc

SEQ ID NO: 1363569 - RNA, 22 nt, Mycobacterium tuberculosis H37Rv
cggcucacagcacagcgcagcc

SEQ ID NO: 1363570 - RNA, 15 nt, Mycobacterium tuberculosis H37Rv
cggcucacagcacag

SEQ ID NO: 1363571 - RNA, 20 nt, Mycobacterium tuberculosis H37Rv
cggcucagaccaaggcgaag

SEQ ID NO: 1363572 - RNA, 15 nt, Mycobacterium tuberculosis H37Rv
cggcuccaccgggcc

SEQ ID NO: 1363573 - RNA, 13 nt, Mycobacterium tuberculosis H37Rv
cggcuccacccac

SEQ ID NO: 1363574 - RNA, 20 nt, Mycobacterium tuberculosis H37Rv
cggcuccacccccacgcugc

SEQ ID NO: 1363575 - RNA, 13 nt, Mycobacterium tuberculosis H37Rv
cggcucaucccga

SEQ ID NO: 1363576 - RNA, 14 nt, Mycobacterium tuberculosis H37Rv
cggcuccagcaccg

SEQ ID NO: 1363577 - RNA, 17 nt, Mycobacterium tuberculosis H37Rv
cggcuccagcaugggcg

SEQ ID NO: 1363578 - RNA, 19 nt, Mycobacterium tuberculosis H37Rv
cggcucccauggcgcgagc

SEQ ID NO: 1363579 - RNA, 20 nt, Mycobacterium tuberculosis H37Rv
cggcuccagguccacaucca

SEQ ID NO: 1363580 - RNA, 20 nt, Mycobacterium tuberculosis H37Rv
cggcuccuccccggcccgcu

SEQ ID NO: 1363581 - RNA, 13 nt, Mycobacterium tuberculosis H37Rv
cggcuccgcagcg

SEQ ID NO: 1363582 - RNA, 16 nt, Mycobacterium tuberculosis H37Rv
cggcuccgccagcgcc

SEQ ID NO: 1363583 - RNA, 19 nt, Mycobacterium tuberculosis H37Rv
cggcuccgccagcgccgcc

SEQ ID NO: 1363584 - RNA, 13 nt, Mycobacterium tuberculosis H37Rv
cggcuccgcaacc

SEQ ID NO: 1363585 - RNA, 16 nt, Mycobacterium tuberculosis H37Rv
cggcuccgcccggcgu

SEQ ID NO: 1363586 - RNA, 21 nt, Mycobacterium tuberculosis H37Rv
cgggccguccggcgccugcug

SEQ ID NO: 1363587 - RNA, 15 nt, Mycobacterium tuberculosis H37Rv
cgggccgucaaucgc

SEQ ID NO: 1363588 - RNA, 16 nt, Mycobacterium tuberculosis H37Rv
cgggccgggcgguguc

SEQ ID NO: 1363589 - RNA, 23 nt, Mycobacterium tuberculosis H37Rv
cgggccgguggaaaagccacggc

SEQ ID NO: 1363590 - RNA, 16 nt, Mycobacterium tuberculosis H37Rv
cgggccggccgccgcg

SEQ ID NO: 1363591 - RNA, 14 nt, Mycobacterium tuberculosis H37Rv
cgggccgcgcgcag

SEQ ID NO: 1363592 - RNA, 14 nt, Mycobacterium tuberculosis H37Rv
cgggccgccuggag

SEQ ID NO: 1363593 - RNA, 15 nt, Mycobacterium tuberculosis H37Rv
cgggccgccuggagc

SEQ ID NO: 1363594 - RNA, 20 nt, Mycobacterium tuberculosis H37Rv
cgggccgccuggagcugugg

SEQ ID NO: 1363595 - RNA, 23 nt, Mycobacterium tuberculosis H37Rv
cgggccucaugcuaggccaccgg

SEQ ID NO: 1363596 - RNA, 19 nt, Mycobacterium tuberculosis H37Rv
cgggccucggcgccgucgg

SEQ ID NO: 1363597 - RNA, 14 nt, Mycobacterium tuberculosis H37Rv
cgggccguccuccc

SEQ ID NO: 1363598 - RNA, 14 nt, Mycobacterium tuberculosis H37Rv
cgggccgugacccu

SEQ ID NO: 1363599 - RNA, 22 nt, Mycobacterium tuberculosis H37Rv
cgggccuggccugcccagcacc

SEQ ID NO: 1363600 - RNA, 16 nt, Mycobacterium tuberculosis H37Rv
cgggccuugcgcgcgc

SEQ ID NO: 1363601 - RNA, 22 nt, Mycobacterium tuberculosis H37Rv
cgggccugcgcgauccgcgcgc

SEQ ID NO: 1363602 - RNA, 20 nt, Mycobacterium tuberculosis H37Rv
cgggcccacguuggccccgc

SEQ ID NO: 1363603 - RNA, 19 nt, Mycobacterium tuberculosis H37Rv
cgggcccacguuggccccg

SEQ ID NO: 1363604 - RNA, 18 nt, Mycobacterium tuberculosis H37Rv
cgggcccacguuggcccc

SEQ ID NO: 1363605 - RNA, 15 nt, Mycobacterium tuberculosis H37Rv
cgggccaugugggga

SEQ ID NO: 1363606 - RNA, 19 nt, Mycobacterium tuberculosis H37Rv
cgggccauucaccgcgcac

SEQ ID NO: 1363607 - RNA, 23 nt, Mycobacterium tuberculosis H37Rv
cgggccauggguagccgcccagc

SEQ ID NO: 1363608 - RNA, 18 nt, Mycobacterium tuberculosis H37Rv
cgggcccuccggcgcagc

SEQ ID NO: 1363609 - RNA, 19 nt, Mycobacterium tuberculosis H37Rv
cgggcccggcggccagcuc

SEQ ID NO: 1363610 - RNA, 17 nt, Mycobacterium tuberculosis H37Rv
cgggccgaagcgcgcgc

SEQ ID NO: 1363611 - RNA, 18 nt, Mycobacterium tuberculosis H37Rv
cgggccgaauaccacacc

SEQ ID NO: 1363612 - RNA, 16 nt, Mycobacterium tuberculosis H37Rv
cgggccgacagcacgc

SEQ ID NO: 1363613 - RNA, 21 nt, Mycobacterium tuberculosis H37Rv
cgggccgacagcacgccaggc

SEQ ID NO: 1363614 - RNA, 15 nt, Mycobacterium tuberculosis H37Rv
cgggcccggacaagg

SEQ ID NO: 1363615 - RNA, 17 nt, Mycobacterium tuberculosis H37Rv
cgggccgaagccccgau

SEQ ID NO: 1363616 - RNA, 20 nt, Mycobacterium tuberculosis H37Rv
cgggcccguagccgagcuug

SEQ ID NO: 1363617 - RNA, 22 nt, Mycobacterium tuberculosis H37Rv
cgggcccuccacugcgagcgcc

SEQ ID NO: 1363618 - RNA, 18 nt, Mycobacterium tuberculosis H37Rv
cgggcccgccggccccgc

SEQ ID NO: 1363619 - RNA, 18 nt, Mycobacterium tuberculosis H37Rv
cgggcccgccguccccgc

SEQ ID NO: 1363620 - RNA, 15 nt, Mycobacterium tuberculosis H37Rv
cgggccgaucacccc

SEQ ID NO: 1363621 - RNA, 16 nt, Mycobacterium tuberculosis H37Rv
cgggccgccagggccc

SEQ ID NO: 1363622 - RNA, 14 nt, Mycobacterium tuberculosis H37Rv
cgggccgagcgcac

SEQ ID NO: 1363623 - RNA, 19 nt, Mycobacterium tuberculosis H37Rv
cgggcggaucggcccagau

SEQ ID NO: 1363624 - RNA, 20 nt, Mycobacterium tuberculosis H37Rv
cgggcggccgcggcgcggcg

SEQ ID NO: 1363625 - RNA, 20 nt, Mycobacterium tuberculosis H37Rv
cgggcgcuguagucgcgccu

SEQ ID NO: 1363626 - RNA, 20 nt, Mycobacterium tuberculosis H37Rv
cgggcgcuugcaccaggggc

SEQ ID NO: 1363627 - RNA, 15 nt, Mycobacterium tuberculosis H37Rv
cgggcggaaacaagc

SEQ ID NO: 1363628 - RNA, 16 nt, Mycobacterium tuberculosis H37Rv
cgggcggaggccgccu

SEQ ID NO: 1363629 - RNA, 18 nt, Mycobacterium tuberculosis H37Rv
cgggcgcuguagucgcgc

SEQ ID NO: 1363630 - RNA, 19 nt, Mycobacterium tuberculosis H37Rv
cgggcgggguaucaaccgg

SEQ ID NO: 1363631 - RNA, 23 nt, Mycobacterium tuberculosis H37Rv
cgggcgggguaucaaccggccgg

SEQ ID NO: 1363632 - RNA, 18 nt, Mycobacterium tuberculosis H37Rv
cgggcgggauccacccag

SEQ ID NO: 1363633 - RNA, 20 nt, Mycobacterium tuberculosis H37Rv
cgggcgucacggugcguucg

SEQ ID NO: 1363634 - RNA, 21 nt, Mycobacterium tuberculosis H37Rv
cgggcguccacgcugaccaac

SEQ ID NO: 1363635 - RNA, 16 nt, Mycobacterium tuberculosis H37Rv
cgggcgucccggcggu

SEQ ID NO: 1363636 - RNA, 19 nt, Mycobacterium tuberculosis H37Rv
cgggcguccacgcugacca

SEQ ID NO: 1363637 - RNA, 18 nt, Mycobacterium tuberculosis H37Rv
cgggcggugggcagcagc

SEQ ID NO: 1363638 - RNA, 15 nt, Mycobacterium tuberculosis H37Rv
cgggcgggucggcgg

SEQ ID NO: 1363639 - RNA, 15 nt, Mycobacterium tuberculosis H37Rv
cgggcgugugcaguc

SEQ ID NO: 1363640 - RNA, 23 nt, Mycobacterium tuberculosis H37Rv
cgggcguucucgauugucgccgc

SEQ ID NO: 1363641 - RNA, 19 nt, Mycobacterium tuberculosis H37Rv
cgggcgugggugucggcga

SEQ ID NO: 1363642 - RNA, 20 nt, Mycobacterium tuberculosis H37Rv
cgggcguugcccuccuucuc

SEQ ID NO: 1363643 - RNA, 23 nt, Mycobacterium tuberculosis H37Rv
cgggcgaccaccaccgccgccga

SEQ ID NO: 1363644 - RNA, 20 nt, Mycobacterium tuberculosis H37Rv
cgggcgaccuccggaaucgc

SEQ ID NO: 1363645 - RNA, 20 nt, Mycobacterium tuberculosis H37Rv
cgggcgaguacaggcgcagc

SEQ ID NO: 1363646 - RNA, 22 nt, Mycobacterium tuberculosis H37Rv
cgggcgagcgcggccugcacca

SEQ ID NO: 1363647 - RNA, 12 nt, Mycobacterium tuberculosis H37Rv
cgggcgagaucu

SEQ ID NO: 1363648 - RNA, 16 nt, Mycobacterium tuberculosis H37Rv
cgggcgaugagcgcga

SEQ ID NO: 1363649 - RNA, 21 nt, Mycobacterium tuberculosis H37Rv
cgggcgcaccaagacgccacc

SEQ ID NO: 1363650 - RNA, 19 nt, Mycobacterium tuberculosis H37Rv
cgggcgcaagcagcccggg

SEQ ID NO: 1363651 - RNA, 15 nt, Mycobacterium tuberculosis H37Rv
cgggcgcgucggcgu

SEQ ID NO: 1363652 - RNA, 16 nt, Mycobacterium tuberculosis H37Rv
cgggcgcggguggcgc

SEQ ID NO: 1363653 - RNA, 22 nt, Mycobacterium tuberculosis H37Rv
cgggcgcgcuuuccucaccagc

SEQ ID NO: 1363654 - RNA, 20 nt, Mycobacterium tuberculosis H37Rv
cgggcgcgccggccaugccu

SEQ ID NO: 1363655 - RNA, 22 nt, Mycobacterium tuberculosis H37Rv
cgggcgccuuggucgccgccuu

SEQ ID NO: 1363656 - RNA, 22 nt, Mycobacterium tuberculosis H37Rv
cgggcgccggaacgagcggccg

SEQ ID NO: 1363657 - RNA, 19 nt, Mycobacterium tuberculosis H37Rv
cgggcgccgguuacccgga

SEQ ID NO: 1363658 - RNA, 16 nt, Mycobacterium tuberculosis H37Rv
cgggcgccccaccggc

SEQ ID NO: 1363659 - RNA, 13 nt, Mycobacterium tuberculosis H37Rv
cgggcgccccacc

SEQ ID NO: 1363660 - RNA, 17 nt, Mycobacterium tuberculosis H37Rv
cgggauggacaccaccu

SEQ ID NO: 1363661 - RNA, 13 nt, Mycobacterium tuberculosis H37Rv
cgggauggacagc

SEQ ID NO: 1363662 - RNA, 17 nt, Mycobacterium tuberculosis H37Rv
cgggauggacagcuguu

SEQ ID NO: 1363663 - RNA, 20 nt, Mycobacterium tuberculosis H37Rv
cgggaugcucgauccacugc

SEQ ID NO: 1363664 - RNA, 14 nt, Mycobacterium tuberculosis H37Rv
cgggaugcucccua

SEQ ID NO: 1363665 - RNA, 18 nt, Mycobacterium tuberculosis H37Rv
cgggaucugcgccgcgcg

SEQ ID NO: 1363666 - RNA, 14 nt, Mycobacterium tuberculosis H37Rv
cgggaucgacccgc

SEQ ID NO: 1363667 - RNA, 15 nt, Mycobacterium tuberculosis H37Rv
cgggaucgacccgcc

SEQ ID NO: 1363668 - RNA, 14 nt, Mycobacterium tuberculosis H37Rv
cgggaggccaccgc

SEQ ID NO: 1363669 - RNA, 20 nt, Mycobacterium tuberculosis H37Rv
cgggagcugccgggaggggu

SEQ ID NO: 1363670 - RNA, 17 nt, Mycobacterium tuberculosis H37Rv
cgggauaacccagcacc

SEQ ID NO: 1363671 - RNA, 14 nt, Mycobacterium tuberculosis H37Rv
cgggauaacccagc

SEQ ID NO: 1363672 - RNA, 18 nt, Mycobacterium tuberculosis H37Rv
cgggauaacccagcacca

SEQ ID NO: 1363673 - RNA, 21 nt, Mycobacterium tuberculosis H37Rv
cgggauaccaauggacacagg

SEQ ID NO: 1363674 - RNA, 19 nt, Mycobacterium tuberculosis H37Rv
cgggauaucgucgacgccc

SEQ ID NO: 1363675 - RNA, 16 nt, Mycobacterium tuberculosis H37Rv
cgggauagccguucgg

SEQ ID NO: 1363676 - RNA, 19 nt, Mycobacterium tuberculosis H37Rv
cgggauccacccagugcca

SEQ ID NO: 1363677 - RNA, 14 nt, Mycobacterium tuberculosis H37Rv
cgggauccaggccc

SEQ ID NO: 1363678 - RNA, 17 nt, Mycobacterium tuberculosis H37Rv
cgggauccaggcccagc

SEQ ID NO: 1363679 - RNA, 19 nt, Mycobacterium tuberculosis H37Rv
cgggaccggggacgcgccc

SEQ ID NO: 1363680 - RNA, 15 nt, Mycobacterium tuberculosis H37Rv
cgggacagcgccggg

SEQ ID NO: 1363681 - RNA, 23 nt, Mycobacterium tuberculosis H37Rv
cgggaccgccccggccaggacau

SEQ ID NO: 1363682 - RNA, 22 nt, Mycobacterium tuberculosis H37Rv
cgggaccgcgaacccgugggcg

SEQ ID NO: 1363683 - RNA, 17 nt, Mycobacterium tuberculosis H37Rv
cgggacggccgccgccg

SEQ ID NO: 1363684 - RNA, 23 nt, Mycobacterium tuberculosis H37Rv
cgggacgccgcccccguggggug

SEQ ID NO: 1363685 - RNA, 22 nt, Mycobacterium tuberculosis H37Rv
cgggagcaccgaccagggccgc

SEQ ID NO: 1363686 - RNA, 14 nt, Mycobacterium tuberculosis H37Rv
cgggagcggcugcg

SEQ ID NO: 1363687 - RNA, 16 nt, Mycobacterium tuberculosis H37Rv
cgggagcccgagcuca

SEQ ID NO: 1363688 - RNA, 15 nt, Mycobacterium tuberculosis H37Rv
cgggacuucccgcga

SEQ ID NO: 1363689 - RNA, 20 nt, Mycobacterium tuberculosis H37Rv
cgggacguuguccaccgcca

SEQ ID NO: 1363690 - RNA, 19 nt, Mycobacterium tuberculosis H37Rv
cgggagacgcugcgcgcca

SEQ ID NO: 1363691 - RNA, 19 nt, Mycobacterium tuberculosis H37Rv
cgggagagugguugcgccc

SEQ ID NO: 1363692 - RNA, 16 nt, Mycobacterium tuberculosis H37Rv
cgggaagucgggccgg

SEQ ID NO: 1363693 - RNA, 23 nt, Mycobacterium tuberculosis H37Rv
cgggaagugauguggcugagcag

SEQ ID NO: 1363694 - RNA, 24 nt, Mycobacterium tuberculosis H37Rv
cgggacaaagccgaacgacagcag

SEQ ID NO: 1363695 - RNA, 21 nt, Mycobacterium tuberculosis H37Rv
cgggaauuucgucggccaugg

SEQ ID NO: 1363696 - RNA, 15 nt, Mycobacterium tuberculosis H37Rv
cgggaauggcgacca

SEQ ID NO: 1363697 - RNA, 22 nt, Mycobacterium tuberculosis H37Rv
cgggaccgaucuuggccaccgc

SEQ ID NO: 1363698 - RNA, 13 nt, Mycobacterium tuberculosis H37Rv
cgggacaccaccg

SEQ ID NO: 1363699 - RNA, 15 nt, Mycobacterium tuberculosis H37Rv
cgggacaaccgggcg

SEQ ID NO: 1363700 - RNA, 16 nt, Mycobacterium tuberculosis H37Rv
cgggacccgggugguc

SEQ ID NO: 1363701 - RNA, 16 nt, Mycobacterium tuberculosis H37Rv
cgggcaacgcagcacg

SEQ ID NO: 1363702 - RNA, 19 nt, Mycobacterium tuberculosis H37Rv
cgggcaaaucaagcacagc

SEQ ID NO: 1363703 - RNA, 18 nt, Mycobacterium tuberculosis H37Rv
cgggcaaccgaugacgcg

SEQ ID NO: 1363704 - RNA, 15 nt, Mycobacterium tuberculosis H37Rv
cgggcaaaucaagca

SEQ ID NO: 1363705 - RNA, 17 nt, Mycobacterium tuberculosis H37Rv
cgggaugugcggcugca

SEQ ID NO: 1363706 - RNA, 19 nt, Mycobacterium tuberculosis H37Rv
cgggaugugcggcugcacc

SEQ ID NO: 1363707 - RNA, 21 nt, Mycobacterium tuberculosis H37Rv
cgggauugccgccaccuuggc

SEQ ID NO: 1363708 - RNA, 15 nt, Mycobacterium tuberculosis H37Rv
cgggcaccgcgcgcu

SEQ ID NO: 1363709 - RNA, 16 nt, Mycobacterium tuberculosis H37Rv
cgggcaccuggucggc

SEQ ID NO: 1363710 - RNA, 21 nt, Mycobacterium tuberculosis H37Rv
cgggcaccaauaccgcacccg

SEQ ID NO: 1363711 - RNA, 15 nt, Mycobacterium tuberculosis H37Rv
cgggcacucagcagg

SEQ ID NO: 1363712 - RNA, 23 nt, Mycobacterium tuberculosis H37Rv
cgggcacguuuacauagaccacc

SEQ ID NO: 1363713 - RNA, 14 nt, Mycobacterium tuberculosis H37Rv
cgggcacgcggcga

SEQ ID NO: 1363714 - RNA, 17 nt, Mycobacterium tuberculosis H37Rv
cgggcaagucgcccagc

SEQ ID NO: 1363715 - RNA, 16 nt, Mycobacterium tuberculosis H37Rv
cgggcaaggcccgguc

SEQ ID NO: 1363716 - RNA, 21 nt, Mycobacterium tuberculosis H37Rv
cgggcacaccgcaccugggcg

SEQ ID NO: 1363717 - RNA, 14 nt, Mycobacterium tuberculosis H37Rv
cgggcaggccgucg

SEQ ID NO: 1363718 - RNA, 15 nt, Mycobacterium tuberculosis H37Rv
cgggcaggccgucga

SEQ ID NO: 1363719 - RNA, 14 nt, Mycobacterium tuberculosis H37Rv
cgggcaguccaggc

SEQ ID NO: 1363720 - RNA, 15 nt, Mycobacterium tuberculosis H37Rv
cgggcaguccaggca

SEQ ID NO: 1363721 - RNA, 15 nt, Mycobacterium tuberculosis H37Rv
cgggcagcugggcag

SEQ ID NO: 1363722 - RNA, 18 nt, Mycobacterium tuberculosis H37Rv
cgggcagcuguucggcca

SEQ ID NO: 1363723 - RNA, 11 nt, Mycobacterium tuberculosis H37Rv
cgggcagcgcg

SEQ ID NO: 1363724 - RNA, 16 nt, Mycobacterium tuberculosis H37Rv
cgggcagauucuucac

SEQ ID NO: 1363725 - RNA, 23 nt, Mycobacterium tuberculosis H37Rv
cgggcagcaacaggcccacggcg

SEQ ID NO: 1363726 - RNA, 11 nt, Mycobacterium tuberculosis H37Rv
cgggcagcacc

SEQ ID NO: 1363727 - RNA, 11 nt, Mycobacterium tuberculosis H37Rv
cgggcagcacu

SEQ ID NO: 1363728 - RNA, 16 nt, Mycobacterium tuberculosis H37Rv
cgggcagccccuccgc

SEQ ID NO: 1363729 - RNA, 17 nt, Mycobacterium tuberculosis H37Rv
cgggcacugugagguca

SEQ ID NO: 1363730 - RNA, 15 nt, Mycobacterium tuberculosis H37Rv
cgggcacugugaggu

SEQ ID NO: 1363731 - RNA, 14 nt, Mycobacterium tuberculosis H37Rv
cgggccacagcaac

SEQ ID NO: 1363732 - RNA, 15 nt, Mycobacterium tuberculosis H37Rv
cgggccaagacggcg

SEQ ID NO: 1363733 - RNA, 18 nt, Mycobacterium tuberculosis H37Rv
cgggccaagacggcgggc

SEQ ID NO: 1363734 - RNA, 20 nt, Mycobacterium tuberculosis H37Rv
cgggccaagacggcgggccc

SEQ ID NO: 1363735 - RNA, 19 nt, Mycobacterium tuberculosis H37Rv
cgggcauggucgccggaga

SEQ ID NO: 1363736 - RNA, 14 nt, Mycobacterium tuberculosis H37Rv
cgggcaugccggcg

SEQ ID NO: 1363737 - RNA, 16 nt, Mycobacterium tuberculosis H37Rv
cgggcauggucgccgg

SEQ ID NO: 1363738 - RNA, 23 nt, Mycobacterium tuberculosis H37Rv
cgggcaugauccccguugaccca

SEQ ID NO: 1363739 - RNA, 20 nt, Mycobacterium tuberculosis H37Rv
cgggcauaacccgcaccggg

SEQ ID NO: 1363740 - RNA, 20 nt, Mycobacterium tuberculosis H37Rv
cgggcaguuuguucgcgaag

SEQ ID NO: 1363741 - RNA, 23 nt, Mycobacterium tuberculosis H37Rv
cgggcaguuguugacagacacag

SEQ ID NO: 1363742 - RNA, 11 nt, Mycobacterium tuberculosis H37Rv
cgggcagguag

SEQ ID NO: 1363743 - RNA, 18 nt, Mycobacterium tuberculosis H37Rv
cgggcagguaggucuggg

SEQ ID NO: 1363744 - RNA, 19 nt, Mycobacterium tuberculosis H37Rv
cgggcagguaggucugggc

SEQ ID NO: 1363745 - RNA, 23 nt, Mycobacterium tuberculosis H37Rv
cggucggucaccauggcgccgcg

SEQ ID NO: 1363746 - RNA, 23 nt, Mycobacterium tuberculosis H37Rv
cggucggccauugcccgggcggg

SEQ ID NO: 1363747 - RNA, 13 nt, Mycobacterium tuberculosis H37Rv
cggucggccacca

SEQ ID NO: 1363748 - RNA, 15 nt, Mycobacterium tuberculosis H37Rv
cggucggccaccaac

SEQ ID NO: 1363749 - RNA, 18 nt, Mycobacterium tuberculosis H37Rv
cggucggccauccaccgc

SEQ ID NO: 1363750 - RNA, 16 nt, Mycobacterium tuberculosis H37Rv
cggucguuggucgggg

SEQ ID NO: 1363751 - RNA, 18 nt, Mycobacterium tuberculosis H37Rv
cggucguuggugcagacc

SEQ ID NO: 1363752 - RNA, 16 nt, Mycobacterium tuberculosis H37Rv
cggucuacgccaccga

SEQ ID NO: 1363753 - RNA, 14 nt, Mycobacterium tuberculosis H37Rv
cggucggugagccg

SEQ ID NO: 1363754 - RNA, 16 nt, Mycobacterium tuberculosis H37Rv
cggucgugaucagcag

SEQ ID NO: 1363755 - RNA, 17 nt, Mycobacterium tuberculosis H37Rv
cggucgguguagcaacg

SEQ ID NO: 1363756 - RNA, 20 nt, Mycobacterium tuberculosis H37Rv
cggucgguguggacugggcc

SEQ ID NO: 1363757 - RNA, 23 nt, Mycobacterium tuberculosis H37Rv
cggucugaugguggacagcaauu

SEQ ID NO: 1363758 - RNA, 19 nt, Mycobacterium tuberculosis H37Rv
cggucuugggcgcgggugc

SEQ ID NO: 1363759 - RNA, 21 nt, Mycobacterium tuberculosis H37Rv
cggucuuggcgauccaggcca

SEQ ID NO: 1363760 - RNA, 18 nt, Mycobacterium tuberculosis H37Rv
cggugaaaaaggcgacuc

SEQ ID NO: 1363761 - RNA, 21 nt, Mycobacterium tuberculosis H37Rv
cggucuggacaucggccggcg

SEQ ID NO: 1363762 - RNA, 23 nt, Mycobacterium tuberculosis H37Rv
cggucugcgccuucgccagcggc

SEQ ID NO: 1363763 - RNA, 21 nt, Mycobacterium tuberculosis H37Rv
cggucugguugggccagcucc

SEQ ID NO: 1363764 - RNA, 17 nt, Mycobacterium tuberculosis H37Rv
cggucucauagugcagg

SEQ ID NO: 1363765 - RNA, 21 nt, Mycobacterium tuberculosis H37Rv
cggucuccgcccgcgggcccc

SEQ ID NO: 1363766 - RNA, 18 nt, Mycobacterium tuberculosis H37Rv
cggucucaugcacccggu

SEQ ID NO: 1363767 - RNA, 22 nt, Mycobacterium tuberculosis H37Rv
cggucucgucgcggguccaggc

SEQ ID NO: 1363768 - RNA, 19 nt, Mycobacterium tuberculosis H37Rv
cggugacgaaacagagcgu

SEQ ID NO: 1363769 - RNA, 14 nt, Mycobacterium tuberculosis H37Rv
cggugacccccgag

SEQ ID NO: 1363770 - RNA, 20 nt, Mycobacterium tuberculosis H37Rv
cggugacgaagagcaccgcg

SEQ ID NO: 1363771 - RNA, 14 nt, Mycobacterium tuberculosis H37Rv
cggugacgccagcc

SEQ ID NO: 1363772 - RNA, 17 nt, Mycobacterium tuberculosis H37Rv
cggugacgccagccugg

SEQ ID NO: 1363773 - RNA, 22 nt, Mycobacterium tuberculosis H37Rv
cggugacgucgccgggcggcgg

SEQ ID NO: 1363774 - RNA, 17 nt, Mycobacterium tuberculosis H37Rv
cggugacuucacucguu

SEQ ID NO: 1363775 - RNA, 15 nt, Mycobacterium tuberculosis H37Rv
cggugaggaagcggc

SEQ ID NO: 1363776 - RNA, 16 nt, Mycobacterium tuberculosis H37Rv
cggugaggucgaugcc

SEQ ID NO: 1363777 - RNA, 16 nt, Mycobacterium tuberculosis H37Rv
cggugaguccgcugag

SEQ ID NO: 1363778 - RNA, 14 nt, Mycobacterium tuberculosis H37Rv
cggugagccgggcg

SEQ ID NO: 1363779 - RNA, 16 nt, Mycobacterium tuberculosis H37Rv
cggugagaagaagccc

SEQ ID NO: 1363780 - RNA, 17 nt, Mycobacterium tuberculosis H37Rv
cggugaacggcagcacg

SEQ ID NO: 1363781 - RNA, 17 nt, Mycobacterium tuberculosis H37Rv
cggugaacgccgccccg

SEQ ID NO: 1363782 - RNA, 14 nt, Mycobacterium tuberculosis H37Rv
cggugaauucacga

SEQ ID NO: 1363783 - RNA, 19 nt, Mycobacterium tuberculosis H37Rv
cggugaaggucaccgucga

SEQ ID NO: 1363784 - RNA, 17 nt, Mycobacterium tuberculosis H37Rv
cggugaacgguagcacu

SEQ ID NO: 1363785 - RNA, 15 nt, Mycobacterium tuberculosis H37Rv
cggugacccccgaga

SEQ ID NO: 1363786 - RNA, 19 nt, Mycobacterium tuberculosis H37Rv
cggugaccaccccggccaa

SEQ ID NO: 1363787 - RNA, 22 nt, Mycobacterium tuberculosis H37Rv
cggugaccgugaacggcucggg

SEQ ID NO: 1363788 - RNA, 19 nt, Mycobacterium tuberculosis H37Rv
cggugaccucaccaaccgc

SEQ ID NO: 1363789 - RNA, 17 nt, Mycobacterium tuberculosis H37Rv
cgguccggcccaccagc

SEQ ID NO: 1363790 - RNA, 17 nt, Mycobacterium tuberculosis H37Rv
cggucgaugccgaugcg

SEQ ID NO: 1363791 - RNA, 21 nt, Mycobacterium tuberculosis H37Rv
cggucgauguccgcagcaccg

SEQ ID NO: 1363792 - RNA, 20 nt, Mycobacterium tuberculosis H37Rv
cggucgacuccagcaccagc

SEQ ID NO: 1363793 - RNA, 21 nt, Mycobacterium tuberculosis H37Rv
cggucgagcuucaucccggag

SEQ ID NO: 1363794 - RNA, 20 nt, Mycobacterium tuberculosis H37Rv
cggucgagccagcggagcag

SEQ ID NO: 1363795 - RNA, 13 nt, Mycobacterium tuberculosis H37Rv
cggucgacuccag

SEQ ID NO: 1363796 - RNA, 15 nt, Mycobacterium tuberculosis H37Rv
cggucgcggcugaca

SEQ ID NO: 1363797 - RNA, 17 nt, Mycobacterium tuberculosis H37Rv
cggucggcagaccgacc

SEQ ID NO: 1363798 - RNA, 15 nt, Mycobacterium tuberculosis H37Rv
cggucggcagcuggg

SEQ ID NO: 1363799 - RNA, 19 nt, Mycobacterium tuberculosis H37Rv
cggucgcucgacgaccacg

SEQ ID NO: 1363800 - RNA, 22 nt, Mycobacterium tuberculosis H37Rv
cggucgccucgcuaacucccca

SEQ ID NO: 1363801 - RNA, 22 nt, Mycobacterium tuberculosis H37Rv
cggucgcguaccgguggaaacc

SEQ ID NO: 1363802 - RNA, 20 nt, Mycobacterium tuberculosis H37Rv
cggucgcccgcuaccaacgc

SEQ ID NO: 1363803 - RNA, 22 nt, Mycobacterium tuberculosis H37Rv
cggucgccucaccggcgcgagc

SEQ ID NO: 1363804 - RNA, 20 nt, Mycobacterium tuberculosis H37Rv
cggucgccaccgccggcagc

SEQ ID NO: 1363805 - RNA, 14 nt, Mycobacterium tuberculosis H37Rv
cggucgccaccgug

SEQ ID NO: 1363806 - RNA, 20 nt, Mycobacterium tuberculosis H37Rv
cgguccaucccgagcuccgc

SEQ ID NO: 1363807 - RNA, 16 nt, Mycobacterium tuberculosis H37Rv
cggucccacggccggc

SEQ ID NO: 1363808 - RNA, 19 nt, Mycobacterium tuberculosis H37Rv
cggucccacugccggugcu

SEQ ID NO: 1363809 - RNA, 22 nt, Mycobacterium tuberculosis H37Rv
cggucccaugugcccgcacccg

SEQ ID NO: 1363810 - RNA, 20 nt, Mycobacterium tuberculosis H37Rv
cgguccccgcagcucgacca

SEQ ID NO: 1363811 - RNA, 17 nt, Mycobacterium tuberculosis H37Rv
cgguccgccacggcggg

SEQ ID NO: 1363812 - RNA, 19 nt, Mycobacterium tuberculosis H37Rv
cgguccacugucagcgauc

SEQ ID NO: 1363813 - RNA, 19 nt, Mycobacterium tuberculosis H37Rv
cgguccaccgccucacugg

SEQ ID NO: 1363814 - RNA, 13 nt, Mycobacterium tuberculosis H37Rv
cgguccagcagcu

SEQ ID NO: 1363815 - RNA, 23 nt, Mycobacterium tuberculosis H37Rv
cgguccagcagcucggccgaggc

SEQ ID NO: 1363816 - RNA, 15 nt, Mycobacterium tuberculosis H37Rv
cgguccagccaccgc

SEQ ID NO: 1363817 - RNA, 22 nt, Mycobacterium tuberculosis H37Rv
cggucagcucggcagcaucucc

SEQ ID NO: 1363818 - RNA, 17 nt, Mycobacterium tuberculosis H37Rv
cggucagcucgcugacg

SEQ ID NO: 1363819 - RNA, 20 nt, Mycobacterium tuberculosis H37Rv
cggucaggauggggaccacu

SEQ ID NO: 1363820 - RNA, 17 nt, Mycobacterium tuberculosis H37Rv
cggucaguauggcgacg

SEQ ID NO: 1363821 - RNA, 18 nt, Mycobacterium tuberculosis H37Rv
cggucaggucugacagac

SEQ ID NO: 1363822 - RNA, 20 nt, Mycobacterium tuberculosis H37Rv
cggucaggccgccgcggcga

SEQ ID NO: 1363823 - RNA, 15 nt, Mycobacterium tuberculosis H37Rv
cggucauccgggcga

SEQ ID NO: 1363824 - RNA, 22 nt, Mycobacterium tuberculosis H37Rv
cggucauccgggcgaccaccac

SEQ ID NO: 1363825 - RNA, 15 nt, Mycobacterium tuberculosis H37Rv
cgguaaccacgcgga

SEQ ID NO: 1363826 - RNA, 17 nt, Mycobacterium tuberculosis H37Rv
cgguaauacaggugcag

SEQ ID NO: 1363827 - RNA, 19 nt, Mycobacterium tuberculosis H37Rv
cgguaauggcgugcagacc

SEQ ID NO: 1363828 - RNA, 15 nt, Mycobacterium tuberculosis H37Rv
cgguaccaccggcac

SEQ ID NO: 1363829 - RNA, 21 nt, Mycobacterium tuberculosis H37Rv
cgguaccaucaccgcgccagc

SEQ ID NO: 1363830 - RNA, 23 nt, Mycobacterium tuberculosis H37Rv
cgguacccgauguccuauuugca

SEQ ID NO: 1363831 - RNA, 16 nt, Mycobacterium tuberculosis H37Rv
cgguacccguagcacc

SEQ ID NO: 1363832 - RNA, 18 nt, Mycobacterium tuberculosis H37Rv
cgguaccgaucagcaggg

SEQ ID NO: 1363833 - RNA, 20 nt, Mycobacterium tuberculosis H37Rv
cgguacccaccucccgcagc

SEQ ID NO: 1363834 - RNA, 12 nt, Mycobacterium tuberculosis H37Rv
cgguacgcaacc

SEQ ID NO: 1363835 - RNA, 18 nt, Mycobacterium tuberculosis H37Rv
cgguacgcaaccaaccgu

SEQ ID NO: 1363836 - RNA, 15 nt, Mycobacterium tuberculosis H37Rv
cgguaccgccggcuc

SEQ ID NO: 1363837 - RNA, 18 nt, Mycobacterium tuberculosis H37Rv
cgguagacaagucggcgc

SEQ ID NO: 1363838 - RNA, 18 nt, Mycobacterium tuberculosis H37Rv
cgguagcacagcagcaac

SEQ ID NO: 1363839 - RNA, 14 nt, Mycobacterium tuberculosis H37Rv
cgguacugagccgc

SEQ ID NO: 1363840 - RNA, 17 nt, Mycobacterium tuberculosis H37Rv
cgguacugcgcagcgcc

SEQ ID NO: 1363841 - RNA, 17 nt, Mycobacterium tuberculosis H37Rv
cgguagcucgucgagga

SEQ ID NO: 1363842 - RNA, 20 nt, Mycobacterium tuberculosis H37Rv
cgguagcgauuccaggaugg

SEQ ID NO: 1363843 - RNA, 15 nt, Mycobacterium tuberculosis H37Rv
cgguagccgaccagc

SEQ ID NO: 1363844 - RNA, 19 nt, Mycobacterium tuberculosis H37Rv
cgguaggccaucugcucgc

SEQ ID NO: 1363845 - RNA, 15 nt, Mycobacterium tuberculosis H37Rv
cgguaggggugaucc

SEQ ID NO: 1363846 - RNA, 19 nt, Mycobacterium tuberculosis H37Rv
cgguaucgagggcagccgc

SEQ ID NO: 1363847 - RNA, 17 nt, Mycobacterium tuberculosis H37Rv
cgguaucggcagauggu

SEQ ID NO: 1363848 - RNA, 18 nt, Mycobacterium tuberculosis H37Rv
cgguaucggcgaccagcu

SEQ ID NO: 1363849 - RNA, 19 nt, Mycobacterium tuberculosis H37Rv
cgguaucccccagccgcgg

SEQ ID NO: 1363850 - RNA, 16 nt, Mycobacterium tuberculosis H37Rv
cgguaguacuagcacg

SEQ ID NO: 1363851 - RNA, 17 nt, Mycobacterium tuberculosis H37Rv
cgguauacucggccccg

SEQ ID NO: 1363852 - RNA, 17 nt, Mycobacterium tuberculosis H37Rv
cggucaagccggcgccc

SEQ ID NO: 1363853 - RNA, 12 nt, Mycobacterium tuberculosis H37Rv
cggucaccaccg

SEQ ID NO: 1363854 - RNA, 23 nt, Mycobacterium tuberculosis H37Rv
cggucaccauggcgccgcgccga

SEQ ID NO: 1363855 - RNA, 19 nt, Mycobacterium tuberculosis H37Rv
cggucacacgccagccggu

SEQ ID NO: 1363856 - RNA, 23 nt, Mycobacterium tuberculosis H37Rv
cggucaaugccacuaggaaggug

SEQ ID NO: 1363857 - RNA, 22 nt, Mycobacterium tuberculosis H37Rv
cggucaauucggugcgcuggcg

SEQ ID NO: 1363858 - RNA, 24 nt, Mycobacterium tuberculosis H37Rv
cggucaagccggcgcccgccgcga

SEQ ID NO: 1363859 - RNA, 18 nt, Mycobacterium tuberculosis H37Rv
cggucaaauccagcagcc

SEQ ID NO: 1363860 - RNA, 19 nt, Mycobacterium tuberculosis H37Rv
cggucaaacgcgcgcgcca

SEQ ID NO: 1363861 - RNA, 15 nt, Mycobacterium tuberculosis H37Rv
cggucaaacgcgcgc

SEQ ID NO: 1363862 - RNA, 22 nt, Mycobacterium tuberculosis H37Rv
cgguauuugaacgcccgcuuca

SEQ ID NO: 1363863 - RNA, 18 nt, Mycobacterium tuberculosis H37Rv
cggucaccgacgcagaac

SEQ ID NO: 1363864 - RNA, 14 nt, Mycobacterium tuberculosis H37Rv
cggucaccgcgcag

SEQ ID NO: 1363865 - RNA, 21 nt, Mycobacterium tuberculosis H37Rv
cggucaccgacaauucaacac

SEQ ID NO: 1363866 - RNA, 17 nt, Mycobacterium tuberculosis H37Rv
cggucaccgacgcagaa

SEQ ID NO: 1363867 - RNA, 15 nt, Mycobacterium tuberculosis H37Rv
cggucaccgcgcagc

SEQ ID NO: 1363868 - RNA, 15 nt, Mycobacterium tuberculosis H37Rv
cggucaccgcggcau

SEQ ID NO: 1363869 - RNA, 16 nt, Mycobacterium tuberculosis H37Rv
cggucagagccgucga

SEQ ID NO: 1363870 - RNA, 18 nt, Mycobacterium tuberculosis H37Rv
cggucagaugcgccgcug

SEQ ID NO: 1363871 - RNA, 13 nt, Mycobacterium tuberculosis H37Rv
cggucagauggcc

SEQ ID NO: 1363872 - RNA, 15 nt, Mycobacterium tuberculosis H37Rv
cggucagauggccac

SEQ ID NO: 1363873 - RNA, 23 nt, Mycobacterium tuberculosis H37Rv
cggucagauguuguacggcccgc

SEQ ID NO: 1363874 - RNA, 22 nt, Mycobacterium tuberculosis H37Rv
cggucagcacgcugaccacaac

SEQ ID NO: 1363875 - RNA, 22 nt, Mycobacterium tuberculosis H37Rv
cggucagcgcggcgcacaaccc

SEQ ID NO: 1363876 - RNA, 17 nt, Mycobacterium tuberculosis H37Rv
cggucagcggccaaccc

SEQ ID NO: 1363877 - RNA, 22 nt, Mycobacterium tuberculosis H37Rv
cggucagcgggcacgccgccga

SEQ ID NO: 1363878 - RNA, 18 nt, Mycobacterium tuberculosis H37Rv
cggucagcggauccaggc

SEQ ID NO: 1363879 - RNA, 13 nt, Mycobacterium tuberculosis H37Rv
aaacuaccgaaca

SEQ ID NO: 1363880 - RNA, 18 nt, Mycobacterium tuberculosis H37Rv
cggguagugcacggacag

SEQ ID NO: 1363881 - RNA, 22 nt, Mycobacterium tuberculosis H37Rv
cggguagauguucacgccgccg

SEQ ID NO: 1363882 - RNA, 14 nt, Mycobacterium tuberculosis H37Rv
cggguagcucccug

SEQ ID NO: 1363883 - RNA, 13 nt, Mycobacterium tuberculosis H37Rv
cggguaggugacg

SEQ ID NO: 1363884 - RNA, 19 nt, Mycobacterium tuberculosis H37Rv
cggguagaaccagcccggc

SEQ ID NO: 1363885 - RNA, 18 nt, Mycobacterium tuberculosis H37Rv
cgggucagcucgaccuga

SEQ ID NO: 1363886 - RNA, 23 nt, Mycobacterium tuberculosis H37Rv
cgggucauccgugucgagaucuc

SEQ ID NO: 1363887 - RNA, 20 nt, Mycobacterium tuberculosis H37Rv
cgggucaacgccaucacccc

SEQ ID NO: 1363888 - RNA, 20 nt, Mycobacterium tuberculosis H37Rv
cgggucagcaccaccagcag

SEQ ID NO: 1363889 - RNA, 19 nt, Mycobacterium tuberculosis H37Rv
cggguccgaaguacuggcc

SEQ ID NO: 1363890 - RNA, 16 nt, Mycobacterium tuberculosis H37Rv
cggguccgccgggccc

SEQ ID NO: 1363891 - RNA, 19 nt, Mycobacterium tuberculosis H37Rv
cggguccagcggccgccgc

SEQ ID NO: 1363892 - RNA, 19 nt, Mycobacterium tuberculosis H37Rv
cggguccaucaaccccagc

SEQ ID NO: 1363893 - RNA, 14 nt, Mycobacterium tuberculosis H37Rv
cgggucgccgccau

SEQ ID NO: 1363894 - RNA, 22 nt, Mycobacterium tuberculosis H37Rv
cgggugauggaugggucgaccg

SEQ ID NO: 1363895 - RNA, 23 nt, Mycobacterium tuberculosis H37Rv
cgggugcagcacggcgccgccac

SEQ ID NO: 1363896 - RNA, 20 nt, Mycobacterium tuberculosis H37Rv
cgggugcagaucgccccagc

SEQ ID NO: 1363897 - RNA, 15 nt, Mycobacterium tuberculosis H37Rv
cgggugcagccagau

SEQ ID NO: 1363898 - RNA, 17 nt, Mycobacterium tuberculosis H37Rv
cgggugccgacucggcc

SEQ ID NO: 1363899 - RNA, 14 nt, Mycobacterium tuberculosis H37Rv
cgggucucgcgagc

SEQ ID NO: 1363900 - RNA, 13 nt, Mycobacterium tuberculosis H37Rv
cgggugagcaccc

SEQ ID NO: 1363901 - RNA, 16 nt, Mycobacterium tuberculosis H37Rv
cgggugagcacccagc

SEQ ID NO: 1363902 - RNA, 18 nt, Mycobacterium tuberculosis H37Rv
cgggugagcacccagcgg

SEQ ID NO: 1363903 - RNA, 23 nt, Mycobacterium tuberculosis H37Rv
cgggugaccaggcggcgcggguc

SEQ ID NO: 1363904 - RNA, 23 nt, Mycobacterium tuberculosis H37Rv
cgggugacccgugcggccacggu

SEQ ID NO: 1363905 - RNA, 20 nt, Mycobacterium tuberculosis H37Rv
cgggucggcggugccgugug

SEQ ID NO: 1363906 - RNA, 19 nt, Mycobacterium tuberculosis H37Rv
cgggucggcggccuccgcg

SEQ ID NO: 1363907 - RNA, 20 nt, Mycobacterium tuberculosis H37Rv
cgggucgggcaccgcgcgcu

SEQ ID NO: 1363908 - RNA, 15 nt, Mycobacterium tuberculosis H37Rv
cgggucgggcaccgc

SEQ ID NO: 1363909 - RNA, 22 nt, Mycobacterium tuberculosis H37Rv
cgggucggcacgacccgggaag

SEQ ID NO: 1363910 - RNA, 22 nt, Mycobacterium tuberculosis H37Rv
cgggucgcgggguaggcccagc

SEQ ID NO: 1363911 - RNA, 14 nt, Mycobacterium tuberculosis H37Rv
cgggucgcgggugc

SEQ ID NO: 1363912 - RNA, 16 nt, Mycobacterium tuberculosis H37Rv
cgggucggcacgaccc

SEQ ID NO: 1363913 - RNA, 23 nt, Mycobacterium tuberculosis H37Rv
cgggucgcggcuauggcgccgcg

SEQ ID NO: 1363914 - RNA, 15 nt, Mycobacterium tuberculosis H37Rv
cgggucuccggcgca

SEQ ID NO: 1363915 - RNA, 20 nt, Mycobacterium tuberculosis H37Rv
cgggucguucuccgcgccgc

SEQ ID NO: 1363916 - RNA, 21 nt, Mycobacterium tuberculosis H37Rv
cgggucgucauacagcgcccu

SEQ ID NO: 1363917 - RNA, 22 nt, Mycobacterium tuberculosis H37Rv
cgggucgguuuccuccggcagc

SEQ ID NO: 1363918 - RNA, 16 nt, Mycobacterium tuberculosis H37Rv
cgggucgucauacagc

SEQ ID NO: 1363919 - RNA, 19 nt, Mycobacterium tuberculosis H37Rv
cgggugggagcagccgaac

SEQ ID NO: 1363920 - RNA, 23 nt, Mycobacterium tuberculosis H37Rv
cggguggugccaggucggcgggc

SEQ ID NO: 1363921 - RNA, 17 nt, Mycobacterium tuberculosis H37Rv
cggguggcgaggcagca

SEQ ID NO: 1363922 - RNA, 23 nt, Mycobacterium tuberculosis H37Rv
cggguggcgccaggucggcgggc

SEQ ID NO: 1363923 - RNA, 23 nt, Mycobacterium tuberculosis H37Rv
cggguggcgccaguucggcgggc

SEQ ID NO: 1363924 - RNA, 19 nt, Mycobacterium tuberculosis H37Rv
cggguggaguuggcugccg

SEQ ID NO: 1363925 - RNA, 20 nt, Mycobacterium tuberculosis H37Rv
cggguggccaucaccgcgcu

SEQ ID NO: 1363926 - RNA, 14 nt, Mycobacterium tuberculosis H37Rv
cgggugccagcccg

SEQ ID NO: 1363927 - RNA, 22 nt, Mycobacterium tuberculosis H37Rv
cgggugcgccacaaccguugcu

SEQ ID NO: 1363928 - RNA, 15 nt, Mycobacterium tuberculosis H37Rv
cgggugcgcccggcc

SEQ ID NO: 1363929 - RNA, 22 nt, Mycobacterium tuberculosis H37Rv
cgggugcgccguugccgccguc

SEQ ID NO: 1363930 - RNA, 22 nt, Mycobacterium tuberculosis H37Rv
cgggugcugaugggucaggccg

SEQ ID NO: 1363931 - RNA, 21 nt, Mycobacterium tuberculosis H37Rv
cgggugcgggccgaacacacc

SEQ ID NO: 1363932 - RNA, 19 nt, Mycobacterium tuberculosis H37Rv
cgggugcgggcgugguaac

SEQ ID NO: 1363933 - RNA, 21 nt, Mycobacterium tuberculosis H37Rv
cggguguuccacaccaggccg

SEQ ID NO: 1363934 - RNA, 17 nt, Mycobacterium tuberculosis H37Rv
cggguguuccacaccag

SEQ ID NO: 1363935 - RNA, 15 nt, Mycobacterium tuberculosis H37Rv
cgggugucgggcgcg

SEQ ID NO: 1363936 - RNA, 13 nt, Mycobacterium tuberculosis H37Rv
cgggugucgggcg

SEQ ID NO: 1363937 - RNA, 18 nt, Mycobacterium tuberculosis H37Rv
cgggugucgggcagcaac

SEQ ID NO: 1363938 - RNA, 18 nt, Mycobacterium tuberculosis H37Rv
cggguggugcggccgugg

SEQ ID NO: 1363939 - RNA, 16 nt, Mycobacterium tuberculosis H37Rv
cgggugucgggcagca

SEQ ID NO: 1363940 - RNA, 20 nt, Mycobacterium tuberculosis H37Rv
cggguuccgaucucaagggc

SEQ ID NO: 1363941 - RNA, 16 nt, Mycobacterium tuberculosis H37Rv
cggguuaucggcagca

SEQ ID NO: 1363942 - RNA, 22 nt, Mycobacterium tuberculosis H37Rv
cggguucaacgcgcgcacgcca

SEQ ID NO: 1363943 - RNA, 20 nt, Mycobacterium tuberculosis H37Rv
cggguucacuuccgggcagc

SEQ ID NO: 1363944 - RNA, 14 nt, Mycobacterium tuberculosis H37Rv
cggguugcgacgaa

SEQ ID NO: 1363945 - RNA, 18 nt, Mycobacterium tuberculosis H37Rv
cggguuggaagccgcacc

SEQ ID NO: 1363946 - RNA, 13 nt, Mycobacterium tuberculosis H37Rv
cggguugcagcag

SEQ ID NO: 1363947 - RNA, 15 nt, Mycobacterium tuberculosis H37Rv
cggguugcagcagca

SEQ ID NO: 1363948 - RNA, 15 nt, Mycobacterium tuberculosis H37Rv
cggguuggcgacgau

SEQ ID NO: 1363949 - RNA, 15 nt, Mycobacterium tuberculosis H37Rv
cggguuggccgggcu

SEQ ID NO: 1363950 - RNA, 23 nt, Mycobacterium tuberculosis H37Rv
cggguugggcaucaggccgcgcg

SEQ ID NO: 1363951 - RNA, 17 nt, Mycobacterium tuberculosis H37Rv
cggguuugaucagcucg

SEQ ID NO: 1363952 - RNA, 14 nt, Mycobacterium tuberculosis H37Rv
cgguaaagccccgc

SEQ ID NO: 1363953 - RNA, 15 nt, Mycobacterium tuberculosis H37Rv
cgggguggcggcgcu

SEQ ID NO: 1363954 - RNA, 20 nt, Mycobacterium tuberculosis H37Rv
cggggugggaaguagugcau

SEQ ID NO: 1363955 - RNA, 15 nt, Mycobacterium tuberculosis H37Rv
cggggugguggaagg

SEQ ID NO: 1363956 - RNA, 14 nt, Mycobacterium tuberculosis H37Rv
cgggguggcacgca

SEQ ID NO: 1363957 - RNA, 16 nt, Mycobacterium tuberculosis H37Rv
cggggucguugaggcc

SEQ ID NO: 1363958 - RNA, 15 nt, Mycobacterium tuberculosis H37Rv
cggggugcacaccgu

SEQ ID NO: 1363959 - RNA, 21 nt, Mycobacterium tuberculosis H37Rv
cggggugcacaccgucgcgcu

SEQ ID NO: 1363960 - RNA, 14 nt, Mycobacterium tuberculosis H37Rv
cggggugagccgac

SEQ ID NO: 1363961 - RNA, 14 nt, Mycobacterium tuberculosis H37Rv
cgggguccagcggg

SEQ ID NO: 1363962 - RNA, 18 nt, Mycobacterium tuberculosis H37Rv
cgggguccgaugcgugcc

SEQ ID NO: 1363963 - RNA, 18 nt, Mycobacterium tuberculosis H37Rv
cgggguaucgacccucca

SEQ ID NO: 1363964 - RNA, 20 nt, Mycobacterium tuberculosis H37Rv
cgggguaucgacccuccagc

SEQ ID NO: 1363965 - RNA, 17 nt, Mycobacterium tuberculosis H37Rv
cggguaaccggcuccgg

SEQ ID NO: 1363966 - RNA, 23 nt, Mycobacterium tuberculosis H37Rv
cggguacaagacgauucaccaau

SEQ ID NO: 1363967 - RNA, 15 nt, Mycobacterium tuberculosis H37Rv
cggguaccggcggca

SEQ ID NO: 1363968 - RNA, 13 nt, Mycobacterium tuberculosis H37Rv
cggggugcacacc

SEQ ID NO: 1363969 - RNA, 14 nt, Mycobacterium tuberculosis H37Rv
cgggguugggcgga

SEQ ID NO: 1363970 - RNA, 20 nt, Mycobacterium tuberculosis H37Rv
cgggguuggggaacaggccg

SEQ ID NO: 1363971 - RNA, 19 nt, Mycobacterium tuberculosis H37Rv
cgggguugacuggccgccc

SEQ ID NO: 1363972 - RNA, 14 nt, Mycobacterium tuberculosis H37Rv
cgggguugcccgcg

SEQ ID NO: 1363973 - RNA, 15 nt, Mycobacterium tuberculosis H37Rv
cgggguugacuggcc

SEQ ID NO: 1363974 - RNA, 23 nt, Mycobacterium tuberculosis H37Rv
cggggugugcgggcggugcacac

SEQ ID NO: 1363975 - RNA, 16 nt, Mycobacterium tuberculosis H37Rv
cgggguacagacacgc

SEQ ID NO: 1363976 - RNA, 21 nt, Mycobacterium tuberculosis H37Rv
cgggguacagacacgcgcgcu

SEQ ID NO: 1363977 - RNA, 22 nt, Mycobacterium tuberculosis H37Rv
cgggguacagacacgcgcgcuc

SEQ ID NO: 1363978 - RNA, 17 nt, Mycobacterium tuberculosis H37Rv
cggggguugcggcagcu

SEQ ID NO: 1363979 - RNA, 12 nt, Mycobacterium tuberculosis H37Rv
cgggggucgggc

SEQ ID NO: 1363980 - RNA, 17 nt, Mycobacterium tuberculosis H37Rv
cgggggugggcgugacg

SEQ ID NO: 1363981 - RNA, 18 nt, Mycobacterium tuberculosis H37Rv
cgggggcuuaugcgacug

SEQ ID NO: 1363982 - RNA, 20 nt, Mycobacterium tuberculosis H37Rv
cggggggauccagcaggccg

SEQ ID NO: 1363983 - RNA, 15 nt, Mycobacterium tuberculosis H37Rv
cggggggcugcugcu

SEQ ID NO: 1363984 - RNA, 12 nt, Mycobacterium tuberculosis H37Rv
cgggggcgcgcg

SEQ ID NO: 1363985 - RNA, 19 nt, Mycobacterium tuberculosis H37Rv
cggggcgauccccagcacc

SEQ ID NO: 1363986 - RNA, 15 nt, Mycobacterium tuberculosis H37Rv
cggggcgcucgcgcg

SEQ ID NO: 1363987 - RNA, 12 nt, Mycobacterium tuberculosis H37Rv
cgggggaagcgc

SEQ ID NO: 1363988 - RNA, 16 nt, Mycobacterium tuberculosis H37Rv
cgggggaagcgcgucc

SEQ ID NO: 1363989 - RNA, 15 nt, Mycobacterium tuberculosis H37Rv
cggggcugucggcga

SEQ ID NO: 1363990 - RNA, 11 nt, Mycobacterium tuberculosis H37Rv
cggggcugccg

SEQ ID NO: 1363991 - RNA, 12 nt, Mycobacterium tuberculosis H37Rv
cggggcuggggg

SEQ ID NO: 1363992 - RNA, 20 nt, Mycobacterium tuberculosis H37Rv
cggggcugggggccggcagc

SEQ ID NO: 1363993 - RNA, 23 nt, Mycobacterium tuberculosis H37Rv
cggggcucaagucucccggccgc

SEQ ID NO: 1363994 - RNA, 15 nt, Mycobacterium tuberculosis H37Rv
cggggaugucgaccg

SEQ ID NO: 1363995 - RNA, 20 nt, Mycobacterium tuberculosis H37Rv
cggggauaccggucagcacc

SEQ ID NO: 1363996 - RNA, 18 nt, Mycobacterium tuberculosis H37Rv
cggggaguucgcgcagca

SEQ ID NO: 1363997 - RNA, 17 nt, Mycobacterium tuberculosis H37Rv
cggggcaaaggagccgu

SEQ ID NO: 1363998 - RNA, 16 nt, Mycobacterium tuberculosis H37Rv
cggggaccucggcgau

SEQ ID NO: 1363999 - RNA, 21 nt, Mycobacterium tuberculosis H37Rv
cggggacgccgcggcgccggu

SEQ ID NO: 1364000 - RNA, 17 nt, Mycobacterium tuberculosis H37Rv
cggggacgcgccccagu

SEQ ID NO: 1364001 - RNA, 14 nt, Mycobacterium tuberculosis H37Rv
cggggaccacgccg

SEQ ID NO: 1364002 - RNA, 15 nt, Mycobacterium tuberculosis H37Rv
cggggccacccgcag

SEQ ID NO: 1364003 - RNA, 13 nt, Mycobacterium tuberculosis H37Rv
cggggcccacacc

SEQ ID NO: 1364004 - RNA, 17 nt, Mycobacterium tuberculosis H37Rv
cggggcgauccccagca

SEQ ID NO: 1364005 - RNA, 21 nt, Mycobacterium tuberculosis H37Rv
cggggccgccgucgccuccgc

SEQ ID NO: 1364006 - RNA, 22 nt, Mycobacterium tuberculosis H37Rv
cggggccgccgucgccuccgcu

SEQ ID NO: 1364007 - RNA, 16 nt, Mycobacterium tuberculosis H37Rv
cggggccucgcgagaa

SEQ ID NO: 1364008 - RNA, 19 nt, Mycobacterium tuberculosis H37Rv
cggggccgucggcaauacu

SEQ ID NO: 1364009 - RNA, 15 nt, Mycobacterium tuberculosis H37Rv
cggggccgcaaccau

SEQ ID NO: 1364010 - RNA, 15 nt, Mycobacterium tuberculosis H37Rv
cggggccgccgcggc

SEQ ID NO: 1364011 - RNA, 15 nt, Mycobacterium tuberculosis H37Rv
cgggcuggccgacuc

SEQ ID NO: 1364012 - RNA, 15 nt, Mycobacterium tuberculosis H37Rv
cgggcugcggcagua

SEQ ID NO: 1364013 - RNA, 23 nt, Mycobacterium tuberculosis H37Rv
cgggcugccgcaugcgcuccggc

SEQ ID NO: 1364014 - RNA, 21 nt, Mycobacterium tuberculosis H37Rv
cgggcugaggcggcgacgacc

SEQ ID NO: 1364015 - RNA, 20 nt, Mycobacterium tuberculosis H37Rv
cgggcugaucgcccggcgcg

SEQ ID NO: 1364016 - RNA, 21 nt, Mycobacterium tuberculosis H37Rv
cgggcucagacuuucgcccag

SEQ ID NO: 1364017 - RNA, 22 nt, Mycobacterium tuberculosis H37Rv
cgggcuccccggauuccucguc

SEQ ID NO: 1364018 - RNA, 17 nt, Mycobacterium tuberculosis H37Rv
cgggcucgcauguucuc

SEQ ID NO: 1364019 - RNA, 15 nt, Mycobacterium tuberculosis H37Rv
cgggcucgcuucagg

SEQ ID NO: 1364020 - RNA, 16 nt, Mycobacterium tuberculosis H37Rv
cgggcucgcugcacca

SEQ ID NO: 1364021 - RNA, 15 nt, Mycobacterium tuberculosis H37Rv
cgggcucggcgaagg

SEQ ID NO: 1364022 - RNA, 19 nt, Mycobacterium tuberculosis H37Rv
cgggcucggcguugaugaa

SEQ ID NO: 1364023 - RNA, 23 nt, Mycobacterium tuberculosis H37Rv
cgggcucggucccgcuacaccug

SEQ ID NO: 1364024 - RNA, 15 nt, Mycobacterium tuberculosis H37Rv
cgggcucaacaccag

SEQ ID NO: 1364025 - RNA, 16 nt, Mycobacterium tuberculosis H37Rv
cgggcuaccggcagcu

SEQ ID NO: 1364026 - RNA, 16 nt, Mycobacterium tuberculosis H37Rv
cgggcuuaggccgcgg

SEQ ID NO: 1364027 - RNA, 22 nt, Mycobacterium tuberculosis H37Rv
cgggcugugaacagcgcgucgg

SEQ ID NO: 1364028 - RNA, 22 nt, Mycobacterium tuberculosis H37Rv
cgggcugugauccgacaguggc

SEQ ID NO: 1364029 - RNA, 14 nt, Mycobacterium tuberculosis H37Rv
cgggcuggucgguc

SEQ ID NO: 1364030 - RNA, 13 nt, Mycobacterium tuberculosis H37Rv
cgggcuggcgacg

SEQ ID NO: 1364031 - RNA, 15 nt, Mycobacterium tuberculosis H37Rv
cgggcuugcgcagca

SEQ ID NO: 1364032 - RNA, 17 nt, Mycobacterium tuberculosis H37Rv
cgggcuugcgcagcagc

SEQ ID NO: 1364033 - RNA, 20 nt, Mycobacterium tuberculosis H37Rv
cggggaacguccgcgccgag

SEQ ID NO: 1364034 - RNA, 17 nt, Mycobacterium tuberculosis H37Rv
cggggaagcccggcaga

SEQ ID NO: 1364035 - RNA, 22 nt, Mycobacterium tuberculosis H37Rv
cggggaagcccggcagaugcag

SEQ ID NO: 1364036 - RNA, 15 nt, Mycobacterium tuberculosis H37Rv
cgucgaugcgcugcu

SEQ ID NO: 1364037 - RNA, 17 nt, Mycobacterium tuberculosis H37Rv
cgucgauggugcggccc

SEQ ID NO: 1364038 - RNA, 16 nt, Mycobacterium tuberculosis H37Rv
cgucgaucucggcgca

SEQ ID NO: 1364039 - RNA, 21 nt, Mycobacterium tuberculosis H37Rv
cgucgaugccggcugccgcac

SEQ ID NO: 1364040 - RNA, 19 nt, Mycobacterium tuberculosis H37Rv
cgucgagugccgccaccgc

SEQ ID NO: 1364041 - RNA, 18 nt, Mycobacterium tuberculosis H37Rv
cgucgaucagcggcagca

SEQ ID NO: 1364042 - RNA, 24 nt, Mycobacterium tuberculosis H37Rv
cgucgaguagguaacgcgcacgcu

SEQ ID NO: 1364043 - RNA, 16 nt, Mycobacterium tuberculosis H37Rv
cgucgaguagugcagg

SEQ ID NO: 1364044 - RNA, 18 nt, Mycobacterium tuberculosis H37Rv
cgucgagggagcgccgca

SEQ ID NO: 1364045 - RNA, 21 nt, Mycobacterium tuberculosis H37Rv
cgucgaggaagaucaccuccc

SEQ ID NO: 1364046 - RNA, 21 nt, Mycobacterium tuberculosis H37Rv
cgucgaggcugaccguggcgc

SEQ ID NO: 1364047 - RNA, 13 nt, Mycobacterium tuberculosis H37Rv
cgucgacucggcg

SEQ ID NO: 1364048 - RNA, 17 nt, Mycobacterium tuberculosis H37Rv
cgucgacgucguagacc

SEQ ID NO: 1364049 - RNA, 16 nt, Mycobacterium tuberculosis H37Rv
cgucgacgucggcccc

SEQ ID NO: 1364050 - RNA, 19 nt, Mycobacterium tuberculosis H37Rv
cgucgacuugcaggcgucc

SEQ ID NO: 1364051 - RNA, 18 nt, Mycobacterium tuberculosis H37Rv
cgucgacuucagcggccg

SEQ ID NO: 1364052 - RNA, 12 nt, Mycobacterium tuberculosis H37Rv
cgucgacgccga

SEQ ID NO: 1364053 - RNA, 21 nt, Mycobacterium tuberculosis H37Rv
cgucgacggccuggggcagcc

SEQ ID NO: 1364054 - RNA, 22 nt, Mycobacterium tuberculosis H37Rv
cgucgacggccuggggcagccg

SEQ ID NO: 1364055 - RNA, 20 nt, Mycobacterium tuberculosis H37Rv
cgucgacggcgauggcgcgc

SEQ ID NO: 1364056 - RNA, 16 nt, Mycobacterium tuberculosis H37Rv
cgucgacggucuggcc

SEQ ID NO: 1364057 - RNA, 15 nt, Mycobacterium tuberculosis H37Rv
cgucgagcagcgcca

SEQ ID NO: 1364058 - RNA, 15 nt, Mycobacterium tuberculosis H37Rv
cgucgagcagccgcg

SEQ ID NO: 1364059 - RNA, 15 nt, Mycobacterium tuberculosis H37Rv
cgucgagcaccuugg

SEQ ID NO: 1364060 - RNA, 15 nt, Mycobacterium tuberculosis H37Rv
cgucgagcagcacca

SEQ ID NO: 1364061 - RNA, 14 nt, Mycobacterium tuberculosis H37Rv
cgucgagcgcgcca

SEQ ID NO: 1364062 - RNA, 22 nt, Mycobacterium tuberculosis H37Rv
cgucgagcgccuugucgaucuc

SEQ ID NO: 1364063 - RNA, 19 nt, Mycobacterium tuberculosis H37Rv
cgucgagcgcggugccgcc

SEQ ID NO: 1364064 - RNA, 21 nt, Mycobacterium tuberculosis H37Rv
cgucgagcgcggugccgccac

SEQ ID NO: 1364065 - RNA, 14 nt, Mycobacterium tuberculosis H37Rv
cgucgagcgcuccc

SEQ ID NO: 1364066 - RNA, 16 nt, Mycobacterium tuberculosis H37Rv
cgucgagcgcgccacu

SEQ ID NO: 1364067 - RNA, 12 nt, Mycobacterium tuberculosis H37Rv
cgucgagcgcgg

SEQ ID NO: 1364068 - RNA, 16 nt, Mycobacterium tuberculosis H37Rv
cguccucgucuucguc

SEQ ID NO: 1364069 - RNA, 20 nt, Mycobacterium tuberculosis H37Rv
cgucgaacacgucgggaugc

SEQ ID NO: 1364070 - RNA, 15 nt, Mycobacterium tuberculosis H37Rv
cgucgaacagcaccg

SEQ ID NO: 1364071 - RNA, 17 nt, Mycobacterium tuberculosis H37Rv
cguccuugcgcagcacc

SEQ ID NO: 1364072 - RNA, 17 nt, Mycobacterium tuberculosis H37Rv
cgucgaacgguagcacg

SEQ ID NO: 1364073 - RNA, 15 nt, Mycobacterium tuberculosis H37Rv
cguccuuuccaggag

SEQ ID NO: 1364074 - RNA, 16 nt, Mycobacterium tuberculosis H37Rv
cguccucgccgcacgc

SEQ ID NO: 1364075 - RNA, 21 nt, Mycobacterium tuberculosis H37Rv
cgucgacaguucaacgggccu

SEQ ID NO: 1364076 - RNA, 14 nt, Mycobacterium tuberculosis H37Rv
cgucgacacaccca

SEQ ID NO: 1364077 - RNA, 12 nt, Mycobacterium tuberculosis H37Rv
cgucgaccucgc

SEQ ID NO: 1364078 - RNA, 22 nt, Mycobacterium tuberculosis H37Rv
cgucgaccgaacccgacgucgc

SEQ ID NO: 1364079 - RNA, 21 nt, Mycobacterium tuberculosis H37Rv
cgucgaaguuggcgaagcccg

SEQ ID NO: 1364080 - RNA, 22 nt, Mycobacterium tuberculosis H37Rv
cgucgaacuuugucgcgcugcu

SEQ ID NO: 1364081 - RNA, 22 nt, Mycobacterium tuberculosis H37Rv
cgucgacaacgaucgcgcgagc

SEQ ID NO: 1364082 - RNA, 16 nt, Mycobacterium tuberculosis H37Rv
cgucgacaacacgccg

SEQ ID NO: 1364083 - RNA, 24 nt, Mycobacterium tuberculosis H37Rv
cgucgaaucuucugagacugccgc

SEQ ID NO: 1364084 - RNA, 21 nt, Mycobacterium tuberculosis H37Rv
cgucgaaguagccgacgucgc

SEQ ID NO: 1364085 - RNA, 22 nt, Mycobacterium tuberculosis H37Rv
cgucgaagaccucaacccccuu

SEQ ID NO: 1364086 - RNA, 17 nt, Mycobacterium tuberculosis H37Rv
cgucgaacugggcgccc

SEQ ID NO: 1364087 - RNA, 17 nt, Mycobacterium tuberculosis H37Rv
cguccagccguggcggc

SEQ ID NO: 1364088 - RNA, 18 nt, Mycobacterium tuberculosis H37Rv
cguccagcgccgcggccc

SEQ ID NO: 1364089 - RNA, 12 nt, Mycobacterium tuberculosis H37Rv
cguccagcgagc

SEQ ID NO: 1364090 - RNA, 13 nt, Mycobacterium tuberculosis H37Rv
cgucaucaggucg

SEQ ID NO: 1364091 - RNA, 18 nt, Mycobacterium tuberculosis H37Rv
cguccagcgcggccuugg

SEQ ID NO: 1364092 - RNA, 10 nt, Mycobacterium tuberculosis H37Rv
cguccaucag

SEQ ID NO: 1364093 - RNA, 18 nt, Mycobacterium tuberculosis H37Rv
cguccaucccggcgccgc

SEQ ID NO: 1364094 - RNA, 16 nt, Mycobacterium tuberculosis H37Rv
cguccaucgccaccgc

SEQ ID NO: 1364095 - RNA, 18 nt, Mycobacterium tuberculosis H37Rv
cguccaguggcagccagc

SEQ ID NO: 1364096 - RNA, 18 nt, Mycobacterium tuberculosis H37Rv
cguccaggcgcugcagca

SEQ ID NO: 1364097 - RNA, 21 nt, Mycobacterium tuberculosis H37Rv
cguccagggauuaccagugga

SEQ ID NO: 1364098 - RNA, 15 nt, Mycobacterium tuberculosis H37Rv
cguccucgacccggc

SEQ ID NO: 1364099 - RNA, 16 nt, Mycobacterium tuberculosis H37Rv
cguccgguccgucggg

SEQ ID NO: 1364100 - RNA, 20 nt, Mycobacterium tuberculosis H37Rv
cguccggucgccucaccggc

SEQ ID NO: 1364101 - RNA, 21 nt, Mycobacterium tuberculosis H37Rv
cguccucagccgugcccaggc

SEQ ID NO: 1364102 - RNA, 20 nt, Mycobacterium tuberculosis H37Rv
cguccggccgggcccuccac

SEQ ID NO: 1364103 - RNA, 17 nt, Mycobacterium tuberculosis H37Rv
cguccggccacgguccg

SEQ ID NO: 1364104 - RNA, 13 nt, Mycobacterium tuberculosis H37Rv
cguccggcuuggc

SEQ ID NO: 1364105 - RNA, 21 nt, Mycobacterium tuberculosis H37Rv
cguccgcugcagguccagggu

SEQ ID NO: 1364106 - RNA, 14 nt, Mycobacterium tuberculosis H37Rv
cguccccggccgau

SEQ ID NO: 1364107 - RNA, 16 nt, Mycobacterium tuberculosis H37Rv
cguccgcgccgagccc

SEQ ID NO: 1364108 - RNA, 13 nt, Mycobacterium tuberculosis H37Rv
cguccccagaccg

SEQ ID NO: 1364109 - RNA, 19 nt, Mycobacterium tuberculosis H37Rv
cguccccagaccggcggcu

SEQ ID NO: 1364110 - RNA, 13 nt, Mycobacterium tuberculosis H37Rv
cgucccagaaguc

SEQ ID NO: 1364111 - RNA, 20 nt, Mycobacterium tuberculosis H37Rv
cgucccagcgguagccgagc

SEQ ID NO: 1364112 - RNA, 23 nt, Mycobacterium tuberculosis H37Rv
cgucccagcgguagccgagcucg

SEQ ID NO: 1364113 - RNA, 14 nt, Mycobacterium tuberculosis H37Rv
cgucccaggacucc

SEQ ID NO: 1364114 - RNA, 21 nt, Mycobacterium tuberculosis H37Rv
cgucccacagguuugcgccgc

SEQ ID NO: 1364115 - RNA, 14 nt, Mycobacterium tuberculosis H37Rv
cgucacguaauucc

SEQ ID NO: 1364116 - RNA, 18 nt, Mycobacterium tuberculosis H37Rv
cgucacguaauuccccag

SEQ ID NO: 1364117 - RNA, 18 nt, Mycobacterium tuberculosis H37Rv
cgucacggaccuggaacu

SEQ ID NO: 1364118 - RNA, 19 nt, Mycobacterium tuberculosis H37Rv
cgucacgggguccgaugcg

SEQ ID NO: 1364119 - RNA, 12 nt, Mycobacterium tuberculosis H37Rv
cgucacgcgggu

SEQ ID NO: 1364120 - RNA, 17 nt, Mycobacterium tuberculosis H37Rv
cgucacgcgcggcggcg

SEQ ID NO: 1364121 - RNA, 20 nt, Mycobacterium tuberculosis H37Rv
cgucacggacccuuccgccg

SEQ ID NO: 1364122 - RNA, 21 nt, Mycobacterium tuberculosis H37Rv
cgucacggaccgccaccuugg

SEQ ID NO: 1364123 - RNA, 23 nt, Mycobacterium tuberculosis H37Rv
cgucacgcggaaaccaucgccag

SEQ ID NO: 1364124 - RNA, 16 nt, Mycobacterium tuberculosis H37Rv
cgucacguucggcgca

SEQ ID NO: 1364125 - RNA, 20 nt, Mycobacterium tuberculosis H37Rv
cgucacguggucggccaccc

SEQ ID NO: 1364126 - RNA, 21 nt, Mycobacterium tuberculosis H37Rv
cgucacguggucggccacccc

SEQ ID NO: 1364127 - RNA, 16 nt, Mycobacterium tuberculosis H37Rv
cgucagccaccgcaug

SEQ ID NO: 1364128 - RNA, 21 nt, Mycobacterium tuberculosis H37Rv
cgucagccccgacugcgccca

SEQ ID NO: 1364129 - RNA, 19 nt, Mycobacterium tuberculosis H37Rv
cgucaguccucaucgagcg

SEQ ID NO: 1364130 - RNA, 13 nt, Mycobacterium tuberculosis H37Rv
cgucagcgccgcc

SEQ ID NO: 1364131 - RNA, 14 nt, Mycobacterium tuberculosis H37Rv
cgucagcgccgccg

SEQ ID NO: 1364132 - RNA, 22 nt, Mycobacterium tuberculosis H37Rv
cgucagccguucggcuaagccu

SEQ ID NO: 1364133 - RNA, 14 nt, Mycobacterium tuberculosis H37Rv
cgucagcggcggcc

SEQ ID NO: 1364134 - RNA, 18 nt, Mycobacterium tuberculosis H37Rv
cgucagcggcgagcagag

SEQ ID NO: 1364135 - RNA, 19 nt, Mycobacterium tuberculosis H37Rv
cgucagguuccgcgacaac

SEQ ID NO: 1364136 - RNA, 15 nt, Mycobacterium tuberculosis H37Rv
cgucaaggaaggcgu

SEQ ID NO: 1364137 - RNA, 20 nt, Mycobacterium tuberculosis H37Rv
cgucaaucaccaccgccagc

SEQ ID NO: 1364138 - RNA, 15 nt, Mycobacterium tuberculosis H37Rv
cgucaaccugcugca

SEQ ID NO: 1364139 - RNA, 20 nt, Mycobacterium tuberculosis H37Rv
cgucaacgccucugcucagc

SEQ ID NO: 1364140 - RNA, 14 nt, Mycobacterium tuberculosis H37Rv
cgucaacagccagg

SEQ ID NO: 1364141 - RNA, 16 nt, Mycobacterium tuberculosis H37Rv
cgucaaauccagcgag

SEQ ID NO: 1364142 - RNA, 12 nt, Mycobacterium tuberculosis H37Rv
cgucacccccga

SEQ ID NO: 1364143 - RNA, 20 nt, Mycobacterium tuberculosis H37Rv
cgucaccccggucccgccga

SEQ ID NO: 1364144 - RNA, 12 nt, Mycobacterium tuberculosis H37Rv
cgucacgcaacc

SEQ ID NO: 1364145 - RNA, 15 nt, Mycobacterium tuberculosis H37Rv
cgucaccaccgccgc

SEQ ID NO: 1364146 - RNA, 17 nt, Mycobacterium tuberculosis H37Rv
cgucacaaugcccaggc

SEQ ID NO: 1364147 - RNA, 15 nt, Mycobacterium tuberculosis H37Rv
cgucacaccgaugcg

SEQ ID NO: 1364148 - RNA, 18 nt, Mycobacterium tuberculosis H37Rv
cgucacaggccgccuggg

SEQ ID NO: 1364149 - RNA, 14 nt, Mycobacterium tuberculosis H37Rv
cguagugcgcgcca

SEQ ID NO: 1364150 - RNA, 18 nt, Mycobacterium tuberculosis H37Rv
cguaguaguggccgccac

SEQ ID NO: 1364151 - RNA, 17 nt, Mycobacterium tuberculosis H37Rv
cguagugcucgccggca

SEQ ID NO: 1364152 - RNA, 16 nt, Mycobacterium tuberculosis H37Rv
cguaguggaagccgac

SEQ ID NO: 1364153 - RNA, 17 nt, Mycobacterium tuberculosis H37Rv
cguaugccgccaaccgc

SEQ ID NO: 1364154 - RNA, 17 nt, Mycobacterium tuberculosis H37Rv
cgucaaacgacagcccu

SEQ ID NO: 1364155 - RNA, 23 nt, Mycobacterium tuberculosis H37Rv
cgucaaacccgacaucggccagc

SEQ ID NO: 1364156 - RNA, 21 nt, Mycobacterium tuberculosis H37Rv
cguaaggccggagucgacgac

SEQ ID NO: 1364157 - RNA, 15 nt, Mycobacterium tuberculosis H37Rv
cguaaucaagcagcg

SEQ ID NO: 1364158 - RNA, 22 nt, Mycobacterium tuberculosis H37Rv
cguagcgggggagcgaacggcg

SEQ ID NO: 1364159 - RNA, 15 nt, Mycobacterium tuberculosis H37Rv
cguagccguggagca

SEQ ID NO: 1364160 - RNA, 22 nt, Mycobacterium tuberculosis H37Rv
cguagccguggagcacagcacg

SEQ ID NO: 1364161 - RNA, 19 nt, Mycobacterium tuberculosis H37Rv
cguagcgaccgcggucgcu

SEQ ID NO: 1364162 - RNA, 12 nt, Mycobacterium tuberculosis H37Rv
cguagcgcagcg

SEQ ID NO: 1364163 - RNA, 16 nt, Mycobacterium tuberculosis H37Rv
cgguggagggcgagca

SEQ ID NO: 1364164 - RNA, 15 nt, Mycobacterium tuberculosis H37Rv
cgguggacccggcgg

SEQ ID NO: 1364165 - RNA, 22 nt, Mycobacterium tuberculosis H37Rv
cgguggacgagccagaggugga

SEQ ID NO: 1364166 - RNA, 17 nt, Mycobacterium tuberculosis H37Rv
cggugcuguugcgcggu

SEQ ID NO: 1364167 - RNA, 15 nt, Mycobacterium tuberculosis H37Rv
cgguggaaaaagccc

SEQ ID NO: 1364168 - RNA, 16 nt, Mycobacterium tuberculosis H37Rv
cgguggaaacccugca

SEQ ID NO: 1364169 - RNA, 19 nt, Mycobacterium tuberculosis H37Rv
cgguggaagaguuggggca

SEQ ID NO: 1364170 - RNA, 14 nt, Mycobacterium tuberculosis H37Rv
cgguggcagccugc

SEQ ID NO: 1364171 - RNA, 16 nt, Mycobacterium tuberculosis H37Rv
cgguggcagagccgcc

SEQ ID NO: 1364172 - RNA, 13 nt, Mycobacterium tuberculosis H37Rv
cgguggcagcaca

SEQ ID NO: 1364173 - RNA, 15 nt, Mycobacterium tuberculosis H37Rv
cgguggcacggcccc

SEQ ID NO: 1364174 - RNA, 16 nt, Mycobacterium tuberculosis H37Rv
cgguggccacccggcc

SEQ ID NO: 1364175 - RNA, 18 nt, Mycobacterium tuberculosis H37Rv
cgguggccacccggccgc

SEQ ID NO: 1364176 - RNA, 21 nt, Mycobacterium tuberculosis H37Rv
cgguggccaacaccgccagca

SEQ ID NO: 1364177 - RNA, 23 nt, Mycobacterium tuberculosis H37Rv
cgguggccaucgcgcggaccaga

SEQ ID NO: 1364178 - RNA, 20 nt, Mycobacterium tuberculosis H37Rv
cgguggccaucgcgcggacc

SEQ ID NO: 1364179 - RNA, 18 nt, Mycobacterium tuberculosis H37Rv
cgguggcccgccggcagu

SEQ ID NO: 1364180 - RNA, 20 nt, Mycobacterium tuberculosis H37Rv
cgguggcccgccggcaguga

SEQ ID NO: 1364181 - RNA, 21 nt, Mycobacterium tuberculosis H37Rv
cgguggccgcaucgacgcuca

SEQ ID NO: 1364182 - RNA, 17 nt, Mycobacterium tuberculosis H37Rv
cggugggugccagccgg

SEQ ID NO: 1364183 - RNA, 13 nt, Mycobacterium tuberculosis H37Rv
cgguggggcccuc

SEQ ID NO: 1364184 - RNA, 14 nt, Mycobacterium tuberculosis H37Rv
cggugggggcggcg

SEQ ID NO: 1364185 - RNA, 19 nt, Mycobacterium tuberculosis H37Rv
cggugguaacaccggcgag

SEQ ID NO: 1364186 - RNA, 14 nt, Mycobacterium tuberculosis H37Rv
cgguggcggcagca

SEQ ID NO: 1364187 - RNA, 19 nt, Mycobacterium tuberculosis H37Rv
cgguggcgucgucggcggg

SEQ ID NO: 1364188 - RNA, 17 nt, Mycobacterium tuberculosis H37Rv
cgguggcuugccccgcc

SEQ ID NO: 1364189 - RNA, 13 nt, Mycobacterium tuberculosis H37Rv
cggugggcgucau

SEQ ID NO: 1364190 - RNA, 17 nt, Mycobacterium tuberculosis H37Rv
cgguggcggcgagcagc

SEQ ID NO: 1364191 - RNA, 18 nt, Mycobacterium tuberculosis H37Rv
cgguggcggcgagcagca

SEQ ID NO: 1364192 - RNA, 21 nt, Mycobacterium tuberculosis H37Rv
cgguggcgccgaacgccagca

SEQ ID NO: 1364193 - RNA, 22 nt, Mycobacterium tuberculosis H37Rv
cgguggcgagguggucacgcag

SEQ ID NO: 1364194 - RNA, 18 nt, Mycobacterium tuberculosis H37Rv
cgguggcgccggggccgc

SEQ ID NO: 1364195 - RNA, 15 nt, Mycobacterium tuberculosis H37Rv
cgguggcgccgucgg

SEQ ID NO: 1364196 - RNA, 15 nt, Mycobacterium tuberculosis H37Rv
cggugucgccacccg

SEQ ID NO: 1364197 - RNA, 22 nt, Mycobacterium tuberculosis H37Rv
cggugucgacguucaucuucac

SEQ ID NO: 1364198 - RNA, 14 nt, Mycobacterium tuberculosis H37Rv
cggugucggcgccg

SEQ ID NO: 1364199 - RNA, 20 nt, Mycobacterium tuberculosis H37Rv
cggugucgucaucggggccu

SEQ ID NO: 1364200 - RNA, 12 nt, Mycobacterium tuberculosis H37Rv
cgguguugauuc

SEQ ID NO: 1364201 - RNA, 14 nt, Mycobacterium tuberculosis H37Rv
cggugugcggcgca

SEQ ID NO: 1364202 - RNA, 13 nt, Mycobacterium tuberculosis H37Rv
cgguguugcuccc

SEQ ID NO: 1364203 - RNA, 18 nt, Mycobacterium tuberculosis H37Rv
cgguguuuccgaaacccg

SEQ ID NO: 1364204 - RNA, 19 nt, Mycobacterium tuberculosis H37Rv
cgguguagcagcgccagca

SEQ ID NO: 1364205 - RNA, 19 nt, Mycobacterium tuberculosis H37Rv
cgguguacaccgcgcccgc

SEQ ID NO: 1364206 - RNA, 16 nt, Mycobacterium tuberculosis H37Rv
cgguguaacccuggcg

SEQ ID NO: 1364207 - RNA, 17 nt, Mycobacterium tuberculosis H37Rv
cgguguaacccuggcgg

SEQ ID NO: 1364208 - RNA, 16 nt, Mycobacterium tuberculosis H37Rv
cggugguuuggcgcgc

SEQ ID NO: 1364209 - RNA, 19 nt, Mycobacterium tuberculosis H37Rv
cggugguuagguggcuggc

SEQ ID NO: 1364210 - RNA, 17 nt, Mycobacterium tuberculosis H37Rv
cgguggugccgcggcca

SEQ ID NO: 1364211 - RNA, 18 nt, Mycobacterium tuberculosis H37Rv
cgguggugccggcgccgc

SEQ ID NO: 1364212 - RNA, 21 nt, Mycobacterium tuberculosis H37Rv
cgguggucuuggcccggcggu

SEQ ID NO: 1364213 - RNA, 17 nt, Mycobacterium tuberculosis H37Rv
cgguggugaccgcgggc

SEQ ID NO: 1364214 - RNA, 13 nt, Mycobacterium tuberculosis H37Rv
cgguggugcugcc

SEQ ID NO: 1364215 - RNA, 15 nt, Mycobacterium tuberculosis H37Rv
cgguggugggcggga

SEQ ID NO: 1364216 - RNA, 13 nt, Mycobacterium tuberculosis H37Rv
cggugguccuggc

SEQ ID NO: 1364217 - RNA, 16 nt, Mycobacterium tuberculosis H37Rv
cggugguaccggcggc

SEQ ID NO: 1364218 - RNA, 16 nt, Mycobacterium tuberculosis H37Rv
cggugguagcgacgau

SEQ ID NO: 1364219 - RNA, 21 nt, Mycobacterium tuberculosis H37Rv
cgguggucucgacggcgccgc

SEQ ID NO: 1364220 - RNA, 16 nt, Mycobacterium tuberculosis H37Rv
cggugccgaucagcag

SEQ ID NO: 1364221 - RNA, 14 nt, Mycobacterium tuberculosis H37Rv
cggugccgcagcag

SEQ ID NO: 1364222 - RNA, 13 nt, Mycobacterium tuberculosis H37Rv
cggugccgccgcc

SEQ ID NO: 1364223 - RNA, 14 nt, Mycobacterium tuberculosis H37Rv
cggugccgccgccg

SEQ ID NO: 1364224 - RNA, 16 nt, Mycobacterium tuberculosis H37Rv
cggugccgccgccggc

SEQ ID NO: 1364225 - RNA, 13 nt, Mycobacterium tuberculosis H37Rv
cggugccgcccga

SEQ ID NO: 1364226 - RNA, 16 nt, Mycobacterium tuberculosis H37Rv
cggugccgccaccggc

SEQ ID NO: 1364227 - RNA, 21 nt, Mycobacterium tuberculosis H37Rv
cggugccgccggugccgccug

SEQ ID NO: 1364228 - RNA, 18 nt, Mycobacterium tuberculosis H37Rv
cggugccgccguucccac

SEQ ID NO: 1364229 - RNA, 20 nt, Mycobacterium tuberculosis H37Rv
cggugccgccgggugcaacg

SEQ ID NO: 1364230 - RNA, 19 nt, Mycobacterium tuberculosis H37Rv
cggugccgccgcggccacc

SEQ ID NO: 1364231 - RNA, 20 nt, Mycobacterium tuberculosis H37Rv
cggugccgccgcggccacca

SEQ ID NO: 1364232 - RNA, 15 nt, Mycobacterium tuberculosis H37Rv
cggugccgcggacgu

SEQ ID NO: 1364233 - RNA, 15 nt, Mycobacterium tuberculosis H37Rv
cggugccggccaucg

SEQ ID NO: 1364234 - RNA, 19 nt, Mycobacterium tuberculosis H37Rv
cggugccgucagcggcggc

SEQ ID NO: 1364235 - RNA, 21 nt, Mycobacterium tuberculosis H37Rv
cggugccguuggagccgccac

SEQ ID NO: 1364236 - RNA, 17 nt, Mycobacterium tuberculosis H37Rv
cggugcgauccugacca

SEQ ID NO: 1364237 - RNA, 20 nt, Mycobacterium tuberculosis H37Rv
cggugcgcauggacaacagc

SEQ ID NO: 1364238 - RNA, 23 nt, Mycobacterium tuberculosis H37Rv
cggugcgccacgaccgcggcggc

SEQ ID NO: 1364239 - RNA, 14 nt, Mycobacterium tuberculosis H37Rv
cggugcgcgcagac

SEQ ID NO: 1364240 - RNA, 13 nt, Mycobacterium tuberculosis H37Rv
cggugcgcgcaga

SEQ ID NO: 1364241 - RNA, 20 nt, Mycobacterium tuberculosis H37Rv
cggugcggaacaccgcccgg

SEQ ID NO: 1364242 - RNA, 21 nt, Mycobacterium tuberculosis H37Rv
cggugcggaacaccgcccggc

SEQ ID NO: 1364243 - RNA, 14 nt, Mycobacterium tuberculosis H37Rv
cggugcggaacacc

SEQ ID NO: 1364244 - RNA, 18 nt, Mycobacterium tuberculosis H37Rv
cggugcucuucggcacca

SEQ ID NO: 1364245 - RNA, 17 nt, Mycobacterium tuberculosis H37Rv
cggugcuaaccgacgcu

SEQ ID NO: 1364246 - RNA, 14 nt, Mycobacterium tuberculosis H37Rv
cggugcguccggug

SEQ ID NO: 1364247 - RNA, 14 nt, Mycobacterium tuberculosis H37Rv
cggugcggugcaca

SEQ ID NO: 1364248 - RNA, 22 nt, Mycobacterium tuberculosis H37Rv
cggugaucgauccggcuccacc

SEQ ID NO: 1364249 - RNA, 18 nt, Mycobacterium tuberculosis H37Rv
cggugaucucgcgcuccc

SEQ ID NO: 1364250 - RNA, 18 nt, Mycobacterium tuberculosis H37Rv
cggugaucuugccggcca

SEQ ID NO: 1364251 - RNA, 20 nt, Mycobacterium tuberculosis H37Rv
cggugaucuugccggccagc

SEQ ID NO: 1364252 - RNA, 17 nt, Mycobacterium tuberculosis H37Rv
cggugaucaccaugauc

SEQ ID NO: 1364253 - RNA, 22 nt, Mycobacterium tuberculosis H37Rv
cggugaucagguaagcgaacgg

SEQ ID NO: 1364254 - RNA, 15 nt, Mycobacterium tuberculosis H37Rv
cggugaucagcagca

SEQ ID NO: 1364255 - RNA, 18 nt, Mycobacterium tuberculosis H37Rv
cggugauggccgaccagc

SEQ ID NO: 1364256 - RNA, 20 nt, Mycobacterium tuberculosis H37Rv
cggugaugggccaggcgccc

SEQ ID NO: 1364257 - RNA, 12 nt, Mycobacterium tuberculosis H37Rv
cggugauugaca

SEQ ID NO: 1364258 - RNA, 15 nt, Mycobacterium tuberculosis H37Rv
cggugauugacaaca

SEQ ID NO: 1364259 - RNA, 17 nt, Mycobacterium tuberculosis H37Rv
cggugccaccagugagc

SEQ ID NO: 1364260 - RNA, 22 nt, Mycobacterium tuberculosis H37Rv
cggugccaucgggcgcgguaac

SEQ ID NO: 1364261 - RNA, 14 nt, Mycobacterium tuberculosis H37Rv
cggugccgaacagc

SEQ ID NO: 1364262 - RNA, 18 nt, Mycobacterium tuberculosis H37Rv
cggugcccugccggcagc

SEQ ID NO: 1364263 - RNA, 15 nt, Mycobacterium tuberculosis H37Rv
cggugccgacgguga

SEQ ID NO: 1364264 - RNA, 17 nt, Mycobacterium tuberculosis H37Rv
cggugccgacggugggc

SEQ ID NO: 1364265 - RNA, 17 nt, Mycobacterium tuberculosis H37Rv
cggugcccagcagcgcg

SEQ ID NO: 1364266 - RNA, 14 nt, Mycobacterium tuberculosis H37Rv
cggugcccgcacca

SEQ ID NO: 1364267 - RNA, 18 nt, Mycobacterium tuberculosis H37Rv
cggugccacugccggugg

SEQ ID NO: 1364268 - RNA, 14 nt, Mycobacterium tuberculosis H37Rv
cggugccagcacca

SEQ ID NO: 1364269 - RNA, 15 nt, Mycobacterium tuberculosis H37Rv
cggugccaccacgcu

SEQ ID NO: 1364270 - RNA, 19 nt, Mycobacterium tuberculosis H37Rv
cggugcagcgcacgcagcc

SEQ ID NO: 1364271 - RNA, 17 nt, Mycobacterium tuberculosis H37Rv
cggugcagcuccccgcc

SEQ ID NO: 1364272 - RNA, 12 nt, Mycobacterium tuberculosis H37Rv
cggugcagcgca

SEQ ID NO: 1364273 - RNA, 17 nt, Mycobacterium tuberculosis H37Rv
cggugcagaucggcuca

SEQ ID NO: 1364274 - RNA, 18 nt, Mycobacterium tuberculosis H37Rv
cggugcagcagggcgcgc

SEQ ID NO: 1364275 - RNA, 21 nt, Mycobacterium tuberculosis H37Rv
cggugcagcagggcgcgcauc

SEQ ID NO: 1364276 - RNA, 15 nt, Mycobacterium tuberculosis H37Rv
cgguuucgaccacca

SEQ ID NO: 1364277 - RNA, 17 nt, Mycobacterium tuberculosis H37Rv
cgguuucugguguuuca

SEQ ID NO: 1364278 - RNA, 13 nt, Mycobacterium tuberculosis H37Rv
cgguuguggcuga

SEQ ID NO: 1364279 - RNA, 14 nt, Mycobacterium tuberculosis H37Rv
cgguuguccuccga

SEQ ID NO: 1364280 - RNA, 15 nt, Mycobacterium tuberculosis H37Rv
cgguuggguagcacc

SEQ ID NO: 1364281 - RNA, 15 nt, Mycobacterium tuberculosis H37Rv
cgguugguccgccgu

SEQ ID NO: 1364282 - RNA, 19 nt, Mycobacterium tuberculosis H37Rv
cgguuggcucgggccagau

SEQ ID NO: 1364283 - RNA, 17 nt, Mycobacterium tuberculosis H37Rv
cgguuggcugccggcaa

SEQ ID NO: 1364284 - RNA, 13 nt, Mycobacterium tuberculosis H37Rv
cgguuggccacca

SEQ ID NO: 1364285 - RNA, 16 nt, Mycobacterium tuberculosis H37Rv
cgguuggccagccaca

SEQ ID NO: 1364286 - RNA, 18 nt, Mycobacterium tuberculosis H37Rv
cgguuggccagugacuca

SEQ ID NO: 1364287 - RNA, 17 nt, Mycobacterium tuberculosis H37Rv
cgguugccacgccgccg

SEQ ID NO: 1364288 - RNA, 17 nt, Mycobacterium tuberculosis H37Rv
cgguugauugugcccag

SEQ ID NO: 1364289 - RNA, 14 nt, Mycobacterium tuberculosis H37Rv
cgguugccccgacc

SEQ ID NO: 1364290 - RNA, 13 nt, Mycobacterium tuberculosis H37Rv
cgguugccccggc

SEQ ID NO: 1364291 - RNA, 14 nt, Mycobacterium tuberculosis H37Rv
cgguuagaucaccc

SEQ ID NO: 1364292 - RNA, 19 nt, Mycobacterium tuberculosis H37Rv
cgguucauccacuccgcca

SEQ ID NO: 1364293 - RNA, 22 nt, Mycobacterium tuberculosis H37Rv
cgguucaccaugucggccaccc

SEQ ID NO: 1364294 - RNA, 17 nt, Mycobacterium tuberculosis H37Rv
cgguugcauaccgccgg

SEQ ID NO: 1364295 - RNA, 21 nt, Mycobacterium tuberculosis H37Rv
cgguugaugaucuuggugaag

SEQ ID NO: 1364296 - RNA, 17 nt, Mycobacterium tuberculosis H37Rv
cgguugacgccgguccc

SEQ ID NO: 1364297 - RNA, 13 nt, Mycobacterium tuberculosis H37Rv
cgguugacccaca

SEQ ID NO: 1364298 - RNA, 21 nt, Mycobacterium tuberculosis H37Rv
cgguucgggcagcacccgcgc

SEQ ID NO: 1364299 - RNA, 20 nt, Mycobacterium tuberculosis H37Rv
cgguucgucggcgagcgcgg

SEQ ID NO: 1364300 - RNA, 23 nt, Mycobacterium tuberculosis H37Rv
cgguucgccccugcacagcaggc

SEQ ID NO: 1364301 - RNA, 15 nt, Mycobacterium tuberculosis H37Rv
cgguuccggccggcu

SEQ ID NO: 1364302 - RNA, 15 nt, Mycobacterium tuberculosis H37Rv
cgguuccgccggccc

SEQ ID NO: 1364303 - RNA, 23 nt, Mycobacterium tuberculosis H37Rv
cguaacgccaagcucggcccagc

SEQ ID NO: 1364304 - RNA, 21 nt, Mycobacterium tuberculosis H37Rv
cguaaccuggggugaacucca

SEQ ID NO: 1364305 - RNA, 12 nt, Mycobacterium tuberculosis H37Rv
cgguuugccggu

SEQ ID NO: 1364306 - RNA, 20 nt, Mycobacterium tuberculosis H37Rv
cgguuuggaucacccgccgc

SEQ ID NO: 1364307 - RNA, 12 nt, Mycobacterium tuberculosis H37Rv
cguaaacgucgg

SEQ ID NO: 1364308 - RNA, 23 nt, Mycobacterium tuberculosis H37Rv
cguaaaccgauaucgcugcggaa

SEQ ID NO: 1364309 - RNA, 13 nt, Mycobacterium tuberculosis H37Rv
cguaaacagcgcg

SEQ ID NO: 1364310 - RNA, 15 nt, Mycobacterium tuberculosis H37Rv
cgugaaagccgacca

SEQ ID NO: 1364311 - RNA, 20 nt, Mycobacterium tuberculosis H37Rv
cgugaaagccgaccagcgcg

SEQ ID NO: 1364312 - RNA, 16 nt, Mycobacterium tuberculosis H37Rv
cgugacgaccagcccc

SEQ ID NO: 1364313 - RNA, 17 nt, Mycobacterium tuberculosis H37Rv
cgugacguaccacggcg

SEQ ID NO: 1364314 - RNA, 19 nt, Mycobacterium tuberculosis H37Rv
cgugacguaccacggcgau

SEQ ID NO: 1364315 - RNA, 20 nt, Mycobacterium tuberculosis H37Rv
cgugacguagggcagcgcca

SEQ ID NO: 1364316 - RNA, 21 nt, Mycobacterium tuberculosis H37Rv
cgugacguagggcagcgccag

SEQ ID NO: 1364317 - RNA, 21 nt, Mycobacterium tuberculosis H37Rv
cgugacguaucgccgcgggcg

SEQ ID NO: 1364318 - RNA, 21 nt, Mycobacterium tuberculosis H37Rv
cgugaccagggccugaguguu

SEQ ID NO: 1364319 - RNA, 20 nt, Mycobacterium tuberculosis H37Rv
cgugacccucagcaccgcug

SEQ ID NO: 1364320 - RNA, 16 nt, Mycobacterium tuberculosis H37Rv
cgugaccgaccgccau

SEQ ID NO: 1364321 - RNA, 15 nt, Mycobacterium tuberculosis H37Rv
cgucugacccaccgc

SEQ ID NO: 1364322 - RNA, 17 nt, Mycobacterium tuberculosis H37Rv
cgucugcccgcccagcc

SEQ ID NO: 1364323 - RNA, 16 nt, Mycobacterium tuberculosis H37Rv
cgucugcccgcccagc

SEQ ID NO: 1364324 - RNA, 22 nt, Mycobacterium tuberculosis H37Rv
cgucugcacguacucggccagc

SEQ ID NO: 1364325 - RNA, 24 nt, Mycobacterium tuberculosis H37Rv
cgucugcacguacucggccagcuc

SEQ ID NO: 1364326 - RNA, 23 nt, Mycobacterium tuberculosis H37Rv
cgucugcgaucccgaucgcgcug

SEQ ID NO: 1364327 - RNA, 18 nt, Mycobacterium tuberculosis H37Rv
cgucugcccgcccagccc

SEQ ID NO: 1364328 - RNA, 18 nt, Mycobacterium tuberculosis H37Rv
cgucuuaccugaagccgc

SEQ ID NO: 1364329 - RNA, 21 nt, Mycobacterium tuberculosis H37Rv
cgucuuaccugaagccgcgcu

SEQ ID NO: 1364330 - RNA, 21 nt, Mycobacterium tuberculosis H37Rv
cgucgccggucaggccgccgc

SEQ ID NO: 1364331 - RNA, 14 nt, Mycobacterium tuberculosis H37Rv
cgucgccgguggca

SEQ ID NO: 1364332 - RNA, 22 nt, Mycobacterium tuberculosis H37Rv
cgucgccguacaaccacccacc

SEQ ID NO: 1364333 - RNA, 13 nt, Mycobacterium tuberculosis H37Rv
cgucgcaaacaga

SEQ ID NO: 1364334 - RNA, 19 nt, Mycobacterium tuberculosis H37Rv
cgucgcaaacuucgcgcac

SEQ ID NO: 1364335 - RNA, 13 nt, Mycobacterium tuberculosis H37Rv
cgucgccggcggc

SEQ ID NO: 1364336 - RNA, 14 nt, Mycobacterium tuberculosis H37Rv
cgucgccggcggcg

SEQ ID NO: 1364337 - RNA, 17 nt, Mycobacterium tuberculosis H37Rv
cgucgcgcaucgccucc

SEQ ID NO: 1364338 - RNA, 19 nt, Mycobacterium tuberculosis H37Rv
cgucgcgauugccgcgguu

SEQ ID NO: 1364339 - RNA, 18 nt, Mycobacterium tuberculosis H37Rv
cgucgcgauugccgcggu

SEQ ID NO: 1364340 - RNA, 12 nt, Mycobacterium tuberculosis H37Rv
cgugcggcggcu

SEQ ID NO: 1364341 - RNA, 15 nt, Mycobacterium tuberculosis H37Rv
cgugcggcugccagu

SEQ ID NO: 1364342 - RNA, 21 nt, Mycobacterium tuberculosis H37Rv
cgugcggcgaccgucaaccug

SEQ ID NO: 1364343 - RNA, 22 nt, Mycobacterium tuberculosis H37Rv
cgugcgcuuggucgaccgccga

SEQ ID NO: 1364344 - RNA, 19 nt, Mycobacterium tuberculosis H37Rv
cgugcgucggcccggugcu

SEQ ID NO: 1364345 - RNA, 15 nt, Mycobacterium tuberculosis H37Rv
cgugcgugcgggggc

SEQ ID NO: 1364346 - RNA, 12 nt, Mycobacterium tuberculosis H37Rv
cgugcgggccgg

SEQ ID NO: 1364347 - RNA, 14 nt, Mycobacterium tuberculosis H37Rv
cgugcgggcgggcg

SEQ ID NO: 1364348 - RNA, 20 nt, Mycobacterium tuberculosis H37Rv
cgugccagcaggggacgggc

SEQ ID NO: 1364349 - RNA, 22 nt, Mycobacterium tuberculosis H37Rv
cgugccagcaggggacgggcgg

SEQ ID NO: 1364350 - RNA, 17 nt, Mycobacterium tuberculosis H37Rv
cgugcccaagcucaggg

SEQ ID NO: 1364351 - RNA, 22 nt, Mycobacterium tuberculosis H37Rv
cgugcccaagcucagggugggc

SEQ ID NO: 1364352 - RNA, 13 nt, Mycobacterium tuberculosis H37Rv
cgugcgcaucccg

SEQ ID NO: 1364353 - RNA, 18 nt, Mycobacterium tuberculosis H37Rv
cgugcgcggccggcacga

SEQ ID NO: 1364354 - RNA, 19 nt, Mycobacterium tuberculosis H37Rv
cgugcgccggggacacagc

SEQ ID NO: 1364355 - RNA, 22 nt, Mycobacterium tuberculosis H37Rv
cgugcgcgcgcagcugacguca

SEQ ID NO: 1364356 - RNA, 14 nt, Mycobacterium tuberculosis H37Rv
cgugcaucugugag

SEQ ID NO: 1364357 - RNA, 20 nt, Mycobacterium tuberculosis H37Rv
cgugcaauagcucgggcgca

SEQ ID NO: 1364358 - RNA, 14 nt, Mycobacterium tuberculosis H37Rv
cgugcacaggucag

SEQ ID NO: 1364359 - RNA, 14 nt, Mycobacterium tuberculosis H37Rv
cgugcaccuccagg

SEQ ID NO: 1364360 - RNA, 18 nt, Mycobacterium tuberculosis H37Rv
cgugcaccucgucccagc

SEQ ID NO: 1364361 - RNA, 20 nt, Mycobacterium tuberculosis H37Rv
cgugcaccucgucccagcgg

SEQ ID NO: 1364362 - RNA, 22 nt, Mycobacterium tuberculosis H37Rv
cgugcacgcacagcccgaugcc

SEQ ID NO: 1364363 - RNA, 13 nt, Mycobacterium tuberculosis H37Rv
cgugaucagcagg

SEQ ID NO: 1364364 - RNA, 20 nt, Mycobacterium tuberculosis H37Rv
cgugaucgcgguccaacagc

SEQ ID NO: 1364365 - RNA, 21 nt, Mycobacterium tuberculosis H37Rv
cgugaucgcgguccaacagcg

SEQ ID NO: 1364366 - RNA, 16 nt, Mycobacterium tuberculosis H37Rv
cgugagucacccggcc

SEQ ID NO: 1364367 - RNA, 15 nt, Mycobacterium tuberculosis H37Rv
cgugaguuucaccac

SEQ ID NO: 1364368 - RNA, 18 nt, Mycobacterium tuberculosis H37Rv
cguggcuucacccaaccc

SEQ ID NO: 1364369 - RNA, 22 nt, Mycobacterium tuberculosis H37Rv
cguggcuucacccaaccccgcc

SEQ ID NO: 1364370 - RNA, 15 nt, Mycobacterium tuberculosis H37Rv
cguggcgggggcuua

SEQ ID NO: 1364371 - RNA, 16 nt, Mycobacterium tuberculosis H37Rv
cguggcggugagccgc

SEQ ID NO: 1364372 - RNA, 17 nt, Mycobacterium tuberculosis H37Rv
cguggcggugagccgcc

SEQ ID NO: 1364373 - RNA, 20 nt, Mycobacterium tuberculosis H37Rv
cguggcggccuccuccccga

SEQ ID NO: 1364374 - RNA, 20 nt, Mycobacterium tuberculosis H37Rv
cguggcggaucgcgagcgcc

SEQ ID NO: 1364375 - RNA, 13 nt, Mycobacterium tuberculosis H37Rv
cguggcggcgcgc

SEQ ID NO: 1364376 - RNA, 16 nt, Mycobacterium tuberculosis H37Rv
cguggcgcgccgcauc

SEQ ID NO: 1364377 - RNA, 17 nt, Mycobacterium tuberculosis H37Rv
cguggguccaacccgcg

SEQ ID NO: 1364378 - RNA, 16 nt, Mycobacterium tuberculosis H37Rv
cgugggcacucaucga

SEQ ID NO: 1364379 - RNA, 18 nt, Mycobacterium tuberculosis H37Rv
cguggcuggcaccucccg

SEQ ID NO: 1364380 - RNA, 13 nt, Mycobacterium tuberculosis H37Rv
cgugggccaccac

SEQ ID NO: 1364381 - RNA, 22 nt, Mycobacterium tuberculosis H37Rv
cgugggccacuugaugcucgau

SEQ ID NO: 1364382 - RNA, 20 nt, Mycobacterium tuberculosis H37Rv
cgugggcgugcaggcugguu

SEQ ID NO: 1364383 - RNA, 22 nt, Mycobacterium tuberculosis H37Rv
cguggcgcccgucuccagcacc

SEQ ID NO: 1364384 - RNA, 17 nt, Mycobacterium tuberculosis H37Rv
cguggcgcccgugccgc

SEQ ID NO: 1364385 - RNA, 18 nt, Mycobacterium tuberculosis H37Rv
cguggcgccggccacgag

SEQ ID NO: 1364386 - RNA, 16 nt, Mycobacterium tuberculosis H37Rv
cguggcgcaccaccgc

SEQ ID NO: 1364387 - RNA, 14 nt, Mycobacterium tuberculosis H37Rv
cguggccggaccca

SEQ ID NO: 1364388 - RNA, 20 nt, Mycobacterium tuberculosis H37Rv
cguggccugaaacggcugca

SEQ ID NO: 1364389 - RNA, 15 nt, Mycobacterium tuberculosis H37Rv
cguggcccuccucgg

SEQ ID NO: 1364390 - RNA, 20 nt, Mycobacterium tuberculosis H37Rv
cguggaagccgacgaccagc

SEQ ID NO: 1364391 - RNA, 22 nt, Mycobacterium tuberculosis H37Rv
cguggaucaucccgaccagcag

SEQ ID NO: 1364392 - RNA, 16 nt, Mycobacterium tuberculosis H37Rv
cguggaucugccucuc

SEQ ID NO: 1364393 - RNA, 16 nt, Mycobacterium tuberculosis H37Rv
cguggaucggcagccc

SEQ ID NO: 1364394 - RNA, 22 nt, Mycobacterium tuberculosis H37Rv
cgugguggacgaccgcgcggca

SEQ ID NO: 1364395 - RNA, 16 nt, Mycobacterium tuberculosis H37Rv
cguggucggccacccc

SEQ ID NO: 1364396 - RNA, 14 nt, Mycobacterium tuberculosis H37Rv
cguggucggccucg

SEQ ID NO: 1364397 - RNA, 20 nt, Mycobacterium tuberculosis H37Rv
cguggugauccggucuccgc

SEQ ID NO: 1364398 - RNA, 22 nt, Mycobacterium tuberculosis H37Rv
cguggucggagcgggugcgggc

SEQ ID NO: 1364399 - RNA, 18 nt, Mycobacterium tuberculosis H37Rv
cguggucaccccuucgcc

SEQ ID NO: 1364400 - RNA, 14 nt, Mycobacterium tuberculosis H37Rv
cgugguagccggcg

SEQ ID NO: 1364401 - RNA, 20 nt, Mycobacterium tuberculosis H37Rv
cgugguuccggcgugcagca

SEQ ID NO: 1364402 - RNA, 21 nt, Mycobacterium tuberculosis H37Rv
cgugguguaucgacggcggcc

SEQ ID NO: 1364403 - RNA, 13 nt, Mycobacterium tuberculosis H37Rv
cgugguucccggc

SEQ ID NO: 1364404 - RNA, 15 nt, Mycobacterium tuberculosis H37Rv
cguguaaccccaggc

SEQ ID NO: 1364405 - RNA, 17 nt, Mycobacterium tuberculosis H37Rv
cguguaaccccaggcgc

SEQ ID NO: 1364406 - RNA, 20 nt, Mycobacterium tuberculosis H37Rv
cguguaacgccgacuccccc

SEQ ID NO: 1364407 - RNA, 21 nt, Mycobacterium tuberculosis H37Rv
cguguagccugcggcggucau

SEQ ID NO: 1364408 - RNA, 16 nt, Mycobacterium tuberculosis H37Rv
cguguaccagcccagc

SEQ ID NO: 1364409 - RNA, 17 nt, Mycobacterium tuberculosis H37Rv
cgugucggugcgcgcag

SEQ ID NO: 1364410 - RNA, 19 nt, Mycobacterium tuberculosis H37Rv
cgugugcaccaucaucacc

SEQ ID NO: 1364411 - RNA, 16 nt, Mycobacterium tuberculosis H37Rv
cgugugccacggggca

SEQ ID NO: 1364412 - RNA, 20 nt, Mycobacterium tuberculosis H37Rv
cgugugcaccaucaucaccu

SEQ ID NO: 1364413 - RNA, 20 nt, Mycobacterium tuberculosis H37Rv
cguguggagcucgcggcgca

SEQ ID NO: 1364414 - RNA, 14 nt, Mycobacterium tuberculosis H37Rv
cguguggagcucgc

SEQ ID NO: 1364415 - RNA, 13 nt, Mycobacterium tuberculosis H37Rv
cgugucgccgccg

SEQ ID NO: 1364416 - RNA, 20 nt, Mycobacterium tuberculosis H37Rv
cgugucgagcgccgcaguga

SEQ ID NO: 1364417 - RNA, 23 nt, Mycobacterium tuberculosis H37Rv
cgugucgcgucgcaggauuccca

SEQ ID NO: 1364418 - RNA, 18 nt, Mycobacterium tuberculosis H37Rv
cgugucuugucgcgcagc

SEQ ID NO: 1364419 - RNA, 19 nt, Mycobacterium tuberculosis H37Rv
cgugucggugaaccaacgc

SEQ ID NO: 1364420 - RNA, 14 nt, Mycobacterium tuberculosis H37Rv
cguguccagcaugc

SEQ ID NO: 1364421 - RNA, 22 nt, Mycobacterium tuberculosis H37Rv
cguguccagcaugcccgccauc

SEQ ID NO: 1364422 - RNA, 19 nt, Mycobacterium tuberculosis H37Rv
cgugucccaagccugccga

SEQ ID NO: 1364423 - RNA, 13 nt, Mycobacterium tuberculosis H37Rv
cguguccagcaug

SEQ ID NO: 1364424 - RNA, 12 nt, Mycobacterium tuberculosis H37Rv
cguguugaagaa

SEQ ID NO: 1364425 - RNA, 14 nt, Mycobacterium tuberculosis H37Rv
cguguugaagaagc

SEQ ID NO: 1364426 - RNA, 15 nt, Mycobacterium tuberculosis H37Rv
cguguggcagaugug

SEQ ID NO: 1364427 - RNA, 16 nt, Mycobacterium tuberculosis H37Rv
cgugugugcgccuccg

SEQ ID NO: 1364428 - RNA, 16 nt, Mycobacterium tuberculosis H37Rv
cgugugugcggcggua

SEQ ID NO: 1364429 - RNA, 18 nt, Mycobacterium tuberculosis H37Rv
cguugacgucgagcagcg

SEQ ID NO: 1364430 - RNA, 18 nt, Mycobacterium tuberculosis H37Rv
cguugacguccaacagcg

SEQ ID NO: 1364431 - RNA, 17 nt, Mycobacterium tuberculosis H37Rv
cguugacguccaacagc

SEQ ID NO: 1364432 - RNA, 20 nt, Mycobacterium tuberculosis H37Rv
cguugacgguugccccggcg

SEQ ID NO: 1364433 - RNA, 22 nt, Mycobacterium tuberculosis H37Rv
cguugccgaacgucgcggccag

SEQ ID NO: 1364434 - RNA, 18 nt, Mycobacterium tuberculosis H37Rv
cguugccgaucagcccgg

SEQ ID NO: 1364435 - RNA, 20 nt, Mycobacterium tuberculosis H37Rv
cguugcccccguugccgccc

SEQ ID NO: 1364436 - RNA, 21 nt, Mycobacterium tuberculosis H37Rv
cguugcccccguugccgcccg

SEQ ID NO: 1364437 - RNA, 22 nt, Mycobacterium tuberculosis H37Rv
cguugagaagcgucacaguccc

SEQ ID NO: 1364438 - RNA, 17 nt, Mycobacterium tuberculosis H37Rv
cguugaacggcaccagc

SEQ ID NO: 1364439 - RNA, 14 nt, Mycobacterium tuberculosis H37Rv
cguugaccugcaga

SEQ ID NO: 1364440 - RNA, 16 nt, Mycobacterium tuberculosis H37Rv
cguucuucagccaggg

SEQ ID NO: 1364441 - RNA, 22 nt, Mycobacterium tuberculosis H37Rv
cguucgcgggugcgcugcagcg

SEQ ID NO: 1364442 - RNA, 19 nt, Mycobacterium tuberculosis H37Rv
cguucgcgucacaccagcg

SEQ ID NO: 1364443 - RNA, 17 nt, Mycobacterium tuberculosis H37Rv
cguucgcgugccagcgc

SEQ ID NO: 1364444 - RNA, 15 nt, Mycobacterium tuberculosis H37Rv
cguucggccgggccg

SEQ ID NO: 1364445 - RNA, 15 nt, Mycobacterium tuberculosis H37Rv
cguucggcgacgcgc

SEQ ID NO: 1364446 - RNA, 19 nt, Mycobacterium tuberculosis H37Rv
cguucggcgacgcgccggu

SEQ ID NO: 1364447 - RNA, 16 nt, Mycobacterium tuberculosis H37Rv
cguucucggcacccuc

SEQ ID NO: 1364448 - RNA, 20 nt, Mycobacterium tuberculosis H37Rv
cguucugacggcuugcguga

SEQ ID NO: 1364449 - RNA, 20 nt, Mycobacterium tuberculosis H37Rv
cguuaacugcgccuaacccc

SEQ ID NO: 1364450 - RNA, 21 nt, Mycobacterium tuberculosis H37Rv
cguucauguagcagcgcggcu

SEQ ID NO: 1364451 - RNA, 19 nt, Mycobacterium tuberculosis H37Rv
cguuccagcacacccagau

SEQ ID NO: 1364452 - RNA, 12 nt, Mycobacterium tuberculosis H37Rv
cguucgccgccc

SEQ ID NO: 1364453 - RNA, 15 nt, Mycobacterium tuberculosis H37Rv
cguucgcccgcccgu

SEQ ID NO: 1364454 - RNA, 22 nt, Mycobacterium tuberculosis H37Rv
cguucgcgggcgucccgcauac

SEQ ID NO: 1364455 - RNA, 19 nt, Mycobacterium tuberculosis H37Rv
cguuccaucacggaccagg

SEQ ID NO: 1364456 - RNA, 21 nt, Mycobacterium tuberculosis H37Rv
cguuggaugaagucgucggca

SEQ ID NO: 1364457 - RNA, 16 nt, Mycobacterium tuberculosis H37Rv
cguuggcaucggcgga

SEQ ID NO: 1364458 - RNA, 14 nt, Mycobacterium tuberculosis H37Rv
cguuggccagcagg

SEQ ID NO: 1364459 - RNA, 24 nt, Mycobacterium tuberculosis H37Rv
cguuggagccgccaccgaggccgc

SEQ ID NO: 1364460 - RNA, 15 nt, Mycobacterium tuberculosis H37Rv
cguugcggcaacagc

SEQ ID NO: 1364461 - RNA, 17 nt, Mycobacterium tuberculosis H37Rv
cguugcucccacggcac

SEQ ID NO: 1364462 - RNA, 15 nt, Mycobacterium tuberculosis H37Rv
cguugcugcgcagcg

SEQ ID NO: 1364463 - RNA, 18 nt, Mycobacterium tuberculosis H37Rv
cguugccggugccgccgc

SEQ ID NO: 1364464 - RNA, 17 nt, Mycobacterium tuberculosis H37Rv
cguugccggugccgccg

SEQ ID NO: 1364465 - RNA, 20 nt, Mycobacterium tuberculosis H37Rv
cguugccggcguugccgccg

SEQ ID NO: 1364466 - RNA, 15 nt, Mycobacterium tuberculosis H37Rv
cguugccggcuuggc

SEQ ID NO: 1364467 - RNA, 20 nt, Mycobacterium tuberculosis H37Rv
cguugccgaucagcccggcc

SEQ ID NO: 1364468 - RNA, 16 nt, Mycobacterium tuberculosis H37Rv
cguugccgcccguccc

SEQ ID NO: 1364469 - RNA, 16 nt, Mycobacterium tuberculosis H37Rv
cguugccgccgucccc

SEQ ID NO: 1364470 - RNA, 14 nt, Mycobacterium tuberculosis H37Rv
cguuggcgaacagc

SEQ ID NO: 1364471 - RNA, 15 nt, Mycobacterium tuberculosis H37Rv
cguuggcgaccaccg

SEQ ID NO: 1364472 - RNA, 16 nt, Mycobacterium tuberculosis H37Rv
cguuggcgaccaccgc

SEQ ID NO: 1364473 - RNA, 22 nt, Mycobacterium tuberculosis H37Rv
cguuggcgguagacaccccacc

SEQ ID NO: 1364474 - RNA, 21 nt, Mycobacterium tuberculosis H37Rv
cguuggucagcguggacgccc

SEQ ID NO: 1364475 - RNA, 20 nt, Mycobacterium tuberculosis H37Rv
cguugguggucugccaaaag

SEQ ID NO: 1364476 - RNA, 17 nt, Mycobacterium tuberculosis H37Rv
cguugggaucccagcgc

SEQ ID NO: 1364477 - RNA, 21 nt, Mycobacterium tuberculosis H37Rv
cguugggauccgguggugggc

SEQ ID NO: 1364478 - RNA, 18 nt, Mycobacterium tuberculosis H37Rv
cguugggccaccggcgcc

SEQ ID NO: 1364479 - RNA, 14 nt, Mycobacterium tuberculosis H37Rv
cguugggccgcgcc

SEQ ID NO: 1364480 - RNA, 20 nt, Mycobacterium tuberculosis H37Rv
cguuggguugaaaacgcccg

SEQ ID NO: 1364481 - RNA, 15 nt, Mycobacterium tuberculosis H37Rv
cguuuagucuccggc

SEQ ID NO: 1364482 - RNA, 17 nt, Mycobacterium tuberculosis H37Rv
cguuucaagucccuuca

SEQ ID NO: 1364483 - RNA, 22 nt, Mycobacterium tuberculosis H37Rv
cuaaagcgugucgaugcgggcu

SEQ ID NO: 1364484 - RNA, 20 nt, Mycobacterium tuberculosis H37Rv
cuaaagcgugucgcccuguu

SEQ ID NO: 1364485 - RNA, 18 nt, Mycobacterium tuberculosis H37Rv
cguuugagcggccaccgu

SEQ ID NO: 1364486 - RNA, 16 nt, Mycobacterium tuberculosis H37Rv
cguuugcgaagcccac

SEQ ID NO: 1364487 - RNA, 14 nt, Mycobacterium tuberculosis H37Rv
cguuugccggccga

SEQ ID NO: 1364488 - RNA, 15 nt, Mycobacterium tuberculosis H37Rv
cuacuccggucccgc

SEQ ID NO: 1364489 - RNA, 16 nt, Mycobacterium tuberculosis H37Rv
cuacucgaaacccaug

SEQ ID NO: 1364490 - RNA, 16 nt, Mycobacterium tuberculosis H37Rv
cuacuaggcccagcac

SEQ ID NO: 1364491 - RNA, 15 nt, Mycobacterium tuberculosis H37Rv
cuacgcagcgcggcu

SEQ ID NO: 1364492 - RNA, 12 nt, Mycobacterium tuberculosis H37Rv
cuaccuucuugg

SEQ ID NO: 1364493 - RNA, 22 nt, Mycobacterium tuberculosis H37Rv
cuaccuuagcgccguugccgcc

SEQ ID NO: 1364494 - RNA, 20 nt, Mycobacterium tuberculosis H37Rv
cuaaccacuguuucugagcg

SEQ ID NO: 1364495 - RNA, 11 nt, Mycobacterium tuberculosis H37Rv
cuagcgcggcg

SEQ ID NO: 1364496 - RNA, 16 nt, Mycobacterium tuberculosis H37Rv
cuagcgcggcgacgau

SEQ ID NO: 1364497 - RNA, 23 nt, Mycobacterium tuberculosis H37Rv
cuagcgccucgccggccacccgc

SEQ ID NO: 1364498 - RNA, 16 nt, Mycobacterium tuberculosis H37Rv
cuagcagagacaugcc

SEQ ID NO: 1364499 - RNA, 17 nt, Mycobacterium tuberculosis H37Rv
cuagcgccucgccggcc

SEQ ID NO: 1364500 - RNA, 21 nt, Mycobacterium tuberculosis H37Rv
cuagcgguggaaaaagcccga

SEQ ID NO: 1364501 - RNA, 19 nt, Mycobacterium tuberculosis H37Rv
cuagcacggggaccgggcu

SEQ ID NO: 1364502 - RNA, 21 nt, Mycobacterium tuberculosis H37Rv
cuagcagcagcccgacagugg

SEQ ID NO: 1364503 - RNA, 16 nt, Mycobacterium tuberculosis H37Rv
cuaggccucagaaccg

SEQ ID NO: 1364504 - RNA, 14 nt, Mycobacterium tuberculosis H37Rv
cuaggccaaacccc

SEQ ID NO: 1364505 - RNA, 16 nt, Mycobacterium tuberculosis H37Rv
cuaggccagcacggcg

SEQ ID NO: 1364506 - RNA, 14 nt, Mycobacterium tuberculosis H37Rv
cuaggccggccgga

SEQ ID NO: 1364507 - RNA, 15 nt, Mycobacterium tuberculosis H37Rv
cuaggcgcuccuuca

SEQ ID NO: 1364508 - RNA, 20 nt, Mycobacterium tuberculosis H37Rv
cuaggcaccagcggaucgca

SEQ ID NO: 1364509 - RNA, 20 nt, Mycobacterium tuberculosis H37Rv
cuaggaucggauggcggcca

SEQ ID NO: 1364510 - RNA, 20 nt, Mycobacterium tuberculosis H37Rv
cuagcuuggcggccagcgug

SEQ ID NO: 1364511 - RNA, 18 nt, Mycobacterium tuberculosis H37Rv
cuagcuugacaacccugu

SEQ ID NO: 1364512 - RNA, 16 nt, Mycobacterium tuberculosis H37Rv
cuagcugcuagcccgg

SEQ ID NO: 1364513 - RNA, 16 nt, Mycobacterium tuberculosis H37Rv
cuagcugcugaugcgg

SEQ ID NO: 1364514 - RNA, 14 nt, Mycobacterium tuberculosis H37Rv
cuagggugagcccg

SEQ ID NO: 1364515 - RNA, 17 nt, Mycobacterium tuberculosis H37Rv
cuagguccgaucgugug

SEQ ID NO: 1364516 - RNA, 17 nt, Mycobacterium tuberculosis H37Rv
cuaggucgcgcugaagg

SEQ ID NO: 1364517 - RNA, 16 nt, Mycobacterium tuberculosis H37Rv
cuaggugacgccgcca

SEQ ID NO: 1364518 - RNA, 16 nt, Mycobacterium tuberculosis H37Rv
cuaugcguccaggcga

SEQ ID NO: 1364519 - RNA, 22 nt, Mycobacterium tuberculosis H37Rv
cuauccuugguuagccgcggcc

SEQ ID NO: 1364520 - RNA, 14 nt, Mycobacterium tuberculosis H37Rv
cucacccgcccgga

SEQ ID NO: 1364521 - RNA, 12 nt, Mycobacterium tuberculosis H37Rv
cucacacuggcu

SEQ ID NO: 1364522 - RNA, 13 nt, Mycobacterium tuberculosis H37Rv
cucaccgccgcua

SEQ ID NO: 1364523 - RNA, 22 nt, Mycobacterium tuberculosis H37Rv
cucaccgcacaccugcgcggcg

SEQ ID NO: 1364524 - RNA, 20 nt, Mycobacterium tuberculosis H37Rv
cucaccggcuggugccaacu

SEQ ID NO: 1364525 - RNA, 23 nt, Mycobacterium tuberculosis H37Rv
cucacgaggcacaaucaccgccg

SEQ ID NO: 1364526 - RNA, 20 nt, Mycobacterium tuberculosis H37Rv
cucaccgugaaccgcccgcc

SEQ ID NO: 1364527 - RNA, 16 nt, Mycobacterium tuberculosis H37Rv
cucaccucaugaucuc

SEQ ID NO: 1364528 - RNA, 19 nt, Mycobacterium tuberculosis H37Rv
cucacguugugagccacgc

SEQ ID NO: 1364529 - RNA, 23 nt, Mycobacterium tuberculosis H37Rv
cucacguuugaggaccuugccgg

SEQ ID NO: 1364530 - RNA, 17 nt, Mycobacterium tuberculosis H37Rv
cucacguuugccggccc

SEQ ID NO: 1364531 - RNA, 13 nt, Mycobacterium tuberculosis H37Rv
cucacgacgccgu

SEQ ID NO: 1364532 - RNA, 21 nt, Mycobacterium tuberculosis H37Rv
cucaccuuuggccgcgaccgg

SEQ ID NO: 1364533 - RNA, 22 nt, Mycobacterium tuberculosis H37Rv
cucacgcaggaaaaccccggcc

SEQ ID NO: 1364534 - RNA, 21 nt, Mycobacterium tuberculosis H37Rv
cucacguggacugaccucguc

SEQ ID NO: 1364535 - RNA, 19 nt, Mycobacterium tuberculosis H37Rv
cucaaccagcagacgccgu

SEQ ID NO: 1364536 - RNA, 12 nt, Mycobacterium tuberculosis H37Rv
cucaacaccagg

SEQ ID NO: 1364537 - RNA, 19 nt, Mycobacterium tuberculosis H37Rv
cucaagggacacccgcuuu

SEQ ID NO: 1364538 - RNA, 20 nt, Mycobacterium tuberculosis H37Rv
cucaagggcaucaaccaacu

SEQ ID NO: 1364539 - RNA, 13 nt, Mycobacterium tuberculosis H37Rv
cucaagucucccg

SEQ ID NO: 1364540 - RNA, 22 nt, Mycobacterium tuberculosis H37Rv
cucaagcaauggugcggucugg

SEQ ID NO: 1364541 - RNA, 14 nt, Mycobacterium tuberculosis H37Rv
cucaagcgaagagc

SEQ ID NO: 1364542 - RNA, 19 nt, Mycobacterium tuberculosis H37Rv
cucaucguggggaucgacc

SEQ ID NO: 1364543 - RNA, 17 nt, Mycobacterium tuberculosis H37Rv
cucaucgcgcacgcccu

SEQ ID NO: 1364544 - RNA, 18 nt, Mycobacterium tuberculosis H37Rv
cucaucggcaaacuccug

SEQ ID NO: 1364545 - RNA, 15 nt, Mycobacterium tuberculosis H37Rv
cucaucgcgcccgcc

SEQ ID NO: 1364546 - RNA, 18 nt, Mycobacterium tuberculosis H37Rv
cucaucgcggucgccacc

SEQ ID NO: 1364547 - RNA, 17 nt, Mycobacterium tuberculosis H37Rv
cucaucggacagcgccu

SEQ ID NO: 1364548 - RNA, 20 nt, Mycobacterium tuberculosis H37Rv
cucaucggacagcgccuggc

SEQ ID NO: 1364549 - RNA, 15 nt, Mycobacterium tuberculosis H37Rv
cucauccgccgggcc

SEQ ID NO: 1364550 - RNA, 16 nt, Mycobacterium tuberculosis H37Rv
cucauccgccgggcca

SEQ ID NO: 1364551 - RNA, 22 nt, Mycobacterium tuberculosis H37Rv
cucaucccgacccuucgggcug

SEQ ID NO: 1364552 - RNA, 13 nt, Mycobacterium tuberculosis H37Rv
cucaucgcagacg

SEQ ID NO: 1364553 - RNA, 19 nt, Mycobacterium tuberculosis H37Rv
cucaucuguaaccuccucg

SEQ ID NO: 1364554 - RNA, 24 nt, Mycobacterium tuberculosis H37Rv
cucaugaugccggacgccaugccc

SEQ ID NO: 1364555 - RNA, 17 nt, Mycobacterium tuberculosis H37Rv
cucaugcaucugcuucu

SEQ ID NO: 1364556 - RNA, 15 nt, Mycobacterium tuberculosis H37Rv
cucauagugcagguc

SEQ ID NO: 1364557 - RNA, 12 nt, Mycobacterium tuberculosis H37Rv
cucaggucaucg

SEQ ID NO: 1364558 - RNA, 18 nt, Mycobacterium tuberculosis H37Rv
cucaggucaccggccgcc

SEQ ID NO: 1364559 - RNA, 17 nt, Mycobacterium tuberculosis H37Rv
cucagggugcgccgcag

SEQ ID NO: 1364560 - RNA, 17 nt, Mycobacterium tuberculosis H37Rv
cucaggucgcagaccag

SEQ ID NO: 1364561 - RNA, 19 nt, Mycobacterium tuberculosis H37Rv
cucaggucgacaggugcca

SEQ ID NO: 1364562 - RNA, 15 nt, Mycobacterium tuberculosis H37Rv
cucaggucgcagacc

SEQ ID NO: 1364563 - RNA, 17 nt, Mycobacterium tuberculosis H37Rv
cucaguucacguucggc

SEQ ID NO: 1364564 - RNA, 21 nt, Mycobacterium tuberculosis H37Rv
cucaguucugcacagugcggc

SEQ ID NO: 1364565 - RNA, 17 nt, Mycobacterium tuberculosis H37Rv
cucagugaugcgccccg

SEQ ID NO: 1364566 - RNA, 16 nt, Mycobacterium tuberculosis H37Rv
cucagucacgcacucc

SEQ ID NO: 1364567 - RNA, 23 nt, Mycobacterium tuberculosis H37Rv
cucauaccgggaggacaccagcu

SEQ ID NO: 1364568 - RNA, 23 nt, Mycobacterium tuberculosis H37Rv
cucauagcgacggcgcucggcga

SEQ ID NO: 1364569 - RNA, 16 nt, Mycobacterium tuberculosis H37Rv
cucaguuuggcgggug

SEQ ID NO: 1364570 - RNA, 16 nt, Mycobacterium tuberculosis H37Rv
cucaguuuuccccugu

SEQ ID NO: 1364571 - RNA, 16 nt, Mycobacterium tuberculosis H37Rv
cucccuuccgcgcuuc

SEQ ID NO: 1364572 - RNA, 23 nt, Mycobacterium tuberculosis H37Rv
cuccgaugaccagggucugcuca

SEQ ID NO: 1364573 - RNA, 20 nt, Mycobacterium tuberculosis H37Rv
cuccgaugccgacggcgccc

SEQ ID NO: 1364574 - RNA, 18 nt, Mycobacterium tuberculosis H37Rv
cuccgauuccgaacuggu

SEQ ID NO: 1364575 - RNA, 20 nt, Mycobacterium tuberculosis H37Rv
cuccgccagaauugccggcg

SEQ ID NO: 1364576 - RNA, 22 nt, Mycobacterium tuberculosis H37Rv
cuccggcaagcacaccgccagc

SEQ ID NO: 1364577 - RNA, 14 nt, Mycobacterium tuberculosis H37Rv
cuccgcggcgcgca

SEQ ID NO: 1364578 - RNA, 19 nt, Mycobacterium tuberculosis H37Rv
cuccgcggcgcgcaacaca

SEQ ID NO: 1364579 - RNA, 18 nt, Mycobacterium tuberculosis H37Rv
cuccgcggaacccagcac

SEQ ID NO: 1364580 - RNA, 21 nt, Mycobacterium tuberculosis H37Rv
cuccgccgagcagacgcagaa

SEQ ID NO: 1364581 - RNA, 20 nt, Mycobacterium tuberculosis H37Rv
cuccgccgaggaaaccacca

SEQ ID NO: 1364582 - RNA, 21 nt, Mycobacterium tuberculosis H37Rv
cuccgccggucccgcgugcca

SEQ ID NO: 1364583 - RNA, 20 nt, Mycobacterium tuberculosis H37Rv
cuccgccgucgccgccggcg

SEQ ID NO: 1364584 - RNA, 17 nt, Mycobacterium tuberculosis H37Rv
cuccgccguugccgccg

SEQ ID NO: 1364585 - RNA, 19 nt, Mycobacterium tuberculosis H37Rv
cuccgccggcaccuccggc

SEQ ID NO: 1364586 - RNA, 14 nt, Mycobacterium tuberculosis H37Rv
cuccgccugccgcu

SEQ ID NO: 1364587 - RNA, 18 nt, Mycobacterium tuberculosis H37Rv
cuccgccguugccgccgc

SEQ ID NO: 1364588 - RNA, 17 nt, Mycobacterium tuberculosis H37Rv
cucccgaaaagcgccuc

SEQ ID NO: 1364589 - RNA, 22 nt, Mycobacterium tuberculosis H37Rv
cucccgcaacauuuucgcccgc

SEQ ID NO: 1364590 - RNA, 13 nt, Mycobacterium tuberculosis H37Rv
cucccgcgccggc

SEQ ID NO: 1364591 - RNA, 17 nt, Mycobacterium tuberculosis H37Rv
cucccucuacacccgga

SEQ ID NO: 1364592 - RNA, 16 nt, Mycobacterium tuberculosis H37Rv
cucccgccacugcugg

SEQ ID NO: 1364593 - RNA, 21 nt, Mycobacterium tuberculosis H37Rv
cucccucgaucacggcggccc

SEQ ID NO: 1364594 - RNA, 14 nt, Mycobacterium tuberculosis H37Rv
cucccgcgccggcg

SEQ ID NO: 1364595 - RNA, 16 nt, Mycobacterium tuberculosis H37Rv
cucccgcggcgccacc

SEQ ID NO: 1364596 - RNA, 15 nt, Mycobacterium tuberculosis H37Rv
cucccgcgcgggcgg

SEQ ID NO: 1364597 - RNA, 15 nt, Mycobacterium tuberculosis H37Rv
cucccaagaaggaca

SEQ ID NO: 1364598 - RNA, 21 nt, Mycobacterium tuberculosis H37Rv
cucccacgcuucggccugugc

SEQ ID NO: 1364599 - RNA, 18 nt, Mycobacterium tuberculosis H37Rv
cucccaggccgccgccag

SEQ ID NO: 1364600 - RNA, 18 nt, Mycobacterium tuberculosis H37Rv
cuccagcgcgcgccgcag

SEQ ID NO: 1364601 - RNA, 23 nt, Mycobacterium tuberculosis H37Rv
cuccagcuugccgaccugcgcga

SEQ ID NO: 1364602 - RNA, 18 nt, Mycobacterium tuberculosis H37Rv
cuccagcugcgcgggcga

SEQ ID NO: 1364603 - RNA, 20 nt, Mycobacterium tuberculosis H37Rv
cuccagcucggccagugccg

SEQ ID NO: 1364604 - RNA, 14 nt, Mycobacterium tuberculosis H37Rv
cucaugccgagcga

SEQ ID NO: 1364605 - RNA, 20 nt, Mycobacterium tuberculosis H37Rv
cucaugggcgccaucccgcc

SEQ ID NO: 1364606 - RNA, 15 nt, Mycobacterium tuberculosis H37Rv
cuccagcgcccgguc

SEQ ID NO: 1364607 - RNA, 13 nt, Mycobacterium tuberculosis H37Rv
cuccaucagcgcg

SEQ ID NO: 1364608 - RNA, 15 nt, Mycobacterium tuberculosis H37Rv
cuccaucaccacacc

SEQ ID NO: 1364609 - RNA, 13 nt, Mycobacterium tuberculosis H37Rv
cuccaucaacugc

SEQ ID NO: 1364610 - RNA, 12 nt, Mycobacterium tuberculosis H37Rv
cuccagugcggc

SEQ ID NO: 1364611 - RNA, 15 nt, Mycobacterium tuberculosis H37Rv
cuccagugcggccuu

SEQ ID NO: 1364612 - RNA, 20 nt, Mycobacterium tuberculosis H37Rv
cuccagugcggccuuggcga

SEQ ID NO: 1364613 - RNA, 15 nt, Mycobacterium tuberculosis H37Rv
cuccagguuccaggu

SEQ ID NO: 1364614 - RNA, 23 nt, Mycobacterium tuberculosis H37Rv
cuccaggucgcauucugcugcca

SEQ ID NO: 1364615 - RNA, 14 nt, Mycobacterium tuberculosis H37Rv
cuccaggcgcgccg

SEQ ID NO: 1364616 - RNA, 14 nt, Mycobacterium tuberculosis H37Rv
cuccaggcgccacc

SEQ ID NO: 1364617 - RNA, 13 nt, Mycobacterium tuberculosis H37Rv
cuccaggcccggc

SEQ ID NO: 1364618 - RNA, 15 nt, Mycobacterium tuberculosis H37Rv
cuccaggguccggac

SEQ ID NO: 1364619 - RNA, 19 nt, Mycobacterium tuberculosis H37Rv
cuccugagaugcggccaug

SEQ ID NO: 1364620 - RNA, 13 nt, Mycobacterium tuberculosis H37Rv
cuccugcccuccg

SEQ ID NO: 1364621 - RNA, 23 nt, Mycobacterium tuberculosis H37Rv
cuccugcagcccgggcagcacca

SEQ ID NO: 1364622 - RNA, 18 nt, Mycobacterium tuberculosis H37Rv
cuccugcacacaggacuu

SEQ ID NO: 1364623 - RNA, 12 nt, Mycobacterium tuberculosis H37Rv
cuccugcacaca

SEQ ID NO: 1364624 - RNA, 18 nt, Mycobacterium tuberculosis H37Rv
cuccugcuggcccugcuc

SEQ ID NO: 1364625 - RNA, 22 nt, Mycobacterium tuberculosis H37Rv
cuccuggaaaggacggccggcc

SEQ ID NO: 1364626 - RNA, 23 nt, Mycobacterium tuberculosis H37Rv
cuccuggaaaggacggccggccg

SEQ ID NO: 1364627 - RNA, 19 nt, Mycobacterium tuberculosis H37Rv
cuccugcucgucgagccga

SEQ ID NO: 1364628 - RNA, 17 nt, Mycobacterium tuberculosis H37Rv
cuccugcuggcccugcu

SEQ ID NO: 1364629 - RNA, 22 nt, Mycobacterium tuberculosis H37Rv
cuccggcgcaccugggcugccg

SEQ ID NO: 1364630 - RNA, 20 nt, Mycobacterium tuberculosis H37Rv
cuccggcgcaccugggcugc

SEQ ID NO: 1364631 - RNA, 21 nt, Mycobacterium tuberculosis H37Rv
cuccggcgcaccugggcugcc

SEQ ID NO: 1364632 - RNA, 13 nt, Mycobacterium tuberculosis H37Rv
cuccggcgccgcc

SEQ ID NO: 1364633 - RNA, 19 nt, Mycobacterium tuberculosis H37Rv
cuccucgaauucgcgcucu

SEQ ID NO: 1364634 - RNA, 23 nt, Mycobacterium tuberculosis H37Rv
cuccuccuugagccgggcaacca

SEQ ID NO: 1364635 - RNA, 17 nt, Mycobacterium tuberculosis H37Rv
cuccucgaccgcggccu

SEQ ID NO: 1364636 - RNA, 18 nt, Mycobacterium tuberculosis H37Rv
cuccucgaccguggcggc

SEQ ID NO: 1364637 - RNA, 22 nt, Mycobacterium tuberculosis H37Rv
cuccucgaccguggcggccucc

SEQ ID NO: 1364638 - RNA, 19 nt, Mycobacterium tuberculosis H37Rv
cuccucgauagcggcgccu

SEQ ID NO: 1364639 - RNA, 22 nt, Mycobacterium tuberculosis H37Rv
cuccggcaccuccagcaccacc

SEQ ID NO: 1364640 - RNA, 21 nt, Mycobacterium tuberculosis H37Rv
cuccggccgcacgccuacgau

SEQ ID NO: 1364641 - RNA, 16 nt, Mycobacterium tuberculosis H37Rv
cuccggccgcacgccu

SEQ ID NO: 1364642 - RNA, 23 nt, Mycobacterium tuberculosis H37Rv
cuccucgugcaggaccagcaccg

SEQ ID NO: 1364643 - RNA, 15 nt, Mycobacterium tuberculosis H37Rv
cuccucgugcacgca

SEQ ID NO: 1364644 - RNA, 20 nt, Mycobacterium tuberculosis H37Rv
cuccucgucgcucccgguug

SEQ ID NO: 1364645 - RNA, 19 nt, Mycobacterium tuberculosis H37Rv
cuccucgucgacgucggca

SEQ ID NO: 1364646 - RNA, 14 nt, Mycobacterium tuberculosis H37Rv
cuccucgguguaga

SEQ ID NO: 1364647 - RNA, 20 nt, Mycobacterium tuberculosis H37Rv
cuccucggcguggcaguaca

SEQ ID NO: 1364648 - RNA, 15 nt, Mycobacterium tuberculosis H37Rv
cuccucggcaggccg

SEQ ID NO: 1364649 - RNA, 15 nt, Mycobacterium tuberculosis H37Rv
cuccucgcgggcggc

SEQ ID NO: 1364650 - RNA, 13 nt, Mycobacterium tuberculosis H37Rv
cucgagcugcugg

SEQ ID NO: 1364651 - RNA, 19 nt, Mycobacterium tuberculosis H37Rv
cucgagcugcuggcgcgcc

SEQ ID NO: 1364652 - RNA, 13 nt, Mycobacterium tuberculosis H37Rv
cucgaggaccugc

SEQ ID NO: 1364653 - RNA, 13 nt, Mycobacterium tuberculosis H37Rv
cucgagcgcgccg

SEQ ID NO: 1364654 - RNA, 14 nt, Mycobacterium tuberculosis H37Rv
cucgagcgcgccgc

SEQ ID NO: 1364655 - RNA, 15 nt, Mycobacterium tuberculosis H37Rv
cucgagccagcuccg

SEQ ID NO: 1364656 - RNA, 14 nt, Mycobacterium tuberculosis H37Rv
cucgagucgcagca

SEQ ID NO: 1364657 - RNA, 18 nt, Mycobacterium tuberculosis H37Rv
cucgagguguagcccucc

SEQ ID NO: 1364658 - RNA, 21 nt, Mycobacterium tuberculosis H37Rv
cucgaguggaucauguucggc

SEQ ID NO: 1364659 - RNA, 20 nt, Mycobacterium tuberculosis H37Rv
cucgaguucgaccggcggga

SEQ ID NO: 1364660 - RNA, 23 nt, Mycobacterium tuberculosis H37Rv
cucgauauaacccggcuccagca

SEQ ID NO: 1364661 - RNA, 20 nt, Mycobacterium tuberculosis H37Rv
cucgaccaccgccggcccgc

SEQ ID NO: 1364662 - RNA, 14 nt, Mycobacterium tuberculosis H37Rv
cucgaccagcgccg

SEQ ID NO: 1364663 - RNA, 16 nt, Mycobacterium tuberculosis H37Rv
cucgacggcgccgcuc

SEQ ID NO: 1364664 - RNA, 20 nt, Mycobacterium tuberculosis H37Rv
cucgaccaggaacggcucgg

SEQ ID NO: 1364665 - RNA, 12 nt, Mycobacterium tuberculosis H37Rv
cucgacggcucc

SEQ ID NO: 1364666 - RNA, 16 nt, Mycobacterium tuberculosis H37Rv
cucgacguacagcgcg

SEQ ID NO: 1364667 - RNA, 20 nt, Mycobacterium tuberculosis H37Rv
cucgagcaagaucaccuucg

SEQ ID NO: 1364668 - RNA, 15 nt, Mycobacterium tuberculosis H37Rv
cucgagaguggccuc

SEQ ID NO: 1364669 - RNA, 22 nt, Mycobacterium tuberculosis H37Rv
cuccuugagcaaugacccgcgg

SEQ ID NO: 1364670 - RNA, 15 nt, Mycobacterium tuberculosis H37Rv
cuccuugagcuucuc

SEQ ID NO: 1364671 - RNA, 14 nt, Mycobacterium tuberculosis H37Rv
cuccuugaggucac

SEQ ID NO: 1364672 - RNA, 17 nt, Mycobacterium tuberculosis H37Rv
cuccugugcgaugguca

SEQ ID NO: 1364673 - RNA, 19 nt, Mycobacterium tuberculosis H37Rv
cucgaaacgcuuacccagc

SEQ ID NO: 1364674 - RNA, 17 nt, Mycobacterium tuberculosis H37Rv
cuccuuggccguucggc

SEQ ID NO: 1364675 - RNA, 15 nt, Mycobacterium tuberculosis H37Rv
cucgacagugcugcc

SEQ ID NO: 1364676 - RNA, 16 nt, Mycobacterium tuberculosis H37Rv
cucgaauucgcgcucu

SEQ ID NO: 1364677 - RNA, 18 nt, Mycobacterium tuberculosis H37Rv
cucgacaaagcggcugcc

SEQ ID NO: 1364678 - RNA, 15 nt, Mycobacterium tuberculosis H37Rv
cucgcuaacucccca

SEQ ID NO: 1364679 - RNA, 12 nt, Mycobacterium tuberculosis H37Rv
cucgcucaccgg

SEQ ID NO: 1364680 - RNA, 17 nt, Mycobacterium tuberculosis H37Rv
cucggaaacggaccucc

SEQ ID NO: 1364681 - RNA, 19 nt, Mycobacterium tuberculosis H37Rv
cucgcuuaggucgcugccc

SEQ ID NO: 1364682 - RNA, 20 nt, Mycobacterium tuberculosis H37Rv
cucggaccagacccacgaug

SEQ ID NO: 1364683 - RNA, 19 nt, Mycobacterium tuberculosis H37Rv
cucgcguccucggggaggu

SEQ ID NO: 1364684 - RNA, 14 nt, Mycobacterium tuberculosis H37Rv
cucgcguggccgcc

SEQ ID NO: 1364685 - RNA, 15 nt, Mycobacterium tuberculosis H37Rv
cucgaucggcagcca

SEQ ID NO: 1364686 - RNA, 15 nt, Mycobacterium tuberculosis H37Rv
cucgcguggccgccg

SEQ ID NO: 1364687 - RNA, 21 nt, Mycobacterium tuberculosis H37Rv
cucgaucuggucaagacccgc

SEQ ID NO: 1364688 - RNA, 17 nt, Mycobacterium tuberculosis H37Rv
cucgaucuugggccacg

SEQ ID NO: 1364689 - RNA, 19 nt, Mycobacterium tuberculosis H37Rv
cucgaucuugggccacgcu

SEQ ID NO: 1364690 - RNA, 21 nt, Mycobacterium tuberculosis H37Rv
cucgauccggauucagaucuc

SEQ ID NO: 1364691 - RNA, 16 nt, Mycobacterium tuberculosis H37Rv
cucgauccgcagaaug

SEQ ID NO: 1364692 - RNA, 22 nt, Mycobacterium tuberculosis H37Rv
cucgaucgccugagacucgcuc

SEQ ID NO: 1364693 - RNA, 23 nt, Mycobacterium tuberculosis H37Rv
cucgaucaucaugucggcgcagg

SEQ ID NO: 1364694 - RNA, 16 nt, Mycobacterium tuberculosis H37Rv
cucgaucaucgggagc

SEQ ID NO: 1364695 - RNA, 24 nt, Mycobacterium tuberculosis H37Rv
cucgaucagguuggugcucagcgg

SEQ ID NO: 1364696 - RNA, 15 nt, Mycobacterium tuberculosis H37Rv
cucggcaaccaccuc

SEQ ID NO: 1364697 - RNA, 18 nt, Mycobacterium tuberculosis H37Rv
cucggcaggaaggacauc

SEQ ID NO: 1364698 - RNA, 15 nt, Mycobacterium tuberculosis H37Rv
cucggcagccggcuu

SEQ ID NO: 1364699 - RNA, 18 nt, Mycobacterium tuberculosis H37Rv
cucggaucggcucgccac

SEQ ID NO: 1364700 - RNA, 16 nt, Mycobacterium tuberculosis H37Rv
cucggcaugcucgaca

SEQ ID NO: 1364701 - RNA, 13 nt, Mycobacterium tuberculosis H37Rv
cucggccaccagc

SEQ ID NO: 1364702 - RNA, 12 nt, Mycobacterium tuberculosis H37Rv
cucggccaccag

SEQ ID NO: 1364703 - RNA, 17 nt, Mycobacterium tuberculosis H37Rv
cucggcccagcgcgcca

SEQ ID NO: 1364704 - RNA, 22 nt, Mycobacterium tuberculosis H37Rv
cucggccaucagaaccuccucg

SEQ ID NO: 1364705 - RNA, 17 nt, Mycobacterium tuberculosis H37Rv
cucggccauagcgccgc

SEQ ID NO: 1364706 - RNA, 21 nt, Mycobacterium tuberculosis H37Rv
cucggccgugaccgagccgcg

SEQ ID NO: 1364707 - RNA, 13 nt, Mycobacterium tuberculosis H37Rv
cucggccagcacg

SEQ ID NO: 1364708 - RNA, 15 nt, Mycobacterium tuberculosis H37Rv
cucggccagcacgcc

SEQ ID NO: 1364709 - RNA, 17 nt, Mycobacterium tuberculosis H37Rv
cucggccagcacgccgc

SEQ ID NO: 1364710 - RNA, 13 nt, Mycobacterium tuberculosis H37Rv
cucggccagccag

SEQ ID NO: 1364711 - RNA, 22 nt, Mycobacterium tuberculosis H37Rv
cucggccaccagcgcccggccc

SEQ ID NO: 1364712 - RNA, 12 nt, Mycobacterium tuberculosis H37Rv
cucggccacgaa

SEQ ID NO: 1364713 - RNA, 22 nt, Mycobacterium tuberculosis H37Rv
cucggccagcgauucacgggug

SEQ ID NO: 1364714 - RNA, 15 nt, Mycobacterium tuberculosis H37Rv
cucggugaacgccgc

SEQ ID NO: 1364715 - RNA, 22 nt, Mycobacterium tuberculosis H37Rv
cucggugaagauuccaugcgac

SEQ ID NO: 1364716 - RNA, 19 nt, Mycobacterium tuberculosis H37Rv
cucggugaaguggcgcacc

SEQ ID NO: 1364717 - RNA, 23 nt, Mycobacterium tuberculosis H37Rv
cucggugaaguggcgcaccaccu

SEQ ID NO: 1364718 - RNA, 17 nt, Mycobacterium tuberculosis H37Rv
cucgguccacgggccgg

SEQ ID NO: 1364719 - RNA, 17 nt, Mycobacterium tuberculosis H37Rv
cucggucagcgucaggu

SEQ ID NO: 1364720 - RNA, 18 nt, Mycobacterium tuberculosis H37Rv
cucggucagcgucaggug

SEQ ID NO: 1364721 - RNA, 14 nt, Mycobacterium tuberculosis H37Rv
cucggucgccaccg

SEQ ID NO: 1364722 - RNA, 12 nt, Mycobacterium tuberculosis H37Rv
cucgggcggcuu

SEQ ID NO: 1364723 - RNA, 18 nt, Mycobacterium tuberculosis H37Rv
cucgggcaggccccacug

SEQ ID NO: 1364724 - RNA, 12 nt, Mycobacterium tuberculosis H37Rv
cucgggccagau

SEQ ID NO: 1364725 - RNA, 22 nt, Mycobacterium tuberculosis H37Rv
cucgggcaccuggucggccgca

SEQ ID NO: 1364726 - RNA, 22 nt, Mycobacterium tuberculosis H37Rv
cucgggcagcgcggccagugcu

SEQ ID NO: 1364727 - RNA, 21 nt, Mycobacterium tuberculosis H37Rv
cucggcgaccugccggaccgc

SEQ ID NO: 1364728 - RNA, 13 nt, Mycobacterium tuberculosis H37Rv
cucggccuggaug

SEQ ID NO: 1364729 - RNA, 14 nt, Mycobacterium tuberculosis H37Rv
cucggcgacugcgu

SEQ ID NO: 1364730 - RNA, 22 nt, Mycobacterium tuberculosis H37Rv
cucggcgacugcgucggcggcu

SEQ ID NO: 1364731 - RNA, 20 nt, Mycobacterium tuberculosis H37Rv
cucggcgaaggccgcgcgca

SEQ ID NO: 1364732 - RNA, 16 nt, Mycobacterium tuberculosis H37Rv
cucggcgagcaccacc

SEQ ID NO: 1364733 - RNA, 21 nt, Mycobacterium tuberculosis H37Rv
cucggcgagcaccaccccagc

SEQ ID NO: 1364734 - RNA, 22 nt, Mycobacterium tuberculosis H37Rv
cucggccuguucggcggcugcc

SEQ ID NO: 1364735 - RNA, 13 nt, Mycobacterium tuberculosis H37Rv
cucggcgagccgc

SEQ ID NO: 1364736 - RNA, 17 nt, Mycobacterium tuberculosis H37Rv
cucggcuuugccgcugu

SEQ ID NO: 1364737 - RNA, 17 nt, Mycobacterium tuberculosis H37Rv
cucggcuuggccggcgg

SEQ ID NO: 1364738 - RNA, 19 nt, Mycobacterium tuberculosis H37Rv
cucgggacggccgccgccg

SEQ ID NO: 1364739 - RNA, 15 nt, Mycobacterium tuberculosis H37Rv
cucggcugcucgacg

SEQ ID NO: 1364740 - RNA, 20 nt, Mycobacterium tuberculosis H37Rv
cucggcgaguucggcagcgg

SEQ ID NO: 1364741 - RNA, 16 nt, Mycobacterium tuberculosis H37Rv
cucggcgaucaagccu

SEQ ID NO: 1364742 - RNA, 16 nt, Mycobacterium tuberculosis H37Rv
cucggcgaggucagag

SEQ ID NO: 1364743 - RNA, 22 nt, Mycobacterium tuberculosis H37Rv
cucguaguaguccagcacggcc

SEQ ID NO: 1364744 - RNA, 16 nt, Mycobacterium tuberculosis H37Rv
cucguccagcagugcg

SEQ ID NO: 1364745 - RNA, 17 nt, Mycobacterium tuberculosis H37Rv
cucguccaggucggccg

SEQ ID NO: 1364746 - RNA, 14 nt, Mycobacterium tuberculosis H37Rv
cucguccagcaacc

SEQ ID NO: 1364747 - RNA, 18 nt, Mycobacterium tuberculosis H37Rv
cucgucgaacauggcacg

SEQ ID NO: 1364748 - RNA, 18 nt, Mycobacterium tuberculosis H37Rv
cucgucgaggucagcucc

SEQ ID NO: 1364749 - RNA, 21 nt, Mycobacterium tuberculosis H37Rv
cucguccggugcgaucccacc

SEQ ID NO: 1364750 - RNA, 23 nt, Mycobacterium tuberculosis H37Rv
cucguccugacgguacagcucca

SEQ ID NO: 1364751 - RNA, 18 nt, Mycobacterium tuberculosis H37Rv
cucgucgagguccucguc

SEQ ID NO: 1364752 - RNA, 20 nt, Mycobacterium tuberculosis H37Rv
cucgucgaugucguuggcca

SEQ ID NO: 1364753 - RNA, 22 nt, Mycobacterium tuberculosis H37Rv
cucgucgaugucguuggccacc

SEQ ID NO: 1364754 - RNA, 14 nt, Mycobacterium tuberculosis H37Rv
cucgucgccccguu

SEQ ID NO: 1364755 - RNA, 18 nt, Mycobacterium tuberculosis H37Rv
cucguagaaucggcucag

SEQ ID NO: 1364756 - RNA, 22 nt, Mycobacterium tuberculosis H37Rv
cucggugacgucgccgggcggc

SEQ ID NO: 1364757 - RNA, 16 nt, Mycobacterium tuberculosis H37Rv
cucggugaccaggccg

SEQ ID NO: 1364758 - RNA, 19 nt, Mycobacterium tuberculosis H37Rv
cucggugaccaggccggcc

SEQ ID NO: 1364759 - RNA, 22 nt, Mycobacterium tuberculosis H37Rv
cucggugaccaggccggcccgc

SEQ ID NO: 1364760 - RNA, 23 nt, Mycobacterium tuberculosis H37Rv
cucgucacccgguguccagugca

SEQ ID NO: 1364761 - RNA, 19 nt, Mycobacterium tuberculosis H37Rv
cucguaggcguacaccagg

SEQ ID NO: 1364762 - RNA, 16 nt, Mycobacterium tuberculosis H37Rv
cucguaggugaagagc

SEQ ID NO: 1364763 - RNA, 20 nt, Mycobacterium tuberculosis H37Rv
cucguaggugaagagcacgu

SEQ ID NO: 1364764 - RNA, 20 nt, Mycobacterium tuberculosis H37Rv
cucucagcacgguuguugua

SEQ ID NO: 1364765 - RNA, 19 nt, Mycobacterium tuberculosis H37Rv
cucuccguccucgucccag

SEQ ID NO: 1364766 - RNA, 14 nt, Mycobacterium tuberculosis H37Rv
cucuccccuggccc

SEQ ID NO: 1364767 - RNA, 18 nt, Mycobacterium tuberculosis H37Rv
cucuccuggaaaggacgg

SEQ ID NO: 1364768 - RNA, 14 nt, Mycobacterium tuberculosis H37Rv
cucgucggccaccg

SEQ ID NO: 1364769 - RNA, 14 nt, Mycobacterium tuberculosis H37Rv
cucgucggccagug

SEQ ID NO: 1364770 - RNA, 16 nt, Mycobacterium tuberculosis H37Rv
cucgucggccagugcg

SEQ ID NO: 1364771 - RNA, 21 nt, Mycobacterium tuberculosis H37Rv
cucgucggccgacaccgccac

SEQ ID NO: 1364772 - RNA, 24 nt, Mycobacterium tuberculosis H37Rv
cucgucggccugguacucccgcga

SEQ ID NO: 1364773 - RNA, 15 nt, Mycobacterium tuberculosis H37Rv
cucgucgcugcccau

SEQ ID NO: 1364774 - RNA, 21 nt, Mycobacterium tuberculosis H37Rv
cucgucggcgauggccagcac

SEQ ID NO: 1364775 - RNA, 14 nt, Mycobacterium tuberculosis H37Rv
cucuaugcgggcag

SEQ ID NO: 1364776 - RNA, 15 nt, Mycobacterium tuberculosis H37Rv
cucucuucgcgcgcu

SEQ ID NO: 1364777 - RNA, 23 nt, Mycobacterium tuberculosis H37Rv
cucucugucgcguuguggcugaa

SEQ ID NO: 1364778 - RNA, 16 nt, Mycobacterium tuberculosis H37Rv
cucucuuugagcaggu

SEQ ID NO: 1364779 - RNA, 17 nt, Mycobacterium tuberculosis H37Rv
cucucggucugcaugcg

SEQ ID NO: 1364780 - RNA, 17 nt, Mycobacterium tuberculosis H37Rv
cucucggucaguuccuc

SEQ ID NO: 1364781 - RNA, 19 nt, Mycobacterium tuberculosis H37Rv
cucucggucaguuccucua

SEQ ID NO: 1364782 - RNA, 14 nt, Mycobacterium tuberculosis H37Rv
cucucgcucgugca

SEQ ID NO: 1364783 - RNA, 23 nt, Mycobacterium tuberculosis H37Rv
cucuccuggaaaggacggccggc

SEQ ID NO: 1364784 - RNA, 20 nt, Mycobacterium tuberculosis H37Rv
cucugagcgggcgggccugc

SEQ ID NO: 1364785 - RNA, 16 nt, Mycobacterium tuberculosis H37Rv
cucugcgucugcucac

SEQ ID NO: 1364786 - RNA, 14 nt, Mycobacterium tuberculosis H37Rv
cucuugcgggcagc

SEQ ID NO: 1364787 - RNA, 13 nt, Mycobacterium tuberculosis H37Rv
cucuugcaccagg

SEQ ID NO: 1364788 - RNA, 14 nt, Mycobacterium tuberculosis H37Rv
cucuugcaaccugg

SEQ ID NO: 1364789 - RNA, 13 nt, Mycobacterium tuberculosis H37Rv
cucuucgcgcgcu

SEQ ID NO: 1364790 - RNA, 23 nt, Mycobacterium tuberculosis H37Rv
cucuucgcgcgcugggcgcgcuc

SEQ ID NO: 1364791 - RNA, 20 nt, Mycobacterium tuberculosis H37Rv
cucuucgaucuguuccugca

SEQ ID NO: 1364792 - RNA, 15 nt, Mycobacterium tuberculosis H37Rv
cucuguuguggucag

SEQ ID NO: 1364793 - RNA, 12 nt, Mycobacterium tuberculosis H37Rv
cucuucaggccc

SEQ ID NO: 1364794 - RNA, 16 nt, Mycobacterium tuberculosis H37Rv
cucugucgcguugugg

SEQ ID NO: 1364795 - RNA, 14 nt, Mycobacterium tuberculosis H37Rv
cucugucuucagcu

SEQ ID NO: 1364796 - RNA, 14 nt, Mycobacterium tuberculosis H37Rv
cucugggcuguccu

SEQ ID NO: 1364797 - RNA, 20 nt, Mycobacterium tuberculosis H37Rv
cucugggcuguccuccugaa

SEQ ID NO: 1364798 - RNA, 23 nt, Mycobacterium tuberculosis H37Rv
cucuggcgagggcuaccggcgcc

SEQ ID NO: 1364799 - RNA, 22 nt, Mycobacterium tuberculosis H37Rv
cucuggauucuucagcgcggca

SEQ ID NO: 1364800 - RNA, 20 nt, Mycobacterium tuberculosis H37Rv
cugaacaguugcacaccggc

SEQ ID NO: 1364801 - RNA, 21 nt, Mycobacterium tuberculosis H37Rv
cugaacauacgaaacaugcgc

SEQ ID NO: 1364802 - RNA, 16 nt, Mycobacterium tuberculosis H37Rv
cugaacaccgugggcg

SEQ ID NO: 1364803 - RNA, 23 nt, Mycobacterium tuberculosis H37Rv
cugaaccgguugacacccgggcc

SEQ ID NO: 1364804 - RNA, 21 nt, Mycobacterium tuberculosis H37Rv
cugaacgaaaugcacgccggg

SEQ ID NO: 1364805 - RNA, 15 nt, Mycobacterium tuberculosis H37Rv
cugaacucaacacca

SEQ ID NO: 1364806 - RNA, 17 nt, Mycobacterium tuberculosis H37Rv
cugaacucaacaccagc

SEQ ID NO: 1364807 - RNA, 13 nt, Mycobacterium tuberculosis H37Rv
cugaagagcaaug

SEQ ID NO: 1364808 - RNA, 14 nt, Mycobacterium tuberculosis H37Rv
cucuuuuagccaca

SEQ ID NO: 1364809 - RNA, 19 nt, Mycobacterium tuberculosis H37Rv
cugaaacgcuuggcccugg

SEQ ID NO: 1364810 - RNA, 16 nt, Mycobacterium tuberculosis H37Rv
cugaaaauugaccccc

SEQ ID NO: 1364811 - RNA, 14 nt, Mycobacterium tuberculosis H37Rv
cugagacugccgcc

SEQ ID NO: 1364812 - RNA, 23 nt, Mycobacterium tuberculosis H37Rv
cugagcagcgcggccagagccgc

SEQ ID NO: 1364813 - RNA, 17 nt, Mycobacterium tuberculosis H37Rv
cugagcacggcgcggcg

SEQ ID NO: 1364814 - RNA, 11 nt, Mycobacterium tuberculosis H37Rv
cugacggccau

SEQ ID NO: 1364815 - RNA, 16 nt, Mycobacterium tuberculosis H37Rv
cugacuagggucaccg

SEQ ID NO: 1364816 - RNA, 16 nt, Mycobacterium tuberculosis H37Rv
cugacgccgagcuggu

SEQ ID NO: 1364817 - RNA, 19 nt, Mycobacterium tuberculosis H37Rv
cugacgccgagcugguuga

SEQ ID NO: 1364818 - RNA, 17 nt, Mycobacterium tuberculosis H37Rv
cugacgcccucauaggc

SEQ ID NO: 1364819 - RNA, 22 nt, Mycobacterium tuberculosis H37Rv
cugacggaaguacuccauggca

SEQ ID NO: 1364820 - RNA, 16 nt, Mycobacterium tuberculosis H37Rv
cugacgcggccgggcg

SEQ ID NO: 1364821 - RNA, 15 nt, Mycobacterium tuberculosis H37Rv
cugacgcggccgggc

SEQ ID NO: 1364822 - RNA, 24 nt, Mycobacterium tuberculosis H37Rv
cugaccagccuuaugcagugacag

SEQ ID NO: 1364823 - RNA, 20 nt, Mycobacterium tuberculosis H37Rv
cugaccaugaccgggcuggc

SEQ ID NO: 1364824 - RNA, 13 nt, Mycobacterium tuberculosis H37Rv
cugaccagcgucc

SEQ ID NO: 1364825 - RNA, 13 nt, Mycobacterium tuberculosis H37Rv
cugacauuuccac

SEQ ID NO: 1364826 - RNA, 17 nt, Mycobacterium tuberculosis H37Rv
cugaccacgucggacag

SEQ ID NO: 1364827 - RNA, 22 nt, Mycobacterium tuberculosis H37Rv
cugaccacgucggacagcuuuc

SEQ ID NO: 1364828 - RNA, 13 nt, Mycobacterium tuberculosis H37Rv
cugaccacgguag

SEQ ID NO: 1364829 - RNA, 14 nt, Mycobacterium tuberculosis H37Rv
cugaccgugcugaa

SEQ ID NO: 1364830 - RNA, 15 nt, Mycobacterium tuberculosis H37Rv
cugaccccggcagcg

SEQ ID NO: 1364831 - RNA, 18 nt, Mycobacterium tuberculosis H37Rv
cugaccccgccggcugcg

SEQ ID NO: 1364832 - RNA, 15 nt, Mycobacterium tuberculosis H37Rv
cugacccgccacaac

SEQ ID NO: 1364833 - RNA, 12 nt, Mycobacterium tuberculosis H37Rv
cugaccccgccg

SEQ ID NO: 1364834 - RNA, 16 nt, Mycobacterium tuberculosis H37Rv
cugacccccgaccccg

SEQ ID NO: 1364835 - RNA, 18 nt, Mycobacterium tuberculosis H37Rv
cugacccaccgccccggc

SEQ ID NO: 1364836 - RNA, 14 nt, Mycobacterium tuberculosis H37Rv
cugacccaccgccc

SEQ ID NO: 1364837 - RNA, 22 nt, Mycobacterium tuberculosis H37Rv
cugacccauggucaccagcugg

SEQ ID NO: 1364838 - RNA, 21 nt, Mycobacterium tuberculosis H37Rv
cugaccuucucacgcaccaug

SEQ ID NO: 1364839 - RNA, 15 nt, Mycobacterium tuberculosis H37Rv
cugaccuucaggccc

SEQ ID NO: 1364840 - RNA, 13 nt, Mycobacterium tuberculosis H37Rv
cugaagcccgaca

SEQ ID NO: 1364841 - RNA, 13 nt, Mycobacterium tuberculosis H37Rv
cugaagggccgcc

SEQ ID NO: 1364842 - RNA, 21 nt, Mycobacterium tuberculosis H37Rv
cugaaggccgguagcgcgggu

SEQ ID NO: 1364843 - RNA, 17 nt, Mycobacterium tuberculosis H37Rv
cugaaggacggcagcuu

SEQ ID NO: 1364844 - RNA, 16 nt, Mycobacterium tuberculosis H37Rv
cugacacccgcagcug

SEQ ID NO: 1364845 - RNA, 17 nt, Mycobacterium tuberculosis H37Rv
cugacauuuccaccacg

SEQ ID NO: 1364846 - RNA, 22 nt, Mycobacterium tuberculosis H37Rv
cugacacccacggcgccaccac

SEQ ID NO: 1364847 - RNA, 18 nt, Mycobacterium tuberculosis H37Rv
cugacaacgacaacaccc

SEQ ID NO: 1364848 - RNA, 19 nt, Mycobacterium tuberculosis H37Rv
cugauaugggggcucuuca

SEQ ID NO: 1364849 - RNA, 24 nt, Mycobacterium tuberculosis H37Rv
cugagcccgccgcgaccacgcacc

SEQ ID NO: 1364850 - RNA, 22 nt, Mycobacterium tuberculosis H37Rv
cugagucgguucagccacgcag

SEQ ID NO: 1364851 - RNA, 19 nt, Mycobacterium tuberculosis H37Rv
cugagucgguucagccacg

SEQ ID NO: 1364852 - RNA, 23 nt, Mycobacterium tuberculosis H37Rv
cugagccgcgaaaucaccgcuga

SEQ ID NO: 1364853 - RNA, 21 nt, Mycobacterium tuberculosis H37Rv
cugagccgggguacccggugg

SEQ ID NO: 1364854 - RNA, 16 nt, Mycobacterium tuberculosis H37Rv
cugaguggcgaguggc

SEQ ID NO: 1364855 - RNA, 18 nt, Mycobacterium tuberculosis H37Rv
cugaguugcgggcuuuga

SEQ ID NO: 1364856 - RNA, 21 nt, Mycobacterium tuberculosis H37Rv
cugauccacgauaucgaugcg

SEQ ID NO: 1364857 - RNA, 16 nt, Mycobacterium tuberculosis H37Rv
cugauccgccugccga

SEQ ID NO: 1364858 - RNA, 13 nt, Mycobacterium tuberculosis H37Rv
cugaucaggccac

SEQ ID NO: 1364859 - RNA, 15 nt, Mycobacterium tuberculosis H37Rv
cugaucaggccacac

SEQ ID NO: 1364860 - RNA, 16 nt, Mycobacterium tuberculosis H37Rv
cugaucaggccacacu

SEQ ID NO: 1364861 - RNA, 20 nt, Mycobacterium tuberculosis H37Rv
cugaucaggccacacuugca

SEQ ID NO: 1364862 - RNA, 18 nt, Mycobacterium tuberculosis H37Rv
cugaucaagugccagcgu

SEQ ID NO: 1364863 - RNA, 16 nt, Mycobacterium tuberculosis H37Rv
cugauuggcccaccgc

SEQ ID NO: 1364864 - RNA, 21 nt, Mycobacterium tuberculosis H37Rv
cugauuguguuccaccagcgc

SEQ ID NO: 1364865 - RNA, 19 nt, Mycobacterium tuberculosis H37Rv
cugauugagguagaccugg

SEQ ID NO: 1364866 - RNA, 14 nt, Mycobacterium tuberculosis H37Rv
cugaucugcguugc

SEQ ID NO: 1364867 - RNA, 16 nt, Mycobacterium tuberculosis H37Rv
cugaucuggggcacca

SEQ ID NO: 1364868 - RNA, 23 nt, Mycobacterium tuberculosis H37Rv
cugaucuuggagaagguuucccg

SEQ ID NO: 1364869 - RNA, 19 nt, Mycobacterium tuberculosis H37Rv
cugcaacgucacucccugg

SEQ ID NO: 1364870 - RNA, 18 nt, Mycobacterium tuberculosis H37Rv
cugcaacucuucccauuu

SEQ ID NO: 1364871 - RNA, 11 nt, Mycobacterium tuberculosis H37Rv
cugcuggaugu

SEQ ID NO: 1364872 - RNA, 17 nt, Mycobacterium tuberculosis H37Rv
cugcuguuucggcagga

SEQ ID NO: 1364873 - RNA, 18 nt, Mycobacterium tuberculosis H37Rv
cugcuggcccugcuccuc

SEQ ID NO: 1364874 - RNA, 13 nt, Mycobacterium tuberculosis H37Rv
cugcuggcccugc

SEQ ID NO: 1364875 - RNA, 13 nt, Mycobacterium tuberculosis H37Rv
cugcuggcagacc

SEQ ID NO: 1364876 - RNA, 22 nt, Mycobacterium tuberculosis H37Rv
cugcugcuugacuccgcgcgcu

SEQ ID NO: 1364877 - RNA, 16 nt, Mycobacterium tuberculosis H37Rv
cugcugcucggccugg

SEQ ID NO: 1364878 - RNA, 11 nt, Mycobacterium tuberculosis H37Rv
cugcugcucgg

SEQ ID NO: 1364879 - RNA, 23 nt, Mycobacterium tuberculosis H37Rv
cugcuuugccuuagcccggccgc

SEQ ID NO: 1364880 - RNA, 15 nt, Mycobacterium tuberculosis H37Rv
cuggaaagggccgcc

SEQ ID NO: 1364881 - RNA, 15 nt, Mycobacterium tuberculosis H37Rv
cuggacaagcuccuc

SEQ ID NO: 1364882 - RNA, 18 nt, Mycobacterium tuberculosis H37Rv
cuggaccacagccgcgcc

SEQ ID NO: 1364883 - RNA, 19 nt, Mycobacterium tuberculosis H37Rv
cuggaccacucgccggcgg

SEQ ID NO: 1364884 - RNA, 20 nt, Mycobacterium tuberculosis H37Rv
cuggacauaccggcccgggu

SEQ ID NO: 1364885 - RNA, 18 nt, Mycobacterium tuberculosis H37Rv
cuggagaacucugcgaga

SEQ ID NO: 1364886 - RNA, 20 nt, Mycobacterium tuberculosis H37Rv
cuggaucgcgcccugagcca

SEQ ID NO: 1364887 - RNA, 12 nt, Mycobacterium tuberculosis H37Rv
cuggaucgagcu

SEQ ID NO: 1364888 - RNA, 19 nt, Mycobacterium tuberculosis H37Rv
cuggauccccugauggacc

SEQ ID NO: 1364889 - RNA, 15 nt, Mycobacterium tuberculosis H37Rv
cuggaucgugagcuu

SEQ ID NO: 1364890 - RNA, 16 nt, Mycobacterium tuberculosis H37Rv
cuggacccgcauggcg

SEQ ID NO: 1364891 - RNA, 15 nt, Mycobacterium tuberculosis H37Rv
cuggacccgcccagg

SEQ ID NO: 1364892 - RNA, 13 nt, Mycobacterium tuberculosis H37Rv
cuggaccgcggug

SEQ ID NO: 1364893 - RNA, 18 nt, Mycobacterium tuberculosis H37Rv
cuggacggaucuggaugu

SEQ ID NO: 1364894 - RNA, 20 nt, Mycobacterium tuberculosis H37Rv
cuggagaaaccacuggaugg

SEQ ID NO: 1364895 - RNA, 17 nt, Mycobacterium tuberculosis H37Rv
cuggacugcagcccugc

SEQ ID NO: 1364896 - RNA, 19 nt, Mycobacterium tuberculosis H37Rv
cuggacuccggucagcgcg

SEQ ID NO: 1364897 - RNA, 15 nt, Mycobacterium tuberculosis H37Rv
cuggacggggaagcc

SEQ ID NO: 1364898 - RNA, 20 nt, Mycobacterium tuberculosis H37Rv
cuggacggucauccggccgu

SEQ ID NO: 1364899 - RNA, 22 nt, Mycobacterium tuberculosis H37Rv
cuggcaacgacacgccgcuccc

SEQ ID NO: 1364900 - RNA, 15 nt, Mycobacterium tuberculosis H37Rv
cuggcaucccgggca

SEQ ID NO: 1364901 - RNA, 20 nt, Mycobacterium tuberculosis H37Rv
cuggcaucccgggcagucca

SEQ ID NO: 1364902 - RNA, 22 nt, Mycobacterium tuberculosis H37Rv
cuggccaugcggaaagccccuc

SEQ ID NO: 1364903 - RNA, 13 nt, Mycobacterium tuberculosis H37Rv
cuggcccaauugc

SEQ ID NO: 1364904 - RNA, 14 nt, Mycobacterium tuberculosis H37Rv
cuggccagcgcgcu

SEQ ID NO: 1364905 - RNA, 15 nt, Mycobacterium tuberculosis H37Rv
cuggccacucacauu

SEQ ID NO: 1364906 - RNA, 20 nt, Mycobacterium tuberculosis H37Rv
cuggccacggggcugccggu

SEQ ID NO: 1364907 - RNA, 23 nt, Mycobacterium tuberculosis H37Rv
cuggccacucacauuggccaggu

SEQ ID NO: 1364908 - RNA, 19 nt, Mycobacterium tuberculosis H37Rv
cuggccagcagagcggcac

SEQ ID NO: 1364909 - RNA, 20 nt, Mycobacterium tuberculosis H37Rv
cugcuccucgcgggcggcgu

SEQ ID NO: 1364910 - RNA, 15 nt, Mycobacterium tuberculosis H37Rv
cugcuccgcgccgcu

SEQ ID NO: 1364911 - RNA, 13 nt, Mycobacterium tuberculosis H37Rv
cugcuccuggaag

SEQ ID NO: 1364912 - RNA, 21 nt, Mycobacterium tuberculosis H37Rv
cugcuccucauagagcggcac

SEQ ID NO: 1364913 - RNA, 21 nt, Mycobacterium tuberculosis H37Rv
cugcucguagcggcggcgccc

SEQ ID NO: 1364914 - RNA, 17 nt, Mycobacterium tuberculosis H37Rv
cugcucgucggccaccg

SEQ ID NO: 1364915 - RNA, 14 nt, Mycobacterium tuberculosis H37Rv
cugcucgugagccc

SEQ ID NO: 1364916 - RNA, 13 nt, Mycobacterium tuberculosis H37Rv
cugcucgucgguc

SEQ ID NO: 1364917 - RNA, 20 nt, Mycobacterium tuberculosis H37Rv
cugcucgucgagccgaccgc

SEQ ID NO: 1364918 - RNA, 21 nt, Mycobacterium tuberculosis H37Rv
cugcucggucaggcggcuggc

SEQ ID NO: 1364919 - RNA, 21 nt, Mycobacterium tuberculosis H37Rv
cugcucgucgugagacugggc

SEQ ID NO: 1364920 - RNA, 16 nt, Mycobacterium tuberculosis H37Rv
cugcugccguggcggc

SEQ ID NO: 1364921 - RNA, 16 nt, Mycobacterium tuberculosis H37Rv
cugcugccgcaccggu

SEQ ID NO: 1364922 - RNA, 19 nt, Mycobacterium tuberculosis H37Rv
cugcugccguggcggcagc

SEQ ID NO: 1364923 - RNA, 19 nt, Mycobacterium tuberculosis H37Rv
cugcugcggcagcgcggcc

SEQ ID NO: 1364924 - RNA, 16 nt, Mycobacterium tuberculosis H37Rv
cugcugcggcagcgcg

SEQ ID NO: 1364925 - RNA, 16 nt, Mycobacterium tuberculosis H37Rv
cugcugcgagaucuug

SEQ ID NO: 1364926 - RNA, 20 nt, Mycobacterium tuberculosis H37Rv
cugcugcgagaucuugaugc

SEQ ID NO: 1364927 - RNA, 15 nt, Mycobacterium tuberculosis H37Rv
cugcugccagccgaa

SEQ ID NO: 1364928 - RNA, 14 nt, Mycobacterium tuberculosis H37Rv
cugcugccagccga

SEQ ID NO: 1364929 - RNA, 15 nt, Mycobacterium tuberculosis H37Rv
cugcugccagccugg

SEQ ID NO: 1364930 - RNA, 19 nt, Mycobacterium tuberculosis H37Rv
cugcugcacaucgcaucca

SEQ ID NO: 1364931 - RNA, 13 nt, Mycobacterium tuberculosis H37Rv
cugcugaacaacc

SEQ ID NO: 1364932 - RNA, 15 nt, Mycobacterium tuberculosis H37Rv
cugcugaacaaccag

SEQ ID NO: 1364933 - RNA, 15 nt, Mycobacterium tuberculosis H37Rv
cugcugcagcaauug

SEQ ID NO: 1364934 - RNA, 15 nt, Mycobacterium tuberculosis H37Rv
cugcggugccacggu

SEQ ID NO: 1364935 - RNA, 18 nt, Mycobacterium tuberculosis H37Rv
cugcgggcccggcggcca

SEQ ID NO: 1364936 - RNA, 14 nt, Mycobacterium tuberculosis H37Rv
cugcgggccgagau

SEQ ID NO: 1364937 - RNA, 15 nt, Mycobacterium tuberculosis H37Rv
cugcggugcgggcuu

SEQ ID NO: 1364938 - RNA, 21 nt, Mycobacterium tuberculosis H37Rv
cugcgcgugggcacagccaug

SEQ ID NO: 1364939 - RNA, 22 nt, Mycobacterium tuberculosis H37Rv
cugcguugggaucccagcgcag

SEQ ID NO: 1364940 - RNA, 22 nt, Mycobacterium tuberculosis H37Rv
cugcguccagcaaaugcggcgc

SEQ ID NO: 1364941 - RNA, 19 nt, Mycobacterium tuberculosis H37Rv
cugcucacgcagcagugcg

SEQ ID NO: 1364942 - RNA, 23 nt, Mycobacterium tuberculosis H37Rv
cugcguuggaauguccggcagcg

SEQ ID NO: 1364943 - RNA, 18 nt, Mycobacterium tuberculosis H37Rv
cugcgcgcccaccgggcg

SEQ ID NO: 1364944 - RNA, 17 nt, Mycobacterium tuberculosis H37Rv
cugcgcgcggccgcgcu

SEQ ID NO: 1364945 - RNA, 21 nt, Mycobacterium tuberculosis H37Rv
cugcgcgcggcggccgcggcu

SEQ ID NO: 1364946 - RNA, 14 nt, Mycobacterium tuberculosis H37Rv
cugcgcgcggccgc

SEQ ID NO: 1364947 - RNA, 14 nt, Mycobacterium tuberculosis H37Rv
cugcgccuaacccc

SEQ ID NO: 1364948 - RNA, 15 nt, Mycobacterium tuberculosis H37Rv
cugcgccgucgcagc

SEQ ID NO: 1364949 - RNA, 16 nt, Mycobacterium tuberculosis H37Rv
cugcgccgugacccau

SEQ ID NO: 1364950 - RNA, 21 nt, Mycobacterium tuberculosis H37Rv
cugcgccuucgccagcggcgc

SEQ ID NO: 1364951 - RNA, 18 nt, Mycobacterium tuberculosis H37Rv
cugcgccuugaagcggug

SEQ ID NO: 1364952 - RNA, 16 nt, Mycobacterium tuberculosis H37Rv
cugcgccuucgccagc

SEQ ID NO: 1364953 - RNA, 21 nt, Mycobacterium tuberculosis H37Rv
cugcgcgaugcccacgcacag

SEQ ID NO: 1364954 - RNA, 20 nt, Mycobacterium tuberculosis H37Rv
cugcgcgauggccguugcca

SEQ ID NO: 1364955 - RNA, 12 nt, Mycobacterium tuberculosis H37Rv
cugcgccgaccc

SEQ ID NO: 1364956 - RNA, 18 nt, Mycobacterium tuberculosis H37Rv
cugcgccgacccgcgcgc

SEQ ID NO: 1364957 - RNA, 19 nt, Mycobacterium tuberculosis H37Rv
cugcgccgacccgcgcgcc

SEQ ID NO: 1364958 - RNA, 17 nt, Mycobacterium tuberculosis H37Rv
cugcgcccauagcugcc

SEQ ID NO: 1364959 - RNA, 22 nt, Mycobacterium tuberculosis H37Rv
cugcgccgggucuguccaaugc

SEQ ID NO: 1364960 - RNA, 19 nt, Mycobacterium tuberculosis H37Rv
cugcgccgguaacuguccg

SEQ ID NO: 1364961 - RNA, 21 nt, Mycobacterium tuberculosis H37Rv
cugcgccggugccggccaucg

SEQ ID NO: 1364962 - RNA, 13 nt, Mycobacterium tuberculosis H37Rv
cugcgccggccgc

SEQ ID NO: 1364963 - RNA, 21 nt, Mycobacterium tuberculosis H37Rv
cugcgccaaaauccgcccacc

SEQ ID NO: 1364964 - RNA, 17 nt, Mycobacterium tuberculosis H37Rv
cugccgguagcacagca

SEQ ID NO: 1364965 - RNA, 16 nt, Mycobacterium tuberculosis H37Rv
cugccguucggggcgc

SEQ ID NO: 1364966 - RNA, 17 nt, Mycobacterium tuberculosis H37Rv
cugccguggcggcagcg

SEQ ID NO: 1364967 - RNA, 21 nt, Mycobacterium tuberculosis H37Rv
cugccggugucucccuugccg

SEQ ID NO: 1364968 - RNA, 17 nt, Mycobacterium tuberculosis H37Rv
cugccuccggaaggcuc

SEQ ID NO: 1364969 - RNA, 19 nt, Mycobacterium tuberculosis H37Rv
cugccucggggccuaucaa

SEQ ID NO: 1364970 - RNA, 21 nt, Mycobacterium tuberculosis H37Rv
cugccucggcgagccgcucgc

SEQ ID NO: 1364971 - RNA, 16 nt, Mycobacterium tuberculosis H37Rv
cugccguugggcaccg

SEQ ID NO: 1364972 - RNA, 15 nt, Mycobacterium tuberculosis H37Rv
cugccucaaaccgga

SEQ ID NO: 1364973 - RNA, 22 nt, Mycobacterium tuberculosis H37Rv
cugccgcacacgcgugcacgau

SEQ ID NO: 1364974 - RNA, 16 nt, Mycobacterium tuberculosis H37Rv
cugccgcacccccucc

SEQ ID NO: 1364975 - RNA, 14 nt, Mycobacterium tuberculosis H37Rv
cugccgcacccggu

SEQ ID NO: 1364976 - RNA, 14 nt, Mycobacterium tuberculosis H37Rv
cugccgcagugaca

SEQ ID NO: 1364977 - RNA, 16 nt, Mycobacterium tuberculosis H37Rv
cugccgggggcccgac

SEQ ID NO: 1364978 - RNA, 12 nt, Mycobacterium tuberculosis H37Rv
cugccgggaggg

SEQ ID NO: 1364979 - RNA, 15 nt, Mycobacterium tuberculosis H37Rv
cugccgggcgcgcgu

SEQ ID NO: 1364980 - RNA, 20 nt, Mycobacterium tuberculosis H37Rv
cugccgggcgcgcguagccg

SEQ ID NO: 1364981 - RNA, 15 nt, Mycobacterium tuberculosis H37Rv
cugccgccaggcucg

SEQ ID NO: 1364982 - RNA, 18 nt, Mycobacterium tuberculosis H37Rv
cugcgcaauagcgacagc

SEQ ID NO: 1364983 - RNA, 23 nt, Mycobacterium tuberculosis H37Rv
cugcgcaacaccgugcaccagcu

SEQ ID NO: 1364984 - RNA, 20 nt, Mycobacterium tuberculosis H37Rv
cugcgcaaauugcaacagag

SEQ ID NO: 1364985 - RNA, 21 nt, Mycobacterium tuberculosis H37Rv
cugcgcagugaauugcccaag

SEQ ID NO: 1364986 - RNA, 22 nt, Mycobacterium tuberculosis H37Rv
cugcgcagguggucgaucaggu

SEQ ID NO: 1364987 - RNA, 15 nt, Mycobacterium tuberculosis H37Rv
cugcgcagccgccuc

SEQ ID NO: 1364988 - RNA, 21 nt, Mycobacterium tuberculosis H37Rv
cugcgcagcggcauccacacc

SEQ ID NO: 1364989 - RNA, 15 nt, Mycobacterium tuberculosis H37Rv
cugccuuacacgccu

SEQ ID NO: 1364990 - RNA, 13 nt, Mycobacterium tuberculosis H37Rv
cugcauccuccuc

SEQ ID NO: 1364991 - RNA, 23 nt, Mycobacterium tuberculosis H37Rv
cugcaucgucgccaagcccaggc

SEQ ID NO: 1364992 - RNA, 14 nt, Mycobacterium tuberculosis H37Rv
cugcauccuccucg

SEQ ID NO: 1364993 - RNA, 15 nt, Mycobacterium tuberculosis H37Rv
cugcaugcccagaaa

SEQ ID NO: 1364994 - RNA, 16 nt, Mycobacterium tuberculosis H37Rv
cugccaaaagggcggc

SEQ ID NO: 1364995 - RNA, 16 nt, Mycobacterium tuberculosis H37Rv
cugcauguccuccccg

SEQ ID NO: 1364996 - RNA, 21 nt, Mycobacterium tuberculosis H37Rv
cugcacaacguggugucucgg

SEQ ID NO: 1364997 - RNA, 17 nt, Mycobacterium tuberculosis H37Rv
cugcacacugccgcgcu

SEQ ID NO: 1364998 - RNA, 12 nt, Mycobacterium tuberculosis H37Rv
cugcacaccacc

SEQ ID NO: 1364999 - RNA, 15 nt, Mycobacterium tuberculosis H37Rv
cugcacagcaggcuc

SEQ ID NO: 1365000 - RNA, 13 nt, Mycobacterium tuberculosis H37Rv
cugcacagcagcg

SEQ ID NO: 1365001 - RNA, 18 nt, Mycobacterium tuberculosis H37Rv
cugcagugacucgaucac

SEQ ID NO: 1365002 - RNA, 23 nt, Mycobacterium tuberculosis H37Rv
cugcagugacucgaucaccauga

SEQ ID NO: 1365003 - RNA, 18 nt, Mycobacterium tuberculosis H37Rv
cugcccgagguccgcccu

SEQ ID NO: 1365004 - RNA, 18 nt, Mycobacterium tuberculosis H37Rv
cugcccgccagcgccgcc

SEQ ID NO: 1365005 - RNA, 20 nt, Mycobacterium tuberculosis H37Rv
cugcccgccagcgccgccgc

SEQ ID NO: 1365006 - RNA, 23 nt, Mycobacterium tuberculosis H37Rv
cugcccgcccagcccggcguugu

SEQ ID NO: 1365007 - RNA, 19 nt, Mycobacterium tuberculosis H37Rv
cugcccgccgacgccagau

SEQ ID NO: 1365008 - RNA, 13 nt, Mycobacterium tuberculosis H37Rv
cugcccgcggcgg

SEQ ID NO: 1365009 - RNA, 21 nt, Mycobacterium tuberculosis H37Rv
cugcccgcgcggccaaucagc

SEQ ID NO: 1365010 - RNA, 23 nt, Mycobacterium tuberculosis H37Rv
cugccgauguguggaacauccgc

SEQ ID NO: 1365011 - RNA, 19 nt, Mycobacterium tuberculosis H37Rv
cugccaucccgaucccggc

SEQ ID NO: 1365012 - RNA, 13 nt, Mycobacterium tuberculosis H37Rv
cugcccaccuucg

SEQ ID NO: 1365013 - RNA, 22 nt, Mycobacterium tuberculosis H37Rv
cugcccacgggccggccgagcg

SEQ ID NO: 1365014 - RNA, 16 nt, Mycobacterium tuberculosis H37Rv
cugcccacgggccggc

SEQ ID NO: 1365015 - RNA, 13 nt, Mycobacterium tuberculosis H37Rv
cugcccagcaccc

SEQ ID NO: 1365016 - RNA, 14 nt, Mycobacterium tuberculosis H37Rv
cugcccagcaccac

SEQ ID NO: 1365017 - RNA, 17 nt, Mycobacterium tuberculosis H37Rv
cugcccagcagaccaag

SEQ ID NO: 1365018 - RNA, 15 nt, Mycobacterium tuberculosis H37Rv
cugccaacgggccau

SEQ ID NO: 1365019 - RNA, 15 nt, Mycobacterium tuberculosis H37Rv
cugccagaaugggcg

SEQ ID NO: 1365020 - RNA, 17 nt, Mycobacterium tuberculosis H37Rv
cugccagugccgcccac

SEQ ID NO: 1365021 - RNA, 17 nt, Mycobacterium tuberculosis H37Rv
cugccaguucuuggcga

SEQ ID NO: 1365022 - RNA, 15 nt, Mycobacterium tuberculosis H37Rv
cugccaucacgcgcu

SEQ ID NO: 1365023 - RNA, 19 nt, Mycobacterium tuberculosis H37Rv
cugccagaucggucggcca

SEQ ID NO: 1365024 - RNA, 20 nt, Mycobacterium tuberculosis H37Rv
cugccagaucggucggccaa

SEQ ID NO: 1365025 - RNA, 20 nt, Mycobacterium tuberculosis H37Rv
cugccagcacccugauguga

SEQ ID NO: 1365026 - RNA, 17 nt, Mycobacterium tuberculosis H37Rv
cugccagcacccugaug

SEQ ID NO: 1365027 - RNA, 17 nt, Mycobacterium tuberculosis H37Rv
aaaagcccgacacgaaa

SEQ ID NO: 1365028 - RNA, 14 nt, Mycobacterium tuberculosis H37Rv
aaaagcaucaaagc

SEQ ID NO: 1365029 - RNA, 15 nt, Mycobacterium tuberculosis H37Rv
aaaaaccacccccac

SEQ ID NO: 1365030 - RNA, 17 nt, Mycobacterium tuberculosis H37Rv
aaacgauugcugcggcu

SEQ ID NO: 1365031 - RNA, 11 nt, Mycobacterium tuberculosis H37Rv
aaaccugggau

SEQ ID NO: 1365032 - RNA, 22 nt, Mycobacterium tuberculosis H37Rv
aaacgggguggcacgcaugagg

SEQ ID NO: 1365033 - RNA, 15 nt, Mycobacterium tuberculosis H37Rv
aaacuaauucuccug

SEQ ID NO: 1365034 - RNA, 18 nt, Mycobacterium tuberculosis H37Rv
aaacucaccagcaccccg

SEQ ID NO: 1365035 - RNA, 16 nt, Mycobacterium tuberculosis H37Rv
aaacuccgugccgagc

SEQ ID NO: 1365036 - RNA, 14 nt, Mycobacterium tuberculosis H37Rv
aaaggaagaccucg

SEQ ID NO: 1365037 - RNA, 21 nt, Mycobacterium tuberculosis H37Rv
aaagcgugaaguccgcuugcc

SEQ ID NO: 1365038 - RNA, 16 nt, Mycobacterium tuberculosis H37Rv
aaagggccgccgcugg

SEQ ID NO: 1365039 - RNA, 22 nt, Mycobacterium tuberculosis H37Rv
aaagucaccguccacgacagca

SEQ ID NO: 1365040 - RNA, 16 nt, Mycobacterium tuberculosis H37Rv
aaaguacgcccuggaa

SEQ ID NO: 1365041 - RNA, 17 nt, Mycobacterium tuberculosis H37Rv
aaagaucagcauggucc

SEQ ID NO: 1365042 - RNA, 22 nt, Mycobacterium tuberculosis H37Rv
aaagaucagcaugguccacagc

SEQ ID NO: 1365043 - RNA, 23 nt, Mycobacterium tuberculosis H37Rv
aaagaucagcaugguccacagcc

SEQ ID NO: 1365044 - RNA, 22 nt, Mycobacterium tuberculosis H37Rv
aaagccaccagaauccugcuuu

SEQ ID NO: 1365045 - RNA, 13 nt, Mycobacterium tuberculosis H37Rv
aaagccagcgcag

SEQ ID NO: 1365046 - RNA, 19 nt, Mycobacterium tuberculosis H37Rv
aaagaccgccgcugggucc

SEQ ID NO: 1365047 - RNA, 20 nt, Mycobacterium tuberculosis H37Rv
aaaucaagcacagcccggcu

SEQ ID NO: 1365048 - RNA, 15 nt, Mycobacterium tuberculosis H37Rv
aaaucaagcacagcc

SEQ ID NO: 1365049 - RNA, 14 nt, Mycobacterium tuberculosis H37Rv
aaaucaagcacagc

SEQ ID NO: 1365050 - RNA, 13 nt, Mycobacterium tuberculosis H37Rv
aaaucaagcacag

SEQ ID NO: 1365051 - RNA, 21 nt, Mycobacterium tuberculosis H37Rv
aaaucaccucaccagucaggu

SEQ ID NO: 1365052 - RNA, 19 nt, Mycobacterium tuberculosis H37Rv
aaagucaggacggccggcg

SEQ ID NO: 1365053 - RNA, 15 nt, Mycobacterium tuberculosis H37Rv
aaauaagggccggcg

SEQ ID NO: 1365054 - RNA, 22 nt, Mycobacterium tuberculosis H37Rv
aaaaaggcggcguuguccccca

SEQ ID NO: 1365055 - RNA, 18 nt, Mycobacterium tuberculosis H37Rv
aaaugccgggcccgacgu

SEQ ID NO: 1365056 - RNA, 16 nt, Mycobacterium tuberculosis H37Rv
augcaacgccaaaaug

SEQ ID NO: 1365057 - RNA, 15 nt, Mycobacterium tuberculosis H37Rv
augcaaacggauggu

SEQ ID NO: 1365058 - RNA, 10 nt, Mycobacterium tuberculosis H37Rv
augcaaugcu

SEQ ID NO: 1365059 - RNA, 16 nt, Mycobacterium tuberculosis H37Rv
augcacaaccgcugcu

SEQ ID NO: 1365060 - RNA, 14 nt, Mycobacterium tuberculosis H37Rv
augauugccaggac

SEQ ID NO: 1365061 - RNA, 16 nt, Mycobacterium tuberculosis H37Rv
augauguccucccauc

SEQ ID NO: 1365062 - RNA, 13 nt, Mycobacterium tuberculosis H37Rv
augaugucggccg

SEQ ID NO: 1365063 - RNA, 16 nt, Mycobacterium tuberculosis H37Rv
augauguugaaacacc

SEQ ID NO: 1365064 - RNA, 20 nt, Mycobacterium tuberculosis H37Rv
augauguugagcuggaccuc

SEQ ID NO: 1365065 - RNA, 17 nt, Mycobacterium tuberculosis H37Rv
augaugaccacauuggu

SEQ ID NO: 1365066 - RNA, 19 nt, Mycobacterium tuberculosis H37Rv
augaugaccggcaauuccg

SEQ ID NO: 1365067 - RNA, 18 nt, Mycobacterium tuberculosis H37Rv
augagcaugcccagcgca

SEQ ID NO: 1365068 - RNA, 12 nt, Mycobacterium tuberculosis H37Rv
augagcaugccc

SEQ ID NO: 1365069 - RNA, 15 nt, Mycobacterium tuberculosis H37Rv
augaucucacccagc

SEQ ID NO: 1365070 - RNA, 17 nt, Mycobacterium tuberculosis H37Rv
augaucucggcaaggac

SEQ ID NO: 1365071 - RNA, 22 nt, Mycobacterium tuberculosis H37Rv
augaucuugccacuccaggagc

SEQ ID NO: 1365072 - RNA, 16 nt, Mycobacterium tuberculosis H37Rv
augccugcccaccuuc

SEQ ID NO: 1365073 - RNA, 20 nt, Mycobacterium tuberculosis H37Rv
augccuucggccaaccaugc

SEQ ID NO: 1365074 - RNA, 19 nt, Mycobacterium tuberculosis H37Rv
augccgcucggcaaccugc

SEQ ID NO: 1365075 - RNA, 13 nt, Mycobacterium tuberculosis H37Rv
augccgcggugga

SEQ ID NO: 1365076 - RNA, 23 nt, Mycobacterium tuberculosis H37Rv
augccgccggcagcgcggauguc

SEQ ID NO: 1365077 - RNA, 14 nt, Mycobacterium tuberculosis H37Rv
augcgccaggcuga

SEQ ID NO: 1365078 - RNA, 21 nt, Mycobacterium tuberculosis H37Rv
augcgccccaugaugaacagc

SEQ ID NO: 1365079 - RNA, 16 nt, Mycobacterium tuberculosis H37Rv
augccacccagaugca

SEQ ID NO: 1365080 - RNA, 20 nt, Mycobacterium tuberculosis H37Rv
augccacccagaugcagcgg

SEQ ID NO: 1365081 - RNA, 14 nt, Mycobacterium tuberculosis H37Rv
augccaccgagcaa

SEQ ID NO: 1365082 - RNA, 19 nt, Mycobacterium tuberculosis H37Rv
augccauaaccggugggga

SEQ ID NO: 1365083 - RNA, 21 nt, Mycobacterium tuberculosis H37Rv
augccauaugggggaaagcuu

SEQ ID NO: 1365084 - RNA, 13 nt, Mycobacterium tuberculosis H37Rv
augccgaucggcc

SEQ ID NO: 1365085 - RNA, 12 nt, Mycobacterium tuberculosis H37Rv
augccgagaaga

SEQ ID NO: 1365086 - RNA, 17 nt, Mycobacterium tuberculosis H37Rv
augcccuuguaggccau

SEQ ID NO: 1365087 - RNA, 17 nt, Mycobacterium tuberculosis H37Rv
augccgacgacaacagc

SEQ ID NO: 1365088 - RNA, 22 nt, Mycobacterium tuberculosis H37Rv
augccgacgacaacagccagcu

SEQ ID NO: 1365089 - RNA, 20 nt, Mycobacterium tuberculosis H37Rv
augccgagaagugggcggua

SEQ ID NO: 1365090 - RNA, 10 nt, Mycobacterium tuberculosis H37Rv
augccgccga

SEQ ID NO: 1365091 - RNA, 10 nt, Mycobacterium tuberculosis H37Rv
augccgccgc

SEQ ID NO: 1365092 - RNA, 17 nt, Mycobacterium tuberculosis H37Rv
augccgcccaucacccc

SEQ ID NO: 1365093 - RNA, 19 nt, Mycobacterium tuberculosis H37Rv
augccgcccgcgccgccgg

SEQ ID NO: 1365094 - RNA, 16 nt, Mycobacterium tuberculosis H37Rv
augcaccccaugaccg

SEQ ID NO: 1365095 - RNA, 19 nt, Mycobacterium tuberculosis H37Rv
augcaccccaugaccggga

SEQ ID NO: 1365096 - RNA, 17 nt, Mycobacterium tuberculosis H37Rv
augccaagcuccaacca

SEQ ID NO: 1365097 - RNA, 12 nt, Mycobacterium tuberculosis H37Rv
augccacacacu

SEQ ID NO: 1365098 - RNA, 14 nt, Mycobacterium tuberculosis H37Rv
augccacacacugc

SEQ ID NO: 1365099 - RNA, 20 nt, Mycobacterium tuberculosis H37Rv
augcagcgggucgccgggcc

SEQ ID NO: 1365100 - RNA, 20 nt, Mycobacterium tuberculosis H37Rv
augcagccccacuucgggcg

SEQ ID NO: 1365101 - RNA, 13 nt, Mycobacterium tuberculosis H37Rv
augcugcccggca

SEQ ID NO: 1365102 - RNA, 20 nt, Mycobacterium tuberculosis H37Rv
augcugcccggcaaccugga

SEQ ID NO: 1365103 - RNA, 21 nt, Mycobacterium tuberculosis H37Rv
augcgcguuacccaucgccac

SEQ ID NO: 1365104 - RNA, 15 nt, Mycobacterium tuberculosis H37Rv
augcucggaaacagc

SEQ ID NO: 1365105 - RNA, 16 nt, Mycobacterium tuberculosis H37Rv
augcucgucuugggcc

SEQ ID NO: 1365106 - RNA, 20 nt, Mycobacterium tuberculosis H37Rv
augcucgucuugggccggga

SEQ ID NO: 1365107 - RNA, 13 nt, Mycobacterium tuberculosis H37Rv
augcuuccagcau

SEQ ID NO: 1365108 - RNA, 13 nt, Mycobacterium tuberculosis H37Rv
auggacaccaccu

SEQ ID NO: 1365109 - RNA, 16 nt, Mycobacterium tuberculosis H37Rv
auggacaacagcuugg

SEQ ID NO: 1365110 - RNA, 17 nt, Mycobacterium tuberculosis H37Rv
auggaaggcggccaggu

SEQ ID NO: 1365111 - RNA, 15 nt, Mycobacterium tuberculosis H37Rv
auggaccgccagggc

SEQ ID NO: 1365112 - RNA, 22 nt, Mycobacterium tuberculosis H37Rv
auggacgcuuggguagccugac

SEQ ID NO: 1365113 - RNA, 17 nt, Mycobacterium tuberculosis H37Rv
auggcacgcgggaagug

SEQ ID NO: 1365114 - RNA, 20 nt, Mycobacterium tuberculosis H37Rv
auggcccguuggcagcacag

SEQ ID NO: 1365115 - RNA, 22 nt, Mycobacterium tuberculosis H37Rv
auggcccggcucacagcacagc

SEQ ID NO: 1365116 - RNA, 22 nt, Mycobacterium tuberculosis H37Rv
auggcccgcacuugcccuagau

SEQ ID NO: 1365117 - RNA, 18 nt, Mycobacterium tuberculosis H37Rv
auggccgccuugaggccc

SEQ ID NO: 1365118 - RNA, 15 nt, Mycobacterium tuberculosis H37Rv
auggccgcgugcagc

SEQ ID NO: 1365119 - RNA, 23 nt, Mycobacterium tuberculosis H37Rv
augggcgccaucccgccgcccgc

SEQ ID NO: 1365120 - RNA, 15 nt, Mycobacterium tuberculosis H37Rv
auggggccaacaccu

SEQ ID NO: 1365121 - RNA, 22 nt, Mycobacterium tuberculosis H37Rv
augggcgucggucaccuggcga

SEQ ID NO: 1365122 - RNA, 14 nt, Mycobacterium tuberculosis H37Rv
augggcuaccgaga

SEQ ID NO: 1365123 - RNA, 22 nt, Mycobacterium tuberculosis H37Rv
augggcggauaguucaccacau

SEQ ID NO: 1365124 - RNA, 15 nt, Mycobacterium tuberculosis H37Rv
auggugcgccgggcg

SEQ ID NO: 1365125 - RNA, 20 nt, Mycobacterium tuberculosis H37Rv
auggugaaggcaaacaccag

SEQ ID NO: 1365126 - RNA, 21 nt, Mycobacterium tuberculosis H37Rv
augguggcgaucaucggcccc

SEQ ID NO: 1365127 - RNA, 21 nt, Mycobacterium tuberculosis H37Rv
augguggcgguuccggccggc

SEQ ID NO: 1365128 - RNA, 22 nt, Mycobacterium tuberculosis H37Rv
auggugggaaaugaaguggcgu

SEQ ID NO: 1365129 - RNA, 16 nt, Mycobacterium tuberculosis H37Rv
auggugugcagcagca

SEQ ID NO: 1365130 - RNA, 21 nt, Mycobacterium tuberculosis H37Rv
augguggugccaaccugggcc

SEQ ID NO: 1365131 - RNA, 21 nt, Mycobacterium tuberculosis H37Rv
augguggugccaacgggcagg

SEQ ID NO: 1365132 - RNA, 15 nt, Mycobacterium tuberculosis H37Rv
augguggugggugau

SEQ ID NO: 1365133 - RNA, 20 nt, Mycobacterium tuberculosis H37Rv
augguguaacggcggcugaa

SEQ ID NO: 1365134 - RNA, 21 nt, Mycobacterium tuberculosis H37Rv
augguucgcacaccuccucga

SEQ ID NO: 1365135 - RNA, 22 nt, Mycobacterium tuberculosis H37Rv
augguugcucgagcgguggcgu

SEQ ID NO: 1365136 - RNA, 16 nt, Mycobacterium tuberculosis H37Rv
augucgccgccuggcu

SEQ ID NO: 1365137 - RNA, 22 nt, Mycobacterium tuberculosis H37Rv
augucgccgcccacaugaacga

SEQ ID NO: 1365138 - RNA, 13 nt, Mycobacterium tuberculosis H37Rv
augucggccaggu

SEQ ID NO: 1365139 - RNA, 13 nt, Mycobacterium tuberculosis H37Rv
augucggccaccg

SEQ ID NO: 1365140 - RNA, 15 nt, Mycobacterium tuberculosis H37Rv
augucgggccaggcg

SEQ ID NO: 1365141 - RNA, 16 nt, Mycobacterium tuberculosis H37Rv
augucgcugccgccgc

SEQ ID NO: 1365142 - RNA, 17 nt, Mycobacterium tuberculosis H37Rv
augucgcggucgcccgc

SEQ ID NO: 1365143 - RNA, 14 nt, Mycobacterium tuberculosis H37Rv
augucgcgccaggc

SEQ ID NO: 1365144 - RNA, 17 nt, Mycobacterium tuberculosis H37Rv
augucgucgaccaggcc

SEQ ID NO: 1365145 - RNA, 22 nt, Mycobacterium tuberculosis H37Rv
augucgugcgggcgcaccaggg

SEQ ID NO: 1365146 - RNA, 18 nt, Mycobacterium tuberculosis H37Rv
augugaccgaacaacagc

SEQ ID NO: 1365147 - RNA, 19 nt, Mycobacterium tuberculosis H37Rv
augugaaagacaacccgcu

SEQ ID NO: 1365148 - RNA, 14 nt, Mycobacterium tuberculosis H37Rv
auguggccgugggu

SEQ ID NO: 1365149 - RNA, 16 nt, Mycobacterium tuberculosis H37Rv
auguguugccagauca

SEQ ID NO: 1365150 - RNA, 18 nt, Mycobacterium tuberculosis H37Rv
auguguugcgggugguuu

SEQ ID NO: 1365151 - RNA, 13 nt, Mycobacterium tuberculosis H37Rv
auguggccgccgu

SEQ ID NO: 1365152 - RNA, 15 nt, Mycobacterium tuberculosis H37Rv
augugcggcugcacc

SEQ ID NO: 1365153 - RNA, 23 nt, Mycobacterium tuberculosis H37Rv
augugccaggugcggugaucgau

SEQ ID NO: 1365154 - RNA, 15 nt, Mycobacterium tuberculosis H37Rv
auguguuugaucacc

SEQ ID NO: 1365155 - RNA, 16 nt, Mycobacterium tuberculosis H37Rv
auguucugcgggggua

SEQ ID NO: 1365156 - RNA, 20 nt, Mycobacterium tuberculosis H37Rv
auguucgccgcgcggaacac

SEQ ID NO: 1365157 - RNA, 15 nt, Mycobacterium tuberculosis H37Rv
auguucuuggucacc

SEQ ID NO: 1365158 - RNA, 20 nt, Mycobacterium tuberculosis H37Rv
auguugaucguugugcaccc

SEQ ID NO: 1365159 - RNA, 15 nt, Mycobacterium tuberculosis H37Rv
auuaaagccaccaga

SEQ ID NO: 1365160 - RNA, 14 nt, Mycobacterium tuberculosis H37Rv
auuaacugcuucca

SEQ ID NO: 1365161 - RNA, 19 nt, Mycobacterium tuberculosis H37Rv
auuagcccacccauggccu

SEQ ID NO: 1365162 - RNA, 13 nt, Mycobacterium tuberculosis H37Rv
auucauggcggca

SEQ ID NO: 1365163 - RNA, 21 nt, Mycobacterium tuberculosis H37Rv
auucaugccgguguugccgaa

SEQ ID NO: 1365164 - RNA, 19 nt, Mycobacterium tuberculosis H37Rv
auucauccaccccugagcu

SEQ ID NO: 1365165 - RNA, 14 nt, Mycobacterium tuberculosis H37Rv
aaaaggaagaccuc

SEQ ID NO: 1365166 - RNA, 16 nt, Mycobacterium tuberculosis H37Rv
auuccacgaucggcuc

SEQ ID NO: 1365167 - RNA, 23 nt, Mycobacterium tuberculosis H37Rv
auuccaugucgucgacaaacagc

SEQ ID NO: 1365168 - RNA, 17 nt, Mycobacterium tuberculosis H37Rv
auucccgcccagcagca

SEQ ID NO: 1365169 - RNA, 15 nt, Mycobacterium tuberculosis H37Rv
auuccuacgccgcca

SEQ ID NO: 1365170 - RNA, 13 nt, Mycobacterium tuberculosis H37Rv
auuccuugaugcc

SEQ ID NO: 1365171 - RNA, 19 nt, Mycobacterium tuberculosis H37Rv
auucucgagccaacgcauc

SEQ ID NO: 1365172 - RNA, 19 nt, Mycobacterium tuberculosis H37Rv
auucuccgcccucaguuca

SEQ ID NO: 1365173 - RNA, 13 nt, Mycobacterium tuberculosis H37Rv
auucugcugccag

SEQ ID NO: 1365174 - RNA, 18 nt, Mycobacterium tuberculosis H37Rv
auugcaccgcggccagca

SEQ ID NO: 1365175 - RNA, 19 nt, Mycobacterium tuberculosis H37Rv
auugcaccgcggccagcac

SEQ ID NO: 1365176 - RNA, 22 nt, Mycobacterium tuberculosis H37Rv
auugaugucagggaugaucacc

SEQ ID NO: 1365177 - RNA, 14 nt, Mycobacterium tuberculosis H37Rv
auugccuccgcuag

SEQ ID NO: 1365178 - RNA, 14 nt, Mycobacterium tuberculosis H37Rv
auugcggccgccgg

SEQ ID NO: 1365179 - RNA, 15 nt, Mycobacterium tuberculosis H37Rv
auugcccgcgcucgc

SEQ ID NO: 1365180 - RNA, 21 nt, Mycobacterium tuberculosis H37Rv
auugccgggcgcacgcccgca

SEQ ID NO: 1365181 - RNA, 11 nt, Mycobacterium tuberculosis H37Rv
auugccgccgg

SEQ ID NO: 1365182 - RNA, 17 nt, Mycobacterium tuberculosis H37Rv
auugccgcaugcucagc

SEQ ID NO: 1365183 - RNA, 16 nt, Mycobacterium tuberculosis H37Rv
auugccgccaccuugg

SEQ ID NO: 1365184 - RNA, 23 nt, Mycobacterium tuberculosis H37Rv
auugcccgucagguacgucuugg

SEQ ID NO: 1365185 - RNA, 21 nt, Mycobacterium tuberculosis H37Rv
auugcccguguuaaagaagcc

SEQ ID NO: 1365186 - RNA, 17 nt, Mycobacterium tuberculosis H37Rv
auugcccuugaccaugu

SEQ ID NO: 1365187 - RNA, 16 nt, Mycobacterium tuberculosis H37Rv
auugccgcaugcucag

SEQ ID NO: 1365188 - RNA, 14 nt, Mycobacterium tuberculosis H37Rv
auugugugcagcag

SEQ ID NO: 1365189 - RNA, 16 nt, Mycobacterium tuberculosis H37Rv
auugugugcagcagca

SEQ ID NO: 1365190 - RNA, 16 nt, Mycobacterium tuberculosis H37Rv
auugucgaucaccugc

SEQ ID NO: 1365191 - RNA, 17 nt, Mycobacterium tuberculosis H37Rv
auugucggcgaaaugaa

SEQ ID NO: 1365192 - RNA, 14 nt, Mycobacterium tuberculosis H37Rv
auuguugaagaaag

SEQ ID NO: 1365193 - RNA, 18 nt, Mycobacterium tuberculosis H37Rv
auuggugggccagcagca

SEQ ID NO: 1365194 - RNA, 14 nt, Mycobacterium tuberculosis H37Rv
auuggcucgagcaa

SEQ ID NO: 1365195 - RNA, 14 nt, Mycobacterium tuberculosis H37Rv
auuggcuccgaaca

SEQ ID NO: 1365196 - RNA, 17 nt, Mycobacterium tuberculosis H37Rv
auuucgcgucugcucgc

SEQ ID NO: 1365197 - RNA, 11 nt, Mycobacterium tuberculosis H37Rv
auuucgccgga

SEQ ID NO: 1365198 - RNA, 13 nt, Mycobacterium tuberculosis H37Rv
auuuccaugcugg

SEQ ID NO: 1365199 - RNA, 19 nt, Mycobacterium tuberculosis H37Rv
auuucgugucgcugcggcg

SEQ ID NO: 1365200 - RNA, 17 nt, Mycobacterium tuberculosis H37Rv
auuucgugccgaaaugg

SEQ ID NO: 1365201 - RNA, 22 nt, Mycobacterium tuberculosis H37Rv
auuucgucgucgcugagcagcg

SEQ ID NO: 1365202 - RNA, 12 nt, Mycobacterium tuberculosis H37Rv
caauuccagccc

SEQ ID NO: 1365203 - RNA, 13 nt, Mycobacterium tuberculosis H37Rv
caauuccucagcc

SEQ ID NO: 1365204 - RNA, 18 nt, Mycobacterium tuberculosis H37Rv
caauucggugcgcuggcg

SEQ ID NO: 1365205 - RNA, 12 nt, Mycobacterium tuberculosis H37Rv
caauucgacugc

SEQ ID NO: 1365206 - RNA, 19 nt, Mycobacterium tuberculosis H37Rv
caauugcgcugaagcccau

SEQ ID NO: 1365207 - RNA, 18 nt, Mycobacterium tuberculosis H37Rv
caauugcucguagcccag

SEQ ID NO: 1365208 - RNA, 15 nt, Mycobacterium tuberculosis H37Rv
caauugucaagccgu

SEQ ID NO: 1365209 - RNA, 14 nt, Mycobacterium tuberculosis H37Rv
caauuucacugcga

SEQ ID NO: 1365210 - RNA, 20 nt, Mycobacterium tuberculosis H37Rv
caauggugggcgagcugcug

SEQ ID NO: 1365211 - RNA, 14 nt, Mycobacterium tuberculosis H37Rv
caauggccagcacc

SEQ ID NO: 1365212 - RNA, 14 nt, Mycobacterium tuberculosis H37Rv
caauggccugcagc

SEQ ID NO: 1365213 - RNA, 17 nt, Mycobacterium tuberculosis H37Rv
caauggcgcgaccgaug

SEQ ID NO: 1365214 - RNA, 19 nt, Mycobacterium tuberculosis H37Rv
caauggcucugaggucacc

SEQ ID NO: 1365215 - RNA, 17 nt, Mycobacterium tuberculosis H37Rv
caaugaccugcagcgca

SEQ ID NO: 1365216 - RNA, 20 nt, Mycobacterium tuberculosis H37Rv
caaugacucggccgcaccag

SEQ ID NO: 1365217 - RNA, 16 nt, Mycobacterium tuberculosis H37Rv
cacacguuggcagccc

SEQ ID NO: 1365218 - RNA, 22 nt, Mycobacterium tuberculosis H37Rv
cacacgucaggcaacgaagagg

SEQ ID NO: 1365219 - RNA, 15 nt, Mycobacterium tuberculosis H37Rv
cacaccaacaccgcg

SEQ ID NO: 1365220 - RNA, 18 nt, Mycobacterium tuberculosis H37Rv
cacaccaaccgagcgccc

SEQ ID NO: 1365221 - RNA, 23 nt, Mycobacterium tuberculosis H37Rv
cacaccaaccgagcgcccuccuc

SEQ ID NO: 1365222 - RNA, 22 nt, Mycobacterium tuberculosis H37Rv
cacacgcccucgacgccgcgca

SEQ ID NO: 1365223 - RNA, 21 nt, Mycobacterium tuberculosis H37Rv
cacacaggcggcgaacugccu

SEQ ID NO: 1365224 - RNA, 20 nt, Mycobacterium tuberculosis H37Rv
cacacacagccgguggcauu

SEQ ID NO: 1365225 - RNA, 16 nt, Mycobacterium tuberculosis H37Rv
cacacaauucgggcgu

SEQ ID NO: 1365226 - RNA, 22 nt, Mycobacterium tuberculosis H37Rv
cacagaacucaccgacggauga

SEQ ID NO: 1365227 - RNA, 21 nt, Mycobacterium tuberculosis H37Rv
cacagaaucgcacgaaaucag

SEQ ID NO: 1365228 - RNA, 14 nt, Mycobacterium tuberculosis H37Rv
cacagaaccgggua

SEQ ID NO: 1365229 - RNA, 22 nt, Mycobacterium tuberculosis H37Rv
cacacguuggcagcccucuggu

SEQ ID NO: 1365230 - RNA, 16 nt, Mycobacterium tuberculosis H37Rv
cacagcacagcgcagc

SEQ ID NO: 1365231 - RNA, 13 nt, Mycobacterium tuberculosis H37Rv
cacagcacccacg

SEQ ID NO: 1365232 - RNA, 12 nt, Mycobacterium tuberculosis H37Rv
cacagcaggcuc

SEQ ID NO: 1365233 - RNA, 14 nt, Mycobacterium tuberculosis H37Rv
cacaagcugaacua

SEQ ID NO: 1365234 - RNA, 22 nt, Mycobacterium tuberculosis H37Rv
cacaaggcgugagcuaugcugg

SEQ ID NO: 1365235 - RNA, 23 nt, Mycobacterium tuberculosis H37Rv
cacaagcgauggcaccacuacau

SEQ ID NO: 1365236 - RNA, 20 nt, Mycobacterium tuberculosis H37Rv
cacaauccacgucgcggcgu

SEQ ID NO: 1365237 - RNA, 18 nt, Mycobacterium tuberculosis H37Rv
cacaauaggcuccagcgc

SEQ ID NO: 1365238 - RNA, 20 nt, Mycobacterium tuberculosis H37Rv
cacaagucgcgcgccaagac

SEQ ID NO: 1365239 - RNA, 17 nt, Mycobacterium tuberculosis H37Rv
cacaauacggucagcag

SEQ ID NO: 1365240 - RNA, 19 nt, Mycobacterium tuberculosis H37Rv
cacaaccggauugagcacg

SEQ ID NO: 1365241 - RNA, 16 nt, Mycobacterium tuberculosis H37Rv
cacaacggcggcgccg

SEQ ID NO: 1365242 - RNA, 23 nt, Mycobacterium tuberculosis H37Rv
cacaacgcgugaccagggccuga

SEQ ID NO: 1365243 - RNA, 16 nt, Mycobacterium tuberculosis H37Rv
cacaaccgcugcugcu

SEQ ID NO: 1365244 - RNA, 23 nt, Mycobacterium tuberculosis H37Rv
cacaacguggugucucggcugau

SEQ ID NO: 1365245 - RNA, 14 nt, Mycobacterium tuberculosis H37Rv
cacaaccaacgaca

SEQ ID NO: 1365246 - RNA, 17 nt, Mycobacterium tuberculosis H37Rv
caauuugccguagaaac

SEQ ID NO: 1365247 - RNA, 20 nt, Mycobacterium tuberculosis H37Rv
cacauccacgcacucacuac

SEQ ID NO: 1365248 - RNA, 15 nt, Mycobacterium tuberculosis H37Rv
cacauccggucagau

SEQ ID NO: 1365249 - RNA, 13 nt, Mycobacterium tuberculosis H37Rv
cacauccaguaac

SEQ ID NO: 1365250 - RNA, 17 nt, Mycobacterium tuberculosis H37Rv
cacagcuugcccgagcc

SEQ ID NO: 1365251 - RNA, 17 nt, Mycobacterium tuberculosis H37Rv
cacauaugugcccggcg

SEQ ID NO: 1365252 - RNA, 22 nt, Mycobacterium tuberculosis H37Rv
cacagcugauucugguucagcc

SEQ ID NO: 1365253 - RNA, 18 nt, Mycobacterium tuberculosis H37Rv
cacagcucgccgugacca

SEQ ID NO: 1365254 - RNA, 13 nt, Mycobacterium tuberculosis H37Rv
cacagcguaugca

SEQ ID NO: 1365255 - RNA, 13 nt, Mycobacterium tuberculosis H37Rv
cacagccaccagc

SEQ ID NO: 1365256 - RNA, 22 nt, Mycobacterium tuberculosis H37Rv
cacagcggccauaucgcccacc

SEQ ID NO: 1365257 - RNA, 16 nt, Mycobacterium tuberculosis H37Rv
cacagccccagggugc

SEQ ID NO: 1365258 - RNA, 17 nt, Mycobacterium tuberculosis H37Rv
cacaucgcauccacuuc

SEQ ID NO: 1365259 - RNA, 22 nt, Mycobacterium tuberculosis H37Rv
cacaucggccucugaccagccg

SEQ ID NO: 1365260 - RNA, 13 nt, Mycobacterium tuberculosis H37Rv
cacauucagcgcc

SEQ ID NO: 1365261 - RNA, 16 nt, Mycobacterium tuberculosis H37Rv
cacauuccgcaguccc

SEQ ID NO: 1365262 - RNA, 15 nt, Mycobacterium tuberculosis H37Rv
caccaaccagugcag

SEQ ID NO: 1365263 - RNA, 17 nt, Mycobacterium tuberculosis H37Rv
caccaaccgcccgauca

SEQ ID NO: 1365264 - RNA, 18 nt, Mycobacterium tuberculosis H37Rv
caccaacaccgcggcgcu

SEQ ID NO: 1365265 - RNA, 17 nt, Mycobacterium tuberculosis H37Rv
caccaacaccgcggcgc

SEQ ID NO: 1365266 - RNA, 15 nt, Mycobacterium tuberculosis H37Rv
caccaacacccgggc

SEQ ID NO: 1365267 - RNA, 17 nt, Mycobacterium tuberculosis H37Rv
caccaacacccgggccu

SEQ ID NO: 1365268 - RNA, 21 nt, Mycobacterium tuberculosis H37Rv
caccacaaacaccccacacag

SEQ ID NO: 1365269 - RNA, 23 nt, Mycobacterium tuberculosis H37Rv
caccaacgcgaucaggcgcucga

SEQ ID NO: 1365270 - RNA, 15 nt, Mycobacterium tuberculosis H37Rv
caccacaauccacgc

SEQ ID NO: 1365271 - RNA, 18 nt, Mycobacterium tuberculosis H37Rv
caccacaauccacgcacu

SEQ ID NO: 1365272 - RNA, 13 nt, Mycobacterium tuberculosis H37Rv
caccacaugggag

SEQ ID NO: 1365273 - RNA, 15 nt, Mycobacterium tuberculosis H37Rv
caccacaugggagcc

SEQ ID NO: 1365274 - RNA, 24 nt, Mycobacterium tuberculosis H37Rv
caccacauuggcgaucagcagccg

SEQ ID NO: 1365275 - RNA, 22 nt, Mycobacterium tuberculosis H37Rv
caccagaucgcacaccaacacc

SEQ ID NO: 1365276 - RNA, 21 nt, Mycobacterium tuberculosis H37Rv
caccagcaagugugagcagac

SEQ ID NO: 1365277 - RNA, 24 nt, Mycobacterium tuberculosis H37Rv
caccagcacggcaaccagcgagcc

SEQ ID NO: 1365278 - RNA, 18 nt, Mycobacterium tuberculosis H37Rv
caccacugcgcccgccac

SEQ ID NO: 1365279 - RNA, 17 nt, Mycobacterium tuberculosis H37Rv
caccacugcggccgcgc

SEQ ID NO: 1365280 - RNA, 21 nt, Mycobacterium tuberculosis H37Rv
caccacuagcggcucaccgcg

SEQ ID NO: 1365281 - RNA, 16 nt, Mycobacterium tuberculosis H37Rv
caccacgucgacgaug

SEQ ID NO: 1365282 - RNA, 22 nt, Mycobacterium tuberculosis H37Rv
caccacguugugcagcgcguca

SEQ ID NO: 1365283 - RNA, 14 nt, Mycobacterium tuberculosis H37Rv
caccacggccagaa

SEQ ID NO: 1365284 - RNA, 20 nt, Mycobacterium tuberculosis H37Rv
caccacggaccagcgccgga

SEQ ID NO: 1365285 - RNA, 12 nt, Mycobacterium tuberculosis H37Rv
caccacggccag

SEQ ID NO: 1365286 - RNA, 19 nt, Mycobacterium tuberculosis H37Rv
caccacgaccgacaccccg

SEQ ID NO: 1365287 - RNA, 17 nt, Mycobacterium tuberculosis H37Rv
caccacgauggcggcca

SEQ ID NO: 1365288 - RNA, 20 nt, Mycobacterium tuberculosis H37Rv
caccacgauggcggccaccg

SEQ ID NO: 1365289 - RNA, 16 nt, Mycobacterium tuberculosis H37Rv
caccacgauggcggcc

SEQ ID NO: 1365290 - RNA, 21 nt, Mycobacterium tuberculosis H37Rv
caccacgcgcguuuagucucc

SEQ ID NO: 1365291 - RNA, 13 nt, Mycobacterium tuberculosis H37Rv
caccacgcuggcc

SEQ ID NO: 1365292 - RNA, 18 nt, Mycobacterium tuberculosis H37Rv
caccacgcuggccucguc

SEQ ID NO: 1365293 - RNA, 18 nt, Mycobacterium tuberculosis H37Rv
caccacggaccagcgccg

SEQ ID NO: 1365294 - RNA, 15 nt, Mycobacterium tuberculosis H37Rv
caccacggaccagcg

SEQ ID NO: 1365295 - RNA, 17 nt, Mycobacterium tuberculosis H37Rv
caccacgcgccgcacau

SEQ ID NO: 1365296 - RNA, 14 nt, Mycobacterium tuberculosis H37Rv
caccaccaccgccg

SEQ ID NO: 1365297 - RNA, 13 nt, Mycobacterium tuberculosis H37Rv
caccaccacgccg

SEQ ID NO: 1365298 - RNA, 22 nt, Mycobacterium tuberculosis H37Rv
caccaccacugcggccgcgccg

SEQ ID NO: 1365299 - RNA, 21 nt, Mycobacterium tuberculosis H37Rv
caccaccuggugcaaccgugc

SEQ ID NO: 1365300 - RNA, 13 nt, Mycobacterium tuberculosis H37Rv
caccaccuuggau

SEQ ID NO: 1365301 - RNA, 16 nt, Mycobacterium tuberculosis H37Rv
caccagcgcccggccc

SEQ ID NO: 1365302 - RNA, 17 nt, Mycobacterium tuberculosis H37Rv
caccagcgcccggcccg

SEQ ID NO: 1365303 - RNA, 20 nt, Mycobacterium tuberculosis H37Rv
caccagcgcccggcccgcca

SEQ ID NO: 1365304 - RNA, 23 nt, Mycobacterium tuberculosis H37Rv
caccagcgcccggcccgccaccc

SEQ ID NO: 1365305 - RNA, 20 nt, Mycobacterium tuberculosis H37Rv
caccagcgccgacccguacc

SEQ ID NO: 1365306 - RNA, 21 nt, Mycobacterium tuberculosis H37Rv
caccagcgcgagcccgaacca

SEQ ID NO: 1365307 - RNA, 15 nt, Mycobacterium tuberculosis H37Rv
caccagcgcccggcc

SEQ ID NO: 1365308 - RNA, 13 nt, Mycobacterium tuberculosis H37Rv
caccagcgcgccg

SEQ ID NO: 1365309 - RNA, 15 nt, Mycobacterium tuberculosis H37Rv
caccagccacgccag

SEQ ID NO: 1365310 - RNA, 19 nt, Mycobacterium tuberculosis H37Rv
caccagccaccgcgcguca

SEQ ID NO: 1365311 - RNA, 17 nt, Mycobacterium tuberculosis H37Rv
caccagcauucucgccg

SEQ ID NO: 1365312 - RNA, 13 nt, Mycobacterium tuberculosis H37Rv
caccagcaugccu

SEQ ID NO: 1365313 - RNA, 15 nt, Mycobacterium tuberculosis H37Rv
caccagccagccugc

SEQ ID NO: 1365314 - RNA, 13 nt, Mycobacterium tuberculosis H37Rv
caccagcaggcgg

SEQ ID NO: 1365315 - RNA, 23 nt, Mycobacterium tuberculosis H37Rv
caccagguugccgagguugcgga

SEQ ID NO: 1365316 - RNA, 19 nt, Mycobacterium tuberculosis H37Rv
caccagcggcaccgcggcc

SEQ ID NO: 1365317 - RNA, 20 nt, Mycobacterium tuberculosis H37Rv
caccagcggcaccgcggcca

SEQ ID NO: 1365318 - RNA, 18 nt, Mycobacterium tuberculosis H37Rv
caccagcgcuccagcacc

SEQ ID NO: 1365319 - RNA, 13 nt, Mycobacterium tuberculosis H37Rv
caccagcggcggc

SEQ ID NO: 1365320 - RNA, 16 nt, Mycobacterium tuberculosis H37Rv
caccagcggcggcccu

SEQ ID NO: 1365321 - RNA, 20 nt, Mycobacterium tuberculosis H37Rv
caccagcggcugaccgggca

SEQ ID NO: 1365322 - RNA, 23 nt, Mycobacterium tuberculosis H37Rv
caccagcggcauauggauguugg

SEQ ID NO: 1365323 - RNA, 15 nt, Mycobacterium tuberculosis H37Rv
caccagcgucgcggc

SEQ ID NO: 1365324 - RNA, 20 nt, Mycobacterium tuberculosis H37Rv
caccagcggucagccggcca

SEQ ID NO: 1365325 - RNA, 16 nt, Mycobacterium tuberculosis H37Rv
caccagcucacccgga

SEQ ID NO: 1365326 - RNA, 21 nt, Mycobacterium tuberculosis H37Rv
caccagcucacccggagcacc

SEQ ID NO: 1365327 - RNA, 21 nt, Mycobacterium tuberculosis H37Rv
cacccugaugugaguccagcc

SEQ ID NO: 1365328 - RNA, 22 nt, Mycobacterium tuberculosis H37Rv
cacccugcgaauagccaccaag

SEQ ID NO: 1365329 - RNA, 21 nt, Mycobacterium tuberculosis H37Rv
cacccugcucgaacgcugagg

SEQ ID NO: 1365330 - RNA, 22 nt, Mycobacterium tuberculosis H37Rv
cacccugggcaaacugggcacc

SEQ ID NO: 1365331 - RNA, 13 nt, Mycobacterium tuberculosis H37Rv
cacccuuggcccg

SEQ ID NO: 1365332 - RNA, 20 nt, Mycobacterium tuberculosis H37Rv
cacccuugcccacggcgacc

SEQ ID NO: 1365333 - RNA, 22 nt, Mycobacterium tuberculosis H37Rv
caccgacagccccaucaccacc

SEQ ID NO: 1365334 - RNA, 20 nt, Mycobacterium tuberculosis H37Rv
caccgacagcccgaacgagg

SEQ ID NO: 1365335 - RNA, 14 nt, Mycobacterium tuberculosis H37Rv
caccgacaccgugu

SEQ ID NO: 1365336 - RNA, 16 nt, Mycobacterium tuberculosis H37Rv
caccgacagcacccgg

SEQ ID NO: 1365337 - RNA, 21 nt, Mycobacterium tuberculosis H37Rv
caccgacaucgucauccaggg

SEQ ID NO: 1365338 - RNA, 15 nt, Mycobacterium tuberculosis H37Rv
caccgacaugacgcg

SEQ ID NO: 1365339 - RNA, 19 nt, Mycobacterium tuberculosis H37Rv
caccgaccagggccgccgc

SEQ ID NO: 1365340 - RNA, 14 nt, Mycobacterium tuberculosis H37Rv
caccgaccagggcc

SEQ ID NO: 1365341 - RNA, 18 nt, Mycobacterium tuberculosis H37Rv
caccgacgacgcgcgcga

SEQ ID NO: 1365342 - RNA, 22 nt, Mycobacterium tuberculosis H37Rv
caccgacccgcugccacccauc

SEQ ID NO: 1365343 - RNA, 23 nt, Mycobacterium tuberculosis H37Rv
caccgaccccggaacgaccccac

SEQ ID NO: 1365344 - RNA, 21 nt, Mycobacterium tuberculosis H37Rv
caccgagaugcgcaauagacc

SEQ ID NO: 1365345 - RNA, 15 nt, Mycobacterium tuberculosis H37Rv
caccgagccacgacc

SEQ ID NO: 1365346 - RNA, 22 nt, Mycobacterium tuberculosis H37Rv
caccgagcccuccagggcccug

SEQ ID NO: 1365347 - RNA, 17 nt, Mycobacterium tuberculosis H37Rv
caccgagcgcaacccgu

SEQ ID NO: 1365348 - RNA, 21 nt, Mycobacterium tuberculosis H37Rv
caccgagccguccaagccagc

SEQ ID NO: 1365349 - RNA, 20 nt, Mycobacterium tuberculosis H37Rv
cacccggggugcccggccgc

SEQ ID NO: 1365350 - RNA, 21 nt, Mycobacterium tuberculosis H37Rv
cacccggggugcccggccgcc

SEQ ID NO: 1365351 - RNA, 20 nt, Mycobacterium tuberculosis H37Rv
cacccgggcagccugcugca

SEQ ID NO: 1365352 - RNA, 20 nt, Mycobacterium tuberculosis H37Rv
cacccgggccaccccgagcu

SEQ ID NO: 1365353 - RNA, 17 nt, Mycobacterium tuberculosis H37Rv
cacccgggccgccucga

SEQ ID NO: 1365354 - RNA, 18 nt, Mycobacterium tuberculosis H37Rv
cacccggucaucggccgu

SEQ ID NO: 1365355 - RNA, 15 nt, Mycobacterium tuberculosis H37Rv
cacccgguccggccc

SEQ ID NO: 1365356 - RNA, 17 nt, Mycobacterium tuberculosis H37Rv
cacccggucaacgugaa

SEQ ID NO: 1365357 - RNA, 19 nt, Mycobacterium tuberculosis H37Rv
cacccggguggcacgcacg

SEQ ID NO: 1365358 - RNA, 21 nt, Mycobacterium tuberculosis H37Rv
cacccgggccucggcgccguc

SEQ ID NO: 1365359 - RNA, 19 nt, Mycobacterium tuberculosis H37Rv
cacccggcuucgccgcgcu

SEQ ID NO: 1365360 - RNA, 21 nt, Mycobacterium tuberculosis H37Rv
cacccgguugugcgcgcgccc

SEQ ID NO: 1365361 - RNA, 15 nt, Mycobacterium tuberculosis H37Rv
cacccguaagcggau

SEQ ID NO: 1365362 - RNA, 23 nt, Mycobacterium tuberculosis H37Rv
cacccgcaggucgaucugcgcca

SEQ ID NO: 1365363 - RNA, 21 nt, Mycobacterium tuberculosis H37Rv
cacccgccaggccgcgcgaca

SEQ ID NO: 1365364 - RNA, 14 nt, Mycobacterium tuberculosis H37Rv
cacccgccaggccg

SEQ ID NO: 1365365 - RNA, 14 nt, Mycobacterium tuberculosis H37Rv
caccccgccaugcg

SEQ ID NO: 1365366 - RNA, 16 nt, Mycobacterium tuberculosis H37Rv
cacccccaccgaagcg

SEQ ID NO: 1365367 - RNA, 22 nt, Mycobacterium tuberculosis H37Rv
caccccggcggccaucccgcgu

SEQ ID NO: 1365368 - RNA, 18 nt, Mycobacterium tuberculosis H37Rv
caccccgcuugcgcggcu

SEQ ID NO: 1365369 - RNA, 18 nt, Mycobacterium tuberculosis H37Rv
cacccaucgaccgcccgc

SEQ ID NO: 1365370 - RNA, 21 nt, Mycobacterium tuberculosis H37Rv
cacccauccucgcggugcgcc

SEQ ID NO: 1365371 - RNA, 15 nt, Mycobacterium tuberculosis H37Rv
cacccauggccuccc

SEQ ID NO: 1365372 - RNA, 13 nt, Mycobacterium tuberculosis H37Rv
cacccaugauccc

SEQ ID NO: 1365373 - RNA, 19 nt, Mycobacterium tuberculosis H37Rv
cacccagugccacgccuga

SEQ ID NO: 1365374 - RNA, 17 nt, Mycobacterium tuberculosis H37Rv
cacccaguuccacccgg

SEQ ID NO: 1365375 - RNA, 23 nt, Mycobacterium tuberculosis H37Rv
cacccagucggcgccgccgucca

SEQ ID NO: 1365376 - RNA, 12 nt, Mycobacterium tuberculosis H37Rv
cacccaggccau

SEQ ID NO: 1365377 - RNA, 18 nt, Mycobacterium tuberculosis H37Rv
cacccaggugucgcugcu

SEQ ID NO: 1365378 - RNA, 19 nt, Mycobacterium tuberculosis H37Rv
caccccaucgauaaccgaa

SEQ ID NO: 1365379 - RNA, 19 nt, Mycobacterium tuberculosis H37Rv
caccccaugaccgggaggc

SEQ ID NO: 1365380 - RNA, 12 nt, Mycobacterium tuberculosis H37Rv
caccccagggca

SEQ ID NO: 1365381 - RNA, 19 nt, Mycobacterium tuberculosis H37Rv
caccccauacucggcggcu

SEQ ID NO: 1365382 - RNA, 12 nt, Mycobacterium tuberculosis H37Rv
caccccacaccg

SEQ ID NO: 1365383 - RNA, 18 nt, Mycobacterium tuberculosis H37Rv
caccccauggccaccgaa

SEQ ID NO: 1365384 - RNA, 13 nt, Mycobacterium tuberculosis H37Rv
cacccccggccag

SEQ ID NO: 1365385 - RNA, 13 nt, Mycobacterium tuberculosis H37Rv
caccccccccacc

SEQ ID NO: 1365386 - RNA, 14 nt, Mycobacterium tuberculosis H37Rv
cacccccugcaccg

SEQ ID NO: 1365387 - RNA, 17 nt, Mycobacterium tuberculosis H37Rv
cacccccgucgccaccg

SEQ ID NO: 1365388 - RNA, 18 nt, Mycobacterium tuberculosis H37Rv
cacccccggugccggcgg

SEQ ID NO: 1365389 - RNA, 13 nt, Mycobacterium tuberculosis H37Rv
cacccccuggacu

SEQ ID NO: 1365390 - RNA, 22 nt, Mycobacterium tuberculosis H37Rv
caccccgaucuggcguagugcu

SEQ ID NO: 1365391 - RNA, 15 nt, Mycobacterium tuberculosis H37Rv
cacccacuccgccga

SEQ ID NO: 1365392 - RNA, 19 nt, Mycobacterium tuberculosis H37Rv
cacccacuggaccaccgcc

SEQ ID NO: 1365393 - RNA, 20 nt, Mycobacterium tuberculosis H37Rv
cacccacuggaccaccgccg

SEQ ID NO: 1365394 - RNA, 21 nt, Mycobacterium tuberculosis H37Rv
cacccacuggaccaccgccga

SEQ ID NO: 1365395 - RNA, 20 nt, Mycobacterium tuberculosis H37Rv
cacccacuuuucgguggcgg

SEQ ID NO: 1365396 - RNA, 17 nt, Mycobacterium tuberculosis H37Rv
cacccacgucgagcagg

SEQ ID NO: 1365397 - RNA, 22 nt, Mycobacterium tuberculosis H37Rv
cacccacccguucggcugcgcu

SEQ ID NO: 1365398 - RNA, 15 nt, Mycobacterium tuberculosis H37Rv
caccagugccccgcc

SEQ ID NO: 1365399 - RNA, 20 nt, Mycobacterium tuberculosis H37Rv
caccagugccccgccgagcg

SEQ ID NO: 1365400 - RNA, 13 nt, Mycobacterium tuberculosis H37Rv
cacccaccuggau

SEQ ID NO: 1365401 - RNA, 15 nt, Mycobacterium tuberculosis H37Rv
caccagucacgccca

SEQ ID NO: 1365402 - RNA, 14 nt, Mycobacterium tuberculosis H37Rv
caccagugccccgc

SEQ ID NO: 1365403 - RNA, 13 nt, Mycobacterium tuberculosis H37Rv
cacccagcccagc

SEQ ID NO: 1365404 - RNA, 14 nt, Mycobacterium tuberculosis H37Rv
cacccagaugcagg

SEQ ID NO: 1365405 - RNA, 14 nt, Mycobacterium tuberculosis H37Rv
cacccagcacgcgc

SEQ ID NO: 1365406 - RNA, 18 nt, Mycobacterium tuberculosis H37Rv
cacccagaccgccgaaga

SEQ ID NO: 1365407 - RNA, 18 nt, Mycobacterium tuberculosis H37Rv
cacccagacgauggccag

SEQ ID NO: 1365408 - RNA, 13 nt, Mycobacterium tuberculosis H37Rv
cacccagcgcgcu

SEQ ID NO: 1365409 - RNA, 13 nt, Mycobacterium tuberculosis H37Rv
cacccagcggcgc

SEQ ID NO: 1365410 - RNA, 19 nt, Mycobacterium tuberculosis H37Rv
cacccagcggcgcgggcag

SEQ ID NO: 1365411 - RNA, 23 nt, Mycobacterium tuberculosis H37Rv
cacccagcucgcgcacccagccc

SEQ ID NO: 1365412 - RNA, 13 nt, Mycobacterium tuberculosis H37Rv
caccgcuugcugg

SEQ ID NO: 1365413 - RNA, 14 nt, Mycobacterium tuberculosis H37Rv
caccgcuugcuggc

SEQ ID NO: 1365414 - RNA, 19 nt, Mycobacterium tuberculosis H37Rv
caccgcuucaggcgccacu

SEQ ID NO: 1365415 - RNA, 23 nt, Mycobacterium tuberculosis H37Rv
caccgcguugaugaccgccgccg

SEQ ID NO: 1365416 - RNA, 14 nt, Mycobacterium tuberculosis H37Rv
caccgcugccggca

SEQ ID NO: 1365417 - RNA, 18 nt, Mycobacterium tuberculosis H37Rv
caccgcugcggcaccacc

SEQ ID NO: 1365418 - RNA, 22 nt, Mycobacterium tuberculosis H37Rv
caccgcugcggcaccacccggc

SEQ ID NO: 1365419 - RNA, 15 nt, Mycobacterium tuberculosis H37Rv
caccgcggccagcgg

SEQ ID NO: 1365420 - RNA, 22 nt, Mycobacterium tuberculosis H37Rv
caccgcggauaggccgcgcggc

SEQ ID NO: 1365421 - RNA, 22 nt, Mycobacterium tuberculosis H37Rv
caccgcggacccgcagcugcgg

SEQ ID NO: 1365422 - RNA, 14 nt, Mycobacterium tuberculosis H37Rv
caccgcggccgcgg

SEQ ID NO: 1365423 - RNA, 17 nt, Mycobacterium tuberculosis H37Rv
caccgcggcggcggcca

SEQ ID NO: 1365424 - RNA, 24 nt, Mycobacterium tuberculosis H37Rv
caccgccuuugccgccggcaccgc

SEQ ID NO: 1365425 - RNA, 20 nt, Mycobacterium tuberculosis H37Rv
caccgcgaccucgcggcgcu

SEQ ID NO: 1365426 - RNA, 19 nt, Mycobacterium tuberculosis H37Rv
caccgcgacgagcggccgu

SEQ ID NO: 1365427 - RNA, 22 nt, Mycobacterium tuberculosis H37Rv
caccgcgcggcgcagcaccguc

SEQ ID NO: 1365428 - RNA, 18 nt, Mycobacterium tuberculosis H37Rv
caccgcgcggcgcagcac

SEQ ID NO: 1365429 - RNA, 15 nt, Mycobacterium tuberculosis H37Rv
caccgccaccacggu

SEQ ID NO: 1365430 - RNA, 23 nt, Mycobacterium tuberculosis H37Rv
caccgccguugccgccggcgccg

SEQ ID NO: 1365431 - RNA, 22 nt, Mycobacterium tuberculosis H37Rv
caccgcauucguggagccggcc

SEQ ID NO: 1365432 - RNA, 13 nt, Mycobacterium tuberculosis H37Rv
caccgccaccacc

SEQ ID NO: 1365433 - RNA, 17 nt, Mycobacterium tuberculosis H37Rv
caccgccugcgccgccc

SEQ ID NO: 1365434 - RNA, 23 nt, Mycobacterium tuberculosis H37Rv
caccgccugcgccgcccgcgcca

SEQ ID NO: 1365435 - RNA, 16 nt, Mycobacterium tuberculosis H37Rv
caccgccugcgccgcc

SEQ ID NO: 1365436 - RNA, 17 nt, Mycobacterium tuberculosis H37Rv
caccgccuuugccgccg

SEQ ID NO: 1365437 - RNA, 20 nt, Mycobacterium tuberculosis H37Rv
caccgccuuugccgccggca

SEQ ID NO: 1365438 - RNA, 18 nt, Mycobacterium tuberculosis H37Rv
caccgccugugccgccgg

SEQ ID NO: 1365439 - RNA, 20 nt, Mycobacterium tuberculosis H37Rv
caccgcauaacgccaguccc

SEQ ID NO: 1365440 - RNA, 16 nt, Mycobacterium tuberculosis H37Rv
caccgcauaacgccag

SEQ ID NO: 1365441 - RNA, 16 nt, Mycobacterium tuberculosis H37Rv
caccgcagcggguggu

SEQ ID NO: 1365442 - RNA, 18 nt, Mycobacterium tuberculosis H37Rv
caccgcagcggguggugc

SEQ ID NO: 1365443 - RNA, 18 nt, Mycobacterium tuberculosis H37Rv
caccgcaccggaauacag

SEQ ID NO: 1365444 - RNA, 16 nt, Mycobacterium tuberculosis H37Rv
caccgaggugccgcgc

SEQ ID NO: 1365445 - RNA, 13 nt, Mycobacterium tuberculosis H37Rv
caccgaguuccuc

SEQ ID NO: 1365446 - RNA, 16 nt, Mycobacterium tuberculosis H37Rv
caccggccaccagccc

SEQ ID NO: 1365447 - RNA, 21 nt, Mycobacterium tuberculosis H37Rv
caccggaauccgggccgccgc

SEQ ID NO: 1365448 - RNA, 20 nt, Mycobacterium tuberculosis H37Rv
caccggaacccccagcugca

SEQ ID NO: 1365449 - RNA, 14 nt, Mycobacterium tuberculosis H37Rv
caccggcaggcggg

SEQ ID NO: 1365450 - RNA, 14 nt, Mycobacterium tuberculosis H37Rv
caccggcacugccc

SEQ ID NO: 1365451 - RNA, 19 nt, Mycobacterium tuberculosis H37Rv
caccggcuucuccuccaga

SEQ ID NO: 1365452 - RNA, 24 nt, Mycobacterium tuberculosis H37Rv
caccggcgcgggcacgcccucguc

SEQ ID NO: 1365453 - RNA, 13 nt, Mycobacterium tuberculosis H37Rv
caccggcggcgcc

SEQ ID NO: 1365454 - RNA, 13 nt, Mycobacterium tuberculosis H37Rv
caccggcgucgcu

SEQ ID NO: 1365455 - RNA, 18 nt, Mycobacterium tuberculosis H37Rv
caccggcgucgcugccuu

SEQ ID NO: 1365456 - RNA, 16 nt, Mycobacterium tuberculosis H37Rv
caccggcucccggggg

SEQ ID NO: 1365457 - RNA, 13 nt, Mycobacterium tuberculosis H37Rv
caccggcucgacu

SEQ ID NO: 1365458 - RNA, 12 nt, Mycobacterium tuberculosis H37Rv
caccggcugcaa

SEQ ID NO: 1365459 - RNA, 23 nt, Mycobacterium tuberculosis H37Rv
caccggcuggugccaacugcgcc

SEQ ID NO: 1365460 - RNA, 17 nt, Mycobacterium tuberculosis H37Rv
caccggcugcugaggag

SEQ ID NO: 1365461 - RNA, 18 nt, Mycobacterium tuberculosis H37Rv
caccggcugcugaggaga

SEQ ID NO: 1365462 - RNA, 22 nt, Mycobacterium tuberculosis H37Rv
caccguuguaugcugcgcgccg

SEQ ID NO: 1365463 - RNA, 17 nt, Mycobacterium tuberculosis H37Rv
caccguuggccgcgcuc

SEQ ID NO: 1365464 - RNA, 21 nt, Mycobacterium tuberculosis H37Rv
caccguugccgaaccacgcgc

SEQ ID NO: 1365465 - RNA, 15 nt, Mycobacterium tuberculosis H37Rv
caccguugccgccgu

SEQ ID NO: 1365466 - RNA, 16 nt, Mycobacterium tuberculosis H37Rv
caccguugccgccguc

SEQ ID NO: 1365467 - RNA, 15 nt, Mycobacterium tuberculosis H37Rv
caccguccagcagcu

SEQ ID NO: 1365468 - RNA, 23 nt, Mycobacterium tuberculosis H37Rv
caccgucgcugcccgcgcggcca

SEQ ID NO: 1365469 - RNA, 20 nt, Mycobacterium tuberculosis H37Rv
caccgucgcauacgcccacu

SEQ ID NO: 1365470 - RNA, 14 nt, Mycobacterium tuberculosis H37Rv
caccgucgcaccca

SEQ ID NO: 1365471 - RNA, 17 nt, Mycobacterium tuberculosis H37Rv
caccgucgggcccagcc

SEQ ID NO: 1365472 - RNA, 17 nt, Mycobacterium tuberculosis H37Rv
caccgucggcaccagca

SEQ ID NO: 1365473 - RNA, 17 nt, Mycobacterium tuberculosis H37Rv
caccgucggcagcagcg

SEQ ID NO: 1365474 - RNA, 20 nt, Mycobacterium tuberculosis H37Rv
caccgucguacucggcggcc

SEQ ID NO: 1365475 - RNA, 17 nt, Mycobacterium tuberculosis H37Rv
caccgucuccggcgcca

SEQ ID NO: 1365476 - RNA, 22 nt, Mycobacterium tuberculosis H37Rv
caccuaccgagaucaccgccac

SEQ ID NO: 1365477 - RNA, 19 nt, Mycobacterium tuberculosis H37Rv
caccuaccguacgcagcgu

SEQ ID NO: 1365478 - RNA, 17 nt, Mycobacterium tuberculosis H37Rv
caccuaccgagaucacc

SEQ ID NO: 1365479 - RNA, 14 nt, Mycobacterium tuberculosis H37Rv
caccuauggucaac

SEQ ID NO: 1365480 - RNA, 13 nt, Mycobacterium tuberculosis H37Rv
caccuagucgcgg

SEQ ID NO: 1365481 - RNA, 18 nt, Mycobacterium tuberculosis H37Rv
cacgggaucgaucugcgg

SEQ ID NO: 1365482 - RNA, 16 nt, Mycobacterium tuberculosis H37Rv
cacggcggccaccugc

SEQ ID NO: 1365483 - RNA, 21 nt, Mycobacterium tuberculosis H37Rv
cacggcggcaucaccuggcgu

SEQ ID NO: 1365484 - RNA, 15 nt, Mycobacterium tuberculosis H37Rv
cacggcgcuaccagc

SEQ ID NO: 1365485 - RNA, 17 nt, Mycobacterium tuberculosis H37Rv
cacggcggcaucaccug

SEQ ID NO: 1365486 - RNA, 12 nt, Mycobacterium tuberculosis H37Rv
cacgggcggcca

SEQ ID NO: 1365487 - RNA, 13 nt, Mycobacterium tuberculosis H37Rv
cacggcgccgcca

SEQ ID NO: 1365488 - RNA, 16 nt, Mycobacterium tuberculosis H37Rv
cacggcgcgcgcgccg

SEQ ID NO: 1365489 - RNA, 16 nt, Mycobacterium tuberculosis H37Rv
cacggcgauccccgac

SEQ ID NO: 1365490 - RNA, 16 nt, Mycobacterium tuberculosis H37Rv
cacggcgaaccggccc

SEQ ID NO: 1365491 - RNA, 23 nt, Mycobacterium tuberculosis H37Rv
cacggcgauccggucggccaggc

SEQ ID NO: 1365492 - RNA, 18 nt, Mycobacterium tuberculosis H37Rv
cacgggugagcaccacgu

SEQ ID NO: 1365493 - RNA, 19 nt, Mycobacterium tuberculosis H37Rv
cacggguagcguccagguc

SEQ ID NO: 1365494 - RNA, 13 nt, Mycobacterium tuberculosis H37Rv
cacggggcugccg

SEQ ID NO: 1365495 - RNA, 20 nt, Mycobacterium tuberculosis H37Rv
cacgggcucgcugcaccagc

SEQ ID NO: 1365496 - RNA, 17 nt, Mycobacterium tuberculosis H37Rv
cacgcguuccuccagca

SEQ ID NO: 1365497 - RNA, 18 nt, Mycobacterium tuberculosis H37Rv
cacgcuccagcucggcca

SEQ ID NO: 1365498 - RNA, 23 nt, Mycobacterium tuberculosis H37Rv
cacggcagacacgcugcaggcgg

SEQ ID NO: 1365499 - RNA, 22 nt, Mycobacterium tuberculosis H37Rv
cacggcacccaauccggcgcca

SEQ ID NO: 1365500 - RNA, 14 nt, Mycobacterium tuberculosis H37Rv
cacggcaccgauca

SEQ ID NO: 1365501 - RNA, 22 nt, Mycobacterium tuberculosis H37Rv
cacggcaccaccaagcucggcc

SEQ ID NO: 1365502 - RNA, 20 nt, Mycobacterium tuberculosis H37Rv
cacggcaaaggcgcucugcu

SEQ ID NO: 1365503 - RNA, 14 nt, Mycobacterium tuberculosis H37Rv
cacggccuccggac

SEQ ID NO: 1365504 - RNA, 14 nt, Mycobacterium tuberculosis H37Rv
cacggagaccgugg

SEQ ID NO: 1365505 - RNA, 20 nt, Mycobacterium tuberculosis H37Rv
cacggauacccuucgucaca

SEQ ID NO: 1365506 - RNA, 12 nt, Mycobacterium tuberculosis H37Rv
cacggagcucuu

SEQ ID NO: 1365507 - RNA, 20 nt, Mycobacterium tuberculosis H37Rv
cacggaggccuccacauacg

SEQ ID NO: 1365508 - RNA, 14 nt, Mycobacterium tuberculosis H37Rv
cacgcgcucaccga

SEQ ID NO: 1365509 - RNA, 21 nt, Mycobacterium tuberculosis H37Rv
cacgcgcccgcaccaccggcc

SEQ ID NO: 1365510 - RNA, 13 nt, Mycobacterium tuberculosis H37Rv
cacgcggucccac

SEQ ID NO: 1365511 - RNA, 18 nt, Mycobacterium tuberculosis H37Rv
cacgcggguugcgcggcu

SEQ ID NO: 1365512 - RNA, 20 nt, Mycobacterium tuberculosis H37Rv
cacgcgggagguacccccag

SEQ ID NO: 1365513 - RNA, 16 nt, Mycobacterium tuberculosis H37Rv
cacgcgacgcggggcu

SEQ ID NO: 1365514 - RNA, 15 nt, Mycobacterium tuberculosis H37Rv
cacgccuugagccga

SEQ ID NO: 1365515 - RNA, 15 nt, Mycobacterium tuberculosis H37Rv
cacgcgaaugacgau

SEQ ID NO: 1365516 - RNA, 22 nt, Mycobacterium tuberculosis H37Rv
cacgcgaaugacgauccagccc

SEQ ID NO: 1365517 - RNA, 21 nt, Mycobacterium tuberculosis H37Rv
cacgccuggcuacgcgcgccc

SEQ ID NO: 1365518 - RNA, 19 nt, Mycobacterium tuberculosis H37Rv
cacgccuggcuacgcgcgc

SEQ ID NO: 1365519 - RNA, 14 nt, Mycobacterium tuberculosis H37Rv
cacgccucgccgaa

SEQ ID NO: 1365520 - RNA, 17 nt, Mycobacterium tuberculosis H37Rv
cacgccuugagccgagg

SEQ ID NO: 1365521 - RNA, 19 nt, Mycobacterium tuberculosis H37Rv
cacgccgaccagcacccgc

SEQ ID NO: 1365522 - RNA, 16 nt, Mycobacterium tuberculosis H37Rv
cacgccgaccagcacc

SEQ ID NO: 1365523 - RNA, 19 nt, Mycobacterium tuberculosis H37Rv
cacgccguggcccgcuccc

SEQ ID NO: 1365524 - RNA, 14 nt, Mycobacterium tuberculosis H37Rv
cacgauggcggcca

SEQ ID NO: 1365525 - RNA, 18 nt, Mycobacterium tuberculosis H37Rv
cacgcaacaccgccaacu

SEQ ID NO: 1365526 - RNA, 19 nt, Mycobacterium tuberculosis H37Rv
cacgcaagggaauccgaac

SEQ ID NO: 1365527 - RNA, 15 nt, Mycobacterium tuberculosis H37Rv
caccugggccagcag

SEQ ID NO: 1365528 - RNA, 20 nt, Mycobacterium tuberculosis H37Rv
caccuggcgugucgccgcca

SEQ ID NO: 1365529 - RNA, 16 nt, Mycobacterium tuberculosis H37Rv
caccugggcugccggc

SEQ ID NO: 1365530 - RNA, 14 nt, Mycobacterium tuberculosis H37Rv
caccugcugcaacc

SEQ ID NO: 1365531 - RNA, 22 nt, Mycobacterium tuberculosis H37Rv
caccuccaauugcgaaccggcc

SEQ ID NO: 1365532 - RNA, 21 nt, Mycobacterium tuberculosis H37Rv
caccuccgacggccgcggcgu

SEQ ID NO: 1365533 - RNA, 18 nt, Mycobacterium tuberculosis H37Rv
caccuccgacggccgcgg

SEQ ID NO: 1365534 - RNA, 16 nt, Mycobacterium tuberculosis H37Rv
caccucccgcagccgg

SEQ ID NO: 1365535 - RNA, 16 nt, Mycobacterium tuberculosis H37Rv
caccuccgacggccgc

SEQ ID NO: 1365536 - RNA, 17 nt, Mycobacterium tuberculosis H37Rv
caccucccgcggcaccu

SEQ ID NO: 1365537 - RNA, 19 nt, Mycobacterium tuberculosis H37Rv
caccuccagguagucgcgg

SEQ ID NO: 1365538 - RNA, 19 nt, Mycobacterium tuberculosis H37Rv
caccugguuccagaggccc

SEQ ID NO: 1365539 - RNA, 22 nt, Mycobacterium tuberculosis H37Rv
caccuuagcgcuugccgcugag

SEQ ID NO: 1365540 - RNA, 20 nt, Mycobacterium tuberculosis H37Rv
cacgaguccgcggaucacca

SEQ ID NO: 1365541 - RNA, 22 nt, Mycobacterium tuberculosis H37Rv
cacgaguccgcggaucaccauc

SEQ ID NO: 1365542 - RNA, 22 nt, Mycobacterium tuberculosis H37Rv
cacgauccgcgguagcagcagc

SEQ ID NO: 1365543 - RNA, 23 nt, Mycobacterium tuberculosis H37Rv
cacgaucggcggggguggaauca

SEQ ID NO: 1365544 - RNA, 23 nt, Mycobacterium tuberculosis H37Rv
cacgaucucguggaucugccucu

SEQ ID NO: 1365545 - RNA, 13 nt, Mycobacterium tuberculosis H37Rv
cacgaucgccaac

SEQ ID NO: 1365546 - RNA, 23 nt, Mycobacterium tuberculosis H37Rv
cacgaugcgguucucgagcucgg

SEQ ID NO: 1365547 - RNA, 21 nt, Mycobacterium tuberculosis H37Rv
cacgaucugcaggcccaggcu

SEQ ID NO: 1365548 - RNA, 14 nt, Mycobacterium tuberculosis H37Rv
cacgaugaucccaa

SEQ ID NO: 1365549 - RNA, 15 nt, Mycobacterium tuberculosis H37Rv
cacgacucccccggc

SEQ ID NO: 1365550 - RNA, 15 nt, Mycobacterium tuberculosis H37Rv
cacgacaggucgccc

SEQ ID NO: 1365551 - RNA, 18 nt, Mycobacterium tuberculosis H37Rv
cacgacaugaccgacagg

SEQ ID NO: 1365552 - RNA, 14 nt, Mycobacterium tuberculosis H37Rv
cacgacagccagug

SEQ ID NO: 1365553 - RNA, 15 nt, Mycobacterium tuberculosis H37Rv
cacgacuggcgccca

SEQ ID NO: 1365554 - RNA, 18 nt, Mycobacterium tuberculosis H37Rv
cacgacuggcgcccagcc

SEQ ID NO: 1365555 - RNA, 14 nt, Mycobacterium tuberculosis H37Rv
cacgaaaccgcagc

SEQ ID NO: 1365556 - RNA, 23 nt, Mycobacterium tuberculosis H37Rv
cacgaacgccugcucgucggcca

SEQ ID NO: 1365557 - RNA, 23 nt, Mycobacterium tuberculosis H37Rv
cacgaaccgggugccggauugac

SEQ ID NO: 1365558 - RNA, 17 nt, Mycobacterium tuberculosis H37Rv
caagucacagcucacca

SEQ ID NO: 1365559 - RNA, 17 nt, Mycobacterium tuberculosis H37Rv
caagucaacccugccac

SEQ ID NO: 1365560 - RNA, 16 nt, Mycobacterium tuberculosis H37Rv
caaguccaacgacugu

SEQ ID NO: 1365561 - RNA, 17 nt, Mycobacterium tuberculosis H37Rv
caagcuggggaacagca

SEQ ID NO: 1365562 - RNA, 23 nt, Mycobacterium tuberculosis H37Rv
caaggaugucggggcgaagcuug

SEQ ID NO: 1365563 - RNA, 15 nt, Mycobacterium tuberculosis H37Rv
caagucugcccgacu

SEQ ID NO: 1365564 - RNA, 12 nt, Mycobacterium tuberculosis H37Rv
caagucugugcu

SEQ ID NO: 1365565 - RNA, 18 nt, Mycobacterium tuberculosis H37Rv
caagucugcccgacugcc

SEQ ID NO: 1365566 - RNA, 16 nt, Mycobacterium tuberculosis H37Rv
caagucggcgcuggcc

SEQ ID NO: 1365567 - RNA, 16 nt, Mycobacterium tuberculosis H37Rv
caagucccucggcggc

SEQ ID NO: 1365568 - RNA, 15 nt, Mycobacterium tuberculosis H37Rv
caaguccgcccgccg

SEQ ID NO: 1365569 - RNA, 21 nt, Mycobacterium tuberculosis H37Rv
caagucgauguacaccgugcg

SEQ ID NO: 1365570 - RNA, 20 nt, Mycobacterium tuberculosis H37Rv
caagucgccgaggcaaccga

SEQ ID NO: 1365571 - RNA, 15 nt, Mycobacterium tuberculosis H37Rv
caaguccuucacugc

SEQ ID NO: 1365572 - RNA, 19 nt, Mycobacterium tuberculosis H37Rv
caagugcuuccggccauug

SEQ ID NO: 1365573 - RNA, 20 nt, Mycobacterium tuberculosis H37Rv
caaguggucgaugaaccaau

SEQ ID NO: 1365574 - RNA, 20 nt, Mycobacterium tuberculosis H37Rv
caaguggcgcucgcaaacaa

SEQ ID NO: 1365575 - RNA, 13 nt, Mycobacterium tuberculosis H37Rv
caaguggcgcucg

SEQ ID NO: 1365576 - RNA, 16 nt, Mycobacterium tuberculosis H37Rv
caagugugagcagacc

SEQ ID NO: 1365577 - RNA, 19 nt, Mycobacterium tuberculosis H37Rv
caauaagggagaccgcggc

SEQ ID NO: 1365578 - RNA, 21 nt, Mycobacterium tuberculosis H37Rv
caaguucggccgagugcacgc

SEQ ID NO: 1365579 - RNA, 20 nt, Mycobacterium tuberculosis H37Rv
caauccaggccaccccgacc

SEQ ID NO: 1365580 - RNA, 19 nt, Mycobacterium tuberculosis H37Rv
caaucagcccgacaccguc

SEQ ID NO: 1365581 - RNA, 16 nt, Mycobacterium tuberculosis H37Rv
caaucgucggccagca

SEQ ID NO: 1365582 - RNA, 18 nt, Mycobacterium tuberculosis H37Rv
caaucccgccaucugccu

SEQ ID NO: 1365583 - RNA, 13 nt, Mycobacterium tuberculosis H37Rv
caaucgaggaagg

SEQ ID NO: 1365584 - RNA, 19 nt, Mycobacterium tuberculosis H37Rv
caaucgaguagcugaccga

SEQ ID NO: 1365585 - RNA, 18 nt, Mycobacterium tuberculosis H37Rv
caaucgagaacgcccgcu

SEQ ID NO: 1365586 - RNA, 20 nt, Mycobacterium tuberculosis H37Rv
caaucgagaacgcccgcugc

SEQ ID NO: 1365587 - RNA, 21 nt, Mycobacterium tuberculosis H37Rv
caaucacauagccggucagua

SEQ ID NO: 1365588 - RNA, 17 nt, Mycobacterium tuberculosis H37Rv
caaucaccgccgcgacc

SEQ ID NO: 1365589 - RNA, 15 nt, Mycobacterium tuberculosis H37Rv
caauacguagucgcc

SEQ ID NO: 1365590 - RNA, 19 nt, Mycobacterium tuberculosis H37Rv
caauacggucagcagacug

SEQ ID NO: 1365591 - RNA, 16 nt, Mycobacterium tuberculosis H37Rv
caagaucggcgccccu

SEQ ID NO: 1365592 - RNA, 17 nt, Mycobacterium tuberculosis H37Rv
caagaaguugacaccag

SEQ ID NO: 1365593 - RNA, 20 nt, Mycobacterium tuberculosis H37Rv
caacuuccgcagcgccaccc

SEQ ID NO: 1365594 - RNA, 16 nt, Mycobacterium tuberculosis H37Rv
caacuucaccacccug

SEQ ID NO: 1365595 - RNA, 17 nt, Mycobacterium tuberculosis H37Rv
caacuucaacuggauca

SEQ ID NO: 1365596 - RNA, 12 nt, Mycobacterium tuberculosis H37Rv
caacuucaccac

SEQ ID NO: 1365597 - RNA, 17 nt, Mycobacterium tuberculosis H37Rv
caagaccaagugucgcc

SEQ ID NO: 1365598 - RNA, 15 nt, Mycobacterium tuberculosis H37Rv
caagcuaccggcccg

SEQ ID NO: 1365599 - RNA, 19 nt, Mycobacterium tuberculosis H37Rv
caagcgcgcgaaccccagc

SEQ ID NO: 1365600 - RNA, 22 nt, Mycobacterium tuberculosis H37Rv
caagcugacacgacgaacuagg

SEQ ID NO: 1365601 - RNA, 15 nt, Mycobacterium tuberculosis H37Rv
caagcugaccgccag

SEQ ID NO: 1365602 - RNA, 19 nt, Mycobacterium tuberculosis H37Rv
caagcugccccgccaccuc

SEQ ID NO: 1365603 - RNA, 21 nt, Mycobacterium tuberculosis H37Rv
caagcucggccaccagcgccc

SEQ ID NO: 1365604 - RNA, 15 nt, Mycobacterium tuberculosis H37Rv
caagcucggccagca

SEQ ID NO: 1365605 - RNA, 18 nt, Mycobacterium tuberculosis H37Rv
caagcucggccagcacgc

SEQ ID NO: 1365606 - RNA, 15 nt, Mycobacterium tuberculosis H37Rv
caagcucggcccagc

SEQ ID NO: 1365607 - RNA, 14 nt, Mycobacterium tuberculosis H37Rv
caagcucggccacc

SEQ ID NO: 1365608 - RNA, 18 nt, Mycobacterium tuberculosis H37Rv
caagcucggccaccagcg

SEQ ID NO: 1365609 - RNA, 16 nt, Mycobacterium tuberculosis H37Rv
caagcucgacaacugc

SEQ ID NO: 1365610 - RNA, 24 nt, Mycobacterium tuberculosis H37Rv
caagccuuaccccgcagcucaccu

SEQ ID NO: 1365611 - RNA, 23 nt, Mycobacterium tuberculosis H37Rv
caagccucgauaggugagcgcgg

SEQ ID NO: 1365612 - RNA, 13 nt, Mycobacterium tuberculosis H37Rv
caagccugcgcug

SEQ ID NO: 1365613 - RNA, 18 nt, Mycobacterium tuberculosis H37Rv
caagcgaagagcgcacug

SEQ ID NO: 1365614 - RNA, 12 nt, Mycobacterium tuberculosis H37Rv
caagccugccga

SEQ ID NO: 1365615 - RNA, 21 nt, Mycobacterium tuberculosis H37Rv
caagcgcaucgcacagcgccg

SEQ ID NO: 1365616 - RNA, 13 nt, Mycobacterium tuberculosis H37Rv
caagcgcagccug

SEQ ID NO: 1365617 - RNA, 14 nt, Mycobacterium tuberculosis H37Rv
caagcgcagccugg

SEQ ID NO: 1365618 - RNA, 21 nt, Mycobacterium tuberculosis H37Rv
caagauuaccgaagcccgacu

SEQ ID NO: 1365619 - RNA, 17 nt, Mycobacterium tuberculosis H37Rv
caagaugccugacacga

SEQ ID NO: 1365620 - RNA, 14 nt, Mycobacterium tuberculosis H37Rv
caagccgugcagcu

SEQ ID NO: 1365621 - RNA, 17 nt, Mycobacterium tuberculosis H37Rv
caagccgccggugcgca

SEQ ID NO: 1365622 - RNA, 12 nt, Mycobacterium tuberculosis H37Rv
caagccaagcgu

SEQ ID NO: 1365623 - RNA, 13 nt, Mycobacterium tuberculosis H37Rv
caagccggacaga

SEQ ID NO: 1365624 - RNA, 18 nt, Mycobacterium tuberculosis H37Rv
caagccaaccagcccggc

SEQ ID NO: 1365625 - RNA, 19 nt, Mycobacterium tuberculosis H37Rv
caacguggugucucggcug

SEQ ID NO: 1365626 - RNA, 16 nt, Mycobacterium tuberculosis H37Rv
caacguuguagcccaa

SEQ ID NO: 1365627 - RNA, 20 nt, Mycobacterium tuberculosis H37Rv
caacuaucgucgugucgccg

SEQ ID NO: 1365628 - RNA, 23 nt, Mycobacterium tuberculosis H37Rv
caacuaucgucgugucgccgccg

SEQ ID NO: 1365629 - RNA, 22 nt, Mycobacterium tuberculosis H37Rv
caacuaucgucgugucgccgcc

SEQ ID NO: 1365630 - RNA, 21 nt, Mycobacterium tuberculosis H37Rv
caacggucaaucccggccagg

SEQ ID NO: 1365631 - RNA, 16 nt, Mycobacterium tuberculosis H37Rv
caacggugcucuucga

SEQ ID NO: 1365632 - RNA, 16 nt, Mycobacterium tuberculosis H37Rv
caacguagccagcagc

SEQ ID NO: 1365633 - RNA, 17 nt, Mycobacterium tuberculosis H37Rv
caacugcggcaggucuu

SEQ ID NO: 1365634 - RNA, 13 nt, Mycobacterium tuberculosis H37Rv
caacugcucgacg

SEQ ID NO: 1365635 - RNA, 19 nt, Mycobacterium tuberculosis H37Rv
caacucuucagcaagccaa

SEQ ID NO: 1365636 - RNA, 13 nt, Mycobacterium tuberculosis H37Rv
caacucgggcagc

SEQ ID NO: 1365637 - RNA, 17 nt, Mycobacterium tuberculosis H37Rv
caacucgggcagcgcgg

SEQ ID NO: 1365638 - RNA, 19 nt, Mycobacterium tuberculosis H37Rv
caacucgggcagcgcggcc

SEQ ID NO: 1365639 - RNA, 17 nt, Mycobacterium tuberculosis H37Rv
caacucguccagcagug

SEQ ID NO: 1365640 - RNA, 17 nt, Mycobacterium tuberculosis H37Rv
caacucguccaacugaa

SEQ ID NO: 1365641 - RNA, 19 nt, Mycobacterium tuberculosis H37Rv
caacgguaguugcgcggca

SEQ ID NO: 1365642 - RNA, 20 nt, Mycobacterium tuberculosis H37Rv
caacgggccuucagcucacc

SEQ ID NO: 1365643 - RNA, 19 nt, Mycobacterium tuberculosis H37Rv
caacggcacuagcccgacc

SEQ ID NO: 1365644 - RNA, 16 nt, Mycobacterium tuberculosis H37Rv
caacggcgcgccgacc

SEQ ID NO: 1365645 - RNA, 18 nt, Mycobacterium tuberculosis H37Rv
caacggcagcgccaccga

SEQ ID NO: 1365646 - RNA, 19 nt, Mycobacterium tuberculosis H37Rv
caacggcaucccggccgcu

SEQ ID NO: 1365647 - RNA, 21 nt, Mycobacterium tuberculosis H37Rv
caacggaagaagcaguagcug

SEQ ID NO: 1365648 - RNA, 22 nt, Mycobacterium tuberculosis H37Rv
caacggacgggaucgcccaggc

SEQ ID NO: 1365649 - RNA, 22 nt, Mycobacterium tuberculosis H37Rv
caacggacgaagcaccucccga

SEQ ID NO: 1365650 - RNA, 14 nt, Mycobacterium tuberculosis H37Rv
caacgcuucugccu

SEQ ID NO: 1365651 - RNA, 13 nt, Mycobacterium tuberculosis H37Rv
caacgcugcagca

SEQ ID NO: 1365652 - RNA, 17 nt, Mycobacterium tuberculosis H37Rv
caacgcugcagcagguc

SEQ ID NO: 1365653 - RNA, 17 nt, Mycobacterium tuberculosis H37Rv
caacgcguugcacagca

SEQ ID NO: 1365654 - RNA, 18 nt, Mycobacterium tuberculosis H37Rv
caaccuaaauugccgggc

SEQ ID NO: 1365655 - RNA, 19 nt, Mycobacterium tuberculosis H37Rv
caaccguuguaccccagca

SEQ ID NO: 1365656 - RNA, 19 nt, Mycobacterium tuberculosis H37Rv
caaccgugccgcaucaccc

SEQ ID NO: 1365657 - RNA, 15 nt, Mycobacterium tuberculosis H37Rv
caaccgucgaaaaau

SEQ ID NO: 1365658 - RNA, 18 nt, Mycobacterium tuberculosis H37Rv
caaccgugagcaccagca

SEQ ID NO: 1365659 - RNA, 16 nt, Mycobacterium tuberculosis H37Rv
caaccgugagcaccag

SEQ ID NO: 1365660 - RNA, 13 nt, Mycobacterium tuberculosis H37Rv
caaccgguccagg

SEQ ID NO: 1365661 - RNA, 24 nt, Mycobacterium tuberculosis H37Rv
caaccgggucguucgggugagcac

SEQ ID NO: 1365662 - RNA, 14 nt, Mycobacterium tuberculosis H37Rv
caaccgggacaacc

SEQ ID NO: 1365663 - RNA, 17 nt, Mycobacterium tuberculosis H37Rv
caaccgggccgccugga

SEQ ID NO: 1365664 - RNA, 19 nt, Mycobacterium tuberculosis H37Rv
caaccucgucgucaucgag

SEQ ID NO: 1365665 - RNA, 22 nt, Mycobacterium tuberculosis H37Rv
caacgcgauguccagguggcgc

SEQ ID NO: 1365666 - RNA, 17 nt, Mycobacterium tuberculosis H37Rv
caacgcgaugccgucca

SEQ ID NO: 1365667 - RNA, 15 nt, Mycobacterium tuberculosis H37Rv
caacgcggugggcac

SEQ ID NO: 1365668 - RNA, 18 nt, Mycobacterium tuberculosis H37Rv
caacgcgguaaagccccg

SEQ ID NO: 1365669 - RNA, 15 nt, Mycobacterium tuberculosis H37Rv
caacgcgacgccgcu

SEQ ID NO: 1365670 - RNA, 14 nt, Mycobacterium tuberculosis H37Rv
caaaucccagagca

SEQ ID NO: 1365671 - RNA, 14 nt, Mycobacterium tuberculosis H37Rv
caaaucaagcacag

SEQ ID NO: 1365672 - RNA, 15 nt, Mycobacterium tuberculosis H37Rv
caaaucaagcacagc

SEQ ID NO: 1365673 - RNA, 15 nt, Mycobacterium tuberculosis H37Rv
caaaucccagagcau

SEQ ID NO: 1365674 - RNA, 16 nt, Mycobacterium tuberculosis H37Rv
caaauccgcaccagcc

SEQ ID NO: 1365675 - RNA, 22 nt, Mycobacterium tuberculosis H37Rv
caaagucggcgucacgguggac

SEQ ID NO: 1365676 - RNA, 14 nt, Mycobacterium tuberculosis H37Rv
caaagggaguguuu

SEQ ID NO: 1365677 - RNA, 21 nt, Mycobacterium tuberculosis H37Rv
caaaguacgcccuggaaugcc

SEQ ID NO: 1365678 - RNA, 14 nt, Mycobacterium tuberculosis H37Rv
caaaucgguggcaa

SEQ ID NO: 1365679 - RNA, 19 nt, Mycobacterium tuberculosis H37Rv
caaccggacauccgaugcg

SEQ ID NO: 1365680 - RNA, 18 nt, Mycobacterium tuberculosis H37Rv
caacccugcggugcagga

SEQ ID NO: 1365681 - RNA, 20 nt, Mycobacterium tuberculosis H37Rv
caaccgaauccaucgagacc

SEQ ID NO: 1365682 - RNA, 20 nt, Mycobacterium tuberculosis H37Rv
caaccgaauugaacugagga

SEQ ID NO: 1365683 - RNA, 19 nt, Mycobacterium tuberculosis H37Rv
caacccggucggcagcugg

SEQ ID NO: 1365684 - RNA, 23 nt, Mycobacterium tuberculosis H37Rv
caacccggugauggugugcagca

SEQ ID NO: 1365685 - RNA, 21 nt, Mycobacterium tuberculosis H37Rv
caacccgggccgccagggccc

SEQ ID NO: 1365686 - RNA, 21 nt, Mycobacterium tuberculosis H37Rv
caacccggcgggcccgccggc

SEQ ID NO: 1365687 - RNA, 19 nt, Mycobacterium tuberculosis H37Rv
caacccguuguggccgccu

SEQ ID NO: 1365688 - RNA, 15 nt, Mycobacterium tuberculosis H37Rv
caacccugccgcgau

SEQ ID NO: 1365689 - RNA, 11 nt, Mycobacterium tuberculosis H37Rv
caacccacccc

SEQ ID NO: 1365690 - RNA, 21 nt, Mycobacterium tuberculosis H37Rv
caacccaccccccagcgccgc

SEQ ID NO: 1365691 - RNA, 22 nt, Mycobacterium tuberculosis H37Rv
caaccagcccggccgccgagga

SEQ ID NO: 1365692 - RNA, 21 nt, Mycobacterium tuberculosis H37Rv
caaccagcgagcccagcugcg

SEQ ID NO: 1365693 - RNA, 13 nt, Mycobacterium tuberculosis H37Rv
caaccagcccggc

SEQ ID NO: 1365694 - RNA, 22 nt, Mycobacterium tuberculosis H37Rv
caacauuggugagguggucagc

SEQ ID NO: 1365695 - RNA, 15 nt, Mycobacterium tuberculosis H37Rv
caaccagcaaugccg

SEQ ID NO: 1365696 - RNA, 14 nt, Mycobacterium tuberculosis H37Rv
caacaugcuggaga

SEQ ID NO: 1365697 - RNA, 15 nt, Mycobacterium tuberculosis H37Rv
caacaugggugaugc

SEQ ID NO: 1365698 - RNA, 14 nt, Mycobacterium tuberculosis H37Rv
caacagcgcuccag

SEQ ID NO: 1365699 - RNA, 16 nt, Mycobacterium tuberculosis H37Rv
caacagcguggagcgc

SEQ ID NO: 1365700 - RNA, 20 nt, Mycobacterium tuberculosis H37Rv
caacagcggcaacgccuccg

SEQ ID NO: 1365701 - RNA, 14 nt, Mycobacterium tuberculosis H37Rv
caacagcaugggcg

SEQ ID NO: 1365702 - RNA, 15 nt, Mycobacterium tuberculosis H37Rv
caacaucagcgacag

SEQ ID NO: 1365703 - RNA, 22 nt, Mycobacterium tuberculosis H37Rv
caacaguucucgcgcuugcgcc

SEQ ID NO: 1365704 - RNA, 15 nt, Mycobacterium tuberculosis H37Rv
caacaucggaugacc

SEQ ID NO: 1365705 - RNA, 17 nt, Mycobacterium tuberculosis H37Rv
caacaucuugccgucgg

SEQ ID NO: 1365706 - RNA, 17 nt, Mycobacterium tuberculosis H37Rv
caacaucgaaaaccgag

SEQ ID NO: 1365707 - RNA, 15 nt, Mycobacterium tuberculosis H37Rv
caacaucgagcgcca

SEQ ID NO: 1365708 - RNA, 14 nt, Mycobacterium tuberculosis H37Rv
caacagccgcagcc

SEQ ID NO: 1365709 - RNA, 17 nt, Mycobacterium tuberculosis H37Rv
caacacccgcccgggcg

SEQ ID NO: 1365710 - RNA, 19 nt, Mycobacterium tuberculosis H37Rv
caacagccgcagccagguc

SEQ ID NO: 1365711 - RNA, 17 nt, Mycobacterium tuberculosis H37Rv
caacagcacguacugcu

SEQ ID NO: 1365712 - RNA, 12 nt, Mycobacterium tuberculosis H37Rv
caacagcaccag

SEQ ID NO: 1365713 - RNA, 18 nt, Mycobacterium tuberculosis H37Rv
caacaccgaguuccucug

SEQ ID NO: 1365714 - RNA, 19 nt, Mycobacterium tuberculosis H37Rv
caacacccacgugcugccu

SEQ ID NO: 1365715 - RNA, 18 nt, Mycobacterium tuberculosis H37Rv
caacaccccccccaccca

SEQ ID NO: 1365716 - RNA, 13 nt, Mycobacterium tuberculosis H37Rv
caacaccagguca

SEQ ID NO: 1365717 - RNA, 11 nt, Mycobacterium tuberculosis H37Rv
caacaccauca

SEQ ID NO: 1365718 - RNA, 15 nt, Mycobacterium tuberculosis H37Rv
caacaccagccgguc

SEQ ID NO: 1365719 - RNA, 18 nt, Mycobacterium tuberculosis H37Rv
caacaccaccagcacgcu

SEQ ID NO: 1365720 - RNA, 15 nt, Mycobacterium tuberculosis H37Rv
caaaccggaaacagc

SEQ ID NO: 1365721 - RNA, 14 nt, Mycobacterium tuberculosis H37Rv
caaacaacgacucc

SEQ ID NO: 1365722 - RNA, 19 nt, Mycobacterium tuberculosis H37Rv
caaacguaccgucauggcg

SEQ ID NO: 1365723 - RNA, 22 nt, Mycobacterium tuberculosis H37Rv
caaagaauucguucagcgccag

SEQ ID NO: 1365724 - RNA, 22 nt, Mycobacterium tuberculosis H37Rv
caaagacccgacgccacgcguc

SEQ ID NO: 1365725 - RNA, 13 nt, Mycobacterium tuberculosis H37Rv
caaagcggccucg

SEQ ID NO: 1365726 - RNA, 12 nt, Mycobacterium tuberculosis H37Rv
caaagccgugcc

SEQ ID NO: 1365727 - RNA, 15 nt, Mycobacterium tuberculosis H37Rv
caaaacgagcuucca

SEQ ID NO: 1365728 - RNA, 17 nt, Mycobacterium tuberculosis H37Rv
caaaaggaucaacgugc

SEQ ID NO: 1365729 - RNA, 14 nt, Mycobacterium tuberculosis H37Rv
caaaaggaagaccu

SEQ ID NO: 1365730 - RNA, 20 nt, Mycobacterium tuberculosis H37Rv
caaaaucgcccaauucggca

SEQ ID NO: 1365731 - RNA, 13 nt, Mycobacterium tuberculosis H37Rv
aucaugagcagca

SEQ ID NO: 1365732 - RNA, 18 nt, Mycobacterium tuberculosis H37Rv
aucaucuuggugggaagc

SEQ ID NO: 1365733 - RNA, 14 nt, Mycobacterium tuberculosis H37Rv
aucauagacagggc

SEQ ID NO: 1365734 - RNA, 18 nt, Mycobacterium tuberculosis H37Rv
aucaucgcugugcgcugg

SEQ ID NO: 1365735 - RNA, 18 nt, Mycobacterium tuberculosis H37Rv
aucaugucgaagaaccgg

SEQ ID NO: 1365736 - RNA, 14 nt, Mycobacterium tuberculosis H37Rv
aucaugucgaagaa

SEQ ID NO: 1365737 - RNA, 14 nt, Mycobacterium tuberculosis H37Rv
auccacaaucacau

SEQ ID NO: 1365738 - RNA, 23 nt, Mycobacterium tuberculosis H37Rv
auccacgacaucguaggccggca

SEQ ID NO: 1365739 - RNA, 15 nt, Mycobacterium tuberculosis H37Rv
auccaacgaccucca

SEQ ID NO: 1365740 - RNA, 14 nt, Mycobacterium tuberculosis H37Rv
auccagauaauccu

SEQ ID NO: 1365741 - RNA, 16 nt, Mycobacterium tuberculosis H37Rv
auccagaugcccagca

SEQ ID NO: 1365742 - RNA, 17 nt, Mycobacterium tuberculosis H37Rv
auccagaugcccagcag

SEQ ID NO: 1365743 - RNA, 19 nt, Mycobacterium tuberculosis H37Rv
auccagcagccaggagccg

SEQ ID NO: 1365744 - RNA, 16 nt, Mycobacterium tuberculosis H37Rv
aucccacggugguggg

SEQ ID NO: 1365745 - RNA, 15 nt, Mycobacterium tuberculosis H37Rv
aucccaucggggcua

SEQ ID NO: 1365746 - RNA, 21 nt, Mycobacterium tuberculosis H37Rv
aucccaagcguccgcugcagg

SEQ ID NO: 1365747 - RNA, 12 nt, Mycobacterium tuberculosis H37Rv
auccauccugcc

SEQ ID NO: 1365748 - RNA, 19 nt, Mycobacterium tuberculosis H37Rv
aucccgaaguagaagccca

SEQ ID NO: 1365749 - RNA, 13 nt, Mycobacterium tuberculosis H37Rv
auccccuggccag

SEQ ID NO: 1365750 - RNA, 15 nt, Mycobacterium tuberculosis H37Rv
auccccuggccagca

SEQ ID NO: 1365751 - RNA, 17 nt, Mycobacterium tuberculosis H37Rv
auccccuggccagcaga

SEQ ID NO: 1365752 - RNA, 17 nt, Mycobacterium tuberculosis H37Rv
auccccauugcgcccca

SEQ ID NO: 1365753 - RNA, 19 nt, Mycobacterium tuberculosis H37Rv
auccccaguugugcggcca

SEQ ID NO: 1365754 - RNA, 21 nt, Mycobacterium tuberculosis H37Rv
aucccgaaguagaagcccagg

SEQ ID NO: 1365755 - RNA, 14 nt, Mycobacterium tuberculosis H37Rv
aucccgaugcuggc

SEQ ID NO: 1365756 - RNA, 23 nt, Mycobacterium tuberculosis H37Rv
aucccgaggggagugucagcgcc

SEQ ID NO: 1365757 - RNA, 12 nt, Mycobacterium tuberculosis H37Rv
auccccagcaca

SEQ ID NO: 1365758 - RNA, 12 nt, Mycobacterium tuberculosis H37Rv
auccggccacca

SEQ ID NO: 1365759 - RNA, 23 nt, Mycobacterium tuberculosis H37Rv
auccggccgccaacuucaccacc

SEQ ID NO: 1365760 - RNA, 21 nt, Mycobacterium tuberculosis H37Rv
auccggcgggugccgagcugg

SEQ ID NO: 1365761 - RNA, 14 nt, Mycobacterium tuberculosis H37Rv
auccggcuccaccc

SEQ ID NO: 1365762 - RNA, 14 nt, Mycobacterium tuberculosis H37Rv
auccgggccgccgc

SEQ ID NO: 1365763 - RNA, 17 nt, Mycobacterium tuberculosis H37Rv
auccgggcgaccaccac

SEQ ID NO: 1365764 - RNA, 15 nt, Mycobacterium tuberculosis H37Rv
auccguacaguccac

SEQ ID NO: 1365765 - RNA, 12 nt, Mycobacterium tuberculosis H37Rv
auccgucccagg

SEQ ID NO: 1365766 - RNA, 16 nt, Mycobacterium tuberculosis H37Rv
auccgguucugggccu

SEQ ID NO: 1365767 - RNA, 15 nt, Mycobacterium tuberculosis H37Rv
auccggucgaugacc

SEQ ID NO: 1365768 - RNA, 13 nt, Mycobacterium tuberculosis H37Rv
auccggucggcca

SEQ ID NO: 1365769 - RNA, 16 nt, Mycobacterium tuberculosis H37Rv
auccggucggccaggc

SEQ ID NO: 1365770 - RNA, 14 nt, Mycobacterium tuberculosis H37Rv
auccggugaugacc

SEQ ID NO: 1365771 - RNA, 15 nt, Mycobacterium tuberculosis H37Rv
auccuuugccgccga

SEQ ID NO: 1365772 - RNA, 20 nt, Mycobacterium tuberculosis H37Rv
auccucgaugacaucgguca

SEQ ID NO: 1365773 - RNA, 22 nt, Mycobacterium tuberculosis H37Rv
aucgcugaccgcguagaccagu

SEQ ID NO: 1365774 - RNA, 20 nt, Mycobacterium tuberculosis H37Rv
aucgcguggcgcaccaccgc

SEQ ID NO: 1365775 - RNA, 19 nt, Mycobacterium tuberculosis H37Rv
aucgcguggcgcaccaccg

SEQ ID NO: 1365776 - RNA, 14 nt, Mycobacterium tuberculosis H37Rv
aucgcguggaucgc

SEQ ID NO: 1365777 - RNA, 19 nt, Mycobacterium tuberculosis H37Rv
aucgcguuguaggcuucca

SEQ ID NO: 1365778 - RNA, 17 nt, Mycobacterium tuberculosis H37Rv
aucgcguucugcaccag

SEQ ID NO: 1365779 - RNA, 20 nt, Mycobacterium tuberculosis H37Rv
aucgcgucggcgaugaacag

SEQ ID NO: 1365780 - RNA, 17 nt, Mycobacterium tuberculosis H37Rv
aucgcgggcggcgcugg

SEQ ID NO: 1365781 - RNA, 20 nt, Mycobacterium tuberculosis H37Rv
aucgccuuggcgcccgcgaa

SEQ ID NO: 1365782 - RNA, 16 nt, Mycobacterium tuberculosis H37Rv
aucgcgaucugaaggu

SEQ ID NO: 1365783 - RNA, 23 nt, Mycobacterium tuberculosis H37Rv
aucgcgggcgugccgaccagcau

SEQ ID NO: 1365784 - RNA, 13 nt, Mycobacterium tuberculosis H37Rv
aucgccgcgggcg

SEQ ID NO: 1365785 - RNA, 19 nt, Mycobacterium tuberculosis H37Rv
aucgccgcuaccgucagua

SEQ ID NO: 1365786 - RNA, 15 nt, Mycobacterium tuberculosis H37Rv
aucgccgcuggccag

SEQ ID NO: 1365787 - RNA, 18 nt, Mycobacterium tuberculosis H37Rv
aucgccgggccguagaaa

SEQ ID NO: 1365788 - RNA, 17 nt, Mycobacterium tuberculosis H37Rv
aucgcccauuucggcac

SEQ ID NO: 1365789 - RNA, 11 nt, Mycobacterium tuberculosis H37Rv
aucgccgccgg

SEQ ID NO: 1365790 - RNA, 15 nt, Mycobacterium tuberculosis H37Rv
aucgccguccagcaa

SEQ ID NO: 1365791 - RNA, 20 nt, Mycobacterium tuberculosis H37Rv
aucgccggcuucgcccagag

SEQ ID NO: 1365792 - RNA, 12 nt, Mycobacterium tuberculosis H37Rv
aucgccuccucg

SEQ ID NO: 1365793 - RNA, 20 nt, Mycobacterium tuberculosis H37Rv
aucgccuaccggccuuucca

SEQ ID NO: 1365794 - RNA, 17 nt, Mycobacterium tuberculosis H37Rv
aucgccuccagccggcg

SEQ ID NO: 1365795 - RNA, 14 nt, Mycobacterium tuberculosis H37Rv
aucgccugagacuc

SEQ ID NO: 1365796 - RNA, 23 nt, Mycobacterium tuberculosis H37Rv
aucgccugauaugacuugcgcgc

SEQ ID NO: 1365797 - RNA, 15 nt, Mycobacterium tuberculosis H37Rv
aucgccugccacagc

SEQ ID NO: 1365798 - RNA, 21 nt, Mycobacterium tuberculosis H37Rv
aucgagaguugaauccgggaa

SEQ ID NO: 1365799 - RNA, 17 nt, Mycobacterium tuberculosis H37Rv
aucgaggccagcagcug

SEQ ID NO: 1365800 - RNA, 21 nt, Mycobacterium tuberculosis H37Rv
aucgaggaacucggacccacc

SEQ ID NO: 1365801 - RNA, 20 nt, Mycobacterium tuberculosis H37Rv
aucgaucguguacugcuccu

SEQ ID NO: 1365802 - RNA, 19 nt, Mycobacterium tuberculosis H37Rv
aucgauugcguagcggguc

SEQ ID NO: 1365803 - RNA, 17 nt, Mycobacterium tuberculosis H37Rv
aucgauguguacugaga

SEQ ID NO: 1365804 - RNA, 23 nt, Mycobacterium tuberculosis H37Rv
aucgauucgucgcggaucagccc

SEQ ID NO: 1365805 - RNA, 13 nt, Mycobacterium tuberculosis H37Rv
aucgcagccgguc

SEQ ID NO: 1365806 - RNA, 11 nt, Mycobacterium tuberculosis H37Rv
aucgcaggcac

SEQ ID NO: 1365807 - RNA, 17 nt, Mycobacterium tuberculosis H37Rv
aucgcagucauguccau

SEQ ID NO: 1365808 - RNA, 16 nt, Mycobacterium tuberculosis H37Rv
aucgcauccccagcac

SEQ ID NO: 1365809 - RNA, 22 nt, Mycobacterium tuberculosis H37Rv
aucgccaugauggacagcugcg

SEQ ID NO: 1365810 - RNA, 21 nt, Mycobacterium tuberculosis H37Rv
aucgcccaauuucgugccgaa

SEQ ID NO: 1365811 - RNA, 22 nt, Mycobacterium tuberculosis H37Rv
aucgcaagcgcggcgaagccgg

SEQ ID NO: 1365812 - RNA, 20 nt, Mycobacterium tuberculosis H37Rv
aucgcacgaaaucagcccgc

SEQ ID NO: 1365813 - RNA, 17 nt, Mycobacterium tuberculosis H37Rv
aucgcacggaugaugcc

SEQ ID NO: 1365814 - RNA, 14 nt, Mycobacterium tuberculosis H37Rv
aucgcacaaaccgg

SEQ ID NO: 1365815 - RNA, 22 nt, Mycobacterium tuberculosis H37Rv
aucgcaccgugugggccccgcc

SEQ ID NO: 1365816 - RNA, 17 nt, Mycobacterium tuberculosis H37Rv
aucgcagauggcgaggu

SEQ ID NO: 1365817 - RNA, 16 nt, Mycobacterium tuberculosis H37Rv
aucguguacugcuccu

SEQ ID NO: 1365818 - RNA, 18 nt, Mycobacterium tuberculosis H37Rv
aucguguacuggucugga

SEQ ID NO: 1365819 - RNA, 21 nt, Mycobacterium tuberculosis H37Rv
aucgugcggaaccugcucggc

SEQ ID NO: 1365820 - RNA, 14 nt, Mycobacterium tuberculosis H37Rv
aucgucugguggca

SEQ ID NO: 1365821 - RNA, 19 nt, Mycobacterium tuberculosis H37Rv
aucgucugguggcagcgca

SEQ ID NO: 1365822 - RNA, 15 nt, Mycobacterium tuberculosis H37Rv
aucgucucggccacg

SEQ ID NO: 1365823 - RNA, 18 nt, Mycobacterium tuberculosis H37Rv
aucgucuugucgccgagu

SEQ ID NO: 1365824 - RNA, 18 nt, Mycobacterium tuberculosis H37Rv
aucgugcggaaccugcuc

SEQ ID NO: 1365825 - RNA, 22 nt, Mycobacterium tuberculosis H37Rv
aucguucaugaucggcagaauc

SEQ ID NO: 1365826 - RNA, 18 nt, Mycobacterium tuberculosis H37Rv
aucguucaugaucggcag

SEQ ID NO: 1365827 - RNA, 20 nt, Mycobacterium tuberculosis H37Rv
aucguucaugaucggcagaa

SEQ ID NO: 1365828 - RNA, 14 nt, Mycobacterium tuberculosis H37Rv
aucgucgccacgau

SEQ ID NO: 1365829 - RNA, 17 nt, Mycobacterium tuberculosis H37Rv
aucgucggccagcagau

SEQ ID NO: 1365830 - RNA, 12 nt, Mycobacterium tuberculosis H37Rv
aucggaggcccg

SEQ ID NO: 1365831 - RNA, 18 nt, Mycobacterium tuberculosis H37Rv
aucggauacccagccggc

SEQ ID NO: 1365832 - RNA, 17 nt, Mycobacterium tuberculosis H37Rv
aucggcacaggcggcca

SEQ ID NO: 1365833 - RNA, 22 nt, Mycobacterium tuberculosis H37Rv
aucggcacaggcggccagcauc

SEQ ID NO: 1365834 - RNA, 17 nt, Mycobacterium tuberculosis H37Rv
aucggcaacggcggcgu

SEQ ID NO: 1365835 - RNA, 17 nt, Mycobacterium tuberculosis H37Rv
aucggauggcggccaca

SEQ ID NO: 1365836 - RNA, 14 nt, Mycobacterium tuberculosis H37Rv
aucggauggccccc

SEQ ID NO: 1365837 - RNA, 14 nt, Mycobacterium tuberculosis H37Rv
aucuauggaugacc

SEQ ID NO: 1365838 - RNA, 17 nt, Mycobacterium tuberculosis H37Rv
aucguuggccaugccac

SEQ ID NO: 1365839 - RNA, 13 nt, Mycobacterium tuberculosis H37Rv
aucucggcggcca

SEQ ID NO: 1365840 - RNA, 20 nt, Mycobacterium tuberculosis H37Rv
aucucggugaccucaccaac

SEQ ID NO: 1365841 - RNA, 16 nt, Mycobacterium tuberculosis H37Rv
aucucguacuccccgc

SEQ ID NO: 1365842 - RNA, 15 nt, Mycobacterium tuberculosis H37Rv
aucucgguggacggc

SEQ ID NO: 1365843 - RNA, 23 nt, Mycobacterium tuberculosis H37Rv
aucucuaccagccgccccggcuu

SEQ ID NO: 1365844 - RNA, 21 nt, Mycobacterium tuberculosis H37Rv
aucuccgcgucggucagcugu

SEQ ID NO: 1365845 - RNA, 13 nt, Mycobacterium tuberculosis H37Rv
aucucggccagga

SEQ ID NO: 1365846 - RNA, 20 nt, Mycobacterium tuberculosis H37Rv
aucucggccagggucacaaa

SEQ ID NO: 1365847 - RNA, 20 nt, Mycobacterium tuberculosis H37Rv
aucucggcgagcaccacccc

SEQ ID NO: 1365848 - RNA, 18 nt, Mycobacterium tuberculosis H37Rv
aucuccccgaccgcgccc

SEQ ID NO: 1365849 - RNA, 17 nt, Mycobacterium tuberculosis H37Rv
aucuccccguccugcca

SEQ ID NO: 1365850 - RNA, 15 nt, Mycobacterium tuberculosis H37Rv
aucugcuuggugacc

SEQ ID NO: 1365851 - RNA, 12 nt, Mycobacterium tuberculosis H37Rv
aucuggguuccc

SEQ ID NO: 1365852 - RNA, 14 nt, Mycobacterium tuberculosis H37Rv
aucugguccagugg

SEQ ID NO: 1365853 - RNA, 21 nt, Mycobacterium tuberculosis H37Rv
aucuggucacgguucgcccgu

SEQ ID NO: 1365854 - RNA, 21 nt, Mycobacterium tuberculosis H37Rv
aucugguccagugggaugacc

SEQ ID NO: 1365855 - RNA, 18 nt, Mycobacterium tuberculosis H37Rv
aucugcuggccgaaccgg

SEQ ID NO: 1365856 - RNA, 19 nt, Mycobacterium tuberculosis H37Rv
aucugcuggccgaaccggu

SEQ ID NO: 1365857 - RNA, 21 nt, Mycobacterium tuberculosis H37Rv
aucugcucgcguagcgcagga

SEQ ID NO: 1365858 - RNA, 13 nt, Mycobacterium tuberculosis H37Rv
aucugcugcagcg

SEQ ID NO: 1365859 - RNA, 18 nt, Mycobacterium tuberculosis H37Rv
aucugcaggcccaggcug

SEQ ID NO: 1365860 - RNA, 12 nt, Mycobacterium tuberculosis H37Rv
aucuugccacuc

SEQ ID NO: 1365861 - RNA, 12 nt, Mycobacterium tuberculosis H37Rv
aucuugcgcaug

SEQ ID NO: 1365862 - RNA, 22 nt, Mycobacterium tuberculosis H37Rv
aucuugcgacgcccgccuucga

SEQ ID NO: 1365863 - RNA, 21 nt, Mycobacterium tuberculosis H37Rv
aucuuggagaagguuucccgc

SEQ ID NO: 1365864 - RNA, 17 nt, Mycobacterium tuberculosis H37Rv
aucuugcggcagcgaaa

SEQ ID NO: 1365865 - RNA, 18 nt, Mycobacterium tuberculosis H37Rv
aucuugguggccucaucc

SEQ ID NO: 1365866 - RNA, 19 nt, Mycobacterium tuberculosis H37Rv
aucuuggugaagaucgaca

SEQ ID NO: 1365867 - RNA, 12 nt, Mycobacterium tuberculosis H37Rv
aucuuggccacc

SEQ ID NO: 1365868 - RNA, 15 nt, Mycobacterium tuberculosis H37Rv
aucuuggccagcagc

SEQ ID NO: 1365869 - RNA, 15 nt, Mycobacterium tuberculosis H37Rv
aucuugugccaggcg

SEQ ID NO: 1365870 - RNA, 22 nt, Mycobacterium tuberculosis H37Rv
augaccgguauuaccgccgugg

SEQ ID NO: 1365871 - RNA, 22 nt, Mycobacterium tuberculosis H37Rv
augaccccggcguugccgccgu

SEQ ID NO: 1365872 - RNA, 15 nt, Mycobacterium tuberculosis H37Rv
augacccgcggguga

SEQ ID NO: 1365873 - RNA, 17 nt, Mycobacterium tuberculosis H37Rv
augacccgcgggugaug

SEQ ID NO: 1365874 - RNA, 19 nt, Mycobacterium tuberculosis H37Rv
augaccgaaccuggucuug

SEQ ID NO: 1365875 - RNA, 16 nt, Mycobacterium tuberculosis H37Rv
augaccgacaggugcu

SEQ ID NO: 1365876 - RNA, 14 nt, Mycobacterium tuberculosis H37Rv
augaccgacaggug

SEQ ID NO: 1365877 - RNA, 22 nt, Mycobacterium tuberculosis H37Rv
augaccgccagcagcaggccag

SEQ ID NO: 1365878 - RNA, 15 nt, Mycobacterium tuberculosis H37Rv
augaccgcagcacuc

SEQ ID NO: 1365879 - RNA, 20 nt, Mycobacterium tuberculosis H37Rv
augaccgcagcacucccugg

SEQ ID NO: 1365880 - RNA, 18 nt, Mycobacterium tuberculosis H37Rv
augacgaccgaucggcgc

SEQ ID NO: 1365881 - RNA, 16 nt, Mycobacterium tuberculosis H37Rv
augaagauggcgcgca

SEQ ID NO: 1365882 - RNA, 21 nt, Mycobacterium tuberculosis H37Rv
auauuucuaaauaccuuuggc

SEQ ID NO: 1365883 - RNA, 21 nt, Mycobacterium tuberculosis H37Rv
aucaacuuccgcagcgccacc

SEQ ID NO: 1365884 - RNA, 16 nt, Mycobacterium tuberculosis H37Rv
auauucgcugggcgca

SEQ ID NO: 1365885 - RNA, 21 nt, Mycobacterium tuberculosis H37Rv
auaugcgugagcugcucgagc

SEQ ID NO: 1365886 - RNA, 18 nt, Mycobacterium tuberculosis H37Rv
auauggcagugucguggu

SEQ ID NO: 1365887 - RNA, 22 nt, Mycobacterium tuberculosis H37Rv
aucagcaccgugacagcggcau

SEQ ID NO: 1365888 - RNA, 13 nt, Mycobacterium tuberculosis H37Rv
aucagaacgugac

SEQ ID NO: 1365889 - RNA, 15 nt, Mycobacterium tuberculosis H37Rv
aucagccgcugcgua

SEQ ID NO: 1365890 - RNA, 13 nt, Mycobacterium tuberculosis H37Rv
aucagcccgccca

SEQ ID NO: 1365891 - RNA, 22 nt, Mycobacterium tuberculosis H37Rv
aucagcccuucagcgaagccgg

SEQ ID NO: 1365892 - RNA, 22 nt, Mycobacterium tuberculosis H37Rv
aucagcccggccuugccgccgg

SEQ ID NO: 1365893 - RNA, 13 nt, Mycobacterium tuberculosis H37Rv
aucagcccucggc

SEQ ID NO: 1365894 - RNA, 15 nt, Mycobacterium tuberculosis H37Rv
aucagcgacuugcug

SEQ ID NO: 1365895 - RNA, 20 nt, Mycobacterium tuberculosis H37Rv
aucagcgacuugcuggcgua

SEQ ID NO: 1365896 - RNA, 17 nt, Mycobacterium tuberculosis H37Rv
aucaggucgucacgccc

SEQ ID NO: 1365897 - RNA, 21 nt, Mycobacterium tuberculosis H37Rv
aaaacgggguggcacgcauga

SEQ ID NO: 1365898 - RNA, 19 nt, Mycobacterium tuberculosis H37Rv
aucaguucgugacgugcau

SEQ ID NO: 1365899 - RNA, 16 nt, Mycobacterium tuberculosis H37Rv
aaaacgaacccaggca

SEQ ID NO: 1365900 - RNA, 14 nt, Mycobacterium tuberculosis H37Rv
aucacaucaaaguc

SEQ ID NO: 1365901 - RNA, 13 nt, Mycobacterium tuberculosis H37Rv
aucacauccacgc

SEQ ID NO: 1365902 - RNA, 12 nt, Mycobacterium tuberculosis H37Rv
aucacaccgcug

SEQ ID NO: 1365903 - RNA, 16 nt, Mycobacterium tuberculosis H37Rv
aucacaccauuggcca

SEQ ID NO: 1365904 - RNA, 15 nt, Mycobacterium tuberculosis H37Rv
aucaauugcccggca

SEQ ID NO: 1365905 - RNA, 12 nt, Mycobacterium tuberculosis H37Rv
aucaccccgcca

SEQ ID NO: 1365906 - RNA, 15 nt, Mycobacterium tuberculosis H37Rv
aucaccauaggcaag

SEQ ID NO: 1365907 - RNA, 21 nt, Mycobacterium tuberculosis H37Rv
aucaccgaacggcgaggugcc

SEQ ID NO: 1365908 - RNA, 20 nt, Mycobacterium tuberculosis H37Rv
aucaccaggguguauggcca

SEQ ID NO: 1365909 - RNA, 12 nt, Mycobacterium tuberculosis H37Rv
aucaccagaaau

SEQ ID NO: 1365910 - RNA, 18 nt, Mycobacterium tuberculosis H37Rv
aucacucccccacacacc

SEQ ID NO: 1365911 - RNA, 21 nt, Mycobacterium tuberculosis H37Rv
auaccgguggcagccugcugc

SEQ ID NO: 1365912 - RNA, 13 nt, Mycobacterium tuberculosis H37Rv
auacgggcaguga

SEQ ID NO: 1365913 - RNA, 15 nt, Mycobacterium tuberculosis H37Rv
auagaacaacgucgc

SEQ ID NO: 1365914 - RNA, 20 nt, Mycobacterium tuberculosis H37Rv
auagacagggccgcucgccu

SEQ ID NO: 1365915 - RNA, 23 nt, Mycobacterium tuberculosis H37Rv
auacauuucgucgucgcagugca

SEQ ID NO: 1365916 - RNA, 17 nt, Mycobacterium tuberculosis H37Rv
auacaucgccuugccca

SEQ ID NO: 1365917 - RNA, 19 nt, Mycobacterium tuberculosis H37Rv
auacauccaggcuguggcc

SEQ ID NO: 1365918 - RNA, 22 nt, Mycobacterium tuberculosis H37Rv
auaauucaacagcaccgcgacg

SEQ ID NO: 1365919 - RNA, 24 nt, Mycobacterium tuberculosis H37Rv
auaccaguccggcggacgugacca

SEQ ID NO: 1365920 - RNA, 18 nt, Mycobacterium tuberculosis H37Rv
auacccagcgcagcagcg

SEQ ID NO: 1365921 - RNA, 13 nt, Mycobacterium tuberculosis H37Rv
auacccagcgccc

SEQ ID NO: 1365922 - RNA, 13 nt, Mycobacterium tuberculosis H37Rv
auacccaggaugu

SEQ ID NO: 1365923 - RNA, 22 nt, Mycobacterium tuberculosis H37Rv
auaccacuuugcguucccaucc

SEQ ID NO: 1365924 - RNA, 23 nt, Mycobacterium tuberculosis H37Rv
auaccagaccggccgacgugaca

SEQ ID NO: 1365925 - RNA, 14 nt, Mycobacterium tuberculosis H37Rv
auagccgaacagcg

SEQ ID NO: 1365926 - RNA, 19 nt, Mycobacterium tuberculosis H37Rv
auagcgcggcaccagcacc

SEQ ID NO: 1365927 - RNA, 14 nt, Mycobacterium tuberculosis H37Rv
auagcgcacugccg

SEQ ID NO: 1365928 - RNA, 14 nt, Mycobacterium tuberculosis H37Rv
auagcccaagccga

SEQ ID NO: 1365929 - RNA, 23 nt, Mycobacterium tuberculosis H37Rv
auagcuuuucgcaagucuccucg

SEQ ID NO: 1365930 - RNA, 18 nt, Mycobacterium tuberculosis H37Rv
auaggucgggcaugacga

SEQ ID NO: 1365931 - RNA, 13 nt, Mycobacterium tuberculosis H37Rv
auagggcugguau

SEQ ID NO: 1365932 - RNA, 16 nt, Mycobacterium tuberculosis H37Rv
auaggccgggcagugc

SEQ ID NO: 1365933 - RNA, 23 nt, Mycobacterium tuberculosis H37Rv
auauccggacuugaccagagcac

SEQ ID NO: 1365934 - RNA, 13 nt, Mycobacterium tuberculosis H37Rv
auaucacaacugc

SEQ ID NO: 1365935 - RNA, 18 nt, Mycobacterium tuberculosis H37Rv
auaguccuugcgccagcg

SEQ ID NO: 1365936 - RNA, 19 nt, Mycobacterium tuberculosis H37Rv
auauagggcuccucgugca

SEQ ID NO: 1365937 - RNA, 20 nt, Mycobacterium tuberculosis H37Rv
aguacucgcgcagguagcca

SEQ ID NO: 1365938 - RNA, 11 nt, Mycobacterium tuberculosis H37Rv
agucagaaccg

SEQ ID NO: 1365939 - RNA, 23 nt, Mycobacterium tuberculosis H37Rv
agucagaacggcggcagcggcgu

SEQ ID NO: 1365940 - RNA, 14 nt, Mycobacterium tuberculosis H37Rv
agucacagcucacc

SEQ ID NO: 1365941 - RNA, 19 nt, Mycobacterium tuberculosis H37Rv
agucaccaaaggcgucuga

SEQ ID NO: 1365942 - RNA, 21 nt, Mycobacterium tuberculosis H37Rv
agucacgcagccgcgcgguga

SEQ ID NO: 1365943 - RNA, 16 nt, Mycobacterium tuberculosis H37Rv
agucauguccauagcc

SEQ ID NO: 1365944 - RNA, 14 nt, Mycobacterium tuberculosis H37Rv
aguccaccaccugg

SEQ ID NO: 1365945 - RNA, 21 nt, Mycobacterium tuberculosis H37Rv
aguccaccaccuggccggcca

SEQ ID NO: 1365946 - RNA, 22 nt, Mycobacterium tuberculosis H37Rv
aguccaggcugaucccgaugcu

SEQ ID NO: 1365947 - RNA, 20 nt, Mycobacterium tuberculosis H37Rv
aguccagggcgccacgggug

SEQ ID NO: 1365948 - RNA, 15 nt, Mycobacterium tuberculosis H37Rv
agucccacugggccg

SEQ ID NO: 1365949 - RNA, 15 nt, Mycobacterium tuberculosis H37Rv
agucccagcgccgca

SEQ ID NO: 1365950 - RNA, 18 nt, Mycobacterium tuberculosis H37Rv
aguccaggcagcuugcca

SEQ ID NO: 1365951 - RNA, 20 nt, Mycobacterium tuberculosis H37Rv
aguccaggccggcagcuugc

SEQ ID NO: 1365952 - RNA, 18 nt, Mycobacterium tuberculosis H37Rv
aguccagcucgcugcgcg

SEQ ID NO: 1365953 - RNA, 21 nt, Mycobacterium tuberculosis H37Rv
agucauccaggucgccuuccc

SEQ ID NO: 1365954 - RNA, 23 nt, Mycobacterium tuberculosis H37Rv
agugacucaccgugaaccgcccg

SEQ ID NO: 1365955 - RNA, 13 nt, Mycobacterium tuberculosis H37Rv
agugacgccucga

SEQ ID NO: 1365956 - RNA, 20 nt, Mycobacterium tuberculosis H37Rv
agugacgggacccggguggu

SEQ ID NO: 1365957 - RNA, 18 nt, Mycobacterium tuberculosis H37Rv
agugaaaguucaugccau

SEQ ID NO: 1365958 - RNA, 21 nt, Mycobacterium tuberculosis H37Rv
agucugggcgaucgcuucgca

SEQ ID NO: 1365959 - RNA, 14 nt, Mycobacterium tuberculosis H37Rv
agucuggcgguauc

SEQ ID NO: 1365960 - RNA, 21 nt, Mycobacterium tuberculosis H37Rv
agucuugaccgcaccggccgc

SEQ ID NO: 1365961 - RNA, 18 nt, Mycobacterium tuberculosis H37Rv
agucucaagguuucgaca

SEQ ID NO: 1365962 - RNA, 18 nt, Mycobacterium tuberculosis H37Rv
agucgugcuugcccgguu

SEQ ID NO: 1365963 - RNA, 11 nt, Mycobacterium tuberculosis H37Rv
agucgccgagg

SEQ ID NO: 1365964 - RNA, 22 nt, Mycobacterium tuberculosis H37Rv
agucgccgaggacgccggcgcc

SEQ ID NO: 1365965 - RNA, 23 nt, Mycobacterium tuberculosis H37Rv
agucgccgaggacgccggcgccg

SEQ ID NO: 1365966 - RNA, 13 nt, Mycobacterium tuberculosis H37Rv
agucgcccguggc

SEQ ID NO: 1365967 - RNA, 13 nt, Mycobacterium tuberculosis H37Rv
agucgccgaaccu

SEQ ID NO: 1365968 - RNA, 12 nt, Mycobacterium tuberculosis H37Rv
agucgcaggauc

SEQ ID NO: 1365969 - RNA, 15 nt, Mycobacterium tuberculosis H37Rv
agucgccagaccgca

SEQ ID NO: 1365970 - RNA, 13 nt, Mycobacterium tuberculosis H37Rv
agucgccagaccg

SEQ ID NO: 1365971 - RNA, 19 nt, Mycobacterium tuberculosis H37Rv
agucguaguaggcgccgcg

SEQ ID NO: 1365972 - RNA, 14 nt, Mycobacterium tuberculosis H37Rv
agucgccgcgggca

SEQ ID NO: 1365973 - RNA, 22 nt, Mycobacterium tuberculosis H37Rv
agucgccgucgugccaccguug

SEQ ID NO: 1365974 - RNA, 20 nt, Mycobacterium tuberculosis H37Rv
agucgucggcaugggccggc

SEQ ID NO: 1365975 - RNA, 17 nt, Mycobacterium tuberculosis H37Rv
agucgucgcuugcuggg

SEQ ID NO: 1365976 - RNA, 18 nt, Mycobacterium tuberculosis H37Rv
agucgucggcaacgcugg

SEQ ID NO: 1365977 - RNA, 22 nt, Mycobacterium tuberculosis H37Rv
agucgucuucgucauggccggc

SEQ ID NO: 1365978 - RNA, 20 nt, Mycobacterium tuberculosis H37Rv
aguccccgcuuggcgagcca

SEQ ID NO: 1365979 - RNA, 18 nt, Mycobacterium tuberculosis H37Rv
aguccccgaaccgagcgg

SEQ ID NO: 1365980 - RNA, 20 nt, Mycobacterium tuberculosis H37Rv
agucccgccguugccgccgu

SEQ ID NO: 1365981 - RNA, 16 nt, Mycobacterium tuberculosis H37Rv
aguccgagcuuggccg

SEQ ID NO: 1365982 - RNA, 19 nt, Mycobacterium tuberculosis H37Rv
agucccgguagaccaugaa

SEQ ID NO: 1365983 - RNA, 21 nt, Mycobacterium tuberculosis H37Rv
agucgaagaaccugagcacca

SEQ ID NO: 1365984 - RNA, 13 nt, Mycobacterium tuberculosis H37Rv
agucgaacaagac

SEQ ID NO: 1365985 - RNA, 13 nt, Mycobacterium tuberculosis H37Rv
agucgcacugcgc

SEQ ID NO: 1365986 - RNA, 18 nt, Mycobacterium tuberculosis H37Rv
agucgcacggugccgccg

SEQ ID NO: 1365987 - RNA, 18 nt, Mycobacterium tuberculosis H37Rv
aguccgaugggaaucagu

SEQ ID NO: 1365988 - RNA, 18 nt, Mycobacterium tuberculosis H37Rv
aguccgaugccggaaugc

SEQ ID NO: 1365989 - RNA, 12 nt, Mycobacterium tuberculosis H37Rv
agugcuccaccu

SEQ ID NO: 1365990 - RNA, 22 nt, Mycobacterium tuberculosis H37Rv
agugcggugagauggcggugag

SEQ ID NO: 1365991 - RNA, 18 nt, Mycobacterium tuberculosis H37Rv
agugaggcugugccccag

SEQ ID NO: 1365992 - RNA, 18 nt, Mycobacterium tuberculosis H37Rv
agugaggccgaccagcac

SEQ ID NO: 1365993 - RNA, 20 nt, Mycobacterium tuberculosis H37Rv
agugagcaugcgacgucagg

SEQ ID NO: 1365994 - RNA, 17 nt, Mycobacterium tuberculosis H37Rv
agugggacuggcgugaa

SEQ ID NO: 1365995 - RNA, 19 nt, Mycobacterium tuberculosis H37Rv
agugggcaauccggucagc

SEQ ID NO: 1365996 - RNA, 15 nt, Mycobacterium tuberculosis H37Rv
aguggagggcccggc

SEQ ID NO: 1365997 - RNA, 21 nt, Mycobacterium tuberculosis H37Rv
aguggcgcaccaccuccccga

SEQ ID NO: 1365998 - RNA, 15 nt, Mycobacterium tuberculosis H37Rv
aguggcgcaccaccu

SEQ ID NO: 1365999 - RNA, 16 nt, Mycobacterium tuberculosis H37Rv
aguggcgaucugcugc

SEQ ID NO: 1366000 - RNA, 16 nt, Mycobacterium tuberculosis H37Rv
aguggcgccagggccu

SEQ ID NO: 1366001 - RNA, 19 nt, Mycobacterium tuberculosis H37Rv
aguggcgcccauggccacc

SEQ ID NO: 1366002 - RNA, 11 nt, Mycobacterium tuberculosis H37Rv
aguggaagccg

SEQ ID NO: 1366003 - RNA, 19 nt, Mycobacterium tuberculosis H37Rv
agugcuuuggguccgggcg

SEQ ID NO: 1366004 - RNA, 16 nt, Mycobacterium tuberculosis H37Rv
agugugagcagaccca

SEQ ID NO: 1366005 - RNA, 17 nt, Mycobacterium tuberculosis H37Rv
agugucuuagccagcag

SEQ ID NO: 1366006 - RNA, 18 nt, Mycobacterium tuberculosis H37Rv
agugucuuagccagcagc

SEQ ID NO: 1366007 - RNA, 14 nt, Mycobacterium tuberculosis H37Rv
agugugaacugucc

SEQ ID NO: 1366008 - RNA, 19 nt, Mycobacterium tuberculosis H37Rv
aguguugcaguggcgacga

SEQ ID NO: 1366009 - RNA, 13 nt, Mycobacterium tuberculosis H37Rv
agugugcccugcu

SEQ ID NO: 1366010 - RNA, 22 nt, Mycobacterium tuberculosis H37Rv
aguguugcgcugcggccagcgc

SEQ ID NO: 1366011 - RNA, 20 nt, Mycobacterium tuberculosis H37Rv
aguguugcgcugcggccagc

SEQ ID NO: 1366012 - RNA, 20 nt, Mycobacterium tuberculosis H37Rv
aguguuuggguuuuguuugg

SEQ ID NO: 1366013 - RNA, 19 nt, Mycobacterium tuberculosis H37Rv
aguugaccuucaccuggaa

SEQ ID NO: 1366014 - RNA, 21 nt, Mycobacterium tuberculosis H37Rv
aguugagggugugagguaguc

SEQ ID NO: 1366015 - RNA, 22 nt, Mycobacterium tuberculosis H37Rv
aguugcucguugugcagguggc

SEQ ID NO: 1366016 - RNA, 14 nt, Mycobacterium tuberculosis H37Rv
aguugcucggccga

SEQ ID NO: 1366017 - RNA, 18 nt, Mycobacterium tuberculosis H37Rv
aguugcucggccgaugcg

SEQ ID NO: 1366018 - RNA, 11 nt, Mycobacterium tuberculosis H37Rv
aguugaagaau

SEQ ID NO: 1366019 - RNA, 21 nt, Mycobacterium tuberculosis H37Rv
aguugaacaauccgguguuga

SEQ ID NO: 1366020 - RNA, 14 nt, Mycobacterium tuberculosis H37Rv
aguucgagcugcca

SEQ ID NO: 1366021 - RNA, 22 nt, Mycobacterium tuberculosis H37Rv
aguucgacggcgucaaaggccu

SEQ ID NO: 1366022 - RNA, 22 nt, Mycobacterium tuberculosis H37Rv
aguuccuugccgaucgccgagu

SEQ ID NO: 1366023 - RNA, 15 nt, Mycobacterium tuberculosis H37Rv
aguucgcgccacgca

SEQ ID NO: 1366024 - RNA, 19 nt, Mycobacterium tuberculosis H37Rv
aguucagccaggccgcaau

SEQ ID NO: 1366025 - RNA, 17 nt, Mycobacterium tuberculosis H37Rv
aguuccucguggguccg

SEQ ID NO: 1366026 - RNA, 11 nt, Mycobacterium tuberculosis H37Rv
aguuccucuac

SEQ ID NO: 1366027 - RNA, 18 nt, Mycobacterium tuberculosis H37Rv
aguuccugacgccauuca

SEQ ID NO: 1366028 - RNA, 23 nt, Mycobacterium tuberculosis H37Rv
aguucccugaugggcgaauugca

SEQ ID NO: 1366029 - RNA, 17 nt, Mycobacterium tuberculosis H37Rv
aguuaggccgccagccg

SEQ ID NO: 1366030 - RNA, 13 nt, Mycobacterium tuberculosis H37Rv
aguuuucggccgc

SEQ ID NO: 1366031 - RNA, 23 nt, Mycobacterium tuberculosis H37Rv
aguuggcgcccgaagccgggccc

SEQ ID NO: 1366032 - RNA, 19 nt, Mycobacterium tuberculosis H37Rv
aguuggccaguaugcggug

SEQ ID NO: 1366033 - RNA, 15 nt, Mycobacterium tuberculosis H37Rv
aguugggcguucagg

SEQ ID NO: 1366034 - RNA, 15 nt, Mycobacterium tuberculosis H37Rv
aguugggugggugca

SEQ ID NO: 1366035 - RNA, 13 nt, Mycobacterium tuberculosis H37Rv
agcucgccagccu

SEQ ID NO: 1366036 - RNA, 13 nt, Mycobacterium tuberculosis H37Rv
agcucgccagggu

SEQ ID NO: 1366037 - RNA, 19 nt, Mycobacterium tuberculosis H37Rv
agcucgauacccaggaugu

SEQ ID NO: 1366038 - RNA, 15 nt, Mycobacterium tuberculosis H37Rv
agcucgcggcgcagg

SEQ ID NO: 1366039 - RNA, 18 nt, Mycobacterium tuberculosis H37Rv
agcucgccggcacgcagc

SEQ ID NO: 1366040 - RNA, 23 nt, Mycobacterium tuberculosis H37Rv
agcucggccaccagcgcccggcc

SEQ ID NO: 1366041 - RNA, 15 nt, Mycobacterium tuberculosis H37Rv
agcucggccagcacg

SEQ ID NO: 1366042 - RNA, 24 nt, Mycobacterium tuberculosis H37Rv
agcucgaggcccgggugcuacugg

SEQ ID NO: 1366043 - RNA, 16 nt, Mycobacterium tuberculosis H37Rv
agcucgaggaccaccu

SEQ ID NO: 1366044 - RNA, 13 nt, Mycobacterium tuberculosis H37Rv
agcucgaggacca

SEQ ID NO: 1366045 - RNA, 15 nt, Mycobacterium tuberculosis H37Rv
agcucgaggaccacc

SEQ ID NO: 1366046 - RNA, 17 nt, Mycobacterium tuberculosis H37Rv
agcucgaccgcccggcu

SEQ ID NO: 1366047 - RNA, 20 nt, Mycobacterium tuberculosis H37Rv
agcucgaccugaggcaccuc

SEQ ID NO: 1366048 - RNA, 15 nt, Mycobacterium tuberculosis H37Rv
agcucgaagcccgga

SEQ ID NO: 1366049 - RNA, 14 nt, Mycobacterium tuberculosis H37Rv
agcucgaccgcccg

SEQ ID NO: 1366050 - RNA, 17 nt, Mycobacterium tuberculosis H37Rv
agcucgacaacugcccg

SEQ ID NO: 1366051 - RNA, 22 nt, Mycobacterium tuberculosis H37Rv
agcucgaacagguuggccccgg

SEQ ID NO: 1366052 - RNA, 24 nt, Mycobacterium tuberculosis H37Rv
agcuccguggugcuagcgccgcca

SEQ ID NO: 1366053 - RNA, 21 nt, Mycobacterium tuberculosis H37Rv
agcucccugggcgucgaccac

SEQ ID NO: 1366054 - RNA, 21 nt, Mycobacterium tuberculosis H37Rv
agcucccgccacgucgccggc

SEQ ID NO: 1366055 - RNA, 18 nt, Mycobacterium tuberculosis H37Rv
agcgucgcggccacgguc

SEQ ID NO: 1366056 - RNA, 15 nt, Mycobacterium tuberculosis H37Rv
agcgucggugccacc

SEQ ID NO: 1366057 - RNA, 14 nt, Mycobacterium tuberculosis H37Rv
agcgucgccauucc

SEQ ID NO: 1366058 - RNA, 20 nt, Mycobacterium tuberculosis H37Rv
agcucguugaucuuggucgg

SEQ ID NO: 1366059 - RNA, 18 nt, Mycobacterium tuberculosis H37Rv
agcucguugaugcggcua

SEQ ID NO: 1366060 - RNA, 19 nt, Mycobacterium tuberculosis H37Rv
agcucucggcacccggcag

SEQ ID NO: 1366061 - RNA, 22 nt, Mycobacterium tuberculosis H37Rv
agcucguugcuggcggccagca

SEQ ID NO: 1366062 - RNA, 16 nt, Mycobacterium tuberculosis H37Rv
agcucgucgagcgcgu

SEQ ID NO: 1366063 - RNA, 15 nt, Mycobacterium tuberculosis H37Rv
agcucggucagcguc

SEQ ID NO: 1366064 - RNA, 23 nt, Mycobacterium tuberculosis H37Rv
agcucggucagcgucaggugcgc

SEQ ID NO: 1366065 - RNA, 14 nt, Mycobacterium tuberculosis H37Rv
agcucggucagcgu

SEQ ID NO: 1366066 - RNA, 21 nt, Mycobacterium tuberculosis H37Rv
agcucgguggcaucggcggcc

SEQ ID NO: 1366067 - RNA, 13 nt, Mycobacterium tuberculosis H37Rv
agcucgggcaggg

SEQ ID NO: 1366068 - RNA, 16 nt, Mycobacterium tuberculosis H37Rv
agcucggcgcccagcu

SEQ ID NO: 1366069 - RNA, 18 nt, Mycobacterium tuberculosis H37Rv
agcucuucggacacagcc

SEQ ID NO: 1366070 - RNA, 23 nt, Mycobacterium tuberculosis H37Rv
agcucuugcgggcagccgcccgc

SEQ ID NO: 1366071 - RNA, 19 nt, Mycobacterium tuberculosis H37Rv
agcugaaaauaggccgggc

SEQ ID NO: 1366072 - RNA, 20 nt, Mycobacterium tuberculosis H37Rv
agcugaaaauaggccgggca

SEQ ID NO: 1366073 - RNA, 23 nt, Mycobacterium tuberculosis H37Rv
agcugacgugucggcugcuaugg

SEQ ID NO: 1366074 - RNA, 24 nt, Mycobacterium tuberculosis H37Rv
agcugacaccgaaccgccgcugcc

SEQ ID NO: 1366075 - RNA, 12 nt, Mycobacterium tuberculosis H37Rv
agcuggccaggu

SEQ ID NO: 1366076 - RNA, 16 nt, Mycobacterium tuberculosis H37Rv
agcuggcgugcagcag

SEQ ID NO: 1366077 - RNA, 15 nt, Mycobacterium tuberculosis H37Rv
agcugggcaccccgu

SEQ ID NO: 1366078 - RNA, 15 nt, Mycobacterium tuberculosis H37Rv
agcuggggcccggcc

SEQ ID NO: 1366079 - RNA, 18 nt, Mycobacterium tuberculosis H37Rv
agcuggggcccggccgcc

SEQ ID NO: 1366080 - RNA, 22 nt, Mycobacterium tuberculosis H37Rv
agcuguuggcguggaucuuggc

SEQ ID NO: 1366081 - RNA, 21 nt, Mycobacterium tuberculosis H37Rv
agcuguuggcguggaucuugg

SEQ ID NO: 1366082 - RNA, 14 nt, Mycobacterium tuberculosis H37Rv
agcuguugcggggu

SEQ ID NO: 1366083 - RNA, 19 nt, Mycobacterium tuberculosis H37Rv
agcugcgcagcgcaaacau

SEQ ID NO: 1366084 - RNA, 19 nt, Mycobacterium tuberculosis H37Rv
agcugcgcgaagccaccag

SEQ ID NO: 1366085 - RNA, 16 nt, Mycobacterium tuberculosis H37Rv
agcugcuagcccggcg

SEQ ID NO: 1366086 - RNA, 20 nt, Mycobacterium tuberculosis H37Rv
agcugcuagcccggcggcga

SEQ ID NO: 1366087 - RNA, 16 nt, Mycobacterium tuberculosis H37Rv
agcugcgcaucgccac

SEQ ID NO: 1366088 - RNA, 17 nt, Mycobacterium tuberculosis H37Rv
agcugcggauacagccg

SEQ ID NO: 1366089 - RNA, 21 nt, Mycobacterium tuberculosis H37Rv
agcugauuguguuccaccagc

SEQ ID NO: 1366090 - RNA, 15 nt, Mycobacterium tuberculosis H37Rv
agcuuggcggccagc

SEQ ID NO: 1366091 - RNA, 14 nt, Mycobacterium tuberculosis H37Rv
agcuuggagaggcg

SEQ ID NO: 1366092 - RNA, 15 nt, Mycobacterium tuberculosis H37Rv
agcuuggacucaucg

SEQ ID NO: 1366093 - RNA, 22 nt, Mycobacterium tuberculosis H37Rv
agcuuggccgguucaggggugg

SEQ ID NO: 1366094 - RNA, 23 nt, Mycobacterium tuberculosis H37Rv
agcuuggccgguucagggguggc

SEQ ID NO: 1366095 - RNA, 14 nt, Mycobacterium tuberculosis H37Rv
agcuuggccagcca

SEQ ID NO: 1366096 - RNA, 12 nt, Mycobacterium tuberculosis H37Rv
agcuuggccagc

SEQ ID NO: 1366097 - RNA, 15 nt, Mycobacterium tuberculosis H37Rv
agcuuucccguugcu

SEQ ID NO: 1366098 - RNA, 18 nt, Mycobacterium tuberculosis H37Rv
agcuugaaauagucuucu

SEQ ID NO: 1366099 - RNA, 19 nt, Mycobacterium tuberculosis H37Rv
aggacggcuugagccgcag

SEQ ID NO: 1366100 - RNA, 16 nt, Mycobacterium tuberculosis H37Rv
aggacgccagcaaugc

SEQ ID NO: 1366101 - RNA, 13 nt, Mycobacterium tuberculosis H37Rv
aggacgcaccgcc

SEQ ID NO: 1366102 - RNA, 16 nt, Mycobacterium tuberculosis H37Rv
aggacgcaccgccagu

SEQ ID NO: 1366103 - RNA, 15 nt, Mycobacterium tuberculosis H37Rv
aggacggagcccaaa

SEQ ID NO: 1366104 - RNA, 13 nt, Mycobacterium tuberculosis H37Rv
aggacggcggcca

SEQ ID NO: 1366105 - RNA, 17 nt, Mycobacterium tuberculosis H37Rv
aggacggcggccaggac

SEQ ID NO: 1366106 - RNA, 16 nt, Mycobacterium tuberculosis H37Rv
aggacggcguagacgu

SEQ ID NO: 1366107 - RNA, 20 nt, Mycobacterium tuberculosis H37Rv
aggaccuucugucccugcag

SEQ ID NO: 1366108 - RNA, 16 nt, Mycobacterium tuberculosis H37Rv
aggaaugccgcgggga

SEQ ID NO: 1366109 - RNA, 21 nt, Mycobacterium tuberculosis H37Rv
aggaccggugggucugcucag

SEQ ID NO: 1366110 - RNA, 23 nt, Mycobacterium tuberculosis H37Rv
aggaccggugggucugcucagcg

SEQ ID NO: 1366111 - RNA, 23 nt, Mycobacterium tuberculosis H37Rv
aggaccgggaucgucaggcccau

SEQ ID NO: 1366112 - RNA, 19 nt, Mycobacterium tuberculosis H37Rv
aggaccggcaccuggucca

SEQ ID NO: 1366113 - RNA, 13 nt, Mycobacterium tuberculosis H37Rv
aggaccgcgccga

SEQ ID NO: 1366114 - RNA, 16 nt, Mycobacterium tuberculosis H37Rv
aggaguuugaccaccu

SEQ ID NO: 1366115 - RNA, 13 nt, Mycobacterium tuberculosis H37Rv
aggacucacgcag

SEQ ID NO: 1366116 - RNA, 21 nt, Mycobacterium tuberculosis H37Rv
aggaucgguuucugcggcccc

SEQ ID NO: 1366117 - RNA, 19 nt, Mycobacterium tuberculosis H37Rv
aggaucuguuugggcaucu

SEQ ID NO: 1366118 - RNA, 21 nt, Mycobacterium tuberculosis H37Rv
aggaucgaggcgucggcaacc

SEQ ID NO: 1366119 - RNA, 20 nt, Mycobacterium tuberculosis H37Rv
aggaucggcuugggaaaccc

SEQ ID NO: 1366120 - RNA, 21 nt, Mycobacterium tuberculosis H37Rv
aggaucggggcgcugcagcuc

SEQ ID NO: 1366121 - RNA, 17 nt, Mycobacterium tuberculosis H37Rv
aggaucggauggcggcc

SEQ ID NO: 1366122 - RNA, 15 nt, Mycobacterium tuberculosis H37Rv
aggaucucgcggucc

SEQ ID NO: 1366123 - RNA, 16 nt, Mycobacterium tuberculosis H37Rv
aggaucagcgcacugg

SEQ ID NO: 1366124 - RNA, 19 nt, Mycobacterium tuberculosis H37Rv
aggaucccgguggcagcac

SEQ ID NO: 1366125 - RNA, 15 nt, Mycobacterium tuberculosis H37Rv
aggauaucgccgaga

SEQ ID NO: 1366126 - RNA, 15 nt, Mycobacterium tuberculosis H37Rv
aggccaggaucuccc

SEQ ID NO: 1366127 - RNA, 15 nt, Mycobacterium tuberculosis H37Rv
aggcccgggcggcca

SEQ ID NO: 1366128 - RNA, 13 nt, Mycobacterium tuberculosis H37Rv
aggcccuggccag

SEQ ID NO: 1366129 - RNA, 14 nt, Mycobacterium tuberculosis H37Rv
aggcccuggccagc

SEQ ID NO: 1366130 - RNA, 16 nt, Mycobacterium tuberculosis H37Rv
aggcccuggccaccca

SEQ ID NO: 1366131 - RNA, 10 nt, Mycobacterium tuberculosis H37Rv
aggccgccgc

SEQ ID NO: 1366132 - RNA, 19 nt, Mycobacterium tuberculosis H37Rv
aggccgacacgaacgcugc

SEQ ID NO: 1366133 - RNA, 17 nt, Mycobacterium tuberculosis H37Rv
aggccgccgagguguuu

SEQ ID NO: 1366134 - RNA, 20 nt, Mycobacterium tuberculosis H37Rv
aggccgaacugccgcgccga

SEQ ID NO: 1366135 - RNA, 22 nt, Mycobacterium tuberculosis H37Rv
aggccgaacagccgagccagca

SEQ ID NO: 1366136 - RNA, 17 nt, Mycobacterium tuberculosis H37Rv
aggcccuggccacccag

SEQ ID NO: 1366137 - RNA, 12 nt, Mycobacterium tuberculosis H37Rv
aggccgcgucga

SEQ ID NO: 1366138 - RNA, 19 nt, Mycobacterium tuberculosis H37Rv
aggccgccguggugaucaa

SEQ ID NO: 1366139 - RNA, 16 nt, Mycobacterium tuberculosis H37Rv
aggccgcggcacccgg

SEQ ID NO: 1366140 - RNA, 15 nt, Mycobacterium tuberculosis H37Rv
aggccgcgcgcaggg

SEQ ID NO: 1366141 - RNA, 21 nt, Mycobacterium tuberculosis H37Rv
aggccggcaagaccgaacagc

SEQ ID NO: 1366142 - RNA, 14 nt, Mycobacterium tuberculosis H37Rv
aggccgcugggccg

SEQ ID NO: 1366143 - RNA, 21 nt, Mycobacterium tuberculosis H37Rv
aggcagccucgaguucgaccg

SEQ ID NO: 1366144 - RNA, 11 nt, Mycobacterium tuberculosis H37Rv
aggcagugagg

SEQ ID NO: 1366145 - RNA, 22 nt, Mycobacterium tuberculosis H37Rv
aggcaaugcccgaccggucugg

SEQ ID NO: 1366146 - RNA, 13 nt, Mycobacterium tuberculosis H37Rv
aggcaaacaccag

SEQ ID NO: 1366147 - RNA, 23 nt, Mycobacterium tuberculosis H37Rv
aggaugaucugcgcggcccgcug

SEQ ID NO: 1366148 - RNA, 13 nt, Mycobacterium tuberculosis H37Rv
aggaugaugaccg

SEQ ID NO: 1366149 - RNA, 18 nt, Mycobacterium tuberculosis H37Rv
aggaugccgaaccgcgcg

SEQ ID NO: 1366150 - RNA, 20 nt, Mycobacterium tuberculosis H37Rv
aggcugccgaaguugaagaa

SEQ ID NO: 1366151 - RNA, 23 nt, Mycobacterium tuberculosis H37Rv
aggcugccgaaguugaagaagcc

SEQ ID NO: 1366152 - RNA, 16 nt, Mycobacterium tuberculosis H37Rv
aggcuguaacacccgg

SEQ ID NO: 1366153 - RNA, 17 nt, Mycobacterium tuberculosis H37Rv
aggcuggucugcaggcg

SEQ ID NO: 1366154 - RNA, 11 nt, Mycobacterium tuberculosis H37Rv
aggcuggaggu

SEQ ID NO: 1366155 - RNA, 14 nt, Mycobacterium tuberculosis H37Rv
aggcuggaggugaa

SEQ ID NO: 1366156 - RNA, 15 nt, Mycobacterium tuberculosis H37Rv
aggcugaccguggcg

SEQ ID NO: 1366157 - RNA, 17 nt, Mycobacterium tuberculosis H37Rv
aggcugaccguggcgcc

SEQ ID NO: 1366158 - RNA, 18 nt, Mycobacterium tuberculosis H37Rv
aggcucucguagcgcuca

SEQ ID NO: 1366159 - RNA, 23 nt, Mycobacterium tuberculosis H37Rv
aggcucauccgccgggccaggcc

SEQ ID NO: 1366160 - RNA, 15 nt, Mycobacterium tuberculosis H37Rv
aggcucauccgccgg

SEQ ID NO: 1366161 - RNA, 18 nt, Mycobacterium tuberculosis H37Rv
aggcucauccgccgggcc

SEQ ID NO: 1366162 - RNA, 13 nt, Mycobacterium tuberculosis H37Rv
aggcgugcacagg

SEQ ID NO: 1366163 - RNA, 19 nt, Mycobacterium tuberculosis H37Rv
aggcgugcacccccaucac

SEQ ID NO: 1366164 - RNA, 19 nt, Mycobacterium tuberculosis H37Rv
aggcgugcuugaccgccug

SEQ ID NO: 1366165 - RNA, 15 nt, Mycobacterium tuberculosis H37Rv
aggcuaaucagccag

SEQ ID NO: 1366166 - RNA, 19 nt, Mycobacterium tuberculosis H37Rv
aggcguuguagcgguccag

SEQ ID NO: 1366167 - RNA, 20 nt, Mycobacterium tuberculosis H37Rv
aggcguuggaucccagcccg

SEQ ID NO: 1366168 - RNA, 12 nt, Mycobacterium tuberculosis H37Rv
aggccggccacc

SEQ ID NO: 1366169 - RNA, 17 nt, Mycobacterium tuberculosis H37Rv
aggcggccaggugcagg

SEQ ID NO: 1366170 - RNA, 17 nt, Mycobacterium tuberculosis H37Rv
aggccggcggcgguggu

SEQ ID NO: 1366171 - RNA, 18 nt, Mycobacterium tuberculosis H37Rv
aggcggcgccgcacccac

SEQ ID NO: 1366172 - RNA, 14 nt, Mycobacterium tuberculosis H37Rv
aggcggcggccagc

SEQ ID NO: 1366173 - RNA, 21 nt, Mycobacterium tuberculosis H37Rv
aggcggcgcgggucggcgacc

SEQ ID NO: 1366174 - RNA, 12 nt, Mycobacterium tuberculosis H37Rv
aggcggcggccc

SEQ ID NO: 1366175 - RNA, 15 nt, Mycobacterium tuberculosis H37Rv
aggcggcggccuggc

SEQ ID NO: 1366176 - RNA, 20 nt, Mycobacterium tuberculosis H37Rv
aggcggcugaacggcagccg

SEQ ID NO: 1366177 - RNA, 14 nt, Mycobacterium tuberculosis H37Rv
aggcgggcggcacc

SEQ ID NO: 1366178 - RNA, 18 nt, Mycobacterium tuberculosis H37Rv
aggcguaaucaagcagcg

SEQ ID NO: 1366179 - RNA, 15 nt, Mycobacterium tuberculosis H37Rv
aggcguccaucagag

SEQ ID NO: 1366180 - RNA, 14 nt, Mycobacterium tuberculosis H37Rv
aggcgucccagccg

SEQ ID NO: 1366181 - RNA, 22 nt, Mycobacterium tuberculosis H37Rv
agggcgcgagcagacgcagaau

SEQ ID NO: 1366182 - RNA, 20 nt, Mycobacterium tuberculosis H37Rv
agggcgccgggggcgccgcc

SEQ ID NO: 1366183 - RNA, 17 nt, Mycobacterium tuberculosis H37Rv
agggcggaaacggcacc

SEQ ID NO: 1366184 - RNA, 21 nt, Mycobacterium tuberculosis H37Rv
agggcuuucgcuuccugggca

SEQ ID NO: 1366185 - RNA, 19 nt, Mycobacterium tuberculosis H37Rv
agggcuugucgccggcaua

SEQ ID NO: 1366186 - RNA, 20 nt, Mycobacterium tuberculosis H37Rv
aggggaucguccggccgggg

SEQ ID NO: 1366187 - RNA, 15 nt, Mycobacterium tuberculosis H37Rv
aggggaucugagugg

SEQ ID NO: 1366188 - RNA, 14 nt, Mycobacterium tuberculosis H37Rv
aggggcaacagggg

SEQ ID NO: 1366189 - RNA, 19 nt, Mycobacterium tuberculosis H37Rv
aggggauuuugcgucugcu

SEQ ID NO: 1366190 - RNA, 21 nt, Mycobacterium tuberculosis H37Rv
aggguuuccaagucggagcgg

SEQ ID NO: 1366191 - RNA, 21 nt, Mycobacterium tuberculosis H37Rv
aggguggggcgguggccggcg

SEQ ID NO: 1366192 - RNA, 16 nt, Mycobacterium tuberculosis H37Rv
agggucacaaacccag

SEQ ID NO: 1366193 - RNA, 18 nt, Mycobacterium tuberculosis H37Rv
agggucacaaacccagca

SEQ ID NO: 1366194 - RNA, 18 nt, Mycobacterium tuberculosis H37Rv
aggggugcccggcggcca

SEQ ID NO: 1366195 - RNA, 22 nt, Mycobacterium tuberculosis H37Rv
agggucugcucauccgggugcu

SEQ ID NO: 1366196 - RNA, 19 nt, Mycobacterium tuberculosis H37Rv
agggucugcgccgccggcg

SEQ ID NO: 1366197 - RNA, 20 nt, Mycobacterium tuberculosis H37Rv
aggcuucggugacccgggcg

SEQ ID NO: 1366198 - RNA, 15 nt, Mycobacterium tuberculosis H37Rv
aggcuugacugcaca

SEQ ID NO: 1366199 - RNA, 19 nt, Mycobacterium tuberculosis H37Rv
agggaucuagaggcggccc

SEQ ID NO: 1366200 - RNA, 19 nt, Mycobacterium tuberculosis H37Rv
agggauccgaagagccagc

SEQ ID NO: 1366201 - RNA, 17 nt, Mycobacterium tuberculosis H37Rv
agggaucgcagggauca

SEQ ID NO: 1366202 - RNA, 14 nt, Mycobacterium tuberculosis H37Rv
agggaucgcaggga

SEQ ID NO: 1366203 - RNA, 20 nt, Mycobacterium tuberculosis H37Rv
aggcugugccccagggcagu

SEQ ID NO: 1366204 - RNA, 15 nt, Mycobacterium tuberculosis H37Rv
aggcuguggccagca

SEQ ID NO: 1366205 - RNA, 17 nt, Mycobacterium tuberculosis H37Rv
aggcuguggccagcauc

SEQ ID NO: 1366206 - RNA, 15 nt, Mycobacterium tuberculosis H37Rv
aggcuuacaugcccu

SEQ ID NO: 1366207 - RNA, 16 nt, Mycobacterium tuberculosis H37Rv
agggccuguuuaccuu

SEQ ID NO: 1366208 - RNA, 16 nt, Mycobacterium tuberculosis H37Rv
agggccuccacccgcc

SEQ ID NO: 1366209 - RNA, 22 nt, Mycobacterium tuberculosis H37Rv
agggccgucuugccggccagga

SEQ ID NO: 1366210 - RNA, 19 nt, Mycobacterium tuberculosis H37Rv
agggcaucgggccuagccg

SEQ ID NO: 1366211 - RNA, 14 nt, Mycobacterium tuberculosis H37Rv
agggcauccgagcg

SEQ ID NO: 1366212 - RNA, 16 nt, Mycobacterium tuberculosis H37Rv
agggcacugaaccggu

SEQ ID NO: 1366213 - RNA, 23 nt, Mycobacterium tuberculosis H37Rv
agggaucuagaggcggcccccgg

SEQ ID NO: 1366214 - RNA, 16 nt, Mycobacterium tuberculosis H37Rv
agggcagcgccaggcc

SEQ ID NO: 1366215 - RNA, 13 nt, Mycobacterium tuberculosis H37Rv
aggugccagacca

SEQ ID NO: 1366216 - RNA, 16 nt, Mycobacterium tuberculosis H37Rv
aggugccggggcccca

SEQ ID NO: 1366217 - RNA, 19 nt, Mycobacterium tuberculosis H37Rv
aggugccgaagaugaccgc

SEQ ID NO: 1366218 - RNA, 18 nt, Mycobacterium tuberculosis H37Rv
aggugccgcgcagcugcc

SEQ ID NO: 1366219 - RNA, 17 nt, Mycobacterium tuberculosis H37Rv
aggugacgccgccagca

SEQ ID NO: 1366220 - RNA, 19 nt, Mycobacterium tuberculosis H37Rv
aggugacgccgccagcacc

SEQ ID NO: 1366221 - RNA, 23 nt, Mycobacterium tuberculosis H37Rv
aggugggauugaagcuggccacc

SEQ ID NO: 1366222 - RNA, 13 nt, Mycobacterium tuberculosis H37Rv
aggugggcacagc

SEQ ID NO: 1366223 - RNA, 15 nt, Mycobacterium tuberculosis H37Rv
aggugggcagcaggc

SEQ ID NO: 1366224 - RNA, 20 nt, Mycobacterium tuberculosis H37Rv
agguggcgcggggccgccgc

SEQ ID NO: 1366225 - RNA, 16 nt, Mycobacterium tuberculosis H37Rv
agguggcgcggggccg

SEQ ID NO: 1366226 - RNA, 17 nt, Mycobacterium tuberculosis H37Rv
aggugcgggccggugga

SEQ ID NO: 1366227 - RNA, 23 nt, Mycobacterium tuberculosis H37Rv
agguggugacacgacgugcagga

SEQ ID NO: 1366228 - RNA, 15 nt, Mycobacterium tuberculosis H37Rv
agguggggugguggu

SEQ ID NO: 1366229 - RNA, 17 nt, Mycobacterium tuberculosis H37Rv
aggugucgacgcgggcg

SEQ ID NO: 1366230 - RNA, 15 nt, Mycobacterium tuberculosis H37Rv
agguguugcgguggg

SEQ ID NO: 1366231 - RNA, 17 nt, Mycobacterium tuberculosis H37Rv
agguguuggugcggggu

SEQ ID NO: 1366232 - RNA, 18 nt, Mycobacterium tuberculosis H37Rv
aggucgacgggcacgcgg

SEQ ID NO: 1366233 - RNA, 15 nt, Mycobacterium tuberculosis H37Rv
aggucgagcgccgcg

SEQ ID NO: 1366234 - RNA, 24 nt, Mycobacterium tuberculosis H37Rv
aggucgacaccgcggugccccgga

SEQ ID NO: 1366235 - RNA, 17 nt, Mycobacterium tuberculosis H37Rv
agguccucgagguccuc

SEQ ID NO: 1366236 - RNA, 17 nt, Mycobacterium tuberculosis H37Rv
agguccgugccgaugcc

SEQ ID NO: 1366237 - RNA, 20 nt, Mycobacterium tuberculosis H37Rv
agguccgccggugccgccgu

SEQ ID NO: 1366238 - RNA, 14 nt, Mycobacterium tuberculosis H37Rv
aggucgacauaggc

SEQ ID NO: 1366239 - RNA, 19 nt, Mycobacterium tuberculosis H37Rv
agguccuugaugcgcccca

SEQ ID NO: 1366240 - RNA, 21 nt, Mycobacterium tuberculosis H37Rv
agguccuggguguagcaaguc

SEQ ID NO: 1366241 - RNA, 14 nt, Mycobacterium tuberculosis H37Rv
aggucuggcgcgga

SEQ ID NO: 1366242 - RNA, 20 nt, Mycobacterium tuberculosis H37Rv
aggugacgacgagggcggga

SEQ ID NO: 1366243 - RNA, 19 nt, Mycobacterium tuberculosis H37Rv
aggucuucaggccgcgcau

SEQ ID NO: 1366244 - RNA, 22 nt, Mycobacterium tuberculosis H37Rv
aggugaacgccggugcgcugga

SEQ ID NO: 1366245 - RNA, 11 nt, Mycobacterium tuberculosis H37Rv
aggucacccau

SEQ ID NO: 1366246 - RNA, 15 nt, Mycobacterium tuberculosis H37Rv
aggucaccggccgcc

SEQ ID NO: 1366247 - RNA, 20 nt, Mycobacterium tuberculosis H37Rv
aggucaccggucaccgcgca

SEQ ID NO: 1366248 - RNA, 24 nt, Mycobacterium tuberculosis H37Rv
aggucacacguuggcagcccucug

SEQ ID NO: 1366249 - RNA, 21 nt, Mycobacterium tuberculosis H37Rv
aggucacacguuggcagcccu

SEQ ID NO: 1366250 - RNA, 21 nt, Mycobacterium tuberculosis H37Rv
aggucaauggucuuuguccac

SEQ ID NO: 1366251 - RNA, 21 nt, Mycobacterium tuberculosis H37Rv
aggucaacgggaggugguuca

SEQ ID NO: 1366252 - RNA, 15 nt, Mycobacterium tuberculosis H37Rv
aggucagcgcugcca

SEQ ID NO: 1366253 - RNA, 16 nt, Mycobacterium tuberculosis H37Rv
aggucagcgggcuugc

SEQ ID NO: 1366254 - RNA, 19 nt, Mycobacterium tuberculosis H37Rv
aggucagccgcgcggguca

SEQ ID NO: 1366255 - RNA, 16 nt, Mycobacterium tuberculosis H37Rv
agguauuugccgugcu

SEQ ID NO: 1366256 - RNA, 15 nt, Mycobacterium tuberculosis H37Rv
agguauucccacugc

SEQ ID NO: 1366257 - RNA, 15 nt, Mycobacterium tuberculosis H37Rv
aguaaccguccgcgg

SEQ ID NO: 1366258 - RNA, 23 nt, Mycobacterium tuberculosis H37Rv
aguaacggugaugacacgcgcug

SEQ ID NO: 1366259 - RNA, 13 nt, Mycobacterium tuberculosis H37Rv
agguucgggugga

SEQ ID NO: 1366260 - RNA, 19 nt, Mycobacterium tuberculosis H37Rv
agguucuucuccaccaccg

SEQ ID NO: 1366261 - RNA, 16 nt, Mycobacterium tuberculosis H37Rv
agguucuucuccacca

SEQ ID NO: 1366262 - RNA, 16 nt, Mycobacterium tuberculosis H37Rv
agguugaacgccgcca

SEQ ID NO: 1366263 - RNA, 19 nt, Mycobacterium tuberculosis H37Rv
agguucccgcauugacgaa

SEQ ID NO: 1366264 - RNA, 13 nt, Mycobacterium tuberculosis H37Rv
agguucaaagcag

SEQ ID NO: 1366265 - RNA, 11 nt, Mycobacterium tuberculosis H37Rv
aguaccgcgcg

SEQ ID NO: 1366266 - RNA, 13 nt, Mycobacterium tuberculosis H37Rv
aguaccggccagc

SEQ ID NO: 1366267 - RNA, 13 nt, Mycobacterium tuberculosis H37Rv
aguacgugcacag

SEQ ID NO: 1366268 - RNA, 22 nt, Mycobacterium tuberculosis H37Rv
aguacgggcaggccgcugggcc

SEQ ID NO: 1366269 - RNA, 16 nt, Mycobacterium tuberculosis H37Rv
aguacgcugcggcuca

SEQ ID NO: 1366270 - RNA, 15 nt, Mycobacterium tuberculosis H37Rv
aguacacggcggccc

SEQ ID NO: 1366271 - RNA, 17 nt, Mycobacterium tuberculosis H37Rv
accagcgaggccagcgg

SEQ ID NO: 1366272 - RNA, 17 nt, Mycobacterium tuberculosis H37Rv
accagcgaguugagcau

SEQ ID NO: 1366273 - RNA, 14 nt, Mycobacterium tuberculosis H37Rv
accagcgccccggc

SEQ ID NO: 1366274 - RNA, 14 nt, Mycobacterium tuberculosis H37Rv
accagcgcccggcc

SEQ ID NO: 1366275 - RNA, 14 nt, Mycobacterium tuberculosis H37Rv
accagccggugagc

SEQ ID NO: 1366276 - RNA, 20 nt, Mycobacterium tuberculosis H37Rv
accagccucgaggguuucca

SEQ ID NO: 1366277 - RNA, 20 nt, Mycobacterium tuberculosis H37Rv
accagcgaauccagccgcgc

SEQ ID NO: 1366278 - RNA, 20 nt, Mycobacterium tuberculosis H37Rv
accagcggccgaccgcgacc

SEQ ID NO: 1366279 - RNA, 18 nt, Mycobacterium tuberculosis H37Rv
accagcguggggccgcca

SEQ ID NO: 1366280 - RNA, 21 nt, Mycobacterium tuberculosis H37Rv
accagcgccuugaccagcagc

SEQ ID NO: 1366281 - RNA, 16 nt, Mycobacterium tuberculosis H37Rv
accagcgcgagcccga

SEQ ID NO: 1366282 - RNA, 19 nt, Mycobacterium tuberculosis H37Rv
accagcgccgcacccgcuc

SEQ ID NO: 1366283 - RNA, 21 nt, Mycobacterium tuberculosis H37Rv
accagcgcgccguagaccagc

SEQ ID NO: 1366284 - RNA, 16 nt, Mycobacterium tuberculosis H37Rv
accagcgcuccagcac

SEQ ID NO: 1366285 - RNA, 18 nt, Mycobacterium tuberculosis H37Rv
accagccaccaccagguc

SEQ ID NO: 1366286 - RNA, 15 nt, Mycobacterium tuberculosis H37Rv
accagccaccaccag

SEQ ID NO: 1366287 - RNA, 18 nt, Mycobacterium tuberculosis H37Rv
accagccaaaacgagcag

SEQ ID NO: 1366288 - RNA, 20 nt, Mycobacterium tuberculosis H37Rv
accagcaucguggccgcacc

SEQ ID NO: 1366289 - RNA, 14 nt, Mycobacterium tuberculosis H37Rv
accagccagccugc

SEQ ID NO: 1366290 - RNA, 15 nt, Mycobacterium tuberculosis H37Rv
accagccccaacccu

SEQ ID NO: 1366291 - RNA, 23 nt, Mycobacterium tuberculosis H37Rv
accagccggucuuggacagcagc

SEQ ID NO: 1366292 - RNA, 13 nt, Mycobacterium tuberculosis H37Rv
accagccggugag

SEQ ID NO: 1366293 - RNA, 22 nt, Mycobacterium tuberculosis H37Rv
accagcccgaugaucccgccac

SEQ ID NO: 1366294 - RNA, 22 nt, Mycobacterium tuberculosis H37Rv
accagcccggcggcggucacca

SEQ ID NO: 1366295 - RNA, 15 nt, Mycobacterium tuberculosis H37Rv
accagccgaucauca

SEQ ID NO: 1366296 - RNA, 14 nt, Mycobacterium tuberculosis H37Rv
accagaugcaccuc

SEQ ID NO: 1366297 - RNA, 22 nt, Mycobacterium tuberculosis H37Rv
accagaugcaccucgcccugca

SEQ ID NO: 1366298 - RNA, 18 nt, Mycobacterium tuberculosis H37Rv
accagaucgacgcauucc

SEQ ID NO: 1366299 - RNA, 19 nt, Mycobacterium tuberculosis H37Rv
accagaucgacgcauuccu

SEQ ID NO: 1366300 - RNA, 20 nt, Mycobacterium tuberculosis H37Rv
accagauugccgagcccagg

SEQ ID NO: 1366301 - RNA, 17 nt, Mycobacterium tuberculosis H37Rv
accagaggucacgcagc

SEQ ID NO: 1366302 - RNA, 13 nt, Mycobacterium tuberculosis H37Rv
accagacugcagu

SEQ ID NO: 1366303 - RNA, 17 nt, Mycobacterium tuberculosis H37Rv
accagcaaccaccccag

SEQ ID NO: 1366304 - RNA, 21 nt, Mycobacterium tuberculosis H37Rv
accagcaaccaccccagggca

SEQ ID NO: 1366305 - RNA, 17 nt, Mycobacterium tuberculosis H37Rv
accagcaccgccgcgcc

SEQ ID NO: 1366306 - RNA, 20 nt, Mycobacterium tuberculosis H37Rv
accagcaccgccgcugccau

SEQ ID NO: 1366307 - RNA, 22 nt, Mycobacterium tuberculosis H37Rv
accagcaccaaaagcccgguac

SEQ ID NO: 1366308 - RNA, 14 nt, Mycobacterium tuberculosis H37Rv
accagcacggcaac

SEQ ID NO: 1366309 - RNA, 19 nt, Mycobacterium tuberculosis H37Rv
accagcagaccaagcccua

SEQ ID NO: 1366310 - RNA, 15 nt, Mycobacterium tuberculosis H37Rv
accagcagccagccc

SEQ ID NO: 1366311 - RNA, 16 nt, Mycobacterium tuberculosis H37Rv
accagcagcaccaacu

SEQ ID NO: 1366312 - RNA, 23 nt, Mycobacterium tuberculosis H37Rv
accaacucucgcgggauggacag

SEQ ID NO: 1366313 - RNA, 17 nt, Mycobacterium tuberculosis H37Rv
accaacucggcgaccug

SEQ ID NO: 1366314 - RNA, 17 nt, Mycobacterium tuberculosis H37Rv
accaacccaccccccag

SEQ ID NO: 1366315 - RNA, 19 nt, Mycobacterium tuberculosis H37Rv
accagacgaacgaccaggc

SEQ ID NO: 1366316 - RNA, 12 nt, Mycobacterium tuberculosis H37Rv
accagggccacc

SEQ ID NO: 1366317 - RNA, 22 nt, Mycobacterium tuberculosis H37Rv
accagguacgggagcccgagcu

SEQ ID NO: 1366318 - RNA, 15 nt, Mycobacterium tuberculosis H37Rv
accagguacgggagc

SEQ ID NO: 1366319 - RNA, 12 nt, Mycobacterium tuberculosis H37Rv
accagggccucg

SEQ ID NO: 1366320 - RNA, 21 nt, Mycobacterium tuberculosis H37Rv
accagggccuccacccgccac

SEQ ID NO: 1366321 - RNA, 17 nt, Mycobacterium tuberculosis H37Rv
accagggccgccgcugc

SEQ ID NO: 1366322 - RNA, 18 nt, Mycobacterium tuberculosis H37Rv
accagggacgaugcccuc

SEQ ID NO: 1366323 - RNA, 16 nt, Mycobacterium tuberculosis H37Rv
accagggcagcggcca

SEQ ID NO: 1366324 - RNA, 16 nt, Mycobacterium tuberculosis H37Rv
accaggcggucagguc

SEQ ID NO: 1366325 - RNA, 22 nt, Mycobacterium tuberculosis H37Rv
accagguggaccggccuggcuc

SEQ ID NO: 1366326 - RNA, 15 nt, Mycobacterium tuberculosis H37Rv
accagguggccaggc

SEQ ID NO: 1366327 - RNA, 15 nt, Mycobacterium tuberculosis H37Rv
accagguugccgagg

SEQ ID NO: 1366328 - RNA, 17 nt, Mycobacterium tuberculosis H37Rv
accaggucggucagguc

SEQ ID NO: 1366329 - RNA, 15 nt, Mycobacterium tuberculosis H37Rv
accagcucagcugcg

SEQ ID NO: 1366330 - RNA, 17 nt, Mycobacterium tuberculosis H37Rv
accagcucagcugcgga

SEQ ID NO: 1366331 - RNA, 20 nt, Mycobacterium tuberculosis H37Rv
accagcuguccucgcgggcu

SEQ ID NO: 1366332 - RNA, 13 nt, Mycobacterium tuberculosis H37Rv
accaggcccgguu

SEQ ID NO: 1366333 - RNA, 16 nt, Mycobacterium tuberculosis H37Rv
accaggccgaaaucca

SEQ ID NO: 1366334 - RNA, 17 nt, Mycobacterium tuberculosis H37Rv
accaggccgagccgccc

SEQ ID NO: 1366335 - RNA, 13 nt, Mycobacterium tuberculosis H37Rv
accaggccggccc

SEQ ID NO: 1366336 - RNA, 14 nt, Mycobacterium tuberculosis H37Rv
accaggccggugac

SEQ ID NO: 1366337 - RNA, 18 nt, Mycobacterium tuberculosis H37Rv
accaggagccuccagcgc

SEQ ID NO: 1366338 - RNA, 18 nt, Mycobacterium tuberculosis H37Rv
accaggacguggucggga

SEQ ID NO: 1366339 - RNA, 21 nt, Mycobacterium tuberculosis H37Rv
accaggaaugucuccaguagc

SEQ ID NO: 1366340 - RNA, 15 nt, Mycobacterium tuberculosis H37Rv
accaggaagcaggug

SEQ ID NO: 1366341 - RNA, 15 nt, Mycobacterium tuberculosis H37Rv
accaucgccaggccc

SEQ ID NO: 1366342 - RNA, 21 nt, Mycobacterium tuberculosis H37Rv
accaguccucgggcaggcggc

SEQ ID NO: 1366343 - RNA, 15 nt, Mycobacterium tuberculosis H37Rv
accagucgacccagc

SEQ ID NO: 1366344 - RNA, 11 nt, Mycobacterium tuberculosis H37Rv
accagugcccc

SEQ ID NO: 1366345 - RNA, 13 nt, Mycobacterium tuberculosis H37Rv
accaguccagcgg

SEQ ID NO: 1366346 - RNA, 20 nt, Mycobacterium tuberculosis H37Rv
accaguguggcgaugaccac

SEQ ID NO: 1366347 - RNA, 18 nt, Mycobacterium tuberculosis H37Rv
acccgucacaagcugaca

SEQ ID NO: 1366348 - RNA, 14 nt, Mycobacterium tuberculosis H37Rv
acccgucaccgccg

SEQ ID NO: 1366349 - RNA, 22 nt, Mycobacterium tuberculosis H37Rv
acccgguguugagcgaacccgc

SEQ ID NO: 1366350 - RNA, 14 nt, Mycobacterium tuberculosis H37Rv
acccgguugugcgc

SEQ ID NO: 1366351 - RNA, 18 nt, Mycobacterium tuberculosis H37Rv
acccggucggccauccac

SEQ ID NO: 1366352 - RNA, 20 nt, Mycobacterium tuberculosis H37Rv
acccgguccggcccggggac

SEQ ID NO: 1366353 - RNA, 16 nt, Mycobacterium tuberculosis H37Rv
acccggucgacggguc

SEQ ID NO: 1366354 - RNA, 14 nt, Mycobacterium tuberculosis H37Rv
acccggucgccggg

SEQ ID NO: 1366355 - RNA, 20 nt, Mycobacterium tuberculosis H37Rv
acccggugauggugugcagc

SEQ ID NO: 1366356 - RNA, 17 nt, Mycobacterium tuberculosis H37Rv
acccggugagaagaagc

SEQ ID NO: 1366357 - RNA, 18 nt, Mycobacterium tuberculosis H37Rv
acccggugagaagaagcc

SEQ ID NO: 1366358 - RNA, 15 nt, Mycobacterium tuberculosis H37Rv
acccgcccacggcac

SEQ ID NO: 1366359 - RNA, 15 nt, Mycobacterium tuberculosis H37Rv
acccgcagcugcgga

SEQ ID NO: 1366360 - RNA, 14 nt, Mycobacterium tuberculosis H37Rv
acccgcagcugugg

SEQ ID NO: 1366361 - RNA, 17 nt, Mycobacterium tuberculosis H37Rv
acccgcagcuguggccc

SEQ ID NO: 1366362 - RNA, 22 nt, Mycobacterium tuberculosis H37Rv
acccgguaccucaacaccaggc

SEQ ID NO: 1366363 - RNA, 21 nt, Mycobacterium tuberculosis H37Rv
acccgccggcgacugcagcga

SEQ ID NO: 1366364 - RNA, 22 nt, Mycobacterium tuberculosis H37Rv
acccggucaaagaugucgcugg

SEQ ID NO: 1366365 - RNA, 14 nt, Mycobacterium tuberculosis H37Rv
acccgggucggcac

SEQ ID NO: 1366366 - RNA, 16 nt, Mycobacterium tuberculosis H37Rv
acccggggugcccggc

SEQ ID NO: 1366367 - RNA, 17 nt, Mycobacterium tuberculosis H37Rv
acccggggugcccggcc

SEQ ID NO: 1366368 - RNA, 20 nt, Mycobacterium tuberculosis H37Rv
acccgcccaggcguccauca

SEQ ID NO: 1366369 - RNA, 17 nt, Mycobacterium tuberculosis H37Rv
acccgcccuugccgccg

SEQ ID NO: 1366370 - RNA, 21 nt, Mycobacterium tuberculosis H37Rv
acccgcauaccguucacccag

SEQ ID NO: 1366371 - RNA, 13 nt, Mycobacterium tuberculosis H37Rv
acccgccgcccca

SEQ ID NO: 1366372 - RNA, 18 nt, Mycobacterium tuberculosis H37Rv
acccgccgcgcccggcgc

SEQ ID NO: 1366373 - RNA, 21 nt, Mycobacterium tuberculosis H37Rv
acccuucgggcuggucgguca

SEQ ID NO: 1366374 - RNA, 19 nt, Mycobacterium tuberculosis H37Rv
acccugcgccgccacagca

SEQ ID NO: 1366375 - RNA, 15 nt, Mycobacterium tuberculosis H37Rv
acccugcggugcagg

SEQ ID NO: 1366376 - RNA, 17 nt, Mycobacterium tuberculosis H37Rv
acccuggcggaacagcu

SEQ ID NO: 1366377 - RNA, 11 nt, Mycobacterium tuberculosis H37Rv
acccugcugcg

SEQ ID NO: 1366378 - RNA, 20 nt, Mycobacterium tuberculosis H37Rv
acccucagccgcgccggguc

SEQ ID NO: 1366379 - RNA, 14 nt, Mycobacterium tuberculosis H37Rv
accgacaccaccag

SEQ ID NO: 1366380 - RNA, 17 nt, Mycobacterium tuberculosis H37Rv
accgaauggccgccgca

SEQ ID NO: 1366381 - RNA, 16 nt, Mycobacterium tuberculosis H37Rv
accgaauuacgcaccg

SEQ ID NO: 1366382 - RNA, 18 nt, Mycobacterium tuberculosis H37Rv
accgaagcgaacggcaca

SEQ ID NO: 1366383 - RNA, 12 nt, Mycobacterium tuberculosis H37Rv
accgaagaagcc

SEQ ID NO: 1366384 - RNA, 14 nt, Mycobacterium tuberculosis H37Rv
accgaagccgccgg

SEQ ID NO: 1366385 - RNA, 16 nt, Mycobacterium tuberculosis H37Rv
accgaacgcggccacc

SEQ ID NO: 1366386 - RNA, 20 nt, Mycobacterium tuberculosis H37Rv
accgaacagucgcagccagg

SEQ ID NO: 1366387 - RNA, 14 nt, Mycobacterium tuberculosis H37Rv
accgaaccuggucu

SEQ ID NO: 1366388 - RNA, 15 nt, Mycobacterium tuberculosis H37Rv
accgaccagccgugg

SEQ ID NO: 1366389 - RNA, 18 nt, Mycobacterium tuberculosis H37Rv
accgacccgcugccaccc

SEQ ID NO: 1366390 - RNA, 16 nt, Mycobacterium tuberculosis H37Rv
accgaccgggccgcac

SEQ ID NO: 1366391 - RNA, 21 nt, Mycobacterium tuberculosis H37Rv
accgaccuaccgucgaccacu

SEQ ID NO: 1366392 - RNA, 15 nt, Mycobacterium tuberculosis H37Rv
accgacagcacccgg

SEQ ID NO: 1366393 - RNA, 19 nt, Mycobacterium tuberculosis H37Rv
accgacaucgucauccagg

SEQ ID NO: 1366394 - RNA, 20 nt, Mycobacterium tuberculosis H37Rv
accgacggccagcaagacga

SEQ ID NO: 1366395 - RNA, 13 nt, Mycobacterium tuberculosis H37Rv
accgaguaccgau

SEQ ID NO: 1366396 - RNA, 19 nt, Mycobacterium tuberculosis H37Rv
accgaguagaacuucgcca

SEQ ID NO: 1366397 - RNA, 17 nt, Mycobacterium tuberculosis H37Rv
accgagucgacggccag

SEQ ID NO: 1366398 - RNA, 14 nt, Mycobacterium tuberculosis H37Rv
accgaugcugacga

SEQ ID NO: 1366399 - RNA, 16 nt, Mycobacterium tuberculosis H37Rv
accgaugccuugaccg

SEQ ID NO: 1366400 - RNA, 19 nt, Mycobacterium tuberculosis H37Rv
accgaggccugacugaauu

SEQ ID NO: 1366401 - RNA, 23 nt, Mycobacterium tuberculosis H37Rv
accgaggucggccagcagcagug

SEQ ID NO: 1366402 - RNA, 22 nt, Mycobacterium tuberculosis H37Rv
accgacugcugucaccgcaacc

SEQ ID NO: 1366403 - RNA, 18 nt, Mycobacterium tuberculosis H37Rv
accccgucagcgggcagc

SEQ ID NO: 1366404 - RNA, 13 nt, Mycobacterium tuberculosis H37Rv
accccgguggaca

SEQ ID NO: 1366405 - RNA, 23 nt, Mycobacterium tuberculosis H37Rv
accccgucagcgggcagcaggcg

SEQ ID NO: 1366406 - RNA, 16 nt, Mycobacterium tuberculosis H37Rv
acccgacaacgcuggg

SEQ ID NO: 1366407 - RNA, 20 nt, Mycobacterium tuberculosis H37Rv
acccgacaucggccagcgca

SEQ ID NO: 1366408 - RNA, 18 nt, Mycobacterium tuberculosis H37Rv
acccgacaacgcugggcg

SEQ ID NO: 1366409 - RNA, 13 nt, Mycobacterium tuberculosis H37Rv
acccgaccagcac

SEQ ID NO: 1366410 - RNA, 17 nt, Mycobacterium tuberculosis H37Rv
acccgauuggccaaccc

SEQ ID NO: 1366411 - RNA, 16 nt, Mycobacterium tuberculosis H37Rv
acccgaugacccacug

SEQ ID NO: 1366412 - RNA, 19 nt, Mycobacterium tuberculosis H37Rv
acccgaucagguacgccag

SEQ ID NO: 1366413 - RNA, 15 nt, Mycobacterium tuberculosis H37Rv
acccgaucagguacg

SEQ ID NO: 1366414 - RNA, 21 nt, Mycobacterium tuberculosis H37Rv
acccgauaucaauggcagcug

SEQ ID NO: 1366415 - RNA, 15 nt, Mycobacterium tuberculosis H37Rv
acccgcaccccggcc

SEQ ID NO: 1366416 - RNA, 14 nt, Mycobacterium tuberculosis H37Rv
acccgcacggccuc

SEQ ID NO: 1366417 - RNA, 13 nt, Mycobacterium tuberculosis H37Rv
acccgcagcugcg

SEQ ID NO: 1366418 - RNA, 11 nt, Mycobacterium tuberculosis H37Rv
acccgcagacc

SEQ ID NO: 1366419 - RNA, 13 nt, Mycobacterium tuberculosis H37Rv
acccgcaaugcgc

SEQ ID NO: 1366420 - RNA, 14 nt, Mycobacterium tuberculosis H37Rv
acccgcaaugaccg

SEQ ID NO: 1366421 - RNA, 17 nt, Mycobacterium tuberculosis H37Rv
accccaaguccagcagc

SEQ ID NO: 1366422 - RNA, 18 nt, Mycobacterium tuberculosis H37Rv
accccaaucgaccgcccg

SEQ ID NO: 1366423 - RNA, 20 nt, Mycobacterium tuberculosis H37Rv
accccaaucgaccgcccgcc

SEQ ID NO: 1366424 - RNA, 22 nt, Mycobacterium tuberculosis H37Rv
acccccggcauuccguaggcca

SEQ ID NO: 1366425 - RNA, 22 nt, Mycobacterium tuberculosis H37Rv
acccccggccagcgucaacagc

SEQ ID NO: 1366426 - RNA, 16 nt, Mycobacterium tuberculosis H37Rv
acccccgacaccgccg

SEQ ID NO: 1366427 - RNA, 18 nt, Mycobacterium tuberculosis H37Rv
acccccgauggcgucgcc

SEQ ID NO: 1366428 - RNA, 22 nt, Mycobacterium tuberculosis H37Rv
acccauuggaccgagacuugcu

SEQ ID NO: 1366429 - RNA, 15 nt, Mycobacterium tuberculosis H37Rv
accccguaggugcac

SEQ ID NO: 1366430 - RNA, 23 nt, Mycobacterium tuberculosis H37Rv
accccgguucgacgucugcccag

SEQ ID NO: 1366431 - RNA, 16 nt, Mycobacterium tuberculosis H37Rv
accccggcgguaccgc

SEQ ID NO: 1366432 - RNA, 18 nt, Mycobacterium tuberculosis H37Rv
accccggcgguaccgccg

SEQ ID NO: 1366433 - RNA, 12 nt, Mycobacterium tuberculosis H37Rv
accccggcucga

SEQ ID NO: 1366434 - RNA, 18 nt, Mycobacterium tuberculosis H37Rv
accccggccuugccaccg

SEQ ID NO: 1366435 - RNA, 18 nt, Mycobacterium tuberculosis H37Rv
accccgagaccaacgcgc

SEQ ID NO: 1366436 - RNA, 19 nt, Mycobacterium tuberculosis H37Rv
accccgagcggagccgccg

SEQ ID NO: 1366437 - RNA, 15 nt, Mycobacterium tuberculosis H37Rv
accccgaagaugccu

SEQ ID NO: 1366438 - RNA, 14 nt, Mycobacterium tuberculosis H37Rv
accccgaccaccag

SEQ ID NO: 1366439 - RNA, 12 nt, Mycobacterium tuberculosis H37Rv
accccgagcugc

SEQ ID NO: 1366440 - RNA, 19 nt, Mycobacterium tuberculosis H37Rv
accccgaggcaacaagcac

SEQ ID NO: 1366441 - RNA, 23 nt, Mycobacterium tuberculosis H37Rv
accccgaucuggcguagugcucg

SEQ ID NO: 1366442 - RNA, 19 nt, Mycobacterium tuberculosis H37Rv
accccgaagaccuggccug

SEQ ID NO: 1366443 - RNA, 13 nt, Mycobacterium tuberculosis H37Rv
acccacugcaggc

SEQ ID NO: 1366444 - RNA, 15 nt, Mycobacterium tuberculosis H37Rv
acccagaaugacauc

SEQ ID NO: 1366445 - RNA, 13 nt, Mycobacterium tuberculosis H37Rv
acccagcaccaca

SEQ ID NO: 1366446 - RNA, 15 nt, Mycobacterium tuberculosis H37Rv
acccagaugcaggcu

SEQ ID NO: 1366447 - RNA, 20 nt, Mycobacterium tuberculosis H37Rv
accaucugaucgggcccguc

SEQ ID NO: 1366448 - RNA, 16 nt, Mycobacterium tuberculosis H37Rv
acccacgagagcgcug

SEQ ID NO: 1366449 - RNA, 12 nt, Mycobacterium tuberculosis H37Rv
accaugaagaac

SEQ ID NO: 1366450 - RNA, 20 nt, Mycobacterium tuberculosis H37Rv
accaugaagaacuggcugcu

SEQ ID NO: 1366451 - RNA, 21 nt, Mycobacterium tuberculosis H37Rv
acccagcgugcccgccaccgg

SEQ ID NO: 1366452 - RNA, 18 nt, Mycobacterium tuberculosis H37Rv
acccagcgugcccgccac

SEQ ID NO: 1366453 - RNA, 22 nt, Mycobacterium tuberculosis H37Rv
acccagcucgcgcacccagccc

SEQ ID NO: 1366454 - RNA, 15 nt, Mycobacterium tuberculosis H37Rv
acccagcgcccggcc

SEQ ID NO: 1366455 - RNA, 19 nt, Mycobacterium tuberculosis H37Rv
acccagcgcgcugggaagc

SEQ ID NO: 1366456 - RNA, 22 nt, Mycobacterium tuberculosis H37Rv
acccagcgguaucccccagccg

SEQ ID NO: 1366457 - RNA, 14 nt, Mycobacterium tuberculosis H37Rv
acccagcggcgcca

SEQ ID NO: 1366458 - RNA, 19 nt, Mycobacterium tuberculosis H37Rv
acccagcgcagcagcggca

SEQ ID NO: 1366459 - RNA, 14 nt, Mycobacterium tuberculosis H37Rv
acccagccggaacc

SEQ ID NO: 1366460 - RNA, 17 nt, Mycobacterium tuberculosis H37Rv
acccagcccagccguuc

SEQ ID NO: 1366461 - RNA, 14 nt, Mycobacterium tuberculosis H37Rv
acccagcccagccg

SEQ ID NO: 1366462 - RNA, 17 nt, Mycobacterium tuberculosis H37Rv
acccagcaccagggcgc

SEQ ID NO: 1366463 - RNA, 15 nt, Mycobacterium tuberculosis H37Rv
acccagcacgcgcgc

SEQ ID NO: 1366464 - RNA, 20 nt, Mycobacterium tuberculosis H37Rv
acccagggcguuggcggcuu

SEQ ID NO: 1366465 - RNA, 16 nt, Mycobacterium tuberculosis H37Rv
acccagugccacgccu

SEQ ID NO: 1366466 - RNA, 17 nt, Mycobacterium tuberculosis H37Rv
acccagugucagcaaga

SEQ ID NO: 1366467 - RNA, 22 nt, Mycobacterium tuberculosis H37Rv
acccaguuccacccggugccgc

SEQ ID NO: 1366468 - RNA, 21 nt, Mycobacterium tuberculosis H37Rv
accggcuucgucggccagcag

SEQ ID NO: 1366469 - RNA, 16 nt, Mycobacterium tuberculosis H37Rv
accggcuucuccucca

SEQ ID NO: 1366470 - RNA, 20 nt, Mycobacterium tuberculosis H37Rv
accggcuugcccuccgggua

SEQ ID NO: 1366471 - RNA, 12 nt, Mycobacterium tuberculosis H37Rv
accggcuugccg

SEQ ID NO: 1366472 - RNA, 15 nt, Mycobacterium tuberculosis H37Rv
accggcuuggcggga

SEQ ID NO: 1366473 - RNA, 19 nt, Mycobacterium tuberculosis H37Rv
accgggaaccacggucagc

SEQ ID NO: 1366474 - RNA, 14 nt, Mycobacterium tuberculosis H37Rv
accgggacaaucuc

SEQ ID NO: 1366475 - RNA, 18 nt, Mycobacterium tuberculosis H37Rv
accgggacaccaaaagga

SEQ ID NO: 1366476 - RNA, 21 nt, Mycobacterium tuberculosis H37Rv
accggcaugcgugccggcagc

SEQ ID NO: 1366477 - RNA, 13 nt, Mycobacterium tuberculosis H37Rv
accggcagcugcu

SEQ ID NO: 1366478 - RNA, 14 nt, Mycobacterium tuberculosis H37Rv
accggcagcugcuc

SEQ ID NO: 1366479 - RNA, 14 nt, Mycobacterium tuberculosis H37Rv
accgguacaacccc

SEQ ID NO: 1366480 - RNA, 13 nt, Mycobacterium tuberculosis H37Rv
accgguaccggcg

SEQ ID NO: 1366481 - RNA, 17 nt, Mycobacterium tuberculosis H37Rv
accggucaaacgcgcgc

SEQ ID NO: 1366482 - RNA, 14 nt, Mycobacterium tuberculosis H37Rv
accgguauguucgg

SEQ ID NO: 1366483 - RNA, 15 nt, Mycobacterium tuberculosis H37Rv
accgggcaaaucaag

SEQ ID NO: 1366484 - RNA, 18 nt, Mycobacterium tuberculosis H37Rv
accgggcaaaucaagcac

SEQ ID NO: 1366485 - RNA, 16 nt, Mycobacterium tuberculosis H37Rv
accgggugggucguuc

SEQ ID NO: 1366486 - RNA, 19 nt, Mycobacterium tuberculosis H37Rv
accgguuuucgccggcucc

SEQ ID NO: 1366487 - RNA, 19 nt, Mycobacterium tuberculosis H37Rv
accggucagccggaccacc

SEQ ID NO: 1366488 - RNA, 16 nt, Mycobacterium tuberculosis H37Rv
accguagugaacggcu

SEQ ID NO: 1366489 - RNA, 14 nt, Mycobacterium tuberculosis H37Rv
accguacggccacg

SEQ ID NO: 1366490 - RNA, 15 nt, Mycobacterium tuberculosis H37Rv
accguagccagcagg

SEQ ID NO: 1366491 - RNA, 15 nt, Mycobacterium tuberculosis H37Rv
accgucacgccaccg

SEQ ID NO: 1366492 - RNA, 18 nt, Mycobacterium tuberculosis H37Rv
accgcugaccgcaacgcg

SEQ ID NO: 1366493 - RNA, 16 nt, Mycobacterium tuberculosis H37Rv
accgcuucccccgguc

SEQ ID NO: 1366494 - RNA, 13 nt, Mycobacterium tuberculosis H37Rv
accgcuucccccg

SEQ ID NO: 1366495 - RNA, 11 nt, Mycobacterium tuberculosis H37Rv
accggaccugg

SEQ ID NO: 1366496 - RNA, 19 nt, Mycobacterium tuberculosis H37Rv
accggcacccgcuggcggu

SEQ ID NO: 1366497 - RNA, 18 nt, Mycobacterium tuberculosis H37Rv
accggcaccgccugcgcc

SEQ ID NO: 1366498 - RNA, 15 nt, Mycobacterium tuberculosis H37Rv
accggcaccagcggc

SEQ ID NO: 1366499 - RNA, 16 nt, Mycobacterium tuberculosis H37Rv
accggaaaugucuccu

SEQ ID NO: 1366500 - RNA, 22 nt, Mycobacterium tuberculosis H37Rv
accggaauccgggccgccgccc

SEQ ID NO: 1366501 - RNA, 18 nt, Mycobacterium tuberculosis H37Rv
accgcaaaggagaagaca

SEQ ID NO: 1366502 - RNA, 17 nt, Mycobacterium tuberculosis H37Rv
accgcguagagcagcag

SEQ ID NO: 1366503 - RNA, 17 nt, Mycobacterium tuberculosis H37Rv
accgcgucgggccgcaa

SEQ ID NO: 1366504 - RNA, 14 nt, Mycobacterium tuberculosis H37Rv
accgcgugcaccga

SEQ ID NO: 1366505 - RNA, 20 nt, Mycobacterium tuberculosis H37Rv
accgauucgggcuucuccau

SEQ ID NO: 1366506 - RNA, 19 nt, Mycobacterium tuberculosis H37Rv
accgauucgggcuucucca

SEQ ID NO: 1366507 - RNA, 14 nt, Mycobacterium tuberculosis H37Rv
accgauuccagcgg

SEQ ID NO: 1366508 - RNA, 19 nt, Mycobacterium tuberculosis H37Rv
accgauggcucacaugccc

SEQ ID NO: 1366509 - RNA, 18 nt, Mycobacterium tuberculosis H37Rv
accgcucagggugcgccg

SEQ ID NO: 1366510 - RNA, 20 nt, Mycobacterium tuberculosis H37Rv
accgcucggaguugagcugu

SEQ ID NO: 1366511 - RNA, 16 nt, Mycobacterium tuberculosis H37Rv
accgcucgucgccggu

SEQ ID NO: 1366512 - RNA, 24 nt, Mycobacterium tuberculosis H37Rv
accgcucgucguccggccacgguc

SEQ ID NO: 1366513 - RNA, 18 nt, Mycobacterium tuberculosis H37Rv
accgcgugcgccggggac

SEQ ID NO: 1366514 - RNA, 13 nt, Mycobacterium tuberculosis H37Rv
accgcgugcgccg

SEQ ID NO: 1366515 - RNA, 20 nt, Mycobacterium tuberculosis H37Rv
accgcuacccgcgcgaccug

SEQ ID NO: 1366516 - RNA, 22 nt, Mycobacterium tuberculosis H37Rv
accguggugagcuggucggcga

SEQ ID NO: 1366517 - RNA, 12 nt, Mycobacterium tuberculosis H37Rv
accgugguucgg

SEQ ID NO: 1366518 - RNA, 16 nt, Mycobacterium tuberculosis H37Rv
accguguugcugucga

SEQ ID NO: 1366519 - RNA, 14 nt, Mycobacterium tuberculosis H37Rv
accguggucggagg

SEQ ID NO: 1366520 - RNA, 19 nt, Mycobacterium tuberculosis H37Rv
accguggccucgaagggcu

SEQ ID NO: 1366521 - RNA, 14 nt, Mycobacterium tuberculosis H37Rv
accguggcggccuc

SEQ ID NO: 1366522 - RNA, 20 nt, Mycobacterium tuberculosis H37Rv
accgugucacgcgaccaccg

SEQ ID NO: 1366523 - RNA, 23 nt, Mycobacterium tuberculosis H37Rv
accguggcggggaaaccggccag

SEQ ID NO: 1366524 - RNA, 17 nt, Mycobacterium tuberculosis H37Rv
accguggccgcagggcc

SEQ ID NO: 1366525 - RNA, 14 nt, Mycobacterium tuberculosis H37Rv
accgugcugggcau

SEQ ID NO: 1366526 - RNA, 16 nt, Mycobacterium tuberculosis H37Rv
accguucacccagcgg

SEQ ID NO: 1366527 - RNA, 19 nt, Mycobacterium tuberculosis H37Rv
accguuguaccccagcauc

SEQ ID NO: 1366528 - RNA, 21 nt, Mycobacterium tuberculosis H37Rv
accguugcgaagaagaaggcg

SEQ ID NO: 1366529 - RNA, 14 nt, Mycobacterium tuberculosis H37Rv
accgugcaccucca

SEQ ID NO: 1366530 - RNA, 22 nt, Mycobacterium tuberculosis H37Rv
accgugaccgagaagcccaccg

SEQ ID NO: 1366531 - RNA, 13 nt, Mycobacterium tuberculosis H37Rv
accgugaccgccg

SEQ ID NO: 1366532 - RNA, 15 nt, Mycobacterium tuberculosis H37Rv
accgugaaccgcccg

SEQ ID NO: 1366533 - RNA, 16 nt, Mycobacterium tuberculosis H37Rv
accgugaaccgcccgc

SEQ ID NO: 1366534 - RNA, 15 nt, Mycobacterium tuberculosis H37Rv
accgucgcuaaagcu

SEQ ID NO: 1366535 - RNA, 14 nt, Mycobacterium tuberculosis H37Rv
accgucguccagac

SEQ ID NO: 1366536 - RNA, 24 nt, Mycobacterium tuberculosis H37Rv
accgucagcgcgaccgucaggguc

SEQ ID NO: 1366537 - RNA, 19 nt, Mycobacterium tuberculosis H37Rv
accgucagcgccgcugacu

SEQ ID NO: 1366538 - RNA, 15 nt, Mycobacterium tuberculosis H37Rv
accguccaauuggcg

SEQ ID NO: 1366539 - RNA, 23 nt, Mycobacterium tuberculosis H37Rv
accgucaugaaaucgaugaccgc

SEQ ID NO: 1366540 - RNA, 22 nt, Mycobacterium tuberculosis H37Rv
accguccacgacagcagagugg

SEQ ID NO: 1366541 - RNA, 23 nt, Mycobacterium tuberculosis H37Rv
accucaacaccaggccguccucg

SEQ ID NO: 1366542 - RNA, 13 nt, Mycobacterium tuberculosis H37Rv
accuacccugcgc

SEQ ID NO: 1366543 - RNA, 22 nt, Mycobacterium tuberculosis H37Rv
accuacgaagcguugaccgcgg

SEQ ID NO: 1366544 - RNA, 16 nt, Mycobacterium tuberculosis H37Rv
accguuucgaucucga

SEQ ID NO: 1366545 - RNA, 19 nt, Mycobacterium tuberculosis H37Rv
accguuucgaucucgagca

SEQ ID NO: 1366546 - RNA, 16 nt, Mycobacterium tuberculosis H37Rv
accugccggaccgcgg

SEQ ID NO: 1366547 - RNA, 17 nt, Mycobacterium tuberculosis H37Rv
accugcugagccgucgg

SEQ ID NO: 1366548 - RNA, 21 nt, Mycobacterium tuberculosis H37Rv
accuggccgcccgcugcggcg

SEQ ID NO: 1366549 - RNA, 15 nt, Mycobacterium tuberculosis H37Rv
accuggaucagggcu

SEQ ID NO: 1366550 - RNA, 16 nt, Mycobacterium tuberculosis H37Rv
accuggaucagggcuu

SEQ ID NO: 1366551 - RNA, 16 nt, Mycobacterium tuberculosis H37Rv
accuccagcaccaccg

SEQ ID NO: 1366552 - RNA, 18 nt, Mycobacterium tuberculosis H37Rv
accucccacccccgguuc

SEQ ID NO: 1366553 - RNA, 17 nt, Mycobacterium tuberculosis H37Rv
accucccacgccgccgu

SEQ ID NO: 1366554 - RNA, 17 nt, Mycobacterium tuberculosis H37Rv
accugcaugggcagcug

SEQ ID NO: 1366555 - RNA, 23 nt, Mycobacterium tuberculosis H37Rv
accugccgacucaucggccgcgg

SEQ ID NO: 1366556 - RNA, 21 nt, Mycobacterium tuberculosis H37Rv
accugguugcugacgacuggg

SEQ ID NO: 1366557 - RNA, 19 nt, Mycobacterium tuberculosis H37Rv
accugucaacauuucugag

SEQ ID NO: 1366558 - RNA, 23 nt, Mycobacterium tuberculosis H37Rv
accuguaguucgaugacugaauc

SEQ ID NO: 1366559 - RNA, 18 nt, Mycobacterium tuberculosis H37Rv
accuucugguccagcacc

SEQ ID NO: 1366560 - RNA, 14 nt, Mycobacterium tuberculosis H37Rv
accuuggccgugcc

SEQ ID NO: 1366561 - RNA, 17 nt, Mycobacterium tuberculosis H37Rv
accuuggcgaccaugcu

SEQ ID NO: 1366562 - RNA, 18 nt, Mycobacterium tuberculosis H37Rv
accuuguggacccgccag

SEQ ID NO: 1366563 - RNA, 17 nt, Mycobacterium tuberculosis H37Rv
acgagcggccgcgcgca

SEQ ID NO: 1366564 - RNA, 22 nt, Mycobacterium tuberculosis H37Rv
acgagccgguggcgugggcacu

SEQ ID NO: 1366565 - RNA, 22 nt, Mycobacterium tuberculosis H37Rv
acgagccguccaauuccgcaga

SEQ ID NO: 1366566 - RNA, 13 nt, Mycobacterium tuberculosis H37Rv
acgagcaccaucc

SEQ ID NO: 1366567 - RNA, 14 nt, Mycobacterium tuberculosis H37Rv
acgagcagcaaucc

SEQ ID NO: 1366568 - RNA, 13 nt, Mycobacterium tuberculosis H37Rv
acgacucccccgg

SEQ ID NO: 1366569 - RNA, 16 nt, Mycobacterium tuberculosis H37Rv
acgacucccccggcuc

SEQ ID NO: 1366570 - RNA, 23 nt, Mycobacterium tuberculosis H37Rv
acgacugcggcaaacgugaucag

SEQ ID NO: 1366571 - RNA, 19 nt, Mycobacterium tuberculosis H37Rv
acgaguuaccgguggugcg

SEQ ID NO: 1366572 - RNA, 16 nt, Mycobacterium tuberculosis H37Rv
acgacggguccgggcc

SEQ ID NO: 1366573 - RNA, 14 nt, Mycobacterium tuberculosis H37Rv
acgacgucaucguc

SEQ ID NO: 1366574 - RNA, 20 nt, Mycobacterium tuberculosis H37Rv
acgacgacaccgcgcagcgg

SEQ ID NO: 1366575 - RNA, 18 nt, Mycobacterium tuberculosis H37Rv
acgacgacaaccggccag

SEQ ID NO: 1366576 - RNA, 16 nt, Mycobacterium tuberculosis H37Rv
acgacgggaaccagcg

SEQ ID NO: 1366577 - RNA, 18 nt, Mycobacterium tuberculosis H37Rv
acgaccgucggcuccagg

SEQ ID NO: 1366578 - RNA, 15 nt, Mycobacterium tuberculosis H37Rv
acgaccgccugcaac

SEQ ID NO: 1366579 - RNA, 19 nt, Mycobacterium tuberculosis H37Rv
acgaccugcucauccaccu

SEQ ID NO: 1366580 - RNA, 13 nt, Mycobacterium tuberculosis H37Rv
acgaccagcagau

SEQ ID NO: 1366581 - RNA, 23 nt, Mycobacterium tuberculosis H37Rv
acgacccuggccuuugagcgcgg

SEQ ID NO: 1366582 - RNA, 14 nt, Mycobacterium tuberculosis H37Rv
acgacccgggaagg

SEQ ID NO: 1366583 - RNA, 18 nt, Mycobacterium tuberculosis H37Rv
acgacccgggaaggaacc

SEQ ID NO: 1366584 - RNA, 22 nt, Mycobacterium tuberculosis H37Rv
acgacccgggaaggaaccgggc

SEQ ID NO: 1366585 - RNA, 13 nt, Mycobacterium tuberculosis H37Rv
acgaaaggcgcgu

SEQ ID NO: 1366586 - RNA, 23 nt, Mycobacterium tuberculosis H37Rv
acgacaucgagccaacgcgcaga

SEQ ID NO: 1366587 - RNA, 19 nt, Mycobacterium tuberculosis H37Rv
acgacaugagcgccacgcc

SEQ ID NO: 1366588 - RNA, 18 nt, Mycobacterium tuberculosis H37Rv
acgacaugggcaggccgc

SEQ ID NO: 1366589 - RNA, 22 nt, Mycobacterium tuberculosis H37Rv
acgacauacgagcagugaccgc

SEQ ID NO: 1366590 - RNA, 20 nt, Mycobacterium tuberculosis H37Rv
acgacagucgcagucgcuaa

SEQ ID NO: 1366591 - RNA, 13 nt, Mycobacterium tuberculosis H37Rv
acgaccaccacca

SEQ ID NO: 1366592 - RNA, 14 nt, Mycobacterium tuberculosis H37Rv
acgacaacagccag

SEQ ID NO: 1366593 - RNA, 18 nt, Mycobacterium tuberculosis H37Rv
acgccggggaaccuugac

SEQ ID NO: 1366594 - RNA, 18 nt, Mycobacterium tuberculosis H37Rv
acgccgucggcgcgcacc

SEQ ID NO: 1366595 - RNA, 15 nt, Mycobacterium tuberculosis H37Rv
acgccgcgccgcaga

SEQ ID NO: 1366596 - RNA, 22 nt, Mycobacterium tuberculosis H37Rv
acgccgcggaguaggccgcgcc

SEQ ID NO: 1366597 - RNA, 18 nt, Mycobacterium tuberculosis H37Rv
acgccgcuggagaucacg

SEQ ID NO: 1366598 - RNA, 19 nt, Mycobacterium tuberculosis H37Rv
acgccgcuggagaucacgc

SEQ ID NO: 1366599 - RNA, 16 nt, Mycobacterium tuberculosis H37Rv
acgccggccgccgacc

SEQ ID NO: 1366600 - RNA, 17 nt, Mycobacterium tuberculosis H37Rv
acgccgccggcgccacc

SEQ ID NO: 1366601 - RNA, 14 nt, Mycobacterium tuberculosis H37Rv
acgccgcgagagcc

SEQ ID NO: 1366602 - RNA, 20 nt, Mycobacterium tuberculosis H37Rv
acgccgccagcauugaagaa

SEQ ID NO: 1366603 - RNA, 18 nt, Mycobacterium tuberculosis H37Rv
acgccucgacagcggcaa

SEQ ID NO: 1366604 - RNA, 21 nt, Mycobacterium tuberculosis H37Rv
acgccucaccgacgucgccaa

SEQ ID NO: 1366605 - RNA, 20 nt, Mycobacterium tuberculosis H37Rv
acgccugagccaccaacacc

SEQ ID NO: 1366606 - RNA, 15 nt, Mycobacterium tuberculosis H37Rv
acgccucugcucagc

SEQ ID NO: 1366607 - RNA, 19 nt, Mycobacterium tuberculosis H37Rv
acgccuugaucggcgaggu

SEQ ID NO: 1366608 - RNA, 14 nt, Mycobacterium tuberculosis H37Rv
acgcgaacccauac

SEQ ID NO: 1366609 - RNA, 16 nt, Mycobacterium tuberculosis H37Rv
acgcgaaccggccauc

SEQ ID NO: 1366610 - RNA, 16 nt, Mycobacterium tuberculosis H37Rv
acgcgaauaccagacc

SEQ ID NO: 1366611 - RNA, 22 nt, Mycobacterium tuberculosis H37Rv
acgcgaaugacgauccagccca

SEQ ID NO: 1366612 - RNA, 14 nt, Mycobacterium tuberculosis H37Rv
acgccaugccggga

SEQ ID NO: 1366613 - RNA, 14 nt, Mycobacterium tuberculosis H37Rv
acgaucaagcuggc

SEQ ID NO: 1366614 - RNA, 17 nt, Mycobacterium tuberculosis H37Rv
acgccccggcgcggcca

SEQ ID NO: 1366615 - RNA, 18 nt, Mycobacterium tuberculosis H37Rv
acgccccggcgcggccag

SEQ ID NO: 1366616 - RNA, 14 nt, Mycobacterium tuberculosis H37Rv
acgccccacugccg

SEQ ID NO: 1366617 - RNA, 16 nt, Mycobacterium tuberculosis H37Rv
acgccccgaucggcca

SEQ ID NO: 1366618 - RNA, 16 nt, Mycobacterium tuberculosis H37Rv
acgcccagcucggcac

SEQ ID NO: 1366619 - RNA, 17 nt, Mycobacterium tuberculosis H37Rv
acgcccacaugcucagg

SEQ ID NO: 1366620 - RNA, 15 nt, Mycobacterium tuberculosis H37Rv
acgcccacaaugacu

SEQ ID NO: 1366621 - RNA, 14 nt, Mycobacterium tuberculosis H37Rv
acgcccacagcuga

SEQ ID NO: 1366622 - RNA, 21 nt, Mycobacterium tuberculosis H37Rv
acgcccaauguccaggcgcgc

SEQ ID NO: 1366623 - RNA, 22 nt, Mycobacterium tuberculosis H37Rv
acgcccuggaaugccgccacaa

SEQ ID NO: 1366624 - RNA, 16 nt, Mycobacterium tuberculosis H37Rv
acgccgaaaaugccgc

SEQ ID NO: 1366625 - RNA, 12 nt, Mycobacterium tuberculosis H37Rv
acgcccuguucu

SEQ ID NO: 1366626 - RNA, 18 nt, Mycobacterium tuberculosis H37Rv
acgcccguguugaagaag

SEQ ID NO: 1366627 - RNA, 12 nt, Mycobacterium tuberculosis H37Rv
acgcccgcccgc

SEQ ID NO: 1366628 - RNA, 14 nt, Mycobacterium tuberculosis H37Rv
acgcccggcacccc

SEQ ID NO: 1366629 - RNA, 11 nt, Mycobacterium tuberculosis H37Rv
acgcccggcac

SEQ ID NO: 1366630 - RNA, 12 nt, Mycobacterium tuberculosis H37Rv
acgcccgcgaac

SEQ ID NO: 1366631 - RNA, 14 nt, Mycobacterium tuberculosis H37Rv
acgccgccagcacc

SEQ ID NO: 1366632 - RNA, 16 nt, Mycobacterium tuberculosis H37Rv
acgccgauggcuuggu

SEQ ID NO: 1366633 - RNA, 22 nt, Mycobacterium tuberculosis H37Rv
acgccgaauacggcugccucca

SEQ ID NO: 1366634 - RNA, 14 nt, Mycobacterium tuberculosis H37Rv
acgccgagcacuga

SEQ ID NO: 1366635 - RNA, 15 nt, Mycobacterium tuberculosis H37Rv
acgccgaccagcacc

SEQ ID NO: 1366636 - RNA, 17 nt, Mycobacterium tuberculosis H37Rv
acgccgaccggcccgca

SEQ ID NO: 1366637 - RNA, 21 nt, Mycobacterium tuberculosis H37Rv
acgcucggcggccagcucccg

SEQ ID NO: 1366638 - RNA, 18 nt, Mycobacterium tuberculosis H37Rv
acgcucgggcgcgcucgu

SEQ ID NO: 1366639 - RNA, 20 nt, Mycobacterium tuberculosis H37Rv
acgcucggucgccaccgccg

SEQ ID NO: 1366640 - RNA, 18 nt, Mycobacterium tuberculosis H37Rv
acgcugcccgccagccca

SEQ ID NO: 1366641 - RNA, 15 nt, Mycobacterium tuberculosis H37Rv
acgcugcgcccggac

SEQ ID NO: 1366642 - RNA, 17 nt, Mycobacterium tuberculosis H37Rv
acgcugcuggcaugcag

SEQ ID NO: 1366643 - RNA, 13 nt, Mycobacterium tuberculosis H37Rv
acgcuggcgggca

SEQ ID NO: 1366644 - RNA, 21 nt, Mycobacterium tuberculosis H37Rv
acgcguucaacaccgccgacc

SEQ ID NO: 1366645 - RNA, 19 nt, Mycobacterium tuberculosis H37Rv
acgcguagcucgcggggcg

SEQ ID NO: 1366646 - RNA, 16 nt, Mycobacterium tuberculosis H37Rv
acgcguauucggcauc

SEQ ID NO: 1366647 - RNA, 21 nt, Mycobacterium tuberculosis H37Rv
acgcgucggucgcggacaggu

SEQ ID NO: 1366648 - RNA, 19 nt, Mycobacterium tuberculosis H37Rv
acgcgucggucgcggacag

SEQ ID NO: 1366649 - RNA, 15 nt, Mycobacterium tuberculosis H37Rv
acgcgucgcgcgccu

SEQ ID NO: 1366650 - RNA, 22 nt, Mycobacterium tuberculosis H37Rv
acgcggucugcuccaggcgcgc

SEQ ID NO: 1366651 - RNA, 13 nt, Mycobacterium tuberculosis H37Rv
acgcggucugcuc

SEQ ID NO: 1366652 - RNA, 22 nt, Mycobacterium tuberculosis H37Rv
acgcggucgacgacgcccucac

SEQ ID NO: 1366653 - RNA, 16 nt, Mycobacterium tuberculosis H37Rv
acgcgguccucgagcc

SEQ ID NO: 1366654 - RNA, 20 nt, Mycobacterium tuberculosis H37Rv
acgcggucugcuccaggcgc

SEQ ID NO: 1366655 - RNA, 18 nt, Mycobacterium tuberculosis H37Rv
acgcggaaaggcuuccgc

SEQ ID NO: 1366656 - RNA, 21 nt, Mycobacterium tuberculosis H37Rv
acgcggaaaccaucgccagcc

SEQ ID NO: 1366657 - RNA, 14 nt, Mycobacterium tuberculosis H37Rv
acgcgcucaccgac

SEQ ID NO: 1366658 - RNA, 20 nt, Mycobacterium tuberculosis H37Rv
acgcggccgaggucacccgg

SEQ ID NO: 1366659 - RNA, 18 nt, Mycobacterium tuberculosis H37Rv
acgcgggcguuggccagc

SEQ ID NO: 1366660 - RNA, 18 nt, Mycobacterium tuberculosis H37Rv
acgcggaucgggcacccc

SEQ ID NO: 1366661 - RNA, 20 nt, Mycobacterium tuberculosis H37Rv
acgcgcaaacucagacucug

SEQ ID NO: 1366662 - RNA, 21 nt, Mycobacterium tuberculosis H37Rv
acgcgcaacgccgccagccug

SEQ ID NO: 1366663 - RNA, 20 nt, Mycobacterium tuberculosis H37Rv
acgcgcaacgccgccagccu

SEQ ID NO: 1366664 - RNA, 13 nt, Mycobacterium tuberculosis H37Rv
acgcgaggcgcuc

SEQ ID NO: 1366665 - RNA, 14 nt, Mycobacterium tuberculosis H37Rv
acgcgaucaggcgc

SEQ ID NO: 1366666 - RNA, 15 nt, Mycobacterium tuberculosis H37Rv
acgcgaucagcgcgc

SEQ ID NO: 1366667 - RNA, 19 nt, Mycobacterium tuberculosis H37Rv
acgcgaccgcgauccccac

SEQ ID NO: 1366668 - RNA, 19 nt, Mycobacterium tuberculosis H37Rv
acgcgacgguguagcccau

SEQ ID NO: 1366669 - RNA, 22 nt, Mycobacterium tuberculosis H37Rv
acgcgccgucucgaagcucagc

SEQ ID NO: 1366670 - RNA, 17 nt, Mycobacterium tuberculosis H37Rv
acgcgcccgcaccaccg

SEQ ID NO: 1366671 - RNA, 19 nt, Mycobacterium tuberculosis H37Rv
acgugauguagcugcaggu

SEQ ID NO: 1366672 - RNA, 21 nt, Mycobacterium tuberculosis H37Rv
acgugcaaccacggcggcauc

SEQ ID NO: 1366673 - RNA, 19 nt, Mycobacterium tuberculosis H37Rv
acguggacugaccucguca

SEQ ID NO: 1366674 - RNA, 16 nt, Mycobacterium tuberculosis H37Rv
acgugcacggcgaggu

SEQ ID NO: 1366675 - RNA, 21 nt, Mycobacterium tuberculosis H37Rv
acguggggccggggucggccc

SEQ ID NO: 1366676 - RNA, 15 nt, Mycobacterium tuberculosis H37Rv
acgugcaucugugag

SEQ ID NO: 1366677 - RNA, 16 nt, Mycobacterium tuberculosis H37Rv
acguggccacggcauu

SEQ ID NO: 1366678 - RNA, 21 nt, Mycobacterium tuberculosis H37Rv
acgugguccaaccgggccggc

SEQ ID NO: 1366679 - RNA, 18 nt, Mycobacterium tuberculosis H37Rv
acguggucggagcgggug

SEQ ID NO: 1366680 - RNA, 15 nt, Mycobacterium tuberculosis H37Rv
acgugucccgcaugc

SEQ ID NO: 1366681 - RNA, 14 nt, Mycobacterium tuberculosis H37Rv
acgugucggcugcu

SEQ ID NO: 1366682 - RNA, 21 nt, Mycobacterium tuberculosis H37Rv
acgugugcaccaucaucaccu

SEQ ID NO: 1366683 - RNA, 16 nt, Mycobacterium tuberculosis H37Rv
acgucgagcagcgcca

SEQ ID NO: 1366684 - RNA, 15 nt, Mycobacterium tuberculosis H37Rv
acgucgagcaggcug

SEQ ID NO: 1366685 - RNA, 13 nt, Mycobacterium tuberculosis H37Rv
acgucgaucaaca

SEQ ID NO: 1366686 - RNA, 16 nt, Mycobacterium tuberculosis H37Rv
acgucgcgcaucgccu

SEQ ID NO: 1366687 - RNA, 20 nt, Mycobacterium tuberculosis H37Rv
acgucgcuguaggccagccc

SEQ ID NO: 1366688 - RNA, 15 nt, Mycobacterium tuberculosis H37Rv
acgucgcuccgaugu

SEQ ID NO: 1366689 - RNA, 13 nt, Mycobacterium tuberculosis H37Rv
acgucgccagguc

SEQ ID NO: 1366690 - RNA, 16 nt, Mycobacterium tuberculosis H37Rv
acgugaguuucaccac

SEQ ID NO: 1366691 - RNA, 22 nt, Mycobacterium tuberculosis H37Rv
acgucgucggugcgccacgacc

SEQ ID NO: 1366692 - RNA, 21 nt, Mycobacterium tuberculosis H37Rv
acgucucuggugcaggugagu

SEQ ID NO: 1366693 - RNA, 23 nt, Mycobacterium tuberculosis H37Rv
acgucguuggcucgugcccgacc

SEQ ID NO: 1366694 - RNA, 22 nt, Mycobacterium tuberculosis H37Rv
acguccaucaccggcggcccca

SEQ ID NO: 1366695 - RNA, 20 nt, Mycobacterium tuberculosis H37Rv
acguccaucaccggcggccc

SEQ ID NO: 1366696 - RNA, 15 nt, Mycobacterium tuberculosis H37Rv
acguccagggccacg

SEQ ID NO: 1366697 - RNA, 17 nt, Mycobacterium tuberculosis H37Rv
acguccagggccacgau

SEQ ID NO: 1366698 - RNA, 15 nt, Mycobacterium tuberculosis H37Rv
acguccgcgccgagc

SEQ ID NO: 1366699 - RNA, 21 nt, Mycobacterium tuberculosis H37Rv
acgucacgucgacggcggccg

SEQ ID NO: 1366700 - RNA, 18 nt, Mycobacterium tuberculosis H37Rv
acgucacguggucggcca

SEQ ID NO: 1366701 - RNA, 20 nt, Mycobacterium tuberculosis H37Rv
acgucaucuggcgcugcugg

SEQ ID NO: 1366702 - RNA, 14 nt, Mycobacterium tuberculosis H37Rv
acguccaacagcgc

SEQ ID NO: 1366703 - RNA, 16 nt, Mycobacterium tuberculosis H37Rv
acgucaagaagaacuc

SEQ ID NO: 1366704 - RNA, 16 nt, Mycobacterium tuberculosis H37Rv
acgucaaacgcaaaga

SEQ ID NO: 1366705 - RNA, 21 nt, Mycobacterium tuberculosis H37Rv
acgguugaugaucuuggugaa

SEQ ID NO: 1366706 - RNA, 13 nt, Mycobacterium tuberculosis H37Rv
acgguugccggcg

SEQ ID NO: 1366707 - RNA, 20 nt, Mycobacterium tuberculosis H37Rv
acgguugccgucagggucag

SEQ ID NO: 1366708 - RNA, 11 nt, Mycobacterium tuberculosis H37Rv
acgguguuggu

SEQ ID NO: 1366709 - RNA, 23 nt, Mycobacterium tuberculosis H37Rv
acggugucuugccaccacgcaug

SEQ ID NO: 1366710 - RNA, 20 nt, Mycobacterium tuberculosis H37Rv
acggugucgcgaugcuuccc

SEQ ID NO: 1366711 - RNA, 21 nt, Mycobacterium tuberculosis H37Rv
acggcccgagccgcgugggcc

SEQ ID NO: 1366712 - RNA, 22 nt, Mycobacterium tuberculosis H37Rv
acggcccgcaucgucgccgacc

SEQ ID NO: 1366713 - RNA, 19 nt, Mycobacterium tuberculosis H37Rv
acggccgcauaaaacucgc

SEQ ID NO: 1366714 - RNA, 11 nt, Mycobacterium tuberculosis H37Rv
acggccgccgc

SEQ ID NO: 1366715 - RNA, 23 nt, Mycobacterium tuberculosis H37Rv
acggcccgccguccggcgcccac

SEQ ID NO: 1366716 - RNA, 15 nt, Mycobacterium tuberculosis H37Rv
acggccacgguggag

SEQ ID NO: 1366717 - RNA, 21 nt, Mycobacterium tuberculosis H37Rv
acggccagcaggaugaugacc

SEQ ID NO: 1366718 - RNA, 22 nt, Mycobacterium tuberculosis H37Rv
acggccaguugguagccgcccu

SEQ ID NO: 1366719 - RNA, 12 nt, Mycobacterium tuberculosis H37Rv
acggccagccca

SEQ ID NO: 1366720 - RNA, 18 nt, Mycobacterium tuberculosis H37Rv
acggcgacacgccagccg

SEQ ID NO: 1366721 - RNA, 14 nt, Mycobacterium tuberculosis H37Rv
acggcgacgauguc

SEQ ID NO: 1366722 - RNA, 22 nt, Mycobacterium tuberculosis H37Rv
acggcgacgaucucggcggccg

SEQ ID NO: 1366723 - RNA, 16 nt, Mycobacterium tuberculosis H37Rv
acggccuggccaccug

SEQ ID NO: 1366724 - RNA, 20 nt, Mycobacterium tuberculosis H37Rv
acggcgaaaucgacagcagc

SEQ ID NO: 1366725 - RNA, 18 nt, Mycobacterium tuberculosis H37Rv
acggcgaaccggcccacc

SEQ ID NO: 1366726 - RNA, 18 nt, Mycobacterium tuberculosis H37Rv
acggccggccgcugccac

SEQ ID NO: 1366727 - RNA, 11 nt, Mycobacterium tuberculosis H37Rv
acggccgcagc

SEQ ID NO: 1366728 - RNA, 22 nt, Mycobacterium tuberculosis H37Rv
acggcagcccaaagcgccagca

SEQ ID NO: 1366729 - RNA, 13 nt, Mycobacterium tuberculosis H37Rv
acggcagccagcc

SEQ ID NO: 1366730 - RNA, 21 nt, Mycobacterium tuberculosis H37Rv
acggcacccccgacgagauac

SEQ ID NO: 1366731 - RNA, 22 nt, Mycobacterium tuberculosis H37Rv
acggcacccgaaaacugacccc

SEQ ID NO: 1366732 - RNA, 21 nt, Mycobacterium tuberculosis H37Rv
acggcaccauguacaggcugu

SEQ ID NO: 1366733 - RNA, 17 nt, Mycobacterium tuberculosis H37Rv
acggcauucgaccucaa

SEQ ID NO: 1366734 - RNA, 15 nt, Mycobacterium tuberculosis H37Rv
acggcaucggccacc

SEQ ID NO: 1366735 - RNA, 17 nt, Mycobacterium tuberculosis H37Rv
acggcauguaccgaccg

SEQ ID NO: 1366736 - RNA, 11 nt, Mycobacterium tuberculosis H37Rv
acggcaggcgg

SEQ ID NO: 1366737 - RNA, 22 nt, Mycobacterium tuberculosis H37Rv
acggcaggcagggcagcccggc

SEQ ID NO: 1366738 - RNA, 20 nt, Mycobacterium tuberculosis H37Rv
acgggcuuccgacaugaacc

SEQ ID NO: 1366739 - RNA, 11 nt, Mycobacterium tuberculosis H37Rv
acgggcaguga

SEQ ID NO: 1366740 - RNA, 14 nt, Mycobacterium tuberculosis H37Rv
acgggcagugaaca

SEQ ID NO: 1366741 - RNA, 18 nt, Mycobacterium tuberculosis H37Rv
acgggcacccgagccgca

SEQ ID NO: 1366742 - RNA, 19 nt, Mycobacterium tuberculosis H37Rv
acgggcacccgagccgcac

SEQ ID NO: 1366743 - RNA, 12 nt, Mycobacterium tuberculosis H37Rv
acgggcaggagc

SEQ ID NO: 1366744 - RNA, 11 nt, Mycobacterium tuberculosis H37Rv
acgggcaaacc

SEQ ID NO: 1366745 - RNA, 17 nt, Mycobacterium tuberculosis H37Rv
acgggacgccgugugca

SEQ ID NO: 1366746 - RNA, 18 nt, Mycobacterium tuberculosis H37Rv
acggcggggccggcggcu

SEQ ID NO: 1366747 - RNA, 15 nt, Mycobacterium tuberculosis H37Rv
acggcgguaagggcg

SEQ ID NO: 1366748 - RNA, 21 nt, Mycobacterium tuberculosis H37Rv
acgggauagccguucggcauc

SEQ ID NO: 1366749 - RNA, 14 nt, Mycobacterium tuberculosis H37Rv
acggcgucacccgc

SEQ ID NO: 1366750 - RNA, 14 nt, Mycobacterium tuberculosis H37Rv
acggcguccccgac

SEQ ID NO: 1366751 - RNA, 17 nt, Mycobacterium tuberculosis H37Rv
acggcggccccggcauu

SEQ ID NO: 1366752 - RNA, 15 nt, Mycobacterium tuberculosis H37Rv
acggcgauggcgcgc

SEQ ID NO: 1366753 - RNA, 16 nt, Mycobacterium tuberculosis H37Rv
acggcggcgccgccca

SEQ ID NO: 1366754 - RNA, 18 nt, Mycobacterium tuberculosis H37Rv
acggcgggaugcagcugc

SEQ ID NO: 1366755 - RNA, 16 nt, Mycobacterium tuberculosis H37Rv
acgggggcuguccacc

SEQ ID NO: 1366756 - RNA, 14 nt, Mycobacterium tuberculosis H37Rv
acggggccgucucg

SEQ ID NO: 1366757 - RNA, 14 nt, Mycobacterium tuberculosis H37Rv
acggggcgagcaug

SEQ ID NO: 1366758 - RNA, 22 nt, Mycobacterium tuberculosis H37Rv
acggguagacccacaucagguc

SEQ ID NO: 1366759 - RNA, 17 nt, Mycobacterium tuberculosis H37Rv
acgggguugaccgccac

SEQ ID NO: 1366760 - RNA, 19 nt, Mycobacterium tuberculosis H37Rv
acggucaaggugcgccgcc

SEQ ID NO: 1366761 - RNA, 22 nt, Mycobacterium tuberculosis H37Rv
acggucaaggugcgccgccauc

SEQ ID NO: 1366762 - RNA, 18 nt, Mycobacterium tuberculosis H37Rv
acggucagauggccaccc

SEQ ID NO: 1366763 - RNA, 18 nt, Mycobacterium tuberculosis H37Rv
acggucacacgccagccg

SEQ ID NO: 1366764 - RNA, 13 nt, Mycobacterium tuberculosis H37Rv
acggucagccagg

SEQ ID NO: 1366765 - RNA, 16 nt, Mycobacterium tuberculosis H37Rv
acggucagcagacugc

SEQ ID NO: 1366766 - RNA, 23 nt, Mycobacterium tuberculosis H37Rv
acggucagcacgcugaccacaac

SEQ ID NO: 1366767 - RNA, 14 nt, Mycobacterium tuberculosis H37Rv
acggucuugauguu

SEQ ID NO: 1366768 - RNA, 14 nt, Mycobacterium tuberculosis H37Rv
acguucggcacaac

SEQ ID NO: 1366769 - RNA, 17 nt, Mycobacterium tuberculosis H37Rv
acguucggcacaaccaa

SEQ ID NO: 1366770 - RNA, 22 nt, Mycobacterium tuberculosis H37Rv
acguuacgccgagaugcugcac

SEQ ID NO: 1366771 - RNA, 17 nt, Mycobacterium tuberculosis H37Rv
acuacggccuggccacc

SEQ ID NO: 1366772 - RNA, 14 nt, Mycobacterium tuberculosis H37Rv
acuaggcccagcac

SEQ ID NO: 1366773 - RNA, 22 nt, Mycobacterium tuberculosis H37Rv
acucacgaggcacaaucaccgc

SEQ ID NO: 1366774 - RNA, 23 nt, Mycobacterium tuberculosis H37Rv
acucacgcaggaaaaccccggcc

SEQ ID NO: 1366775 - RNA, 18 nt, Mycobacterium tuberculosis H37Rv
acucacgggugcuggcag

SEQ ID NO: 1366776 - RNA, 14 nt, Mycobacterium tuberculosis H37Rv
acucacggugaucg

SEQ ID NO: 1366777 - RNA, 20 nt, Mycobacterium tuberculosis H37Rv
acucacccgggcagccugcu

SEQ ID NO: 1366778 - RNA, 22 nt, Mycobacterium tuberculosis H37Rv
acucacccgggcagccugcugc

SEQ ID NO: 1366779 - RNA, 18 nt, Mycobacterium tuberculosis H37Rv
acucacccgggcagccug

SEQ ID NO: 1366780 - RNA, 20 nt, Mycobacterium tuberculosis H37Rv
acucacccacccgcaccgcg

SEQ ID NO: 1366781 - RNA, 13 nt, Mycobacterium tuberculosis H37Rv
acucaccagcacc

SEQ ID NO: 1366782 - RNA, 16 nt, Mycobacterium tuberculosis H37Rv
acucaacaccagcaag

SEQ ID NO: 1366783 - RNA, 14 nt, Mycobacterium tuberculosis H37Rv
acucagucugggga

SEQ ID NO: 1366784 - RNA, 21 nt, Mycobacterium tuberculosis H37Rv
acucaggaucccgguggcagc

SEQ ID NO: 1366785 - RNA, 18 nt, Mycobacterium tuberculosis H37Rv
acucaucgugguaaccau

SEQ ID NO: 1366786 - RNA, 21 nt, Mycobacterium tuberculosis H37Rv
acucaucgacguuccagcagu

SEQ ID NO: 1366787 - RNA, 20 nt, Mycobacterium tuberculosis H37Rv
acuccaagucacagcucacc

SEQ ID NO: 1366788 - RNA, 21 nt, Mycobacterium tuberculosis H37Rv
acuccacgaucggcccagccc

SEQ ID NO: 1366789 - RNA, 13 nt, Mycobacterium tuberculosis H37Rv
acuccaccgcgcc

SEQ ID NO: 1366790 - RNA, 14 nt, Mycobacterium tuberculosis H37Rv
acuccaccgcgccg

SEQ ID NO: 1366791 - RNA, 17 nt, Mycobacterium tuberculosis H37Rv
acuccaccgcuggcccg

SEQ ID NO: 1366792 - RNA, 20 nt, Mycobacterium tuberculosis H37Rv
acuccacgaucggcccagcc

SEQ ID NO: 1366793 - RNA, 19 nt, Mycobacterium tuberculosis H37Rv
acuccagcaaggccagcac

SEQ ID NO: 1366794 - RNA, 14 nt, Mycobacterium tuberculosis H37Rv
acuccagcaccagc

SEQ ID NO: 1366795 - RNA, 16 nt, Mycobacterium tuberculosis H37Rv
acuccagcaccagcac

SEQ ID NO: 1366796 - RNA, 16 nt, Mycobacterium tuberculosis H37Rv
acuccaucaccacacc

SEQ ID NO: 1366797 - RNA, 21 nt, Mycobacterium tuberculosis H37Rv
acuccaguccuaucagugagc

SEQ ID NO: 1366798 - RNA, 15 nt, Mycobacterium tuberculosis H37Rv
acuccgcggaaccca

SEQ ID NO: 1366799 - RNA, 20 nt, Mycobacterium tuberculosis H37Rv
acuccgcggaacccagcacu

SEQ ID NO: 1366800 - RNA, 12 nt, Mycobacterium tuberculosis H37Rv
acuccgcggcga

SEQ ID NO: 1366801 - RNA, 22 nt, Mycobacterium tuberculosis H37Rv
acuccgccaccaucgccucggc

SEQ ID NO: 1366802 - RNA, 15 nt, Mycobacterium tuberculosis H37Rv
acuccgaucgggccc

SEQ ID NO: 1366803 - RNA, 23 nt, Mycobacterium tuberculosis H37Rv
acucccucgaucacggcggcccc

SEQ ID NO: 1366804 - RNA, 21 nt, Mycobacterium tuberculosis H37Rv
acuccaugaaucgcgcuucag

SEQ ID NO: 1366805 - RNA, 17 nt, Mycobacterium tuberculosis H37Rv
acuccugcggcaccgcu

SEQ ID NO: 1366806 - RNA, 13 nt, Mycobacterium tuberculosis H37Rv
acuccugcacaca

SEQ ID NO: 1366807 - RNA, 20 nt, Mycobacterium tuberculosis H37Rv
acuccuggguuugccgaugg

SEQ ID NO: 1366808 - RNA, 22 nt, Mycobacterium tuberculosis H37Rv
acuccugagaugcggccaugaa

SEQ ID NO: 1366809 - RNA, 24 nt, Mycobacterium tuberculosis H37Rv
acucgggucaauugagucaucugg

SEQ ID NO: 1366810 - RNA, 15 nt, Mycobacterium tuberculosis H37Rv
acucgggcgacugga

SEQ ID NO: 1366811 - RNA, 22 nt, Mycobacterium tuberculosis H37Rv
acucggugauguagggcugcuc

SEQ ID NO: 1366812 - RNA, 20 nt, Mycobacterium tuberculosis H37Rv
acucggucucauagugcagg

SEQ ID NO: 1366813 - RNA, 12 nt, Mycobacterium tuberculosis H37Rv
acucggugaucg

SEQ ID NO: 1366814 - RNA, 19 nt, Mycobacterium tuberculosis H37Rv
acucgggggcugcacgcuc

SEQ ID NO: 1366815 - RNA, 21 nt, Mycobacterium tuberculosis H37Rv
acucgccggcgaauccgcaca

SEQ ID NO: 1366816 - RNA, 14 nt, Mycobacterium tuberculosis H37Rv
acucgcggccggcg

SEQ ID NO: 1366817 - RNA, 21 nt, Mycobacterium tuberculosis H37Rv
acucgccgucauagcaggccu

SEQ ID NO: 1366818 - RNA, 12 nt, Mycobacterium tuberculosis H37Rv
acucgcgcagga

SEQ ID NO: 1366819 - RNA, 15 nt, Mycobacterium tuberculosis H37Rv
acucgcgcagguagc

SEQ ID NO: 1366820 - RNA, 22 nt, Mycobacterium tuberculosis H37Rv
acugcccgauggcuaccuugga

SEQ ID NO: 1366821 - RNA, 23 nt, Mycobacterium tuberculosis H37Rv
acugcccucgcuaauugcggccg

SEQ ID NO: 1366822 - RNA, 17 nt, Mycobacterium tuberculosis H37Rv
acugccguugccgccgg

SEQ ID NO: 1366823 - RNA, 17 nt, Mycobacterium tuberculosis H37Rv
acugccgcggcaccgcc

SEQ ID NO: 1366824 - RNA, 21 nt, Mycobacterium tuberculosis H37Rv
acugccgcggcaccgccccgc

SEQ ID NO: 1366825 - RNA, 19 nt, Mycobacterium tuberculosis H37Rv
acugccggacagccacgca

SEQ ID NO: 1366826 - RNA, 22 nt, Mycobacterium tuberculosis H37Rv
acugccggacagccacgcacaa

SEQ ID NO: 1366827 - RNA, 12 nt, Mycobacterium tuberculosis H37Rv
acugccacuccu

SEQ ID NO: 1366828 - RNA, 24 nt, Mycobacterium tuberculosis H37Rv
acugcagugccguguccagcaugc

SEQ ID NO: 1366829 - RNA, 22 nt, Mycobacterium tuberculosis H37Rv
acugcagguucuugaccagcag

SEQ ID NO: 1366830 - RNA, 13 nt, Mycobacterium tuberculosis H37Rv
acugaagccgcga

SEQ ID NO: 1366831 - RNA, 22 nt, Mycobacterium tuberculosis H37Rv
acugaccccgccgccacgggug

SEQ ID NO: 1366832 - RNA, 14 nt, Mycobacterium tuberculosis H37Rv
acugaccaggucug

SEQ ID NO: 1366833 - RNA, 18 nt, Mycobacterium tuberculosis H37Rv
acugacguuaccgccgca

SEQ ID NO: 1366834 - RNA, 21 nt, Mycobacterium tuberculosis H37Rv
acugaugaaccacggcaggca

SEQ ID NO: 1366835 - RNA, 14 nt, Mycobacterium tuberculosis H37Rv
acucgucgcugccc

SEQ ID NO: 1366836 - RNA, 20 nt, Mycobacterium tuberculosis H37Rv
acuggcgccggugccgccgg

SEQ ID NO: 1366837 - RNA, 16 nt, Mycobacterium tuberculosis H37Rv
acuggcuauaaaccac

SEQ ID NO: 1366838 - RNA, 16 nt, Mycobacterium tuberculosis H37Rv
acugcuuccggaacaa

SEQ ID NO: 1366839 - RNA, 22 nt, Mycobacterium tuberculosis H37Rv
acuggguugcgaacucggccgu

SEQ ID NO: 1366840 - RNA, 13 nt, Mycobacterium tuberculosis H37Rv
acugguauuuccc

SEQ ID NO: 1366841 - RNA, 21 nt, Mycobacterium tuberculosis H37Rv
acugggcgaucgacaccguga

SEQ ID NO: 1366842 - RNA, 14 nt, Mycobacterium tuberculosis H37Rv
acuggggugcugcg

SEQ ID NO: 1366843 - RNA, 23 nt, Mycobacterium tuberculosis H37Rv
acuggggcgccaccacccggcgc

SEQ ID NO: 1366844 - RNA, 16 nt, Mycobacterium tuberculosis H37Rv
acugggcgcuggaggc

SEQ ID NO: 1366845 - RNA, 21 nt, Mycobacterium tuberculosis H37Rv
acuggucgccaacgccagcac

SEQ ID NO: 1366846 - RNA, 20 nt, Mycobacterium tuberculosis H37Rv
acugguggcgauccguagga

SEQ ID NO: 1366847 - RNA, 21 nt, Mycobacterium tuberculosis H37Rv
acugguggucgugguguuggu

SEQ ID NO: 1366848 - RNA, 16 nt, Mycobacterium tuberculosis H37Rv
acuguggcgccgccgg

SEQ ID NO: 1366849 - RNA, 19 nt, Mycobacterium tuberculosis H37Rv
acugugcgagcugcggguc

SEQ ID NO: 1366850 - RNA, 16 nt, Mycobacterium tuberculosis H37Rv
acugugcgccgcagcc

SEQ ID NO: 1366851 - RNA, 15 nt, Mycobacterium tuberculosis H37Rv
acuguuacggccaca

SEQ ID NO: 1366852 - RNA, 22 nt, Mycobacterium tuberculosis H37Rv
agcaacgugugcaccaucauca

SEQ ID NO: 1366853 - RNA, 15 nt, Mycobacterium tuberculosis H37Rv
agcaacucggccacg

SEQ ID NO: 1366854 - RNA, 21 nt, Mycobacterium tuberculosis H37Rv
agcaacucguccagcagugcg

SEQ ID NO: 1366855 - RNA, 22 nt, Mycobacterium tuberculosis H37Rv
agcaacucguccagcagugcga

SEQ ID NO: 1366856 - RNA, 16 nt, Mycobacterium tuberculosis H37Rv
agcaacucguccagca

SEQ ID NO: 1366857 - RNA, 17 nt, Mycobacterium tuberculosis H37Rv
agcaacucguccagcag

SEQ ID NO: 1366858 - RNA, 16 nt, Mycobacterium tuberculosis H37Rv
agcaacgcugcagcag

SEQ ID NO: 1366859 - RNA, 15 nt, Mycobacterium tuberculosis H37Rv
agcaacgccacgccg

SEQ ID NO: 1366860 - RNA, 20 nt, Mycobacterium tuberculosis H37Rv
agcaagucgccgaggcaacc

SEQ ID NO: 1366861 - RNA, 14 nt, Mycobacterium tuberculosis H37Rv
agcaaguccaccgg

SEQ ID NO: 1366862 - RNA, 18 nt, Mycobacterium tuberculosis H37Rv
agcaagugggugccggca

SEQ ID NO: 1366863 - RNA, 15 nt, Mycobacterium tuberculosis H37Rv
agcaagugcgggcug

SEQ ID NO: 1366864 - RNA, 19 nt, Mycobacterium tuberculosis H37Rv
agcaagaucggcagcgugg

SEQ ID NO: 1366865 - RNA, 20 nt, Mycobacterium tuberculosis H37Rv
agcaagaaguacgugcacag

SEQ ID NO: 1366866 - RNA, 16 nt, Mycobacterium tuberculosis H37Rv
agcaagagccgcagcc

SEQ ID NO: 1366867 - RNA, 14 nt, Mycobacterium tuberculosis H37Rv
agcacaaacccagu

SEQ ID NO: 1366868 - RNA, 17 nt, Mycobacterium tuberculosis H37Rv
agcacacaacacccaac

SEQ ID NO: 1366869 - RNA, 24 nt, Mycobacterium tuberculosis H37Rv
agcaaugcgguaccaaccugcgcg

SEQ ID NO: 1366870 - RNA, 19 nt, Mycobacterium tuberculosis H37Rv
agcaauuugccguagaaac

SEQ ID NO: 1366871 - RNA, 14 nt, Mycobacterium tuberculosis H37Rv
agcaaugacccgcg

SEQ ID NO: 1366872 - RNA, 17 nt, Mycobacterium tuberculosis H37Rv
agcaauccgcacagcga

SEQ ID NO: 1366873 - RNA, 15 nt, Mycobacterium tuberculosis H37Rv
agcacccugauguga

SEQ ID NO: 1366874 - RNA, 21 nt, Mycobacterium tuberculosis H37Rv
agcacccguugaucgcggaca

SEQ ID NO: 1366875 - RNA, 23 nt, Mycobacterium tuberculosis H37Rv
agcacccgggccacgucgagcac

SEQ ID NO: 1366876 - RNA, 20 nt, Mycobacterium tuberculosis H37Rv
agcacccugaugugagucca

SEQ ID NO: 1366877 - RNA, 19 nt, Mycobacterium tuberculosis H37Rv
agcacccugaugugagucc

SEQ ID NO: 1366878 - RNA, 15 nt, Mycobacterium tuberculosis H37Rv
agcacccggccaccg

SEQ ID NO: 1366879 - RNA, 17 nt, Mycobacterium tuberculosis H37Rv
agcacccgauaguucug

SEQ ID NO: 1366880 - RNA, 14 nt, Mycobacterium tuberculosis H37Rv
agcacccgcaaugc

SEQ ID NO: 1366881 - RNA, 14 nt, Mycobacterium tuberculosis H37Rv
agcaccccgagguc

SEQ ID NO: 1366882 - RNA, 17 nt, Mycobacterium tuberculosis H37Rv
agcaccccauggccacc

SEQ ID NO: 1366883 - RNA, 18 nt, Mycobacterium tuberculosis H37Rv
agcaccccauggccaccg

SEQ ID NO: 1366884 - RNA, 19 nt, Mycobacterium tuberculosis H37Rv
agcaccccauggccaccga

SEQ ID NO: 1366885 - RNA, 17 nt, Mycobacterium tuberculosis H37Rv
agcacccaacccggcgg

SEQ ID NO: 1366886 - RNA, 19 nt, Mycobacterium tuberculosis H37Rv
agcacccacaucagccgca

SEQ ID NO: 1366887 - RNA, 22 nt, Mycobacterium tuberculosis H37Rv
agcacccaaugccaccgcggcc

SEQ ID NO: 1366888 - RNA, 18 nt, Mycobacterium tuberculosis H37Rv
agcaccagcgucgcggcc

SEQ ID NO: 1366889 - RNA, 16 nt, Mycobacterium tuberculosis H37Rv
agcaccaguucccuac

SEQ ID NO: 1366890 - RNA, 18 nt, Mycobacterium tuberculosis H37Rv
agcaccaaaagcccggua

SEQ ID NO: 1366891 - RNA, 16 nt, Mycobacterium tuberculosis H37Rv
agcaccagcagcacca

SEQ ID NO: 1366892 - RNA, 15 nt, Mycobacterium tuberculosis H37Rv
agcaccagccagccu

SEQ ID NO: 1366893 - RNA, 18 nt, Mycobacterium tuberculosis H37Rv
agcaccagccagccugcu

SEQ ID NO: 1366894 - RNA, 20 nt, Mycobacterium tuberculosis H37Rv
agcacagcgcagccugcagc

SEQ ID NO: 1366895 - RNA, 14 nt, Mycobacterium tuberculosis H37Rv
agcacagcccggcu

SEQ ID NO: 1366896 - RNA, 18 nt, Mycobacterium tuberculosis H37Rv
agcacacuccuagccaac

SEQ ID NO: 1366897 - RNA, 20 nt, Mycobacterium tuberculosis H37Rv
agcacacccagaugcaggcu

SEQ ID NO: 1366898 - RNA, 13 nt, Mycobacterium tuberculosis H37Rv
agcacaccgccag

SEQ ID NO: 1366899 - RNA, 18 nt, Mycobacterium tuberculosis H37Rv
agcacaugguccaaccag

SEQ ID NO: 1366900 - RNA, 14 nt, Mycobacterium tuberculosis H37Rv
agcacaucgccggc

SEQ ID NO: 1366901 - RNA, 17 nt, Mycobacterium tuberculosis H37Rv
agcaccaaaugccccga

SEQ ID NO: 1366902 - RNA, 20 nt, Mycobacterium tuberculosis H37Rv
agcaccaaaugccccgaacc

SEQ ID NO: 1366903 - RNA, 21 nt, Mycobacterium tuberculosis H37Rv
agcaccaccccagcggccacc

SEQ ID NO: 1366904 - RNA, 13 nt, Mycobacterium tuberculosis H37Rv
agcaccaccccag

SEQ ID NO: 1366905 - RNA, 23 nt, Mycobacterium tuberculosis H37Rv
agcacgagcggcuugguguauuc

SEQ ID NO: 1366906 - RNA, 18 nt, Mycobacterium tuberculosis H37Rv
agcaccggauacagccac

SEQ ID NO: 1366907 - RNA, 22 nt, Mycobacterium tuberculosis H37Rv
agcaccgcuacgaccaauagca

SEQ ID NO: 1366908 - RNA, 16 nt, Mycobacterium tuberculosis H37Rv
agcaccgccgcugcca

SEQ ID NO: 1366909 - RNA, 21 nt, Mycobacterium tuberculosis H37Rv
agcaccgccgcgccggcggcc

SEQ ID NO: 1366910 - RNA, 15 nt, Mycobacterium tuberculosis H37Rv
agcaccgacagcccg

SEQ ID NO: 1366911 - RNA, 16 nt, Mycobacterium tuberculosis H37Rv
agcacgcgggcacugg

SEQ ID NO: 1366912 - RNA, 16 nt, Mycobacterium tuberculosis H37Rv
agcacgccaggcaugc

SEQ ID NO: 1366913 - RNA, 13 nt, Mycobacterium tuberculosis H37Rv
agcacgcccucga

SEQ ID NO: 1366914 - RNA, 15 nt, Mycobacterium tuberculosis H37Rv
agcacgccguccagg

SEQ ID NO: 1366915 - RNA, 20 nt, Mycobacterium tuberculosis H37Rv
agcacggcgcggcggagugc

SEQ ID NO: 1366916 - RNA, 16 nt, Mycobacterium tuberculosis H37Rv
agcacgcgugguucgg

SEQ ID NO: 1366917 - RNA, 20 nt, Mycobacterium tuberculosis H37Rv
agcacgcuggcguuguugac

SEQ ID NO: 1366918 - RNA, 23 nt, Mycobacterium tuberculosis H37Rv
agcacgggcucgcugcaccagcu

SEQ ID NO: 1366919 - RNA, 24 nt, Mycobacterium tuberculosis H37Rv
agcacgggcucgcugcaccagcug

SEQ ID NO: 1366920 - RNA, 22 nt, Mycobacterium tuberculosis H37Rv
agcacggcgcggcggagugcau

SEQ ID NO: 1366921 - RNA, 17 nt, Mycobacterium tuberculosis H37Rv
agcagaccacaacgccu

SEQ ID NO: 1366922 - RNA, 19 nt, Mycobacterium tuberculosis H37Rv
agcagacgcggaaucgcac

SEQ ID NO: 1366923 - RNA, 13 nt, Mycobacterium tuberculosis H37Rv
agcagccgaaccg

SEQ ID NO: 1366924 - RNA, 19 nt, Mycobacterium tuberculosis H37Rv
agcagccgaaccggcacca

SEQ ID NO: 1366925 - RNA, 12 nt, Mycobacterium tuberculosis H37Rv
agcagccgaacc

SEQ ID NO: 1366926 - RNA, 17 nt, Mycobacterium tuberculosis H37Rv
agcagcgcaacggccag

SEQ ID NO: 1366927 - RNA, 16 nt, Mycobacterium tuberculosis H37Rv
agcagacgcaaaagaa

SEQ ID NO: 1366928 - RNA, 12 nt, Mycobacterium tuberculosis H37Rv
agcagacgcaac

SEQ ID NO: 1366929 - RNA, 17 nt, Mycobacterium tuberculosis H37Rv
agcagacgcaacggcac

SEQ ID NO: 1366930 - RNA, 22 nt, Mycobacterium tuberculosis H37Rv
agcagacgcauaagcccccgca

SEQ ID NO: 1366931 - RNA, 19 nt, Mycobacterium tuberculosis H37Rv
agcagacgacgaucagccc

SEQ ID NO: 1366932 - RNA, 17 nt, Mycobacterium tuberculosis H37Rv
agcagggccagaccgaa

SEQ ID NO: 1366933 - RNA, 20 nt, Mycobacterium tuberculosis H37Rv
agcagggccaccaccacggc

SEQ ID NO: 1366934 - RNA, 14 nt, Mycobacterium tuberculosis H37Rv
agcagggccaccac

SEQ ID NO: 1366935 - RNA, 22 nt, Mycobacterium tuberculosis H37Rv
agcagggccggcaccgcagcgg

SEQ ID NO: 1366936 - RNA, 18 nt, Mycobacterium tuberculosis H37Rv
agcaggggacgggcggcc

SEQ ID NO: 1366937 - RNA, 21 nt, Mycobacterium tuberculosis H37Rv
agcagguaggcgcgauacaga

SEQ ID NO: 1366938 - RNA, 23 nt, Mycobacterium tuberculosis H37Rv
agcagcugaaaauaggccgggca

SEQ ID NO: 1366939 - RNA, 22 nt, Mycobacterium tuberculosis H37Rv
agcagcugcgauauggucacca

SEQ ID NO: 1366940 - RNA, 15 nt, Mycobacterium tuberculosis H37Rv
agcagcuugacccac

SEQ ID NO: 1366941 - RNA, 23 nt, Mycobacterium tuberculosis H37Rv
agcaggaaaaagggcuuccaggg

SEQ ID NO: 1366942 - RNA, 22 nt, Mycobacterium tuberculosis H37Rv
agcaguuuccguaguaccaaag

SEQ ID NO: 1366943 - RNA, 17 nt, Mycobacterium tuberculosis H37Rv
agcaggugaaacaggac

SEQ ID NO: 1366944 - RNA, 15 nt, Mycobacterium tuberculosis H37Rv
agcaggucgccugcc

SEQ ID NO: 1366945 - RNA, 17 nt, Mycobacterium tuberculosis H37Rv
agcaggugauguucagc

SEQ ID NO: 1366946 - RNA, 15 nt, Mycobacterium tuberculosis H37Rv
agcagguccgccacc

SEQ ID NO: 1366947 - RNA, 23 nt, Mycobacterium tuberculosis H37Rv
agcaguucggcgaugcgcgggug

SEQ ID NO: 1366948 - RNA, 20 nt, Mycobacterium tuberculosis H37Rv
agcaucaacgaaccagcuug

SEQ ID NO: 1366949 - RNA, 21 nt, Mycobacterium tuberculosis H37Rv
agcauccgcccgagccgggga

SEQ ID NO: 1366950 - RNA, 14 nt, Mycobacterium tuberculosis H37Rv
agccacucggcccg

SEQ ID NO: 1366951 - RNA, 14 nt, Mycobacterium tuberculosis H37Rv
agccacucgcgcac

SEQ ID NO: 1366952 - RNA, 13 nt, Mycobacterium tuberculosis H37Rv
agccacuccucgg

SEQ ID NO: 1366953 - RNA, 20 nt, Mycobacterium tuberculosis H37Rv
agccagcaucggcagcagcg

SEQ ID NO: 1366954 - RNA, 17 nt, Mycobacterium tuberculosis H37Rv
agcaugucgacggucag

SEQ ID NO: 1366955 - RNA, 22 nt, Mycobacterium tuberculosis H37Rv
agcaucucggcggccaacagca

SEQ ID NO: 1366956 - RNA, 21 nt, Mycobacterium tuberculosis H37Rv
agcauggcuuuugcgccgaau

SEQ ID NO: 1366957 - RNA, 16 nt, Mycobacterium tuberculosis H37Rv
agcaucucggcggcca

SEQ ID NO: 1366958 - RNA, 19 nt, Mycobacterium tuberculosis H37Rv
agcauugaguucggccacc

SEQ ID NO: 1366959 - RNA, 16 nt, Mycobacterium tuberculosis H37Rv
agcauugaagaagccc

SEQ ID NO: 1366960 - RNA, 20 nt, Mycobacterium tuberculosis H37Rv
agcauugaccaauccacuga

SEQ ID NO: 1366961 - RNA, 15 nt, Mycobacterium tuberculosis H37Rv
agcauugucgccgga

SEQ ID NO: 1366962 - RNA, 22 nt, Mycobacterium tuberculosis H37Rv
agccgauccaggagugauucgg

SEQ ID NO: 1366963 - RNA, 20 nt, Mycobacterium tuberculosis H37Rv
agccgaucgucucggccacg

SEQ ID NO: 1366964 - RNA, 17 nt, Mycobacterium tuberculosis H37Rv
agccgauauaccagggc

SEQ ID NO: 1366965 - RNA, 14 nt, Mycobacterium tuberculosis H37Rv
agccgauccagcag

SEQ ID NO: 1366966 - RNA, 14 nt, Mycobacterium tuberculosis H37Rv
agccgaucgagcag

SEQ ID NO: 1366967 - RNA, 15 nt, Mycobacterium tuberculosis H37Rv
agccgaucgcccgcu

SEQ ID NO: 1366968 - RNA, 20 nt, Mycobacterium tuberculosis H37Rv
agccgaucaucaccggcaua

SEQ ID NO: 1366969 - RNA, 23 nt, Mycobacterium tuberculosis H37Rv
agccgauuuuuccacaccagcuu

SEQ ID NO: 1366970 - RNA, 18 nt, Mycobacterium tuberculosis H37Rv
agccgcaccagaucgucg

SEQ ID NO: 1366971 - RNA, 15 nt, Mycobacterium tuberculosis H37Rv
agccgcaccccgccc

SEQ ID NO: 1366972 - RNA, 14 nt, Mycobacterium tuberculosis H37Rv
agccgaacgacagc

SEQ ID NO: 1366973 - RNA, 14 nt, Mycobacterium tuberculosis H37Rv
agccgaacccaagg

SEQ ID NO: 1366974 - RNA, 15 nt, Mycobacterium tuberculosis H37Rv
agccgaagaaccggu

SEQ ID NO: 1366975 - RNA, 14 nt, Mycobacterium tuberculosis H37Rv
agccgaccagcgcu

SEQ ID NO: 1366976 - RNA, 13 nt, Mycobacterium tuberculosis H37Rv
agccgaccaggac

SEQ ID NO: 1366977 - RNA, 15 nt, Mycobacterium tuberculosis H37Rv
agcccuccgagcaca

SEQ ID NO: 1366978 - RNA, 13 nt, Mycobacterium tuberculosis H37Rv
agcccuccagggc

SEQ ID NO: 1366979 - RNA, 14 nt, Mycobacterium tuberculosis H37Rv
agcccuccgagcac

SEQ ID NO: 1366980 - RNA, 14 nt, Mycobacterium tuberculosis H37Rv
agcccuaucagccg

SEQ ID NO: 1366981 - RNA, 18 nt, Mycobacterium tuberculosis H37Rv
agcccggccuugccgccg

SEQ ID NO: 1366982 - RNA, 15 nt, Mycobacterium tuberculosis H37Rv
agcccguugggcucu

SEQ ID NO: 1366983 - RNA, 21 nt, Mycobacterium tuberculosis H37Rv
agcccggacguaggcaccccg

SEQ ID NO: 1366984 - RNA, 23 nt, Mycobacterium tuberculosis H37Rv
agcccggacgcgcggauggccuc

SEQ ID NO: 1366985 - RNA, 20 nt, Mycobacterium tuberculosis H37Rv
agcccggccucggcgagcac

SEQ ID NO: 1366986 - RNA, 16 nt, Mycobacterium tuberculosis H37Rv
agcccggccgccgagg

SEQ ID NO: 1366987 - RNA, 17 nt, Mycobacterium tuberculosis H37Rv
agccaggcggcaaggac

SEQ ID NO: 1366988 - RNA, 13 nt, Mycobacterium tuberculosis H37Rv
agccagccugcug

SEQ ID NO: 1366989 - RNA, 19 nt, Mycobacterium tuberculosis H37Rv
agccaggccuuggugcggc

SEQ ID NO: 1366990 - RNA, 16 nt, Mycobacterium tuberculosis H37Rv
agcccgcuggccuccu

SEQ ID NO: 1366991 - RNA, 23 nt, Mycobacterium tuberculosis H37Rv
agcccgcguucaggaugccagga

SEQ ID NO: 1366992 - RNA, 22 nt, Mycobacterium tuberculosis H37Rv
agccgcggggcccacaccgagu

SEQ ID NO: 1366993 - RNA, 21 nt, Mycobacterium tuberculosis H37Rv
agccgcggcuaggccagcacg

SEQ ID NO: 1366994 - RNA, 23 nt, Mycobacterium tuberculosis H37Rv
agccgcggucggcgugcaggguc

SEQ ID NO: 1366995 - RNA, 14 nt, Mycobacterium tuberculosis H37Rv
agccgcggccacgg

SEQ ID NO: 1366996 - RNA, 22 nt, Mycobacterium tuberculosis H37Rv
agccgcgcgggucacgaccugc

SEQ ID NO: 1366997 - RNA, 19 nt, Mycobacterium tuberculosis H37Rv
agccgcggcaccgccgagc

SEQ ID NO: 1366998 - RNA, 13 nt, Mycobacterium tuberculosis H37Rv
agccgcggccaca

SEQ ID NO: 1366999 - RNA, 22 nt, Mycobacterium tuberculosis H37Rv
agccgcggccacaaugcggccg

SEQ ID NO: 1367000 - RNA, 17 nt, Mycobacterium tuberculosis H37Rv
agccgcgcgccggccau

SEQ ID NO: 1367001 - RNA, 15 nt, Mycobacterium tuberculosis H37Rv
agccgcgaccgcagc

SEQ ID NO: 1367002 - RNA, 17 nt, Mycobacterium tuberculosis H37Rv
agccgccguugccgccg

SEQ ID NO: 1367003 - RNA, 19 nt, Mycobacterium tuberculosis H37Rv
agccgcgaaaucaccgcug

SEQ ID NO: 1367004 - RNA, 18 nt, Mycobacterium tuberculosis H37Rv
agccgcccaagccgccgg

SEQ ID NO: 1367005 - RNA, 15 nt, Mycobacterium tuberculosis H37Rv
agccgcccgcccacc

SEQ ID NO: 1367006 - RNA, 17 nt, Mycobacterium tuberculosis H37Rv
agccgcccgcccaccuc

SEQ ID NO: 1367007 - RNA, 17 nt, Mycobacterium tuberculosis H37Rv
agccgccgacucggcac

SEQ ID NO: 1367008 - RNA, 20 nt, Mycobacterium tuberculosis H37Rv
agccgcgucgucggccccac

SEQ ID NO: 1367009 - RNA, 21 nt, Mycobacterium tuberculosis H37Rv
agccgcgugggccgcugcaua

SEQ ID NO: 1367010 - RNA, 17 nt, Mycobacterium tuberculosis H37Rv
agccgcucgauggccug

SEQ ID NO: 1367011 - RNA, 13 nt, Mycobacterium tuberculosis H37Rv
agccgcugccaca

SEQ ID NO: 1367012 - RNA, 21 nt, Mycobacterium tuberculosis H37Rv
agccgcugccacaggugaccu

SEQ ID NO: 1367013 - RNA, 20 nt, Mycobacterium tuberculosis H37Rv
agccgcugccuggccgggac

SEQ ID NO: 1367014 - RNA, 11 nt, Mycobacterium tuberculosis H37Rv
agccgcugcac

SEQ ID NO: 1367015 - RNA, 17 nt, Mycobacterium tuberculosis H37Rv
agccgcugcacguggcc

SEQ ID NO: 1367016 - RNA, 12 nt, Mycobacterium tuberculosis H37Rv
agccggccaccu

SEQ ID NO: 1367017 - RNA, 19 nt, Mycobacterium tuberculosis H37Rv
agccggaacagugccaccu

SEQ ID NO: 1367018 - RNA, 14 nt, Mycobacterium tuberculosis H37Rv
agccggcgcccgcc

SEQ ID NO: 1367019 - RNA, 21 nt, Mycobacterium tuberculosis H37Rv
agccggcgaagugcuccaccu

SEQ ID NO: 1367020 - RNA, 18 nt, Mycobacterium tuberculosis H37Rv
agccggccauacgcgcgc

SEQ ID NO: 1367021 - RNA, 14 nt, Mycobacterium tuberculosis H37Rv
agccggcagcagcg

SEQ ID NO: 1367022 - RNA, 21 nt, Mycobacterium tuberculosis H37Rv
agccggcauagcggcccaucg

SEQ ID NO: 1367023 - RNA, 17 nt, Mycobacterium tuberculosis H37Rv
agccggacguucuggau

SEQ ID NO: 1367024 - RNA, 14 nt, Mycobacterium tuberculosis H37Rv
agccggaugcggcc

SEQ ID NO: 1367025 - RNA, 17 nt, Mycobacterium tuberculosis H37Rv
agccuaguacgccgagc

SEQ ID NO: 1367026 - RNA, 16 nt, Mycobacterium tuberculosis H37Rv
agccuccaccaggucg

SEQ ID NO: 1367027 - RNA, 21 nt, Mycobacterium tuberculosis H37Rv
agccucggcaugcagccccac

SEQ ID NO: 1367028 - RNA, 20 nt, Mycobacterium tuberculosis H37Rv
agccucggccaucugcucgu

SEQ ID NO: 1367029 - RNA, 22 nt, Mycobacterium tuberculosis H37Rv
agccucggccaucugcucgugg

SEQ ID NO: 1367030 - RNA, 18 nt, Mycobacterium tuberculosis H37Rv
agccucggcaugcagccc

SEQ ID NO: 1367031 - RNA, 17 nt, Mycobacterium tuberculosis H37Rv
agccucggcaugcagcc

SEQ ID NO: 1367032 - RNA, 13 nt, Mycobacterium tuberculosis H37Rv
agccucuugguca

SEQ ID NO: 1367033 - RNA, 23 nt, Mycobacterium tuberculosis H37Rv
agccucucuucccaaccgcccgu

SEQ ID NO: 1367034 - RNA, 23 nt, Mycobacterium tuberculosis H37Rv
agccuuacgcgggugaccaacac

SEQ ID NO: 1367035 - RNA, 20 nt, Mycobacterium tuberculosis H37Rv
agcgacagacaaacuccgac

SEQ ID NO: 1367036 - RNA, 21 nt, Mycobacterium tuberculosis H37Rv
agcgaagccagaucgcuagga

SEQ ID NO: 1367037 - RNA, 23 nt, Mycobacterium tuberculosis H37Rv
agcgaacccgcguugaaggcgcc

SEQ ID NO: 1367038 - RNA, 14 nt, Mycobacterium tuberculosis H37Rv
agccuugaucucgu

SEQ ID NO: 1367039 - RNA, 14 nt, Mycobacterium tuberculosis H37Rv
agccggcgugcacu

SEQ ID NO: 1367040 - RNA, 15 nt, Mycobacterium tuberculosis H37Rv
agccggcgugcacuc

SEQ ID NO: 1367041 - RNA, 19 nt, Mycobacterium tuberculosis H37Rv
agccggcgcgccggaugua

SEQ ID NO: 1367042 - RNA, 20 nt, Mycobacterium tuberculosis H37Rv
agccgggcaccacccuugcc

SEQ ID NO: 1367043 - RNA, 14 nt, Mycobacterium tuberculosis H37Rv
agccgggcacccac

SEQ ID NO: 1367044 - RNA, 22 nt, Mycobacterium tuberculosis H37Rv
agccgggccccacaucgccccc

SEQ ID NO: 1367045 - RNA, 12 nt, Mycobacterium tuberculosis H37Rv
agccgggcccca

SEQ ID NO: 1367046 - RNA, 23 nt, Mycobacterium tuberculosis H37Rv
agccggguugccugcgcgagugc

SEQ ID NO: 1367047 - RNA, 17 nt, Mycobacterium tuberculosis H37Rv
agccgggugccacaacc

SEQ ID NO: 1367048 - RNA, 12 nt, Mycobacterium tuberculosis H37Rv
agccggguggac

SEQ ID NO: 1367049 - RNA, 19 nt, Mycobacterium tuberculosis H37Rv
agccgguagaucagcgccu

SEQ ID NO: 1367050 - RNA, 21 nt, Mycobacterium tuberculosis H37Rv
agccgguagaucagcgccugg

SEQ ID NO: 1367051 - RNA, 19 nt, Mycobacterium tuberculosis H37Rv
agccggugccgacggcgcc

SEQ ID NO: 1367052 - RNA, 19 nt, Mycobacterium tuberculosis H37Rv
agccggugagcgagcgcgc

SEQ ID NO: 1367053 - RNA, 19 nt, Mycobacterium tuberculosis H37Rv
agccguccaauuccgcaga

SEQ ID NO: 1367054 - RNA, 19 nt, Mycobacterium tuberculosis H37Rv
agccguagccgccguggau

SEQ ID NO: 1367055 - RNA, 16 nt, Mycobacterium tuberculosis H37Rv
agccguacgguccgaa

SEQ ID NO: 1367056 - RNA, 21 nt, Mycobacterium tuberculosis H37Rv
agccgucaccgcgaccccugg

SEQ ID NO: 1367057 - RNA, 18 nt, Mycobacterium tuberculosis H37Rv
agccgugcccaggccacc

SEQ ID NO: 1367058 - RNA, 14 nt, Mycobacterium tuberculosis H37Rv
agccgugcagcucg

SEQ ID NO: 1367059 - RNA, 18 nt, Mycobacterium tuberculosis H37Rv
agccgucucugacgaaug

SEQ ID NO: 1367060 - RNA, 13 nt, Mycobacterium tuberculosis H37Rv
agccguuguacau

SEQ ID NO: 1367061 - RNA, 18 nt, Mycobacterium tuberculosis H37Rv
agccguuguccaagcccu

SEQ ID NO: 1367062 - RNA, 23 nt, Mycobacterium tuberculosis H37Rv
agccguugccgccacgggcggcc

SEQ ID NO: 1367063 - RNA, 18 nt, Mycobacterium tuberculosis H37Rv
agccgugccguggugaaa

SEQ ID NO: 1367064 - RNA, 14 nt, Mycobacterium tuberculosis H37Rv
agccgugccguggu

SEQ ID NO: 1367065 - RNA, 15 nt, Mycobacterium tuberculosis H37Rv
agccguuugcgcugg

SEQ ID NO: 1367066 - RNA, 12 nt, Mycobacterium tuberculosis H37Rv
agcggcgccgcc

SEQ ID NO: 1367067 - RNA, 15 nt, Mycobacterium tuberculosis H37Rv
agcggcgcgggggug

SEQ ID NO: 1367068 - RNA, 20 nt, Mycobacterium tuberculosis H37Rv
agcggcgcgaccgucuggag

SEQ ID NO: 1367069 - RNA, 16 nt, Mycobacterium tuberculosis H37Rv
agcgggucgccgggcc

SEQ ID NO: 1367070 - RNA, 14 nt, Mycobacterium tuberculosis H37Rv
agcggcgcgggggu

SEQ ID NO: 1367071 - RNA, 16 nt, Mycobacterium tuberculosis H37Rv
agcggguggccaucac

SEQ ID NO: 1367072 - RNA, 14 nt, Mycobacterium tuberculosis H37Rv
agcgggugcgggcg

SEQ ID NO: 1367073 - RNA, 17 nt, Mycobacterium tuberculosis H37Rv
agcggguuugccgggcg

SEQ ID NO: 1367074 - RNA, 20 nt, Mycobacterium tuberculosis H37Rv
agcggguuguggcacccggc

SEQ ID NO: 1367075 - RNA, 17 nt, Mycobacterium tuberculosis H37Rv
agcggcauccacaccga

SEQ ID NO: 1367076 - RNA, 18 nt, Mycobacterium tuberculosis H37Rv
agcggccaccgccgccgc

SEQ ID NO: 1367077 - RNA, 10 nt, Mycobacterium tuberculosis H37Rv
agcggccacc

SEQ ID NO: 1367078 - RNA, 22 nt, Mycobacterium tuberculosis H37Rv
agcggcaucggccagccguucu

SEQ ID NO: 1367079 - RNA, 17 nt, Mycobacterium tuberculosis H37Rv
agcggcgcauaggcggc

SEQ ID NO: 1367080 - RNA, 20 nt, Mycobacterium tuberculosis H37Rv
agcggcgaucggaggcccgc

SEQ ID NO: 1367081 - RNA, 17 nt, Mycobacterium tuberculosis H37Rv
agcggcgaacucgggcg

SEQ ID NO: 1367082 - RNA, 23 nt, Mycobacterium tuberculosis H37Rv
agcggcgaacucgggcgacugga

SEQ ID NO: 1367083 - RNA, 23 nt, Mycobacterium tuberculosis H37Rv
agcggccuccgggccaugugggg

SEQ ID NO: 1367084 - RNA, 16 nt, Mycobacterium tuberculosis H37Rv
agcggccuccagcacc

SEQ ID NO: 1367085 - RNA, 14 nt, Mycobacterium tuberculosis H37Rv
agcggccuccagca

SEQ ID NO: 1367086 - RNA, 21 nt, Mycobacterium tuberculosis H37Rv
agcggccuaggacgccgcccu

SEQ ID NO: 1367087 - RNA, 17 nt, Mycobacterium tuberculosis H37Rv
agcggugccauuguaaa

SEQ ID NO: 1367088 - RNA, 15 nt, Mycobacterium tuberculosis H37Rv
agcggugaugggggu

SEQ ID NO: 1367089 - RNA, 12 nt, Mycobacterium tuberculosis H37Rv
agcgguggacga

SEQ ID NO: 1367090 - RNA, 16 nt, Mycobacterium tuberculosis H37Rv
agcgguggcaagccua

SEQ ID NO: 1367091 - RNA, 19 nt, Mycobacterium tuberculosis H37Rv
agcgguggcccgccggcaa

SEQ ID NO: 1367092 - RNA, 12 nt, Mycobacterium tuberculosis H37Rv
agcggugcuggu

SEQ ID NO: 1367093 - RNA, 23 nt, Mycobacterium tuberculosis H37Rv
agcgguggcgucgucggcgggcu

SEQ ID NO: 1367094 - RNA, 14 nt, Mycobacterium tuberculosis H37Rv
agcgguggcguggu

SEQ ID NO: 1367095 - RNA, 14 nt, Mycobacterium tuberculosis H37Rv
agcguaggccagcg

SEQ ID NO: 1367096 - RNA, 17 nt, Mycobacterium tuberculosis H37Rv
agcguaguaggcagccu

SEQ ID NO: 1367097 - RNA, 19 nt, Mycobacterium tuberculosis H37Rv
agcguacccaacggagugu

SEQ ID NO: 1367098 - RNA, 15 nt, Mycobacterium tuberculosis H37Rv
agcguaugcacauga

SEQ ID NO: 1367099 - RNA, 15 nt, Mycobacterium tuberculosis H37Rv
agcggcagcaccgca

SEQ ID NO: 1367100 - RNA, 22 nt, Mycobacterium tuberculosis H37Rv
agcggcagaugaauugccgggc

SEQ ID NO: 1367101 - RNA, 14 nt, Mycobacterium tuberculosis H37Rv
agcggcaaucgggu

SEQ ID NO: 1367102 - RNA, 23 nt, Mycobacterium tuberculosis H37Rv
agcggcaaggucaacgggaggug

SEQ ID NO: 1367103 - RNA, 12 nt, Mycobacterium tuberculosis H37Rv
agcggcacaccc

SEQ ID NO: 1367104 - RNA, 21 nt, Mycobacterium tuberculosis H37Rv
agcggcaauggccagcaccac

SEQ ID NO: 1367105 - RNA, 18 nt, Mycobacterium tuberculosis H37Rv
agcggcacgaucggcagu

SEQ ID NO: 1367106 - RNA, 24 nt, Mycobacterium tuberculosis H37Rv
agcggcacaucaugggcgcugcca

SEQ ID NO: 1367107 - RNA, 19 nt, Mycobacterium tuberculosis H37Rv
agcggaccaccgcucgcca

SEQ ID NO: 1367108 - RNA, 19 nt, Mycobacterium tuberculosis H37Rv
agcggaccgcugccugccg

SEQ ID NO: 1367109 - RNA, 23 nt, Mycobacterium tuberculosis H37Rv
agcggagccggcgcauaacacaa

SEQ ID NO: 1367110 - RNA, 15 nt, Mycobacterium tuberculosis H37Rv
agcggagacugguug

SEQ ID NO: 1367111 - RNA, 19 nt, Mycobacterium tuberculosis H37Rv
agcggauccgugucgcaga

SEQ ID NO: 1367112 - RNA, 11 nt, Mycobacterium tuberculosis H37Rv
agcggaucugg

SEQ ID NO: 1367113 - RNA, 23 nt, Mycobacterium tuberculosis H37Rv
agcgcuuggucaaaaagcucggc

SEQ ID NO: 1367114 - RNA, 13 nt, Mycobacterium tuberculosis H37Rv
agcgcugcugccg

SEQ ID NO: 1367115 - RNA, 21 nt, Mycobacterium tuberculosis H37Rv
agcgcuggcaggccgggcacc

SEQ ID NO: 1367116 - RNA, 19 nt, Mycobacterium tuberculosis H37Rv
agcgcuggcaggccgggca

SEQ ID NO: 1367117 - RNA, 13 nt, Mycobacterium tuberculosis H37Rv
agcgcuccagcac

SEQ ID NO: 1367118 - RNA, 21 nt, Mycobacterium tuberculosis H37Rv
agcgcugucguaccgcggauc

SEQ ID NO: 1367119 - RNA, 16 nt, Mycobacterium tuberculosis H37Rv
agcgcggugccgccac

SEQ ID NO: 1367120 - RNA, 17 nt, Mycobacterium tuberculosis H37Rv
agcgcggcaccagcacc

SEQ ID NO: 1367121 - RNA, 19 nt, Mycobacterium tuberculosis H37Rv
agcgcggcguguacgucga

SEQ ID NO: 1367122 - RNA, 20 nt, Mycobacterium tuberculosis H37Rv
agcgcucgaucacggcggga

SEQ ID NO: 1367123 - RNA, 14 nt, Mycobacterium tuberculosis H37Rv
agcgcucgaucagg

SEQ ID NO: 1367124 - RNA, 15 nt, Mycobacterium tuberculosis H37Rv
agcgcgccacccagc

SEQ ID NO: 1367125 - RNA, 17 nt, Mycobacterium tuberculosis H37Rv
agcgcgccacccagcac

SEQ ID NO: 1367126 - RNA, 19 nt, Mycobacterium tuberculosis H37Rv
agcgcgccaaucgcccagu

SEQ ID NO: 1367127 - RNA, 17 nt, Mycobacterium tuberculosis H37Rv
agcgcgcggagucaagc

SEQ ID NO: 1367128 - RNA, 21 nt, Mycobacterium tuberculosis H37Rv
agcgcggcaaaguuggccgcc

SEQ ID NO: 1367129 - RNA, 19 nt, Mycobacterium tuberculosis H37Rv
agcgcgcuggccagcccgg

SEQ ID NO: 1367130 - RNA, 21 nt, Mycobacterium tuberculosis H37Rv
agcgcgcuggccagcccgguc

SEQ ID NO: 1367131 - RNA, 15 nt, Mycobacterium tuberculosis H37Rv
agcgccgccgcgagc

SEQ ID NO: 1367132 - RNA, 16 nt, Mycobacterium tuberculosis H37Rv
agcgccgccggcaccu

SEQ ID NO: 1367133 - RNA, 11 nt, Mycobacterium tuberculosis H37Rv
agcgccgccgc

SEQ ID NO: 1367134 - RNA, 13 nt, Mycobacterium tuberculosis H37Rv
agcgccgccgagg

SEQ ID NO: 1367135 - RNA, 20 nt, Mycobacterium tuberculosis H37Rv
agcgccgcguggcuggcggc

SEQ ID NO: 1367136 - RNA, 16 nt, Mycobacterium tuberculosis H37Rv
agcgccgcgcuugcga

SEQ ID NO: 1367137 - RNA, 22 nt, Mycobacterium tuberculosis H37Rv
agcgccggauggguggccagca

SEQ ID NO: 1367138 - RNA, 14 nt, Mycobacterium tuberculosis H37Rv
agcgccggccaggc

SEQ ID NO: 1367139 - RNA, 17 nt, Mycobacterium tuberculosis H37Rv
agcgcgaccgucagggu

SEQ ID NO: 1367140 - RNA, 20 nt, Mycobacterium tuberculosis H37Rv
agcgccggccgcggcggccc

SEQ ID NO: 1367141 - RNA, 21 nt, Mycobacterium tuberculosis H37Rv
agcgcgaucugcucgccccau

SEQ ID NO: 1367142 - RNA, 18 nt, Mycobacterium tuberculosis H37Rv
agcgcgaucgggccggcg

SEQ ID NO: 1367143 - RNA, 17 nt, Mycobacterium tuberculosis H37Rv
agcgcgaugcagugcga

SEQ ID NO: 1367144 - RNA, 19 nt, Mycobacterium tuberculosis H37Rv
agcgcgcacacggcuaccc

SEQ ID NO: 1367145 - RNA, 12 nt, Mycobacterium tuberculosis H37Rv
agcgcgagcaga

SEQ ID NO: 1367146 - RNA, 21 nt, Mycobacterium tuberculosis H37Rv
agcgcgagcccgaaccaccgc

SEQ ID NO: 1367147 - RNA, 19 nt, Mycobacterium tuberculosis H37Rv
agcgcccggccacuccagu

SEQ ID NO: 1367148 - RNA, 20 nt, Mycobacterium tuberculosis H37Rv
agcgcccggccacuccagua

SEQ ID NO: 1367149 - RNA, 15 nt, Mycobacterium tuberculosis H37Rv
agcgcccggucacgc

SEQ ID NO: 1367150 - RNA, 14 nt, Mycobacterium tuberculosis H37Rv
agcgcccggccacu

SEQ ID NO: 1367151 - RNA, 16 nt, Mycobacterium tuberculosis H37Rv
agcgccccuggcaccu

SEQ ID NO: 1367152 - RNA, 15 nt, Mycobacterium tuberculosis H37Rv
agcgccccggcgcgu

SEQ ID NO: 1367153 - RNA, 15 nt, Mycobacterium tuberculosis H37Rv
agcgccaacccggcg

SEQ ID NO: 1367154 - RNA, 21 nt, Mycobacterium tuberculosis H37Rv
agcgcauuuguugcugcugcc

SEQ ID NO: 1367155 - RNA, 13 nt, Mycobacterium tuberculosis H37Rv
agcgccaaggcga

SEQ ID NO: 1367156 - RNA, 17 nt, Mycobacterium tuberculosis H37Rv
agcgccaccguuugcgc

SEQ ID NO: 1367157 - RNA, 22 nt, Mycobacterium tuberculosis H37Rv
agcgcauuuguugcugcugccg

SEQ ID NO: 1367158 - RNA, 14 nt, Mycobacterium tuberculosis H37Rv
agcgcaggaccuga

SEQ ID NO: 1367159 - RNA, 15 nt, Mycobacterium tuberculosis H37Rv
agcgcagcgccggca

SEQ ID NO: 1367160 - RNA, 16 nt, Mycobacterium tuberculosis H37Rv
agcgcagccugcagcg

SEQ ID NO: 1367161 - RNA, 14 nt, Mycobacterium tuberculosis H37Rv
agcgaccgcugcag

SEQ ID NO: 1367162 - RNA, 18 nt, Mycobacterium tuberculosis H37Rv
agcgaccgucguccagac

SEQ ID NO: 1367163 - RNA, 20 nt, Mycobacterium tuberculosis H37Rv
agcgaccacgucaagaagaa

SEQ ID NO: 1367164 - RNA, 23 nt, Mycobacterium tuberculosis H37Rv
agcgcacggaccaucgccaggcc

SEQ ID NO: 1367165 - RNA, 21 nt, Mycobacterium tuberculosis H37Rv
agcgcacgcugaguccccagg

SEQ ID NO: 1367166 - RNA, 19 nt, Mycobacterium tuberculosis H37Rv
agcgcacgauuucgagcgc

SEQ ID NO: 1367167 - RNA, 16 nt, Mycobacterium tuberculosis H37Rv
agcgcacugaaauggc

SEQ ID NO: 1367168 - RNA, 23 nt, Mycobacterium tuberculosis H37Rv
agcgacgcauaaccggcgcgccc

SEQ ID NO: 1367169 - RNA, 15 nt, Mycobacterium tuberculosis H37Rv
agcgaccuggguuuc

SEQ ID NO: 1367170 - RNA, 17 nt, Mycobacterium tuberculosis H37Rv
agcgacgaagucgcagc

SEQ ID NO: 1367171 - RNA, 15 nt, Mycobacterium tuberculosis H37Rv
agcgacgcacgcagu

SEQ ID NO: 1367172 - RNA, 19 nt, Mycobacterium tuberculosis H37Rv
agcgacgcauaaccggcgc

SEQ ID NO: 1367173 - RNA, 21 nt, Mycobacterium tuberculosis H37Rv
agacccugggguccagcgucc

SEQ ID NO: 1367174 - RNA, 21 nt, Mycobacterium tuberculosis H37Rv
agaccgguuucuucggccagc

SEQ ID NO: 1367175 - RNA, 22 nt, Mycobacterium tuberculosis H37Rv
agaccguuacaccaucaaggac

SEQ ID NO: 1367176 - RNA, 16 nt, Mycobacterium tuberculosis H37Rv
agaccgggcaccagaa

SEQ ID NO: 1367177 - RNA, 15 nt, Mycobacterium tuberculosis H37Rv
agaccgaacagcacc

SEQ ID NO: 1367178 - RNA, 20 nt, Mycobacterium tuberculosis H37Rv
agaccgaacagcaccgaacc

SEQ ID NO: 1367179 - RNA, 22 nt, Mycobacterium tuberculosis H37Rv
agacccaccaccgcaaccaaag

SEQ ID NO: 1367180 - RNA, 13 nt, Mycobacterium tuberculosis H37Rv
agacccaccaccg

SEQ ID NO: 1367181 - RNA, 22 nt, Mycobacterium tuberculosis H37Rv
agaauucguucagcgccagcgc

SEQ ID NO: 1367182 - RNA, 15 nt, Mycobacterium tuberculosis H37Rv
agaccucaacccccu

SEQ ID NO: 1367183 - RNA, 18 nt, Mycobacterium tuberculosis H37Rv
agaccucagccggcggcu

SEQ ID NO: 1367184 - RNA, 11 nt, Mycobacterium tuberculosis H37Rv
agacgagccac

SEQ ID NO: 1367185 - RNA, 21 nt, Mycobacterium tuberculosis H37Rv
agacgacaucgucaucagcgc

SEQ ID NO: 1367186 - RNA, 14 nt, Mycobacterium tuberculosis H37Rv
agacgcugcgcgcc

SEQ ID NO: 1367187 - RNA, 16 nt, Mycobacterium tuberculosis H37Rv
agacgaugacagacau

SEQ ID NO: 1367188 - RNA, 20 nt, Mycobacterium tuberculosis H37Rv
agacucgauaugcagcucgc

SEQ ID NO: 1367189 - RNA, 12 nt, Mycobacterium tuberculosis H37Rv
agacuccagcaa

SEQ ID NO: 1367190 - RNA, 20 nt, Mycobacterium tuberculosis H37Rv
agacuccagcaaggccagca

SEQ ID NO: 1367191 - RNA, 12 nt, Mycobacterium tuberculosis H37Rv
agacggcacccc

SEQ ID NO: 1367192 - RNA, 21 nt, Mycobacterium tuberculosis H37Rv
agacggcucagcgugcgcugg

SEQ ID NO: 1367193 - RNA, 13 nt, Mycobacterium tuberculosis H37Rv
agacggcugccac

SEQ ID NO: 1367194 - RNA, 15 nt, Mycobacterium tuberculosis H37Rv
agacggcaggaauga

SEQ ID NO: 1367195 - RNA, 18 nt, Mycobacterium tuberculosis H37Rv
agacgcuguccaggucug

SEQ ID NO: 1367196 - RNA, 14 nt, Mycobacterium tuberculosis H37Rv
agacugcuggucau

SEQ ID NO: 1367197 - RNA, 18 nt, Mycobacterium tuberculosis H37Rv
agacugggcgcuggaggc

SEQ ID NO: 1367198 - RNA, 19 nt, Mycobacterium tuberculosis H37Rv
agagccccggcaagcgcag

SEQ ID NO: 1367199 - RNA, 21 nt, Mycobacterium tuberculosis H37Rv
agagcucugguuuuacacacc

SEQ ID NO: 1367200 - RNA, 14 nt, Mycobacterium tuberculosis H37Rv
agagccgcugcggc

SEQ ID NO: 1367201 - RNA, 15 nt, Mycobacterium tuberculosis H37Rv
agacuugcugcuccu

SEQ ID NO: 1367202 - RNA, 13 nt, Mycobacterium tuberculosis H37Rv
agacuugccgagu

SEQ ID NO: 1367203 - RNA, 15 nt, Mycobacterium tuberculosis H37Rv
agacuuucgcccagu

SEQ ID NO: 1367204 - RNA, 15 nt, Mycobacterium tuberculosis H37Rv
agaucuucgccgaga

SEQ ID NO: 1367205 - RNA, 13 nt, Mycobacterium tuberculosis H37Rv
agaucuugcagug

SEQ ID NO: 1367206 - RNA, 20 nt, Mycobacterium tuberculosis H37Rv
agaucuugcagugcgccagc

SEQ ID NO: 1367207 - RNA, 22 nt, Mycobacterium tuberculosis H37Rv
agaucucugagcgggcgggccu

SEQ ID NO: 1367208 - RNA, 19 nt, Mycobacterium tuberculosis H37Rv
agaucuccccgaccgcgcc

SEQ ID NO: 1367209 - RNA, 21 nt, Mycobacterium tuberculosis H37Rv
agaucguugccucgucgccgc

SEQ ID NO: 1367210 - RNA, 21 nt, Mycobacterium tuberculosis H37Rv
agaucgcguggaucgcgcuca

SEQ ID NO: 1367211 - RNA, 19 nt, Mycobacterium tuberculosis H37Rv
agaucgcgugccacagcau

SEQ ID NO: 1367212 - RNA, 12 nt, Mycobacterium tuberculosis H37Rv
agaucgccccag

SEQ ID NO: 1367213 - RNA, 17 nt, Mycobacterium tuberculosis H37Rv
agaucgcccgaguugaa

SEQ ID NO: 1367214 - RNA, 12 nt, Mycobacterium tuberculosis H37Rv
agaucgccgagc

SEQ ID NO: 1367215 - RNA, 16 nt, Mycobacterium tuberculosis H37Rv
agaucgccugggggua

SEQ ID NO: 1367216 - RNA, 13 nt, Mycobacterium tuberculosis H37Rv
agaucgcgcccug

SEQ ID NO: 1367217 - RNA, 17 nt, Mycobacterium tuberculosis H37Rv
agaucgcgcccugcgga

SEQ ID NO: 1367218 - RNA, 22 nt, Mycobacterium tuberculosis H37Rv
agaucgcacaccaacaccgcgg

SEQ ID NO: 1367219 - RNA, 16 nt, Mycobacterium tuberculosis H37Rv
agaucgagaucaccuu

SEQ ID NO: 1367220 - RNA, 14 nt, Mycobacterium tuberculosis H37Rv
agauccgguccacc

SEQ ID NO: 1367221 - RNA, 20 nt, Mycobacterium tuberculosis H37Rv
agaugcaccugcgaggugcc

SEQ ID NO: 1367222 - RNA, 21 nt, Mycobacterium tuberculosis H37Rv
agaugcacgucgagcaggcug

SEQ ID NO: 1367223 - RNA, 17 nt, Mycobacterium tuberculosis H37Rv
agaugauuucgccgagc

SEQ ID NO: 1367224 - RNA, 17 nt, Mycobacterium tuberculosis H37Rv
agaucuugugccaggcg

SEQ ID NO: 1367225 - RNA, 13 nt, Mycobacterium tuberculosis H37Rv
agaugaaggugac

SEQ ID NO: 1367226 - RNA, 20 nt, Mycobacterium tuberculosis H37Rv
agaugaucgcgaacaucgcc

SEQ ID NO: 1367227 - RNA, 19 nt, Mycobacterium tuberculosis H37Rv
agauguugcgacggccggc

SEQ ID NO: 1367228 - RNA, 18 nt, Mycobacterium tuberculosis H37Rv
agaugguggucaccacca

SEQ ID NO: 1367229 - RNA, 19 nt, Mycobacterium tuberculosis H37Rv
agauggugguggcccggcu

SEQ ID NO: 1367230 - RNA, 14 nt, Mycobacterium tuberculosis H37Rv
agaugggccuccac

SEQ ID NO: 1367231 - RNA, 13 nt, Mycobacterium tuberculosis H37Rv
agaugggccaccc

SEQ ID NO: 1367232 - RNA, 15 nt, Mycobacterium tuberculosis H37Rv
agauggucgggcggc

SEQ ID NO: 1367233 - RNA, 17 nt, Mycobacterium tuberculosis H37Rv
agagugcucagcgcgcg

SEQ ID NO: 1367234 - RNA, 11 nt, Mycobacterium tuberculosis H37Rv
agagugaaucc

SEQ ID NO: 1367235 - RNA, 18 nt, Mycobacterium tuberculosis H37Rv
agaguccuuaaacgucgu

SEQ ID NO: 1367236 - RNA, 23 nt, Mycobacterium tuberculosis H37Rv
agaguaucgaauccgucccaggu

SEQ ID NO: 1367237 - RNA, 14 nt, Mycobacterium tuberculosis H37Rv
aaaaccacccccac

SEQ ID NO: 1367238 - RNA, 16 nt, Mycobacterium tuberculosis H37Rv
agauaguuuaguccca

SEQ ID NO: 1367239 - RNA, 12 nt, Mycobacterium tuberculosis H37Rv
agauagucgccg

SEQ ID NO: 1367240 - RNA, 14 nt, Mycobacterium tuberculosis H37Rv
agaacaacggcgcg

SEQ ID NO: 1367241 - RNA, 17 nt, Mycobacterium tuberculosis H37Rv
agaacgauguccgcgcg

SEQ ID NO: 1367242 - RNA, 22 nt, Mycobacterium tuberculosis H37Rv
agaacgcaucggucccacugcc

SEQ ID NO: 1367243 - RNA, 18 nt, Mycobacterium tuberculosis H37Rv
agaacgcccgcugcagac

SEQ ID NO: 1367244 - RNA, 15 nt, Mycobacterium tuberculosis H37Rv
agaacgacgccaccg

SEQ ID NO: 1367245 - RNA, 15 nt, Mycobacterium tuberculosis H37Rv
agaagaagcccagga

SEQ ID NO: 1367246 - RNA, 15 nt, Mycobacterium tuberculosis H37Rv
agaagacaccgcgcu

SEQ ID NO: 1367247 - RNA, 18 nt, Mycobacterium tuberculosis H37Rv
agaacggcguugcggaau

SEQ ID NO: 1367248 - RNA, 20 nt, Mycobacterium tuberculosis H37Rv
agaacgucaaacccagcgac

SEQ ID NO: 1367249 - RNA, 22 nt, Mycobacterium tuberculosis H37Rv
agaaacgcgaugguggccgcca

SEQ ID NO: 1367250 - RNA, 15 nt, Mycobacterium tuberculosis H37Rv
agaaaucaaauccuu

SEQ ID NO: 1367251 - RNA, 21 nt, Mycobacterium tuberculosis H37Rv
agaagucgaucgccgaggcag

SEQ ID NO: 1367252 - RNA, 17 nt, Mycobacterium tuberculosis H37Rv
agaagucgcagcgagga

SEQ ID NO: 1367253 - RNA, 19 nt, Mycobacterium tuberculosis H37Rv
agaaguuagccaccuugga

SEQ ID NO: 1367254 - RNA, 15 nt, Mycobacterium tuberculosis H37Rv
agaagccggccacua

SEQ ID NO: 1367255 - RNA, 14 nt, Mycobacterium tuberculosis H37Rv
agaagcccaggacg

SEQ ID NO: 1367256 - RNA, 13 nt, Mycobacterium tuberculosis H37Rv
agaaucagcagca

SEQ ID NO: 1367257 - RNA, 15 nt, Mycobacterium tuberculosis H37Rv
agaaucaggcucgcc

SEQ ID NO: 1367258 - RNA, 14 nt, Mycobacterium tuberculosis H37Rv
agaaucagcagcag

SEQ ID NO: 1367259 - RNA, 14 nt, Mycobacterium tuberculosis H37Rv
agaaucacggucau

SEQ ID NO: 1367260 - RNA, 16 nt, Mycobacterium tuberculosis H37Rv
agaaucucgccgggcu

SEQ ID NO: 1367261 - RNA, 20 nt, Mycobacterium tuberculosis H37Rv
agaaugcugacggugcagga

SEQ ID NO: 1367262 - RNA, 22 nt, Mycobacterium tuberculosis H37Rv
agaauggccgccuugaggcccu

SEQ ID NO: 1367263 - RNA, 17 nt, Mycobacterium tuberculosis H37Rv
acuuguugaccuccucc

SEQ ID NO: 1367264 - RNA, 21 nt, Mycobacterium tuberculosis H37Rv
acuugccgggcaaucgcucug

SEQ ID NO: 1367265 - RNA, 20 nt, Mycobacterium tuberculosis H37Rv
acuugucgcuaugccccgga

SEQ ID NO: 1367266 - RNA, 18 nt, Mycobacterium tuberculosis H37Rv
acuugucggggugcacac

SEQ ID NO: 1367267 - RNA, 14 nt, Mycobacterium tuberculosis H37Rv
acuuggacccggcc

SEQ ID NO: 1367268 - RNA, 18 nt, Mycobacterium tuberculosis H37Rv
acuuggacgacccgggcc

SEQ ID NO: 1367269 - RNA, 23 nt, Mycobacterium tuberculosis H37Rv
acuuggcccccgacggugaacca

SEQ ID NO: 1367270 - RNA, 19 nt, Mycobacterium tuberculosis H37Rv
acuuggcggccagccgcuc

SEQ ID NO: 1367271 - RNA, 22 nt, Mycobacterium tuberculosis H37Rv
acuuggugauccgagaccaugc

SEQ ID NO: 1367272 - RNA, 19 nt, Mycobacterium tuberculosis H37Rv
acuuuuccagugugaacug

SEQ ID NO: 1367273 - RNA, 15 nt, Mycobacterium tuberculosis H37Rv
acuuucgaagaaccg

SEQ ID NO: 1367274 - RNA, 15 nt, Mycobacterium tuberculosis H37Rv
acuuugggucggcga

SEQ ID NO: 1367275 - RNA, 16 nt, Mycobacterium tuberculosis H37Rv
acuuugcgcccggcac

SEQ ID NO: 1367276 - RNA, 13 nt, Mycobacterium tuberculosis H37Rv
acauugugcucgc

SEQ ID NO: 1367277 - RNA, 18 nt, Mycobacterium tuberculosis H37Rv
acauugaccaggugcccg

SEQ ID NO: 1367278 - RNA, 20 nt, Mycobacterium tuberculosis H37Rv
acauucugcagcgucuccuu

SEQ ID NO: 1367279 - RNA, 20 nt, Mycobacterium tuberculosis H37Rv
accaaaccgcuguaaccggu

SEQ ID NO: 1367280 - RNA, 16 nt, Mycobacterium tuberculosis H37Rv
accaaacggauugcuc

SEQ ID NO: 1367281 - RNA, 18 nt, Mycobacterium tuberculosis H37Rv
accaacaccccccccacc

SEQ ID NO: 1367282 - RNA, 20 nt, Mycobacterium tuberculosis H37Rv
accaaagcgacgagcagcaa

SEQ ID NO: 1367283 - RNA, 18 nt, Mycobacterium tuberculosis H37Rv
accaaagcgacgagcagc

SEQ ID NO: 1367284 - RNA, 21 nt, Mycobacterium tuberculosis H37Rv
acaucguugacccggcgaugc

SEQ ID NO: 1367285 - RNA, 18 nt, Mycobacterium tuberculosis H37Rv
acaucgggaucugggcuc

SEQ ID NO: 1367286 - RNA, 17 nt, Mycobacterium tuberculosis H37Rv
acaucugacagcugggu

SEQ ID NO: 1367287 - RNA, 17 nt, Mycobacterium tuberculosis H37Rv
acaucugcccaccgcag

SEQ ID NO: 1367288 - RNA, 23 nt, Mycobacterium tuberculosis H37Rv
acaucuccgcgucggucagcugu

SEQ ID NO: 1367289 - RNA, 15 nt, Mycobacterium tuberculosis H37Rv
acaugucacacccac

SEQ ID NO: 1367290 - RNA, 14 nt, Mycobacterium tuberculosis H37Rv
acaugugucacugu

SEQ ID NO: 1367291 - RNA, 15 nt, Mycobacterium tuberculosis H37Rv
acauguguggcagcc

SEQ ID NO: 1367292 - RNA, 20 nt, Mycobacterium tuberculosis H37Rv
acaugucuaucgugggggac

SEQ ID NO: 1367293 - RNA, 14 nt, Mycobacterium tuberculosis H37Rv
acaugucacaccca

SEQ ID NO: 1367294 - RNA, 16 nt, Mycobacterium tuberculosis H37Rv
acaugcucagucgcuc

SEQ ID NO: 1367295 - RNA, 13 nt, Mycobacterium tuberculosis H37Rv
acaugcgccgaga

SEQ ID NO: 1367296 - RNA, 14 nt, Mycobacterium tuberculosis H37Rv
acaucaccaaaaac

SEQ ID NO: 1367297 - RNA, 13 nt, Mycobacterium tuberculosis H37Rv
acauccgcacugg

SEQ ID NO: 1367298 - RNA, 18 nt, Mycobacterium tuberculosis H37Rv
acauccgcggcaugcaau

SEQ ID NO: 1367299 - RNA, 22 nt, Mycobacterium tuberculosis H37Rv
acauccgcggcaugcaaugcug

SEQ ID NO: 1367300 - RNA, 22 nt, Mycobacterium tuberculosis H37Rv
acauccucgauggaccgccagg

SEQ ID NO: 1367301 - RNA, 22 nt, Mycobacterium tuberculosis H37Rv
acauccugcagcucgggcaggg

SEQ ID NO: 1367302 - RNA, 16 nt, Mycobacterium tuberculosis H37Rv
acauccugcagcucgg

SEQ ID NO: 1367303 - RNA, 14 nt, Mycobacterium tuberculosis H37Rv
acaucgggccgccg

SEQ ID NO: 1367304 - RNA, 14 nt, Mycobacterium tuberculosis H37Rv
acaucggcggcguc

SEQ ID NO: 1367305 - RNA, 23 nt, Mycobacterium tuberculosis H37Rv
acaucgguggcgccgaacgccag

SEQ ID NO: 1367306 - RNA, 14 nt, Mycobacterium tuberculosis H37Rv
acaggugccagacc

SEQ ID NO: 1367307 - RNA, 21 nt, Mycobacterium tuberculosis H37Rv
acagguguuggacgccuugca

SEQ ID NO: 1367308 - RNA, 14 nt, Mycobacterium tuberculosis H37Rv
acaggucagcgcug

SEQ ID NO: 1367309 - RNA, 13 nt, Mycobacterium tuberculosis H37Rv
acagguccggguu

SEQ ID NO: 1367310 - RNA, 19 nt, Mycobacterium tuberculosis H37Rv
acaggucgccggggccgcu

SEQ ID NO: 1367311 - RNA, 22 nt, Mycobacterium tuberculosis H37Rv
acagggugggggcaucaggguc

SEQ ID NO: 1367312 - RNA, 19 nt, Mycobacterium tuberculosis H37Rv
acagucgcagcacggcuuc

SEQ ID NO: 1367313 - RNA, 21 nt, Mycobacterium tuberculosis H37Rv
acagucgcagucgcuaagacu

SEQ ID NO: 1367314 - RNA, 15 nt, Mycobacterium tuberculosis H37Rv
acagucggugcagcg

SEQ ID NO: 1367315 - RNA, 23 nt, Mycobacterium tuberculosis H37Rv
acagucggugcagcgcacgcagc

SEQ ID NO: 1367316 - RNA, 14 nt, Mycobacterium tuberculosis H37Rv
acaguucugccuua

SEQ ID NO: 1367317 - RNA, 21 nt, Mycobacterium tuberculosis H37Rv
acagugcgcggaucaacaggc

SEQ ID NO: 1367318 - RNA, 21 nt, Mycobacterium tuberculosis H37Rv
acagugucgauagcccgccac

SEQ ID NO: 1367319 - RNA, 20 nt, Mycobacterium tuberculosis H37Rv
acagugaccugggcgcccca

SEQ ID NO: 1367320 - RNA, 15 nt, Mycobacterium tuberculosis H37Rv
acagcgccaugcccu

SEQ ID NO: 1367321 - RNA, 14 nt, Mycobacterium tuberculosis H37Rv
acagcgacgagauc

SEQ ID NO: 1367322 - RNA, 18 nt, Mycobacterium tuberculosis H37Rv
acagcgaaccggcugggc

SEQ ID NO: 1367323 - RNA, 23 nt, Mycobacterium tuberculosis H37Rv
acagcgaacagacaugcgcacca

SEQ ID NO: 1367324 - RNA, 22 nt, Mycobacterium tuberculosis H37Rv
acagcucacgcugaagccgcug

SEQ ID NO: 1367325 - RNA, 21 nt, Mycobacterium tuberculosis H37Rv
acagcuaucccaggggcaccg

SEQ ID NO: 1367326 - RNA, 23 nt, Mycobacterium tuberculosis H37Rv
acagcuuggacgugguguaucga

SEQ ID NO: 1367327 - RNA, 16 nt, Mycobacterium tuberculosis H37Rv
acaggcgcccacaaau

SEQ ID NO: 1367328 - RNA, 20 nt, Mycobacterium tuberculosis H37Rv
acaggcugccauuccagauc

SEQ ID NO: 1367329 - RNA, 19 nt, Mycobacterium tuberculosis H37Rv
acaggcuugacugcacacc

SEQ ID NO: 1367330 - RNA, 13 nt, Mycobacterium tuberculosis H37Rv
acaggcuuggcau

SEQ ID NO: 1367331 - RNA, 15 nt, Mycobacterium tuberculosis H37Rv
acagcagcccgcccu

SEQ ID NO: 1367332 - RNA, 16 nt, Mycobacterium tuberculosis H37Rv
acagcagguugccgaa

SEQ ID NO: 1367333 - RNA, 17 nt, Mycobacterium tuberculosis H37Rv
acagccacgcacaauac

SEQ ID NO: 1367334 - RNA, 15 nt, Mycobacterium tuberculosis H37Rv
acagccaguguugca

SEQ ID NO: 1367335 - RNA, 13 nt, Mycobacterium tuberculosis H37Rv
acacgucgagcag

SEQ ID NO: 1367336 - RNA, 14 nt, Mycobacterium tuberculosis H37Rv
acacgugggugauc

SEQ ID NO: 1367337 - RNA, 23 nt, Mycobacterium tuberculosis H37Rv
acacgucgcggguaaccggcucc

SEQ ID NO: 1367338 - RNA, 20 nt, Mycobacterium tuberculosis H37Rv
acacgucgcgguaggcggga

SEQ ID NO: 1367339 - RNA, 12 nt, Mycobacterium tuberculosis H37Rv
acacgucggcca

SEQ ID NO: 1367340 - RNA, 22 nt, Mycobacterium tuberculosis H37Rv
acagcacagcgcagccugcagc

SEQ ID NO: 1367341 - RNA, 14 nt, Mycobacterium tuberculosis H37Rv
acaaugccagcugu

SEQ ID NO: 1367342 - RNA, 13 nt, Mycobacterium tuberculosis H37Rv
acaauucccuugu

SEQ ID NO: 1367343 - RNA, 18 nt, Mycobacterium tuberculosis H37Rv
acaaucacauagccgguc

SEQ ID NO: 1367344 - RNA, 15 nt, Mycobacterium tuberculosis H37Rv
acaaguuuauggucu

SEQ ID NO: 1367345 - RNA, 13 nt, Mycobacterium tuberculosis H37Rv
acaacgacacgcc

SEQ ID NO: 1367346 - RNA, 13 nt, Mycobacterium tuberculosis H37Rv
acaacgcccacca

SEQ ID NO: 1367347 - RNA, 14 nt, Mycobacterium tuberculosis H37Rv
acaacgcccaccac

SEQ ID NO: 1367348 - RNA, 24 nt, Mycobacterium tuberculosis H37Rv
acaagcggcccgcuguggucuuca

SEQ ID NO: 1367349 - RNA, 17 nt, Mycobacterium tuberculosis H37Rv
acaagcgauggcaccac

SEQ ID NO: 1367350 - RNA, 18 nt, Mycobacterium tuberculosis H37Rv
acaccucgggguuacguu

SEQ ID NO: 1367351 - RNA, 23 nt, Mycobacterium tuberculosis H37Rv
acaccuguaguucgaugacugaa

SEQ ID NO: 1367352 - RNA, 21 nt, Mycobacterium tuberculosis H37Rv
acaccugcggcgucaaaucca

SEQ ID NO: 1367353 - RNA, 12 nt, Mycobacterium tuberculosis H37Rv
acaccugcggcu

SEQ ID NO: 1367354 - RNA, 23 nt, Mycobacterium tuberculosis H37Rv
acaccuuggccgccggccgcgca

SEQ ID NO: 1367355 - RNA, 14 nt, Mycobacterium tuberculosis H37Rv
acaccuuucuccac

SEQ ID NO: 1367356 - RNA, 18 nt, Mycobacterium tuberculosis H37Rv
acaccuuggcggucggca

SEQ ID NO: 1367357 - RNA, 13 nt, Mycobacterium tuberculosis H37Rv
acacgaacgcugc

SEQ ID NO: 1367358 - RNA, 16 nt, Mycobacterium tuberculosis H37Rv
acaccgugucgccggc

SEQ ID NO: 1367359 - RNA, 19 nt, Mycobacterium tuberculosis H37Rv
acaccgugaccgccgcgcc

SEQ ID NO: 1367360 - RNA, 16 nt, Mycobacterium tuberculosis H37Rv
acaccgugcgccgaau

SEQ ID NO: 1367361 - RNA, 20 nt, Mycobacterium tuberculosis H37Rv
acaccgguuucugguguuuc

SEQ ID NO: 1367362 - RNA, 18 nt, Mycobacterium tuberculosis H37Rv
acaccgucggcagcagcg

SEQ ID NO: 1367363 - RNA, 24 nt, Mycobacterium tuberculosis H37Rv
acaccggccugcgcgaccgaccag

SEQ ID NO: 1367364 - RNA, 14 nt, Mycobacterium tuberculosis H37Rv
acaccggggcggcc

SEQ ID NO: 1367365 - RNA, 17 nt, Mycobacterium tuberculosis H37Rv
acaccggcuuugcuugc

SEQ ID NO: 1367366 - RNA, 20 nt, Mycobacterium tuberculosis H37Rv
acacgcccuaacccugcccu

SEQ ID NO: 1367367 - RNA, 13 nt, Mycobacterium tuberculosis H37Rv
acacggccuugcc

SEQ ID NO: 1367368 - RNA, 17 nt, Mycobacterium tuberculosis H37Rv
acacggcggcccgcucg

SEQ ID NO: 1367369 - RNA, 23 nt, Mycobacterium tuberculosis H37Rv
acacggcgucuuccucggccacc

SEQ ID NO: 1367370 - RNA, 18 nt, Mycobacterium tuberculosis H37Rv
acacgccgaacgugcaac

SEQ ID NO: 1367371 - RNA, 13 nt, Mycobacterium tuberculosis H37Rv
acacgccgccggu

SEQ ID NO: 1367372 - RNA, 18 nt, Mycobacterium tuberculosis H37Rv
acacaacgaucugcuggc

SEQ ID NO: 1367373 - RNA, 23 nt, Mycobacterium tuberculosis H37Rv
acacaacgacgaauaaguacucu

SEQ ID NO: 1367374 - RNA, 19 nt, Mycobacterium tuberculosis H37Rv
acaccgcgcccgccgaucc

SEQ ID NO: 1367375 - RNA, 17 nt, Mycobacterium tuberculosis H37Rv
acaccgcgcccgccgau

SEQ ID NO: 1367376 - RNA, 16 nt, Mycobacterium tuberculosis H37Rv
acaccgcggcaagagu

SEQ ID NO: 1367377 - RNA, 21 nt, Mycobacterium tuberculosis H37Rv
acaccgcgccgacgaaaucgu

SEQ ID NO: 1367378 - RNA, 17 nt, Mycobacterium tuberculosis H37Rv
acaccgcggcggcgcgu

SEQ ID NO: 1367379 - RNA, 14 nt, Mycobacterium tuberculosis H37Rv
acaccgaguuccuc

SEQ ID NO: 1367380 - RNA, 22 nt, Mycobacterium tuberculosis H37Rv
acaccgccgccaagcucggcca

SEQ ID NO: 1367381 - RNA, 14 nt, Mycobacterium tuberculosis H37Rv
acaccgccagcaga

SEQ ID NO: 1367382 - RNA, 15 nt, Mycobacterium tuberculosis H37Rv
acaccgagcaccucg

SEQ ID NO: 1367383 - RNA, 19 nt, Mycobacterium tuberculosis H37Rv
acaccccggccuugccacc

SEQ ID NO: 1367384 - RNA, 15 nt, Mycobacterium tuberculosis H37Rv
acacccagcgugccc

SEQ ID NO: 1367385 - RNA, 23 nt, Mycobacterium tuberculosis H37Rv
acacccacgugcugccuuugcga

SEQ ID NO: 1367386 - RNA, 15 nt, Mycobacterium tuberculosis H37Rv
acacccacuggacca

SEQ ID NO: 1367387 - RNA, 21 nt, Mycobacterium tuberculosis H37Rv
acacccauuacugagcuucca

SEQ ID NO: 1367388 - RNA, 19 nt, Mycobacterium tuberculosis H37Rv
acacccaaaccggcccgca

SEQ ID NO: 1367389 - RNA, 14 nt, Mycobacterium tuberculosis H37Rv
acaccaacccaccc

SEQ ID NO: 1367390 - RNA, 21 nt, Mycobacterium tuberculosis H37Rv
acaacagccgcucgcacagcc

SEQ ID NO: 1367391 - RNA, 12 nt, Mycobacterium tuberculosis H37Rv
acaacaacacgg

SEQ ID NO: 1367392 - RNA, 18 nt, Mycobacterium tuberculosis H37Rv
acaaccgugagcaccagc

SEQ ID NO: 1367393 - RNA, 16 nt, Mycobacterium tuberculosis H37Rv
acaaccgcugcugcug

SEQ ID NO: 1367394 - RNA, 15 nt, Mycobacterium tuberculosis H37Rv
acaaccgcugcugcu

SEQ ID NO: 1367395 - RNA, 23 nt, Mycobacterium tuberculosis H37Rv
acaacccggcgucgacgauuccc

SEQ ID NO: 1367396 - RNA, 10 nt, Mycobacterium tuberculosis H37Rv
acaacaugcu

SEQ ID NO: 1367397 - RNA, 14 nt, Mycobacterium tuberculosis H37Rv
acaaccacccaccc

SEQ ID NO: 1367398 - RNA, 13 nt, Mycobacterium tuberculosis H37Rv
acaaccacccacc

SEQ ID NO: 1367399 - RNA, 21 nt, Mycobacterium tuberculosis H37Rv
acaaagguaccgcuggaaaau

SEQ ID NO: 1367400 - RNA, 21 nt, Mycobacterium tuberculosis H37Rv
acaaaguucgacgagaagaca

SEQ ID NO: 1367401 - RNA, 14 nt, Mycobacterium tuberculosis H37Rv
acaaagcugcucgu

SEQ ID NO: 1367402 - RNA, 12 nt, Mycobacterium tuberculosis H37Rv
acaaagauugcc

SEQ ID NO: 1367403 - RNA, 12 nt, Mycobacterium tuberculosis H37Rv
acaaagaagugg

SEQ ID NO: 1367404 - RNA, 15 nt, Mycobacterium tuberculosis H37Rv
acaaacccgaugacu

SEQ ID NO: 1367405 - RNA, 17 nt, Mycobacterium tuberculosis H37Rv
acaaacggcgacccagc

SEQ ID NO: 1367406 - RNA, 21 nt, Mycobacterium tuberculosis H37Rv
acaaacggcuuggcugccucc

SEQ ID NO: 1367407 - RNA, 15 nt, Mycobacterium tuberculosis H37Rv
acaaacggcgaccca

SEQ ID NO: 1367408 - RNA, 17 nt, Mycobacterium tuberculosis H37Rv
acaaaccugcaugccca

SEQ ID NO: 1367409 - RNA, 23 nt, Mycobacterium tuberculosis H37Rv
acaaacaucgcacccaccacacc

SEQ ID NO: 1367410 - RNA, 14 nt, Mycobacterium tuberculosis H37Rv
acaaaaucagcagc

SEQ ID NO: 1367411 - RNA, 15 nt, Mycobacterium tuberculosis H37Rv
aauggccgccgcagc

SEQ ID NO: 1367412 - RNA, 14 nt, Mycobacterium tuberculosis H37Rv
aauggccugcagcg

SEQ ID NO: 1367413 - RNA, 15 nt, Mycobacterium tuberculosis H37Rv
aauggacugaacacc

SEQ ID NO: 1367414 - RNA, 16 nt, Mycobacterium tuberculosis H37Rv
aauggacugaacacca

SEQ ID NO: 1367415 - RNA, 23 nt, Mycobacterium tuberculosis H37Rv
aaugcuguggcccgucauacucg

SEQ ID NO: 1367416 - RNA, 18 nt, Mycobacterium tuberculosis H37Rv
aaugcgccaauagcaacu

SEQ ID NO: 1367417 - RNA, 19 nt, Mycobacterium tuberculosis H37Rv
aaugcacaccgggcaccag

SEQ ID NO: 1367418 - RNA, 16 nt, Mycobacterium tuberculosis H37Rv
aaugucgcucaaaccc

SEQ ID NO: 1367419 - RNA, 18 nt, Mycobacterium tuberculosis H37Rv
aaugucgauuucgaugac

SEQ ID NO: 1367420 - RNA, 20 nt, Mycobacterium tuberculosis H37Rv
aaugucagugccccgcccgg

SEQ ID NO: 1367421 - RNA, 14 nt, Mycobacterium tuberculosis H37Rv
aauuccagccagcc

SEQ ID NO: 1367422 - RNA, 15 nt, Mycobacterium tuberculosis H37Rv
aauucgacugcaacu

SEQ ID NO: 1367423 - RNA, 17 nt, Mycobacterium tuberculosis H37Rv
aauucucgcccugacgu

SEQ ID NO: 1367424 - RNA, 13 nt, Mycobacterium tuberculosis H37Rv
aauugcccugacg

SEQ ID NO: 1367425 - RNA, 19 nt, Mycobacterium tuberculosis H37Rv
aauuggucgaacagcgaac

SEQ ID NO: 1367426 - RNA, 17 nt, Mycobacterium tuberculosis H37Rv
aauuggcuugugcccaa

SEQ ID NO: 1367427 - RNA, 17 nt, Mycobacterium tuberculosis H37Rv
aauaugccacagaccga

SEQ ID NO: 1367428 - RNA, 21 nt, Mycobacterium tuberculosis H37Rv
aauaugccacagaccgaacag

SEQ ID NO: 1367429 - RNA, 17 nt, Mycobacterium tuberculosis H37Rv
aauagcccaagccgauc

SEQ ID NO: 1367430 - RNA, 14 nt, Mycobacterium tuberculosis H37Rv
aaucacggucaucu

SEQ ID NO: 1367431 - RNA, 15 nt, Mycobacterium tuberculosis H37Rv
aaucacggucaucuc

SEQ ID NO: 1367432 - RNA, 21 nt, Mycobacterium tuberculosis H37Rv
aaucaaggugaucagcaggau

SEQ ID NO: 1367433 - RNA, 21 nt, Mycobacterium tuberculosis H37Rv
aaucgcacagcgcgaucaacg

SEQ ID NO: 1367434 - RNA, 17 nt, Mycobacterium tuberculosis H37Rv
aaucgcaucuagguuca

SEQ ID NO: 1367435 - RNA, 13 nt, Mycobacterium tuberculosis H37Rv
aaucgugcgggua

SEQ ID NO: 1367436 - RNA, 21 nt, Mycobacterium tuberculosis H37Rv
aaucuaauucgccucgccuga

SEQ ID NO: 1367437 - RNA, 13 nt, Mycobacterium tuberculosis H37Rv
aauccgugcaggg

SEQ ID NO: 1367438 - RNA, 15 nt, Mycobacterium tuberculosis H37Rv
aauccggcugcggua

SEQ ID NO: 1367439 - RNA, 17 nt, Mycobacterium tuberculosis H37Rv
aauccggcgccagcagu

SEQ ID NO: 1367440 - RNA, 22 nt, Mycobacterium tuberculosis H37Rv
aauccgcccuugccgccuuggc

SEQ ID NO: 1367441 - RNA, 16 nt, Mycobacterium tuberculosis H37Rv
aauccgcacagguccg

SEQ ID NO: 1367442 - RNA, 14 nt, Mycobacterium tuberculosis H37Rv
aauccgcaccagcc

SEQ ID NO: 1367443 - RNA, 21 nt, Mycobacterium tuberculosis H37Rv
aaucgaucgaauuaaagccac

SEQ ID NO: 1367444 - RNA, 16 nt, Mycobacterium tuberculosis H37Rv
aauccagcgccgaccu

SEQ ID NO: 1367445 - RNA, 21 nt, Mycobacterium tuberculosis H37Rv
aacaccagcaggcggcucaac

SEQ ID NO: 1367446 - RNA, 20 nt, Mycobacterium tuberculosis H37Rv
aacaccagggccuccacccg

SEQ ID NO: 1367447 - RNA, 22 nt, Mycobacterium tuberculosis H37Rv
aacaccacaccgagcaccugac

SEQ ID NO: 1367448 - RNA, 16 nt, Mycobacterium tuberculosis H37Rv
aacaccguccaauugg

SEQ ID NO: 1367449 - RNA, 16 nt, Mycobacterium tuberculosis H37Rv
aacaccggccagcggc

SEQ ID NO: 1367450 - RNA, 18 nt, Mycobacterium tuberculosis H37Rv
aacaccgucggcagcagc

SEQ ID NO: 1367451 - RNA, 22 nt, Mycobacterium tuberculosis H37Rv
aacacgagcgguacgcccgaau

SEQ ID NO: 1367452 - RNA, 17 nt, Mycobacterium tuberculosis H37Rv
aacacucauuccccgga

SEQ ID NO: 1367453 - RNA, 15 nt, Mycobacterium tuberculosis H37Rv
aacacgccucgccga

SEQ ID NO: 1367454 - RNA, 18 nt, Mycobacterium tuberculosis H37Rv
aacagcagguuggcgagc

SEQ ID NO: 1367455 - RNA, 21 nt, Mycobacterium tuberculosis H37Rv
aacagauucggugccagcagg

SEQ ID NO: 1367456 - RNA, 12 nt, Mycobacterium tuberculosis H37Rv
aacagcaccagu

SEQ ID NO: 1367457 - RNA, 18 nt, Mycobacterium tuberculosis H37Rv
aacacuugucgcuaugcc

SEQ ID NO: 1367458 - RNA, 23 nt, Mycobacterium tuberculosis H37Rv
aacagagucaccgcgcuggucag

SEQ ID NO: 1367459 - RNA, 15 nt, Mycobacterium tuberculosis H37Rv
aacagaguagacaac

SEQ ID NO: 1367460 - RNA, 20 nt, Mycobacterium tuberculosis H37Rv
aacagcgaaccggcugggcg

SEQ ID NO: 1367461 - RNA, 18 nt, Mycobacterium tuberculosis H37Rv
aacagccgagccagcagc

SEQ ID NO: 1367462 - RNA, 12 nt, Mycobacterium tuberculosis H37Rv
aacagccgcagc

SEQ ID NO: 1367463 - RNA, 15 nt, Mycobacterium tuberculosis H37Rv
aacauacgaaacaug

SEQ ID NO: 1367464 - RNA, 23 nt, Mycobacterium tuberculosis H37Rv
aacaucccagcgaaugcugacau

SEQ ID NO: 1367465 - RNA, 19 nt, Mycobacterium tuberculosis H37Rv
aaccaaccucggaucgcca

SEQ ID NO: 1367466 - RNA, 18 nt, Mycobacterium tuberculosis H37Rv
aaccaagaaucaccggca

SEQ ID NO: 1367467 - RNA, 14 nt, Mycobacterium tuberculosis H37Rv
aaccgaauuguugu

SEQ ID NO: 1367468 - RNA, 19 nt, Mycobacterium tuberculosis H37Rv
aaccgagcgcccuccucga

SEQ ID NO: 1367469 - RNA, 13 nt, Mycobacterium tuberculosis H37Rv
aacccucgccggu

SEQ ID NO: 1367470 - RNA, 22 nt, Mycobacterium tuberculosis H37Rv
aacccugcggugcaggauucgg

SEQ ID NO: 1367471 - RNA, 13 nt, Mycobacterium tuberculosis H37Rv
aaccgcggaucga

SEQ ID NO: 1367472 - RNA, 23 nt, Mycobacterium tuberculosis H37Rv
aaccgccaucgucgaagaccuca

SEQ ID NO: 1367473 - RNA, 17 nt, Mycobacterium tuberculosis H37Rv
aaccgccccgugggccu

SEQ ID NO: 1367474 - RNA, 19 nt, Mycobacterium tuberculosis H37Rv
aaccgccccgugggccucg

SEQ ID NO: 1367475 - RNA, 16 nt, Mycobacterium tuberculosis H37Rv
aaccgauugagcccca

SEQ ID NO: 1367476 - RNA, 15 nt, Mycobacterium tuberculosis H37Rv
aaccgcaguucuuga

SEQ ID NO: 1367477 - RNA, 20 nt, Mycobacterium tuberculosis H37Rv
aacccgugcgacuucgagau

SEQ ID NO: 1367478 - RNA, 21 nt, Mycobacterium tuberculosis H37Rv
aacccguauugccaaagcccg

SEQ ID NO: 1367479 - RNA, 15 nt, Mycobacterium tuberculosis H37Rv
aacccguaagacaga

SEQ ID NO: 1367480 - RNA, 14 nt, Mycobacterium tuberculosis H37Rv
aacccgggccgcca

SEQ ID NO: 1367481 - RNA, 23 nt, Mycobacterium tuberculosis H37Rv
aacccgguguuccggucgcccga

SEQ ID NO: 1367482 - RNA, 17 nt, Mycobacterium tuberculosis H37Rv
aacccggcuccagcacc

SEQ ID NO: 1367483 - RNA, 14 nt, Mycobacterium tuberculosis H37Rv
aacccagucccaac

SEQ ID NO: 1367484 - RNA, 12 nt, Mycobacterium tuberculosis H37Rv
aacccagcacug

SEQ ID NO: 1367485 - RNA, 23 nt, Mycobacterium tuberculosis H37Rv
aacccagcgacgcggccagcggc

SEQ ID NO: 1367486 - RNA, 19 nt, Mycobacterium tuberculosis H37Rv
aacccaccgcauuaagggu

SEQ ID NO: 1367487 - RNA, 22 nt, Mycobacterium tuberculosis H37Rv
aaccaucguuguugaccaccac

SEQ ID NO: 1367488 - RNA, 21 nt, Mycobacterium tuberculosis H37Rv
aaccaucguuguugaccacca

SEQ ID NO: 1367489 - RNA, 19 nt, Mycobacterium tuberculosis H37Rv
aaccacuggauggcucgcc

SEQ ID NO: 1367490 - RNA, 17 nt, Mycobacterium tuberculosis H37Rv
aaccacggucagcacgc

SEQ ID NO: 1367491 - RNA, 18 nt, Mycobacterium tuberculosis H37Rv
aaccacggcggcaucacc

SEQ ID NO: 1367492 - RNA, 15 nt, Mycobacterium tuberculosis H37Rv
aaccacgagcaucaa

SEQ ID NO: 1367493 - RNA, 14 nt, Mycobacterium tuberculosis H37Rv
aacgccagcaccag

SEQ ID NO: 1367494 - RNA, 22 nt, Mycobacterium tuberculosis H37Rv
aacgcacccaucgugcugaagc

SEQ ID NO: 1367495 - RNA, 22 nt, Mycobacterium tuberculosis H37Rv
aacgccacggcaucggccaccu

SEQ ID NO: 1367496 - RNA, 19 nt, Mycobacterium tuberculosis H37Rv
aacgcccaacgucgccagg

SEQ ID NO: 1367497 - RNA, 18 nt, Mycobacterium tuberculosis H37Rv
aacgcccguguugaagaa

SEQ ID NO: 1367498 - RNA, 18 nt, Mycobacterium tuberculosis H37Rv
aaccgggcaaaucaagca

SEQ ID NO: 1367499 - RNA, 15 nt, Mycobacterium tuberculosis H37Rv
aaccgggcaaaucaa

SEQ ID NO: 1367500 - RNA, 16 nt, Mycobacterium tuberculosis H37Rv
aaccgggcaaaucaag

SEQ ID NO: 1367501 - RNA, 23 nt, Mycobacterium tuberculosis H37Rv
aacgauggggcaagcccaaaaag

SEQ ID NO: 1367502 - RNA, 22 nt, Mycobacterium tuberculosis H37Rv
aacgauggggcaagcccaaaaa

SEQ ID NO: 1367503 - RNA, 16 nt, Mycobacterium tuberculosis H37Rv
aacgaugccgccggcg

SEQ ID NO: 1367504 - RNA, 15 nt, Mycobacterium tuberculosis H37Rv
aacgaucagucgucu

SEQ ID NO: 1367505 - RNA, 20 nt, Mycobacterium tuberculosis H37Rv
aacgaugguguaacggcggc

SEQ ID NO: 1367506 - RNA, 14 nt, Mycobacterium tuberculosis H37Rv
aacgcugcgcccgg

SEQ ID NO: 1367507 - RNA, 18 nt, Mycobacterium tuberculosis H37Rv
aacgcugggcggcuaccc

SEQ ID NO: 1367508 - RNA, 15 nt, Mycobacterium tuberculosis H37Rv
aacgcuucugccugc

SEQ ID NO: 1367509 - RNA, 15 nt, Mycobacterium tuberculosis H37Rv
aacggaaacucaagu

SEQ ID NO: 1367510 - RNA, 19 nt, Mycobacterium tuberculosis H37Rv
aacgcugacgugaagcaga

SEQ ID NO: 1367511 - RNA, 15 nt, Mycobacterium tuberculosis H37Rv
aacgccgccagcaga

SEQ ID NO: 1367512 - RNA, 12 nt, Mycobacterium tuberculosis H37Rv
aacggucagggc

SEQ ID NO: 1367513 - RNA, 19 nt, Mycobacterium tuberculosis H37Rv
aacgggguggcacgcauga

SEQ ID NO: 1367514 - RNA, 13 nt, Mycobacterium tuberculosis H37Rv
aacgggguggcac

SEQ ID NO: 1367515 - RNA, 18 nt, Mycobacterium tuberculosis H37Rv
aacuacccgcccacggca

SEQ ID NO: 1367516 - RNA, 18 nt, Mycobacterium tuberculosis H37Rv
aacguuuugggcgccgga

SEQ ID NO: 1367517 - RNA, 14 nt, Mycobacterium tuberculosis H37Rv
aacgugccucucuc

SEQ ID NO: 1367518 - RNA, 17 nt, Mycobacterium tuberculosis H37Rv
aacguucggcacaacca

SEQ ID NO: 1367519 - RNA, 14 nt, Mycobacterium tuberculosis H37Rv
aacgucaccgccgg

SEQ ID NO: 1367520 - RNA, 19 nt, Mycobacterium tuberculosis H37Rv
aacguauccccgaccacug

SEQ ID NO: 1367521 - RNA, 21 nt, Mycobacterium tuberculosis H37Rv
aacugcgccguucgcuccccc

SEQ ID NO: 1367522 - RNA, 21 nt, Mycobacterium tuberculosis H37Rv
aacugcggcccaugaucucgg

SEQ ID NO: 1367523 - RNA, 15 nt, Mycobacterium tuberculosis H37Rv
aacugcucgccgagg

SEQ ID NO: 1367524 - RNA, 19 nt, Mycobacterium tuberculosis H37Rv
aacuggacggggaagcccg

SEQ ID NO: 1367525 - RNA, 14 nt, Mycobacterium tuberculosis H37Rv
aacuggaccacagc

SEQ ID NO: 1367526 - RNA, 16 nt, Mycobacterium tuberculosis H37Rv
aacucaacgacaccau

SEQ ID NO: 1367527 - RNA, 14 nt, Mycobacterium tuberculosis H37Rv
aacuucaacuggau

SEQ ID NO: 1367528 - RNA, 15 nt, Mycobacterium tuberculosis H37Rv
aacuugagcuccuca

SEQ ID NO: 1367529 - RNA, 18 nt, Mycobacterium tuberculosis H37Rv
aacugggcggccuggucg

SEQ ID NO: 1367530 - RNA, 13 nt, Mycobacterium tuberculosis H37Rv
aacugggacugca

SEQ ID NO: 1367531 - RNA, 12 nt, Mycobacterium tuberculosis H37Rv
aacuuggcggcc

SEQ ID NO: 1367532 - RNA, 21 nt, Mycobacterium tuberculosis H37Rv
aacuuggcggccagccgcucc

SEQ ID NO: 1367533 - RNA, 13 nt, Mycobacterium tuberculosis H37Rv
aacuugcugacga

SEQ ID NO: 1367534 - RNA, 23 nt, Mycobacterium tuberculosis H37Rv
aagaaagacgcuguccaggucug

SEQ ID NO: 1367535 - RNA, 21 nt, Mycobacterium tuberculosis H37Rv
aagaacaugcucacgaucacc

SEQ ID NO: 1367536 - RNA, 22 nt, Mycobacterium tuberculosis H37Rv
aagaaccgccaccagaccagga

SEQ ID NO: 1367537 - RNA, 12 nt, Mycobacterium tuberculosis H37Rv
aagaaccggcau

SEQ ID NO: 1367538 - RNA, 16 nt, Mycobacterium tuberculosis H37Rv
aagaaccugagcacca

SEQ ID NO: 1367539 - RNA, 20 nt, Mycobacterium tuberculosis H37Rv
aagaagaugaucgcgaacau

SEQ ID NO: 1367540 - RNA, 18 nt, Mycobacterium tuberculosis H37Rv
aagaagcccgaguuguuc

SEQ ID NO: 1367541 - RNA, 14 nt, Mycobacterium tuberculosis H37Rv
aagugggugccggc

SEQ ID NO: 1367542 - RNA, 20 nt, Mycobacterium tuberculosis H37Rv
aaguggucuccggcaccgag

SEQ ID NO: 1367543 - RNA, 13 nt, Mycobacterium tuberculosis H37Rv
aaguuggcuuucg

SEQ ID NO: 1367544 - RNA, 16 nt, Mycobacterium tuberculosis H37Rv
aaguuggcugagcagc

SEQ ID NO: 1367545 - RNA, 18 nt, Mycobacterium tuberculosis H37Rv
aagucuugaccgcaccgg

SEQ ID NO: 1367546 - RNA, 18 nt, Mycobacterium tuberculosis H37Rv
aaguggcgucagugcaga

SEQ ID NO: 1367547 - RNA, 13 nt, Mycobacterium tuberculosis H37Rv
aagugcagggcug

SEQ ID NO: 1367548 - RNA, 11 nt, Mycobacterium tuberculosis H37Rv
aagugcagggc

SEQ ID NO: 1367549 - RNA, 23 nt, Mycobacterium tuberculosis H37Rv
aaguaauagcuguuggccagccg

SEQ ID NO: 1367550 - RNA, 13 nt, Mycobacterium tuberculosis H37Rv
aauacggcggcgc

SEQ ID NO: 1367551 - RNA, 19 nt, Mycobacterium tuberculosis H37Rv
aagauuauggcgagcgcgc

SEQ ID NO: 1367552 - RNA, 15 nt, Mycobacterium tuberculosis H37Rv
aagaugccugcuagc

SEQ ID NO: 1367553 - RNA, 19 nt, Mycobacterium tuberculosis H37Rv
aagaugccugcuagcagca

SEQ ID NO: 1367554 - RNA, 20 nt, Mycobacterium tuberculosis H37Rv
aagaugccugcuagcagcag

SEQ ID NO: 1367555 - RNA, 14 nt, Mycobacterium tuberculosis H37Rv
aagaucuucgccga

SEQ ID NO: 1367556 - RNA, 16 nt, Mycobacterium tuberculosis H37Rv
aagcacaccgccagcg

SEQ ID NO: 1367557 - RNA, 11 nt, Mycobacterium tuberculosis H37Rv
aagcaauucca

SEQ ID NO: 1367558 - RNA, 15 nt, Mycobacterium tuberculosis H37Rv
aagcacagcccggcg

SEQ ID NO: 1367559 - RNA, 13 nt, Mycobacterium tuberculosis H37Rv
aagcacagcccgg

SEQ ID NO: 1367560 - RNA, 17 nt, Mycobacterium tuberculosis H37Rv
aagcaccagccagccug

SEQ ID NO: 1367561 - RNA, 14 nt, Mycobacterium tuberculosis H37Rv
aagcaccagccagc

SEQ ID NO: 1367562 - RNA, 15 nt, Mycobacterium tuberculosis H37Rv
aagcaccagccagcc

SEQ ID NO: 1367563 - RNA, 19 nt, Mycobacterium tuberculosis H37Rv
aagcaagggcgauggucgg

SEQ ID NO: 1367564 - RNA, 17 nt, Mycobacterium tuberculosis H37Rv
aagcaagcguguuguuu

SEQ ID NO: 1367565 - RNA, 12 nt, Mycobacterium tuberculosis H37Rv
aagcagccagca

SEQ ID NO: 1367566 - RNA, 14 nt, Mycobacterium tuberculosis H37Rv
aagcagccagcaac

SEQ ID NO: 1367567 - RNA, 14 nt, Mycobacterium tuberculosis H37Rv
aagcaccgaugcug

SEQ ID NO: 1367568 - RNA, 20 nt, Mycobacterium tuberculosis H37Rv
aagcccagcgauucagccug

SEQ ID NO: 1367569 - RNA, 18 nt, Mycobacterium tuberculosis H37Rv
aagcccauccccgcucga

SEQ ID NO: 1367570 - RNA, 16 nt, Mycobacterium tuberculosis H37Rv
aagcccgagacggugu

SEQ ID NO: 1367571 - RNA, 14 nt, Mycobacterium tuberculosis H37Rv
aagcccuccucgau

SEQ ID NO: 1367572 - RNA, 15 nt, Mycobacterium tuberculosis H37Rv
aagccagcacugcca

SEQ ID NO: 1367573 - RNA, 15 nt, Mycobacterium tuberculosis H37Rv
aagccacucaucuuc

SEQ ID NO: 1367574 - RNA, 22 nt, Mycobacterium tuberculosis H37Rv
aagguugaacgccgccagcaga

SEQ ID NO: 1367575 - RNA, 11 nt, Mycobacterium tuberculosis H37Rv
aaggugcugcg

SEQ ID NO: 1367576 - RNA, 22 nt, Mycobacterium tuberculosis H37Rv
aagguggccaccaaacgcugcu

SEQ ID NO: 1367577 - RNA, 17 nt, Mycobacterium tuberculosis H37Rv
aaggugcgcugggugau

SEQ ID NO: 1367578 - RNA, 14 nt, Mycobacterium tuberculosis H37Rv
aaggugcgccgcca

SEQ ID NO: 1367579 - RNA, 19 nt, Mycobacterium tuberculosis H37Rv
aagguguccuccagcugcg

SEQ ID NO: 1367580 - RNA, 19 nt, Mycobacterium tuberculosis H37Rv
aaggugugcgucuccagcu

SEQ ID NO: 1367581 - RNA, 17 nt, Mycobacterium tuberculosis H37Rv
aaggugaugaacaccgg

SEQ ID NO: 1367582 - RNA, 14 nt, Mycobacterium tuberculosis H37Rv
aaggucggccaggc

SEQ ID NO: 1367583 - RNA, 22 nt, Mycobacterium tuberculosis H37Rv
aaggucgacaugggucggcugu

SEQ ID NO: 1367584 - RNA, 12 nt, Mycobacterium tuberculosis H37Rv
aagguccgugcc

SEQ ID NO: 1367585 - RNA, 20 nt, Mycobacterium tuberculosis H37Rv
aagguccgugccgaugccgg

SEQ ID NO: 1367586 - RNA, 22 nt, Mycobacterium tuberculosis H37Rv
aagguccgugccgaugccggcg

SEQ ID NO: 1367587 - RNA, 17 nt, Mycobacterium tuberculosis H37Rv
aagggucaucgccagcg

SEQ ID NO: 1367588 - RNA, 15 nt, Mycobacterium tuberculosis H37Rv
aagggcaacagugaa

SEQ ID NO: 1367589 - RNA, 24 nt, Mycobacterium tuberculosis H37Rv
aagggcaaccgccccuucccagua

SEQ ID NO: 1367590 - RNA, 15 nt, Mycobacterium tuberculosis H37Rv
aaggcggucaccacc

SEQ ID NO: 1367591 - RNA, 21 nt, Mycobacterium tuberculosis H37Rv
aaggcgacgccgaaaaugccg

SEQ ID NO: 1367592 - RNA, 16 nt, Mycobacterium tuberculosis H37Rv
aaggcaaacaccagcc

SEQ ID NO: 1367593 - RNA, 18 nt, Mycobacterium tuberculosis H37Rv
aagcggaucuggccuugg

SEQ ID NO: 1367594 - RNA, 17 nt, Mycobacterium tuberculosis H37Rv
aagcguacucgugauga

SEQ ID NO: 1367595 - RNA, 12 nt, Mycobacterium tuberculosis H37Rv
aagccgcugaac

SEQ ID NO: 1367596 - RNA, 14 nt, Mycobacterium tuberculosis H37Rv
aagccgcgcugcga

SEQ ID NO: 1367597 - RNA, 23 nt, Mycobacterium tuberculosis H37Rv
aagcgcguuguugucgaucagaa

SEQ ID NO: 1367598 - RNA, 18 nt, Mycobacterium tuberculosis H37Rv
aagccgcccgaguugugg

SEQ ID NO: 1367599 - RNA, 14 nt, Mycobacterium tuberculosis H37Rv
aagccgcaccagau

SEQ ID NO: 1367600 - RNA, 14 nt, Mycobacterium tuberculosis H37Rv
aagccgagcaucag

SEQ ID NO: 1367601 - RNA, 16 nt, Mycobacterium tuberculosis H37Rv
aagccgagcaucagau

SEQ ID NO: 1367602 - RNA, 14 nt, Mycobacterium tuberculosis H37Rv
aagcucggccacca

SEQ ID NO: 1367603 - RNA, 17 nt, Mycobacterium tuberculosis H37Rv
aagcuaaacccccaccg

SEQ ID NO: 1367604 - RNA, 16 nt, Mycobacterium tuberculosis H37Rv
aagcugaccgccagcg

SEQ ID NO: 1367605 - RNA, 15 nt, Mycobacterium tuberculosis H37Rv
aagcugugcccggcg

SEQ ID NO: 1367606 - RNA, 22 nt, Mycobacterium tuberculosis H37Rv
aagcugcucgucggcgccggcg

SEQ ID NO: 1367607 - RNA, 21 nt, Mycobacterium tuberculosis H37Rv
aaggagccgggccguccgggu

SEQ ID NO: 1367608 - RNA, 13 nt, Mycobacterium tuberculosis H37Rv
aaggaaaagccug

SEQ ID NO: 1367609 - RNA, 17 nt, Mycobacterium tuberculosis H37Rv
cggcauuucagcgcgcc

SEQ ID NO: 1367610 - RNA, 14 nt, Mycobacterium tuberculosis H37Rv
cggcagcauggcca

SEQ ID NO: 1367611 - RNA, 13 nt, Mycobacterium tuberculosis H37Rv
cggcagccaagcg

SEQ ID NO: 1367612 - RNA, 20 nt, Mycobacterium tuberculosis H37Rv
cggcauugcccgagcccagc

SEQ ID NO: 1367613 - RNA, 21 nt, Mycobacterium tuberculosis H37Rv
cggcauugcccgagcccagcg

SEQ ID NO: 1367614 - RNA, 22 nt, Mycobacterium tuberculosis H37Rv
cggccacaccuuggccgccggc

SEQ ID NO: 1367615 - RNA, 13 nt, Mycobacterium tuberculosis H37Rv
cggccaaaauggc

SEQ ID NO: 1367616 - RNA, 22 nt, Mycobacterium tuberculosis H37Rv
cggccaauugcgccgccaacuc

SEQ ID NO: 1367617 - RNA, 13 nt, Mycobacterium tuberculosis H37Rv
cggccacaaccuc

SEQ ID NO: 1367618 - RNA, 16 nt, Mycobacterium tuberculosis H37Rv
cggcacuggccccggu

SEQ ID NO: 1367619 - RNA, 17 nt, Mycobacterium tuberculosis H37Rv
cggcacuggccccggug

SEQ ID NO: 1367620 - RNA, 20 nt, Mycobacterium tuberculosis H37Rv
cggcacugcgaaucuccgcg

SEQ ID NO: 1367621 - RNA, 13 nt, Mycobacterium tuberculosis H37Rv
cggcacugcggcc

SEQ ID NO: 1367622 - RNA, 14 nt, Mycobacterium tuberculosis H37Rv
cggcacugcccagc

SEQ ID NO: 1367623 - RNA, 17 nt, Mycobacterium tuberculosis H37Rv
cggcacuagcccgaccg

SEQ ID NO: 1367624 - RNA, 18 nt, Mycobacterium tuberculosis H37Rv
cggcagaugcagcggguc

SEQ ID NO: 1367625 - RNA, 19 nt, Mycobacterium tuberculosis H37Rv
cggcacugcccagcagacc

SEQ ID NO: 1367626 - RNA, 17 nt, Mycobacterium tuberculosis H37Rv
cggcagcagcgggcgcg

SEQ ID NO: 1367627 - RNA, 11 nt, Mycobacterium tuberculosis H37Rv
cggcagcagca

SEQ ID NO: 1367628 - RNA, 16 nt, Mycobacterium tuberculosis H37Rv
cggcagcacccacauc

SEQ ID NO: 1367629 - RNA, 23 nt, Mycobacterium tuberculosis H37Rv
cggcagcaucggcaccccggcca

SEQ ID NO: 1367630 - RNA, 14 nt, Mycobacterium tuberculosis H37Rv
cggcagcagcgccg

SEQ ID NO: 1367631 - RNA, 14 nt, Mycobacterium tuberculosis H37Rv
cggcagcaucggca

SEQ ID NO: 1367632 - RNA, 14 nt, Mycobacterium tuberculosis H37Rv
cggcagcagcggug

SEQ ID NO: 1367633 - RNA, 17 nt, Mycobacterium tuberculosis H37Rv
cggccaccaccgcgccg

SEQ ID NO: 1367634 - RNA, 12 nt, Mycobacterium tuberculosis H37Rv
cggccaccaccg

SEQ ID NO: 1367635 - RNA, 23 nt, Mycobacterium tuberculosis H37Rv
cggccaccgccgccgccaccggc

SEQ ID NO: 1367636 - RNA, 17 nt, Mycobacterium tuberculosis H37Rv
cggccaccggcgucugc

SEQ ID NO: 1367637 - RNA, 17 nt, Mycobacterium tuberculosis H37Rv
cggccaccgucagcgcg

SEQ ID NO: 1367638 - RNA, 13 nt, Mycobacterium tuberculosis H37Rv
cggccacagugca

SEQ ID NO: 1367639 - RNA, 12 nt, Mycobacterium tuberculosis H37Rv
cggccaccacca

SEQ ID NO: 1367640 - RNA, 20 nt, Mycobacterium tuberculosis H37Rv
cggccaccaccaggcugacg

SEQ ID NO: 1367641 - RNA, 15 nt, Mycobacterium tuberculosis H37Rv
cggccaccaccgccg

SEQ ID NO: 1367642 - RNA, 20 nt, Mycobacterium tuberculosis H37Rv
cggccaccaccgccgccggc

SEQ ID NO: 1367643 - RNA, 14 nt, Mycobacterium tuberculosis H37Rv
cggccaccaccgcg

SEQ ID NO: 1367644 - RNA, 18 nt, Mycobacterium tuberculosis H37Rv
cggccacauccagcgcuu

SEQ ID NO: 1367645 - RNA, 23 nt, Mycobacterium tuberculosis H37Rv
cggccacaucgccagcagcaaac

SEQ ID NO: 1367646 - RNA, 21 nt, Mycobacterium tuberculosis H37Rv
cggccacaugccacagcggcg

SEQ ID NO: 1367647 - RNA, 14 nt, Mycobacterium tuberculosis H37Rv
cggccaccaaccuc

SEQ ID NO: 1367648 - RNA, 22 nt, Mycobacterium tuberculosis H37Rv
cggccacgguucuuccuggucg

SEQ ID NO: 1367649 - RNA, 19 nt, Mycobacterium tuberculosis H37Rv
cggccacgucgaugugcgc

SEQ ID NO: 1367650 - RNA, 13 nt, Mycobacterium tuberculosis H37Rv
cggccacucggga

SEQ ID NO: 1367651 - RNA, 23 nt, Mycobacterium tuberculosis H37Rv
cggccacuacggccuggccaccu

SEQ ID NO: 1367652 - RNA, 17 nt, Mycobacterium tuberculosis H37Rv
cggccacgacgacugga

SEQ ID NO: 1367653 - RNA, 13 nt, Mycobacterium tuberculosis H37Rv
cggccaccgccug

SEQ ID NO: 1367654 - RNA, 21 nt, Mycobacterium tuberculosis H37Rv
cggccacgguggagcgcgccu

SEQ ID NO: 1367655 - RNA, 21 nt, Mycobacterium tuberculosis H37Rv
cggccacggucagccaggugu

SEQ ID NO: 1367656 - RNA, 21 nt, Mycobacterium tuberculosis H37Rv
cggccacggcgucggccaccc

SEQ ID NO: 1367657 - RNA, 14 nt, Mycobacterium tuberculosis H37Rv
cggccagcgcaccg

SEQ ID NO: 1367658 - RNA, 17 nt, Mycobacterium tuberculosis H37Rv
cggccaggggaucaccg

SEQ ID NO: 1367659 - RNA, 16 nt, Mycobacterium tuberculosis H37Rv
cggccaggggcgcagc

SEQ ID NO: 1367660 - RNA, 15 nt, Mycobacterium tuberculosis H37Rv
cggccagcgcgcgcg

SEQ ID NO: 1367661 - RNA, 13 nt, Mycobacterium tuberculosis H37Rv
cggccagcgccuc

SEQ ID NO: 1367662 - RNA, 15 nt, Mycobacterium tuberculosis H37Rv
cggcccacaccagcg

SEQ ID NO: 1367663 - RNA, 14 nt, Mycobacterium tuberculosis H37Rv
cggcccacgcgcac

SEQ ID NO: 1367664 - RNA, 19 nt, Mycobacterium tuberculosis H37Rv
cggccaggucgacaccgcg

SEQ ID NO: 1367665 - RNA, 21 nt, Mycobacterium tuberculosis H37Rv
cggccaggucggcguugaucg

SEQ ID NO: 1367666 - RNA, 13 nt, Mycobacterium tuberculosis H37Rv
cggccaggucggc

SEQ ID NO: 1367667 - RNA, 21 nt, Mycobacterium tuberculosis H37Rv
cggccaggucgagcaccggcu

SEQ ID NO: 1367668 - RNA, 20 nt, Mycobacterium tuberculosis H37Rv
cggccaggucgagcaccggc

SEQ ID NO: 1367669 - RNA, 23 nt, Mycobacterium tuberculosis H37Rv
cggccagucaggaaaccggcgcg

SEQ ID NO: 1367670 - RNA, 22 nt, Mycobacterium tuberculosis H37Rv
cggccccgacauacgucggggc

SEQ ID NO: 1367671 - RNA, 18 nt, Mycobacterium tuberculosis H37Rv
cggccccgacugccgcgg

SEQ ID NO: 1367672 - RNA, 22 nt, Mycobacterium tuberculosis H37Rv
cggccccgccgaugccgccggc

SEQ ID NO: 1367673 - RNA, 17 nt, Mycobacterium tuberculosis H37Rv
cggccccgccggccccg

SEQ ID NO: 1367674 - RNA, 17 nt, Mycobacterium tuberculosis H37Rv
cggccccgcgccaccuc

SEQ ID NO: 1367675 - RNA, 16 nt, Mycobacterium tuberculosis H37Rv
cggcccccgaggcugg

SEQ ID NO: 1367676 - RNA, 14 nt, Mycobacterium tuberculosis H37Rv
cggcccccggcagc

SEQ ID NO: 1367677 - RNA, 15 nt, Mycobacterium tuberculosis H37Rv
cggcccagcgcgcca

SEQ ID NO: 1367678 - RNA, 17 nt, Mycobacterium tuberculosis H37Rv
cggcccagcgcgccagc

SEQ ID NO: 1367679 - RNA, 17 nt, Mycobacterium tuberculosis H37Rv
cggcccacggugucccg

SEQ ID NO: 1367680 - RNA, 14 nt, Mycobacterium tuberculosis H37Rv
cggcccaccggcca

SEQ ID NO: 1367681 - RNA, 18 nt, Mycobacterium tuberculosis H37Rv
cggcccagcgcccccagc

SEQ ID NO: 1367682 - RNA, 13 nt, Mycobacterium tuberculosis H37Rv
cggccccugccac

SEQ ID NO: 1367683 - RNA, 20 nt, Mycobacterium tuberculosis H37Rv
cggcccgacccggccgaugg

SEQ ID NO: 1367684 - RNA, 16 nt, Mycobacterium tuberculosis H37Rv
cggcccgaggcucggg

SEQ ID NO: 1367685 - RNA, 15 nt, Mycobacterium tuberculosis H37Rv
cggcccgaucugagc

SEQ ID NO: 1367686 - RNA, 23 nt, Mycobacterium tuberculosis H37Rv
cggcccgccaaaaacgccccggc

SEQ ID NO: 1367687 - RNA, 18 nt, Mycobacterium tuberculosis H37Rv
cggcccgaucaccagccc

SEQ ID NO: 1367688 - RNA, 21 nt, Mycobacterium tuberculosis H37Rv
cggcccgaagaucuccuccug

SEQ ID NO: 1367689 - RNA, 22 nt, Mycobacterium tuberculosis H37Rv
cggcccgaggugccggggcccc

SEQ ID NO: 1367690 - RNA, 17 nt, Mycobacterium tuberculosis H37Rv
cggcccgcucaccuugg

SEQ ID NO: 1367691 - RNA, 15 nt, Mycobacterium tuberculosis H37Rv
cggcccgcucagccg

SEQ ID NO: 1367692 - RNA, 18 nt, Mycobacterium tuberculosis H37Rv
cggccgcggcgccuagca

SEQ ID NO: 1367693 - RNA, 15 nt, Mycobacterium tuberculosis H37Rv
cggccgcggcggccc

SEQ ID NO: 1367694 - RNA, 16 nt, Mycobacterium tuberculosis H37Rv
cggccgcggcggcccc

SEQ ID NO: 1367695 - RNA, 18 nt, Mycobacterium tuberculosis H37Rv
cggccgcggcggccccgc

SEQ ID NO: 1367696 - RNA, 16 nt, Mycobacterium tuberculosis H37Rv
cggccgcgcugcagca

SEQ ID NO: 1367697 - RNA, 17 nt, Mycobacterium tuberculosis H37Rv
cggccgcggccucccgc

SEQ ID NO: 1367698 - RNA, 16 nt, Mycobacterium tuberculosis H37Rv
cggccgcggccucccg

SEQ ID NO: 1367699 - RNA, 14 nt, Mycobacterium tuberculosis H37Rv
cggccgcgcugcag

SEQ ID NO: 1367700 - RNA, 23 nt, Mycobacterium tuberculosis H37Rv
cggccgcaucggucaaugccacu

SEQ ID NO: 1367701 - RNA, 17 nt, Mycobacterium tuberculosis H37Rv
cggccgcaagccgcgag

SEQ ID NO: 1367702 - RNA, 24 nt, Mycobacterium tuberculosis H37Rv
cggccgcagugcgacucugcgucu

SEQ ID NO: 1367703 - RNA, 14 nt, Mycobacterium tuberculosis H37Rv
cggccgcagccagc

SEQ ID NO: 1367704 - RNA, 18 nt, Mycobacterium tuberculosis H37Rv
cggccgcaaggcgccgau

SEQ ID NO: 1367705 - RNA, 18 nt, Mycobacterium tuberculosis H37Rv
cggccgcucacauacagc

SEQ ID NO: 1367706 - RNA, 21 nt, Mycobacterium tuberculosis H37Rv
cggccgcgucacggaccugga

SEQ ID NO: 1367707 - RNA, 18 nt, Mycobacterium tuberculosis H37Rv
cggccgcggucggccacc

SEQ ID NO: 1367708 - RNA, 11 nt, Mycobacterium tuberculosis H37Rv
cggccggccgc

SEQ ID NO: 1367709 - RNA, 21 nt, Mycobacterium tuberculosis H37Rv
cggccggcgcucgcggcggcg

SEQ ID NO: 1367710 - RNA, 15 nt, Mycobacterium tuberculosis H37Rv
cggccggcgcggcgu

SEQ ID NO: 1367711 - RNA, 13 nt, Mycobacterium tuberculosis H37Rv
cggccggccgcug

SEQ ID NO: 1367712 - RNA, 14 nt, Mycobacterium tuberculosis H37Rv
cggccggccgcggg

SEQ ID NO: 1367713 - RNA, 13 nt, Mycobacterium tuberculosis H37Rv
cggccggccgcuc

SEQ ID NO: 1367714 - RNA, 15 nt, Mycobacterium tuberculosis H37Rv
cggccgggccugcac

SEQ ID NO: 1367715 - RNA, 13 nt, Mycobacterium tuberculosis H37Rv
cggccgggcccuc

SEQ ID NO: 1367716 - RNA, 19 nt, Mycobacterium tuberculosis H37Rv
cggccgggcgggcggccga

SEQ ID NO: 1367717 - RNA, 13 nt, Mycobacterium tuberculosis H37Rv
cggccggcuccgg

SEQ ID NO: 1367718 - RNA, 13 nt, Mycobacterium tuberculosis H37Rv
cggccggcgggcc

SEQ ID NO: 1367719 - RNA, 16 nt, Mycobacterium tuberculosis H37Rv
cggccggcggccgccc

SEQ ID NO: 1367720 - RNA, 14 nt, Mycobacterium tuberculosis H37Rv
cggccggcggccgc

SEQ ID NO: 1367721 - RNA, 17 nt, Mycobacterium tuberculosis H37Rv
cggccggcgucagcccc

SEQ ID NO: 1367722 - RNA, 21 nt, Mycobacterium tuberculosis H37Rv
cggcccucgaugccgcguagc

SEQ ID NO: 1367723 - RNA, 21 nt, Mycobacterium tuberculosis H37Rv
cggcccuggacauaccggccc

SEQ ID NO: 1367724 - RNA, 16 nt, Mycobacterium tuberculosis H37Rv
cggcccugccgccggc

SEQ ID NO: 1367725 - RNA, 17 nt, Mycobacterium tuberculosis H37Rv
cggcccuguucggcccu

SEQ ID NO: 1367726 - RNA, 20 nt, Mycobacterium tuberculosis H37Rv
cggcccggcacccggugaga

SEQ ID NO: 1367727 - RNA, 22 nt, Mycobacterium tuberculosis H37Rv
cggcccggcucggugcgccaga

SEQ ID NO: 1367728 - RNA, 18 nt, Mycobacterium tuberculosis H37Rv
cggcccgucaccgcgggc

SEQ ID NO: 1367729 - RNA, 19 nt, Mycobacterium tuberculosis H37Rv
cggcccguagcugcgcagc

SEQ ID NO: 1367730 - RNA, 16 nt, Mycobacterium tuberculosis H37Rv
cggcccguagcugcgc

SEQ ID NO: 1367731 - RNA, 23 nt, Mycobacterium tuberculosis H37Rv
cggcccgguugggugugcccggg

SEQ ID NO: 1367732 - RNA, 18 nt, Mycobacterium tuberculosis H37Rv
cggcccgggucagcgacc

SEQ ID NO: 1367733 - RNA, 15 nt, Mycobacterium tuberculosis H37Rv
cggcccgggcucggc

SEQ ID NO: 1367734 - RNA, 14 nt, Mycobacterium tuberculosis H37Rv
cggccgaugcgcag

SEQ ID NO: 1367735 - RNA, 18 nt, Mycobacterium tuberculosis H37Rv
cggccgaugcgcagugca

SEQ ID NO: 1367736 - RNA, 21 nt, Mycobacterium tuberculosis H37Rv
cggccgaugcgacccgcagac

SEQ ID NO: 1367737 - RNA, 17 nt, Mycobacterium tuberculosis H37Rv
cggccgaugcgacccgc

SEQ ID NO: 1367738 - RNA, 20 nt, Mycobacterium tuberculosis H37Rv
cggccgaggaccagaggcgc

SEQ ID NO: 1367739 - RNA, 21 nt, Mycobacterium tuberculosis H37Rv
cggccgacaacccggccgggc

SEQ ID NO: 1367740 - RNA, 23 nt, Mycobacterium tuberculosis H37Rv
cggccgacucggucucauagugc

SEQ ID NO: 1367741 - RNA, 19 nt, Mycobacterium tuberculosis H37Rv
cggccgacaacccggccgg

SEQ ID NO: 1367742 - RNA, 16 nt, Mycobacterium tuberculosis H37Rv
cggccgacaacccggc

SEQ ID NO: 1367743 - RNA, 16 nt, Mycobacterium tuberculosis H37Rv
cggccgacaccgccac

SEQ ID NO: 1367744 - RNA, 19 nt, Mycobacterium tuberculosis H37Rv
cggccgacacgccgaugcc

SEQ ID NO: 1367745 - RNA, 22 nt, Mycobacterium tuberculosis H37Rv
cggcccuuguggaguacggcga

SEQ ID NO: 1367746 - RNA, 21 nt, Mycobacterium tuberculosis H37Rv
cggccgaaacuucgcccgggc

SEQ ID NO: 1367747 - RNA, 14 nt, Mycobacterium tuberculosis H37Rv
cggccgaacaaccu

SEQ ID NO: 1367748 - RNA, 23 nt, Mycobacterium tuberculosis H37Rv
cggccgaacaaccuucgggcgcg

SEQ ID NO: 1367749 - RNA, 18 nt, Mycobacterium tuberculosis H37Rv
cggcgacgaaccgccaga

SEQ ID NO: 1367750 - RNA, 19 nt, Mycobacterium tuberculosis H37Rv
cggcgaccucggcggcggc

SEQ ID NO: 1367751 - RNA, 22 nt, Mycobacterium tuberculosis H37Rv
cggcgaccucggguugcagcag

SEQ ID NO: 1367752 - RNA, 15 nt, Mycobacterium tuberculosis H37Rv
cggcgaccugcucgc

SEQ ID NO: 1367753 - RNA, 16 nt, Mycobacterium tuberculosis H37Rv
cggcgacacgccaggu

SEQ ID NO: 1367754 - RNA, 17 nt, Mycobacterium tuberculosis H37Rv
cggcgacaacagcacgu

SEQ ID NO: 1367755 - RNA, 15 nt, Mycobacterium tuberculosis H37Rv
cggcgaacggcacca

SEQ ID NO: 1367756 - RNA, 18 nt, Mycobacterium tuberculosis H37Rv
cggcgaacucgggcgacu

SEQ ID NO: 1367757 - RNA, 15 nt, Mycobacterium tuberculosis H37Rv
cggcgaacuuggccg

SEQ ID NO: 1367758 - RNA, 15 nt, Mycobacterium tuberculosis H37Rv
cggcgaagugcaccc

SEQ ID NO: 1367759 - RNA, 20 nt, Mycobacterium tuberculosis H37Rv
cggcgaaggccgcgcgcagg

SEQ ID NO: 1367760 - RNA, 16 nt, Mycobacterium tuberculosis H37Rv
cggccuuuccagcacc

SEQ ID NO: 1367761 - RNA, 23 nt, Mycobacterium tuberculosis H37Rv
cggccuugccgggccgcgcgggc

SEQ ID NO: 1367762 - RNA, 18 nt, Mycobacterium tuberculosis H37Rv
cggccuugccgccggcuc

SEQ ID NO: 1367763 - RNA, 14 nt, Mycobacterium tuberculosis H37Rv
cggccuucuugagg

SEQ ID NO: 1367764 - RNA, 15 nt, Mycobacterium tuberculosis H37Rv
cggccuucucgccgu

SEQ ID NO: 1367765 - RNA, 20 nt, Mycobacterium tuberculosis H37Rv
cggccuggucggccaggucg

SEQ ID NO: 1367766 - RNA, 18 nt, Mycobacterium tuberculosis H37Rv
cggccuguucgccgucgc

SEQ ID NO: 1367767 - RNA, 23 nt, Mycobacterium tuberculosis H37Rv
cggccuucgggugugacgcgcgc

SEQ ID NO: 1367768 - RNA, 16 nt, Mycobacterium tuberculosis H37Rv
cggccggggccacccg

SEQ ID NO: 1367769 - RNA, 15 nt, Mycobacterium tuberculosis H37Rv
cggccggugcccggg

SEQ ID NO: 1367770 - RNA, 21 nt, Mycobacterium tuberculosis H37Rv
cggccuaacucgccugcaccc

SEQ ID NO: 1367771 - RNA, 14 nt, Mycobacterium tuberculosis H37Rv
cggccguugggcca

SEQ ID NO: 1367772 - RNA, 17 nt, Mycobacterium tuberculosis H37Rv
cggccguugggccaccg

SEQ ID NO: 1367773 - RNA, 22 nt, Mycobacterium tuberculosis H37Rv
cggccggugaugaucgcgccgg

SEQ ID NO: 1367774 - RNA, 23 nt, Mycobacterium tuberculosis H37Rv
cggccggugaugaucgcgccggg

SEQ ID NO: 1367775 - RNA, 19 nt, Mycobacterium tuberculosis H37Rv
cggccggguuaucggcagc

SEQ ID NO: 1367776 - RNA, 17 nt, Mycobacterium tuberculosis H37Rv
cggccugcugcugcagc

SEQ ID NO: 1367777 - RNA, 15 nt, Mycobacterium tuberculosis H37Rv
cggccuggccaccug

SEQ ID NO: 1367778 - RNA, 21 nt, Mycobacterium tuberculosis H37Rv
cggccuccucgucgcucccgg

SEQ ID NO: 1367779 - RNA, 18 nt, Mycobacterium tuberculosis H37Rv
cggccuccgggccaugug

SEQ ID NO: 1367780 - RNA, 19 nt, Mycobacterium tuberculosis H37Rv
cggccuggggcagccgggc

SEQ ID NO: 1367781 - RNA, 14 nt, Mycobacterium tuberculosis H37Rv
cggccuggggcagc

SEQ ID NO: 1367782 - RNA, 21 nt, Mycobacterium tuberculosis H37Rv
cggcgccaguauggccgccac

SEQ ID NO: 1367783 - RNA, 13 nt, Mycobacterium tuberculosis H37Rv
cggcgccagugcg

SEQ ID NO: 1367784 - RNA, 18 nt, Mycobacterium tuberculosis H37Rv
cggcgccauagccgcgac

SEQ ID NO: 1367785 - RNA, 19 nt, Mycobacterium tuberculosis H37Rv
cggcgccaguauggccgcc

SEQ ID NO: 1367786 - RNA, 18 nt, Mycobacterium tuberculosis H37Rv
cggcgccagcgccgccac

SEQ ID NO: 1367787 - RNA, 19 nt, Mycobacterium tuberculosis H37Rv
cggcgauuuugcgucgcgc

SEQ ID NO: 1367788 - RNA, 19 nt, Mycobacterium tuberculosis H37Rv
cggcgccacccgcgccgcc

SEQ ID NO: 1367789 - RNA, 18 nt, Mycobacterium tuberculosis H37Rv
cggcgccacccgcgccgc

SEQ ID NO: 1367790 - RNA, 16 nt, Mycobacterium tuberculosis H37Rv
cggcgcaacucgacca

SEQ ID NO: 1367791 - RNA, 20 nt, Mycobacterium tuberculosis H37Rv
cggcgccacccgcgccgccc

SEQ ID NO: 1367792 - RNA, 18 nt, Mycobacterium tuberculosis H37Rv
cggcgccaccguggugga

SEQ ID NO: 1367793 - RNA, 20 nt, Mycobacterium tuberculosis H37Rv
cggcgacgcuaccgccggag

SEQ ID NO: 1367794 - RNA, 14 nt, Mycobacterium tuberculosis H37Rv
cggcgaugcugagc

SEQ ID NO: 1367795 - RNA, 20 nt, Mycobacterium tuberculosis H37Rv
cggcgaugcguccgcccagc

SEQ ID NO: 1367796 - RNA, 16 nt, Mycobacterium tuberculosis H37Rv
cggcgaugcguccgcc

SEQ ID NO: 1367797 - RNA, 15 nt, Mycobacterium tuberculosis H37Rv
cggcgauuacggcca

SEQ ID NO: 1367798 - RNA, 22 nt, Mycobacterium tuberculosis H37Rv
cggcgaugggccgguccggggc

SEQ ID NO: 1367799 - RNA, 21 nt, Mycobacterium tuberculosis H37Rv
cggcgaugguaucgccgcuag

SEQ ID NO: 1367800 - RNA, 22 nt, Mycobacterium tuberculosis H37Rv
cggcgaugcggucggccacauc

SEQ ID NO: 1367801 - RNA, 17 nt, Mycobacterium tuberculosis H37Rv
cggcgacggccagcgcg

SEQ ID NO: 1367802 - RNA, 15 nt, Mycobacterium tuberculosis H37Rv
cggcgacggcgccca

SEQ ID NO: 1367803 - RNA, 19 nt, Mycobacterium tuberculosis H37Rv
cggcgacgauucgagcggu

SEQ ID NO: 1367804 - RNA, 20 nt, Mycobacterium tuberculosis H37Rv
cggcgccgcccaacgcgagc

SEQ ID NO: 1367805 - RNA, 23 nt, Mycobacterium tuberculosis H37Rv
cggcgccgccacugccggcagcg

SEQ ID NO: 1367806 - RNA, 21 nt, Mycobacterium tuberculosis H37Rv
cggcgccgccaagggccccuc

SEQ ID NO: 1367807 - RNA, 21 nt, Mycobacterium tuberculosis H37Rv
cggcgcccuggccgcccuggc

SEQ ID NO: 1367808 - RNA, 22 nt, Mycobacterium tuberculosis H37Rv
cgcuuguugaccucacgggcgc

SEQ ID NO: 1367809 - RNA, 12 nt, Mycobacterium tuberculosis H37Rv
cgcuacccccga

SEQ ID NO: 1367810 - RNA, 17 nt, Mycobacterium tuberculosis H37Rv
cgcuacaucagaaucag

SEQ ID NO: 1367811 - RNA, 16 nt, Mycobacterium tuberculosis H37Rv
cgcuacaccugcggcg

SEQ ID NO: 1367812 - RNA, 17 nt, Mycobacterium tuberculosis H37Rv
cgcuaaagcccccgaca

SEQ ID NO: 1367813 - RNA, 22 nt, Mycobacterium tuberculosis H37Rv
cgcuuuggaggugcaguacgcg

SEQ ID NO: 1367814 - RNA, 19 nt, Mycobacterium tuberculosis H37Rv
cggaagcccuuguagcaca

SEQ ID NO: 1367815 - RNA, 23 nt, Mycobacterium tuberculosis H37Rv
cggaaggacggcagccaccagcg

SEQ ID NO: 1367816 - RNA, 16 nt, Mycobacterium tuberculosis H37Rv
cggaaggcccggcgcg

SEQ ID NO: 1367817 - RNA, 16 nt, Mycobacterium tuberculosis H37Rv
cggaauacccgcuggc

SEQ ID NO: 1367818 - RNA, 19 nt, Mycobacterium tuberculosis H37Rv
cggaaggcccggcgcggcc

SEQ ID NO: 1367819 - RNA, 19 nt, Mycobacterium tuberculosis H37Rv
cggaaccgauaccucgcca

SEQ ID NO: 1367820 - RNA, 13 nt, Mycobacterium tuberculosis H37Rv
cggaaccggacag

SEQ ID NO: 1367821 - RNA, 15 nt, Mycobacterium tuberculosis H37Rv
cggaaccggacagcg

SEQ ID NO: 1367822 - RNA, 17 nt, Mycobacterium tuberculosis H37Rv
cggaaaccaucgccagc

SEQ ID NO: 1367823 - RNA, 12 nt, Mycobacterium tuberculosis H37Rv
cggaacaccagc

SEQ ID NO: 1367824 - RNA, 14 nt, Mycobacterium tuberculosis H37Rv
cggaaauuccaagc

SEQ ID NO: 1367825 - RNA, 21 nt, Mycobacterium tuberculosis H37Rv
cggaaccggucagccggacca

SEQ ID NO: 1367826 - RNA, 16 nt, Mycobacterium tuberculosis H37Rv
cggagcgaugcgggca

SEQ ID NO: 1367827 - RNA, 21 nt, Mycobacterium tuberculosis H37Rv
cggagcgcauuuguugcugcu

SEQ ID NO: 1367828 - RNA, 17 nt, Mycobacterium tuberculosis H37Rv
cggagccgccggccccg

SEQ ID NO: 1367829 - RNA, 15 nt, Mycobacterium tuberculosis H37Rv
cggagccggccaccu

SEQ ID NO: 1367830 - RNA, 19 nt, Mycobacterium tuberculosis H37Rv
cggagccgggugaggcggg

SEQ ID NO: 1367831 - RNA, 18 nt, Mycobacterium tuberculosis H37Rv
cggagcccaaaaccgcga

SEQ ID NO: 1367832 - RNA, 21 nt, Mycobacterium tuberculosis H37Rv
cggagcccacacgcucacggg

SEQ ID NO: 1367833 - RNA, 15 nt, Mycobacterium tuberculosis H37Rv
cggagccgcccaagc

SEQ ID NO: 1367834 - RNA, 19 nt, Mycobacterium tuberculosis H37Rv
cggagcucuugcgggcagc

SEQ ID NO: 1367835 - RNA, 16 nt, Mycobacterium tuberculosis H37Rv
cggagcucaaccaccu

SEQ ID NO: 1367836 - RNA, 18 nt, Mycobacterium tuberculosis H37Rv
cggagcgggccagcaccc

SEQ ID NO: 1367837 - RNA, 22 nt, Mycobacterium tuberculosis H37Rv
cggagaucgucgcguagugaug

SEQ ID NO: 1367838 - RNA, 23 nt, Mycobacterium tuberculosis H37Rv
cggagaugccauuucgucgucgc

SEQ ID NO: 1367839 - RNA, 15 nt, Mycobacterium tuberculosis H37Rv
cggagaugagcagcu

SEQ ID NO: 1367840 - RNA, 13 nt, Mycobacterium tuberculosis H37Rv
cggagccaggacg

SEQ ID NO: 1367841 - RNA, 22 nt, Mycobacterium tuberculosis H37Rv
cggagccaggacgacgccgacg

SEQ ID NO: 1367842 - RNA, 17 nt, Mycobacterium tuberculosis H37Rv
cggacguucuggaucgu

SEQ ID NO: 1367843 - RNA, 17 nt, Mycobacterium tuberculosis H37Rv
cggacggucgggcggau

SEQ ID NO: 1367844 - RNA, 22 nt, Mycobacterium tuberculosis H37Rv
cggacugaagccgcgagcgcgc

SEQ ID NO: 1367845 - RNA, 18 nt, Mycobacterium tuberculosis H37Rv
cggagaacuugagcuccu

SEQ ID NO: 1367846 - RNA, 20 nt, Mycobacterium tuberculosis H37Rv
cggagaacgcgucgcgcgcc

SEQ ID NO: 1367847 - RNA, 23 nt, Mycobacterium tuberculosis H37Rv
cggagacucucugaucugagacc

SEQ ID NO: 1367848 - RNA, 22 nt, Mycobacterium tuberculosis H37Rv
cggagaccggccgggugaacca

SEQ ID NO: 1367849 - RNA, 18 nt, Mycobacterium tuberculosis H37Rv
cggacuggccucggggau

SEQ ID NO: 1367850 - RNA, 18 nt, Mycobacterium tuberculosis H37Rv
cggacugcggcccgaccc

SEQ ID NO: 1367851 - RNA, 21 nt, Mycobacterium tuberculosis H37Rv
cggacuugcgagccguagacc

SEQ ID NO: 1367852 - RNA, 17 nt, Mycobacterium tuberculosis H37Rv
cggagaaaagcgcgcua

SEQ ID NO: 1367853 - RNA, 14 nt, Mycobacterium tuberculosis H37Rv
cggaaucgcccggg

SEQ ID NO: 1367854 - RNA, 21 nt, Mycobacterium tuberculosis H37Rv
cggaaucgcaccgugugggcc

SEQ ID NO: 1367855 - RNA, 16 nt, Mycobacterium tuberculosis H37Rv
cggaauauggcggccg

SEQ ID NO: 1367856 - RNA, 18 nt, Mycobacterium tuberculosis H37Rv
cggaauauggcggccggg

SEQ ID NO: 1367857 - RNA, 16 nt, Mycobacterium tuberculosis H37Rv
cggaauagcaacgcug

SEQ ID NO: 1367858 - RNA, 19 nt, Mycobacterium tuberculosis H37Rv
cggaauacaccagcgacgc

SEQ ID NO: 1367859 - RNA, 17 nt, Mycobacterium tuberculosis H37Rv
cggaaucgucgcggccg

SEQ ID NO: 1367860 - RNA, 20 nt, Mycobacterium tuberculosis H37Rv
cggaauucgguuggcucggg

SEQ ID NO: 1367861 - RNA, 16 nt, Mycobacterium tuberculosis H37Rv
cggacaaagccgucgc

SEQ ID NO: 1367862 - RNA, 14 nt, Mycobacterium tuberculosis H37Rv
cggacaccucgggc

SEQ ID NO: 1367863 - RNA, 21 nt, Mycobacterium tuberculosis H37Rv
cggacagcguaucucccaacg

SEQ ID NO: 1367864 - RNA, 15 nt, Mycobacterium tuberculosis H37Rv
cggacaguucccggc

SEQ ID NO: 1367865 - RNA, 16 nt, Mycobacterium tuberculosis H37Rv
cggacaugcgggcagc

SEQ ID NO: 1367866 - RNA, 11 nt, Mycobacterium tuberculosis H37Rv
cggacccgcgg

SEQ ID NO: 1367867 - RNA, 14 nt, Mycobacterium tuberculosis H37Rv
cggaccgaccaccg

SEQ ID NO: 1367868 - RNA, 18 nt, Mycobacterium tuberculosis H37Rv
cggacccgcagcugcgga

SEQ ID NO: 1367869 - RNA, 14 nt, Mycobacterium tuberculosis H37Rv
cggaccccgagacc

SEQ ID NO: 1367870 - RNA, 15 nt, Mycobacterium tuberculosis H37Rv
cggacauccgaugcg

SEQ ID NO: 1367871 - RNA, 17 nt, Mycobacterium tuberculosis H37Rv
cggacccaaagcacuuc

SEQ ID NO: 1367872 - RNA, 19 nt, Mycobacterium tuberculosis H37Rv
cggaccucgaagcccagca

SEQ ID NO: 1367873 - RNA, 20 nt, Mycobacterium tuberculosis H37Rv
cggaccucggcgaccugcuc

SEQ ID NO: 1367874 - RNA, 22 nt, Mycobacterium tuberculosis H37Rv
cggaccguguuguuagccccgc

SEQ ID NO: 1367875 - RNA, 14 nt, Mycobacterium tuberculosis H37Rv
cggaccuccucgcc

SEQ ID NO: 1367876 - RNA, 22 nt, Mycobacterium tuberculosis H37Rv
cggaccgauugucggcaacgac

SEQ ID NO: 1367877 - RNA, 12 nt, Mycobacterium tuberculosis H37Rv
cggaccgcagcg

SEQ ID NO: 1367878 - RNA, 21 nt, Mycobacterium tuberculosis H37Rv
cggacgccaugcccgcacgcu

SEQ ID NO: 1367879 - RNA, 15 nt, Mycobacterium tuberculosis H37Rv
cggaccugcgccggu

SEQ ID NO: 1367880 - RNA, 18 nt, Mycobacterium tuberculosis H37Rv
cggacgauuacgccggag

SEQ ID NO: 1367881 - RNA, 20 nt, Mycobacterium tuberculosis H37Rv
cggacgcaacacccgggcga

SEQ ID NO: 1367882 - RNA, 22 nt, Mycobacterium tuberculosis H37Rv
cggacgcaacucgacgcguagc

SEQ ID NO: 1367883 - RNA, 16 nt, Mycobacterium tuberculosis H37Rv
cggauuaagucggcgg

SEQ ID NO: 1367884 - RNA, 20 nt, Mycobacterium tuberculosis H37Rv
cggauucgggcgaagcuagc

SEQ ID NO: 1367885 - RNA, 13 nt, Mycobacterium tuberculosis H37Rv
cggauugcagcgc

SEQ ID NO: 1367886 - RNA, 18 nt, Mycobacterium tuberculosis H37Rv
cggauuccucgucaccgc

SEQ ID NO: 1367887 - RNA, 14 nt, Mycobacterium tuberculosis H37Rv
cggaugcgauggcc

SEQ ID NO: 1367888 - RNA, 20 nt, Mycobacterium tuberculosis H37Rv
cggaugcguuggccccagga

SEQ ID NO: 1367889 - RNA, 23 nt, Mycobacterium tuberculosis H37Rv
cggaugcucaggucaccggccgc

SEQ ID NO: 1367890 - RNA, 22 nt, Mycobacterium tuberculosis H37Rv
cggauccgauccgcacagcaac

SEQ ID NO: 1367891 - RNA, 19 nt, Mycobacterium tuberculosis H37Rv
cggauccgauccgcacagc

SEQ ID NO: 1367892 - RNA, 19 nt, Mycobacterium tuberculosis H37Rv
cggauccucggccgccauc

SEQ ID NO: 1367893 - RNA, 22 nt, Mycobacterium tuberculosis H37Rv
cggauccaccacgcuggccucg

SEQ ID NO: 1367894 - RNA, 20 nt, Mycobacterium tuberculosis H37Rv
cggauccacaccgagaagcu

SEQ ID NO: 1367895 - RNA, 19 nt, Mycobacterium tuberculosis H37Rv
cggaucgcgagcgccgcua

SEQ ID NO: 1367896 - RNA, 14 nt, Mycobacterium tuberculosis H37Rv
cggaucgcggucag

SEQ ID NO: 1367897 - RNA, 18 nt, Mycobacterium tuberculosis H37Rv
cggaucgccaggccgucg

SEQ ID NO: 1367898 - RNA, 13 nt, Mycobacterium tuberculosis H37Rv
cggaucgccaggc

SEQ ID NO: 1367899 - RNA, 17 nt, Mycobacterium tuberculosis H37Rv
cggaucggucggcacca

SEQ ID NO: 1367900 - RNA, 18 nt, Mycobacterium tuberculosis H37Rv
cggaucggcaccccacgc

SEQ ID NO: 1367901 - RNA, 14 nt, Mycobacterium tuberculosis H37Rv
cggaucugcagcac

SEQ ID NO: 1367902 - RNA, 21 nt, Mycobacterium tuberculosis H37Rv
cggaucuggcuccggccaggg

SEQ ID NO: 1367903 - RNA, 21 nt, Mycobacterium tuberculosis H37Rv
cggaggcgaccacgucggcga

SEQ ID NO: 1367904 - RNA, 20 nt, Mycobacterium tuberculosis H37Rv
cggaggcggaccaggccgcg

SEQ ID NO: 1367905 - RNA, 17 nt, Mycobacterium tuberculosis H37Rv
cggaggcgggugcggca

SEQ ID NO: 1367906 - RNA, 15 nt, Mycobacterium tuberculosis H37Rv
cggaggcggcuccug

SEQ ID NO: 1367907 - RNA, 15 nt, Mycobacterium tuberculosis H37Rv
cggaggaaccccgcg

SEQ ID NO: 1367908 - RNA, 18 nt, Mycobacterium tuberculosis H37Rv
cggaggucgggcggcgac

SEQ ID NO: 1367909 - RNA, 21 nt, Mycobacterium tuberculosis H37Rv
cggaggucggagcgggcuccg

SEQ ID NO: 1367910 - RNA, 13 nt, Mycobacterium tuberculosis H37Rv
cggaggucggagc

SEQ ID NO: 1367911 - RNA, 16 nt, Mycobacterium tuberculosis H37Rv
cggagguggggugggg

SEQ ID NO: 1367912 - RNA, 16 nt, Mycobacterium tuberculosis H37Rv
cggaggcugggcugag

SEQ ID NO: 1367913 - RNA, 13 nt, Mycobacterium tuberculosis H37Rv
cggaggguucgga

SEQ ID NO: 1367914 - RNA, 22 nt, Mycobacterium tuberculosis H37Rv
cggagguccuacgugcugcggg

SEQ ID NO: 1367915 - RNA, 18 nt, Mycobacterium tuberculosis H37Rv
cggaguucuucgaaggcg

SEQ ID NO: 1367916 - RNA, 22 nt, Mycobacterium tuberculosis H37Rv
cggaguucuucgaaggcguggg

SEQ ID NO: 1367917 - RNA, 19 nt, Mycobacterium tuberculosis H37Rv
cggaguucgcugacggcca

SEQ ID NO: 1367918 - RNA, 23 nt, Mycobacterium tuberculosis H37Rv
cggagucgcccgguccgccgcag

SEQ ID NO: 1367919 - RNA, 19 nt, Mycobacterium tuberculosis H37Rv
cggaguccgucgacaccgc

SEQ ID NO: 1367920 - RNA, 21 nt, Mycobacterium tuberculosis H37Rv
cggagucgaacaucaccggag

SEQ ID NO: 1367921 - RNA, 20 nt, Mycobacterium tuberculosis H37Rv
cggagucacgcagccgcgcg

SEQ ID NO: 1367922 - RNA, 14 nt, Mycobacterium tuberculosis H37Rv
cggagucacgcagc

SEQ ID NO: 1367923 - RNA, 16 nt, Mycobacterium tuberculosis H37Rv
cggagucaagcagcag

SEQ ID NO: 1367924 - RNA, 16 nt, Mycobacterium tuberculosis H37Rv
cggaguaggccgcgcc

SEQ ID NO: 1367925 - RNA, 19 nt, Mycobacterium tuberculosis H37Rv
cggagugucgaugcgcgcc

SEQ ID NO: 1367926 - RNA, 22 nt, Mycobacterium tuberculosis H37Rv
cggagugucgaugcgcgccggc

SEQ ID NO: 1367927 - RNA, 19 nt, Mycobacterium tuberculosis H37Rv
cggagugguauccaggccc

SEQ ID NO: 1367928 - RNA, 16 nt, Mycobacterium tuberculosis H37Rv
cggauagcaccggcac

SEQ ID NO: 1367929 - RNA, 15 nt, Mycobacterium tuberculosis H37Rv
cggauagcaccggca

SEQ ID NO: 1367930 - RNA, 20 nt, Mycobacterium tuberculosis H37Rv
cggauacaugguccggccgc

SEQ ID NO: 1367931 - RNA, 23 nt, Mycobacterium tuberculosis H37Rv
cggauacagccgccgccggcaac

SEQ ID NO: 1367932 - RNA, 14 nt, Mycobacterium tuberculosis H37Rv
cggauacggcgaca

SEQ ID NO: 1367933 - RNA, 20 nt, Mycobacterium tuberculosis H37Rv
cggauaauucaacagcaccg

SEQ ID NO: 1367934 - RNA, 19 nt, Mycobacterium tuberculosis H37Rv
cggauaggccgcgcggcgg

SEQ ID NO: 1367935 - RNA, 16 nt, Mycobacterium tuberculosis H37Rv
cggauaguucaccaca

SEQ ID NO: 1367936 - RNA, 22 nt, Mycobacterium tuberculosis H37Rv
cggaucaucgccgcggccaggu

SEQ ID NO: 1367937 - RNA, 15 nt, Mycobacterium tuberculosis H37Rv
cggaucaggcccggg

SEQ ID NO: 1367938 - RNA, 17 nt, Mycobacterium tuberculosis H37Rv
cggcacgucggcgccga

SEQ ID NO: 1367939 - RNA, 19 nt, Mycobacterium tuberculosis H37Rv
cggcacgucggcgccgacc

SEQ ID NO: 1367940 - RNA, 14 nt, Mycobacterium tuberculosis H37Rv
cggcacucccuggg

SEQ ID NO: 1367941 - RNA, 15 nt, Mycobacterium tuberculosis H37Rv
cggcacucccugggg

SEQ ID NO: 1367942 - RNA, 19 nt, Mycobacterium tuberculosis H37Rv
cggcaccgguuuucgccgg

SEQ ID NO: 1367943 - RNA, 21 nt, Mycobacterium tuberculosis H37Rv
cggcaccggggcugcccgcgg

SEQ ID NO: 1367944 - RNA, 18 nt, Mycobacterium tuberculosis H37Rv
cggcaccgugcggggggc

SEQ ID NO: 1367945 - RNA, 14 nt, Mycobacterium tuberculosis H37Rv
cggcaccuccgccg

SEQ ID NO: 1367946 - RNA, 16 nt, Mycobacterium tuberculosis H37Rv
cggcaccuccgccggc

SEQ ID NO: 1367947 - RNA, 20 nt, Mycobacterium tuberculosis H37Rv
cggcaccuccgccggcaccu

SEQ ID NO: 1367948 - RNA, 12 nt, Mycobacterium tuberculosis H37Rv
cggcaccgccgc

SEQ ID NO: 1367949 - RNA, 22 nt, Mycobacterium tuberculosis H37Rv
cggcaccgaugcacuccaugaa

SEQ ID NO: 1367950 - RNA, 13 nt, Mycobacterium tuberculosis H37Rv
cggcaccgccccg

SEQ ID NO: 1367951 - RNA, 11 nt, Mycobacterium tuberculosis H37Rv
cggcaccgcca

SEQ ID NO: 1367952 - RNA, 17 nt, Mycobacterium tuberculosis H37Rv
cggcacccgcacggccu

SEQ ID NO: 1367953 - RNA, 23 nt, Mycobacterium tuberculosis H37Rv
cggcacccgaaaacugacccccu

SEQ ID NO: 1367954 - RNA, 20 nt, Mycobacterium tuberculosis H37Rv
cggcacccgacucgucggcc

SEQ ID NO: 1367955 - RNA, 23 nt, Mycobacterium tuberculosis H37Rv
cggcacccgaguuauagaagccg

SEQ ID NO: 1367956 - RNA, 16 nt, Mycobacterium tuberculosis H37Rv
cggcacccggucggcc

SEQ ID NO: 1367957 - RNA, 22 nt, Mycobacterium tuberculosis H37Rv
cggcacccggugagaagaagcc

SEQ ID NO: 1367958 - RNA, 18 nt, Mycobacterium tuberculosis H37Rv
cggcacccgucgggugcu

SEQ ID NO: 1367959 - RNA, 17 nt, Mycobacterium tuberculosis H37Rv
cggcacccggucggcca

SEQ ID NO: 1367960 - RNA, 16 nt, Mycobacterium tuberculosis H37Rv
cggcaccgcuucaggc

SEQ ID NO: 1367961 - RNA, 17 nt, Mycobacterium tuberculosis H37Rv
cggcaccgcgccggcgg

SEQ ID NO: 1367962 - RNA, 15 nt, Mycobacterium tuberculosis H37Rv
cggcaccgcgccggc

SEQ ID NO: 1367963 - RNA, 15 nt, Mycobacterium tuberculosis H37Rv
cggcaccgccugcgc

SEQ ID NO: 1367964 - RNA, 16 nt, Mycobacterium tuberculosis H37Rv
cggcaccgccugcgcc

SEQ ID NO: 1367965 - RNA, 20 nt, Mycobacterium tuberculosis H37Rv
cggcaccggccgugccgccg

SEQ ID NO: 1367966 - RNA, 17 nt, Mycobacterium tuberculosis H37Rv
cggcaccgccggcgccc

SEQ ID NO: 1367967 - RNA, 19 nt, Mycobacterium tuberculosis H37Rv
cggcaccgccggcgccgcc

SEQ ID NO: 1367968 - RNA, 22 nt, Mycobacterium tuberculosis H37Rv
cggcaccgccggcgccgccguc

SEQ ID NO: 1367969 - RNA, 20 nt, Mycobacterium tuberculosis H37Rv
cggcaccgccggcaccgccg

SEQ ID NO: 1367970 - RNA, 11 nt, Mycobacterium tuberculosis H37Rv
cggcaccgccu

SEQ ID NO: 1367971 - RNA, 19 nt, Mycobacterium tuberculosis H37Rv
cggcaccgccggcuccgcc

SEQ ID NO: 1367972 - RNA, 16 nt, Mycobacterium tuberculosis H37Rv
cggcaccgccgccccc

SEQ ID NO: 1367973 - RNA, 15 nt, Mycobacterium tuberculosis H37Rv
cggcaccgccggcuc

SEQ ID NO: 1367974 - RNA, 20 nt, Mycobacterium tuberculosis H37Rv
cggcacaggcggccagcauc

SEQ ID NO: 1367975 - RNA, 22 nt, Mycobacterium tuberculosis H37Rv
cggcacauugaucgacggccag

SEQ ID NO: 1367976 - RNA, 22 nt, Mycobacterium tuberculosis H37Rv
cggcaauucgggauaggacacc

SEQ ID NO: 1367977 - RNA, 19 nt, Mycobacterium tuberculosis H37Rv
cggcaauucgggcaugguc

SEQ ID NO: 1367978 - RNA, 15 nt, Mycobacterium tuberculosis H37Rv
cggcacaaucggcgc

SEQ ID NO: 1367979 - RNA, 18 nt, Mycobacterium tuberculosis H37Rv
cggcaauggccagcacca

SEQ ID NO: 1367980 - RNA, 11 nt, Mycobacterium tuberculosis H37Rv
cggcaccacca

SEQ ID NO: 1367981 - RNA, 14 nt, Mycobacterium tuberculosis H37Rv
cggcaccaccguug

SEQ ID NO: 1367982 - RNA, 22 nt, Mycobacterium tuberculosis H37Rv
cggcaccaccguugccgccguc

SEQ ID NO: 1367983 - RNA, 14 nt, Mycobacterium tuberculosis H37Rv
cggcaccagcaccg

SEQ ID NO: 1367984 - RNA, 19 nt, Mycobacterium tuberculosis H37Rv
cggcaccaccacgccgacc

SEQ ID NO: 1367985 - RNA, 17 nt, Mycobacterium tuberculosis H37Rv
cggcacccagucggcgc

SEQ ID NO: 1367986 - RNA, 14 nt, Mycobacterium tuberculosis H37Rv
cggcacccaccagu

SEQ ID NO: 1367987 - RNA, 22 nt, Mycobacterium tuberculosis H37Rv
cggcacccaauccggcgccagc

SEQ ID NO: 1367988 - RNA, 14 nt, Mycobacterium tuberculosis H37Rv
cggcaccauagcug

SEQ ID NO: 1367989 - RNA, 20 nt, Mycobacterium tuberculosis H37Rv
cggcaacggcgcgccgacca

SEQ ID NO: 1367990 - RNA, 19 nt, Mycobacterium tuberculosis H37Rv
cggcaacggcgcgccgacc

SEQ ID NO: 1367991 - RNA, 18 nt, Mycobacterium tuberculosis H37Rv
cggcaaggacguggcgcu

SEQ ID NO: 1367992 - RNA, 14 nt, Mycobacterium tuberculosis H37Rv
cggcaagcgcagac

SEQ ID NO: 1367993 - RNA, 14 nt, Mycobacterium tuberculosis H37Rv
cggcaagccgggga

SEQ ID NO: 1367994 - RNA, 17 nt, Mycobacterium tuberculosis H37Rv
cggcaaggucgcggcca

SEQ ID NO: 1367995 - RNA, 23 nt, Mycobacterium tuberculosis H37Rv
cggauuggugggccagcagcaac

SEQ ID NO: 1367996 - RNA, 21 nt, Mycobacterium tuberculosis H37Rv
cggauuggugggccagcagca

SEQ ID NO: 1367997 - RNA, 18 nt, Mycobacterium tuberculosis H37Rv
cggcaaaccaguuggcga

SEQ ID NO: 1367998 - RNA, 19 nt, Mycobacterium tuberculosis H37Rv
cggcaaacgcgcaggucag

SEQ ID NO: 1367999 - RNA, 14 nt, Mycobacterium tuberculosis H37Rv
cggcaaacuccagc

SEQ ID NO: 1368000 - RNA, 14 nt, Mycobacterium tuberculosis H37Rv
cggcaaccccgagc

SEQ ID NO: 1368001 - RNA, 15 nt, Mycobacterium tuberculosis H37Rv
cggcaaccagcgagc

SEQ ID NO: 1368002 - RNA, 15 nt, Mycobacterium tuberculosis H37Rv
cggcaacagcaccag

SEQ ID NO: 1368003 - RNA, 16 nt, Mycobacterium tuberculosis H37Rv
cggcaacagcucgccu

SEQ ID NO: 1368004 - RNA, 17 nt, Mycobacterium tuberculosis H37Rv
cgcgagcccgccacagc

SEQ ID NO: 1368005 - RNA, 16 nt, Mycobacterium tuberculosis H37Rv
cgcgagcaacaccagg

SEQ ID NO: 1368006 - RNA, 18 nt, Mycobacterium tuberculosis H37Rv
cgcgagcaacaccagggc

SEQ ID NO: 1368007 - RNA, 16 nt, Mycobacterium tuberculosis H37Rv
cgcgagaucgggccgg

SEQ ID NO: 1368008 - RNA, 17 nt, Mycobacterium tuberculosis H37Rv
cgcgagaaggugcugcg

SEQ ID NO: 1368009 - RNA, 14 nt, Mycobacterium tuberculosis H37Rv
cgcgacgacgaggu

SEQ ID NO: 1368010 - RNA, 15 nt, Mycobacterium tuberculosis H37Rv
cgcgaucagcgcgca

SEQ ID NO: 1368011 - RNA, 14 nt, Mycobacterium tuberculosis H37Rv
cgcgaucagcgcgc

SEQ ID NO: 1368012 - RNA, 15 nt, Mycobacterium tuberculosis H37Rv
cgcgaccccaggcgc

SEQ ID NO: 1368013 - RNA, 17 nt, Mycobacterium tuberculosis H37Rv
cgcgacccggcccagcg

SEQ ID NO: 1368014 - RNA, 16 nt, Mycobacterium tuberculosis H37Rv
cgcgacccgaucgcgc

SEQ ID NO: 1368015 - RNA, 18 nt, Mycobacterium tuberculosis H37Rv
cgcgacccgaucgcgcca

SEQ ID NO: 1368016 - RNA, 14 nt, Mycobacterium tuberculosis H37Rv
cgcgacccggccca

SEQ ID NO: 1368017 - RNA, 21 nt, Mycobacterium tuberculosis H37Rv
cgcgaauaccagaccggccga

SEQ ID NO: 1368018 - RNA, 20 nt, Mycobacterium tuberculosis H37Rv
cgcgaccgcauugagcuggc

SEQ ID NO: 1368019 - RNA, 14 nt, Mycobacterium tuberculosis H37Rv
cgcgaccgaccagc

SEQ ID NO: 1368020 - RNA, 21 nt, Mycobacterium tuberculosis H37Rv
cgcgaccgcgauccccacgau

SEQ ID NO: 1368021 - RNA, 17 nt, Mycobacterium tuberculosis H37Rv
cgcgaccucgcggcgcu

SEQ ID NO: 1368022 - RNA, 13 nt, Mycobacterium tuberculosis H37Rv
cgcgaccucggag

SEQ ID NO: 1368023 - RNA, 16 nt, Mycobacterium tuberculosis H37Rv
cgcgaccgucaggguc

SEQ ID NO: 1368024 - RNA, 22 nt, Mycobacterium tuberculosis H37Rv
cgcgaccggcguaaccggcagc

SEQ ID NO: 1368025 - RNA, 21 nt, Mycobacterium tuberculosis H37Rv
cgcgaagaacgacgccaccgc

SEQ ID NO: 1368026 - RNA, 22 nt, Mycobacterium tuberculosis H37Rv
cgcgaaauaacggagcggccua

SEQ ID NO: 1368027 - RNA, 15 nt, Mycobacterium tuberculosis H37Rv
cgcgaagccaccagg

SEQ ID NO: 1368028 - RNA, 16 nt, Mycobacterium tuberculosis H37Rv
cgcgaagccaccaggu

SEQ ID NO: 1368029 - RNA, 22 nt, Mycobacterium tuberculosis H37Rv
cgcgaagcgcucggcagccggc

SEQ ID NO: 1368030 - RNA, 13 nt, Mycobacterium tuberculosis H37Rv
cgcgaagcugugc

SEQ ID NO: 1368031 - RNA, 22 nt, Mycobacterium tuberculosis H37Rv
cgcgaagcugugcccggcgccc

SEQ ID NO: 1368032 - RNA, 16 nt, Mycobacterium tuberculosis H37Rv
cgccgucgucgcgcag

SEQ ID NO: 1368033 - RNA, 18 nt, Mycobacterium tuberculosis H37Rv
cgccgucgucgucggcag

SEQ ID NO: 1368034 - RNA, 23 nt, Mycobacterium tuberculosis H37Rv
cgccgucaccgaucgaacagugc

SEQ ID NO: 1368035 - RNA, 18 nt, Mycobacterium tuberculosis H37Rv
cgccgucggugccgccgc

SEQ ID NO: 1368036 - RNA, 17 nt, Mycobacterium tuberculosis H37Rv
cgccgucggugccgccg

SEQ ID NO: 1368037 - RNA, 20 nt, Mycobacterium tuberculosis H37Rv
cgccgucggguccgcggccc

SEQ ID NO: 1368038 - RNA, 16 nt, Mycobacterium tuberculosis H37Rv
cgccgucggcgcgcac

SEQ ID NO: 1368039 - RNA, 14 nt, Mycobacterium tuberculosis H37Rv
cgccgucgggccug

SEQ ID NO: 1368040 - RNA, 20 nt, Mycobacterium tuberculosis H37Rv
cgccgucgggccugccggag

SEQ ID NO: 1368041 - RNA, 17 nt, Mycobacterium tuberculosis H37Rv
cgccugcggcagcaccc

SEQ ID NO: 1368042 - RNA, 16 nt, Mycobacterium tuberculosis H37Rv
cgccugugccgccggc

SEQ ID NO: 1368043 - RNA, 15 nt, Mycobacterium tuberculosis H37Rv
cgccuguccugcggg

SEQ ID NO: 1368044 - RNA, 16 nt, Mycobacterium tuberculosis H37Rv
cgccuuugcccgccgc

SEQ ID NO: 1368045 - RNA, 21 nt, Mycobacterium tuberculosis H37Rv
cgccuuguggcacacccgcac

SEQ ID NO: 1368046 - RNA, 14 nt, Mycobacterium tuberculosis H37Rv
cgccuugucggcga

SEQ ID NO: 1368047 - RNA, 23 nt, Mycobacterium tuberculosis H37Rv
cgccuugcgggccugguggauga

SEQ ID NO: 1368048 - RNA, 13 nt, Mycobacterium tuberculosis H37Rv
cgccuuggcaccc

SEQ ID NO: 1368049 - RNA, 21 nt, Mycobacterium tuberculosis H37Rv
cgccuuggucgccgcuuucuu

SEQ ID NO: 1368050 - RNA, 17 nt, Mycobacterium tuberculosis H37Rv
cgccuuggucgccgcuu

SEQ ID NO: 1368051 - RNA, 21 nt, Mycobacterium tuberculosis H37Rv
cgccuuggucgccgccuucuu

SEQ ID NO: 1368052 - RNA, 16 nt, Mycobacterium tuberculosis H37Rv
cgccuuggucgccgcc

SEQ ID NO: 1368053 - RNA, 14 nt, Mycobacterium tuberculosis H37Rv
cgccuuggccacca

SEQ ID NO: 1368054 - RNA, 21 nt, Mycobacterium tuberculosis H37Rv
cgccuuggucaccuucuuggc

SEQ ID NO: 1368055 - RNA, 17 nt, Mycobacterium tuberculosis H37Rv
cgccuucuuggcggccu

SEQ ID NO: 1368056 - RNA, 20 nt, Mycobacterium tuberculosis H37Rv
cgccuugaagcgguggacga

SEQ ID NO: 1368057 - RNA, 21 nt, Mycobacterium tuberculosis H37Rv
cgccuuacgcaccgaugccuu

SEQ ID NO: 1368058 - RNA, 19 nt, Mycobacterium tuberculosis H37Rv
cgccuuaggcguccgagcg

SEQ ID NO: 1368059 - RNA, 19 nt, Mycobacterium tuberculosis H37Rv
cgccuucucccgcacggcc

SEQ ID NO: 1368060 - RNA, 18 nt, Mycobacterium tuberculosis H37Rv
cgccuucucccgcacggc

SEQ ID NO: 1368061 - RNA, 13 nt, Mycobacterium tuberculosis H37Rv
cgcgccgcggccc

SEQ ID NO: 1368062 - RNA, 19 nt, Mycobacterium tuberculosis H37Rv
cgcgccgcgcaucgcggcc

SEQ ID NO: 1368063 - RNA, 13 nt, Mycobacterium tuberculosis H37Rv
cgcgccgccgcua

SEQ ID NO: 1368064 - RNA, 12 nt, Mycobacterium tuberculosis H37Rv
cgcgccgcccgc

SEQ ID NO: 1368065 - RNA, 17 nt, Mycobacterium tuberculosis H37Rv
cgcgccguaacagccgg

SEQ ID NO: 1368066 - RNA, 13 nt, Mycobacterium tuberculosis H37Rv
cgcgccguucacc

SEQ ID NO: 1368067 - RNA, 16 nt, Mycobacterium tuberculosis H37Rv
cgcgccguugccgccc

SEQ ID NO: 1368068 - RNA, 22 nt, Mycobacterium tuberculosis H37Rv
cgcgccguagaccagcaggccc

SEQ ID NO: 1368069 - RNA, 16 nt, Mycobacterium tuberculosis H37Rv
cgcgccguagagccgc

SEQ ID NO: 1368070 - RNA, 21 nt, Mycobacterium tuberculosis H37Rv
cgcgccgucgucgaccacgac

SEQ ID NO: 1368071 - RNA, 19 nt, Mycobacterium tuberculosis H37Rv
cgcgccgucgucgcgcagu

SEQ ID NO: 1368072 - RNA, 17 nt, Mycobacterium tuberculosis H37Rv
cgcgcgccggcugccac

SEQ ID NO: 1368073 - RNA, 15 nt, Mycobacterium tuberculosis H37Rv
cgcgcgccggcggua

SEQ ID NO: 1368074 - RNA, 13 nt, Mycobacterium tuberculosis H37Rv
cgcgcgccgcagc

SEQ ID NO: 1368075 - RNA, 14 nt, Mycobacterium tuberculosis H37Rv
cgcgcgccgcagcg

SEQ ID NO: 1368076 - RNA, 15 nt, Mycobacterium tuberculosis H37Rv
cgcgccaagacgaac

SEQ ID NO: 1368077 - RNA, 12 nt, Mycobacterium tuberculosis H37Rv
cgcgcccgccgc

SEQ ID NO: 1368078 - RNA, 22 nt, Mycobacterium tuberculosis H37Rv
cgcgcccgacgagauugccggg

SEQ ID NO: 1368079 - RNA, 19 nt, Mycobacterium tuberculosis H37Rv
cgcgcccgccucaucggca

SEQ ID NO: 1368080 - RNA, 22 nt, Mycobacterium tuberculosis H37Rv
cgcgcccgccucgaccgccagc

SEQ ID NO: 1368081 - RNA, 14 nt, Mycobacterium tuberculosis H37Rv
cgcgcccgcgcgcu

SEQ ID NO: 1368082 - RNA, 14 nt, Mycobacterium tuberculosis H37Rv
cgcgcccucagccg

SEQ ID NO: 1368083 - RNA, 19 nt, Mycobacterium tuberculosis H37Rv
cgcgcccggaucucggcgu

SEQ ID NO: 1368084 - RNA, 14 nt, Mycobacterium tuberculosis H37Rv
cgcgcauucgccgg

SEQ ID NO: 1368085 - RNA, 19 nt, Mycobacterium tuberculosis H37Rv
cgcgccaaacaccccggcc

SEQ ID NO: 1368086 - RNA, 20 nt, Mycobacterium tuberculosis H37Rv
cgcgcauuuuucgccagcug

SEQ ID NO: 1368087 - RNA, 16 nt, Mycobacterium tuberculosis H37Rv
cgcgcauucgccgggc

SEQ ID NO: 1368088 - RNA, 18 nt, Mycobacterium tuberculosis H37Rv
cgcgcauucgccgggcgg

SEQ ID NO: 1368089 - RNA, 19 nt, Mycobacterium tuberculosis H37Rv
cgcgcaggcuuccagccac

SEQ ID NO: 1368090 - RNA, 14 nt, Mycobacterium tuberculosis H37Rv
cgcgcacgcgugcc

SEQ ID NO: 1368091 - RNA, 18 nt, Mycobacterium tuberculosis H37Rv
cgcgcaccugaucgguca

SEQ ID NO: 1368092 - RNA, 20 nt, Mycobacterium tuberculosis H37Rv
cgcgcaccggguugagccgc

SEQ ID NO: 1368093 - RNA, 17 nt, Mycobacterium tuberculosis H37Rv
cgcgcaacgccgccagc

SEQ ID NO: 1368094 - RNA, 19 nt, Mycobacterium tuberculosis H37Rv
cgcgcaaccgggcggacag

SEQ ID NO: 1368095 - RNA, 18 nt, Mycobacterium tuberculosis H37Rv
cgcgcacuugcguggcgu

SEQ ID NO: 1368096 - RNA, 19 nt, Mycobacterium tuberculosis H37Rv
cgcgaugagcggcgcggca

SEQ ID NO: 1368097 - RNA, 19 nt, Mycobacterium tuberculosis H37Rv
cgcgaucgggcccagcagc

SEQ ID NO: 1368098 - RNA, 17 nt, Mycobacterium tuberculosis H37Rv
cgcgaucgggcccagca

SEQ ID NO: 1368099 - RNA, 21 nt, Mycobacterium tuberculosis H37Rv
cgcgaugcccacgcacagcaa

SEQ ID NO: 1368100 - RNA, 23 nt, Mycobacterium tuberculosis H37Rv
cgcgaugaucaugaacgccagca

SEQ ID NO: 1368101 - RNA, 14 nt, Mycobacterium tuberculosis H37Rv
cgcgaugcgcacca

SEQ ID NO: 1368102 - RNA, 17 nt, Mycobacterium tuberculosis H37Rv
cgcgaugcgcaccagcg

SEQ ID NO: 1368103 - RNA, 15 nt, Mycobacterium tuberculosis H37Rv
cgcgauggcagcgcc

SEQ ID NO: 1368104 - RNA, 22 nt, Mycobacterium tuberculosis H37Rv
cgcgauggccccugucaugucc

SEQ ID NO: 1368105 - RNA, 14 nt, Mycobacterium tuberculosis H37Rv
cgcgauggccgcca

SEQ ID NO: 1368106 - RNA, 20 nt, Mycobacterium tuberculosis H37Rv
cgcgauggcgguccaccggc

SEQ ID NO: 1368107 - RNA, 17 nt, Mycobacterium tuberculosis H37Rv
cgcgauuccggcggcca

SEQ ID NO: 1368108 - RNA, 17 nt, Mycobacterium tuberculosis H37Rv
cgcgaugugcgccaccu

SEQ ID NO: 1368109 - RNA, 14 nt, Mycobacterium tuberculosis H37Rv
cgcgauggugcgcc

SEQ ID NO: 1368110 - RNA, 16 nt, Mycobacterium tuberculosis H37Rv
cgcgaugggagcccgg

SEQ ID NO: 1368111 - RNA, 17 nt, Mycobacterium tuberculosis H37Rv
cgcgaugguggccgcca

SEQ ID NO: 1368112 - RNA, 14 nt, Mycobacterium tuberculosis H37Rv
cgcgcaacccggac

SEQ ID NO: 1368113 - RNA, 15 nt, Mycobacterium tuberculosis H37Rv
cgcgcaaccgggcgg

SEQ ID NO: 1368114 - RNA, 19 nt, Mycobacterium tuberculosis H37Rv
cgcgguggggucgacgcag

SEQ ID NO: 1368115 - RNA, 20 nt, Mycobacterium tuberculosis H37Rv
cgcgguguagaagcgggcgu

SEQ ID NO: 1368116 - RNA, 11 nt, Mycobacterium tuberculosis H37Rv
cgcgguguucg

SEQ ID NO: 1368117 - RNA, 16 nt, Mycobacterium tuberculosis H37Rv
cgcgguguucgcggca

SEQ ID NO: 1368118 - RNA, 21 nt, Mycobacterium tuberculosis H37Rv
cgcggugugcggcagcccgcu

SEQ ID NO: 1368119 - RNA, 18 nt, Mycobacterium tuberculosis H37Rv
cgcggugggcacagccag

SEQ ID NO: 1368120 - RNA, 17 nt, Mycobacterium tuberculosis H37Rv
cgcgguugugacgguga

SEQ ID NO: 1368121 - RNA, 20 nt, Mycobacterium tuberculosis H37Rv
cgcgguuguccuccgacggg

SEQ ID NO: 1368122 - RNA, 14 nt, Mycobacterium tuberculosis H37Rv
cgcgguuggcggcg

SEQ ID NO: 1368123 - RNA, 21 nt, Mycobacterium tuberculosis H37Rv
cgcggucuugacaccgccggg

SEQ ID NO: 1368124 - RNA, 22 nt, Mycobacterium tuberculosis H37Rv
cgcggugacucggccuccgccg

SEQ ID NO: 1368125 - RNA, 15 nt, Mycobacterium tuberculosis H37Rv
cgcggugccggcgga

SEQ ID NO: 1368126 - RNA, 15 nt, Mycobacterium tuberculosis H37Rv
cgcggugccggccgu

SEQ ID NO: 1368127 - RNA, 22 nt, Mycobacterium tuberculosis H37Rv
cgcggugcgcgugacgaccagc

SEQ ID NO: 1368128 - RNA, 20 nt, Mycobacterium tuberculosis H37Rv
cgcggugcggccacucgccc

SEQ ID NO: 1368129 - RNA, 16 nt, Mycobacterium tuberculosis H37Rv
cgcggugccgccaccg

SEQ ID NO: 1368130 - RNA, 15 nt, Mycobacterium tuberculosis H37Rv
cgcggucggcgugca

SEQ ID NO: 1368131 - RNA, 19 nt, Mycobacterium tuberculosis H37Rv
cgcggucucagugcucgcc

SEQ ID NO: 1368132 - RNA, 18 nt, Mycobacterium tuberculosis H37Rv
cgcggucugcuccaggcg

SEQ ID NO: 1368133 - RNA, 22 nt, Mycobacterium tuberculosis H37Rv
cgcggucugcuccaggcgcgcc

SEQ ID NO: 1368134 - RNA, 23 nt, Mycobacterium tuberculosis H37Rv
cgcggucugcuccaggcgcgccg

SEQ ID NO: 1368135 - RNA, 13 nt, Mycobacterium tuberculosis H37Rv
cgcggucgcagca

SEQ ID NO: 1368136 - RNA, 22 nt, Mycobacterium tuberculosis H37Rv
cgcggucggagucgagcacacc

SEQ ID NO: 1368137 - RNA, 12 nt, Mycobacterium tuberculosis H37Rv
cgcggucgcgcg

SEQ ID NO: 1368138 - RNA, 20 nt, Mycobacterium tuberculosis H37Rv
cgcggucggcagcgacgccg

SEQ ID NO: 1368139 - RNA, 17 nt, Mycobacterium tuberculosis H37Rv
cgcggucggccaccaac

SEQ ID NO: 1368140 - RNA, 14 nt, Mycobacterium tuberculosis H37Rv
cgcgguccuccaga

SEQ ID NO: 1368141 - RNA, 15 nt, Mycobacterium tuberculosis H37Rv
cgcggucgagcaggu

SEQ ID NO: 1368142 - RNA, 20 nt, Mycobacterium tuberculosis H37Rv
cgcggucgagguccuugagg

SEQ ID NO: 1368143 - RNA, 17 nt, Mycobacterium tuberculosis H37Rv
cgcggucgaucaggccg

SEQ ID NO: 1368144 - RNA, 22 nt, Mycobacterium tuberculosis H37Rv
cgcggucccacggccggccgcu

SEQ ID NO: 1368145 - RNA, 19 nt, Mycobacterium tuberculosis H37Rv
cgcggucaucgagcugacc

SEQ ID NO: 1368146 - RNA, 19 nt, Mycobacterium tuberculosis H37Rv
cgcggucaaauccagcagc

SEQ ID NO: 1368147 - RNA, 12 nt, Mycobacterium tuberculosis H37Rv
cgcggucagcgg

SEQ ID NO: 1368148 - RNA, 13 nt, Mycobacterium tuberculosis H37Rv
cgcgguagcgccg

SEQ ID NO: 1368149 - RNA, 17 nt, Mycobacterium tuberculosis H37Rv
cgcgguagccgcggcca

SEQ ID NO: 1368150 - RNA, 20 nt, Mycobacterium tuberculosis H37Rv
cgcgguaccgcucgggcgcg

SEQ ID NO: 1368151 - RNA, 21 nt, Mycobacterium tuberculosis H37Rv
cgcgguacccaccucccgcag

SEQ ID NO: 1368152 - RNA, 19 nt, Mycobacterium tuberculosis H37Rv
cgcgguaccaucaccgcgc

SEQ ID NO: 1368153 - RNA, 14 nt, Mycobacterium tuberculosis H37Rv
cgcgguaaagcccc

SEQ ID NO: 1368154 - RNA, 15 nt, Mycobacterium tuberculosis H37Rv
cgcgguaaagccccg

SEQ ID NO: 1368155 - RNA, 16 nt, Mycobacterium tuberculosis H37Rv
cgcgggugcgccggcg

SEQ ID NO: 1368156 - RNA, 12 nt, Mycobacterium tuberculosis H37Rv
cgcgggugcgga

SEQ ID NO: 1368157 - RNA, 17 nt, Mycobacterium tuberculosis H37Rv
cgcgucgugccacuucc

SEQ ID NO: 1368158 - RNA, 15 nt, Mycobacterium tuberculosis H37Rv
cgcgucgaagccggg

SEQ ID NO: 1368159 - RNA, 17 nt, Mycobacterium tuberculosis H37Rv
cgcguccuuuuccgccg

SEQ ID NO: 1368160 - RNA, 17 nt, Mycobacterium tuberculosis H37Rv
cgcgucugcucgccagc

SEQ ID NO: 1368161 - RNA, 15 nt, Mycobacterium tuberculosis H37Rv
cgcgucugcucgcca

SEQ ID NO: 1368162 - RNA, 22 nt, Mycobacterium tuberculosis H37Rv
cgcgucuacgucguccagcacc

SEQ ID NO: 1368163 - RNA, 13 nt, Mycobacterium tuberculosis H37Rv
cgcgugaccaggg

SEQ ID NO: 1368164 - RNA, 17 nt, Mycobacterium tuberculosis H37Rv
cgcguuccuccagcagc

SEQ ID NO: 1368165 - RNA, 19 nt, Mycobacterium tuberculosis H37Rv
cgcguuucgucgaccgcgc

SEQ ID NO: 1368166 - RNA, 17 nt, Mycobacterium tuberculosis H37Rv
cgcguuugcgaagccca

SEQ ID NO: 1368167 - RNA, 14 nt, Mycobacterium tuberculosis H37Rv
cgcguggugcugac

SEQ ID NO: 1368168 - RNA, 20 nt, Mycobacterium tuberculosis H37Rv
cgcguacaggccggccacca

SEQ ID NO: 1368169 - RNA, 16 nt, Mycobacterium tuberculosis H37Rv
cgcguagagcagcagc

SEQ ID NO: 1368170 - RNA, 16 nt, Mycobacterium tuberculosis H37Rv
cgcguagaccagugac

SEQ ID NO: 1368171 - RNA, 18 nt, Mycobacterium tuberculosis H37Rv
cgcguaaaccggcugacc

SEQ ID NO: 1368172 - RNA, 17 nt, Mycobacterium tuberculosis H37Rv
cgcgguuuugugcgggc

SEQ ID NO: 1368173 - RNA, 17 nt, Mycobacterium tuberculosis H37Rv
cgcguagggccagcgcc

SEQ ID NO: 1368174 - RNA, 18 nt, Mycobacterium tuberculosis H37Rv
cgcguagguggccagcgc

SEQ ID NO: 1368175 - RNA, 13 nt, Mycobacterium tuberculosis H37Rv
cgcguaguggugg

SEQ ID NO: 1368176 - RNA, 13 nt, Mycobacterium tuberculosis H37Rv
cgcgucaagucug

SEQ ID NO: 1368177 - RNA, 21 nt, Mycobacterium tuberculosis H37Rv
cgcguccgggcagccgcgccg

SEQ ID NO: 1368178 - RNA, 20 nt, Mycobacterium tuberculosis H37Rv
cgcguccggugcaccaggua

SEQ ID NO: 1368179 - RNA, 13 nt, Mycobacterium tuberculosis H37Rv
cgcguccuccucg

SEQ ID NO: 1368180 - RNA, 14 nt, Mycobacterium tuberculosis H37Rv
cgcguccuccucgg

SEQ ID NO: 1368181 - RNA, 14 nt, Mycobacterium tuberculosis H37Rv
cgcguccgggcagc

SEQ ID NO: 1368182 - RNA, 17 nt, Mycobacterium tuberculosis H37Rv
cgcgucccgccgcaccg

SEQ ID NO: 1368183 - RNA, 21 nt, Mycobacterium tuberculosis H37Rv
cgcggcugccaucccgauccc

SEQ ID NO: 1368184 - RNA, 14 nt, Mycobacterium tuberculosis H37Rv
cgcggcgggcccga

SEQ ID NO: 1368185 - RNA, 12 nt, Mycobacterium tuberculosis H37Rv
cgcggcgggccc

SEQ ID NO: 1368186 - RNA, 12 nt, Mycobacterium tuberculosis H37Rv
cgcggcggcgcc

SEQ ID NO: 1368187 - RNA, 13 nt, Mycobacterium tuberculosis H37Rv
cgcggcgggcagc

SEQ ID NO: 1368188 - RNA, 19 nt, Mycobacterium tuberculosis H37Rv
cgcggcgggcagcgggccc

SEQ ID NO: 1368189 - RNA, 24 nt, Mycobacterium tuberculosis H37Rv
cgcggcgacaagccgagcccgucg

SEQ ID NO: 1368190 - RNA, 16 nt, Mycobacterium tuberculosis H37Rv
cgcggcggccuccacc

SEQ ID NO: 1368191 - RNA, 14 nt, Mycobacterium tuberculosis H37Rv
cgcggcggcggcca

SEQ ID NO: 1368192 - RNA, 12 nt, Mycobacterium tuberculosis H37Rv
cgcggccugcac

SEQ ID NO: 1368193 - RNA, 16 nt, Mycobacterium tuberculosis H37Rv
cgcggccugacgcugc

SEQ ID NO: 1368194 - RNA, 16 nt, Mycobacterium tuberculosis H37Rv
cgcggccucguagucc

SEQ ID NO: 1368195 - RNA, 17 nt, Mycobacterium tuberculosis H37Rv
cgcggccguggaugucg

SEQ ID NO: 1368196 - RNA, 20 nt, Mycobacterium tuberculosis H37Rv
cgcggccguggaugucgcgg

SEQ ID NO: 1368197 - RNA, 23 nt, Mycobacterium tuberculosis H37Rv
cgcggcgaaccgucucgcccccu

SEQ ID NO: 1368198 - RNA, 22 nt, Mycobacterium tuberculosis H37Rv
cgcggccauuagcagcacccgg

SEQ ID NO: 1368199 - RNA, 14 nt, Mycobacterium tuberculosis H37Rv
cgcggccggccgcu

SEQ ID NO: 1368200 - RNA, 13 nt, Mycobacterium tuberculosis H37Rv
cgcggccggcgcu

SEQ ID NO: 1368201 - RNA, 12 nt, Mycobacterium tuberculosis H37Rv
cgcggccagcgg

SEQ ID NO: 1368202 - RNA, 13 nt, Mycobacterium tuberculosis H37Rv
cgcggccagcggg

SEQ ID NO: 1368203 - RNA, 22 nt, Mycobacterium tuberculosis H37Rv
cgcgggagguacccccagcacc

SEQ ID NO: 1368204 - RNA, 23 nt, Mycobacterium tuberculosis H37Rv
cgcggcuuggccuagccgcggca

SEQ ID NO: 1368205 - RNA, 20 nt, Mycobacterium tuberculosis H37Rv
cgcggcuuugacgcccggca

SEQ ID NO: 1368206 - RNA, 19 nt, Mycobacterium tuberculosis H37Rv
cgcggcuggugucgggcgu

SEQ ID NO: 1368207 - RNA, 18 nt, Mycobacterium tuberculosis H37Rv
cgcggcuucaguccggcc

SEQ ID NO: 1368208 - RNA, 18 nt, Mycobacterium tuberculosis H37Rv
cgcggcuuggccaaaacc

SEQ ID NO: 1368209 - RNA, 20 nt, Mycobacterium tuberculosis H37Rv
cgcggcuuggccuagccgcg

SEQ ID NO: 1368210 - RNA, 17 nt, Mycobacterium tuberculosis H37Rv
cgcgggcgugcuacacc

SEQ ID NO: 1368211 - RNA, 12 nt, Mycobacterium tuberculosis H37Rv
cgcggggccggc

SEQ ID NO: 1368212 - RNA, 22 nt, Mycobacterium tuberculosis H37Rv
cgcgggggugggcgugacgggc

SEQ ID NO: 1368213 - RNA, 21 nt, Mycobacterium tuberculosis H37Rv
cgcggggucugucgaacuggu

SEQ ID NO: 1368214 - RNA, 15 nt, Mycobacterium tuberculosis H37Rv
cgcggguccagccac

SEQ ID NO: 1368215 - RNA, 13 nt, Mycobacterium tuberculosis H37Rv
cgcgggucccggc

SEQ ID NO: 1368216 - RNA, 22 nt, Mycobacterium tuberculosis H37Rv
cgcgggugccgggcaugaucac

SEQ ID NO: 1368217 - RNA, 20 nt, Mycobacterium tuberculosis H37Rv
cgcgggugccgacgucggca

SEQ ID NO: 1368218 - RNA, 14 nt, Mycobacterium tuberculosis H37Rv
cgcgggugccgggc

SEQ ID NO: 1368219 - RNA, 21 nt, Mycobacterium tuberculosis H37Rv
cgcgggugccagaucggcggg

SEQ ID NO: 1368220 - RNA, 19 nt, Mycobacterium tuberculosis H37Rv
cgcgggucgugccagcagc

SEQ ID NO: 1368221 - RNA, 21 nt, Mycobacterium tuberculosis H37Rv
cgcggaguucgcugacggcca

SEQ ID NO: 1368222 - RNA, 18 nt, Mycobacterium tuberculosis H37Rv
cgcggagucaagcagcag

SEQ ID NO: 1368223 - RNA, 17 nt, Mycobacterium tuberculosis H37Rv
cgcggaccucgaagccc

SEQ ID NO: 1368224 - RNA, 18 nt, Mycobacterium tuberculosis H37Rv
cgcggaggcggccagccu

SEQ ID NO: 1368225 - RNA, 13 nt, Mycobacterium tuberculosis H37Rv
cgcggagccagga

SEQ ID NO: 1368226 - RNA, 15 nt, Mycobacterium tuberculosis H37Rv
cgcggacuuggcggu

SEQ ID NO: 1368227 - RNA, 16 nt, Mycobacterium tuberculosis H37Rv
cgcggagagccugcuc

SEQ ID NO: 1368228 - RNA, 19 nt, Mycobacterium tuberculosis H37Rv
cgcggacgugccggucccc

SEQ ID NO: 1368229 - RNA, 17 nt, Mycobacterium tuberculosis H37Rv
cgcgcuugcgaucggca

SEQ ID NO: 1368230 - RNA, 14 nt, Mycobacterium tuberculosis H37Rv
cgcggacagcccgg

SEQ ID NO: 1368231 - RNA, 12 nt, Mycobacterium tuberculosis H37Rv
cgcggacccgcg

SEQ ID NO: 1368232 - RNA, 23 nt, Mycobacterium tuberculosis H37Rv
cgcggaccucgaagcccagcacc

SEQ ID NO: 1368233 - RNA, 20 nt, Mycobacterium tuberculosis H37Rv
cgcgcuguacugccccagca

SEQ ID NO: 1368234 - RNA, 17 nt, Mycobacterium tuberculosis H37Rv
cgcgcuguagggcacug

SEQ ID NO: 1368235 - RNA, 20 nt, Mycobacterium tuberculosis H37Rv
cgcgcuguccacgaugacgu

SEQ ID NO: 1368236 - RNA, 23 nt, Mycobacterium tuberculosis H37Rv
cgcgcuucacagccaccagccgg

SEQ ID NO: 1368237 - RNA, 14 nt, Mycobacterium tuberculosis H37Rv
cgcgcgcucgcggc

SEQ ID NO: 1368238 - RNA, 18 nt, Mycobacterium tuberculosis H37Rv
cgcgcgcugggcgcgcuc

SEQ ID NO: 1368239 - RNA, 19 nt, Mycobacterium tuberculosis H37Rv
cgcgcgcugggcgcgcuca

SEQ ID NO: 1368240 - RNA, 20 nt, Mycobacterium tuberculosis H37Rv
cgcgcgcgauggacaacaag

SEQ ID NO: 1368241 - RNA, 19 nt, Mycobacterium tuberculosis H37Rv
cgcggccacaucgccagca

SEQ ID NO: 1368242 - RNA, 23 nt, Mycobacterium tuberculosis H37Rv
cgcggccacaucgccagcagcaa

SEQ ID NO: 1368243 - RNA, 21 nt, Mycobacterium tuberculosis H37Rv
cgcggccacaugaucgagcag

SEQ ID NO: 1368244 - RNA, 11 nt, Mycobacterium tuberculosis H37Rv
cgcggccacca

SEQ ID NO: 1368245 - RNA, 18 nt, Mycobacterium tuberculosis H37Rv
cgcggccacaucgccagc

SEQ ID NO: 1368246 - RNA, 23 nt, Mycobacterium tuberculosis H37Rv
cgcggccacaccuuggccgccgg

SEQ ID NO: 1368247 - RNA, 16 nt, Mycobacterium tuberculosis H37Rv
cgcggccaccaccgcc

SEQ ID NO: 1368248 - RNA, 12 nt, Mycobacterium tuberculosis H37Rv
cgcggccaccac

SEQ ID NO: 1368249 - RNA, 13 nt, Mycobacterium tuberculosis H37Rv
cgcggccacccgc

SEQ ID NO: 1368250 - RNA, 15 nt, Mycobacterium tuberculosis H37Rv
cgcggccagagccgc

SEQ ID NO: 1368251 - RNA, 17 nt, Mycobacterium tuberculosis H37Rv
cgcggccagcccacucg

SEQ ID NO: 1368252 - RNA, 16 nt, Mycobacterium tuberculosis H37Rv
cgcggccaccgccgcc

SEQ ID NO: 1368253 - RNA, 20 nt, Mycobacterium tuberculosis H37Rv
cgcggccaccaccgccgccg

SEQ ID NO: 1368254 - RNA, 12 nt, Mycobacterium tuberculosis H37Rv
cgcggccaccgc

SEQ ID NO: 1368255 - RNA, 18 nt, Mycobacterium tuberculosis H37Rv
cgcggccaccgccgccgc

SEQ ID NO: 1368256 - RNA, 19 nt, Mycobacterium tuberculosis H37Rv
cgcggccaaucagcccgcc

SEQ ID NO: 1368257 - RNA, 16 nt, Mycobacterium tuberculosis H37Rv
cgcggcaagcucgucc

SEQ ID NO: 1368258 - RNA, 20 nt, Mycobacterium tuberculosis H37Rv
cgcggcaauggugcgggcca

SEQ ID NO: 1368259 - RNA, 21 nt, Mycobacterium tuberculosis H37Rv
cgcggcaauggugcgggccac

SEQ ID NO: 1368260 - RNA, 19 nt, Mycobacterium tuberculosis H37Rv
cgcggcacggugugcggca

SEQ ID NO: 1368261 - RNA, 21 nt, Mycobacterium tuberculosis H37Rv
cgcggcacuuuguagcccgcg

SEQ ID NO: 1368262 - RNA, 21 nt, Mycobacterium tuberculosis H37Rv
cgcggcacgcccacagcugac

SEQ ID NO: 1368263 - RNA, 15 nt, Mycobacterium tuberculosis H37Rv
cgcggcacccggcuu

SEQ ID NO: 1368264 - RNA, 14 nt, Mycobacterium tuberculosis H37Rv
cgcggcacccgguc

SEQ ID NO: 1368265 - RNA, 14 nt, Mycobacterium tuberculosis H37Rv
cgcggcagggccug

SEQ ID NO: 1368266 - RNA, 12 nt, Mycobacterium tuberculosis H37Rv
cgcggcagggcg

SEQ ID NO: 1368267 - RNA, 21 nt, Mycobacterium tuberculosis H37Rv
cgcggcaucccgccacaccaa

SEQ ID NO: 1368268 - RNA, 16 nt, Mycobacterium tuberculosis H37Rv
cgcggcagccggcgga

SEQ ID NO: 1368269 - RNA, 14 nt, Mycobacterium tuberculosis H37Rv
cgcggcagccggcg

SEQ ID NO: 1368270 - RNA, 15 nt, Mycobacterium tuberculosis H37Rv
cgcccacccgcugcg

SEQ ID NO: 1368271 - RNA, 22 nt, Mycobacterium tuberculosis H37Rv
cgcccaccacgcgacgcggggc

SEQ ID NO: 1368272 - RNA, 13 nt, Mycobacterium tuberculosis H37Rv
cgcccaccgggcg

SEQ ID NO: 1368273 - RNA, 21 nt, Mycobacterium tuberculosis H37Rv
cgcccagcagcaccugcaccg

SEQ ID NO: 1368274 - RNA, 15 nt, Mycobacterium tuberculosis H37Rv
cgcccagcgaggugg

SEQ ID NO: 1368275 - RNA, 23 nt, Mycobacterium tuberculosis H37Rv
cgcccagccacugacggcuucca

SEQ ID NO: 1368276 - RNA, 19 nt, Mycobacterium tuberculosis H37Rv
cgcccagcaucucggcggc

SEQ ID NO: 1368277 - RNA, 14 nt, Mycobacterium tuberculosis H37Rv
cgcccagccgagcg

SEQ ID NO: 1368278 - RNA, 13 nt, Mycobacterium tuberculosis H37Rv
cgccaugcggcgc

SEQ ID NO: 1368279 - RNA, 23 nt, Mycobacterium tuberculosis H37Rv
cgcccaccacugugacacccgag

SEQ ID NO: 1368280 - RNA, 18 nt, Mycobacterium tuberculosis H37Rv
cgcccaccacgaacacgu

SEQ ID NO: 1368281 - RNA, 16 nt, Mycobacterium tuberculosis H37Rv
cgcccacaugcucagg

SEQ ID NO: 1368282 - RNA, 21 nt, Mycobacterium tuberculosis H37Rv
cgcccaccacacagccgcgcu

SEQ ID NO: 1368283 - RNA, 22 nt, Mycobacterium tuberculosis H37Rv
cgcccaccaccacugcggccgc

SEQ ID NO: 1368284 - RNA, 14 nt, Mycobacterium tuberculosis H37Rv
cgcccacagcugac

SEQ ID NO: 1368285 - RNA, 21 nt, Mycobacterium tuberculosis H37Rv
cgcccacaggggcagcgcggc

SEQ ID NO: 1368286 - RNA, 17 nt, Mycobacterium tuberculosis H37Rv
cgccaucucguaggggu

SEQ ID NO: 1368287 - RNA, 16 nt, Mycobacterium tuberculosis H37Rv
cgccaucgucgcgccg

SEQ ID NO: 1368288 - RNA, 19 nt, Mycobacterium tuberculosis H37Rv
cgccaucgucgaagaccuc

SEQ ID NO: 1368289 - RNA, 17 nt, Mycobacterium tuberculosis H37Rv
cgccacgccgaugaugg

SEQ ID NO: 1368290 - RNA, 18 nt, Mycobacterium tuberculosis H37Rv
cgccaccgugucacgcga

SEQ ID NO: 1368291 - RNA, 20 nt, Mycobacterium tuberculosis H37Rv
cgccaccgugguggacgacc

SEQ ID NO: 1368292 - RNA, 17 nt, Mycobacterium tuberculosis H37Rv
cgccaccgucaccgccg

SEQ ID NO: 1368293 - RNA, 18 nt, Mycobacterium tuberculosis H37Rv
cgccacggaucgcggcgg

SEQ ID NO: 1368294 - RNA, 19 nt, Mycobacterium tuberculosis H37Rv
cgccacggaucgcggcggc

SEQ ID NO: 1368295 - RNA, 16 nt, Mycobacterium tuberculosis H37Rv
cgccacggcagcgccc

SEQ ID NO: 1368296 - RNA, 12 nt, Mycobacterium tuberculosis H37Rv
cgcccgccccgc

SEQ ID NO: 1368297 - RNA, 17 nt, Mycobacterium tuberculosis H37Rv
cgcccgcccgagccgcu

SEQ ID NO: 1368298 - RNA, 14 nt, Mycobacterium tuberculosis H37Rv
cgcccgccaccggg

SEQ ID NO: 1368299 - RNA, 13 nt, Mycobacterium tuberculosis H37Rv
cgcccgccggcau

SEQ ID NO: 1368300 - RNA, 13 nt, Mycobacterium tuberculosis H37Rv
cgcccgcaccacc

SEQ ID NO: 1368301 - RNA, 16 nt, Mycobacterium tuberculosis H37Rv
cgcccgaugcgccagc

SEQ ID NO: 1368302 - RNA, 18 nt, Mycobacterium tuberculosis H37Rv
cgcccgcaccaccggccc

SEQ ID NO: 1368303 - RNA, 19 nt, Mycobacterium tuberculosis H37Rv
cgcccgcaccaccggcccc

SEQ ID NO: 1368304 - RNA, 16 nt, Mycobacterium tuberculosis H37Rv
cgcccgcacccaugau

SEQ ID NO: 1368305 - RNA, 17 nt, Mycobacterium tuberculosis H37Rv
cgcccgcacccccgaca

SEQ ID NO: 1368306 - RNA, 11 nt, Mycobacterium tuberculosis H37Rv
cgccccgcucg

SEQ ID NO: 1368307 - RNA, 12 nt, Mycobacterium tuberculosis H37Rv
cgccccgcgccc

SEQ ID NO: 1368308 - RNA, 16 nt, Mycobacterium tuberculosis H37Rv
cgcccgaagccgggcc

SEQ ID NO: 1368309 - RNA, 13 nt, Mycobacterium tuberculosis H37Rv
cgccccggccgcu

SEQ ID NO: 1368310 - RNA, 19 nt, Mycobacterium tuberculosis H37Rv
cgcccgacgugaagccaag

SEQ ID NO: 1368311 - RNA, 20 nt, Mycobacterium tuberculosis H37Rv
cgcccgagaccggcaccggc

SEQ ID NO: 1368312 - RNA, 16 nt, Mycobacterium tuberculosis H37Rv
cgcccgagccgcugcg

SEQ ID NO: 1368313 - RNA, 17 nt, Mycobacterium tuberculosis H37Rv
cgcccgaggcacccgug

SEQ ID NO: 1368314 - RNA, 18 nt, Mycobacterium tuberculosis H37Rv
cgcccgagugaccagggu

SEQ ID NO: 1368315 - RNA, 13 nt, Mycobacterium tuberculosis H37Rv
cgcccgaguugaa

SEQ ID NO: 1368316 - RNA, 21 nt, Mycobacterium tuberculosis H37Rv
cgcccauucccagaggcccgc

SEQ ID NO: 1368317 - RNA, 15 nt, Mycobacterium tuberculosis H37Rv
cgcccauggccacca

SEQ ID NO: 1368318 - RNA, 17 nt, Mycobacterium tuberculosis H37Rv
cgcccauggccaccagg

SEQ ID NO: 1368319 - RNA, 21 nt, Mycobacterium tuberculosis H37Rv
cgcccauggcgucgaaccagu

SEQ ID NO: 1368320 - RNA, 16 nt, Mycobacterium tuberculosis H37Rv
cgcccaggcgcgacgu

SEQ ID NO: 1368321 - RNA, 18 nt, Mycobacterium tuberculosis H37Rv
cgcccagcgacaacacca

SEQ ID NO: 1368322 - RNA, 15 nt, Mycobacterium tuberculosis H37Rv
cgcccagggugucug

SEQ ID NO: 1368323 - RNA, 14 nt, Mycobacterium tuberculosis H37Rv
cgccccaccggccc

SEQ ID NO: 1368324 - RNA, 17 nt, Mycobacterium tuberculosis H37Rv
cgccccaccggcccggg

SEQ ID NO: 1368325 - RNA, 15 nt, Mycobacterium tuberculosis H37Rv
cgccccaccgcgccg

SEQ ID NO: 1368326 - RNA, 17 nt, Mycobacterium tuberculosis H37Rv
cgccccaccgcgccgag

SEQ ID NO: 1368327 - RNA, 16 nt, Mycobacterium tuberculosis H37Rv
cgccccaagcgccuga

SEQ ID NO: 1368328 - RNA, 16 nt, Mycobacterium tuberculosis H37Rv
cgccccacaacaugcu

SEQ ID NO: 1368329 - RNA, 23 nt, Mycobacterium tuberculosis H37Rv
cgcccauuggguaaccagcgcca

SEQ ID NO: 1368330 - RNA, 14 nt, Mycobacterium tuberculosis H37Rv
cgccccgaggaugc

SEQ ID NO: 1368331 - RNA, 21 nt, Mycobacterium tuberculosis H37Rv
cgccccgauaaaaaccacccc

SEQ ID NO: 1368332 - RNA, 15 nt, Mycobacterium tuberculosis H37Rv
cgccccaccggccga

SEQ ID NO: 1368333 - RNA, 20 nt, Mycobacterium tuberculosis H37Rv
cgccgagcuggcaacgccgc

SEQ ID NO: 1368334 - RNA, 16 nt, Mycobacterium tuberculosis H37Rv
cgccgaguccggcgag

SEQ ID NO: 1368335 - RNA, 16 nt, Mycobacterium tuberculosis H37Rv
cgccgauaccgccggc

SEQ ID NO: 1368336 - RNA, 19 nt, Mycobacterium tuberculosis H37Rv
cgccgauaccgccggcccc

SEQ ID NO: 1368337 - RNA, 16 nt, Mycobacterium tuberculosis H37Rv
cgccgauaucggugac

SEQ ID NO: 1368338 - RNA, 20 nt, Mycobacterium tuberculosis H37Rv
cgccgaucaccaccggcaga

SEQ ID NO: 1368339 - RNA, 19 nt, Mycobacterium tuberculosis H37Rv
cgccgagcugguugacggc

SEQ ID NO: 1368340 - RNA, 18 nt, Mycobacterium tuberculosis H37Rv
cgccgaggucgguucggc

SEQ ID NO: 1368341 - RNA, 20 nt, Mycobacterium tuberculosis H37Rv
cgccgaggucgaaccgccgg

SEQ ID NO: 1368342 - RNA, 16 nt, Mycobacterium tuberculosis H37Rv
cgccgaggacgccggc

SEQ ID NO: 1368343 - RNA, 18 nt, Mycobacterium tuberculosis H37Rv
cgccgaggacgccggcgc

SEQ ID NO: 1368344 - RNA, 19 nt, Mycobacterium tuberculosis H37Rv
cgccgaggaaaccaccagu

SEQ ID NO: 1368345 - RNA, 22 nt, Mycobacterium tuberculosis H37Rv
cgccgagcuggcaacgccgcgc

SEQ ID NO: 1368346 - RNA, 16 nt, Mycobacterium tuberculosis H37Rv
cgccgagcucggucac

SEQ ID NO: 1368347 - RNA, 20 nt, Mycobacterium tuberculosis H37Rv
cgccgacgauuaccagcggc

SEQ ID NO: 1368348 - RNA, 19 nt, Mycobacterium tuberculosis H37Rv
cgccgaccuucggcccgcu

SEQ ID NO: 1368349 - RNA, 20 nt, Mycobacterium tuberculosis H37Rv
cgccgacgauccagucuggg

SEQ ID NO: 1368350 - RNA, 12 nt, Mycobacterium tuberculosis H37Rv
cgccgacgccgc

SEQ ID NO: 1368351 - RNA, 18 nt, Mycobacterium tuberculosis H37Rv
cgccgacgccgccggccc

SEQ ID NO: 1368352 - RNA, 15 nt, Mycobacterium tuberculosis H37Rv
cgccgacgccgccgg

SEQ ID NO: 1368353 - RNA, 16 nt, Mycobacterium tuberculosis H37Rv
cgccgacgccgccggc

SEQ ID NO: 1368354 - RNA, 14 nt, Mycobacterium tuberculosis H37Rv
cgccgacgccagaa

SEQ ID NO: 1368355 - RNA, 21 nt, Mycobacterium tuberculosis H37Rv
cgccgagcacacgucgggagu

SEQ ID NO: 1368356 - RNA, 14 nt, Mycobacterium tuberculosis H37Rv
cgccgagcaccggg

SEQ ID NO: 1368357 - RNA, 20 nt, Mycobacterium tuberculosis H37Rv
cgccgagcagacgcaacggc

SEQ ID NO: 1368358 - RNA, 15 nt, Mycobacterium tuberculosis H37Rv
cgccgagcccgccgg

SEQ ID NO: 1368359 - RNA, 16 nt, Mycobacterium tuberculosis H37Rv
cgccgagcccgccggg

SEQ ID NO: 1368360 - RNA, 13 nt, Mycobacterium tuberculosis H37Rv
cgccgagcccgcc

SEQ ID NO: 1368361 - RNA, 17 nt, Mycobacterium tuberculosis H37Rv
cgccgccagucguccuc

SEQ ID NO: 1368362 - RNA, 17 nt, Mycobacterium tuberculosis H37Rv
cgccgccauugccgccg

SEQ ID NO: 1368363 - RNA, 18 nt, Mycobacterium tuberculosis H37Rv
cgccgccauugccgccgg

SEQ ID NO: 1368364 - RNA, 13 nt, Mycobacterium tuberculosis H37Rv
cgccgccaccagc

SEQ ID NO: 1368365 - RNA, 22 nt, Mycobacterium tuberculosis H37Rv
cgccgccaccaccgcugccggc

SEQ ID NO: 1368366 - RNA, 20 nt, Mycobacterium tuberculosis H37Rv
cgccgccacagcacccacgc

SEQ ID NO: 1368367 - RNA, 16 nt, Mycobacterium tuberculosis H37Rv
cgccgccaaagccggg

SEQ ID NO: 1368368 - RNA, 14 nt, Mycobacterium tuberculosis H37Rv
cgccgccacccggc

SEQ ID NO: 1368369 - RNA, 15 nt, Mycobacterium tuberculosis H37Rv
cgccgccacccggcg

SEQ ID NO: 1368370 - RNA, 16 nt, Mycobacterium tuberculosis H37Rv
cgccgccacccggcgg

SEQ ID NO: 1368371 - RNA, 19 nt, Mycobacterium tuberculosis H37Rv
cgccgcagggccgcgcgca

SEQ ID NO: 1368372 - RNA, 22 nt, Mycobacterium tuberculosis H37Rv
cgccgcagguucaacgcgggga

SEQ ID NO: 1368373 - RNA, 22 nt, Mycobacterium tuberculosis H37Rv
cgccgcagugacgggacccggg

SEQ ID NO: 1368374 - RNA, 23 nt, Mycobacterium tuberculosis H37Rv
cgccgcauugcagaaccgccaac

SEQ ID NO: 1368375 - RNA, 13 nt, Mycobacterium tuberculosis H37Rv
cgccgcaccgccg

SEQ ID NO: 1368376 - RNA, 13 nt, Mycobacterium tuberculosis H37Rv
cgccgcacgcacu

SEQ ID NO: 1368377 - RNA, 20 nt, Mycobacterium tuberculosis H37Rv
cgccgcagaucaccgccagc

SEQ ID NO: 1368378 - RNA, 19 nt, Mycobacterium tuberculosis H37Rv
cgccgcagaugggccucca

SEQ ID NO: 1368379 - RNA, 13 nt, Mycobacterium tuberculosis H37Rv
cgccgcagauggg

SEQ ID NO: 1368380 - RNA, 16 nt, Mycobacterium tuberculosis H37Rv
cgcccugaagggccgc

SEQ ID NO: 1368381 - RNA, 22 nt, Mycobacterium tuberculosis H37Rv
cgcccucgucgaucgccgcgau

SEQ ID NO: 1368382 - RNA, 21 nt, Mycobacterium tuberculosis H37Rv
cgcccucgucgcgggccaccg

SEQ ID NO: 1368383 - RNA, 20 nt, Mycobacterium tuberculosis H37Rv
cgcccuguucuccgugaucg

SEQ ID NO: 1368384 - RNA, 16 nt, Mycobacterium tuberculosis H37Rv
cgcccugggcgccggc

SEQ ID NO: 1368385 - RNA, 23 nt, Mycobacterium tuberculosis H37Rv
cgcccuuaagccggcgcggcggc

SEQ ID NO: 1368386 - RNA, 13 nt, Mycobacterium tuberculosis H37Rv
cgcccuggccgcu

SEQ ID NO: 1368387 - RNA, 14 nt, Mycobacterium tuberculosis H37Rv
cgccgaaucggcag

SEQ ID NO: 1368388 - RNA, 20 nt, Mycobacterium tuberculosis H37Rv
cgccgaaucuggggugacug

SEQ ID NO: 1368389 - RNA, 24 nt, Mycobacterium tuberculosis H37Rv
cgccgaauacggcugccuccauga

SEQ ID NO: 1368390 - RNA, 21 nt, Mycobacterium tuberculosis H37Rv
cgccgaagccuugcagcgccc

SEQ ID NO: 1368391 - RNA, 22 nt, Mycobacterium tuberculosis H37Rv
cgccgaagcgaugccgugcugg

SEQ ID NO: 1368392 - RNA, 15 nt, Mycobacterium tuberculosis H37Rv
cgccgaagcgccgcu

SEQ ID NO: 1368393 - RNA, 20 nt, Mycobacterium tuberculosis H37Rv
cgccgaagcucaucgccgcu

SEQ ID NO: 1368394 - RNA, 14 nt, Mycobacterium tuberculosis H37Rv
cgccgaccuggaca

SEQ ID NO: 1368395 - RNA, 12 nt, Mycobacterium tuberculosis H37Rv
cgccgaccugga

SEQ ID NO: 1368396 - RNA, 14 nt, Mycobacterium tuberculosis H37Rv
cgccgaccggaccg

SEQ ID NO: 1368397 - RNA, 16 nt, Mycobacterium tuberculosis H37Rv
cgccgaccgcgccgca

SEQ ID NO: 1368398 - RNA, 20 nt, Mycobacterium tuberculosis H37Rv
cgccgaccgcgccgcaucau

SEQ ID NO: 1368399 - RNA, 16 nt, Mycobacterium tuberculosis H37Rv
cgccgaccgucacuga

SEQ ID NO: 1368400 - RNA, 15 nt, Mycobacterium tuberculosis H37Rv
cgccgaccuccuccu

SEQ ID NO: 1368401 - RNA, 19 nt, Mycobacterium tuberculosis H37Rv
cgccgacaaccccgccagg

SEQ ID NO: 1368402 - RNA, 16 nt, Mycobacterium tuberculosis H37Rv
cgccgacaccaccggc

SEQ ID NO: 1368403 - RNA, 18 nt, Mycobacterium tuberculosis H37Rv
cgccgacaccaccggcgc

SEQ ID NO: 1368404 - RNA, 15 nt, Mycobacterium tuberculosis H37Rv
cgccgacaccacggc

SEQ ID NO: 1368405 - RNA, 21 nt, Mycobacterium tuberculosis H37Rv
cgccgacaccacggcgcgcag

SEQ ID NO: 1368406 - RNA, 18 nt, Mycobacterium tuberculosis H37Rv
cgcccggaaaggccgcgg

SEQ ID NO: 1368407 - RNA, 15 nt, Mycobacterium tuberculosis H37Rv
cgcccggaaccggcg

SEQ ID NO: 1368408 - RNA, 21 nt, Mycobacterium tuberculosis H37Rv
cgcccggacgcaacacccggg

SEQ ID NO: 1368409 - RNA, 17 nt, Mycobacterium tuberculosis H37Rv
cgcccgcugcggcggcu

SEQ ID NO: 1368410 - RNA, 15 nt, Mycobacterium tuberculosis H37Rv
cgcccgcugcggcgg

SEQ ID NO: 1368411 - RNA, 14 nt, Mycobacterium tuberculosis H37Rv
cgcccgcugcggcg

SEQ ID NO: 1368412 - RNA, 14 nt, Mycobacterium tuberculosis H37Rv
cgcccggcaccccu

SEQ ID NO: 1368413 - RNA, 17 nt, Mycobacterium tuberculosis H37Rv
cgcccggcacacggccu

SEQ ID NO: 1368414 - RNA, 18 nt, Mycobacterium tuberculosis H37Rv
cgcccggauguccgccga

SEQ ID NO: 1368415 - RNA, 20 nt, Mycobacterium tuberculosis H37Rv
cgcccggauguccgccgacg

SEQ ID NO: 1368416 - RNA, 13 nt, Mycobacterium tuberculosis H37Rv
cgcccgggcccac

SEQ ID NO: 1368417 - RNA, 21 nt, Mycobacterium tuberculosis H37Rv
cgcccggucgagccagcggag

SEQ ID NO: 1368418 - RNA, 21 nt, Mycobacterium tuberculosis H37Rv
cgcccgggucccggcagcugg

SEQ ID NO: 1368419 - RNA, 17 nt, Mycobacterium tuberculosis H37Rv
cgcccggggcgcacagc

SEQ ID NO: 1368420 - RNA, 18 nt, Mycobacterium tuberculosis H37Rv
cgcccgggucccggcagc

SEQ ID NO: 1368421 - RNA, 19 nt, Mycobacterium tuberculosis H37Rv
cgcccgggucccggcagcu

SEQ ID NO: 1368422 - RNA, 16 nt, Mycobacterium tuberculosis H37Rv
cgcccucagccgcggc

SEQ ID NO: 1368423 - RNA, 21 nt, Mycobacterium tuberculosis H37Rv
cgcccuauacgcaacaggcca

SEQ ID NO: 1368424 - RNA, 15 nt, Mycobacterium tuberculosis H37Rv
cgcccucccuggggc

SEQ ID NO: 1368425 - RNA, 14 nt, Mycobacterium tuberculosis H37Rv
cgcccucccgggcc

SEQ ID NO: 1368426 - RNA, 22 nt, Mycobacterium tuberculosis H37Rv
cgccggauccgauccgcacagc

SEQ ID NO: 1368427 - RNA, 15 nt, Mycobacterium tuberculosis H37Rv
cgccggauauggcag

SEQ ID NO: 1368428 - RNA, 15 nt, Mycobacterium tuberculosis H37Rv
cgccggauagcgcag

SEQ ID NO: 1368429 - RNA, 14 nt, Mycobacterium tuberculosis H37Rv
cgccggaucgccac

SEQ ID NO: 1368430 - RNA, 22 nt, Mycobacterium tuberculosis H37Rv
cgccggaguugaagaagcccga

SEQ ID NO: 1368431 - RNA, 19 nt, Mycobacterium tuberculosis H37Rv
cgccggaguugaagaagcc

SEQ ID NO: 1368432 - RNA, 14 nt, Mycobacterium tuberculosis H37Rv
cgccggagccgccc

SEQ ID NO: 1368433 - RNA, 15 nt, Mycobacterium tuberculosis H37Rv
cgccggagccgccca

SEQ ID NO: 1368434 - RNA, 19 nt, Mycobacterium tuberculosis H37Rv
cgccggagccgcccaagcc

SEQ ID NO: 1368435 - RNA, 19 nt, Mycobacterium tuberculosis H37Rv
cgccggaccagcuccugca

SEQ ID NO: 1368436 - RNA, 16 nt, Mycobacterium tuberculosis H37Rv
cgccggaccagcuccu

SEQ ID NO: 1368437 - RNA, 20 nt, Mycobacterium tuberculosis H37Rv
cgccggaacgagcggccgcg

SEQ ID NO: 1368438 - RNA, 18 nt, Mycobacterium tuberculosis H37Rv
cgccggacugcggcccga

SEQ ID NO: 1368439 - RNA, 20 nt, Mycobacterium tuberculosis H37Rv
cgccggacccgccggguccg

SEQ ID NO: 1368440 - RNA, 23 nt, Mycobacterium tuberculosis H37Rv
cgccggacccggucgccgggacg

SEQ ID NO: 1368441 - RNA, 14 nt, Mycobacterium tuberculosis H37Rv
cgccggccagcggc

SEQ ID NO: 1368442 - RNA, 16 nt, Mycobacterium tuberculosis H37Rv
cgccggccacccgcgc

SEQ ID NO: 1368443 - RNA, 15 nt, Mycobacterium tuberculosis H37Rv
cgccggccacccgcg

SEQ ID NO: 1368444 - RNA, 21 nt, Mycobacterium tuberculosis H37Rv
cgccggcaucuccaccgucgc

SEQ ID NO: 1368445 - RNA, 20 nt, Mycobacterium tuberculosis H37Rv
cgccggcacgaaucccccgg

SEQ ID NO: 1368446 - RNA, 17 nt, Mycobacterium tuberculosis H37Rv
cgccggcaucgcgcaac

SEQ ID NO: 1368447 - RNA, 15 nt, Mycobacterium tuberculosis H37Rv
cgccggcaucgcgcg

SEQ ID NO: 1368448 - RNA, 16 nt, Mycobacterium tuberculosis H37Rv
cgccggcaucgcgcgc

SEQ ID NO: 1368449 - RNA, 21 nt, Mycobacterium tuberculosis H37Rv
cgccggcaccgccggcgccgc

SEQ ID NO: 1368450 - RNA, 15 nt, Mycobacterium tuberculosis H37Rv
cgccggcaccgccag

SEQ ID NO: 1368451 - RNA, 16 nt, Mycobacterium tuberculosis H37Rv
cgccggcaccuccggc

SEQ ID NO: 1368452 - RNA, 19 nt, Mycobacterium tuberculosis H37Rv
cgccggcaauaccgccagc

SEQ ID NO: 1368453 - RNA, 21 nt, Mycobacterium tuberculosis H37Rv
cgccggcaauaccgccagcgc

SEQ ID NO: 1368454 - RNA, 19 nt, Mycobacterium tuberculosis H37Rv
cgccggcacacccaucagc

SEQ ID NO: 1368455 - RNA, 22 nt, Mycobacterium tuberculosis H37Rv
cgccggcacauugaucgacggc

SEQ ID NO: 1368456 - RNA, 18 nt, Mycobacterium tuberculosis H37Rv
cgccggcgccacccgcgc

SEQ ID NO: 1368457 - RNA, 13 nt, Mycobacterium tuberculosis H37Rv
cgccggcgacggc

SEQ ID NO: 1368458 - RNA, 14 nt, Mycobacterium tuberculosis H37Rv
cgccggccuggccg

SEQ ID NO: 1368459 - RNA, 15 nt, Mycobacterium tuberculosis H37Rv
cgccggccuggccgc

SEQ ID NO: 1368460 - RNA, 17 nt, Mycobacterium tuberculosis H37Rv
cgccggccgucggccgg

SEQ ID NO: 1368461 - RNA, 19 nt, Mycobacterium tuberculosis H37Rv
cgccggcgccagcgccgcc

SEQ ID NO: 1368462 - RNA, 14 nt, Mycobacterium tuberculosis H37Rv
cgccggcgccagca

SEQ ID NO: 1368463 - RNA, 21 nt, Mycobacterium tuberculosis H37Rv
cgccggcgccacccgcgccgc

SEQ ID NO: 1368464 - RNA, 18 nt, Mycobacterium tuberculosis H37Rv
cgccggcgcccaggccga

SEQ ID NO: 1368465 - RNA, 17 nt, Mycobacterium tuberculosis H37Rv
cgccggcgcccaggccg

SEQ ID NO: 1368466 - RNA, 15 nt, Mycobacterium tuberculosis H37Rv
cgccggcgccgccau

SEQ ID NO: 1368467 - RNA, 14 nt, Mycobacterium tuberculosis H37Rv
cgccggcgccgccc

SEQ ID NO: 1368468 - RNA, 19 nt, Mycobacterium tuberculosis H37Rv
cgccggcgccggagccgcc

SEQ ID NO: 1368469 - RNA, 18 nt, Mycobacterium tuberculosis H37Rv
cgccggcgccgccggcac

SEQ ID NO: 1368470 - RNA, 15 nt, Mycobacterium tuberculosis H37Rv
cgccggcgcgccgau

SEQ ID NO: 1368471 - RNA, 17 nt, Mycobacterium tuberculosis H37Rv
cgccggcgccggugccg

SEQ ID NO: 1368472 - RNA, 15 nt, Mycobacterium tuberculosis H37Rv
cgccggccgcugccu

SEQ ID NO: 1368473 - RNA, 19 nt, Mycobacterium tuberculosis H37Rv
cgccggccgcgggcgcgca

SEQ ID NO: 1368474 - RNA, 20 nt, Mycobacterium tuberculosis H37Rv
cgccggccgcgggcgcgcag

SEQ ID NO: 1368475 - RNA, 15 nt, Mycobacterium tuberculosis H37Rv
cgccggccggcccgg

SEQ ID NO: 1368476 - RNA, 13 nt, Mycobacterium tuberculosis H37Rv
cgccggccgcgcu

SEQ ID NO: 1368477 - RNA, 21 nt, Mycobacterium tuberculosis H37Rv
cgccggccgcggcggccccgc

SEQ ID NO: 1368478 - RNA, 22 nt, Mycobacterium tuberculosis H37Rv
cgccggccgcacgccggccagc

SEQ ID NO: 1368479 - RNA, 15 nt, Mycobacterium tuberculosis H37Rv
cgccggccgcgcaga

SEQ ID NO: 1368480 - RNA, 15 nt, Mycobacterium tuberculosis H37Rv
cgccggccccgccgc

SEQ ID NO: 1368481 - RNA, 21 nt, Mycobacterium tuberculosis H37Rv
cgccggccccgccgaugccgc

SEQ ID NO: 1368482 - RNA, 14 nt, Mycobacterium tuberculosis H37Rv
cgccggcccgcagc

SEQ ID NO: 1368483 - RNA, 14 nt, Mycobacterium tuberculosis H37Rv
cgccggccccgccg

SEQ ID NO: 1368484 - RNA, 14 nt, Mycobacterium tuberculosis H37Rv
cgccggccaguccg

SEQ ID NO: 1368485 - RNA, 20 nt, Mycobacterium tuberculosis H37Rv
cgccggccaguccgcgcgca

SEQ ID NO: 1368486 - RNA, 18 nt, Mycobacterium tuberculosis H37Rv
cgccgucggagccggcca

SEQ ID NO: 1368487 - RNA, 16 nt, Mycobacterium tuberculosis H37Rv
cgccgucgcagccagc

SEQ ID NO: 1368488 - RNA, 15 nt, Mycobacterium tuberculosis H37Rv
cgccgucgccaccgg

SEQ ID NO: 1368489 - RNA, 20 nt, Mycobacterium tuberculosis H37Rv
cgccgucgacgcggccggcc

SEQ ID NO: 1368490 - RNA, 23 nt, Mycobacterium tuberculosis H37Rv
cgccguaucggggcaccacgcca

SEQ ID NO: 1368491 - RNA, 19 nt, Mycobacterium tuberculosis H37Rv
cgccguagaccagcaggcc

SEQ ID NO: 1368492 - RNA, 15 nt, Mycobacterium tuberculosis H37Rv
cgccguagccggccg

SEQ ID NO: 1368493 - RNA, 20 nt, Mycobacterium tuberculosis H37Rv
cgccguaagcaccagccagc

SEQ ID NO: 1368494 - RNA, 19 nt, Mycobacterium tuberculosis H37Rv
cgccguaacagccggccgg

SEQ ID NO: 1368495 - RNA, 22 nt, Mycobacterium tuberculosis H37Rv
cgccggugacgaugaccgcgcg

SEQ ID NO: 1368496 - RNA, 21 nt, Mycobacterium tuberculosis H37Rv
cgccggugacgaugaccgcgc

SEQ ID NO: 1368497 - RNA, 17 nt, Mycobacterium tuberculosis H37Rv
cgccggucgccggcugg

SEQ ID NO: 1368498 - RNA, 18 nt, Mycobacterium tuberculosis H37Rv
cgccggugacgacgucgc

SEQ ID NO: 1368499 - RNA, 24 nt, Mycobacterium tuberculosis H37Rv
cgccggucaucccaagcguccgcu

SEQ ID NO: 1368500 - RNA, 14 nt, Mycobacterium tuberculosis H37Rv
cgccggucagcgug

SEQ ID NO: 1368501 - RNA, 15 nt, Mycobacterium tuberculosis H37Rv
cgccggggacgccgc

SEQ ID NO: 1368502 - RNA, 20 nt, Mycobacterium tuberculosis H37Rv
cgccgguaggcggccagcgc

SEQ ID NO: 1368503 - RNA, 22 nt, Mycobacterium tuberculosis H37Rv
cgccggcuucgcccagagccgc

SEQ ID NO: 1368504 - RNA, 19 nt, Mycobacterium tuberculosis H37Rv
cgccggcuucgcccagagc

SEQ ID NO: 1368505 - RNA, 16 nt, Mycobacterium tuberculosis H37Rv
cgccggcuggcggccu

SEQ ID NO: 1368506 - RNA, 14 nt, Mycobacterium tuberculosis H37Rv
cgccggcuccgcca

SEQ ID NO: 1368507 - RNA, 15 nt, Mycobacterium tuberculosis H37Rv
cgccggcuccgccag

SEQ ID NO: 1368508 - RNA, 14 nt, Mycobacterium tuberculosis H37Rv
cgccggcuccgcag

SEQ ID NO: 1368509 - RNA, 18 nt, Mycobacterium tuberculosis H37Rv
cgccggcgucggcgccca

SEQ ID NO: 1368510 - RNA, 13 nt, Mycobacterium tuberculosis H37Rv
cgccggcggcgga

SEQ ID NO: 1368511 - RNA, 13 nt, Mycobacterium tuberculosis H37Rv
cgccggcggcggc

SEQ ID NO: 1368512 - RNA, 14 nt, Mycobacterium tuberculosis H37Rv
cgccggcguccgga

SEQ ID NO: 1368513 - RNA, 17 nt, Mycobacterium tuberculosis H37Rv
cgccggcggcggccgca

SEQ ID NO: 1368514 - RNA, 19 nt, Mycobacterium tuberculosis H37Rv
cgccggcggcggccgcagc

SEQ ID NO: 1368515 - RNA, 22 nt, Mycobacterium tuberculosis H37Rv
cgccggcggcggugcgccccgc

SEQ ID NO: 1368516 - RNA, 13 nt, Mycobacterium tuberculosis H37Rv
cgccggcgcugcu

SEQ ID NO: 1368517 - RNA, 18 nt, Mycobacterium tuberculosis H37Rv
cgccggcggacgcccggc

SEQ ID NO: 1368518 - RNA, 12 nt, Mycobacterium tuberculosis H37Rv
cgccgggcccuc

SEQ ID NO: 1368519 - RNA, 19 nt, Mycobacterium tuberculosis H37Rv
cgccgggaacaucccagcg

SEQ ID NO: 1368520 - RNA, 19 nt, Mycobacterium tuberculosis H37Rv
cgccgggauaacccagcac

SEQ ID NO: 1368521 - RNA, 12 nt, Mycobacterium tuberculosis H37Rv
cgccgggaaaca

SEQ ID NO: 1368522 - RNA, 13 nt, Mycobacterium tuberculosis H37Rv
cgccggggaccac

SEQ ID NO: 1368523 - RNA, 21 nt, Mycobacterium tuberculosis H37Rv
cgccgggcucagcugggccgc

SEQ ID NO: 1368524 - RNA, 20 nt, Mycobacterium tuberculosis H37Rv
cgccgggcaguuuggcggca

SEQ ID NO: 1368525 - RNA, 18 nt, Mycobacterium tuberculosis H37Rv
cgccgcgaagcgcucggc

SEQ ID NO: 1368526 - RNA, 20 nt, Mycobacterium tuberculosis H37Rv
cgccgcgacgcacugccccg

SEQ ID NO: 1368527 - RNA, 22 nt, Mycobacterium tuberculosis H37Rv
cgccgcgaccacgcaccgcccc

SEQ ID NO: 1368528 - RNA, 19 nt, Mycobacterium tuberculosis H37Rv
cgccgcgagcgccggccgc

SEQ ID NO: 1368529 - RNA, 15 nt, Mycobacterium tuberculosis H37Rv
cgccgcgaggcaccg

SEQ ID NO: 1368530 - RNA, 19 nt, Mycobacterium tuberculosis H37Rv
cgccgcgcagccggcccgu

SEQ ID NO: 1368531 - RNA, 16 nt, Mycobacterium tuberculosis H37Rv
cgccgcgcaccgcggg

SEQ ID NO: 1368532 - RNA, 22 nt, Mycobacterium tuberculosis H37Rv
cgccgcgauggcgguccaccgg

SEQ ID NO: 1368533 - RNA, 21 nt, Mycobacterium tuberculosis H37Rv
cgccgcgccccagacgcgcag

SEQ ID NO: 1368534 - RNA, 18 nt, Mycobacterium tuberculosis H37Rv
cgccgcgcauccgcagcc

SEQ ID NO: 1368535 - RNA, 16 nt, Mycobacterium tuberculosis H37Rv
cgccgcgcauccgcag

SEQ ID NO: 1368536 - RNA, 21 nt, Mycobacterium tuberculosis H37Rv
cgccgcgccgaaucgcgggcu

SEQ ID NO: 1368537 - RNA, 18 nt, Mycobacterium tuberculosis H37Rv
cgccgcgccgcgccgccu

SEQ ID NO: 1368538 - RNA, 14 nt, Mycobacterium tuberculosis H37Rv
cgccgcgccggcac

SEQ ID NO: 1368539 - RNA, 18 nt, Mycobacterium tuberculosis H37Rv
cgccgcgcguucggcgcu

SEQ ID NO: 1368540 - RNA, 15 nt, Mycobacterium tuberculosis H37Rv
cgccgcgcgcggcgu

SEQ ID NO: 1368541 - RNA, 20 nt, Mycobacterium tuberculosis H37Rv
cgccgcgcggaacaccgagg

SEQ ID NO: 1368542 - RNA, 18 nt, Mycobacterium tuberculosis H37Rv
cgccgcgcuggucggaga

SEQ ID NO: 1368543 - RNA, 20 nt, Mycobacterium tuberculosis H37Rv
cgccgccuggacgccgccgg

SEQ ID NO: 1368544 - RNA, 22 nt, Mycobacterium tuberculosis H37Rv
cgccgccuuccuggcgggcgcc

SEQ ID NO: 1368545 - RNA, 18 nt, Mycobacterium tuberculosis H37Rv
cgccgccguucccgccgg

SEQ ID NO: 1368546 - RNA, 14 nt, Mycobacterium tuberculosis H37Rv
cgccgccugcccgg

SEQ ID NO: 1368547 - RNA, 15 nt, Mycobacterium tuberculosis H37Rv
cgccgccugcccggc

SEQ ID NO: 1368548 - RNA, 18 nt, Mycobacterium tuberculosis H37Rv
cgccgccugcccggcccg

SEQ ID NO: 1368549 - RNA, 20 nt, Mycobacterium tuberculosis H37Rv
cgccgccugcccggcccgcu

SEQ ID NO: 1368550 - RNA, 12 nt, Mycobacterium tuberculosis H37Rv
cgccgccugcuc

SEQ ID NO: 1368551 - RNA, 18 nt, Mycobacterium tuberculosis H37Rv
cgccgccguugccgccgg

SEQ ID NO: 1368552 - RNA, 19 nt, Mycobacterium tuberculosis H37Rv
cgccgccguugccgccauc

SEQ ID NO: 1368553 - RNA, 14 nt, Mycobacterium tuberculosis H37Rv
cgccgccuccgccg

SEQ ID NO: 1368554 - RNA, 17 nt, Mycobacterium tuberculosis H37Rv
cgccgccggugccgccc

SEQ ID NO: 1368555 - RNA, 21 nt, Mycobacterium tuberculosis H37Rv
cgccgccguccagcgccgcgg

SEQ ID NO: 1368556 - RNA, 16 nt, Mycobacterium tuberculosis H37Rv
cgccgccggugccacc

SEQ ID NO: 1368557 - RNA, 19 nt, Mycobacterium tuberculosis H37Rv
cgccgccguugccgccagc

SEQ ID NO: 1368558 - RNA, 14 nt, Mycobacterium tuberculosis H37Rv
cgccgccggcgccg

SEQ ID NO: 1368559 - RNA, 14 nt, Mycobacterium tuberculosis H37Rv
cgccgccggcgcca

SEQ ID NO: 1368560 - RNA, 16 nt, Mycobacterium tuberculosis H37Rv
cgccgccggcgccacc

SEQ ID NO: 1368561 - RNA, 18 nt, Mycobacterium tuberculosis H37Rv
cgccgccggcgccgccgg

SEQ ID NO: 1368562 - RNA, 19 nt, Mycobacterium tuberculosis H37Rv
cgccgccggcgccggcgcu

SEQ ID NO: 1368563 - RNA, 18 nt, Mycobacterium tuberculosis H37Rv
cgccgccggcgccgcccg

SEQ ID NO: 1368564 - RNA, 13 nt, Mycobacterium tuberculosis H37Rv
cgccgccggcggc

SEQ ID NO: 1368565 - RNA, 13 nt, Mycobacterium tuberculosis H37Rv
cgccgccggcgcu

SEQ ID NO: 1368566 - RNA, 15 nt, Mycobacterium tuberculosis H37Rv
cgccgccggcgcuga

SEQ ID NO: 1368567 - RNA, 18 nt, Mycobacterium tuberculosis H37Rv
cgccgccggccccgccga

SEQ ID NO: 1368568 - RNA, 15 nt, Mycobacterium tuberculosis H37Rv
cgccgccggccgcca

SEQ ID NO: 1368569 - RNA, 15 nt, Mycobacterium tuberculosis H37Rv
cgccgcccgcugggc

SEQ ID NO: 1368570 - RNA, 21 nt, Mycobacterium tuberculosis H37Rv
cgccgccggcaccgccggcgc

SEQ ID NO: 1368571 - RNA, 14 nt, Mycobacterium tuberculosis H37Rv
cgccgccggcaccu

SEQ ID NO: 1368572 - RNA, 15 nt, Mycobacterium tuberculosis H37Rv
cgccgccggcaccuc

SEQ ID NO: 1368573 - RNA, 15 nt, Mycobacterium tuberculosis H37Rv
cgccgcccgcagggc

SEQ ID NO: 1368574 - RNA, 22 nt, Mycobacterium tuberculosis H37Rv
cgccgcccgaggcacccgugcc

SEQ ID NO: 1368575 - RNA, 16 nt, Mycobacterium tuberculosis H37Rv
cgccgcccccgccggc

SEQ ID NO: 1368576 - RNA, 18 nt, Mycobacterium tuberculosis H37Rv
cgccgcccccgccggccg

SEQ ID NO: 1368577 - RNA, 15 nt, Mycobacterium tuberculosis H37Rv
cgccgcccccgccgg

SEQ ID NO: 1368578 - RNA, 20 nt, Mycobacterium tuberculosis H37Rv
aaacgucaccgccgggaugc

SEQ ID NO: 1368579 - RNA, 22 nt, Mycobacterium tuberculosis H37Rv
cgccgcgcuugcgaucgccgcu

SEQ ID NO: 1368580 - RNA, 22 nt, Mycobacterium tuberculosis H37Rv
cgccgcggacucgggcaggccc

SEQ ID NO: 1368581 - RNA, 21 nt, Mycobacterium tuberculosis H37Rv
cgccgcggaguaggccgcgcc

SEQ ID NO: 1368582 - RNA, 14 nt, Mycobacterium tuberculosis H37Rv
cgccgcggccacca

SEQ ID NO: 1368583 - RNA, 17 nt, Mycobacterium tuberculosis H37Rv
cgccgcggccaccaccg

SEQ ID NO: 1368584 - RNA, 14 nt, Mycobacterium tuberculosis H37Rv
cgccgcggcccgcu

SEQ ID NO: 1368585 - RNA, 16 nt, Mycobacterium tuberculosis H37Rv
cgccgcggccggcgcu

SEQ ID NO: 1368586 - RNA, 18 nt, Mycobacterium tuberculosis H37Rv
cgccgcgggacaccaccg

SEQ ID NO: 1368587 - RNA, 23 nt, Mycobacterium tuberculosis H37Rv
cgccgcgggacaccaccgcccgc

SEQ ID NO: 1368588 - RNA, 16 nt, Mycobacterium tuberculosis H37Rv
cgccgcgggugaucug

SEQ ID NO: 1368589 - RNA, 17 nt, Mycobacterium tuberculosis H37Rv
cgccgcggucagaucca

SEQ ID NO: 1368590 - RNA, 22 nt, Mycobacterium tuberculosis H37Rv
cgccgcguaccaauucccgcgc

SEQ ID NO: 1368591 - RNA, 16 nt, Mycobacterium tuberculosis H37Rv
cgccgcugccaucugg

SEQ ID NO: 1368592 - RNA, 19 nt, Mycobacterium tuberculosis H37Rv
cgccgcugggugaccagga

SEQ ID NO: 1368593 - RNA, 22 nt, Mycobacterium tuberculosis H37Rv
cgccgcuuucuuggcgggcgcc

SEQ ID NO: 1368594 - RNA, 23 nt, Mycobacterium tuberculosis H37Rv
cgccgcuaggugacgccgccagc

SEQ ID NO: 1368595 - RNA, 17 nt, Mycobacterium tuberculosis H37Rv
cgccgcugccgcgcggc

SEQ ID NO: 1368596 - RNA, 14 nt, Mycobacterium tuberculosis H37Rv
cgccgcugccgccg

SEQ ID NO: 1368597 - RNA, 16 nt, Mycobacterium tuberculosis H37Rv
cgccgcugacuccugc

SEQ ID NO: 1368598 - RNA, 19 nt, Mycobacterium tuberculosis H37Rv
cgccgcuaggugacgccgc

SEQ ID NO: 1368599 - RNA, 18 nt, Mycobacterium tuberculosis H37Rv
cgccgcuaccgcccgcgc

SEQ ID NO: 1368600 - RNA, 21 nt, Mycobacterium tuberculosis H37Rv
cgccgcguugucggcgcuccc

SEQ ID NO: 1368601 - RNA, 20 nt, Mycobacterium tuberculosis H37Rv
cgccgcgugguuccggcgug

SEQ ID NO: 1368602 - RNA, 21 nt, Mycobacterium tuberculosis H37Rv
cgaugugccgauuggccugcc

SEQ ID NO: 1368603 - RNA, 12 nt, Mycobacterium tuberculosis H37Rv
cgauucugcguc

SEQ ID NO: 1368604 - RNA, 16 nt, Mycobacterium tuberculosis H37Rv
cgauucugcgucugcu

SEQ ID NO: 1368605 - RNA, 14 nt, Mycobacterium tuberculosis H37Rv
cgauugcagcuucg

SEQ ID NO: 1368606 - RNA, 13 nt, Mycobacterium tuberculosis H37Rv
cgauugccaccga

SEQ ID NO: 1368607 - RNA, 14 nt, Mycobacterium tuberculosis H37Rv
cgauugcccgcgcu

SEQ ID NO: 1368608 - RNA, 14 nt, Mycobacterium tuberculosis H37Rv
cgcaaacaagauca

SEQ ID NO: 1368609 - RNA, 17 nt, Mycobacterium tuberculosis H37Rv
cgcaaaaucgcacgguu

SEQ ID NO: 1368610 - RNA, 20 nt, Mycobacterium tuberculosis H37Rv
cgcaaaacgagcuuccacgc

SEQ ID NO: 1368611 - RNA, 22 nt, Mycobacterium tuberculosis H37Rv
cgcaaagacaccgaaagccucu

SEQ ID NO: 1368612 - RNA, 17 nt, Mycobacterium tuberculosis H37Rv
cgcaaagacagcgcggg

SEQ ID NO: 1368613 - RNA, 14 nt, Mycobacterium tuberculosis H37Rv
cgcaaaccacccgc

SEQ ID NO: 1368614 - RNA, 19 nt, Mycobacterium tuberculosis H37Rv
cgaugccguccaagauguc

SEQ ID NO: 1368615 - RNA, 18 nt, Mycobacterium tuberculosis H37Rv
cgaugccgugccgggcca

SEQ ID NO: 1368616 - RNA, 18 nt, Mycobacterium tuberculosis H37Rv
cgaugauguuggccggcg

SEQ ID NO: 1368617 - RNA, 24 nt, Mycobacterium tuberculosis H37Rv
cgaugaugacggcggcccgaucca

SEQ ID NO: 1368618 - RNA, 20 nt, Mycobacterium tuberculosis H37Rv
cgaugauggacaccagccag

SEQ ID NO: 1368619 - RNA, 17 nt, Mycobacterium tuberculosis H37Rv
cgaugaugcggcgcagc

SEQ ID NO: 1368620 - RNA, 18 nt, Mycobacterium tuberculosis H37Rv
cgaugaucucacccagcu

SEQ ID NO: 1368621 - RNA, 18 nt, Mycobacterium tuberculosis H37Rv
cgaugaucgaacacggca

SEQ ID NO: 1368622 - RNA, 18 nt, Mycobacterium tuberculosis H37Rv
cgaugaucccgccaccga

SEQ ID NO: 1368623 - RNA, 14 nt, Mycobacterium tuberculosis H37Rv
cgaugaucccgcca

SEQ ID NO: 1368624 - RNA, 15 nt, Mycobacterium tuberculosis H37Rv
cgaucaacagcaccg

SEQ ID NO: 1368625 - RNA, 16 nt, Mycobacterium tuberculosis H37Rv
cgaucaacaccaaucg

SEQ ID NO: 1368626 - RNA, 17 nt, Mycobacterium tuberculosis H37Rv
cgauaugcagcucgcug

SEQ ID NO: 1368627 - RNA, 12 nt, Mycobacterium tuberculosis H37Rv
cgaugcgccgga

SEQ ID NO: 1368628 - RNA, 22 nt, Mycobacterium tuberculosis H37Rv
cgaugcgcacucccggcucggc

SEQ ID NO: 1368629 - RNA, 13 nt, Mycobacterium tuberculosis H37Rv
cgaugcgggccgc

SEQ ID NO: 1368630 - RNA, 22 nt, Mycobacterium tuberculosis H37Rv
cgaugcgggcgccccaccggcc

SEQ ID NO: 1368631 - RNA, 17 nt, Mycobacterium tuberculosis H37Rv
cgaugcucgucccagaa

SEQ ID NO: 1368632 - RNA, 22 nt, Mycobacterium tuberculosis H37Rv
cgaugcguccgcccagccgcag

SEQ ID NO: 1368633 - RNA, 14 nt, Mycobacterium tuberculosis H37Rv
cgaugcgguucucg

SEQ ID NO: 1368634 - RNA, 15 nt, Mycobacterium tuberculosis H37Rv
cgauggcguacagca

SEQ ID NO: 1368635 - RNA, 17 nt, Mycobacterium tuberculosis H37Rv
cgauggcgguggggcug

SEQ ID NO: 1368636 - RNA, 18 nt, Mycobacterium tuberculosis H37Rv
cgauggcgucggccagga

SEQ ID NO: 1368637 - RNA, 16 nt, Mycobacterium tuberculosis H37Rv
cgauggcuaccccagg

SEQ ID NO: 1368638 - RNA, 18 nt, Mycobacterium tuberculosis H37Rv
cgauggcuuggugcccaa

SEQ ID NO: 1368639 - RNA, 19 nt, Mycobacterium tuberculosis H37Rv
cgaugggagcccggcggcc

SEQ ID NO: 1368640 - RNA, 19 nt, Mycobacterium tuberculosis H37Rv
cgaugggaaucagugaaga

SEQ ID NO: 1368641 - RNA, 19 nt, Mycobacterium tuberculosis H37Rv
cgaugguacccgcgccgcg

SEQ ID NO: 1368642 - RNA, 20 nt, Mycobacterium tuberculosis H37Rv
cgauggguguugcuggccgc

SEQ ID NO: 1368643 - RNA, 17 nt, Mycobacterium tuberculosis H37Rv
cgaugguaucgccgcua

SEQ ID NO: 1368644 - RNA, 18 nt, Mycobacterium tuberculosis H37Rv
cgaugucccgagcccgcu

SEQ ID NO: 1368645 - RNA, 13 nt, Mycobacterium tuberculosis H37Rv
cgauguccucgua

SEQ ID NO: 1368646 - RNA, 21 nt, Mycobacterium tuberculosis H37Rv
cgcacgaaccccacgcagaag

SEQ ID NO: 1368647 - RNA, 16 nt, Mycobacterium tuberculosis H37Rv
cgcacgaaaucagccc

SEQ ID NO: 1368648 - RNA, 20 nt, Mycobacterium tuberculosis H37Rv
cgcacgaaaucagcccgccc

SEQ ID NO: 1368649 - RNA, 22 nt, Mycobacterium tuberculosis H37Rv
cgcacgacugugcgccgcagcc

SEQ ID NO: 1368650 - RNA, 19 nt, Mycobacterium tuberculosis H37Rv
cgcacgacaacuucgccgg

SEQ ID NO: 1368651 - RNA, 22 nt, Mycobacterium tuberculosis H37Rv
cgcacgacaacuucgccggacc

SEQ ID NO: 1368652 - RNA, 12 nt, Mycobacterium tuberculosis H37Rv
cgcacgacaccu

SEQ ID NO: 1368653 - RNA, 19 nt, Mycobacterium tuberculosis H37Rv
cgcacgacugugcgccgca

SEQ ID NO: 1368654 - RNA, 22 nt, Mycobacterium tuberculosis H37Rv
cgcaccuugaccgucgcgcauu

SEQ ID NO: 1368655 - RNA, 19 nt, Mycobacterium tuberculosis H37Rv
cgcaccugggcugccggcc

SEQ ID NO: 1368656 - RNA, 17 nt, Mycobacterium tuberculosis H37Rv
cgcaccugcgcgcggcc

SEQ ID NO: 1368657 - RNA, 13 nt, Mycobacterium tuberculosis H37Rv
cgcaccucggcga

SEQ ID NO: 1368658 - RNA, 18 nt, Mycobacterium tuberculosis H37Rv
cgcaccuccgccccggau

SEQ ID NO: 1368659 - RNA, 13 nt, Mycobacterium tuberculosis H37Rv
cgcaccuccugcg

SEQ ID NO: 1368660 - RNA, 22 nt, Mycobacterium tuberculosis H37Rv
cgcaccgugugggccccgccga

SEQ ID NO: 1368661 - RNA, 17 nt, Mycobacterium tuberculosis H37Rv
cgcaccaagcagcgacc

SEQ ID NO: 1368662 - RNA, 21 nt, Mycobacterium tuberculosis H37Rv
cgcaccacacuggcagugugg

SEQ ID NO: 1368663 - RNA, 14 nt, Mycobacterium tuberculosis H37Rv
cgcaccacaccgug

SEQ ID NO: 1368664 - RNA, 22 nt, Mycobacterium tuberculosis H37Rv
cgcacauugguguccaccaccg

SEQ ID NO: 1368665 - RNA, 12 nt, Mycobacterium tuberculosis H37Rv
cgcaccacgccc

SEQ ID NO: 1368666 - RNA, 15 nt, Mycobacterium tuberculosis H37Rv
cgcaccacgagcagc

SEQ ID NO: 1368667 - RNA, 13 nt, Mycobacterium tuberculosis H37Rv
cgcaccaccgccc

SEQ ID NO: 1368668 - RNA, 16 nt, Mycobacterium tuberculosis H37Rv
cgcaccaccgagccga

SEQ ID NO: 1368669 - RNA, 17 nt, Mycobacterium tuberculosis H37Rv
cgcaccaccgcggcggc

SEQ ID NO: 1368670 - RNA, 15 nt, Mycobacterium tuberculosis H37Rv
cgcagaaagucgcgc

SEQ ID NO: 1368671 - RNA, 14 nt, Mycobacterium tuberculosis H37Rv
cgcacuuucuuccu

SEQ ID NO: 1368672 - RNA, 18 nt, Mycobacterium tuberculosis H37Rv
cgcacucccggcucggcc

SEQ ID NO: 1368673 - RNA, 22 nt, Mycobacterium tuberculosis H37Rv
cgcacuccaagucacagcucac

SEQ ID NO: 1368674 - RNA, 21 nt, Mycobacterium tuberculosis H37Rv
cgcacucccggcucggccagc

SEQ ID NO: 1368675 - RNA, 19 nt, Mycobacterium tuberculosis H37Rv
cgcacucggcgguuccggc

SEQ ID NO: 1368676 - RNA, 19 nt, Mycobacterium tuberculosis H37Rv
cgcacuacucgaacaaccc

SEQ ID NO: 1368677 - RNA, 16 nt, Mycobacterium tuberculosis H37Rv
cgcacguuggcggcca

SEQ ID NO: 1368678 - RNA, 19 nt, Mycobacterium tuberculosis H37Rv
cgcacgugaugcccugggg

SEQ ID NO: 1368679 - RNA, 20 nt, Mycobacterium tuberculosis H37Rv
cgcacgcgguucaccacguc

SEQ ID NO: 1368680 - RNA, 23 nt, Mycobacterium tuberculosis H37Rv
cgcacgcggaaaggcuuccgcgu

SEQ ID NO: 1368681 - RNA, 21 nt, Mycobacterium tuberculosis H37Rv
cgcacgauuucgagcgcugcu

SEQ ID NO: 1368682 - RNA, 19 nt, Mycobacterium tuberculosis H37Rv
cgcacgauggugugcagca

SEQ ID NO: 1368683 - RNA, 18 nt, Mycobacterium tuberculosis H37Rv
cgcacgcagccgauacag

SEQ ID NO: 1368684 - RNA, 18 nt, Mycobacterium tuberculosis H37Rv
cgcacgaucgcaccgagg

SEQ ID NO: 1368685 - RNA, 14 nt, Mycobacterium tuberculosis H37Rv
cgcacgaucugcag

SEQ ID NO: 1368686 - RNA, 13 nt, Mycobacterium tuberculosis H37Rv
cgcacgaucaggg

SEQ ID NO: 1368687 - RNA, 14 nt, Mycobacterium tuberculosis H37Rv
cgcacaggauuuuc

SEQ ID NO: 1368688 - RNA, 21 nt, Mycobacterium tuberculosis H37Rv
cgcacagccgcuuggcgcggc

SEQ ID NO: 1368689 - RNA, 14 nt, Mycobacterium tuberculosis H37Rv
cgcacagcgacgag

SEQ ID NO: 1368690 - RNA, 22 nt, Mycobacterium tuberculosis H37Rv
cgcacaggaagcccauccccgc

SEQ ID NO: 1368691 - RNA, 14 nt, Mycobacterium tuberculosis H37Rv
cgcacacgcgugca

SEQ ID NO: 1368692 - RNA, 13 nt, Mycobacterium tuberculosis H37Rv
cgcacacccugca

SEQ ID NO: 1368693 - RNA, 17 nt, Mycobacterium tuberculosis H37Rv
cgcacaccaacaccgcg

SEQ ID NO: 1368694 - RNA, 22 nt, Mycobacterium tuberculosis H37Rv
cgcacaccaacaccgcggcgcu

SEQ ID NO: 1368695 - RNA, 15 nt, Mycobacterium tuberculosis H37Rv
cgcacaaaccgggcg

SEQ ID NO: 1368696 - RNA, 23 nt, Mycobacterium tuberculosis H37Rv
cgcaacucgccgaaaucggccag

SEQ ID NO: 1368697 - RNA, 22 nt, Mycobacterium tuberculosis H37Rv
cgcaacguacgcacgcagcccc

SEQ ID NO: 1368698 - RNA, 16 nt, Mycobacterium tuberculosis H37Rv
cgcaacucccagcacg

SEQ ID NO: 1368699 - RNA, 12 nt, Mycobacterium tuberculosis H37Rv
cgcaacugcagg

SEQ ID NO: 1368700 - RNA, 13 nt, Mycobacterium tuberculosis H37Rv
cgcaaaggagaag

SEQ ID NO: 1368701 - RNA, 20 nt, Mycobacterium tuberculosis H37Rv
cgcaaaguucgucaccacga

SEQ ID NO: 1368702 - RNA, 14 nt, Mycobacterium tuberculosis H37Rv
cgcaacacauccag

SEQ ID NO: 1368703 - RNA, 13 nt, Mycobacterium tuberculosis H37Rv
cgcaacccagccg

SEQ ID NO: 1368704 - RNA, 15 nt, Mycobacterium tuberculosis H37Rv
cgcaacccagccgcg

SEQ ID NO: 1368705 - RNA, 19 nt, Mycobacterium tuberculosis H37Rv
cgcaaccagccuuuccggc

SEQ ID NO: 1368706 - RNA, 20 nt, Mycobacterium tuberculosis H37Rv
cgcaacccagccgcgccagc

SEQ ID NO: 1368707 - RNA, 22 nt, Mycobacterium tuberculosis H37Rv
cgcaaccccuggggugcucggg

SEQ ID NO: 1368708 - RNA, 20 nt, Mycobacterium tuberculosis H37Rv
cgcaaccgagggcauuccga

SEQ ID NO: 1368709 - RNA, 17 nt, Mycobacterium tuberculosis H37Rv
cgcaaccgccgcgucau

SEQ ID NO: 1368710 - RNA, 14 nt, Mycobacterium tuberculosis H37Rv
cgcaaccgcggccc

SEQ ID NO: 1368711 - RNA, 21 nt, Mycobacterium tuberculosis H37Rv
cgcagcgguggucggcgcgcc

SEQ ID NO: 1368712 - RNA, 19 nt, Mycobacterium tuberculosis H37Rv
cgcagcggccagcccagcc

SEQ ID NO: 1368713 - RNA, 18 nt, Mycobacterium tuberculosis H37Rv
cgcagcggccagcccagc

SEQ ID NO: 1368714 - RNA, 13 nt, Mycobacterium tuberculosis H37Rv
cgcagcggcggca

SEQ ID NO: 1368715 - RNA, 19 nt, Mycobacterium tuberculosis H37Rv
cgcaggaagccggcgugcu

SEQ ID NO: 1368716 - RNA, 15 nt, Mycobacterium tuberculosis H37Rv
cgcaggaagcccacg

SEQ ID NO: 1368717 - RNA, 22 nt, Mycobacterium tuberculosis H37Rv
cgcagcuccaccgugacggcca

SEQ ID NO: 1368718 - RNA, 21 nt, Mycobacterium tuberculosis H37Rv
cgcagcguguaguggcccgcg

SEQ ID NO: 1368719 - RNA, 18 nt, Mycobacterium tuberculosis H37Rv
cgcagcgugagugcagca

SEQ ID NO: 1368720 - RNA, 15 nt, Mycobacterium tuberculosis H37Rv
cgcagaucaccgcca

SEQ ID NO: 1368721 - RNA, 18 nt, Mycobacterium tuberculosis H37Rv
cgcagauccccgccaccg

SEQ ID NO: 1368722 - RNA, 22 nt, Mycobacterium tuberculosis H37Rv
cgcagaucgaaaucagcccgcg

SEQ ID NO: 1368723 - RNA, 18 nt, Mycobacterium tuberculosis H37Rv
cgcagauuugcuccagcg

SEQ ID NO: 1368724 - RNA, 21 nt, Mycobacterium tuberculosis H37Rv
cgcaggauucccaguccagga

SEQ ID NO: 1368725 - RNA, 18 nt, Mycobacterium tuberculosis H37Rv
cgcaggcaccccgaucac

SEQ ID NO: 1368726 - RNA, 18 nt, Mycobacterium tuberculosis H37Rv
cgcaggaucacacuggcc

SEQ ID NO: 1368727 - RNA, 15 nt, Mycobacterium tuberculosis H37Rv
cgcaggaucggcgga

SEQ ID NO: 1368728 - RNA, 15 nt, Mycobacterium tuberculosis H37Rv
cgcaggcacaucgcg

SEQ ID NO: 1368729 - RNA, 21 nt, Mycobacterium tuberculosis H37Rv
cgcaggcagugagggucccac

SEQ ID NO: 1368730 - RNA, 18 nt, Mycobacterium tuberculosis H37Rv
cgcaggauucccagucca

SEQ ID NO: 1368731 - RNA, 22 nt, Mycobacterium tuberculosis H37Rv
cgcaggccgacacgaacgcugc

SEQ ID NO: 1368732 - RNA, 22 nt, Mycobacterium tuberculosis H37Rv
cgcaggcuuccagccacagccc

SEQ ID NO: 1368733 - RNA, 13 nt, Mycobacterium tuberculosis H37Rv
cgcaggcuucccu

SEQ ID NO: 1368734 - RNA, 13 nt, Mycobacterium tuberculosis H37Rv
cgcaggcucaccg

SEQ ID NO: 1368735 - RNA, 17 nt, Mycobacterium tuberculosis H37Rv
cgcaggcucaccgagcc

SEQ ID NO: 1368736 - RNA, 15 nt, Mycobacterium tuberculosis H37Rv
cgcaucgagcaccuc

SEQ ID NO: 1368737 - RNA, 15 nt, Mycobacterium tuberculosis H37Rv
cgcaucgccuccucg

SEQ ID NO: 1368738 - RNA, 22 nt, Mycobacterium tuberculosis H37Rv
cgcaucgccgcuggccagcaca

SEQ ID NO: 1368739 - RNA, 13 nt, Mycobacterium tuberculosis H37Rv
cgcaucgcggcga

SEQ ID NO: 1368740 - RNA, 15 nt, Mycobacterium tuberculosis H37Rv
cgcaucgccgacagc

SEQ ID NO: 1368741 - RNA, 16 nt, Mycobacterium tuberculosis H37Rv
cgcaucgcacagcgcc

SEQ ID NO: 1368742 - RNA, 23 nt, Mycobacterium tuberculosis H37Rv
cgcaucggccagcagcgacucca

SEQ ID NO: 1368743 - RNA, 14 nt, Mycobacterium tuberculosis H37Rv
cgcaucggcaaggc

SEQ ID NO: 1368744 - RNA, 18 nt, Mycobacterium tuberculosis H37Rv
cgcaucgucgaaagccug

SEQ ID NO: 1368745 - RNA, 21 nt, Mycobacterium tuberculosis H37Rv
cgcagggaucaccccggccgg

SEQ ID NO: 1368746 - RNA, 15 nt, Mycobacterium tuberculosis H37Rv
cgcagggccgccgcg

SEQ ID NO: 1368747 - RNA, 15 nt, Mycobacterium tuberculosis H37Rv
cgcauagggccaccg

SEQ ID NO: 1368748 - RNA, 21 nt, Mycobacterium tuberculosis H37Rv
cgcauaggcuuccggcgcgac

SEQ ID NO: 1368749 - RNA, 18 nt, Mycobacterium tuberculosis H37Rv
cgcauaggccccgccagc

SEQ ID NO: 1368750 - RNA, 17 nt, Mycobacterium tuberculosis H37Rv
cgcauaggccccgccag

SEQ ID NO: 1368751 - RNA, 14 nt, Mycobacterium tuberculosis H37Rv
cgcaucaccacugg

SEQ ID NO: 1368752 - RNA, 13 nt, Mycobacterium tuberculosis H37Rv
cgcaucacccggg

SEQ ID NO: 1368753 - RNA, 13 nt, Mycobacterium tuberculosis H37Rv
cgcaugccacggc

SEQ ID NO: 1368754 - RNA, 16 nt, Mycobacterium tuberculosis H37Rv
cgcaugcgcgcgccgg

SEQ ID NO: 1368755 - RNA, 21 nt, Mycobacterium tuberculosis H37Rv
cgcaugcuugaaacccaggcc

SEQ ID NO: 1368756 - RNA, 19 nt, Mycobacterium tuberculosis H37Rv
cgcauggacaacagcuugg

SEQ ID NO: 1368757 - RNA, 19 nt, Mycobacterium tuberculosis H37Rv
cgcaugcgcuccggcgcga

SEQ ID NO: 1368758 - RNA, 14 nt, Mycobacterium tuberculosis H37Rv
cgcauuagccugcg

SEQ ID NO: 1368759 - RNA, 14 nt, Mycobacterium tuberculosis H37Rv
cgcauucugcugcc

SEQ ID NO: 1368760 - RNA, 15 nt, Mycobacterium tuberculosis H37Rv
cgcauucugcugcca

SEQ ID NO: 1368761 - RNA, 21 nt, Mycobacterium tuberculosis H37Rv
cgcauugagcuggcgcccggg

SEQ ID NO: 1368762 - RNA, 15 nt, Mycobacterium tuberculosis H37Rv
cgcauuccggcgcca

SEQ ID NO: 1368763 - RNA, 19 nt, Mycobacterium tuberculosis H37Rv
cgcauuucguggcgcgccg

SEQ ID NO: 1368764 - RNA, 18 nt, Mycobacterium tuberculosis H37Rv
cgcauuuuucgccagcug

SEQ ID NO: 1368765 - RNA, 21 nt, Mycobacterium tuberculosis H37Rv
cgcauuuuucgccagcugaca

SEQ ID NO: 1368766 - RNA, 10 nt, Mycobacterium tuberculosis H37Rv
cgccaaaauc

SEQ ID NO: 1368767 - RNA, 20 nt, Mycobacterium tuberculosis H37Rv
cgccaaacgcugcgcccgga

SEQ ID NO: 1368768 - RNA, 22 nt, Mycobacterium tuberculosis H37Rv
cgccaaauccggugcccgcacc

SEQ ID NO: 1368769 - RNA, 15 nt, Mycobacterium tuberculosis H37Rv
cgccaacgccagcac

SEQ ID NO: 1368770 - RNA, 19 nt, Mycobacterium tuberculosis H37Rv
cgccaacgggcugccccuc

SEQ ID NO: 1368771 - RNA, 18 nt, Mycobacterium tuberculosis H37Rv
cgccaacguugcgccagc

SEQ ID NO: 1368772 - RNA, 22 nt, Mycobacterium tuberculosis H37Rv
cgccaacucgagaguggccucg

SEQ ID NO: 1368773 - RNA, 19 nt, Mycobacterium tuberculosis H37Rv
cgccaacuucaccacccug

SEQ ID NO: 1368774 - RNA, 13 nt, Mycobacterium tuberculosis H37Rv
cgccaacccggcg

SEQ ID NO: 1368775 - RNA, 16 nt, Mycobacterium tuberculosis H37Rv
cgccaacgccacggca

SEQ ID NO: 1368776 - RNA, 14 nt, Mycobacterium tuberculosis H37Rv
cgccaacaccaacc

SEQ ID NO: 1368777 - RNA, 21 nt, Mycobacterium tuberculosis H37Rv
cgccaaccacuuuccggccga

SEQ ID NO: 1368778 - RNA, 15 nt, Mycobacterium tuberculosis H37Rv
cgccaagcucggcca

SEQ ID NO: 1368779 - RNA, 15 nt, Mycobacterium tuberculosis H37Rv
cgccaagccgugccg

SEQ ID NO: 1368780 - RNA, 18 nt, Mycobacterium tuberculosis H37Rv
cgccaagcucggccacca

SEQ ID NO: 1368781 - RNA, 18 nt, Mycobacterium tuberculosis H37Rv
cgccaacuucaccacccu

SEQ ID NO: 1368782 - RNA, 14 nt, Mycobacterium tuberculosis H37Rv
cgccaagggccccu

SEQ ID NO: 1368783 - RNA, 15 nt, Mycobacterium tuberculosis H37Rv
cgccaaugccaccau

SEQ ID NO: 1368784 - RNA, 17 nt, Mycobacterium tuberculosis H37Rv
cgccacacggggccgcc

SEQ ID NO: 1368785 - RNA, 20 nt, Mycobacterium tuberculosis H37Rv
cgccacacggggccgccagc

SEQ ID NO: 1368786 - RNA, 22 nt, Mycobacterium tuberculosis H37Rv
cgccacaaccguugcugcgcag

SEQ ID NO: 1368787 - RNA, 13 nt, Mycobacterium tuberculosis H37Rv
cgccacaccauga

SEQ ID NO: 1368788 - RNA, 16 nt, Mycobacterium tuberculosis H37Rv
cgccacagcacccacg

SEQ ID NO: 1368789 - RNA, 12 nt, Mycobacterium tuberculosis H37Rv
cgccacagcccc

SEQ ID NO: 1368790 - RNA, 22 nt, Mycobacterium tuberculosis H37Rv
cgccacauacaccggccggucc

SEQ ID NO: 1368791 - RNA, 12 nt, Mycobacterium tuberculosis H37Rv
cgccaccgccgg

SEQ ID NO: 1368792 - RNA, 19 nt, Mycobacterium tuberculosis H37Rv
cgccaccgcgacaccccgg

SEQ ID NO: 1368793 - RNA, 17 nt, Mycobacterium tuberculosis H37Rv
cgccaccgccagcgucg

SEQ ID NO: 1368794 - RNA, 19 nt, Mycobacterium tuberculosis H37Rv
cgccacccgcgccgcccgc

SEQ ID NO: 1368795 - RNA, 15 nt, Mycobacterium tuberculosis H37Rv
cgccaccgccgcugc

SEQ ID NO: 1368796 - RNA, 21 nt, Mycobacterium tuberculosis H37Rv
cgccaccgcaagaaucagcag

SEQ ID NO: 1368797 - RNA, 14 nt, Mycobacterium tuberculosis H37Rv
cgccaccgccagcg

SEQ ID NO: 1368798 - RNA, 13 nt, Mycobacterium tuberculosis H37Rv
cgccaccgaccga

SEQ ID NO: 1368799 - RNA, 19 nt, Mycobacterium tuberculosis H37Rv
cgccaccgagaucggacag

SEQ ID NO: 1368800 - RNA, 19 nt, Mycobacterium tuberculosis H37Rv
cgccaccgagcccuccagg

SEQ ID NO: 1368801 - RNA, 20 nt, Mycobacterium tuberculosis H37Rv
cgccaccggcaaucggcggc

SEQ ID NO: 1368802 - RNA, 18 nt, Mycobacterium tuberculosis H37Rv
cgccaccggcaccgccug

SEQ ID NO: 1368803 - RNA, 20 nt, Mycobacterium tuberculosis H37Rv
cgccaccgcggucaccgacg

SEQ ID NO: 1368804 - RNA, 14 nt, Mycobacterium tuberculosis H37Rv
cgccaccgcggcga

SEQ ID NO: 1368805 - RNA, 17 nt, Mycobacterium tuberculosis H37Rv
cgccaccggcgccgccc

SEQ ID NO: 1368806 - RNA, 19 nt, Mycobacterium tuberculosis H37Rv
cgccaccggguucaccgag

SEQ ID NO: 1368807 - RNA, 17 nt, Mycobacterium tuberculosis H37Rv
cgccaccgguaccggcg

SEQ ID NO: 1368808 - RNA, 18 nt, Mycobacterium tuberculosis H37Rv
cgccaccgguaccggcga

SEQ ID NO: 1368809 - RNA, 19 nt, Mycobacterium tuberculosis H37Rv
cgccaccggcguccagucc

SEQ ID NO: 1368810 - RNA, 16 nt, Mycobacterium tuberculosis H37Rv
cgccaccggcgcgacc

SEQ ID NO: 1368811 - RNA, 23 nt, Mycobacterium tuberculosis H37Rv
cgccaccggcgcgaccgcggcga

SEQ ID NO: 1368812 - RNA, 14 nt, Mycobacterium tuberculosis H37Rv
cgccaccggcgccg

SEQ ID NO: 1368813 - RNA, 14 nt, Mycobacterium tuberculosis H37Rv
cgccaccggccgcg

SEQ ID NO: 1368814 - RNA, 18 nt, Mycobacterium tuberculosis H37Rv
cgccacauuucaccaccg

SEQ ID NO: 1368815 - RNA, 12 nt, Mycobacterium tuberculosis H37Rv
cgccaccaccuc

SEQ ID NO: 1368816 - RNA, 11 nt, Mycobacterium tuberculosis H37Rv
cgccaccaccg

SEQ ID NO: 1368817 - RNA, 21 nt, Mycobacterium tuberculosis H37Rv
cgccacccgcgccgcccgcuc

SEQ ID NO: 1368818 - RNA, 11 nt, Mycobacterium tuberculosis H37Rv
cgccacccggu

SEQ ID NO: 1368819 - RNA, 18 nt, Mycobacterium tuberculosis H37Rv
cgccacccgaucgggcgu

SEQ ID NO: 1368820 - RNA, 16 nt, Mycobacterium tuberculosis H37Rv
cgccacccgccaacgc

SEQ ID NO: 1368821 - RNA, 22 nt, Mycobacterium tuberculosis H37Rv
cgccaccccgcguaugccagga

SEQ ID NO: 1368822 - RNA, 15 nt, Mycobacterium tuberculosis H37Rv
cgagcgcccuccucg

SEQ ID NO: 1368823 - RNA, 19 nt, Mycobacterium tuberculosis H37Rv
cgagcgcaucagggugggc

SEQ ID NO: 1368824 - RNA, 19 nt, Mycobacterium tuberculosis H37Rv
cgagcgcacuggggaggcc

SEQ ID NO: 1368825 - RNA, 12 nt, Mycobacterium tuberculosis H37Rv
cgagcgcacugg

SEQ ID NO: 1368826 - RNA, 16 nt, Mycobacterium tuberculosis H37Rv
cgagcgcacaccggcu

SEQ ID NO: 1368827 - RNA, 20 nt, Mycobacterium tuberculosis H37Rv
cgagcgcaagagccguccga

SEQ ID NO: 1368828 - RNA, 13 nt, Mycobacterium tuberculosis H37Rv
cgagccguagacc

SEQ ID NO: 1368829 - RNA, 22 nt, Mycobacterium tuberculosis H37Rv
cgagccguccaauuccgcagag

SEQ ID NO: 1368830 - RNA, 15 nt, Mycobacterium tuberculosis H37Rv
cgagccgcgugggcc

SEQ ID NO: 1368831 - RNA, 14 nt, Mycobacterium tuberculosis H37Rv
cgagccggaacagu

SEQ ID NO: 1368832 - RNA, 22 nt, Mycobacterium tuberculosis H37Rv
cgagccgcggucggcgugcagg

SEQ ID NO: 1368833 - RNA, 17 nt, Mycobacterium tuberculosis H37Rv
cgagcccgccggccucu

SEQ ID NO: 1368834 - RNA, 14 nt, Mycobacterium tuberculosis H37Rv
cgagcccggccucg

SEQ ID NO: 1368835 - RNA, 20 nt, Mycobacterium tuberculosis H37Rv
cgagcccggugcuaccggcu

SEQ ID NO: 1368836 - RNA, 17 nt, Mycobacterium tuberculosis H37Rv
cgagcccgccacagccc

SEQ ID NO: 1368837 - RNA, 22 nt, Mycobacterium tuberculosis H37Rv
cgagcccgccacagccccaggg

SEQ ID NO: 1368838 - RNA, 13 nt, Mycobacterium tuberculosis H37Rv
cgagcccgccagc

SEQ ID NO: 1368839 - RNA, 14 nt, Mycobacterium tuberculosis H37Rv
cgagcccagcugcg

SEQ ID NO: 1368840 - RNA, 13 nt, Mycobacterium tuberculosis H37Rv
cgagcccagcugc

SEQ ID NO: 1368841 - RNA, 17 nt, Mycobacterium tuberculosis H37Rv
cgagcccgaaccaccgc

SEQ ID NO: 1368842 - RNA, 24 nt, Mycobacterium tuberculosis H37Rv
cgagccgccggaucgccacggugg

SEQ ID NO: 1368843 - RNA, 22 nt, Mycobacterium tuberculosis H37Rv
cgagccgcgauugugcagcgaa

SEQ ID NO: 1368844 - RNA, 16 nt, Mycobacterium tuberculosis H37Rv
cgagccgcacagcaug

SEQ ID NO: 1368845 - RNA, 17 nt, Mycobacterium tuberculosis H37Rv
cgagcaugcccagcgaa

SEQ ID NO: 1368846 - RNA, 17 nt, Mycobacterium tuberculosis H37Rv
cgagccacaugaccuga

SEQ ID NO: 1368847 - RNA, 21 nt, Mycobacterium tuberculosis H37Rv
cgagccaacuccacccaacgc

SEQ ID NO: 1368848 - RNA, 19 nt, Mycobacterium tuberculosis H37Rv
cgagcaugauguccuccca

SEQ ID NO: 1368849 - RNA, 17 nt, Mycobacterium tuberculosis H37Rv
cgagccaacgcgcagag

SEQ ID NO: 1368850 - RNA, 14 nt, Mycobacterium tuberculosis H37Rv
cgagccaaggcuuc

SEQ ID NO: 1368851 - RNA, 14 nt, Mycobacterium tuberculosis H37Rv
cgagccagcuccgg

SEQ ID NO: 1368852 - RNA, 13 nt, Mycobacterium tuberculosis H37Rv
cgagccagcggag

SEQ ID NO: 1368853 - RNA, 15 nt, Mycobacterium tuberculosis H37Rv
cgagcccaccgucgc

SEQ ID NO: 1368854 - RNA, 19 nt, Mycobacterium tuberculosis H37Rv
cgagcaccgcgguagccga

SEQ ID NO: 1368855 - RNA, 16 nt, Mycobacterium tuberculosis H37Rv
cgagcacucggccacg

SEQ ID NO: 1368856 - RNA, 20 nt, Mycobacterium tuberculosis H37Rv
cgagcacugaggagaugagc

SEQ ID NO: 1368857 - RNA, 17 nt, Mycobacterium tuberculosis H37Rv
cgagcagacgccgcguu

SEQ ID NO: 1368858 - RNA, 20 nt, Mycobacterium tuberculosis H37Rv
cgagcagacgcggaaucgca

SEQ ID NO: 1368859 - RNA, 17 nt, Mycobacterium tuberculosis H37Rv
cgagcagacgugggcgc

SEQ ID NO: 1368860 - RNA, 13 nt, Mycobacterium tuberculosis H37Rv
cgagcagcccggg

SEQ ID NO: 1368861 - RNA, 17 nt, Mycobacterium tuberculosis H37Rv
cgagcagcaccacccgc

SEQ ID NO: 1368862 - RNA, 16 nt, Mycobacterium tuberculosis H37Rv
cgagcagaucagcacg

SEQ ID NO: 1368863 - RNA, 10 nt, Mycobacterium tuberculosis H37Rv
cgagcagcaa

SEQ ID NO: 1368864 - RNA, 20 nt, Mycobacterium tuberculosis H37Rv
cgagcaccgugcccugggug

SEQ ID NO: 1368865 - RNA, 16 nt, Mycobacterium tuberculosis H37Rv
cgagcaccuccacugg

SEQ ID NO: 1368866 - RNA, 23 nt, Mycobacterium tuberculosis H37Rv
cgagcacggugagccgguggccc

SEQ ID NO: 1368867 - RNA, 18 nt, Mycobacterium tuberculosis H37Rv
cgagcaccacccgggccu

SEQ ID NO: 1368868 - RNA, 22 nt, Mycobacterium tuberculosis H37Rv
cgagcaccacccgggccucggc

SEQ ID NO: 1368869 - RNA, 16 nt, Mycobacterium tuberculosis H37Rv
cgagcaccaccccagc

SEQ ID NO: 1368870 - RNA, 12 nt, Mycobacterium tuberculosis H37Rv
cgagcaccaccc

SEQ ID NO: 1368871 - RNA, 13 nt, Mycobacterium tuberculosis H37Rv
cgagcagcccgcg

SEQ ID NO: 1368872 - RNA, 13 nt, Mycobacterium tuberculosis H37Rv
cgagcagcuacag

SEQ ID NO: 1368873 - RNA, 17 nt, Mycobacterium tuberculosis H37Rv
cgagcagugaccgcugg

SEQ ID NO: 1368874 - RNA, 16 nt, Mycobacterium tuberculosis H37Rv
cgagcagugccgugcg

SEQ ID NO: 1368875 - RNA, 17 nt, Mycobacterium tuberculosis H37Rv
cgagcaguuccagcucg

SEQ ID NO: 1368876 - RNA, 19 nt, Mycobacterium tuberculosis H37Rv
cgagcauaccgccgcugcc

SEQ ID NO: 1368877 - RNA, 22 nt, Mycobacterium tuberculosis H37Rv
cgagcagggccggcaccgcagc

SEQ ID NO: 1368878 - RNA, 21 nt, Mycobacterium tuberculosis H37Rv
cgagcaggcuggcugccacga

SEQ ID NO: 1368879 - RNA, 15 nt, Mycobacterium tuberculosis H37Rv
cgagcagggugacca

SEQ ID NO: 1368880 - RNA, 13 nt, Mycobacterium tuberculosis H37Rv
cgagauuggugca

SEQ ID NO: 1368881 - RNA, 16 nt, Mycobacterium tuberculosis H37Rv
cgagauuggugcagac

SEQ ID NO: 1368882 - RNA, 18 nt, Mycobacterium tuberculosis H37Rv
cgagauugccgggccgcc

SEQ ID NO: 1368883 - RNA, 17 nt, Mycobacterium tuberculosis H37Rv
cgagcaacaccagggcc

SEQ ID NO: 1368884 - RNA, 23 nt, Mycobacterium tuberculosis H37Rv
cgagauggcgaucaugagcagca

SEQ ID NO: 1368885 - RNA, 21 nt, Mycobacterium tuberculosis H37Rv
cgagcaacggacgaagcaccu

SEQ ID NO: 1368886 - RNA, 18 nt, Mycobacterium tuberculosis H37Rv
cgagcaacucguccagca

SEQ ID NO: 1368887 - RNA, 15 nt, Mycobacterium tuberculosis H37Rv
cgagcaauuccucag

SEQ ID NO: 1368888 - RNA, 17 nt, Mycobacterium tuberculosis H37Rv
cgagcacaugcucgacg

SEQ ID NO: 1368889 - RNA, 23 nt, Mycobacterium tuberculosis H37Rv
cgagcacacaacacccaacgcaa

SEQ ID NO: 1368890 - RNA, 17 nt, Mycobacterium tuberculosis H37Rv
cgagcacacuccuagcc

SEQ ID NO: 1368891 - RNA, 16 nt, Mycobacterium tuberculosis H37Rv
cgagauaaccaccauc

SEQ ID NO: 1368892 - RNA, 16 nt, Mycobacterium tuberculosis H37Rv
cgagauacggccacca

SEQ ID NO: 1368893 - RNA, 13 nt, Mycobacterium tuberculosis H37Rv
cgagaucaccgcc

SEQ ID NO: 1368894 - RNA, 15 nt, Mycobacterium tuberculosis H37Rv
cgagaucaccgccac

SEQ ID NO: 1368895 - RNA, 16 nt, Mycobacterium tuberculosis H37Rv
cgagaucagcaugccc

SEQ ID NO: 1368896 - RNA, 16 nt, Mycobacterium tuberculosis H37Rv
cgagaucagccucgcg

SEQ ID NO: 1368897 - RNA, 23 nt, Mycobacterium tuberculosis H37Rv
cgagaucagccucgcgggcaggg

SEQ ID NO: 1368898 - RNA, 12 nt, Mycobacterium tuberculosis H37Rv
cgagaugcugca

SEQ ID NO: 1368899 - RNA, 15 nt, Mycobacterium tuberculosis H37Rv
cgagaugcugcaccc

SEQ ID NO: 1368900 - RNA, 16 nt, Mycobacterium tuberculosis H37Rv
cgagaccaacgcgcag

SEQ ID NO: 1368901 - RNA, 18 nt, Mycobacterium tuberculosis H37Rv
cgagaccaacgcgcaggc

SEQ ID NO: 1368902 - RNA, 20 nt, Mycobacterium tuberculosis H37Rv
cgagaccaacgcgcaggccg

SEQ ID NO: 1368903 - RNA, 23 nt, Mycobacterium tuberculosis H37Rv
cgagaccucucugcgccaggcgg

SEQ ID NO: 1368904 - RNA, 18 nt, Mycobacterium tuberculosis H37Rv
cgagaccgcgagcagcac

SEQ ID NO: 1368905 - RNA, 18 nt, Mycobacterium tuberculosis H37Rv
cgagacgcuuuccgccgc

SEQ ID NO: 1368906 - RNA, 19 nt, Mycobacterium tuberculosis H37Rv
cgagacgguguugccuagg

SEQ ID NO: 1368907 - RNA, 15 nt, Mycobacterium tuberculosis H37Rv
cgagaagucgcagcg

SEQ ID NO: 1368908 - RNA, 20 nt, Mycobacterium tuberculosis H37Rv
cgagaauuccccagccgcau

SEQ ID NO: 1368909 - RNA, 17 nt, Mycobacterium tuberculosis H37Rv
cgagagccccgaccagc

SEQ ID NO: 1368910 - RNA, 19 nt, Mycobacterium tuberculosis H37Rv
cgagagccccgaccagcag

SEQ ID NO: 1368911 - RNA, 20 nt, Mycobacterium tuberculosis H37Rv
cgagagccccgaccagcaga

SEQ ID NO: 1368912 - RNA, 22 nt, Mycobacterium tuberculosis H37Rv
cgagagggcggggcagaagucg

SEQ ID NO: 1368913 - RNA, 16 nt, Mycobacterium tuberculosis H37Rv
cgagagcagccagcca

SEQ ID NO: 1368914 - RNA, 18 nt, Mycobacterium tuberculosis H37Rv
cgagagcagccagccacc

SEQ ID NO: 1368915 - RNA, 23 nt, Mycobacterium tuberculosis H37Rv
cgagacgucgaacuucagcggcg

SEQ ID NO: 1368916 - RNA, 12 nt, Mycobacterium tuberculosis H37Rv
cgacuucuccag

SEQ ID NO: 1368917 - RNA, 22 nt, Mycobacterium tuberculosis H37Rv
cgacuguggcgccgccggcacc

SEQ ID NO: 1368918 - RNA, 19 nt, Mycobacterium tuberculosis H37Rv
cgacuguggcgccgccggc

SEQ ID NO: 1368919 - RNA, 17 nt, Mycobacterium tuberculosis H37Rv
cgacuguggcgccgccg

SEQ ID NO: 1368920 - RNA, 13 nt, Mycobacterium tuberculosis H37Rv
cgagaacacccgu

SEQ ID NO: 1368921 - RNA, 12 nt, Mycobacterium tuberculosis H37Rv
cgagaacgucga

SEQ ID NO: 1368922 - RNA, 22 nt, Mycobacterium tuberculosis H37Rv
cgagaacgcccgagugaccagg

SEQ ID NO: 1368923 - RNA, 15 nt, Mycobacterium tuberculosis H37Rv
cgagaacgcccgcug

SEQ ID NO: 1368924 - RNA, 15 nt, Mycobacterium tuberculosis H37Rv
cgacucccccucuac

SEQ ID NO: 1368925 - RNA, 17 nt, Mycobacterium tuberculosis H37Rv
cgacuccccgccgggca

SEQ ID NO: 1368926 - RNA, 22 nt, Mycobacterium tuberculosis H37Rv
cgacucgccggcgaauccgcac

SEQ ID NO: 1368927 - RNA, 22 nt, Mycobacterium tuberculosis H37Rv
cgacucggcggcgcggucgaag

SEQ ID NO: 1368928 - RNA, 18 nt, Mycobacterium tuberculosis H37Rv
cgacucgguugaggacga

SEQ ID NO: 1368929 - RNA, 19 nt, Mycobacterium tuberculosis H37Rv
cgacucguggcgccacggc

SEQ ID NO: 1368930 - RNA, 18 nt, Mycobacterium tuberculosis H37Rv
cgacugcgaaugcugggc

SEQ ID NO: 1368931 - RNA, 16 nt, Mycobacterium tuberculosis H37Rv
cgacugcugucaccgc

SEQ ID NO: 1368932 - RNA, 16 nt, Mycobacterium tuberculosis H37Rv
cgacuggaaggcgggc

SEQ ID NO: 1368933 - RNA, 21 nt, Mycobacterium tuberculosis H37Rv
cgacuggccccgccagcggca

SEQ ID NO: 1368934 - RNA, 13 nt, Mycobacterium tuberculosis H37Rv
cgacuggccccgc

SEQ ID NO: 1368935 - RNA, 23 nt, Mycobacterium tuberculosis H37Rv
cgacugcagaaacagccgcagcg

SEQ ID NO: 1368936 - RNA, 22 nt, Mycobacterium tuberculosis H37Rv
cgacugcagaaacagccgcagc

SEQ ID NO: 1368937 - RNA, 21 nt, Mycobacterium tuberculosis H37Rv
cgacugcagaaacagccgcag

SEQ ID NO: 1368938 - RNA, 23 nt, Mycobacterium tuberculosis H37Rv
cgacucugugacgggcacaacca

SEQ ID NO: 1368939 - RNA, 16 nt, Mycobacterium tuberculosis H37Rv
cgacugaucgccaccc

SEQ ID NO: 1368940 - RNA, 16 nt, Mycobacterium tuberculosis H37Rv
cgacugcaacucuucc

SEQ ID NO: 1368941 - RNA, 21 nt, Mycobacterium tuberculosis H37Rv
cgacgucuucgaccucaccca

SEQ ID NO: 1368942 - RNA, 16 nt, Mycobacterium tuberculosis H37Rv
cgacgucuaggccaaa

SEQ ID NO: 1368943 - RNA, 22 nt, Mycobacterium tuberculosis H37Rv
cgacgucguuggaaaucccugg

SEQ ID NO: 1368944 - RNA, 14 nt, Mycobacterium tuberculosis H37Rv
cgacgucggccgca

SEQ ID NO: 1368945 - RNA, 17 nt, Mycobacterium tuberculosis H37Rv
cgacgucggugaccucg

SEQ ID NO: 1368946 - RNA, 12 nt, Mycobacterium tuberculosis H37Rv
cgacgucggcgc

SEQ ID NO: 1368947 - RNA, 17 nt, Mycobacterium tuberculosis H37Rv
cgacgucggcuucaccu

SEQ ID NO: 1368948 - RNA, 18 nt, Mycobacterium tuberculosis H37Rv
cgacgucggcuucaccuu

SEQ ID NO: 1368949 - RNA, 20 nt, Mycobacterium tuberculosis H37Rv
cgacgucgccgccgcgggcg

SEQ ID NO: 1368950 - RNA, 14 nt, Mycobacterium tuberculosis H37Rv
cgacgucgccgacc

SEQ ID NO: 1368951 - RNA, 17 nt, Mycobacterium tuberculosis H37Rv
cgacgucgccaagacca

SEQ ID NO: 1368952 - RNA, 14 nt, Mycobacterium tuberculosis H37Rv
cgaauaccagaccg

SEQ ID NO: 1368953 - RNA, 19 nt, Mycobacterium tuberculosis H37Rv
cgaauacggcugccuccau

SEQ ID NO: 1368954 - RNA, 19 nt, Mycobacterium tuberculosis H37Rv
cgacgugcaggaacaccca

SEQ ID NO: 1368955 - RNA, 14 nt, Mycobacterium tuberculosis H37Rv
cgacgugcgcggca

SEQ ID NO: 1368956 - RNA, 17 nt, Mycobacterium tuberculosis H37Rv
cgacgugguugccccgc

SEQ ID NO: 1368957 - RNA, 19 nt, Mycobacterium tuberculosis H37Rv
cgacguggccagcccgccc

SEQ ID NO: 1368958 - RNA, 19 nt, Mycobacterium tuberculosis H37Rv
cgacuacccagccagccgc

SEQ ID NO: 1368959 - RNA, 17 nt, Mycobacterium tuberculosis H37Rv
cgacguuggcgggagca

SEQ ID NO: 1368960 - RNA, 16 nt, Mycobacterium tuberculosis H37Rv
cgacguugcguagcag

SEQ ID NO: 1368961 - RNA, 15 nt, Mycobacterium tuberculosis H37Rv
cgacguugcggacgg

SEQ ID NO: 1368962 - RNA, 21 nt, Mycobacterium tuberculosis H37Rv
cgacguuguuuuugcacugaa

SEQ ID NO: 1368963 - RNA, 19 nt, Mycobacterium tuberculosis H37Rv
cgaggcgcccagcgacaac

SEQ ID NO: 1368964 - RNA, 12 nt, Mycobacterium tuberculosis H37Rv
cgaggcggcggu

SEQ ID NO: 1368965 - RNA, 18 nt, Mycobacterium tuberculosis H37Rv
cgaggcguaaucaagcag

SEQ ID NO: 1368966 - RNA, 18 nt, Mycobacterium tuberculosis H37Rv
cgaggcguucaccacgau

SEQ ID NO: 1368967 - RNA, 14 nt, Mycobacterium tuberculosis H37Rv
cgaggcguucagug

SEQ ID NO: 1368968 - RNA, 19 nt, Mycobacterium tuberculosis H37Rv
cgaggcucgcguggccgcc

SEQ ID NO: 1368969 - RNA, 18 nt, Mycobacterium tuberculosis H37Rv
cgaggcgaguucgcgcac

SEQ ID NO: 1368970 - RNA, 12 nt, Mycobacterium tuberculosis H37Rv
cgaggcgaucac

SEQ ID NO: 1368971 - RNA, 17 nt, Mycobacterium tuberculosis H37Rv
cgaggcgaucaccgcgc

SEQ ID NO: 1368972 - RNA, 21 nt, Mycobacterium tuberculosis H37Rv
cgaggcgaucaccgcgccgga

SEQ ID NO: 1368973 - RNA, 22 nt, Mycobacterium tuberculosis H37Rv
cgaggccuaccaggcgcggccc

SEQ ID NO: 1368974 - RNA, 12 nt, Mycobacterium tuberculosis H37Rv
cgaggcgaaaga

SEQ ID NO: 1368975 - RNA, 18 nt, Mycobacterium tuberculosis H37Rv
cgaggccgcacgucgacc

SEQ ID NO: 1368976 - RNA, 15 nt, Mycobacterium tuberculosis H37Rv
cgaggcccgggugcu

SEQ ID NO: 1368977 - RNA, 16 nt, Mycobacterium tuberculosis H37Rv
cgagggcgggacccgu

SEQ ID NO: 1368978 - RNA, 14 nt, Mycobacterium tuberculosis H37Rv
cgagggcgcguguc

SEQ ID NO: 1368979 - RNA, 23 nt, Mycobacterium tuberculosis H37Rv
cgagggcgcgagcagacgcagaa

SEQ ID NO: 1368980 - RNA, 18 nt, Mycobacterium tuberculosis H37Rv
cgagggccagcagccgcg

SEQ ID NO: 1368981 - RNA, 15 nt, Mycobacterium tuberculosis H37Rv
cgagggccagcagcc

SEQ ID NO: 1368982 - RNA, 20 nt, Mycobacterium tuberculosis H37Rv
cgagggccagcagccgcgac

SEQ ID NO: 1368983 - RNA, 14 nt, Mycobacterium tuberculosis H37Rv
cgagggccagcagc

SEQ ID NO: 1368984 - RNA, 20 nt, Mycobacterium tuberculosis H37Rv
cgagggccacguagcagcag

SEQ ID NO: 1368985 - RNA, 20 nt, Mycobacterium tuberculosis H37Rv
cgagggauguagugcugcuc

SEQ ID NO: 1368986 - RNA, 17 nt, Mycobacterium tuberculosis H37Rv
cgagggaacggugcaca

SEQ ID NO: 1368987 - RNA, 12 nt, Mycobacterium tuberculosis H37Rv
cgaggagggccg

SEQ ID NO: 1368988 - RNA, 24 nt, Mycobacterium tuberculosis H37Rv
cgaggauguugugccgaucggcca

SEQ ID NO: 1368989 - RNA, 15 nt, Mycobacterium tuberculosis H37Rv
cgaggaugugguugg

SEQ ID NO: 1368990 - RNA, 16 nt, Mycobacterium tuberculosis H37Rv
cgaggaugugguuggu

SEQ ID NO: 1368991 - RNA, 15 nt, Mycobacterium tuberculosis H37Rv
cgaggauucauggcg

SEQ ID NO: 1368992 - RNA, 15 nt, Mycobacterium tuberculosis H37Rv
cgaggccacgccagc

SEQ ID NO: 1368993 - RNA, 14 nt, Mycobacterium tuberculosis H37Rv
cgaggccagcagcu

SEQ ID NO: 1368994 - RNA, 15 nt, Mycobacterium tuberculosis H37Rv
cgaggaauuccgcua

SEQ ID NO: 1368995 - RNA, 20 nt, Mycobacterium tuberculosis H37Rv
cgaggaacucggacccaccc

SEQ ID NO: 1368996 - RNA, 18 nt, Mycobacterium tuberculosis H37Rv
cgaggaccugcucgggcg

SEQ ID NO: 1368997 - RNA, 17 nt, Mycobacterium tuberculosis H37Rv
cgaggaccagaggcgcu

SEQ ID NO: 1368998 - RNA, 14 nt, Mycobacterium tuberculosis H37Rv
cgaggacgccggcg

SEQ ID NO: 1368999 - RNA, 19 nt, Mycobacterium tuberculosis H37Rv
cgaggacgccggcgccgcc

SEQ ID NO: 1369000 - RNA, 20 nt, Mycobacterium tuberculosis H37Rv
cgagcugacgccgagcuggu

SEQ ID NO: 1369001 - RNA, 21 nt, Mycobacterium tuberculosis H37Rv
cgagcugagcggccagcaucg

SEQ ID NO: 1369002 - RNA, 14 nt, Mycobacterium tuberculosis H37Rv
cgagcugauccggg

SEQ ID NO: 1369003 - RNA, 14 nt, Mycobacterium tuberculosis H37Rv
cgagcugccaacgc

SEQ ID NO: 1369004 - RNA, 15 nt, Mycobacterium tuberculosis H37Rv
cgagcuuggcuuggc

SEQ ID NO: 1369005 - RNA, 17 nt, Mycobacterium tuberculosis H37Rv
cgagcuggcaacgccgc

SEQ ID NO: 1369006 - RNA, 23 nt, Mycobacterium tuberculosis H37Rv
cgagcuugagcgugagcgccgcg

SEQ ID NO: 1369007 - RNA, 15 nt, Mycobacterium tuberculosis H37Rv
cgagcuugccgucgc

SEQ ID NO: 1369008 - RNA, 18 nt, Mycobacterium tuberculosis H37Rv
cgagcuugccgucgcuga

SEQ ID NO: 1369009 - RNA, 14 nt, Mycobacterium tuberculosis H37Rv
cgagcuucagcgcg

SEQ ID NO: 1369010 - RNA, 19 nt, Mycobacterium tuberculosis H37Rv
cgagcuugucgagcaggcc

SEQ ID NO: 1369011 - RNA, 15 nt, Mycobacterium tuberculosis H37Rv
cgagcucaccgcaca

SEQ ID NO: 1369012 - RNA, 23 nt, Mycobacterium tuberculosis H37Rv
cgagcucaacgacggcugaccuu

SEQ ID NO: 1369013 - RNA, 12 nt, Mycobacterium tuberculosis H37Rv
cgagcgugcgca

SEQ ID NO: 1369014 - RNA, 15 nt, Mycobacterium tuberculosis H37Rv
cgagcuccuccacca

SEQ ID NO: 1369015 - RNA, 18 nt, Mycobacterium tuberculosis H37Rv
cgagcuccuccaccaacu

SEQ ID NO: 1369016 - RNA, 16 nt, Mycobacterium tuberculosis H37Rv
cgagcucguccucguc

SEQ ID NO: 1369017 - RNA, 23 nt, Mycobacterium tuberculosis H37Rv
cgagcucguugcuggcggccagc

SEQ ID NO: 1369018 - RNA, 20 nt, Mycobacterium tuberculosis H37Rv
cgagcucaccgcacaccugc

SEQ ID NO: 1369019 - RNA, 21 nt, Mycobacterium tuberculosis H37Rv
cgagcucaggucgacaggugc

SEQ ID NO: 1369020 - RNA, 14 nt, Mycobacterium tuberculosis H37Rv
cgagcuccgaugcc

SEQ ID NO: 1369021 - RNA, 19 nt, Mycobacterium tuberculosis H37Rv
cgagcggaugaaaucggca

SEQ ID NO: 1369022 - RNA, 20 nt, Mycobacterium tuberculosis H37Rv
cgagcggaccaccgcucgcc

SEQ ID NO: 1369023 - RNA, 20 nt, Mycobacterium tuberculosis H37Rv
cgagcgcuugaccccgccga

SEQ ID NO: 1369024 - RNA, 21 nt, Mycobacterium tuberculosis H37Rv
cgagcgcggugccgccaccgg

SEQ ID NO: 1369025 - RNA, 18 nt, Mycobacterium tuberculosis H37Rv
cgagcgcuaucaccgccu

SEQ ID NO: 1369026 - RNA, 15 nt, Mycobacterium tuberculosis H37Rv
cgagcggccgcgcgc

SEQ ID NO: 1369027 - RNA, 19 nt, Mycobacterium tuberculosis H37Rv
cgagcguaaugcugcugca

SEQ ID NO: 1369028 - RNA, 14 nt, Mycobacterium tuberculosis H37Rv
aaacgcugcuggca

SEQ ID NO: 1369029 - RNA, 11 nt, Mycobacterium tuberculosis H37Rv
cgagcgccggc

SEQ ID NO: 1369030 - RNA, 22 nt, Mycobacterium tuberculosis H37Rv
aaacgcugcgcccggaccacug

SEQ ID NO: 1369031 - RNA, 11 nt, Mycobacterium tuberculosis H37Rv
cgagcgcgcca

SEQ ID NO: 1369032 - RNA, 16 nt, Mycobacterium tuberculosis H37Rv
cgagcgcgccaaucgc

SEQ ID NO: 1369033 - RNA, 18 nt, Mycobacterium tuberculosis H37Rv
cgagguguagcccuccga

SEQ ID NO: 1369034 - RNA, 21 nt, Mycobacterium tuberculosis H37Rv
cgagguguagcccuccgagca

SEQ ID NO: 1369035 - RNA, 15 nt, Mycobacterium tuberculosis H37Rv
cgagguugccgcacc

SEQ ID NO: 1369036 - RNA, 21 nt, Mycobacterium tuberculosis H37Rv
cgagguugauuggggccaggu

SEQ ID NO: 1369037 - RNA, 12 nt, Mycobacterium tuberculosis H37Rv
cgaggucggcgg

SEQ ID NO: 1369038 - RNA, 21 nt, Mycobacterium tuberculosis H37Rv
cgaggugauguuggccgccac

SEQ ID NO: 1369039 - RNA, 14 nt, Mycobacterium tuberculosis H37Rv
cgaggugcccaagg

SEQ ID NO: 1369040 - RNA, 17 nt, Mycobacterium tuberculosis H37Rv
cgagguggggugguggu

SEQ ID NO: 1369041 - RNA, 18 nt, Mycobacterium tuberculosis H37Rv
cgagguauucgcgcagca

SEQ ID NO: 1369042 - RNA, 22 nt, Mycobacterium tuberculosis H37Rv
cgagguauaaacgcggcgcgcu

SEQ ID NO: 1369043 - RNA, 14 nt, Mycobacterium tuberculosis H37Rv
cgaggucgccaacc

SEQ ID NO: 1369044 - RNA, 17 nt, Mycobacterium tuberculosis H37Rv
cgaggucgagcgccgcg

SEQ ID NO: 1369045 - RNA, 15 nt, Mycobacterium tuberculosis H37Rv
cgaggucgccaaccc

SEQ ID NO: 1369046 - RNA, 15 nt, Mycobacterium tuberculosis H37Rv
cgaggucagcucccg

SEQ ID NO: 1369047 - RNA, 21 nt, Mycobacterium tuberculosis H37Rv
cgaggguagacggggcgagca

SEQ ID NO: 1369048 - RNA, 20 nt, Mycobacterium tuberculosis H37Rv
cgaggggagugucagcgcca

SEQ ID NO: 1369049 - RNA, 23 nt, Mycobacterium tuberculosis H37Rv
cgaggguaucgucauugcgaaaa

SEQ ID NO: 1369050 - RNA, 17 nt, Mycobacterium tuberculosis H37Rv
cgagucuaaggaugacc

SEQ ID NO: 1369051 - RNA, 16 nt, Mycobacterium tuberculosis H37Rv
cgagucgggggccgcg

SEQ ID NO: 1369052 - RNA, 17 nt, Mycobacterium tuberculosis H37Rv
cgagucgguccugccaa

SEQ ID NO: 1369053 - RNA, 16 nt, Mycobacterium tuberculosis H37Rv
cgagucgaugaccccg

SEQ ID NO: 1369054 - RNA, 13 nt, Mycobacterium tuberculosis H37Rv
cgagugucagcag

SEQ ID NO: 1369055 - RNA, 17 nt, Mycobacterium tuberculosis H37Rv
cgagugguccagccaga

SEQ ID NO: 1369056 - RNA, 21 nt, Mycobacterium tuberculosis H37Rv
cgagugucacugggccggucg

SEQ ID NO: 1369057 - RNA, 16 nt, Mycobacterium tuberculosis H37Rv
cgagugggugaggcca

SEQ ID NO: 1369058 - RNA, 13 nt, Mycobacterium tuberculosis H37Rv
cgagugaccaggg

SEQ ID NO: 1369059 - RNA, 20 nt, Mycobacterium tuberculosis H37Rv
cgagucaccggguccaccgc

SEQ ID NO: 1369060 - RNA, 16 nt, Mycobacterium tuberculosis H37Rv
cgaguccaggcagcuu

SEQ ID NO: 1369061 - RNA, 16 nt, Mycobacterium tuberculosis H37Rv
cgaguaucucggcucc

SEQ ID NO: 1369062 - RNA, 16 nt, Mycobacterium tuberculosis H37Rv
cgaguaugggggugcu

SEQ ID NO: 1369063 - RNA, 16 nt, Mycobacterium tuberculosis H37Rv
cgagucgaacccgcga

SEQ ID NO: 1369064 - RNA, 16 nt, Mycobacterium tuberculosis H37Rv
cgaguagugcaggugc

SEQ ID NO: 1369065 - RNA, 17 nt, Mycobacterium tuberculosis H37Rv
cgaguagcugacccgcg

SEQ ID NO: 1369066 - RNA, 16 nt, Mycobacterium tuberculosis H37Rv
cgaguaccggccagcc

SEQ ID NO: 1369067 - RNA, 17 nt, Mycobacterium tuberculosis H37Rv
cgaguaccggccagccg

SEQ ID NO: 1369068 - RNA, 19 nt, Mycobacterium tuberculosis H37Rv
cgaguaccgauagccugcg

SEQ ID NO: 1369069 - RNA, 21 nt, Mycobacterium tuberculosis H37Rv
cgauagcggcccgaucaccag

SEQ ID NO: 1369070 - RNA, 12 nt, Mycobacterium tuberculosis H37Rv
cgauagcccgcc

SEQ ID NO: 1369071 - RNA, 16 nt, Mycobacterium tuberculosis H37Rv
cgauagcccgccaccc

SEQ ID NO: 1369072 - RNA, 22 nt, Mycobacterium tuberculosis H37Rv
cgauagcgcggcaccagcaccg

SEQ ID NO: 1369073 - RNA, 21 nt, Mycobacterium tuberculosis H37Rv
cgauaaugaucucggcaagga

SEQ ID NO: 1369074 - RNA, 14 nt, Mycobacterium tuberculosis H37Rv
cgaguugcucgaca

SEQ ID NO: 1369075 - RNA, 23 nt, Mycobacterium tuberculosis H37Rv
cgaguugaagaagccgguguuga

SEQ ID NO: 1369076 - RNA, 17 nt, Mycobacterium tuberculosis H37Rv
cgaguucgcgaaucccg

SEQ ID NO: 1369077 - RNA, 22 nt, Mycobacterium tuberculosis H37Rv
cgaguuaggccgccagccggcg

SEQ ID NO: 1369078 - RNA, 12 nt, Mycobacterium tuberculosis H37Rv
cgaguugaagaa

SEQ ID NO: 1369079 - RNA, 17 nt, Mycobacterium tuberculosis H37Rv
cgaguuucugcucgacc

SEQ ID NO: 1369080 - RNA, 12 nt, Mycobacterium tuberculosis H37Rv
cgauaacacccg

SEQ ID NO: 1369081 - RNA, 22 nt, Mycobacterium tuberculosis H37Rv
ccagggagugccgcacgauggc

SEQ ID NO: 1369082 - RNA, 17 nt, Mycobacterium tuberculosis H37Rv
ccagggagcggcugcac

SEQ ID NO: 1369083 - RNA, 15 nt, Mycobacterium tuberculosis H37Rv
ccagggagcgcagcg

SEQ ID NO: 1369084 - RNA, 18 nt, Mycobacterium tuberculosis H37Rv
ccagggagcgcagcgccg

SEQ ID NO: 1369085 - RNA, 20 nt, Mycobacterium tuberculosis H37Rv
ccagggcaucagcagagccc

SEQ ID NO: 1369086 - RNA, 22 nt, Mycobacterium tuberculosis H37Rv
ccagggcaucagcagagccccg

SEQ ID NO: 1369087 - RNA, 22 nt, Mycobacterium tuberculosis H37Rv
ccaggcuaauagcucgccggcg

SEQ ID NO: 1369088 - RNA, 20 nt, Mycobacterium tuberculosis H37Rv
ccaggcuaauagcucgccgg

SEQ ID NO: 1369089 - RNA, 23 nt, Mycobacterium tuberculosis H37Rv
ccaggcugaaaccuugcggcaga

SEQ ID NO: 1369090 - RNA, 14 nt, Mycobacterium tuberculosis H37Rv
ccaggcugguccgg

SEQ ID NO: 1369091 - RNA, 15 nt, Mycobacterium tuberculosis H37Rv
ccaggcugguccggg

SEQ ID NO: 1369092 - RNA, 15 nt, Mycobacterium tuberculosis H37Rv
ccaggcugcgcagug

SEQ ID NO: 1369093 - RNA, 21 nt, Mycobacterium tuberculosis H37Rv
ccagguccgccggugccgccg

SEQ ID NO: 1369094 - RNA, 18 nt, Mycobacterium tuberculosis H37Rv
ccagguccaccccgccga

SEQ ID NO: 1369095 - RNA, 14 nt, Mycobacterium tuberculosis H37Rv
ccaggucaugccgu

SEQ ID NO: 1369096 - RNA, 17 nt, Mycobacterium tuberculosis H37Rv
ccagguccaccccgccg

SEQ ID NO: 1369097 - RNA, 19 nt, Mycobacterium tuberculosis H37Rv
ccagggcucggcggcccgg

SEQ ID NO: 1369098 - RNA, 15 nt, Mycobacterium tuberculosis H37Rv
ccaggggaccgcggc

SEQ ID NO: 1369099 - RNA, 15 nt, Mycobacterium tuberculosis H37Rv
ccaggggcaccagcg

SEQ ID NO: 1369100 - RNA, 14 nt, Mycobacterium tuberculosis H37Rv
ccaggggcgcagcg

SEQ ID NO: 1369101 - RNA, 16 nt, Mycobacterium tuberculosis H37Rv
ccagggccuuccugag

SEQ ID NO: 1369102 - RNA, 20 nt, Mycobacterium tuberculosis H37Rv
ccagggccucgaccgccagc

SEQ ID NO: 1369103 - RNA, 22 nt, Mycobacterium tuberculosis H37Rv
ccagggcgccgaauuggcccgg

SEQ ID NO: 1369104 - RNA, 18 nt, Mycobacterium tuberculosis H37Rv
ccagggcgguggccaccc

SEQ ID NO: 1369105 - RNA, 14 nt, Mycobacterium tuberculosis H37Rv
ccagggcggcaucc

SEQ ID NO: 1369106 - RNA, 16 nt, Mycobacterium tuberculosis H37Rv
ccagggcggccauccg

SEQ ID NO: 1369107 - RNA, 13 nt, Mycobacterium tuberculosis H37Rv
ccagggccgccgc

SEQ ID NO: 1369108 - RNA, 16 nt, Mycobacterium tuberculosis H37Rv
ccagggccgccgcugc

SEQ ID NO: 1369109 - RNA, 21 nt, Mycobacterium tuberculosis H37Rv
ccagggccgccgcugccgccu

SEQ ID NO: 1369110 - RNA, 15 nt, Mycobacterium tuberculosis H37Rv
ccagggccgccgcug

SEQ ID NO: 1369111 - RNA, 15 nt, Mycobacterium tuberculosis H37Rv
ccagggcccugcugg

SEQ ID NO: 1369112 - RNA, 17 nt, Mycobacterium tuberculosis H37Rv
ccagggcccugcuggcc

SEQ ID NO: 1369113 - RNA, 11 nt, Mycobacterium tuberculosis H37Rv
ccagggccgac

SEQ ID NO: 1369114 - RNA, 14 nt, Mycobacterium tuberculosis H37Rv
ccagggccaucugg

SEQ ID NO: 1369115 - RNA, 15 nt, Mycobacterium tuberculosis H37Rv
ccagggccaccgcgc

SEQ ID NO: 1369116 - RNA, 17 nt, Mycobacterium tuberculosis H37Rv
ccagggccaccgcgccg

SEQ ID NO: 1369117 - RNA, 19 nt, Mycobacterium tuberculosis H37Rv
ccaggccggcggcggcgcu

SEQ ID NO: 1369118 - RNA, 21 nt, Mycobacterium tuberculosis H37Rv
ccaggccggcggcggcgcucg

SEQ ID NO: 1369119 - RNA, 14 nt, Mycobacterium tuberculosis H37Rv
ccaggccggcggcg

SEQ ID NO: 1369120 - RNA, 15 nt, Mycobacterium tuberculosis H37Rv
ccaggccgcuugccc

SEQ ID NO: 1369121 - RNA, 19 nt, Mycobacterium tuberculosis H37Rv
ccaggccgcuugccccgcc

SEQ ID NO: 1369122 - RNA, 21 nt, Mycobacterium tuberculosis H37Rv
ccaggccgcgacaauggugcc

SEQ ID NO: 1369123 - RNA, 20 nt, Mycobacterium tuberculosis H37Rv
ccaggccgcgacaauggugc

SEQ ID NO: 1369124 - RNA, 12 nt, Mycobacterium tuberculosis H37Rv
ccaggccgcgcg

SEQ ID NO: 1369125 - RNA, 15 nt, Mycobacterium tuberculosis H37Rv
ccaggccgcacagca

SEQ ID NO: 1369126 - RNA, 17 nt, Mycobacterium tuberculosis H37Rv
ccaggccgagcucguug

SEQ ID NO: 1369127 - RNA, 16 nt, Mycobacterium tuberculosis H37Rv
ccaggccgagccgccc

SEQ ID NO: 1369128 - RNA, 22 nt, Mycobacterium tuberculosis H37Rv
ccaggccgaucagcguggcgcc

SEQ ID NO: 1369129 - RNA, 13 nt, Mycobacterium tuberculosis H37Rv
ccaggccgagccg

SEQ ID NO: 1369130 - RNA, 19 nt, Mycobacterium tuberculosis H37Rv
ccaggccgagcccggugcu

SEQ ID NO: 1369131 - RNA, 23 nt, Mycobacterium tuberculosis H37Rv
ccaggcccuggccagcccgagcu

SEQ ID NO: 1369132 - RNA, 14 nt, Mycobacterium tuberculosis H37Rv
ccaggcccggcggu

SEQ ID NO: 1369133 - RNA, 18 nt, Mycobacterium tuberculosis H37Rv
ccaggcccauacgugccg

SEQ ID NO: 1369134 - RNA, 15 nt, Mycobacterium tuberculosis H37Rv
ccaggcccaagccgu

SEQ ID NO: 1369135 - RNA, 19 nt, Mycobacterium tuberculosis H37Rv
ccaggcccaagccguggcc

SEQ ID NO: 1369136 - RNA, 13 nt, Mycobacterium tuberculosis H37Rv
ccaggcccagccg

SEQ ID NO: 1369137 - RNA, 14 nt, Mycobacterium tuberculosis H37Rv
ccaggcgaacaggg

SEQ ID NO: 1369138 - RNA, 17 nt, Mycobacterium tuberculosis H37Rv
ccaggcgaacagggcug

SEQ ID NO: 1369139 - RNA, 21 nt, Mycobacterium tuberculosis H37Rv
ccaggcgaucgcccggccccg

SEQ ID NO: 1369140 - RNA, 18 nt, Mycobacterium tuberculosis H37Rv
ccaggcgauaaagccgcu

SEQ ID NO: 1369141 - RNA, 20 nt, Mycobacterium tuberculosis H37Rv
ccaggcgauaaagccgcuga

SEQ ID NO: 1369142 - RNA, 19 nt, Mycobacterium tuberculosis H37Rv
ccaggcgagccgccaccgu

SEQ ID NO: 1369143 - RNA, 23 nt, Mycobacterium tuberculosis H37Rv
ccaggcgcauagggccaccgccg

SEQ ID NO: 1369144 - RNA, 19 nt, Mycobacterium tuberculosis H37Rv
ccaggcgcauagggccacc

SEQ ID NO: 1369145 - RNA, 18 nt, Mycobacterium tuberculosis H37Rv
ccaggcgcgcaccaccgc

SEQ ID NO: 1369146 - RNA, 20 nt, Mycobacterium tuberculosis H37Rv
ccaggcggcaauucgggcau

SEQ ID NO: 1369147 - RNA, 20 nt, Mycobacterium tuberculosis H37Rv
ccaggcgcugcagcauggcu

SEQ ID NO: 1369148 - RNA, 22 nt, Mycobacterium tuberculosis H37Rv
ccaggcgcugcagcauggcucc

SEQ ID NO: 1369149 - RNA, 12 nt, Mycobacterium tuberculosis H37Rv
ccaggcgcgccg

SEQ ID NO: 1369150 - RNA, 20 nt, Mycobacterium tuberculosis H37Rv
ccaggcgcucaucacccagc

SEQ ID NO: 1369151 - RNA, 21 nt, Mycobacterium tuberculosis H37Rv
ccaggcguuggaucccagccc

SEQ ID NO: 1369152 - RNA, 15 nt, Mycobacterium tuberculosis H37Rv
ccaggcguccaucag

SEQ ID NO: 1369153 - RNA, 16 nt, Mycobacterium tuberculosis H37Rv
ccagcuuggcaaccug

SEQ ID NO: 1369154 - RNA, 23 nt, Mycobacterium tuberculosis H37Rv
ccagcuuggagaggcggugcagc

SEQ ID NO: 1369155 - RNA, 19 nt, Mycobacterium tuberculosis H37Rv
ccagcuugcggagccgccg

SEQ ID NO: 1369156 - RNA, 12 nt, Mycobacterium tuberculosis H37Rv
ccaggaacccgu

SEQ ID NO: 1369157 - RNA, 19 nt, Mycobacterium tuberculosis H37Rv
ccaggaagcaggugaaaca

SEQ ID NO: 1369158 - RNA, 22 nt, Mycobacterium tuberculosis H37Rv
ccaggaaugucuccaguagccg

SEQ ID NO: 1369159 - RNA, 16 nt, Mycobacterium tuberculosis H37Rv
ccaggacaacgcaccg

SEQ ID NO: 1369160 - RNA, 13 nt, Mycobacterium tuberculosis H37Rv
ccaggaagucccg

SEQ ID NO: 1369161 - RNA, 16 nt, Mycobacterium tuberculosis H37Rv
ccagcugcagcagacc

SEQ ID NO: 1369162 - RNA, 13 nt, Mycobacterium tuberculosis H37Rv
ccagcugcucguc

SEQ ID NO: 1369163 - RNA, 17 nt, Mycobacterium tuberculosis H37Rv
ccagcuggaacggcagc

SEQ ID NO: 1369164 - RNA, 14 nt, Mycobacterium tuberculosis H37Rv
ccagcugggcagcc

SEQ ID NO: 1369165 - RNA, 18 nt, Mycobacterium tuberculosis H37Rv
ccagcuguacaacgccgu

SEQ ID NO: 1369166 - RNA, 18 nt, Mycobacterium tuberculosis H37Rv
ccagcucgucgucggcgu

SEQ ID NO: 1369167 - RNA, 20 nt, Mycobacterium tuberculosis H37Rv
ccagcucgucgagcugaucc

SEQ ID NO: 1369168 - RNA, 17 nt, Mycobacterium tuberculosis H37Rv
ccagcucggcgggcucg

SEQ ID NO: 1369169 - RNA, 16 nt, Mycobacterium tuberculosis H37Rv
ccagcucggccagcug

SEQ ID NO: 1369170 - RNA, 17 nt, Mycobacterium tuberculosis H37Rv
ccagcucgcgggccgcg

SEQ ID NO: 1369171 - RNA, 19 nt, Mycobacterium tuberculosis H37Rv
ccaggagugcgggcaugcc

SEQ ID NO: 1369172 - RNA, 19 nt, Mycobacterium tuberculosis H37Rv
ccaggaguuugaccaccug

SEQ ID NO: 1369173 - RNA, 17 nt, Mycobacterium tuberculosis H37Rv
ccaggacuggcaccgcc

SEQ ID NO: 1369174 - RNA, 19 nt, Mycobacterium tuberculosis H37Rv
ccaggacuggcaccgccag

SEQ ID NO: 1369175 - RNA, 23 nt, Mycobacterium tuberculosis H37Rv
ccaggacgguugguccgccgucg

SEQ ID NO: 1369176 - RNA, 21 nt, Mycobacterium tuberculosis H37Rv
ccaggacuggcaccgccagcc

SEQ ID NO: 1369177 - RNA, 20 nt, Mycobacterium tuberculosis H37Rv
ccaggacuggcaccgccagc

SEQ ID NO: 1369178 - RNA, 18 nt, Mycobacterium tuberculosis H37Rv
ccaggagcaccucgaagu

SEQ ID NO: 1369179 - RNA, 17 nt, Mycobacterium tuberculosis H37Rv
ccaggagcacggguuga

SEQ ID NO: 1369180 - RNA, 18 nt, Mycobacterium tuberculosis H37Rv
ccaggaccaacuguggug

SEQ ID NO: 1369181 - RNA, 21 nt, Mycobacterium tuberculosis H37Rv
ccaggacgauggcaagggccg

SEQ ID NO: 1369182 - RNA, 12 nt, Mycobacterium tuberculosis H37Rv
ccaggaccgcgc

SEQ ID NO: 1369183 - RNA, 13 nt, Mycobacterium tuberculosis H37Rv
ccaggaccaccgc

SEQ ID NO: 1369184 - RNA, 14 nt, Mycobacterium tuberculosis H37Rv
ccaggcauggccug

SEQ ID NO: 1369185 - RNA, 20 nt, Mycobacterium tuberculosis H37Rv
ccaggcauuggugaguagau

SEQ ID NO: 1369186 - RNA, 19 nt, Mycobacterium tuberculosis H37Rv
ccaggccaagguggccacc

SEQ ID NO: 1369187 - RNA, 23 nt, Mycobacterium tuberculosis H37Rv
ccaggcacguccgaucggcgcgc

SEQ ID NO: 1369188 - RNA, 19 nt, Mycobacterium tuberculosis H37Rv
ccaggcacaacaucgccgc

SEQ ID NO: 1369189 - RNA, 21 nt, Mycobacterium tuberculosis H37Rv
ccaggcacaacaucgccgcag

SEQ ID NO: 1369190 - RNA, 14 nt, Mycobacterium tuberculosis H37Rv
ccaggauugccgcc

SEQ ID NO: 1369191 - RNA, 18 nt, Mycobacterium tuberculosis H37Rv
ccaggcaaccggucagcc

SEQ ID NO: 1369192 - RNA, 15 nt, Mycobacterium tuberculosis H37Rv
ccagcgcccccagca

SEQ ID NO: 1369193 - RNA, 13 nt, Mycobacterium tuberculosis H37Rv
ccagcgccccggc

SEQ ID NO: 1369194 - RNA, 18 nt, Mycobacterium tuberculosis H37Rv
ccagcgccgcacccgcuc

SEQ ID NO: 1369195 - RNA, 12 nt, Mycobacterium tuberculosis H37Rv
ccagcgccgccg

SEQ ID NO: 1369196 - RNA, 15 nt, Mycobacterium tuberculosis H37Rv
ccagcgccgccgcgu

SEQ ID NO: 1369197 - RNA, 19 nt, Mycobacterium tuberculosis H37Rv
ccagcgccgccgcguucac

SEQ ID NO: 1369198 - RNA, 20 nt, Mycobacterium tuberculosis H37Rv
ccagcgccgccggcaccucc

SEQ ID NO: 1369199 - RNA, 16 nt, Mycobacterium tuberculosis H37Rv
ccagcgccgaccuccu

SEQ ID NO: 1369200 - RNA, 12 nt, Mycobacterium tuberculosis H37Rv
ccagcgcccggc

SEQ ID NO: 1369201 - RNA, 18 nt, Mycobacterium tuberculosis H37Rv
ccagcgccugcgcccagc

SEQ ID NO: 1369202 - RNA, 12 nt, Mycobacterium tuberculosis H37Rv
ccagcgccuuga

SEQ ID NO: 1369203 - RNA, 16 nt, Mycobacterium tuberculosis H37Rv
ccagcgccggucaggg

SEQ ID NO: 1369204 - RNA, 23 nt, Mycobacterium tuberculosis H37Rv
ccagcgccggccaagaccgcggc

SEQ ID NO: 1369205 - RNA, 16 nt, Mycobacterium tuberculosis H37Rv
ccagcgccggccaggc

SEQ ID NO: 1369206 - RNA, 12 nt, Mycobacterium tuberculosis H37Rv
ccagcgccgcug

SEQ ID NO: 1369207 - RNA, 14 nt, Mycobacterium tuberculosis H37Rv
ccagcgccgcggcc

SEQ ID NO: 1369208 - RNA, 14 nt, Mycobacterium tuberculosis H37Rv
ccagcgaccagugg

SEQ ID NO: 1369209 - RNA, 14 nt, Mycobacterium tuberculosis H37Rv
ccagcgacucggcc

SEQ ID NO: 1369210 - RNA, 20 nt, Mycobacterium tuberculosis H37Rv
ccagcgagcgcaaaucgauu

SEQ ID NO: 1369211 - RNA, 13 nt, Mycobacterium tuberculosis H37Rv
ccagcgaggagca

SEQ ID NO: 1369212 - RNA, 20 nt, Mycobacterium tuberculosis H37Rv
ccagcgagaucagcaugccc

SEQ ID NO: 1369213 - RNA, 16 nt, Mycobacterium tuberculosis H37Rv
ccagcgagcccagcug

SEQ ID NO: 1369214 - RNA, 22 nt, Mycobacterium tuberculosis H37Rv
ccagcgauggguguugcuggcc

SEQ ID NO: 1369215 - RNA, 15 nt, Mycobacterium tuberculosis H37Rv
ccagcgaggccagcg

SEQ ID NO: 1369216 - RNA, 17 nt, Mycobacterium tuberculosis H37Rv
ccagcgaguugagcaug

SEQ ID NO: 1369217 - RNA, 15 nt, Mycobacterium tuberculosis H37Rv
ccagcgcagcagcgg

SEQ ID NO: 1369218 - RNA, 14 nt, Mycobacterium tuberculosis H37Rv
ccagcgcagugccu

SEQ ID NO: 1369219 - RNA, 17 nt, Mycobacterium tuberculosis H37Rv
ccagcgcaaccuccgcg

SEQ ID NO: 1369220 - RNA, 21 nt, Mycobacterium tuberculosis H37Rv
ccagcgccaccguuugcgcac

SEQ ID NO: 1369221 - RNA, 18 nt, Mycobacterium tuberculosis H37Rv
ccagcgccacuggaagcc

SEQ ID NO: 1369222 - RNA, 18 nt, Mycobacterium tuberculosis H37Rv
ccagcgaccuagcagcgc

SEQ ID NO: 1369223 - RNA, 18 nt, Mycobacterium tuberculosis H37Rv
ccagcgacgaccacacca

SEQ ID NO: 1369224 - RNA, 15 nt, Mycobacterium tuberculosis H37Rv
ccagcgacgccaugu

SEQ ID NO: 1369225 - RNA, 17 nt, Mycobacterium tuberculosis H37Rv
ccagcgacgcggccagc

SEQ ID NO: 1369226 - RNA, 23 nt, Mycobacterium tuberculosis H37Rv
ccagccuggccaucgagggcauc

SEQ ID NO: 1369227 - RNA, 20 nt, Mycobacterium tuberculosis H37Rv
ccagccuuaugcagugacag

SEQ ID NO: 1369228 - RNA, 17 nt, Mycobacterium tuberculosis H37Rv
ccagccuuuccggccgc

SEQ ID NO: 1369229 - RNA, 18 nt, Mycobacterium tuberculosis H37Rv
ccagccuuuccggccgcc

SEQ ID NO: 1369230 - RNA, 14 nt, Mycobacterium tuberculosis H37Rv
ccagcgaacgcugc

SEQ ID NO: 1369231 - RNA, 22 nt, Mycobacterium tuberculosis H37Rv
ccagccgucgucagguggccaa

SEQ ID NO: 1369232 - RNA, 12 nt, Mycobacterium tuberculosis H37Rv
ccagccguggcg

SEQ ID NO: 1369233 - RNA, 23 nt, Mycobacterium tuberculosis H37Rv
ccagccgucggcgcugcgcgcga

SEQ ID NO: 1369234 - RNA, 14 nt, Mycobacterium tuberculosis H37Rv
ccagccggucuugg

SEQ ID NO: 1369235 - RNA, 20 nt, Mycobacterium tuberculosis H37Rv
ccagccgguuggcugccggc

SEQ ID NO: 1369236 - RNA, 14 nt, Mycobacterium tuberculosis H37Rv
ccagccuaccggcu

SEQ ID NO: 1369237 - RNA, 13 nt, Mycobacterium tuberculosis H37Rv
ccagccuggcaac

SEQ ID NO: 1369238 - RNA, 17 nt, Mycobacterium tuberculosis H37Rv
ccagccuggcaaccacg

SEQ ID NO: 1369239 - RNA, 23 nt, Mycobacterium tuberculosis H37Rv
ccagccugcuggccgcggccucg

SEQ ID NO: 1369240 - RNA, 18 nt, Mycobacterium tuberculosis H37Rv
ccagccugaaccgccccg

SEQ ID NO: 1369241 - RNA, 13 nt, Mycobacterium tuberculosis H37Rv
ccacucggacccg

SEQ ID NO: 1369242 - RNA, 16 nt, Mycobacterium tuberculosis H37Rv
ccacuccacgcagccc

SEQ ID NO: 1369243 - RNA, 14 nt, Mycobacterium tuberculosis H37Rv
ccacucccgccccg

SEQ ID NO: 1369244 - RNA, 16 nt, Mycobacterium tuberculosis H37Rv
ccacuccgccaacauc

SEQ ID NO: 1369245 - RNA, 13 nt, Mycobacterium tuberculosis H37Rv
ccacucccgcccc

SEQ ID NO: 1369246 - RNA, 20 nt, Mycobacterium tuberculosis H37Rv
ccacucccagccaacccguc

SEQ ID NO: 1369247 - RNA, 20 nt, Mycobacterium tuberculosis H37Rv
ccacucggucguugccgcgg

SEQ ID NO: 1369248 - RNA, 16 nt, Mycobacterium tuberculosis H37Rv
ccacucgcggauccgg

SEQ ID NO: 1369249 - RNA, 17 nt, Mycobacterium tuberculosis H37Rv
ccacugaacaggccggu

SEQ ID NO: 1369250 - RNA, 15 nt, Mycobacterium tuberculosis H37Rv
ccacugagccacagg

SEQ ID NO: 1369251 - RNA, 21 nt, Mycobacterium tuberculosis H37Rv
ccagccgguccagacccagcu

SEQ ID NO: 1369252 - RNA, 17 nt, Mycobacterium tuberculosis H37Rv
ccagccgguccagaccc

SEQ ID NO: 1369253 - RNA, 24 nt, Mycobacterium tuberculosis H37Rv
ccagccgggagucgucggcauggg

SEQ ID NO: 1369254 - RNA, 14 nt, Mycobacterium tuberculosis H37Rv
ccagccggcgcgcc

SEQ ID NO: 1369255 - RNA, 12 nt, Mycobacterium tuberculosis H37Rv
ccagccggccug

SEQ ID NO: 1369256 - RNA, 14 nt, Mycobacterium tuberculosis H37Rv
ccacugagccacag

SEQ ID NO: 1369257 - RNA, 14 nt, Mycobacterium tuberculosis H37Rv
ccagccggcagcag

SEQ ID NO: 1369258 - RNA, 16 nt, Mycobacterium tuberculosis H37Rv
ccagccggcagcagcg

SEQ ID NO: 1369259 - RNA, 20 nt, Mycobacterium tuberculosis H37Rv
ccagcucacggacgcugggc

SEQ ID NO: 1369260 - RNA, 22 nt, Mycobacterium tuberculosis H37Rv
ccagcucacccggagcacccgg

SEQ ID NO: 1369261 - RNA, 20 nt, Mycobacterium tuberculosis H37Rv
ccagcguuaggucgccggcu

SEQ ID NO: 1369262 - RNA, 21 nt, Mycobacterium tuberculosis H37Rv
ccagcguguggagcucgcggc

SEQ ID NO: 1369263 - RNA, 18 nt, Mycobacterium tuberculosis H37Rv
ccagcguucccgccggcu

SEQ ID NO: 1369264 - RNA, 12 nt, Mycobacterium tuberculosis H37Rv
ccagcuccugac

SEQ ID NO: 1369265 - RNA, 18 nt, Mycobacterium tuberculosis H37Rv
ccagcuccucagccaccg

SEQ ID NO: 1369266 - RNA, 15 nt, Mycobacterium tuberculosis H37Rv
ccagcucgcgcaccc

SEQ ID NO: 1369267 - RNA, 14 nt, Mycobacterium tuberculosis H37Rv
ccagcucccgcggc

SEQ ID NO: 1369268 - RNA, 16 nt, Mycobacterium tuberculosis H37Rv
ccagcuccgccugccg

SEQ ID NO: 1369269 - RNA, 13 nt, Mycobacterium tuberculosis H37Rv
ccagcuccagcgc

SEQ ID NO: 1369270 - RNA, 19 nt, Mycobacterium tuberculosis H37Rv
ccagcguguggagcucgcg

SEQ ID NO: 1369271 - RNA, 23 nt, Mycobacterium tuberculosis H37Rv
ccagcguggugaagucggugccg

SEQ ID NO: 1369272 - RNA, 19 nt, Mycobacterium tuberculosis H37Rv
ccagcgugucuugucgcgc

SEQ ID NO: 1369273 - RNA, 17 nt, Mycobacterium tuberculosis H37Rv
ccagcguggggccgcca

SEQ ID NO: 1369274 - RNA, 16 nt, Mycobacterium tuberculosis H37Rv
ccagcguggggccgcc

SEQ ID NO: 1369275 - RNA, 22 nt, Mycobacterium tuberculosis H37Rv
ccagcgugcccgccaccggcgc

SEQ ID NO: 1369276 - RNA, 20 nt, Mycobacterium tuberculosis H37Rv
ccagcgucgccgccagguug

SEQ ID NO: 1369277 - RNA, 18 nt, Mycobacterium tuberculosis H37Rv
ccagcguaaauagcgccc

SEQ ID NO: 1369278 - RNA, 22 nt, Mycobacterium tuberculosis H37Rv
ccagcguaaauagcgcccugcc

SEQ ID NO: 1369279 - RNA, 22 nt, Mycobacterium tuberculosis H37Rv
ccagcgucccgauguaugacag

SEQ ID NO: 1369280 - RNA, 20 nt, Mycobacterium tuberculosis H37Rv
ccagcgucgcgauugccgcg

SEQ ID NO: 1369281 - RNA, 22 nt, Mycobacterium tuberculosis H37Rv
ccagcgucgcgauugccgcggu

SEQ ID NO: 1369282 - RNA, 15 nt, Mycobacterium tuberculosis H37Rv
ccagcguccaaccca

SEQ ID NO: 1369283 - RNA, 18 nt, Mycobacterium tuberculosis H37Rv
ccagcguccagccgcccu

SEQ ID NO: 1369284 - RNA, 14 nt, Mycobacterium tuberculosis H37Rv
ccagcggucggcga

SEQ ID NO: 1369285 - RNA, 17 nt, Mycobacterium tuberculosis H37Rv
ccagcgguagccgagcu

SEQ ID NO: 1369286 - RNA, 16 nt, Mycobacterium tuberculosis H37Rv
ccagcgguaaugccag

SEQ ID NO: 1369287 - RNA, 19 nt, Mycobacterium tuberculosis H37Rv
ccagcgggcgaugagcgcg

SEQ ID NO: 1369288 - RNA, 19 nt, Mycobacterium tuberculosis H37Rv
ccagcgggcauaacccgca

SEQ ID NO: 1369289 - RNA, 12 nt, Mycobacterium tuberculosis H37Rv
ccagcggcggcc

SEQ ID NO: 1369290 - RNA, 21 nt, Mycobacterium tuberculosis H37Rv
ccagcggcaccgcggccagcg

SEQ ID NO: 1369291 - RNA, 16 nt, Mycobacterium tuberculosis H37Rv
ccagcggcaccgcggc

SEQ ID NO: 1369292 - RNA, 14 nt, Mycobacterium tuberculosis H37Rv
ccagcggcaccgcg

SEQ ID NO: 1369293 - RNA, 21 nt, Mycobacterium tuberculosis H37Rv
ccagcggcaauggccagcacc

SEQ ID NO: 1369294 - RNA, 12 nt, Mycobacterium tuberculosis H37Rv
ccagcggccacc

SEQ ID NO: 1369295 - RNA, 14 nt, Mycobacterium tuberculosis H37Rv
ccagcggccgccgc

SEQ ID NO: 1369296 - RNA, 17 nt, Mycobacterium tuberculosis H37Rv
ccagcggccgccgcggc

SEQ ID NO: 1369297 - RNA, 14 nt, Mycobacterium tuberculosis H37Rv
ccagcggccauccg

SEQ ID NO: 1369298 - RNA, 15 nt, Mycobacterium tuberculosis H37Rv
ccagcggcgccacgu

SEQ ID NO: 1369299 - RNA, 17 nt, Mycobacterium tuberculosis H37Rv
ccagcggcgccacgugg

SEQ ID NO: 1369300 - RNA, 21 nt, Mycobacterium tuberculosis H37Rv
ccagcggcgccacguggucga

SEQ ID NO: 1369301 - RNA, 21 nt, Mycobacterium tuberculosis H37Rv
ccagcggaagcgguugaccca

SEQ ID NO: 1369302 - RNA, 14 nt, Mycobacterium tuberculosis H37Rv
ccagcgcuccagca

SEQ ID NO: 1369303 - RNA, 16 nt, Mycobacterium tuberculosis H37Rv
ccagcgcgucgggaug

SEQ ID NO: 1369304 - RNA, 16 nt, Mycobacterium tuberculosis H37Rv
ccagcgcguuguccuc

SEQ ID NO: 1369305 - RNA, 23 nt, Mycobacterium tuberculosis H37Rv
ccagcgcgacguccaccagccgg

SEQ ID NO: 1369306 - RNA, 22 nt, Mycobacterium tuberculosis H37Rv
ccagcgcgccgaucacgguggg

SEQ ID NO: 1369307 - RNA, 24 nt, Mycobacterium tuberculosis H37Rv
ccagcgcgcggagucaagcagcag

SEQ ID NO: 1369308 - RNA, 13 nt, Mycobacterium tuberculosis H37Rv
ccagcgcgcgccg

SEQ ID NO: 1369309 - RNA, 14 nt, Mycobacterium tuberculosis H37Rv
ccagcgcggccuug

SEQ ID NO: 1369310 - RNA, 17 nt, Mycobacterium tuberculosis H37Rv
ccagcgcggcaacuccg

SEQ ID NO: 1369311 - RNA, 12 nt, Mycobacterium tuberculosis H37Rv
ccaucaaggcca

SEQ ID NO: 1369312 - RNA, 15 nt, Mycobacterium tuberculosis H37Rv
ccaucaacugcauca

SEQ ID NO: 1369313 - RNA, 20 nt, Mycobacterium tuberculosis H37Rv
ccaucaacugcaucaccacu

SEQ ID NO: 1369314 - RNA, 23 nt, Mycobacterium tuberculosis H37Rv
ccaucaacugcaucaccacugga

SEQ ID NO: 1369315 - RNA, 17 nt, Mycobacterium tuberculosis H37Rv
ccaucacaucggccucu

SEQ ID NO: 1369316 - RNA, 15 nt, Mycobacterium tuberculosis H37Rv
ccaucacacccggua

SEQ ID NO: 1369317 - RNA, 23 nt, Mycobacterium tuberculosis H37Rv
ccaucaccacggccgccgacucc

SEQ ID NO: 1369318 - RNA, 20 nt, Mycobacterium tuberculosis H37Rv
ccaucaccacaccggcagcu

SEQ ID NO: 1369319 - RNA, 19 nt, Mycobacterium tuberculosis H37Rv
ccaucaccaccggcaccgc

SEQ ID NO: 1369320 - RNA, 15 nt, Mycobacterium tuberculosis H37Rv
ccaucaccccggccu

SEQ ID NO: 1369321 - RNA, 13 nt, Mycobacterium tuberculosis H37Rv
ccaucaccagcgg

SEQ ID NO: 1369322 - RNA, 13 nt, Mycobacterium tuberculosis H37Rv
ccauauagaucac

SEQ ID NO: 1369323 - RNA, 15 nt, Mycobacterium tuberculosis H37Rv
ccauaucgcccacca

SEQ ID NO: 1369324 - RNA, 11 nt, Mycobacterium tuberculosis H37Rv
ccaucaacaag

SEQ ID NO: 1369325 - RNA, 21 nt, Mycobacterium tuberculosis H37Rv
ccaucaacauugugcucgccg

SEQ ID NO: 1369326 - RNA, 20 nt, Mycobacterium tuberculosis H37Rv
ccauaagcucguagagcacc

SEQ ID NO: 1369327 - RNA, 21 nt, Mycobacterium tuberculosis H37Rv
ccauaagcucguagagcaccg

SEQ ID NO: 1369328 - RNA, 15 nt, Mycobacterium tuberculosis H37Rv
ccaggucuccuuggg

SEQ ID NO: 1369329 - RNA, 22 nt, Mycobacterium tuberculosis H37Rv
ccaggucugggcuuugcagcgu

SEQ ID NO: 1369330 - RNA, 18 nt, Mycobacterium tuberculosis H37Rv
ccaggucuuucgaauccc

SEQ ID NO: 1369331 - RNA, 21 nt, Mycobacterium tuberculosis H37Rv
ccaggucuccaucaaccgcgc

SEQ ID NO: 1369332 - RNA, 22 nt, Mycobacterium tuberculosis H37Rv
ccaggucguaggcgcuaggaac

SEQ ID NO: 1369333 - RNA, 14 nt, Mycobacterium tuberculosis H37Rv
ccaggucggccacc

SEQ ID NO: 1369334 - RNA, 15 nt, Mycobacterium tuberculosis H37Rv
ccaggucggccgccu

SEQ ID NO: 1369335 - RNA, 15 nt, Mycobacterium tuberculosis H37Rv
ccaggucgcauucug

SEQ ID NO: 1369336 - RNA, 14 nt, Mycobacterium tuberculosis H37Rv
ccaguggugcaccg

SEQ ID NO: 1369337 - RNA, 15 nt, Mycobacterium tuberculosis H37Rv
ccaguggcgcgugca

SEQ ID NO: 1369338 - RNA, 12 nt, Mycobacterium tuberculosis H37Rv
ccaguggcagcc

SEQ ID NO: 1369339 - RNA, 20 nt, Mycobacterium tuberculosis H37Rv
ccagugcgguggccagugcg

SEQ ID NO: 1369340 - RNA, 15 nt, Mycobacterium tuberculosis H37Rv
ccagugcugcaccga

SEQ ID NO: 1369341 - RNA, 19 nt, Mycobacterium tuberculosis H37Rv
ccaguguugcggacgugac

SEQ ID NO: 1369342 - RNA, 19 nt, Mycobacterium tuberculosis H37Rv
ccaguucggcggccgccgc

SEQ ID NO: 1369343 - RNA, 16 nt, Mycobacterium tuberculosis H37Rv
ccaguucggugagccg

SEQ ID NO: 1369344 - RNA, 16 nt, Mycobacterium tuberculosis H37Rv
ccaguucgugggucaa

SEQ ID NO: 1369345 - RNA, 19 nt, Mycobacterium tuberculosis H37Rv
ccaucgccaacaccaacca

SEQ ID NO: 1369346 - RNA, 20 nt, Mycobacterium tuberculosis H37Rv
ccaucguguacuggucugga

SEQ ID NO: 1369347 - RNA, 16 nt, Mycobacterium tuberculosis H37Rv
ccaucuccgccgucgc

SEQ ID NO: 1369348 - RNA, 20 nt, Mycobacterium tuberculosis H37Rv
ccaucucggaccacaucugg

SEQ ID NO: 1369349 - RNA, 14 nt, Mycobacterium tuberculosis H37Rv
ccaucuccaacagg

SEQ ID NO: 1369350 - RNA, 13 nt, Mycobacterium tuberculosis H37Rv
ccaucgacgccgc

SEQ ID NO: 1369351 - RNA, 14 nt, Mycobacterium tuberculosis H37Rv
ccaucgaccgcccg

SEQ ID NO: 1369352 - RNA, 13 nt, Mycobacterium tuberculosis H37Rv
ccaucgaccgccc

SEQ ID NO: 1369353 - RNA, 14 nt, Mycobacterium tuberculosis H37Rv
ccaugaucccgcug

SEQ ID NO: 1369354 - RNA, 20 nt, Mycobacterium tuberculosis H37Rv
ccaucugugcgcggacaccu

SEQ ID NO: 1369355 - RNA, 14 nt, Mycobacterium tuberculosis H37Rv
ccaucugcuggcug

SEQ ID NO: 1369356 - RNA, 20 nt, Mycobacterium tuberculosis H37Rv
ccaucuggcugagcagacug

SEQ ID NO: 1369357 - RNA, 20 nt, Mycobacterium tuberculosis H37Rv
ccaucugaucgggcccgucc

SEQ ID NO: 1369358 - RNA, 20 nt, Mycobacterium tuberculosis H37Rv
ccaugaugccuaccgggccc

SEQ ID NO: 1369359 - RNA, 18 nt, Mycobacterium tuberculosis H37Rv
ccaugaugaacagcucac

SEQ ID NO: 1369360 - RNA, 14 nt, Mycobacterium tuberculosis H37Rv
ccaucacggucagc

SEQ ID NO: 1369361 - RNA, 12 nt, Mycobacterium tuberculosis H37Rv
ccaucacgcccu

SEQ ID NO: 1369362 - RNA, 21 nt, Mycobacterium tuberculosis H37Rv
ccaucaccgcgccagccucca

SEQ ID NO: 1369363 - RNA, 21 nt, Mycobacterium tuberculosis H37Rv
ccaucagccgcugcguagugu

SEQ ID NO: 1369364 - RNA, 13 nt, Mycobacterium tuberculosis H37Rv
ccaucagcccggc

SEQ ID NO: 1369365 - RNA, 16 nt, Mycobacterium tuberculosis H37Rv
ccaucagcucgccagg

SEQ ID NO: 1369366 - RNA, 19 nt, Mycobacterium tuberculosis H37Rv
ccaucaucuuggcgcgguc

SEQ ID NO: 1369367 - RNA, 22 nt, Mycobacterium tuberculosis H37Rv
ccaucaugugcgcgaccacccg

SEQ ID NO: 1369368 - RNA, 17 nt, Mycobacterium tuberculosis H37Rv
ccaucauggcggcccgg

SEQ ID NO: 1369369 - RNA, 16 nt, Mycobacterium tuberculosis H37Rv
ccaucccguucagcga

SEQ ID NO: 1369370 - RNA, 14 nt, Mycobacterium tuberculosis H37Rv
ccaucaugguccgg

SEQ ID NO: 1369371 - RNA, 14 nt, Mycobacterium tuberculosis H37Rv
cccacgagagcgcu

SEQ ID NO: 1369372 - RNA, 12 nt, Mycobacterium tuberculosis H37Rv
cccacgauaggu

SEQ ID NO: 1369373 - RNA, 13 nt, Mycobacterium tuberculosis H37Rv
cccacgaauccca

SEQ ID NO: 1369374 - RNA, 16 nt, Mycobacterium tuberculosis H37Rv
cccaccggugccgccc

SEQ ID NO: 1369375 - RNA, 14 nt, Mycobacterium tuberculosis H37Rv
cccaccgucacccc

SEQ ID NO: 1369376 - RNA, 23 nt, Mycobacterium tuberculosis H37Rv
cccaccgucgucguuucgccagc

SEQ ID NO: 1369377 - RNA, 15 nt, Mycobacterium tuberculosis H37Rv
cccaccgucugcugg

SEQ ID NO: 1369378 - RNA, 14 nt, Mycobacterium tuberculosis H37Rv
cccaccgccccggc

SEQ ID NO: 1369379 - RNA, 16 nt, Mycobacterium tuberculosis H37Rv
cccaccggccaccagg

SEQ ID NO: 1369380 - RNA, 18 nt, Mycobacterium tuberculosis H37Rv
cccaccgcugcggcacca

SEQ ID NO: 1369381 - RNA, 21 nt, Mycobacterium tuberculosis H37Rv
cccaccgccguugggccgcgc

SEQ ID NO: 1369382 - RNA, 16 nt, Mycobacterium tuberculosis H37Rv
cccaccgcugcggcac

SEQ ID NO: 1369383 - RNA, 13 nt, Mycobacterium tuberculosis H37Rv
cccacccacgccg

SEQ ID NO: 1369384 - RNA, 23 nt, Mycobacterium tuberculosis H37Rv
cccaccgacaagaauggccgccu

SEQ ID NO: 1369385 - RNA, 23 nt, Mycobacterium tuberculosis H37Rv
cccaccgacauguguggcagccc

SEQ ID NO: 1369386 - RNA, 21 nt, Mycobacterium tuberculosis H37Rv
cccacccgcaccaccggcccc

SEQ ID NO: 1369387 - RNA, 15 nt, Mycobacterium tuberculosis H37Rv
cccacccgcaccgcc

SEQ ID NO: 1369388 - RNA, 16 nt, Mycobacterium tuberculosis H37Rv
cccacccgcaccgccg

SEQ ID NO: 1369389 - RNA, 21 nt, Mycobacterium tuberculosis H37Rv
cccacccccgguucaccuccc

SEQ ID NO: 1369390 - RNA, 18 nt, Mycobacterium tuberculosis H37Rv
cccacccgcaccgccggc

SEQ ID NO: 1369391 - RNA, 16 nt, Mycobacterium tuberculosis H37Rv
cccacccgcggcgccg

SEQ ID NO: 1369392 - RNA, 22 nt, Mycobacterium tuberculosis H37Rv
cccacaucagccgcaccagugg

SEQ ID NO: 1369393 - RNA, 13 nt, Mycobacterium tuberculosis H37Rv
cccaccaccaccg

SEQ ID NO: 1369394 - RNA, 14 nt, Mycobacterium tuberculosis H37Rv
cccaccaccaccgc

SEQ ID NO: 1369395 - RNA, 15 nt, Mycobacterium tuberculosis H37Rv
cccaccaccgacagc

SEQ ID NO: 1369396 - RNA, 15 nt, Mycobacterium tuberculosis H37Rv
cccacaccuuggcgg

SEQ ID NO: 1369397 - RNA, 12 nt, Mycobacterium tuberculosis H37Rv
cccacaccagcg

SEQ ID NO: 1369398 - RNA, 13 nt, Mycobacterium tuberculosis H37Rv
cccacacccagcg

SEQ ID NO: 1369399 - RNA, 14 nt, Mycobacterium tuberculosis H37Rv
cccacacacccgac

SEQ ID NO: 1369400 - RNA, 23 nt, Mycobacterium tuberculosis H37Rv
cccacacgcccucgacgccgcgc

SEQ ID NO: 1369401 - RNA, 20 nt, Mycobacterium tuberculosis H37Rv
cccacagucgccggccggcc

SEQ ID NO: 1369402 - RNA, 19 nt, Mycobacterium tuberculosis H37Rv
cccacaucagccgcaccag

SEQ ID NO: 1369403 - RNA, 14 nt, Mycobacterium tuberculosis H37Rv
cccacagcgugcgg

SEQ ID NO: 1369404 - RNA, 24 nt, Mycobacterium tuberculosis H37Rv
cccagaccgccgacgccguugccc

SEQ ID NO: 1369405 - RNA, 13 nt, Mycobacterium tuberculosis H37Rv
cccagagcugguc

SEQ ID NO: 1369406 - RNA, 23 nt, Mycobacterium tuberculosis H37Rv
cccagauaucguacuggcuauaa

SEQ ID NO: 1369407 - RNA, 19 nt, Mycobacterium tuberculosis H37Rv
cccagaugcagcgguccag

SEQ ID NO: 1369408 - RNA, 16 nt, Mycobacterium tuberculosis H37Rv
cccagauccgcagcgu

SEQ ID NO: 1369409 - RNA, 14 nt, Mycobacterium tuberculosis H37Rv
cccacugggccggu

SEQ ID NO: 1369410 - RNA, 12 nt, Mycobacterium tuberculosis H37Rv
cccacuggaggu

SEQ ID NO: 1369411 - RNA, 15 nt, Mycobacterium tuberculosis H37Rv
cccacugccacuccu

SEQ ID NO: 1369412 - RNA, 22 nt, Mycobacterium tuberculosis H37Rv
cccacugccgugccgguguguc

SEQ ID NO: 1369413 - RNA, 23 nt, Mycobacterium tuberculosis H37Rv
cccacugccgugccggugugucc

SEQ ID NO: 1369414 - RNA, 18 nt, Mycobacterium tuberculosis H37Rv
cccacuggaccaccgccg

SEQ ID NO: 1369415 - RNA, 22 nt, Mycobacterium tuberculosis H37Rv
cccacuggaccaccgccgaagc

SEQ ID NO: 1369416 - RNA, 15 nt, Mycobacterium tuberculosis H37Rv
cccacuugccgggca

SEQ ID NO: 1369417 - RNA, 18 nt, Mycobacterium tuberculosis H37Rv
cccacucccgccccgcuc

SEQ ID NO: 1369418 - RNA, 23 nt, Mycobacterium tuberculosis H37Rv
cccacugaccgaacgcaacagcc

SEQ ID NO: 1369419 - RNA, 13 nt, Mycobacterium tuberculosis H37Rv
cccacuccgccga

SEQ ID NO: 1369420 - RNA, 13 nt, Mycobacterium tuberculosis H37Rv
cccacucccgccc

SEQ ID NO: 1369421 - RNA, 16 nt, Mycobacterium tuberculosis H37Rv
cccacguuggccccgc

SEQ ID NO: 1369422 - RNA, 16 nt, Mycobacterium tuberculosis H37Rv
cccacgugcugccuuu

SEQ ID NO: 1369423 - RNA, 16 nt, Mycobacterium tuberculosis H37Rv
cccacguugcugaugc

SEQ ID NO: 1369424 - RNA, 14 nt, Mycobacterium tuberculosis H37Rv
cccacgucgagcag

SEQ ID NO: 1369425 - RNA, 14 nt, Mycobacterium tuberculosis H37Rv
cccacgugcugccu

SEQ ID NO: 1369426 - RNA, 23 nt, Mycobacterium tuberculosis H37Rv
cccacguugaugaugccggcguu

SEQ ID NO: 1369427 - RNA, 16 nt, Mycobacterium tuberculosis H37Rv
cccacguggggccggg

SEQ ID NO: 1369428 - RNA, 20 nt, Mycobacterium tuberculosis H37Rv
cccacggcgaccacgccgcc

SEQ ID NO: 1369429 - RNA, 18 nt, Mycobacterium tuberculosis H37Rv
cccacggcgaccacgccg

SEQ ID NO: 1369430 - RNA, 22 nt, Mycobacterium tuberculosis H37Rv
cccacggccggccgcugccacu

SEQ ID NO: 1369431 - RNA, 15 nt, Mycobacterium tuberculosis H37Rv
cccacggcgaccacg

SEQ ID NO: 1369432 - RNA, 17 nt, Mycobacterium tuberculosis H37Rv
cccacggcgaccacgcc

SEQ ID NO: 1369433 - RNA, 17 nt, Mycobacterium tuberculosis H37Rv
cccacggcgggcgagcc

SEQ ID NO: 1369434 - RNA, 19 nt, Mycobacterium tuberculosis H37Rv
cccacggcggguuccacac

SEQ ID NO: 1369435 - RNA, 15 nt, Mycobacterium tuberculosis H37Rv
cccacgggccggccg

SEQ ID NO: 1369436 - RNA, 19 nt, Mycobacterium tuberculosis H37Rv
cccacgggccggccgagcg

SEQ ID NO: 1369437 - RNA, 22 nt, Mycobacterium tuberculosis H37Rv
cccacggugucccgcgaggcaa

SEQ ID NO: 1369438 - RNA, 15 nt, Mycobacterium tuberculosis H37Rv
cccacggcagcgccg

SEQ ID NO: 1369439 - RNA, 16 nt, Mycobacterium tuberculosis H37Rv
cccacggagggcagga

SEQ ID NO: 1369440 - RNA, 15 nt, Mycobacterium tuberculosis H37Rv
cccacggcaccacca

SEQ ID NO: 1369441 - RNA, 22 nt, Mycobacterium tuberculosis H37Rv
cccacgcacagcaacgcccaac

SEQ ID NO: 1369442 - RNA, 23 nt, Mycobacterium tuberculosis H37Rv
cccaacagcccaccggugccgcc

SEQ ID NO: 1369443 - RNA, 21 nt, Mycobacterium tuberculosis H37Rv
cccaaaaugccuuggcagccc

SEQ ID NO: 1369444 - RNA, 22 nt, Mycobacterium tuberculosis H37Rv
cccaaaggcuguaacacccggc

SEQ ID NO: 1369445 - RNA, 18 nt, Mycobacterium tuberculosis H37Rv
cccaauucgacugcaacu

SEQ ID NO: 1369446 - RNA, 21 nt, Mycobacterium tuberculosis H37Rv
cccaauucacgacgccgagca

SEQ ID NO: 1369447 - RNA, 23 nt, Mycobacterium tuberculosis H37Rv
cccaauucagauagucgccgccg

SEQ ID NO: 1369448 - RNA, 22 nt, Mycobacterium tuberculosis H37Rv
cccaauuucgugccgaaauggg

SEQ ID NO: 1369449 - RNA, 17 nt, Mycobacterium tuberculosis H37Rv
cccacaaccgcaccagg

SEQ ID NO: 1369450 - RNA, 15 nt, Mycobacterium tuberculosis H37Rv
cccacaaucagcccg

SEQ ID NO: 1369451 - RNA, 15 nt, Mycobacterium tuberculosis H37Rv
cccaauguccaggcg

SEQ ID NO: 1369452 - RNA, 13 nt, Mycobacterium tuberculosis H37Rv
cccaaugcgggcu

SEQ ID NO: 1369453 - RNA, 18 nt, Mycobacterium tuberculosis H37Rv
cccaaucgucggccagca

SEQ ID NO: 1369454 - RNA, 21 nt, Mycobacterium tuberculosis H37Rv
cccaaguccagcagcgacgcu

SEQ ID NO: 1369455 - RNA, 19 nt, Mycobacterium tuberculosis H37Rv
cccaacccuaaaccagcca

SEQ ID NO: 1369456 - RNA, 16 nt, Mycobacterium tuberculosis H37Rv
cccaaccccgccggcc

SEQ ID NO: 1369457 - RNA, 15 nt, Mycobacterium tuberculosis H37Rv
cccaacaccgccaga

SEQ ID NO: 1369458 - RNA, 17 nt, Mycobacterium tuberculosis H37Rv
cccaaucagugcagcgu

SEQ ID NO: 1369459 - RNA, 15 nt, Mycobacterium tuberculosis H37Rv
cccaaucgaccgccc

SEQ ID NO: 1369460 - RNA, 22 nt, Mycobacterium tuberculosis H37Rv
ccauugucgaucaccugcagca

SEQ ID NO: 1369461 - RNA, 15 nt, Mycobacterium tuberculosis H37Rv
ccauugugggacgcg

SEQ ID NO: 1369462 - RNA, 14 nt, Mycobacterium tuberculosis H37Rv
ccauuggcgccgcc

SEQ ID NO: 1369463 - RNA, 15 nt, Mycobacterium tuberculosis H37Rv
ccauuggcgccgccg

SEQ ID NO: 1369464 - RNA, 14 nt, Mycobacterium tuberculosis H37Rv
ccauuggcgccguc

SEQ ID NO: 1369465 - RNA, 19 nt, Mycobacterium tuberculosis H37Rv
ccauuggccaagucagccc

SEQ ID NO: 1369466 - RNA, 22 nt, Mycobacterium tuberculosis H37Rv
ccauuggaccgagacuugcugg

SEQ ID NO: 1369467 - RNA, 21 nt, Mycobacterium tuberculosis H37Rv
ccauuccaucgcgcaccgcau

SEQ ID NO: 1369468 - RNA, 17 nt, Mycobacterium tuberculosis H37Rv
ccauucccaacacagcc

SEQ ID NO: 1369469 - RNA, 16 nt, Mycobacterium tuberculosis H37Rv
ccauucuuggugaucg

SEQ ID NO: 1369470 - RNA, 19 nt, Mycobacterium tuberculosis H37Rv
ccaugcuaggaccaccagc

SEQ ID NO: 1369471 - RNA, 14 nt, Mycobacterium tuberculosis H37Rv
ccaugcuaggacca

SEQ ID NO: 1369472 - RNA, 19 nt, Mycobacterium tuberculosis H37Rv
ccaugcugcccuuguugaa

SEQ ID NO: 1369473 - RNA, 22 nt, Mycobacterium tuberculosis H37Rv
ccaugcuaggaccaccagcgcu

SEQ ID NO: 1369474 - RNA, 23 nt, Mycobacterium tuberculosis H37Rv
ccaugcuaggaccaccagcgcuc

SEQ ID NO: 1369475 - RNA, 20 nt, Mycobacterium tuberculosis H37Rv
ccaugcgguuagcagccgcu

SEQ ID NO: 1369476 - RNA, 21 nt, Mycobacterium tuberculosis H37Rv
ccaugcggguaaaccaggugg

SEQ ID NO: 1369477 - RNA, 18 nt, Mycobacterium tuberculosis H37Rv
ccaugcggcaggugccca

SEQ ID NO: 1369478 - RNA, 16 nt, Mycobacterium tuberculosis H37Rv
ccaugcgcaccagucc

SEQ ID NO: 1369479 - RNA, 18 nt, Mycobacterium tuberculosis H37Rv
ccaugcgcaccaguccag

SEQ ID NO: 1369480 - RNA, 18 nt, Mycobacterium tuberculosis H37Rv
ccaugcgccaacccggcc

SEQ ID NO: 1369481 - RNA, 12 nt, Mycobacterium tuberculosis H37Rv
ccauucaccgcg

SEQ ID NO: 1369482 - RNA, 12 nt, Mycobacterium tuberculosis H37Rv
cccgacacccgu

SEQ ID NO: 1369483 - RNA, 13 nt, Mycobacterium tuberculosis H37Rv
cccgacggcgccc

SEQ ID NO: 1369484 - RNA, 19 nt, Mycobacterium tuberculosis H37Rv
cccgacaccacgucccgga

SEQ ID NO: 1369485 - RNA, 18 nt, Mycobacterium tuberculosis H37Rv
cccgacgugaagccaagc

SEQ ID NO: 1369486 - RNA, 19 nt, Mycobacterium tuberculosis H37Rv
cccgacguugccgaagccg

SEQ ID NO: 1369487 - RNA, 22 nt, Mycobacterium tuberculosis H37Rv
cccgacgucaggcagcuccgcc

SEQ ID NO: 1369488 - RNA, 18 nt, Mycobacterium tuberculosis H37Rv
cccgacucggccgugacc

SEQ ID NO: 1369489 - RNA, 18 nt, Mycobacterium tuberculosis H37Rv
cccgaaguagaagcccag

SEQ ID NO: 1369490 - RNA, 14 nt, Mycobacterium tuberculosis H37Rv
cccgaagccgaccg

SEQ ID NO: 1369491 - RNA, 21 nt, Mycobacterium tuberculosis H37Rv
cccgaagccggugccggcguu

SEQ ID NO: 1369492 - RNA, 18 nt, Mycobacterium tuberculosis H37Rv
cccgaagaucuccuccug

SEQ ID NO: 1369493 - RNA, 20 nt, Mycobacterium tuberculosis H37Rv
cccgaagaucuccuccugug

SEQ ID NO: 1369494 - RNA, 14 nt, Mycobacterium tuberculosis H37Rv
cccgaaccccgacc

SEQ ID NO: 1369495 - RNA, 16 nt, Mycobacterium tuberculosis H37Rv
cccgaaccaccgcguu

SEQ ID NO: 1369496 - RNA, 14 nt, Mycobacterium tuberculosis H37Rv
cccgaaccgcgcug

SEQ ID NO: 1369497 - RNA, 20 nt, Mycobacterium tuberculosis H37Rv
cccgauagcgaccgcggccc

SEQ ID NO: 1369498 - RNA, 13 nt, Mycobacterium tuberculosis H37Rv
cccgauccagugg

SEQ ID NO: 1369499 - RNA, 16 nt, Mycobacterium tuberculosis H37Rv
cccgaucagcaccgac

SEQ ID NO: 1369500 - RNA, 19 nt, Mycobacterium tuberculosis H37Rv
cccgacuucaagacagccg

SEQ ID NO: 1369501 - RNA, 17 nt, Mycobacterium tuberculosis H37Rv
cccgacuggucacugcc

SEQ ID NO: 1369502 - RNA, 21 nt, Mycobacterium tuberculosis H37Rv
cccgacggacuccggccggcc

SEQ ID NO: 1369503 - RNA, 22 nt, Mycobacterium tuberculosis H37Rv
cccgagaccaacgcgcaggccg

SEQ ID NO: 1369504 - RNA, 14 nt, Mycobacterium tuberculosis H37Rv
ccccggggguccac

SEQ ID NO: 1369505 - RNA, 19 nt, Mycobacterium tuberculosis H37Rv
ccccgggcggugaggcagc

SEQ ID NO: 1369506 - RNA, 13 nt, Mycobacterium tuberculosis H37Rv
ccccgggcgguga

SEQ ID NO: 1369507 - RNA, 16 nt, Mycobacterium tuberculosis H37Rv
ccccuaaaccggcagg

SEQ ID NO: 1369508 - RNA, 21 nt, Mycobacterium tuberculosis H37Rv
ccccguugccgccguugccgc

SEQ ID NO: 1369509 - RNA, 16 nt, Mycobacterium tuberculosis H37Rv
ccccguugccgcccgu

SEQ ID NO: 1369510 - RNA, 21 nt, Mycobacterium tuberculosis H37Rv
ccccguucuggaaccccgagc

SEQ ID NO: 1369511 - RNA, 13 nt, Mycobacterium tuberculosis H37Rv
ccccuggccgccg

SEQ ID NO: 1369512 - RNA, 18 nt, Mycobacterium tuberculosis H37Rv
ccccugguacaccaggcc

SEQ ID NO: 1369513 - RNA, 13 nt, Mycobacterium tuberculosis H37Rv
ccccuggccaacc

SEQ ID NO: 1369514 - RNA, 14 nt, Mycobacterium tuberculosis H37Rv
cccgaaccaccacc

SEQ ID NO: 1369515 - RNA, 18 nt, Mycobacterium tuberculosis H37Rv
cccgaacauccgccgccc

SEQ ID NO: 1369516 - RNA, 19 nt, Mycobacterium tuberculosis H37Rv
cccgaacauugcgcccagc

SEQ ID NO: 1369517 - RNA, 22 nt, Mycobacterium tuberculosis H37Rv
ccccuggccgccggcgccgcca

SEQ ID NO: 1369518 - RNA, 13 nt, Mycobacterium tuberculosis H37Rv
ccccuggccagca

SEQ ID NO: 1369519 - RNA, 12 nt, Mycobacterium tuberculosis H37Rv
ccccuggccgcc

SEQ ID NO: 1369520 - RNA, 13 nt, Mycobacterium tuberculosis H37Rv
cccgaugaccgcc

SEQ ID NO: 1369521 - RNA, 23 nt, Mycobacterium tuberculosis H37Rv
cccgaucgucgagccgaucgccc

SEQ ID NO: 1369522 - RNA, 19 nt, Mycobacterium tuberculosis H37Rv
cccgaugacccacugcagg

SEQ ID NO: 1369523 - RNA, 13 nt, Mycobacterium tuberculosis H37Rv
cccgaucggcaac

SEQ ID NO: 1369524 - RNA, 23 nt, Mycobacterium tuberculosis H37Rv
cccgaugaggacauccggcgccg

SEQ ID NO: 1369525 - RNA, 23 nt, Mycobacterium tuberculosis H37Rv
cccgaugccgugccgggccagau

SEQ ID NO: 1369526 - RNA, 23 nt, Mycobacterium tuberculosis H37Rv
cccgauguuacggccccacagcg

SEQ ID NO: 1369527 - RNA, 22 nt, Mycobacterium tuberculosis H37Rv
cccgaugguacccgcgccgcgc

SEQ ID NO: 1369528 - RNA, 21 nt, Mycobacterium tuberculosis H37Rv
cccgaugguggugccgaccug

SEQ ID NO: 1369529 - RNA, 15 nt, Mycobacterium tuberculosis H37Rv
cccgcaucgcaccag

SEQ ID NO: 1369530 - RNA, 18 nt, Mycobacterium tuberculosis H37Rv
cccgcauccacgucgccc

SEQ ID NO: 1369531 - RNA, 12 nt, Mycobacterium tuberculosis H37Rv
cccgcccaccuc

SEQ ID NO: 1369532 - RNA, 18 nt, Mycobacterium tuberculosis H37Rv
cccgcaugcccuggacca

SEQ ID NO: 1369533 - RNA, 22 nt, Mycobacterium tuberculosis H37Rv
cccgcaugcccuggaccagcgg

SEQ ID NO: 1369534 - RNA, 15 nt, Mycobacterium tuberculosis H37Rv
cccgcaucgcccaag

SEQ ID NO: 1369535 - RNA, 13 nt, Mycobacterium tuberculosis H37Rv
cccgcaggacgcu

SEQ ID NO: 1369536 - RNA, 15 nt, Mycobacterium tuberculosis H37Rv
cccgcaggacgcugc

SEQ ID NO: 1369537 - RNA, 14 nt, Mycobacterium tuberculosis H37Rv
cccgcagcucgacc

SEQ ID NO: 1369538 - RNA, 21 nt, Mycobacterium tuberculosis H37Rv
cccgauuggccaaccccaugg

SEQ ID NO: 1369539 - RNA, 18 nt, Mycobacterium tuberculosis H37Rv
cccgcaggucgcaccaca

SEQ ID NO: 1369540 - RNA, 12 nt, Mycobacterium tuberculosis H37Rv
cccgcccgagcc

SEQ ID NO: 1369541 - RNA, 14 nt, Mycobacterium tuberculosis H37Rv
cccgccccgcgccu

SEQ ID NO: 1369542 - RNA, 14 nt, Mycobacterium tuberculosis H37Rv
cccgcccggccagc

SEQ ID NO: 1369543 - RNA, 21 nt, Mycobacterium tuberculosis H37Rv
cccgcccguagacccacaguc

SEQ ID NO: 1369544 - RNA, 15 nt, Mycobacterium tuberculosis H37Rv
cccgcccugaccgcc

SEQ ID NO: 1369545 - RNA, 17 nt, Mycobacterium tuberculosis H37Rv
cccgcccugaccgcccg

SEQ ID NO: 1369546 - RNA, 21 nt, Mycobacterium tuberculosis H37Rv
cccgccgcgcauccgcagccc

SEQ ID NO: 1369547 - RNA, 16 nt, Mycobacterium tuberculosis H37Rv
cccgcccuugccgcca

SEQ ID NO: 1369548 - RNA, 21 nt, Mycobacterium tuberculosis H37Rv
cccgcccuugccgccagcccc

SEQ ID NO: 1369549 - RNA, 21 nt, Mycobacterium tuberculosis H37Rv
cccgccuaaagcgugucgccc

SEQ ID NO: 1369550 - RNA, 14 nt, Mycobacterium tuberculosis H37Rv
cccgccuuggccac

SEQ ID NO: 1369551 - RNA, 20 nt, Mycobacterium tuberculosis H37Rv
cccgccguuuccgccgccgc

SEQ ID NO: 1369552 - RNA, 22 nt, Mycobacterium tuberculosis H37Rv
cccgccguuuccgccgccgcca

SEQ ID NO: 1369553 - RNA, 16 nt, Mycobacterium tuberculosis H37Rv
cccgccguugccgccg

SEQ ID NO: 1369554 - RNA, 18 nt, Mycobacterium tuberculosis H37Rv
cccgccguugccgccguc

SEQ ID NO: 1369555 - RNA, 18 nt, Mycobacterium tuberculosis H37Rv
cccgccguuuccgccgcc

SEQ ID NO: 1369556 - RNA, 16 nt, Mycobacterium tuberculosis H37Rv
cccgccggacccgccc

SEQ ID NO: 1369557 - RNA, 17 nt, Mycobacterium tuberculosis H37Rv
cccgccggacccgcccu

SEQ ID NO: 1369558 - RNA, 13 nt, Mycobacterium tuberculosis H37Rv
cccgccggcagug

SEQ ID NO: 1369559 - RNA, 14 nt, Mycobacterium tuberculosis H37Rv
cccgccggccccgc

SEQ ID NO: 1369560 - RNA, 15 nt, Mycobacterium tuberculosis H37Rv
cccgccggccccgcc

SEQ ID NO: 1369561 - RNA, 19 nt, Mycobacterium tuberculosis H37Rv
cccgccggccccgccggcc

SEQ ID NO: 1369562 - RNA, 14 nt, Mycobacterium tuberculosis H37Rv
cccgccggaacugc

SEQ ID NO: 1369563 - RNA, 24 nt, Mycobacterium tuberculosis H37Rv
cccgccggauccgccagaccgcgg

SEQ ID NO: 1369564 - RNA, 13 nt, Mycobacterium tuberculosis H37Rv
cccgccgcgugcu

SEQ ID NO: 1369565 - RNA, 21 nt, Mycobacterium tuberculosis H37Rv
ccccacuugccgggcaaucgc

SEQ ID NO: 1369566 - RNA, 11 nt, Mycobacterium tuberculosis H37Rv
ccccacugccg

SEQ ID NO: 1369567 - RNA, 16 nt, Mycobacterium tuberculosis H37Rv
ccccaugcgguuugga

SEQ ID NO: 1369568 - RNA, 13 nt, Mycobacterium tuberculosis H37Rv
ccccaggugggca

SEQ ID NO: 1369569 - RNA, 17 nt, Mycobacterium tuberculosis H37Rv
ccccagggggcgugccg

SEQ ID NO: 1369570 - RNA, 19 nt, Mycobacterium tuberculosis H37Rv
ccccagcugcggucgcggc

SEQ ID NO: 1369571 - RNA, 20 nt, Mycobacterium tuberculosis H37Rv
ccccagggagugccgcacga

SEQ ID NO: 1369572 - RNA, 16 nt, Mycobacterium tuberculosis H37Rv
ccccaaucagugcagc

SEQ ID NO: 1369573 - RNA, 22 nt, Mycobacterium tuberculosis H37Rv
ccccaaucgaccgcccgccaac

SEQ ID NO: 1369574 - RNA, 21 nt, Mycobacterium tuberculosis H37Rv
cccauuggguaaccagcgcca

SEQ ID NO: 1369575 - RNA, 12 nt, Mycobacterium tuberculosis H37Rv
cccauugccgcc

SEQ ID NO: 1369576 - RNA, 13 nt, Mycobacterium tuberculosis H37Rv
cccauugccgccg

SEQ ID NO: 1369577 - RNA, 16 nt, Mycobacterium tuberculosis H37Rv
cccauugccgccgucg

SEQ ID NO: 1369578 - RNA, 22 nt, Mycobacterium tuberculosis H37Rv
cccauugucgaucaccugcagc

SEQ ID NO: 1369579 - RNA, 21 nt, Mycobacterium tuberculosis H37Rv
ccccaacugcgaaacgccacc

SEQ ID NO: 1369580 - RNA, 18 nt, Mycobacterium tuberculosis H37Rv
cccauucucggccggcgg

SEQ ID NO: 1369581 - RNA, 16 nt, Mycobacterium tuberculosis H37Rv
cccauucaucuugcgg

SEQ ID NO: 1369582 - RNA, 14 nt, Mycobacterium tuberculosis H37Rv
cccagccagcugga

SEQ ID NO: 1369583 - RNA, 21 nt, Mycobacterium tuberculosis H37Rv
cccagccagcagcggcgagcc

SEQ ID NO: 1369584 - RNA, 15 nt, Mycobacterium tuberculosis H37Rv
cccagccaacccguc

SEQ ID NO: 1369585 - RNA, 24 nt, Mycobacterium tuberculosis H37Rv
cccagcauggggucagcucgccag

SEQ ID NO: 1369586 - RNA, 14 nt, Mycobacterium tuberculosis H37Rv
ccccgacaccacgu

SEQ ID NO: 1369587 - RNA, 16 nt, Mycobacterium tuberculosis H37Rv
ccccgaccgccaccgc

SEQ ID NO: 1369588 - RNA, 22 nt, Mycobacterium tuberculosis H37Rv
cccccggauuccagcagccugc

SEQ ID NO: 1369589 - RNA, 12 nt, Mycobacterium tuberculosis H37Rv
cccccgcgcgaa

SEQ ID NO: 1369590 - RNA, 16 nt, Mycobacterium tuberculosis H37Rv
cccccaagcucugcgu

SEQ ID NO: 1369591 - RNA, 12 nt, Mycobacterium tuberculosis H37Rv
cccccgccgcgc

SEQ ID NO: 1369592 - RNA, 14 nt, Mycobacterium tuberculosis H37Rv
cccccgccggccgc

SEQ ID NO: 1369593 - RNA, 13 nt, Mycobacterium tuberculosis H37Rv
ccccccccaccca

SEQ ID NO: 1369594 - RNA, 16 nt, Mycobacterium tuberculosis H37Rv
ccccccgagcccgcca

SEQ ID NO: 1369595 - RNA, 13 nt, Mycobacterium tuberculosis H37Rv
cccccccacccac

SEQ ID NO: 1369596 - RNA, 16 nt, Mycobacterium tuberculosis H37Rv
ccccccguugccgccg

SEQ ID NO: 1369597 - RNA, 14 nt, Mycobacterium tuberculosis H37Rv
ccccccacccacca

SEQ ID NO: 1369598 - RNA, 20 nt, Mycobacterium tuberculosis H37Rv
cccccgacuccggcaggccc

SEQ ID NO: 1369599 - RNA, 21 nt, Mycobacterium tuberculosis H37Rv
cccccgacuccggcaggcccg

SEQ ID NO: 1369600 - RNA, 17 nt, Mycobacterium tuberculosis H37Rv
cccccgagcccgccagc

SEQ ID NO: 1369601 - RNA, 22 nt, Mycobacterium tuberculosis H37Rv
cccccgagcccgccagcgccgc

SEQ ID NO: 1369602 - RNA, 19 nt, Mycobacterium tuberculosis H37Rv
ccccaugaugaacagcuca

SEQ ID NO: 1369603 - RNA, 14 nt, Mycobacterium tuberculosis H37Rv
ccccauugcgcccc

SEQ ID NO: 1369604 - RNA, 16 nt, Mycobacterium tuberculosis H37Rv
ccccauugcgccccau

SEQ ID NO: 1369605 - RNA, 15 nt, Mycobacterium tuberculosis H37Rv
cccccaaccgccggc

SEQ ID NO: 1369606 - RNA, 14 nt, Mycobacterium tuberculosis H37Rv
ccccgccggccgcg

SEQ ID NO: 1369607 - RNA, 16 nt, Mycobacterium tuberculosis H37Rv
ccccgccggccgcgcc

SEQ ID NO: 1369608 - RNA, 13 nt, Mycobacterium tuberculosis H37Rv
ccccgccgagcgg

SEQ ID NO: 1369609 - RNA, 14 nt, Mycobacterium tuberculosis H37Rv
ccccgccagcgccg

SEQ ID NO: 1369610 - RNA, 14 nt, Mycobacterium tuberculosis H37Rv
ccccgcccuugccg

SEQ ID NO: 1369611 - RNA, 15 nt, Mycobacterium tuberculosis H37Rv
ccccgcccggccagc

SEQ ID NO: 1369612 - RNA, 23 nt, Mycobacterium tuberculosis H37Rv
ccccgcaggggguggugucgcgg

SEQ ID NO: 1369613 - RNA, 20 nt, Mycobacterium tuberculosis H37Rv
ccccgcagcucaccucauga

SEQ ID NO: 1369614 - RNA, 13 nt, Mycobacterium tuberculosis H37Rv
ccccgccaacccc

SEQ ID NO: 1369615 - RNA, 21 nt, Mycobacterium tuberculosis H37Rv
ccccgacggcaaugcggggca

SEQ ID NO: 1369616 - RNA, 17 nt, Mycobacterium tuberculosis H37Rv
ccccgacggacuccggc

SEQ ID NO: 1369617 - RNA, 12 nt, Mycobacterium tuberculosis H37Rv
ccccgaccgcgc

SEQ ID NO: 1369618 - RNA, 13 nt, Mycobacterium tuberculosis H37Rv
ccccgcagcgccu

SEQ ID NO: 1369619 - RNA, 22 nt, Mycobacterium tuberculosis H37Rv
ccccgcagccagaucuccccga

SEQ ID NO: 1369620 - RNA, 22 nt, Mycobacterium tuberculosis H37Rv
ccccgcagcaucgccagcagga

SEQ ID NO: 1369621 - RNA, 13 nt, Mycobacterium tuberculosis H37Rv
ccccgacuccggc

SEQ ID NO: 1369622 - RNA, 15 nt, Mycobacterium tuberculosis H37Rv
ccccggcaccgccgg

SEQ ID NO: 1369623 - RNA, 14 nt, Mycobacterium tuberculosis H37Rv
ccccggcagcgccc

SEQ ID NO: 1369624 - RNA, 16 nt, Mycobacterium tuberculosis H37Rv
ccccggacggcaggcu

SEQ ID NO: 1369625 - RNA, 17 nt, Mycobacterium tuberculosis H37Rv
ccccggaacgaccccac

SEQ ID NO: 1369626 - RNA, 22 nt, Mycobacterium tuberculosis H37Rv
ccccggcauugcccgagcccag

SEQ ID NO: 1369627 - RNA, 12 nt, Mycobacterium tuberculosis H37Rv
ccccggccacca

SEQ ID NO: 1369628 - RNA, 12 nt, Mycobacterium tuberculosis H37Rv
ccccggccagga

SEQ ID NO: 1369629 - RNA, 19 nt, Mycobacterium tuberculosis H37Rv
ccccggcccgaucggcaac

SEQ ID NO: 1369630 - RNA, 12 nt, Mycobacterium tuberculosis H37Rv
ccccggccggcu

SEQ ID NO: 1369631 - RNA, 14 nt, Mycobacterium tuberculosis H37Rv
ccccggcugccagc

SEQ ID NO: 1369632 - RNA, 18 nt, Mycobacterium tuberculosis H37Rv
ccccggcugccagcgccg

SEQ ID NO: 1369633 - RNA, 18 nt, Mycobacterium tuberculosis H37Rv
ccccggcgacggcguagc

SEQ ID NO: 1369634 - RNA, 18 nt, Mycobacterium tuberculosis H37Rv
cccggcgcuggugcgcca

SEQ ID NO: 1369635 - RNA, 22 nt, Mycobacterium tuberculosis H37Rv
cccggcgcuggugcgccacgcc

SEQ ID NO: 1369636 - RNA, 14 nt, Mycobacterium tuberculosis H37Rv
cccggcgcuccaac

SEQ ID NO: 1369637 - RNA, 22 nt, Mycobacterium tuberculosis H37Rv
cccggcgcggccgcaagccgcg

SEQ ID NO: 1369638 - RNA, 20 nt, Mycobacterium tuberculosis H37Rv
cccggcgcgguuugcucguu

SEQ ID NO: 1369639 - RNA, 12 nt, Mycobacterium tuberculosis H37Rv
cccggcggcagc

SEQ ID NO: 1369640 - RNA, 20 nt, Mycobacterium tuberculosis H37Rv
cccggcgggcggugggcagc

SEQ ID NO: 1369641 - RNA, 18 nt, Mycobacterium tuberculosis H37Rv
cccggcgugucgccgcca

SEQ ID NO: 1369642 - RNA, 19 nt, Mycobacterium tuberculosis H37Rv
cccggcguggugagccucg

SEQ ID NO: 1369643 - RNA, 20 nt, Mycobacterium tuberculosis H37Rv
cccggcguggcuucacccaa

SEQ ID NO: 1369644 - RNA, 22 nt, Mycobacterium tuberculosis H37Rv
cccggcguggcuucacccaacc

SEQ ID NO: 1369645 - RNA, 15 nt, Mycobacterium tuberculosis H37Rv
cccggcgucucgcag

SEQ ID NO: 1369646 - RNA, 15 nt, Mycobacterium tuberculosis H37Rv
cccggcgggcccgcc

SEQ ID NO: 1369647 - RNA, 21 nt, Mycobacterium tuberculosis H37Rv
cccggcgguaccagagcagcu

SEQ ID NO: 1369648 - RNA, 18 nt, Mycobacterium tuberculosis H37Rv
cccggggguccaccuugg

SEQ ID NO: 1369649 - RNA, 20 nt, Mycobacterium tuberculosis H37Rv
cccggggcugggggccggca

SEQ ID NO: 1369650 - RNA, 21 nt, Mycobacterium tuberculosis H37Rv
cccggggcugggggccggcag

SEQ ID NO: 1369651 - RNA, 13 nt, Mycobacterium tuberculosis H37Rv
cccggguccugga

SEQ ID NO: 1369652 - RNA, 12 nt, Mycobacterium tuberculosis H37Rv
cccgggucccau

SEQ ID NO: 1369653 - RNA, 18 nt, Mycobacterium tuberculosis H37Rv
cccgggugaaacgauggc

SEQ ID NO: 1369654 - RNA, 13 nt, Mycobacterium tuberculosis H37Rv
cccggucccgccg

SEQ ID NO: 1369655 - RNA, 15 nt, Mycobacterium tuberculosis H37Rv
cccgguccauucguc

SEQ ID NO: 1369656 - RNA, 19 nt, Mycobacterium tuberculosis H37Rv
cccggggacgggucggcag

SEQ ID NO: 1369657 - RNA, 18 nt, Mycobacterium tuberculosis H37Rv
cccgggcgggagucgucg

SEQ ID NO: 1369658 - RNA, 19 nt, Mycobacterium tuberculosis H37Rv
cccgggcggcgccggcgca

SEQ ID NO: 1369659 - RNA, 14 nt, Mycobacterium tuberculosis H37Rv
cccgggcggcgccg

SEQ ID NO: 1369660 - RNA, 21 nt, Mycobacterium tuberculosis H37Rv
cccgggccgccgcgauggccc

SEQ ID NO: 1369661 - RNA, 21 nt, Mycobacterium tuberculosis H37Rv
cccggcguggugagccucggc

SEQ ID NO: 1369662 - RNA, 15 nt, Mycobacterium tuberculosis H37Rv
cccggcguugccgcc

SEQ ID NO: 1369663 - RNA, 16 nt, Mycobacterium tuberculosis H37Rv
cccggcguugccgccg

SEQ ID NO: 1369664 - RNA, 22 nt, Mycobacterium tuberculosis H37Rv
cccggcguuguugaccagcacg

SEQ ID NO: 1369665 - RNA, 14 nt, Mycobacterium tuberculosis H37Rv
cccgggccgccgcg

SEQ ID NO: 1369666 - RNA, 17 nt, Mycobacterium tuberculosis H37Rv
cccgggccucggcgccg

SEQ ID NO: 1369667 - RNA, 15 nt, Mycobacterium tuberculosis H37Rv
cccgggccugaacca

SEQ ID NO: 1369668 - RNA, 22 nt, Mycobacterium tuberculosis H37Rv
cccgggccggucggugagccgu

SEQ ID NO: 1369669 - RNA, 14 nt, Mycobacterium tuberculosis H37Rv
cccguaaaccgaua

SEQ ID NO: 1369670 - RNA, 17 nt, Mycobacterium tuberculosis H37Rv
cccguaagcggaugucc

SEQ ID NO: 1369671 - RNA, 14 nt, Mycobacterium tuberculosis H37Rv
cccguaccagcccg

SEQ ID NO: 1369672 - RNA, 18 nt, Mycobacterium tuberculosis H37Rv
cccguagaccuucgagua

SEQ ID NO: 1369673 - RNA, 14 nt, Mycobacterium tuberculosis H37Rv
cccguagcaccaca

SEQ ID NO: 1369674 - RNA, 19 nt, Mycobacterium tuberculosis H37Rv
cccgguguuccggucgccc

SEQ ID NO: 1369675 - RNA, 12 nt, Mycobacterium tuberculosis H37Rv
cccgguguugag

SEQ ID NO: 1369676 - RNA, 22 nt, Mycobacterium tuberculosis H37Rv
cccggucuuuaauccagcgccg

SEQ ID NO: 1369677 - RNA, 18 nt, Mycobacterium tuberculosis H37Rv
cccgguugggugugcccg

SEQ ID NO: 1369678 - RNA, 13 nt, Mycobacterium tuberculosis H37Rv
cccggucgccgcg

SEQ ID NO: 1369679 - RNA, 21 nt, Mycobacterium tuberculosis H37Rv
cccggucgcacuuggcccccg

SEQ ID NO: 1369680 - RNA, 22 nt, Mycobacterium tuberculosis H37Rv
cccggucgacgggucggcgccg

SEQ ID NO: 1369681 - RNA, 12 nt, Mycobacterium tuberculosis H37Rv
cccggucggcga

SEQ ID NO: 1369682 - RNA, 18 nt, Mycobacterium tuberculosis H37Rv
cccggucgguguggacug

SEQ ID NO: 1369683 - RNA, 14 nt, Mycobacterium tuberculosis H37Rv
cccggucggcggca

SEQ ID NO: 1369684 - RNA, 21 nt, Mycobacterium tuberculosis H37Rv
cccggccguugggccaccggc

SEQ ID NO: 1369685 - RNA, 15 nt, Mycobacterium tuberculosis H37Rv
cccggccgucgcgcg

SEQ ID NO: 1369686 - RNA, 22 nt, Mycobacterium tuberculosis H37Rv
cccggccgcgucacggaccugg

SEQ ID NO: 1369687 - RNA, 14 nt, Mycobacterium tuberculosis H37Rv
cccggccgcgcgca

SEQ ID NO: 1369688 - RNA, 14 nt, Mycobacterium tuberculosis H37Rv
cccggccgcgcggg

SEQ ID NO: 1369689 - RNA, 14 nt, Mycobacterium tuberculosis H37Rv
cccggccgcggccc

SEQ ID NO: 1369690 - RNA, 17 nt, Mycobacterium tuberculosis H37Rv
cccggcgaugcagccgg

SEQ ID NO: 1369691 - RNA, 15 nt, Mycobacterium tuberculosis H37Rv
cccggcgacgacccg

SEQ ID NO: 1369692 - RNA, 16 nt, Mycobacterium tuberculosis H37Rv
cccggccuugccgccg

SEQ ID NO: 1369693 - RNA, 18 nt, Mycobacterium tuberculosis H37Rv
cccggcgcaagcgccgcg

SEQ ID NO: 1369694 - RNA, 12 nt, Mycobacterium tuberculosis H37Rv
cccggcgcgccg

SEQ ID NO: 1369695 - RNA, 12 nt, Mycobacterium tuberculosis H37Rv
cccggcgccgcg

SEQ ID NO: 1369696 - RNA, 23 nt, Mycobacterium tuberculosis H37Rv
cccggccaggaguuugaccaccu

SEQ ID NO: 1369697 - RNA, 22 nt, Mycobacterium tuberculosis H37Rv
cccggcccauugucgaucaccu

SEQ ID NO: 1369698 - RNA, 22 nt, Mycobacterium tuberculosis H37Rv
cccggcccgaucggcaacccgc

SEQ ID NO: 1369699 - RNA, 15 nt, Mycobacterium tuberculosis H37Rv
cccggcccgccaccc

SEQ ID NO: 1369700 - RNA, 16 nt, Mycobacterium tuberculosis H37Rv
cccggcccgccacccc

SEQ ID NO: 1369701 - RNA, 13 nt, Mycobacterium tuberculosis H37Rv
cccggcccggcuc

SEQ ID NO: 1369702 - RNA, 23 nt, Mycobacterium tuberculosis H37Rv
cccggcccguagcguccgcgccc

SEQ ID NO: 1369703 - RNA, 16 nt, Mycobacterium tuberculosis H37Rv
cccggccgcgcacccg

SEQ ID NO: 1369704 - RNA, 23 nt, Mycobacterium tuberculosis H37Rv
cccggccgcgcacccguccgccg

SEQ ID NO: 1369705 - RNA, 11 nt, Mycobacterium tuberculosis H37Rv
cccggccgccg

SEQ ID NO: 1369706 - RNA, 18 nt, Mycobacterium tuberculosis H37Rv
cccggccaggucgacacc

SEQ ID NO: 1369707 - RNA, 14 nt, Mycobacterium tuberculosis H37Rv
cccggccgcacccg

SEQ ID NO: 1369708 - RNA, 12 nt, Mycobacterium tuberculosis H37Rv
cccggccgccac

SEQ ID NO: 1369709 - RNA, 15 nt, Mycobacterium tuberculosis H37Rv
cccggcccgcucagc

SEQ ID NO: 1369710 - RNA, 17 nt, Mycobacterium tuberculosis H37Rv
cccggcccgcucagccg

SEQ ID NO: 1369711 - RNA, 23 nt, Mycobacterium tuberculosis H37Rv
cccggcauacaacuggugggcca

SEQ ID NO: 1369712 - RNA, 21 nt, Mycobacterium tuberculosis H37Rv
cccggcauacaacuggugggc

SEQ ID NO: 1369713 - RNA, 14 nt, Mycobacterium tuberculosis H37Rv
cccggcagagcacg

SEQ ID NO: 1369714 - RNA, 22 nt, Mycobacterium tuberculosis H37Rv
cccggccagcuccucagccacc

SEQ ID NO: 1369715 - RNA, 12 nt, Mycobacterium tuberculosis H37Rv
cccggccagcug

SEQ ID NO: 1369716 - RNA, 11 nt, Mycobacterium tuberculosis H37Rv
cccggccaggc

SEQ ID NO: 1369717 - RNA, 14 nt, Mycobacterium tuberculosis H37Rv
cccggccaaaaugg

SEQ ID NO: 1369718 - RNA, 15 nt, Mycobacterium tuberculosis H37Rv
cccggccaaccacca

SEQ ID NO: 1369719 - RNA, 17 nt, Mycobacterium tuberculosis H37Rv
cccggccaccagcaugc

SEQ ID NO: 1369720 - RNA, 16 nt, Mycobacterium tuberculosis H37Rv
cccggcauacucuuug

SEQ ID NO: 1369721 - RNA, 15 nt, Mycobacterium tuberculosis H37Rv
cccggaccgcggcca

SEQ ID NO: 1369722 - RNA, 21 nt, Mycobacterium tuberculosis H37Rv
cccggacaugcgggcagcacu

SEQ ID NO: 1369723 - RNA, 14 nt, Mycobacterium tuberculosis H37Rv
cccggaccacuguu

SEQ ID NO: 1369724 - RNA, 13 nt, Mycobacterium tuberculosis H37Rv
cccggaagcgccg

SEQ ID NO: 1369725 - RNA, 12 nt, Mycobacterium tuberculosis H37Rv
cccggagccgcu

SEQ ID NO: 1369726 - RNA, 23 nt, Mycobacterium tuberculosis H37Rv
cccggacucuccccuggccccca

SEQ ID NO: 1369727 - RNA, 18 nt, Mycobacterium tuberculosis H37Rv
cccggacguaggcacccc

SEQ ID NO: 1369728 - RNA, 19 nt, Mycobacterium tuberculosis H37Rv
cccggacucuccccuggcc

SEQ ID NO: 1369729 - RNA, 23 nt, Mycobacterium tuberculosis H37Rv
cccggaguggccaguuggccggc

SEQ ID NO: 1369730 - RNA, 18 nt, Mycobacterium tuberculosis H37Rv
cccggagcggucagcgga

SEQ ID NO: 1369731 - RNA, 18 nt, Mycobacterium tuberculosis H37Rv
cccggauguccgccgacg

SEQ ID NO: 1369732 - RNA, 17 nt, Mycobacterium tuberculosis H37Rv
cccggcaaccuggacug

SEQ ID NO: 1369733 - RNA, 22 nt, Mycobacterium tuberculosis H37Rv
cccggcacccaguuccacccgg

SEQ ID NO: 1369734 - RNA, 13 nt, Mycobacterium tuberculosis H37Rv
cccggcaccgccg

SEQ ID NO: 1369735 - RNA, 19 nt, Mycobacterium tuberculosis H37Rv
cccgcucauaccgggagga

SEQ ID NO: 1369736 - RNA, 20 nt, Mycobacterium tuberculosis H37Rv
cccgcuaggcgaagcgucug

SEQ ID NO: 1369737 - RNA, 17 nt, Mycobacterium tuberculosis H37Rv
cccgcuccgccgucgcc

SEQ ID NO: 1369738 - RNA, 20 nt, Mycobacterium tuberculosis H37Rv
cccgcuccgccgucgccgcc

SEQ ID NO: 1369739 - RNA, 16 nt, Mycobacterium tuberculosis H37Rv
cccgcucccugcaccc

SEQ ID NO: 1369740 - RNA, 15 nt, Mycobacterium tuberculosis H37Rv
cccgcugcggcggcu

SEQ ID NO: 1369741 - RNA, 14 nt, Mycobacterium tuberculosis H37Rv
cccgcuggcccgcc

SEQ ID NO: 1369742 - RNA, 15 nt, Mycobacterium tuberculosis H37Rv
cccgcugcgcggccc

SEQ ID NO: 1369743 - RNA, 16 nt, Mycobacterium tuberculosis H37Rv
cccgcuggccuccugg

SEQ ID NO: 1369744 - RNA, 18 nt, Mycobacterium tuberculosis H37Rv
cccgcuggcgagcagacg

SEQ ID NO: 1369745 - RNA, 14 nt, Mycobacterium tuberculosis H37Rv
cccggaaccagccg

SEQ ID NO: 1369746 - RNA, 15 nt, Mycobacterium tuberculosis H37Rv
cccggaaccggcgug

SEQ ID NO: 1369747 - RNA, 15 nt, Mycobacterium tuberculosis H37Rv
cccgcuucgcccggc

SEQ ID NO: 1369748 - RNA, 16 nt, Mycobacterium tuberculosis H37Rv
cccgcuucgcccggcu

SEQ ID NO: 1369749 - RNA, 21 nt, Mycobacterium tuberculosis H37Rv
cccgcgaagcgggaaggcuca

SEQ ID NO: 1369750 - RNA, 19 nt, Mycobacterium tuberculosis H37Rv
cccgccucugucuucagcu

SEQ ID NO: 1369751 - RNA, 15 nt, Mycobacterium tuberculosis H37Rv
cccgccugaccgcca

SEQ ID NO: 1369752 - RNA, 21 nt, Mycobacterium tuberculosis H37Rv
cccgccuucucccgcacggcc

SEQ ID NO: 1369753 - RNA, 21 nt, Mycobacterium tuberculosis H37Rv
cccgcgagguugaccaccagc

SEQ ID NO: 1369754 - RNA, 13 nt, Mycobacterium tuberculosis H37Rv
cccgcgagcagcc

SEQ ID NO: 1369755 - RNA, 20 nt, Mycobacterium tuberculosis H37Rv
cccgcgaugcgcaccagcgg

SEQ ID NO: 1369756 - RNA, 15 nt, Mycobacterium tuberculosis H37Rv
cccgcgcagcacugc

SEQ ID NO: 1369757 - RNA, 23 nt, Mycobacterium tuberculosis H37Rv
cccgcgaggacagcugguugugc

SEQ ID NO: 1369758 - RNA, 17 nt, Mycobacterium tuberculosis H37Rv
cccgcgagcagcccggc

SEQ ID NO: 1369759 - RNA, 13 nt, Mycobacterium tuberculosis H37Rv
cccgcgagcaucg

SEQ ID NO: 1369760 - RNA, 17 nt, Mycobacterium tuberculosis H37Rv
cccgcgagaucgggccg

SEQ ID NO: 1369761 - RNA, 20 nt, Mycobacterium tuberculosis H37Rv
cccgcgagaucgggccggcc

SEQ ID NO: 1369762 - RNA, 23 nt, Mycobacterium tuberculosis H37Rv
cccgcgagaucgggccggccgcc

SEQ ID NO: 1369763 - RNA, 14 nt, Mycobacterium tuberculosis H37Rv
cccgcgccgcgcau

SEQ ID NO: 1369764 - RNA, 23 nt, Mycobacterium tuberculosis H37Rv
cccgcgccgccggacccaccguc

SEQ ID NO: 1369765 - RNA, 13 nt, Mycobacterium tuberculosis H37Rv
cccgcgccgccag

SEQ ID NO: 1369766 - RNA, 19 nt, Mycobacterium tuberculosis H37Rv
cccgcgccgccgccaccac

SEQ ID NO: 1369767 - RNA, 13 nt, Mycobacterium tuberculosis H37Rv
cccgcgccggccg

SEQ ID NO: 1369768 - RNA, 20 nt, Mycobacterium tuberculosis H37Rv
cccgcgccuccguugccccc

SEQ ID NO: 1369769 - RNA, 21 nt, Mycobacterium tuberculosis H37Rv
cccgcgccuccguugccccca

SEQ ID NO: 1369770 - RNA, 17 nt, Mycobacterium tuberculosis H37Rv
cccgcgcgagagccucc

SEQ ID NO: 1369771 - RNA, 20 nt, Mycobacterium tuberculosis H37Rv
cccgcgccaccucccacgcc

SEQ ID NO: 1369772 - RNA, 20 nt, Mycobacterium tuberculosis H37Rv
cccgcgccaccggcaccgcc

SEQ ID NO: 1369773 - RNA, 13 nt, Mycobacterium tuberculosis H37Rv
cccgcgccaccag

SEQ ID NO: 1369774 - RNA, 12 nt, Mycobacterium tuberculosis H37Rv
cccgcgccgccg

SEQ ID NO: 1369775 - RNA, 12 nt, Mycobacterium tuberculosis H37Rv
cccgcgcccaac

SEQ ID NO: 1369776 - RNA, 18 nt, Mycobacterium tuberculosis H37Rv
cccgcuaacuggcccgga

SEQ ID NO: 1369777 - RNA, 22 nt, Mycobacterium tuberculosis H37Rv
cccgcuaacuggcccggacaug

SEQ ID NO: 1369778 - RNA, 23 nt, Mycobacterium tuberculosis H37Rv
cccgcuaacuggcccggacaugc

SEQ ID NO: 1369779 - RNA, 17 nt, Mycobacterium tuberculosis H37Rv
cccgcuacggcagcccg

SEQ ID NO: 1369780 - RNA, 15 nt, Mycobacterium tuberculosis H37Rv
cccgcuacgcgcgcu

SEQ ID NO: 1369781 - RNA, 19 nt, Mycobacterium tuberculosis H37Rv
cccgcguucucggcacccu

SEQ ID NO: 1369782 - RNA, 23 nt, Mycobacterium tuberculosis H37Rv
cccgcguugaaggcgccgguguu

SEQ ID NO: 1369783 - RNA, 17 nt, Mycobacterium tuberculosis H37Rv
cccgcguaugccaggac

SEQ ID NO: 1369784 - RNA, 22 nt, Mycobacterium tuberculosis H37Rv
cccgcgucgagugccgccaccg

SEQ ID NO: 1369785 - RNA, 15 nt, Mycobacterium tuberculosis H37Rv
cccgcggacagcccg

SEQ ID NO: 1369786 - RNA, 13 nt, Mycobacterium tuberculosis H37Rv
cccgcgcucgcac

SEQ ID NO: 1369787 - RNA, 17 nt, Mycobacterium tuberculosis H37Rv
cccgcgcucgcacccgc

SEQ ID NO: 1369788 - RNA, 19 nt, Mycobacterium tuberculosis H37Rv
cccgcgguccugguguagc

SEQ ID NO: 1369789 - RNA, 17 nt, Mycobacterium tuberculosis H37Rv
cccgcggugaccacccc

SEQ ID NO: 1369790 - RNA, 19 nt, Mycobacterium tuberculosis H37Rv
cccgcgggucguccggcgg

SEQ ID NO: 1369791 - RNA, 19 nt, Mycobacterium tuberculosis H37Rv
cccgcggacgugccggucc

SEQ ID NO: 1369792 - RNA, 22 nt, Mycobacterium tuberculosis H37Rv
cccgcggcgcggagagccugcu

SEQ ID NO: 1369793 - RNA, 14 nt, Mycobacterium tuberculosis H37Rv
cccgcggcgccgcc

SEQ ID NO: 1369794 - RNA, 15 nt, Mycobacterium tuberculosis H37Rv
cccgcggcgccgcca

SEQ ID NO: 1369795 - RNA, 21 nt, Mycobacterium tuberculosis H37Rv
cccgcggcgccacccgcgccg

SEQ ID NO: 1369796 - RNA, 23 nt, Mycobacterium tuberculosis H37Rv
cccgcggcgccacccgcgccgcc

SEQ ID NO: 1369797 - RNA, 20 nt, Mycobacterium tuberculosis H37Rv
ccgauccacaacagcccgua

SEQ ID NO: 1369798 - RNA, 16 nt, Mycobacterium tuberculosis H37Rv
ccgauccagcaggccg

SEQ ID NO: 1369799 - RNA, 12 nt, Mycobacterium tuberculosis H37Rv
ccgauccccagg

SEQ ID NO: 1369800 - RNA, 13 nt, Mycobacterium tuberculosis H37Rv
ccgauccccaggc

SEQ ID NO: 1369801 - RNA, 14 nt, Mycobacterium tuberculosis H37Rv
ccgauccccaggcc

SEQ ID NO: 1369802 - RNA, 22 nt, Mycobacterium tuberculosis H37Rv
ccgauccccggagaacuugagc

SEQ ID NO: 1369803 - RNA, 15 nt, Mycobacterium tuberculosis H37Rv
ccgauccgcacagca

SEQ ID NO: 1369804 - RNA, 18 nt, Mycobacterium tuberculosis H37Rv
ccgauccggaucccacca

SEQ ID NO: 1369805 - RNA, 20 nt, Mycobacterium tuberculosis H37Rv
ccgaucaucauauccgcccc

SEQ ID NO: 1369806 - RNA, 16 nt, Mycobacterium tuberculosis H37Rv
ccgaucagcgcggcgc

SEQ ID NO: 1369807 - RNA, 20 nt, Mycobacterium tuberculosis H37Rv
ccgaucagcaccgacggcgc

SEQ ID NO: 1369808 - RNA, 16 nt, Mycobacterium tuberculosis H37Rv
ccgaucacggugggcg

SEQ ID NO: 1369809 - RNA, 13 nt, Mycobacterium tuberculosis H37Rv
ccgaucagcgacg

SEQ ID NO: 1369810 - RNA, 22 nt, Mycobacterium tuberculosis H37Rv
ccgauacuaaacaggccgccac

SEQ ID NO: 1369811 - RNA, 15 nt, Mycobacterium tuberculosis H37Rv
ccgauaccgccggcc

SEQ ID NO: 1369812 - RNA, 15 nt, Mycobacterium tuberculosis H37Rv
ccgauacgcacccgc

SEQ ID NO: 1369813 - RNA, 22 nt, Mycobacterium tuberculosis H37Rv
ccgauaucggugaccguggcgg

SEQ ID NO: 1369814 - RNA, 17 nt, Mycobacterium tuberculosis H37Rv
ccgauagcgcggcacca

SEQ ID NO: 1369815 - RNA, 19 nt, Mycobacterium tuberculosis H37Rv
ccgauagcgcggcaccagc

SEQ ID NO: 1369816 - RNA, 17 nt, Mycobacterium tuberculosis H37Rv
ccgaugaucucacccag

SEQ ID NO: 1369817 - RNA, 19 nt, Mycobacterium tuberculosis H37Rv
ccgaugauggacaccagcc

SEQ ID NO: 1369818 - RNA, 18 nt, Mycobacterium tuberculosis H37Rv
ccgaugaucucacccagc

SEQ ID NO: 1369819 - RNA, 21 nt, Mycobacterium tuberculosis H37Rv
ccgaugacgguccccaggucg

SEQ ID NO: 1369820 - RNA, 13 nt, Mycobacterium tuberculosis H37Rv
ccgaugaggcgcc

SEQ ID NO: 1369821 - RNA, 15 nt, Mycobacterium tuberculosis H37Rv
ccgaugacccacugc

SEQ ID NO: 1369822 - RNA, 19 nt, Mycobacterium tuberculosis H37Rv
ccgaugacccacugcaggc

SEQ ID NO: 1369823 - RNA, 21 nt, Mycobacterium tuberculosis H37Rv
ccgaugauguuuuccccgccc

SEQ ID NO: 1369824 - RNA, 13 nt, Mycobacterium tuberculosis H37Rv
ccgaugccacauc

SEQ ID NO: 1369825 - RNA, 19 nt, Mycobacterium tuberculosis H37Rv
ccgaugccuugaccgcggu

SEQ ID NO: 1369826 - RNA, 22 nt, Mycobacterium tuberculosis H37Rv
ccgaugccgccgccgccgccgg

SEQ ID NO: 1369827 - RNA, 13 nt, Mycobacterium tuberculosis H37Rv
ccgaugccgccgg

SEQ ID NO: 1369828 - RNA, 16 nt, Mycobacterium tuberculosis H37Rv
ccgaugccgccggcac

SEQ ID NO: 1369829 - RNA, 23 nt, Mycobacterium tuberculosis H37Rv
ccgaucuggaugucccaugcacg

SEQ ID NO: 1369830 - RNA, 16 nt, Mycobacterium tuberculosis H37Rv
ccgaucuuggccaccg

SEQ ID NO: 1369831 - RNA, 14 nt, Mycobacterium tuberculosis H37Rv
ccgaucugcuccuc

SEQ ID NO: 1369832 - RNA, 23 nt, Mycobacterium tuberculosis H37Rv
ccgaucucggugaccucaccaac

SEQ ID NO: 1369833 - RNA, 19 nt, Mycobacterium tuberculosis H37Rv
ccgaucucgaccagcgccg

SEQ ID NO: 1369834 - RNA, 20 nt, Mycobacterium tuberculosis H37Rv
ccgaucgggcccaccgcugc

SEQ ID NO: 1369835 - RNA, 23 nt, Mycobacterium tuberculosis H37Rv
ccgauccuggccacucccagcca

SEQ ID NO: 1369836 - RNA, 21 nt, Mycobacterium tuberculosis H37Rv
ccgaucgaaccgcugcuccuc

SEQ ID NO: 1369837 - RNA, 20 nt, Mycobacterium tuberculosis H37Rv
ccgaucgccgaggcuagcag

SEQ ID NO: 1369838 - RNA, 18 nt, Mycobacterium tuberculosis H37Rv
ccgaucgcggcggccucc

SEQ ID NO: 1369839 - RNA, 15 nt, Mycobacterium tuberculosis H37Rv
ccgaucggcaggccg

SEQ ID NO: 1369840 - RNA, 14 nt, Mycobacterium tuberculosis H37Rv
ccgaucggcgcgcc

SEQ ID NO: 1369841 - RNA, 15 nt, Mycobacterium tuberculosis H37Rv
ccgaucggcgcgccg

SEQ ID NO: 1369842 - RNA, 13 nt, Mycobacterium tuberculosis H37Rv
ccgcacgaucagg

SEQ ID NO: 1369843 - RNA, 18 nt, Mycobacterium tuberculosis H37Rv
ccgcacgauggccgucga

SEQ ID NO: 1369844 - RNA, 23 nt, Mycobacterium tuberculosis H37Rv
ccgcacgcaaugcgggcccucua

SEQ ID NO: 1369845 - RNA, 13 nt, Mycobacterium tuberculosis H37Rv
ccgcacgccggca

SEQ ID NO: 1369846 - RNA, 16 nt, Mycobacterium tuberculosis H37Rv
ccgcacgccggccagc

SEQ ID NO: 1369847 - RNA, 18 nt, Mycobacterium tuberculosis H37Rv
ccgcacgccggccagcga

SEQ ID NO: 1369848 - RNA, 17 nt, Mycobacterium tuberculosis H37Rv
ccgcacgcucggcgugu

SEQ ID NO: 1369849 - RNA, 17 nt, Mycobacterium tuberculosis H37Rv
ccgcacgcucgggggau

SEQ ID NO: 1369850 - RNA, 17 nt, Mycobacterium tuberculosis H37Rv
ccgcagcaccgucgggc

SEQ ID NO: 1369851 - RNA, 15 nt, Mycobacterium tuberculosis H37Rv
ccgcagcaccgucgg

SEQ ID NO: 1369852 - RNA, 13 nt, Mycobacterium tuberculosis H37Rv
ccgcagcaccguc

SEQ ID NO: 1369853 - RNA, 18 nt, Mycobacterium tuberculosis H37Rv
ccgcacgguugccgucag

SEQ ID NO: 1369854 - RNA, 19 nt, Mycobacterium tuberculosis H37Rv
ccgcacguauccacggucg

SEQ ID NO: 1369855 - RNA, 13 nt, Mycobacterium tuberculosis H37Rv
ccgcacgggcgac

SEQ ID NO: 1369856 - RNA, 15 nt, Mycobacterium tuberculosis H37Rv
ccgcacggucagcgc

SEQ ID NO: 1369857 - RNA, 16 nt, Mycobacterium tuberculosis H37Rv
ccgcacccggccgcgc

SEQ ID NO: 1369858 - RNA, 17 nt, Mycobacterium tuberculosis H37Rv
ccgcaccccggccgcgc

SEQ ID NO: 1369859 - RNA, 12 nt, Mycobacterium tuberculosis H37Rv
ccgcacccgucc

SEQ ID NO: 1369860 - RNA, 15 nt, Mycobacterium tuberculosis H37Rv
ccgcaccgucccagu

SEQ ID NO: 1369861 - RNA, 21 nt, Mycobacterium tuberculosis H37Rv
ccgcaccguggacaccuggcu

SEQ ID NO: 1369862 - RNA, 20 nt, Mycobacterium tuberculosis H37Rv
ccgcaccuacccugcgcguu

SEQ ID NO: 1369863 - RNA, 16 nt, Mycobacterium tuberculosis H37Rv
ccgcaccuccgccccg

SEQ ID NO: 1369864 - RNA, 16 nt, Mycobacterium tuberculosis H37Rv
ccgcaccugggcggcg

SEQ ID NO: 1369865 - RNA, 17 nt, Mycobacterium tuberculosis H37Rv
ccgcaccugggcggcgc

SEQ ID NO: 1369866 - RNA, 23 nt, Mycobacterium tuberculosis H37Rv
ccgcaccgcgguacgccggucgg

SEQ ID NO: 1369867 - RNA, 19 nt, Mycobacterium tuberculosis H37Rv
ccgcaccgaaaccaugccg

SEQ ID NO: 1369868 - RNA, 17 nt, Mycobacterium tuberculosis H37Rv
ccgcaagaaucagcagc

SEQ ID NO: 1369869 - RNA, 19 nt, Mycobacterium tuberculosis H37Rv
ccgcaacauuuucgcccgc

SEQ ID NO: 1369870 - RNA, 19 nt, Mycobacterium tuberculosis H37Rv
ccgauggugccgacccgcc

SEQ ID NO: 1369871 - RNA, 22 nt, Mycobacterium tuberculosis H37Rv
ccgauggugaugggggagccgg

SEQ ID NO: 1369872 - RNA, 21 nt, Mycobacterium tuberculosis H37Rv
ccgauggcgguggugccgcgg

SEQ ID NO: 1369873 - RNA, 21 nt, Mycobacterium tuberculosis H37Rv
ccgauggcgcaccggcgucgg

SEQ ID NO: 1369874 - RNA, 21 nt, Mycobacterium tuberculosis H37Rv
ccgauggcgucgccggccccg

SEQ ID NO: 1369875 - RNA, 23 nt, Mycobacterium tuberculosis H37Rv
ccgauggauuggcgucagcagca

SEQ ID NO: 1369876 - RNA, 20 nt, Mycobacterium tuberculosis H37Rv
ccgaggacgccggcgccgcc

SEQ ID NO: 1369877 - RNA, 19 nt, Mycobacterium tuberculosis H37Rv
ccgaggaaaccaccagugg

SEQ ID NO: 1369878 - RNA, 23 nt, Mycobacterium tuberculosis H37Rv
ccgagcuucagcgcgcugcagug

SEQ ID NO: 1369879 - RNA, 12 nt, Mycobacterium tuberculosis H37Rv
ccgagcuucagc

SEQ ID NO: 1369880 - RNA, 20 nt, Mycobacterium tuberculosis H37Rv
ccgaggccgccaucgccgcc

SEQ ID NO: 1369881 - RNA, 15 nt, Mycobacterium tuberculosis H37Rv
ccgaggccgccgaga

SEQ ID NO: 1369882 - RNA, 16 nt, Mycobacterium tuberculosis H37Rv
ccgaggccgccgagau

SEQ ID NO: 1369883 - RNA, 16 nt, Mycobacterium tuberculosis H37Rv
ccgaggccgcugccag

SEQ ID NO: 1369884 - RNA, 19 nt, Mycobacterium tuberculosis H37Rv
ccgaggccaugcucgccaa

SEQ ID NO: 1369885 - RNA, 16 nt, Mycobacterium tuberculosis H37Rv
ccgaggccgaccucgu

SEQ ID NO: 1369886 - RNA, 23 nt, Mycobacterium tuberculosis H37Rv
ccgaggcagacacgagucgccag

SEQ ID NO: 1369887 - RNA, 21 nt, Mycobacterium tuberculosis H37Rv
ccgaggacacauugaccaggu

SEQ ID NO: 1369888 - RNA, 23 nt, Mycobacterium tuberculosis H37Rv
ccgaggaugugguuggugcuggc

SEQ ID NO: 1369889 - RNA, 22 nt, Mycobacterium tuberculosis H37Rv
ccgaggauguugugccgaucgg

SEQ ID NO: 1369890 - RNA, 16 nt, Mycobacterium tuberculosis H37Rv
ccgaggcacccgugcc

SEQ ID NO: 1369891 - RNA, 21 nt, Mycobacterium tuberculosis H37Rv
ccgaggcggucuuguccagga

SEQ ID NO: 1369892 - RNA, 22 nt, Mycobacterium tuberculosis H37Rv
ccgaggcgagacgcuccagugg

SEQ ID NO: 1369893 - RNA, 18 nt, Mycobacterium tuberculosis H37Rv
ccgagggaacggugcaca

SEQ ID NO: 1369894 - RNA, 17 nt, Mycobacterium tuberculosis H37Rv
ccgaggcucgggccgca

SEQ ID NO: 1369895 - RNA, 15 nt, Mycobacterium tuberculosis H37Rv
ccgaggcucgggccg

SEQ ID NO: 1369896 - RNA, 13 nt, Mycobacterium tuberculosis H37Rv
ccgagggucgggc

SEQ ID NO: 1369897 - RNA, 15 nt, Mycobacterium tuberculosis H37Rv
ccgagggcgucgccg

SEQ ID NO: 1369898 - RNA, 18 nt, Mycobacterium tuberculosis H37Rv
ccgagggcgucgccgccg

SEQ ID NO: 1369899 - RNA, 19 nt, Mycobacterium tuberculosis H37Rv
ccgaggucgguucggccgg

SEQ ID NO: 1369900 - RNA, 17 nt, Mycobacterium tuberculosis H37Rv
ccgagugaccagggugg

SEQ ID NO: 1369901 - RNA, 17 nt, Mycobacterium tuberculosis H37Rv
ccgagucucgucgggua

SEQ ID NO: 1369902 - RNA, 21 nt, Mycobacterium tuberculosis H37Rv
ccgaguccggcgagcucaaca

SEQ ID NO: 1369903 - RNA, 23 nt, Mycobacterium tuberculosis H37Rv
ccgaguauuggucggugggguau

SEQ ID NO: 1369904 - RNA, 22 nt, Mycobacterium tuberculosis H37Rv
ccgaguagaagauggcaccgcc

SEQ ID NO: 1369905 - RNA, 22 nt, Mycobacterium tuberculosis H37Rv
ccgaguagaacuucgccagcgg

SEQ ID NO: 1369906 - RNA, 14 nt, Mycobacterium tuberculosis H37Rv
ccgaggugccgcgc

SEQ ID NO: 1369907 - RNA, 15 nt, Mycobacterium tuberculosis H37Rv
ccgaggugccgcgca

SEQ ID NO: 1369908 - RNA, 19 nt, Mycobacterium tuberculosis H37Rv
ccgaggugccgcgcagcug

SEQ ID NO: 1369909 - RNA, 23 nt, Mycobacterium tuberculosis H37Rv
ccgagguucaaagcagcgcacca

SEQ ID NO: 1369910 - RNA, 17 nt, Mycobacterium tuberculosis H37Rv
ccgauaaaaaccacccc

SEQ ID NO: 1369911 - RNA, 20 nt, Mycobacterium tuberculosis H37Rv
ccgaguuguggacgcccgag

SEQ ID NO: 1369912 - RNA, 21 nt, Mycobacterium tuberculosis H37Rv
ccgaguugaugaagauggcgc

SEQ ID NO: 1369913 - RNA, 18 nt, Mycobacterium tuberculosis H37Rv
ccgaguucgucagcggcc

SEQ ID NO: 1369914 - RNA, 22 nt, Mycobacterium tuberculosis H37Rv
ccgagugcggugugugcaagcc

SEQ ID NO: 1369915 - RNA, 16 nt, Mycobacterium tuberculosis H37Rv
ccgagucucgucgggu

SEQ ID NO: 1369916 - RNA, 18 nt, Mycobacterium tuberculosis H37Rv
ccgaguggccggugggcc

SEQ ID NO: 1369917 - RNA, 20 nt, Mycobacterium tuberculosis H37Rv
ccgagaugcuggucggcgau

SEQ ID NO: 1369918 - RNA, 19 nt, Mycobacterium tuberculosis H37Rv
ccgagaugcuggucggcga

SEQ ID NO: 1369919 - RNA, 18 nt, Mycobacterium tuberculosis H37Rv
ccgagccggugccacugc

SEQ ID NO: 1369920 - RNA, 16 nt, Mycobacterium tuberculosis H37Rv
ccgagccuugagcgcg

SEQ ID NO: 1369921 - RNA, 14 nt, Mycobacterium tuberculosis H37Rv
ccgagccucgcucu

SEQ ID NO: 1369922 - RNA, 13 nt, Mycobacterium tuberculosis H37Rv
ccgagccuggauc

SEQ ID NO: 1369923 - RNA, 17 nt, Mycobacterium tuberculosis H37Rv
ccgagcgcaacucccag

SEQ ID NO: 1369924 - RNA, 18 nt, Mycobacterium tuberculosis H37Rv
ccgagcgaccgucccagc

SEQ ID NO: 1369925 - RNA, 13 nt, Mycobacterium tuberculosis H37Rv
ccgagcgcccucc

SEQ ID NO: 1369926 - RNA, 20 nt, Mycobacterium tuberculosis H37Rv
ccgagcgcgccgaaggcggc

SEQ ID NO: 1369927 - RNA, 12 nt, Mycobacterium tuberculosis H37Rv
ccgagcgcgcgc

SEQ ID NO: 1369928 - RNA, 12 nt, Mycobacterium tuberculosis H37Rv
ccgagcgcgccg

SEQ ID NO: 1369929 - RNA, 22 nt, Mycobacterium tuberculosis H37Rv
ccgagcggaccaccgcucgcca

SEQ ID NO: 1369930 - RNA, 22 nt, Mycobacterium tuberculosis H37Rv
ccgagcgggaacgagccacgcc

SEQ ID NO: 1369931 - RNA, 23 nt, Mycobacterium tuberculosis H37Rv
ccgagcgggaacgagccacgcca

SEQ ID NO: 1369932 - RNA, 18 nt, Mycobacterium tuberculosis H37Rv
ccgacuggccccgccagc

SEQ ID NO: 1369933 - RNA, 19 nt, Mycobacterium tuberculosis H37Rv
ccgacucuccggcauccuc

SEQ ID NO: 1369934 - RNA, 18 nt, Mycobacterium tuberculosis H37Rv
ccgacugggcgcgacccc

SEQ ID NO: 1369935 - RNA, 21 nt, Mycobacterium tuberculosis H37Rv
ccgacuuccgcgucgccggcc

SEQ ID NO: 1369936 - RNA, 21 nt, Mycobacterium tuberculosis H37Rv
ccgacuucgucaaccaccagg

SEQ ID NO: 1369937 - RNA, 21 nt, Mycobacterium tuberculosis H37Rv
ccgagaccgggcaacggcggg

SEQ ID NO: 1369938 - RNA, 13 nt, Mycobacterium tuberculosis H37Rv
ccgagaccaacgc

SEQ ID NO: 1369939 - RNA, 22 nt, Mycobacterium tuberculosis H37Rv
ccgagauagcaacgaagccggc

SEQ ID NO: 1369940 - RNA, 19 nt, Mycobacterium tuberculosis H37Rv
ccgagaucaccgccaccac

SEQ ID NO: 1369941 - RNA, 15 nt, Mycobacterium tuberculosis H37Rv
ccgagaucccagcgg

SEQ ID NO: 1369942 - RNA, 16 nt, Mycobacterium tuberculosis H37Rv
ccgagaucggacaggu

SEQ ID NO: 1369943 - RNA, 22 nt, Mycobacterium tuberculosis H37Rv
ccgacgucgcggaguagccgca

SEQ ID NO: 1369944 - RNA, 20 nt, Mycobacterium tuberculosis H37Rv
ccgacguggccagcccgccc

SEQ ID NO: 1369945 - RNA, 17 nt, Mycobacterium tuberculosis H37Rv
ccgacgugguugccccg

SEQ ID NO: 1369946 - RNA, 20 nt, Mycobacterium tuberculosis H37Rv
ccgacgucgaccacugcccg

SEQ ID NO: 1369947 - RNA, 17 nt, Mycobacterium tuberculosis H37Rv
ccgacguauagaccagg

SEQ ID NO: 1369948 - RNA, 15 nt, Mycobacterium tuberculosis H37Rv
ccgacgucgccgacg

SEQ ID NO: 1369949 - RNA, 16 nt, Mycobacterium tuberculosis H37Rv
ccgacuaucggccgcc

SEQ ID NO: 1369950 - RNA, 18 nt, Mycobacterium tuberculosis H37Rv
ccgacugccguucagcgg

SEQ ID NO: 1369951 - RNA, 22 nt, Mycobacterium tuberculosis H37Rv
ccgacugccguucagcggcggg

SEQ ID NO: 1369952 - RNA, 14 nt, Mycobacterium tuberculosis H37Rv
ccgacuccaguucg

SEQ ID NO: 1369953 - RNA, 17 nt, Mycobacterium tuberculosis H37Rv
ccgacuccggcaggccc

SEQ ID NO: 1369954 - RNA, 17 nt, Mycobacterium tuberculosis H37Rv
ccgacuccugggccaac

SEQ ID NO: 1369955 - RNA, 15 nt, Mycobacterium tuberculosis H37Rv
ccgacggcagugcug

SEQ ID NO: 1369956 - RNA, 20 nt, Mycobacterium tuberculosis H37Rv
ccgacggcaaaccaguuggc

SEQ ID NO: 1369957 - RNA, 20 nt, Mycobacterium tuberculosis H37Rv
ccgacgcguccggugcacca

SEQ ID NO: 1369958 - RNA, 13 nt, Mycobacterium tuberculosis H37Rv
ccgacgcuccagg

SEQ ID NO: 1369959 - RNA, 19 nt, Mycobacterium tuberculosis H37Rv
ccgacggugaaccaccacu

SEQ ID NO: 1369960 - RNA, 22 nt, Mycobacterium tuberculosis H37Rv
ccgacggguaucccgucccagc

SEQ ID NO: 1369961 - RNA, 20 nt, Mycobacterium tuberculosis H37Rv
ccgacgggacaaggucaucg

SEQ ID NO: 1369962 - RNA, 16 nt, Mycobacterium tuberculosis H37Rv
ccgacgggggucgggc

SEQ ID NO: 1369963 - RNA, 15 nt, Mycobacterium tuberculosis H37Rv
ccgacggccagcagg

SEQ ID NO: 1369964 - RNA, 19 nt, Mycobacterium tuberculosis H37Rv
ccgacggccagcaggauga

SEQ ID NO: 1369965 - RNA, 13 nt, Mycobacterium tuberculosis H37Rv
ccgacggccagca

SEQ ID NO: 1369966 - RNA, 13 nt, Mycobacterium tuberculosis H37Rv
cccuggacuucgg

SEQ ID NO: 1369967 - RNA, 20 nt, Mycobacterium tuberculosis H37Rv
cccuggaccagcgggcggcc

SEQ ID NO: 1369968 - RNA, 17 nt, Mycobacterium tuberculosis H37Rv
cccuggacauaccggcc

SEQ ID NO: 1369969 - RNA, 17 nt, Mycobacterium tuberculosis H37Rv
cccugcuggugucggcu

SEQ ID NO: 1369970 - RNA, 19 nt, Mycobacterium tuberculosis H37Rv
cccugcgccucggcggcca

SEQ ID NO: 1369971 - RNA, 20 nt, Mycobacterium tuberculosis H37Rv
cccugcgccucggcggccag

SEQ ID NO: 1369972 - RNA, 13 nt, Mycobacterium tuberculosis H37Rv
cccugcgcagccg

SEQ ID NO: 1369973 - RNA, 13 nt, Mycobacterium tuberculosis H37Rv
cccugcgccucgg

SEQ ID NO: 1369974 - RNA, 22 nt, Mycobacterium tuberculosis H37Rv
cccuggauggcgcccugcgcca

SEQ ID NO: 1369975 - RNA, 14 nt, Mycobacterium tuberculosis H37Rv
cccuggccgccggc

SEQ ID NO: 1369976 - RNA, 12 nt, Mycobacterium tuberculosis H37Rv
cccuggccgccg

SEQ ID NO: 1369977 - RNA, 14 nt, Mycobacterium tuberculosis H37Rv
cccuggccgcccag

SEQ ID NO: 1369978 - RNA, 20 nt, Mycobacterium tuberculosis H37Rv
cccuggccgcccagaccgcc

SEQ ID NO: 1369979 - RNA, 20 nt, Mycobacterium tuberculosis H37Rv
cccuggcccccgguaccgcc

SEQ ID NO: 1369980 - RNA, 22 nt, Mycobacterium tuberculosis H37Rv
cccuggcgugugugcgccuccg

SEQ ID NO: 1369981 - RNA, 20 nt, Mycobacterium tuberculosis H37Rv
cccuggccgccggcgccgcc

SEQ ID NO: 1369982 - RNA, 15 nt, Mycobacterium tuberculosis H37Rv
cccuggccgccggcg

SEQ ID NO: 1369983 - RNA, 19 nt, Mycobacterium tuberculosis H37Rv
cccuggccgccggcgccgc

SEQ ID NO: 1369984 - RNA, 15 nt, Mycobacterium tuberculosis H37Rv
cccugcacggugccc

SEQ ID NO: 1369985 - RNA, 15 nt, Mycobacterium tuberculosis H37Rv
cccugcacagcaggc

SEQ ID NO: 1369986 - RNA, 12 nt, Mycobacterium tuberculosis H37Rv
cccugcacagca

SEQ ID NO: 1369987 - RNA, 14 nt, Mycobacterium tuberculosis H37Rv
cccugcacccagcc

SEQ ID NO: 1369988 - RNA, 20 nt, Mycobacterium tuberculosis H37Rv
cccugcacccagccgugccc

SEQ ID NO: 1369989 - RNA, 21 nt, Mycobacterium tuberculosis H37Rv
cccugcacccagccgugccca

SEQ ID NO: 1369990 - RNA, 14 nt, Mycobacterium tuberculosis H37Rv
cccugcacccgacc

SEQ ID NO: 1369991 - RNA, 13 nt, Mycobacterium tuberculosis H37Rv
cccgucggcgccg

SEQ ID NO: 1369992 - RNA, 14 nt, Mycobacterium tuberculosis H37Rv
cccgucgggcaguu

SEQ ID NO: 1369993 - RNA, 15 nt, Mycobacterium tuberculosis H37Rv
cccugcaacccgguc

SEQ ID NO: 1369994 - RNA, 20 nt, Mycobacterium tuberculosis H37Rv
cccugcaacccggucggcag

SEQ ID NO: 1369995 - RNA, 13 nt, Mycobacterium tuberculosis H37Rv
cccgucgcggccg

SEQ ID NO: 1369996 - RNA, 12 nt, Mycobacterium tuberculosis H37Rv
cccgucgccgcc

SEQ ID NO: 1369997 - RNA, 19 nt, Mycobacterium tuberculosis H37Rv
cccgucgaucagcggcagc

SEQ ID NO: 1369998 - RNA, 18 nt, Mycobacterium tuberculosis H37Rv
cccgucgaguagguaacg

SEQ ID NO: 1369999 - RNA, 13 nt, Mycobacterium tuberculosis H37Rv
cccguccgcgccc

SEQ ID NO: 1370000 - RNA, 16 nt, Mycobacterium tuberculosis H37Rv
cccuugacggugagau

SEQ ID NO: 1370001 - RNA, 16 nt, Mycobacterium tuberculosis H37Rv
cccuugaccgcugccc

SEQ ID NO: 1370002 - RNA, 14 nt, Mycobacterium tuberculosis H37Rv
cccuugaccaugug

SEQ ID NO: 1370003 - RNA, 16 nt, Mycobacterium tuberculosis H37Rv
cccuugccgccggccc

SEQ ID NO: 1370004 - RNA, 20 nt, Mycobacterium tuberculosis H37Rv
cccuugccgcagaaucccaa

SEQ ID NO: 1370005 - RNA, 22 nt, Mycobacterium tuberculosis H37Rv
cccuuguggucugccagcaccc

SEQ ID NO: 1370006 - RNA, 18 nt, Mycobacterium tuberculosis H37Rv
cccuuggacugucccacc

SEQ ID NO: 1370007 - RNA, 20 nt, Mycobacterium tuberculosis H37Rv
cccuugccuccggcgccgcc

SEQ ID NO: 1370008 - RNA, 15 nt, Mycobacterium tuberculosis H37Rv
cccuugggcaccacc

SEQ ID NO: 1370009 - RNA, 18 nt, Mycobacterium tuberculosis H37Rv
cccuugggcaccacccga

SEQ ID NO: 1370010 - RNA, 16 nt, Mycobacterium tuberculosis H37Rv
cccugucaacgccgcg

SEQ ID NO: 1370011 - RNA, 15 nt, Mycobacterium tuberculosis H37Rv
cccugucgcgcaccg

SEQ ID NO: 1370012 - RNA, 23 nt, Mycobacterium tuberculosis H37Rv
cccuguucggcccuauggguucc

SEQ ID NO: 1370013 - RNA, 14 nt, Mycobacterium tuberculosis H37Rv
cccugugccagcag

SEQ ID NO: 1370014 - RNA, 13 nt, Mycobacterium tuberculosis H37Rv
aaacagaguagac

SEQ ID NO: 1370015 - RNA, 14 nt, Mycobacterium tuberculosis H37Rv
ccgaaauacccagc

SEQ ID NO: 1370016 - RNA, 20 nt, Mycobacterium tuberculosis H37Rv
cccuuuggguagcaaacccc

SEQ ID NO: 1370017 - RNA, 16 nt, Mycobacterium tuberculosis H37Rv
cccuuuguggggccgg

SEQ ID NO: 1370018 - RNA, 22 nt, Mycobacterium tuberculosis H37Rv
ccgaacaccgagugcggugugu

SEQ ID NO: 1370019 - RNA, 21 nt, Mycobacterium tuberculosis H37Rv
ccgaaaucaguugcgcuccaa

SEQ ID NO: 1370020 - RNA, 19 nt, Mycobacterium tuberculosis H37Rv
ccgaacauccgccgccccc

SEQ ID NO: 1370021 - RNA, 18 nt, Mycobacterium tuberculosis H37Rv
ccgaacagcagcccgccc

SEQ ID NO: 1370022 - RNA, 12 nt, Mycobacterium tuberculosis H37Rv
ccgaacagcugg

SEQ ID NO: 1370023 - RNA, 18 nt, Mycobacterium tuberculosis H37Rv
ccgaacagcuggacggcc

SEQ ID NO: 1370024 - RNA, 11 nt, Mycobacterium tuberculosis H37Rv
ccgaacaccgu

SEQ ID NO: 1370025 - RNA, 22 nt, Mycobacterium tuberculosis H37Rv
ccgaacagcugcccgccagcgc

SEQ ID NO: 1370026 - RNA, 20 nt, Mycobacterium tuberculosis H37Rv
ccgaaccaccuguccggugg

SEQ ID NO: 1370027 - RNA, 18 nt, Mycobacterium tuberculosis H37Rv
ccgaaccacgcgcccgca

SEQ ID NO: 1370028 - RNA, 17 nt, Mycobacterium tuberculosis H37Rv
ccgaaccaccaccggca

SEQ ID NO: 1370029 - RNA, 17 nt, Mycobacterium tuberculosis H37Rv
ccgaaccccgggcggcg

SEQ ID NO: 1370030 - RNA, 20 nt, Mycobacterium tuberculosis H37Rv
ccgaacccgccgucaccgcg

SEQ ID NO: 1370031 - RNA, 17 nt, Mycobacterium tuberculosis H37Rv
ccgaaccgacguucccc

SEQ ID NO: 1370032 - RNA, 17 nt, Mycobacterium tuberculosis H37Rv
ccgaaccggcaccagcg

SEQ ID NO: 1370033 - RNA, 23 nt, Mycobacterium tuberculosis H37Rv
ccgaaccgcguuaugccaggcgc

SEQ ID NO: 1370034 - RNA, 19 nt, Mycobacterium tuberculosis H37Rv
ccgaaccggcaccagcggc

SEQ ID NO: 1370035 - RNA, 22 nt, Mycobacterium tuberculosis H37Rv
ccgaaccguucgcucagggugu

SEQ ID NO: 1370036 - RNA, 16 nt, Mycobacterium tuberculosis H37Rv
ccgaaccugcggcagc

SEQ ID NO: 1370037 - RNA, 18 nt, Mycobacterium tuberculosis H37Rv
ccgaaccuggucuugacu

SEQ ID NO: 1370038 - RNA, 21 nt, Mycobacterium tuberculosis H37Rv
ccgaacgacccuggccuuuga

SEQ ID NO: 1370039 - RNA, 15 nt, Mycobacterium tuberculosis H37Rv
ccgaacgccucugcg

SEQ ID NO: 1370040 - RNA, 22 nt, Mycobacterium tuberculosis H37Rv
ccgaagaaaacgaacccacugc

SEQ ID NO: 1370041 - RNA, 17 nt, Mycobacterium tuberculosis H37Rv
ccgaagcggaucuggcc

SEQ ID NO: 1370042 - RNA, 16 nt, Mycobacterium tuberculosis H37Rv
ccgaagcggccaccgc

SEQ ID NO: 1370043 - RNA, 21 nt, Mycobacterium tuberculosis H37Rv
ccgaagcggccaccgccgccg

SEQ ID NO: 1370044 - RNA, 12 nt, Mycobacterium tuberculosis H37Rv
ccgaagcugccc

SEQ ID NO: 1370045 - RNA, 18 nt, Mycobacterium tuberculosis H37Rv
ccgaagcucaucaccggc

SEQ ID NO: 1370046 - RNA, 12 nt, Mycobacterium tuberculosis H37Rv
ccgaaguugaag

SEQ ID NO: 1370047 - RNA, 18 nt, Mycobacterium tuberculosis H37Rv
ccgaaguagaagcccagg

SEQ ID NO: 1370048 - RNA, 17 nt, Mycobacterium tuberculosis H37Rv
ccgaaguacuggccgcc

SEQ ID NO: 1370049 - RNA, 16 nt, Mycobacterium tuberculosis H37Rv
ccgacaaccccgccag

SEQ ID NO: 1370050 - RNA, 17 nt, Mycobacterium tuberculosis H37Rv
ccgacaaccccgccagg

SEQ ID NO: 1370051 - RNA, 16 nt, Mycobacterium tuberculosis H37Rv
ccgaauuugucggcga

SEQ ID NO: 1370052 - RNA, 14 nt, Mycobacterium tuberculosis H37Rv
ccgaauggccgccg

SEQ ID NO: 1370053 - RNA, 20 nt, Mycobacterium tuberculosis H37Rv
ccgacaccaccggcgccgcc

SEQ ID NO: 1370054 - RNA, 16 nt, Mycobacterium tuberculosis H37Rv
ccgacaaugucggcga

SEQ ID NO: 1370055 - RNA, 17 nt, Mycobacterium tuberculosis H37Rv
ccgacaaugucggcgau

SEQ ID NO: 1370056 - RNA, 17 nt, Mycobacterium tuberculosis H37Rv
ccgacaacccggccggg

SEQ ID NO: 1370057 - RNA, 19 nt, Mycobacterium tuberculosis H37Rv
ccgacaacuguccugccag

SEQ ID NO: 1370058 - RNA, 17 nt, Mycobacterium tuberculosis H37Rv
ccgacaccaccaggucc

SEQ ID NO: 1370059 - RNA, 20 nt, Mycobacterium tuberculosis H37Rv
ccgcgauucgcggcagccgg

SEQ ID NO: 1370060 - RNA, 15 nt, Mycobacterium tuberculosis H37Rv
ccgcgcaacccggac

SEQ ID NO: 1370061 - RNA, 14 nt, Mycobacterium tuberculosis H37Rv
ccgcgcaaccggcc

SEQ ID NO: 1370062 - RNA, 18 nt, Mycobacterium tuberculosis H37Rv
ccgcgcaaccggccgucc

SEQ ID NO: 1370063 - RNA, 20 nt, Mycobacterium tuberculosis H37Rv
ccgcgcaaccggccguccag

SEQ ID NO: 1370064 - RNA, 23 nt, Mycobacterium tuberculosis H37Rv
ccgcgaugacgaccgaucggcgc

SEQ ID NO: 1370065 - RNA, 16 nt, Mycobacterium tuberculosis H37Rv
ccgcgaugagcggcgc

SEQ ID NO: 1370066 - RNA, 20 nt, Mycobacterium tuberculosis H37Rv
ccgcgaugcgcaccagcggc

SEQ ID NO: 1370067 - RNA, 14 nt, Mycobacterium tuberculosis H37Rv
ccgcgaugugccca

SEQ ID NO: 1370068 - RNA, 13 nt, Mycobacterium tuberculosis H37Rv
ccgcgcacggcug

SEQ ID NO: 1370069 - RNA, 17 nt, Mycobacterium tuberculosis H37Rv
ccgcgcagauucccggc

SEQ ID NO: 1370070 - RNA, 19 nt, Mycobacterium tuberculosis H37Rv
ccgcgcaccgaccgcaccg

SEQ ID NO: 1370071 - RNA, 21 nt, Mycobacterium tuberculosis H37Rv
ccgcgcacccguccgccgcag

SEQ ID NO: 1370072 - RNA, 17 nt, Mycobacterium tuberculosis H37Rv
ccgcgcaucaucgccca

SEQ ID NO: 1370073 - RNA, 17 nt, Mycobacterium tuberculosis H37Rv
ccgcgcaucugucgcgc

SEQ ID NO: 1370074 - RNA, 13 nt, Mycobacterium tuberculosis H37Rv
ccgcgccagccuc

SEQ ID NO: 1370075 - RNA, 13 nt, Mycobacterium tuberculosis H37Rv
ccgcgcagcugcc

SEQ ID NO: 1370076 - RNA, 20 nt, Mycobacterium tuberculosis H37Rv
ccgcgcagcacugcggcagc

SEQ ID NO: 1370077 - RNA, 14 nt, Mycobacterium tuberculosis H37Rv
ccgcgcagccggcc

SEQ ID NO: 1370078 - RNA, 18 nt, Mycobacterium tuberculosis H37Rv
ccgcgcagcugccgcacc

SEQ ID NO: 1370079 - RNA, 17 nt, Mycobacterium tuberculosis H37Rv
ccgcgacagcggcgucg

SEQ ID NO: 1370080 - RNA, 20 nt, Mycobacterium tuberculosis H37Rv
ccgcgaccacgcaccgcccc

SEQ ID NO: 1370081 - RNA, 21 nt, Mycobacterium tuberculosis H37Rv
ccgcgacccggcccagcgccc

SEQ ID NO: 1370082 - RNA, 15 nt, Mycobacterium tuberculosis H37Rv
ccgcgaccucgcggc

SEQ ID NO: 1370083 - RNA, 17 nt, Mycobacterium tuberculosis H37Rv
ccgcgaccgccucgccg

SEQ ID NO: 1370084 - RNA, 15 nt, Mycobacterium tuberculosis H37Rv
ccgcgacgagcggcc

SEQ ID NO: 1370085 - RNA, 19 nt, Mycobacterium tuberculosis H37Rv
ccgcgacgcucgcugcagc

SEQ ID NO: 1370086 - RNA, 16 nt, Mycobacterium tuberculosis H37Rv
ccgcgacggcgccggc

SEQ ID NO: 1370087 - RNA, 20 nt, Mycobacterium tuberculosis H37Rv
ccgcgacggcgccggcaucg

SEQ ID NO: 1370088 - RNA, 18 nt, Mycobacterium tuberculosis H37Rv
ccgcgagaucgggccggc

SEQ ID NO: 1370089 - RNA, 15 nt, Mycobacterium tuberculosis H37Rv
ccgcgacuuugccuu

SEQ ID NO: 1370090 - RNA, 14 nt, Mycobacterium tuberculosis H37Rv
ccgcgagcagagga

SEQ ID NO: 1370091 - RNA, 23 nt, Mycobacterium tuberculosis H37Rv
ccgcgagcuuggccagcagcagc

SEQ ID NO: 1370092 - RNA, 13 nt, Mycobacterium tuberculosis H37Rv
ccgcgauccccac

SEQ ID NO: 1370093 - RNA, 16 nt, Mycobacterium tuberculosis H37Rv
ccgcgaucgacggugu

SEQ ID NO: 1370094 - RNA, 19 nt, Mycobacterium tuberculosis H37Rv
ccgcgaucgcgacacggcc

SEQ ID NO: 1370095 - RNA, 18 nt, Mycobacterium tuberculosis H37Rv
ccgcgagcgccggccgcg

SEQ ID NO: 1370096 - RNA, 12 nt, Mycobacterium tuberculosis H37Rv
ccgcgagcgcgc

SEQ ID NO: 1370097 - RNA, 13 nt, Mycobacterium tuberculosis H37Rv
ccgcagccagcgg

SEQ ID NO: 1370098 - RNA, 21 nt, Mycobacterium tuberculosis H37Rv
ccgcagcccgccgggcuccac

SEQ ID NO: 1370099 - RNA, 19 nt, Mycobacterium tuberculosis H37Rv
ccgcagcgaaaacccgguc

SEQ ID NO: 1370100 - RNA, 22 nt, Mycobacterium tuberculosis H37Rv
ccgcagcggccagcccagccgg

SEQ ID NO: 1370101 - RNA, 13 nt, Mycobacterium tuberculosis H37Rv
ccgcagcggccug

SEQ ID NO: 1370102 - RNA, 20 nt, Mycobacterium tuberculosis H37Rv
ccgcagcggaacugggcccc

SEQ ID NO: 1370103 - RNA, 19 nt, Mycobacterium tuberculosis H37Rv
ccgcagcggaacugggccc

SEQ ID NO: 1370104 - RNA, 21 nt, Mycobacterium tuberculosis H37Rv
ccgccugcagguuuccggccu

SEQ ID NO: 1370105 - RNA, 22 nt, Mycobacterium tuberculosis H37Rv
ccgccugccccacccgcggcgc

SEQ ID NO: 1370106 - RNA, 15 nt, Mycobacterium tuberculosis H37Rv
ccgccugcccggccc

SEQ ID NO: 1370107 - RNA, 17 nt, Mycobacterium tuberculosis H37Rv
ccgccugcgccgcccgc

SEQ ID NO: 1370108 - RNA, 15 nt, Mycobacterium tuberculosis H37Rv
ccgccugcgccgccc

SEQ ID NO: 1370109 - RNA, 21 nt, Mycobacterium tuberculosis H37Rv
ccgcgaacgauuucggcccac

SEQ ID NO: 1370110 - RNA, 19 nt, Mycobacterium tuberculosis H37Rv
ccgcgaagcgcucggcagc

SEQ ID NO: 1370111 - RNA, 21 nt, Mycobacterium tuberculosis H37Rv
ccgcgaacgggucgggacgcu

SEQ ID NO: 1370112 - RNA, 16 nt, Mycobacterium tuberculosis H37Rv
ccgcgaaccucacagc

SEQ ID NO: 1370113 - RNA, 16 nt, Mycobacterium tuberculosis H37Rv
ccgccuuugccgccgg

SEQ ID NO: 1370114 - RNA, 13 nt, Mycobacterium tuberculosis H37Rv
ccgccuuggcccc

SEQ ID NO: 1370115 - RNA, 20 nt, Mycobacterium tuberculosis H37Rv
ccgccuugaggcccugcggc

SEQ ID NO: 1370116 - RNA, 14 nt, Mycobacterium tuberculosis H37Rv
ccgccuucuuggcg

SEQ ID NO: 1370117 - RNA, 16 nt, Mycobacterium tuberculosis H37Rv
ccgccuuggucaccuu

SEQ ID NO: 1370118 - RNA, 18 nt, Mycobacterium tuberculosis H37Rv
ccgccuuggucgcgucgg

SEQ ID NO: 1370119 - RNA, 22 nt, Mycobacterium tuberculosis H37Rv
ccgccuucuuggcggccuuugu

SEQ ID NO: 1370120 - RNA, 13 nt, Mycobacterium tuberculosis H37Rv
ccgccuucuuggc

SEQ ID NO: 1370121 - RNA, 12 nt, Mycobacterium tuberculosis H37Rv
ccgccuucuugg

SEQ ID NO: 1370122 - RNA, 14 nt, Mycobacterium tuberculosis H37Rv
ccgccuucucccgc

SEQ ID NO: 1370123 - RNA, 17 nt, Mycobacterium tuberculosis H37Rv
ccgccuuccuggcgggc

SEQ ID NO: 1370124 - RNA, 15 nt, Mycobacterium tuberculosis H37Rv
ccgccuucgccgccg

SEQ ID NO: 1370125 - RNA, 17 nt, Mycobacterium tuberculosis H37Rv
ccgccugugccgccggc

SEQ ID NO: 1370126 - RNA, 15 nt, Mycobacterium tuberculosis H37Rv
ccgccuggacgccgc

SEQ ID NO: 1370127 - RNA, 14 nt, Mycobacterium tuberculosis H37Rv
ccgcgccggccccg

SEQ ID NO: 1370128 - RNA, 12 nt, Mycobacterium tuberculosis H37Rv
ccgcgccgucgg

SEQ ID NO: 1370129 - RNA, 15 nt, Mycobacterium tuberculosis H37Rv
ccgcgccgucgucgc

SEQ ID NO: 1370130 - RNA, 11 nt, Mycobacterium tuberculosis H37Rv
ccgcgccgccu

SEQ ID NO: 1370131 - RNA, 19 nt, Mycobacterium tuberculosis H37Rv
ccgcgccgccggacccacc

SEQ ID NO: 1370132 - RNA, 20 nt, Mycobacterium tuberculosis H37Rv
ccgcgccgcggcccgcucca

SEQ ID NO: 1370133 - RNA, 14 nt, Mycobacterium tuberculosis H37Rv
ccgcgccgccagcg

SEQ ID NO: 1370134 - RNA, 16 nt, Mycobacterium tuberculosis H37Rv
ccgcgccgccccgcuc

SEQ ID NO: 1370135 - RNA, 22 nt, Mycobacterium tuberculosis H37Rv
ccgcgccgcccgcuccuccggc

SEQ ID NO: 1370136 - RNA, 18 nt, Mycobacterium tuberculosis H37Rv
ccgcgccgacgccgcgga

SEQ ID NO: 1370137 - RNA, 20 nt, Mycobacterium tuberculosis H37Rv
ccgcgccaguggccaccauc

SEQ ID NO: 1370138 - RNA, 13 nt, Mycobacterium tuberculosis H37Rv
ccgcgccaguggc

SEQ ID NO: 1370139 - RNA, 13 nt, Mycobacterium tuberculosis H37Rv
ccgcgcccacccc

SEQ ID NO: 1370140 - RNA, 12 nt, Mycobacterium tuberculosis H37Rv
ccgcgcccggcg

SEQ ID NO: 1370141 - RNA, 16 nt, Mycobacterium tuberculosis H37Rv
ccgcgcccuucagcac

SEQ ID NO: 1370142 - RNA, 15 nt, Mycobacterium tuberculosis H37Rv
ccgcgcccgccgcgg

SEQ ID NO: 1370143 - RNA, 23 nt, Mycobacterium tuberculosis H37Rv
ccgcgcgagagccuccauggccu

SEQ ID NO: 1370144 - RNA, 20 nt, Mycobacterium tuberculosis H37Rv
ccgcgcgcacggcgucggcc

SEQ ID NO: 1370145 - RNA, 11 nt, Mycobacterium tuberculosis H37Rv
ccgcgcgcaga

SEQ ID NO: 1370146 - RNA, 21 nt, Mycobacterium tuberculosis H37Rv
ccgcgcgcaucgcgccuuuga

SEQ ID NO: 1370147 - RNA, 19 nt, Mycobacterium tuberculosis H37Rv
ccgcgcgccggcgacccgg

SEQ ID NO: 1370148 - RNA, 18 nt, Mycobacterium tuberculosis H37Rv
ccgcgcgaccugaaugcg

SEQ ID NO: 1370149 - RNA, 21 nt, Mycobacterium tuberculosis H37Rv
ccgcgcgacgccguccucgcu

SEQ ID NO: 1370150 - RNA, 17 nt, Mycobacterium tuberculosis H37Rv
ccgcgcgacaacccggc

SEQ ID NO: 1370151 - RNA, 15 nt, Mycobacterium tuberculosis H37Rv
ccgcgcgacaggccc

SEQ ID NO: 1370152 - RNA, 15 nt, Mycobacterium tuberculosis H37Rv
ccgcgccugccucac

SEQ ID NO: 1370153 - RNA, 17 nt, Mycobacterium tuberculosis H37Rv
ccgcgccugccucaccg

SEQ ID NO: 1370154 - RNA, 13 nt, Mycobacterium tuberculosis H37Rv
aaacccugcugcg

SEQ ID NO: 1370155 - RNA, 15 nt, Mycobacterium tuberculosis H37Rv
aaacccugcacccga

SEQ ID NO: 1370156 - RNA, 14 nt, Mycobacterium tuberculosis H37Rv
ccgcgcggcgugcu

SEQ ID NO: 1370157 - RNA, 14 nt, Mycobacterium tuberculosis H37Rv
ccgcgcggcggcgc

SEQ ID NO: 1370158 - RNA, 19 nt, Mycobacterium tuberculosis H37Rv
ccgcgcggcgagagccucg

SEQ ID NO: 1370159 - RNA, 12 nt, Mycobacterium tuberculosis H37Rv
ccgcgcggcagg

SEQ ID NO: 1370160 - RNA, 23 nt, Mycobacterium tuberculosis H37Rv
ccgcgcggugauggucaccgucu

SEQ ID NO: 1370161 - RNA, 20 nt, Mycobacterium tuberculosis H37Rv
ccgcgcgguacugcgcagcg

SEQ ID NO: 1370162 - RNA, 19 nt, Mycobacterium tuberculosis H37Rv
ccgcgcgguacugcgcagc

SEQ ID NO: 1370163 - RNA, 18 nt, Mycobacterium tuberculosis H37Rv
ccgcgcgguacugcgcag

SEQ ID NO: 1370164 - RNA, 22 nt, Mycobacterium tuberculosis H37Rv
ccgcgcggugcccugccggcag

SEQ ID NO: 1370165 - RNA, 20 nt, Mycobacterium tuberculosis H37Rv
ccgcgcggugcccugccggc

SEQ ID NO: 1370166 - RNA, 15 nt, Mycobacterium tuberculosis H37Rv
ccgcgcucagcuccg

SEQ ID NO: 1370167 - RNA, 18 nt, Mycobacterium tuberculosis H37Rv
ccgcgcucgaacuccccg

SEQ ID NO: 1370168 - RNA, 17 nt, Mycobacterium tuberculosis H37Rv
ccgcgcucccggcgucu

SEQ ID NO: 1370169 - RNA, 14 nt, Mycobacterium tuberculosis H37Rv
ccgcgcucucgguc

SEQ ID NO: 1370170 - RNA, 16 nt, Mycobacterium tuberculosis H37Rv
aaaccgaggauguggu

SEQ ID NO: 1370171 - RNA, 17 nt, Mycobacterium tuberculosis H37Rv
aaaccgcagucgcggca

SEQ ID NO: 1370172 - RNA, 20 nt, Mycobacterium tuberculosis H37Rv
ccgcgcgggaaacguuccag

SEQ ID NO: 1370173 - RNA, 15 nt, Mycobacterium tuberculosis H37Rv
ccgcgcgggccgccg

SEQ ID NO: 1370174 - RNA, 16 nt, Mycobacterium tuberculosis H37Rv
ccgcggcaacaccacc

SEQ ID NO: 1370175 - RNA, 14 nt, Mycobacterium tuberculosis H37Rv
ccgcggcacccggc

SEQ ID NO: 1370176 - RNA, 23 nt, Mycobacterium tuberculosis H37Rv
ccgcggauaggccgcgcggcggc

SEQ ID NO: 1370177 - RNA, 23 nt, Mycobacterium tuberculosis H37Rv
ccgcggaucaccaucgccgccgc

SEQ ID NO: 1370178 - RNA, 22 nt, Mycobacterium tuberculosis H37Rv
ccgcggaucauccuucgccggc

SEQ ID NO: 1370179 - RNA, 21 nt, Mycobacterium tuberculosis H37Rv
ccgcggaucauccuucgccgg

SEQ ID NO: 1370180 - RNA, 12 nt, Mycobacterium tuberculosis H37Rv
ccgcggcacgcu

SEQ ID NO: 1370181 - RNA, 19 nt, Mycobacterium tuberculosis H37Rv
ccgcggccaccgccgccgc

SEQ ID NO: 1370182 - RNA, 16 nt, Mycobacterium tuberculosis H37Rv
ccgcggccaccgccug

SEQ ID NO: 1370183 - RNA, 15 nt, Mycobacterium tuberculosis H37Rv
ccgcggccagcagca

SEQ ID NO: 1370184 - RNA, 18 nt, Mycobacterium tuberculosis H37Rv
ccgcggccaccgccgccg

SEQ ID NO: 1370185 - RNA, 21 nt, Mycobacterium tuberculosis H37Rv
ccgcggcgaaccagcgcgucu

SEQ ID NO: 1370186 - RNA, 13 nt, Mycobacterium tuberculosis H37Rv
ccgcggccccgcc

SEQ ID NO: 1370187 - RNA, 15 nt, Mycobacterium tuberculosis H37Rv
ccgcgcuggucagcc

SEQ ID NO: 1370188 - RNA, 23 nt, Mycobacterium tuberculosis H37Rv
ccgcgcuggucagccgugccgug

SEQ ID NO: 1370189 - RNA, 19 nt, Mycobacterium tuberculosis H37Rv
ccgcgcuugcgaucgccgc

SEQ ID NO: 1370190 - RNA, 16 nt, Mycobacterium tuberculosis H37Rv
ccgcggaaggccagcu

SEQ ID NO: 1370191 - RNA, 15 nt, Mycobacterium tuberculosis H37Rv
ccgcggaaggccagc

SEQ ID NO: 1370192 - RNA, 16 nt, Mycobacterium tuberculosis H37Rv
ccgcggacccgcagcu

SEQ ID NO: 1370193 - RNA, 17 nt, Mycobacterium tuberculosis H37Rv
ccgcggacuuggcgguc

SEQ ID NO: 1370194 - RNA, 19 nt, Mycobacterium tuberculosis H37Rv
ccgcggacguggucggagc

SEQ ID NO: 1370195 - RNA, 19 nt, Mycobacterium tuberculosis H37Rv
ccgcggacucgggcaggcc

SEQ ID NO: 1370196 - RNA, 12 nt, Mycobacterium tuberculosis H37Rv
ccgcggagcgca

SEQ ID NO: 1370197 - RNA, 22 nt, Mycobacterium tuberculosis H37Rv
ccgcggacucgggcaggcccca

SEQ ID NO: 1370198 - RNA, 21 nt, Mycobacterium tuberculosis H37Rv
ccgcggaggcggccagccuac

SEQ ID NO: 1370199 - RNA, 22 nt, Mycobacterium tuberculosis H37Rv
ccgcggaguaggccgcgcccga

SEQ ID NO: 1370200 - RNA, 15 nt, Mycobacterium tuberculosis H37Rv
ccgcgucggcguucu

SEQ ID NO: 1370201 - RNA, 15 nt, Mycobacterium tuberculosis H37Rv
ccgcgucgggccgca

SEQ ID NO: 1370202 - RNA, 16 nt, Mycobacterium tuberculosis H37Rv
ccgcgucuaccaaccg

SEQ ID NO: 1370203 - RNA, 20 nt, Mycobacterium tuberculosis H37Rv
ccgcgucggccgaacaaccu

SEQ ID NO: 1370204 - RNA, 12 nt, Mycobacterium tuberculosis H37Rv
ccgcgucggcgg

SEQ ID NO: 1370205 - RNA, 14 nt, Mycobacterium tuberculosis H37Rv
ccgcgucgucgaga

SEQ ID NO: 1370206 - RNA, 20 nt, Mycobacterium tuberculosis H37Rv
ccgcgugcaccgagccgucg

SEQ ID NO: 1370207 - RNA, 23 nt, Mycobacterium tuberculosis H37Rv
ccgcgucacggaccuggaacugc

SEQ ID NO: 1370208 - RNA, 22 nt, Mycobacterium tuberculosis H37Rv
ccgcgucgaacugggcgcccgc

SEQ ID NO: 1370209 - RNA, 15 nt, Mycobacterium tuberculosis H37Rv
ccgcgucgaacuggg

SEQ ID NO: 1370210 - RNA, 19 nt, Mycobacterium tuberculosis H37Rv
ccgcguccuuuuccgccgg

SEQ ID NO: 1370211 - RNA, 15 nt, Mycobacterium tuberculosis H37Rv
ccgcgucgccggccu

SEQ ID NO: 1370212 - RNA, 20 nt, Mycobacterium tuberculosis H37Rv
ccgcguagugguggaagugu

SEQ ID NO: 1370213 - RNA, 22 nt, Mycobacterium tuberculosis H37Rv
ccgcgucaccggaggccgccgc

SEQ ID NO: 1370214 - RNA, 12 nt, Mycobacterium tuberculosis H37Rv
ccgcgucaccgg

SEQ ID NO: 1370215 - RNA, 20 nt, Mycobacterium tuberculosis H37Rv
ccgcgucaccggaggccgcc

SEQ ID NO: 1370216 - RNA, 15 nt, Mycobacterium tuberculosis H37Rv
ccgcguagagcagca

SEQ ID NO: 1370217 - RNA, 17 nt, Mycobacterium tuberculosis H37Rv
ccgcgguuggcaguggc

SEQ ID NO: 1370218 - RNA, 22 nt, Mycobacterium tuberculosis H37Rv
ccgcgguuggcaguggcgcggc

SEQ ID NO: 1370219 - RNA, 17 nt, Mycobacterium tuberculosis H37Rv
ccgcggugacggcggcu

SEQ ID NO: 1370220 - RNA, 15 nt, Mycobacterium tuberculosis H37Rv
ccgcggucuucuuca

SEQ ID NO: 1370221 - RNA, 20 nt, Mycobacterium tuberculosis H37Rv
ccgcggugaccaccccggcc

SEQ ID NO: 1370222 - RNA, 13 nt, Mycobacterium tuberculosis H37Rv
ccgcggucugcgc

SEQ ID NO: 1370223 - RNA, 23 nt, Mycobacterium tuberculosis H37Rv
ccgcggucucagugcucgcccag

SEQ ID NO: 1370224 - RNA, 13 nt, Mycobacterium tuberculosis H37Rv
ccgcggcggcccc

SEQ ID NO: 1370225 - RNA, 14 nt, Mycobacterium tuberculosis H37Rv
ccgcggcggcagcg

SEQ ID NO: 1370226 - RNA, 14 nt, Mycobacterium tuberculosis H37Rv
ccgcggcgcggaga

SEQ ID NO: 1370227 - RNA, 18 nt, Mycobacterium tuberculosis H37Rv
ccgcggcgccggugggcg

SEQ ID NO: 1370228 - RNA, 20 nt, Mycobacterium tuberculosis H37Rv
ccgcggcgccguugccgccg

SEQ ID NO: 1370229 - RNA, 17 nt, Mycobacterium tuberculosis H37Rv
ccgcggcgucgccgugc

SEQ ID NO: 1370230 - RNA, 16 nt, Mycobacterium tuberculosis H37Rv
ccgcggcgucgugaga

SEQ ID NO: 1370231 - RNA, 20 nt, Mycobacterium tuberculosis H37Rv
ccgcggcgcugaugccgucu

SEQ ID NO: 1370232 - RNA, 13 nt, Mycobacterium tuberculosis H37Rv
ccgcggcgccgcc

SEQ ID NO: 1370233 - RNA, 23 nt, Mycobacterium tuberculosis H37Rv
ccgcggccucguagucccacugc

SEQ ID NO: 1370234 - RNA, 15 nt, Mycobacterium tuberculosis H37Rv
ccgcggcgaagcaag

SEQ ID NO: 1370235 - RNA, 14 nt, Mycobacterium tuberculosis H37Rv
ccgcggcgaagaua

SEQ ID NO: 1370236 - RNA, 16 nt, Mycobacterium tuberculosis H37Rv
ccgcggcgccacccgc

SEQ ID NO: 1370237 - RNA, 19 nt, Mycobacterium tuberculosis H37Rv
ccgcggcgccacccgcgcc

SEQ ID NO: 1370238 - RNA, 17 nt, Mycobacterium tuberculosis H37Rv
ccgcgggcggaggccgc

SEQ ID NO: 1370239 - RNA, 14 nt, Mycobacterium tuberculosis H37Rv
ccgcgggcggcauc

SEQ ID NO: 1370240 - RNA, 14 nt, Mycobacterium tuberculosis H37Rv
ccgcgggcguugcu

SEQ ID NO: 1370241 - RNA, 21 nt, Mycobacterium tuberculosis H37Rv
ccgcgggaucgguggcggcac

SEQ ID NO: 1370242 - RNA, 20 nt, Mycobacterium tuberculosis H37Rv
ccgcgggacaucaccgcagc

SEQ ID NO: 1370243 - RNA, 17 nt, Mycobacterium tuberculosis H37Rv
ccgcggcugccaucccg

SEQ ID NO: 1370244 - RNA, 15 nt, Mycobacterium tuberculosis H37Rv
ccgcgggccagcacc

SEQ ID NO: 1370245 - RNA, 13 nt, Mycobacterium tuberculosis H37Rv
ccgcgggccgcca

SEQ ID NO: 1370246 - RNA, 18 nt, Mycobacterium tuberculosis H37Rv
ccgcgguaauggcgugca

SEQ ID NO: 1370247 - RNA, 15 nt, Mycobacterium tuberculosis H37Rv
ccgcgguacccaccu

SEQ ID NO: 1370248 - RNA, 19 nt, Mycobacterium tuberculosis H37Rv
ccgcgguacccaccucccg

SEQ ID NO: 1370249 - RNA, 15 nt, Mycobacterium tuberculosis H37Rv
ccgcggucagcucgg

SEQ ID NO: 1370250 - RNA, 18 nt, Mycobacterium tuberculosis H37Rv
ccgcggucagcucggcag

SEQ ID NO: 1370251 - RNA, 17 nt, Mycobacterium tuberculosis H37Rv
ccgcgguaggugcaugu

SEQ ID NO: 1370252 - RNA, 13 nt, Mycobacterium tuberculosis H37Rv
ccgcuaccccagc

SEQ ID NO: 1370253 - RNA, 12 nt, Mycobacterium tuberculosis H37Rv
ccgcuacccccg

SEQ ID NO: 1370254 - RNA, 16 nt, Mycobacterium tuberculosis H37Rv
ccgcuaccagcugggc

SEQ ID NO: 1370255 - RNA, 17 nt, Mycobacterium tuberculosis H37Rv
ccgcuaccgcccgcgcc

SEQ ID NO: 1370256 - RNA, 13 nt, Mycobacterium tuberculosis H37Rv
ccgcuaccgcaca

SEQ ID NO: 1370257 - RNA, 14 nt, Mycobacterium tuberculosis H37Rv
ccgcuacgccggcc

SEQ ID NO: 1370258 - RNA, 13 nt, Mycobacterium tuberculosis H37Rv
ccgcuacgcgcgc

SEQ ID NO: 1370259 - RNA, 21 nt, Mycobacterium tuberculosis H37Rv
ccgcuacgcgcgcucgcucac

SEQ ID NO: 1370260 - RNA, 20 nt, Mycobacterium tuberculosis H37Rv
ccgcuagcgcuugcgacccc

SEQ ID NO: 1370261 - RNA, 15 nt, Mycobacterium tuberculosis H37Rv
ccgcuaggacggcgc

SEQ ID NO: 1370262 - RNA, 16 nt, Mycobacterium tuberculosis H37Rv
ccgcuaggucagguga

SEQ ID NO: 1370263 - RNA, 21 nt, Mycobacterium tuberculosis H37Rv
ccgcuaggugacgccgccagc

SEQ ID NO: 1370264 - RNA, 19 nt, Mycobacterium tuberculosis H37Rv
ccgcuaggugacgccgcca

SEQ ID NO: 1370265 - RNA, 22 nt, Mycobacterium tuberculosis H37Rv
ccgcuacucgugaagugcuuug

SEQ ID NO: 1370266 - RNA, 22 nt, Mycobacterium tuberculosis H37Rv
ccgcuaacuggcccggacaugc

SEQ ID NO: 1370267 - RNA, 16 nt, Mycobacterium tuberculosis H37Rv
ccgcuacaccugcggc

SEQ ID NO: 1370268 - RNA, 20 nt, Mycobacterium tuberculosis H37Rv
ccgcguggugcugaccgcgc

SEQ ID NO: 1370269 - RNA, 16 nt, Mycobacterium tuberculosis H37Rv
ccgcgugcgucagcgc

SEQ ID NO: 1370270 - RNA, 22 nt, Mycobacterium tuberculosis H37Rv
ccgcguugaugaccgccgccgg

SEQ ID NO: 1370271 - RNA, 13 nt, Mycobacterium tuberculosis H37Rv
ccgcguugccaaa

SEQ ID NO: 1370272 - RNA, 16 nt, Mycobacterium tuberculosis H37Rv
ccgcguugaaggcgcc

SEQ ID NO: 1370273 - RNA, 22 nt, Mycobacterium tuberculosis H37Rv
ccgcucgacggcccgccguccg

SEQ ID NO: 1370274 - RNA, 16 nt, Mycobacterium tuberculosis H37Rv
ccgcucgacggcccgc

SEQ ID NO: 1370275 - RNA, 19 nt, Mycobacterium tuberculosis H37Rv
ccgcucgaucggcagccag

SEQ ID NO: 1370276 - RNA, 15 nt, Mycobacterium tuberculosis H37Rv
ccgcucgcccgccgc

SEQ ID NO: 1370277 - RNA, 18 nt, Mycobacterium tuberculosis H37Rv
ccgcucgcaggccggcgg

SEQ ID NO: 1370278 - RNA, 12 nt, Mycobacterium tuberculosis H37Rv
ccgcucccccgc

SEQ ID NO: 1370279 - RNA, 21 nt, Mycobacterium tuberculosis H37Rv
ccgcuccacguacgcggcugc

SEQ ID NO: 1370280 - RNA, 21 nt, Mycobacterium tuberculosis H37Rv
ccgcucacauacagcaggccg

SEQ ID NO: 1370281 - RNA, 14 nt, Mycobacterium tuberculosis H37Rv
ccgcucacccgccc

SEQ ID NO: 1370282 - RNA, 20 nt, Mycobacterium tuberculosis H37Rv
ccgcucaccccgcgcuccuc

SEQ ID NO: 1370283 - RNA, 13 nt, Mycobacterium tuberculosis H37Rv
ccgcucacccgcc

SEQ ID NO: 1370284 - RNA, 18 nt, Mycobacterium tuberculosis H37Rv
ccgcucacgcucacccgg

SEQ ID NO: 1370285 - RNA, 14 nt, Mycobacterium tuberculosis H37Rv
ccgcucacgcucac

SEQ ID NO: 1370286 - RNA, 15 nt, Mycobacterium tuberculosis H37Rv
ccgcucagcgcagca

SEQ ID NO: 1370287 - RNA, 17 nt, Mycobacterium tuberculosis H37Rv
ccgcucauccagcgcgu

SEQ ID NO: 1370288 - RNA, 17 nt, Mycobacterium tuberculosis H37Rv
ccgcucagggugcgccg

SEQ ID NO: 1370289 - RNA, 19 nt, Mycobacterium tuberculosis H37Rv
ccgcucagggugcgccgca

SEQ ID NO: 1370290 - RNA, 22 nt, Mycobacterium tuberculosis H37Rv
ccgcuccaaaagccucagccgc

SEQ ID NO: 1370291 - RNA, 13 nt, Mycobacterium tuberculosis H37Rv
ccggaaagcucuc

SEQ ID NO: 1370292 - RNA, 19 nt, Mycobacterium tuberculosis H37Rv
ccggaaagcccgucgucgg

SEQ ID NO: 1370293 - RNA, 17 nt, Mycobacterium tuberculosis H37Rv
ccggaaagaucucgguc

SEQ ID NO: 1370294 - RNA, 14 nt, Mycobacterium tuberculosis H37Rv
ccgcuuggcgcggc

SEQ ID NO: 1370295 - RNA, 14 nt, Mycobacterium tuberculosis H37Rv
ccgcuuggcgugac

SEQ ID NO: 1370296 - RNA, 14 nt, Mycobacterium tuberculosis H37Rv
ccggaacccccagc

SEQ ID NO: 1370297 - RNA, 22 nt, Mycobacterium tuberculosis H37Rv
ccggaaccggcgugcagcacuu

SEQ ID NO: 1370298 - RNA, 16 nt, Mycobacterium tuberculosis H37Rv
ccggaaccggcgugca

SEQ ID NO: 1370299 - RNA, 15 nt, Mycobacterium tuberculosis H37Rv
ccggaaaggccgcgg

SEQ ID NO: 1370300 - RNA, 20 nt, Mycobacterium tuberculosis H37Rv
ccgcuggucgagcagugccu

SEQ ID NO: 1370301 - RNA, 16 nt, Mycobacterium tuberculosis H37Rv
ccgcuggggcgcccga

SEQ ID NO: 1370302 - RNA, 12 nt, Mycobacterium tuberculosis H37Rv
ccgcugggccgg

SEQ ID NO: 1370303 - RNA, 20 nt, Mycobacterium tuberculosis H37Rv
ccgcugguggucagcaccca

SEQ ID NO: 1370304 - RNA, 23 nt, Mycobacterium tuberculosis H37Rv
ccgcuggugugucccggggugaa

SEQ ID NO: 1370305 - RNA, 22 nt, Mycobacterium tuberculosis H37Rv
ccgcuugaccccuggccgccgg

SEQ ID NO: 1370306 - RNA, 14 nt, Mycobacterium tuberculosis H37Rv
ccgcuugccccgcc

SEQ ID NO: 1370307 - RNA, 20 nt, Mycobacterium tuberculosis H37Rv
ccgcuugccggacaacugga

SEQ ID NO: 1370308 - RNA, 21 nt, Mycobacterium tuberculosis H37Rv
ccggacggggaggucaaaauc

SEQ ID NO: 1370309 - RNA, 16 nt, Mycobacterium tuberculosis H37Rv
ccggaaugcccgagca

SEQ ID NO: 1370310 - RNA, 18 nt, Mycobacterium tuberculosis H37Rv
ccggaauccgggccgccg

SEQ ID NO: 1370311 - RNA, 20 nt, Mycobacterium tuberculosis H37Rv
ccggaacgagcggccgcgcg

SEQ ID NO: 1370312 - RNA, 21 nt, Mycobacterium tuberculosis H37Rv
ccggaacuguggugccugcgg

SEQ ID NO: 1370313 - RNA, 23 nt, Mycobacterium tuberculosis H37Rv
ccggaaguugaucuugccgcccu

SEQ ID NO: 1370314 - RNA, 20 nt, Mycobacterium tuberculosis H37Rv
ccggaauacccgcuggcccg

SEQ ID NO: 1370315 - RNA, 21 nt, Mycobacterium tuberculosis H37Rv
ccggaagcgccggccgaucgg

SEQ ID NO: 1370316 - RNA, 22 nt, Mycobacterium tuberculosis H37Rv
ccggagaugaucaugugguggc

SEQ ID NO: 1370317 - RNA, 21 nt, Mycobacterium tuberculosis H37Rv
ccggagauguaguccucggug

SEQ ID NO: 1370318 - RNA, 14 nt, Mycobacterium tuberculosis H37Rv
ccggagacucucug

SEQ ID NO: 1370319 - RNA, 17 nt, Mycobacterium tuberculosis H37Rv
ccggagccgccggcccc

SEQ ID NO: 1370320 - RNA, 13 nt, Mycobacterium tuberculosis H37Rv
ccggagccgccgg

SEQ ID NO: 1370321 - RNA, 16 nt, Mycobacterium tuberculosis H37Rv
ccggacguucuggauc

SEQ ID NO: 1370322 - RNA, 14 nt, Mycobacterium tuberculosis H37Rv
ccggacgucggcgg

SEQ ID NO: 1370323 - RNA, 17 nt, Mycobacterium tuberculosis H37Rv
ccggagacccgggugcu

SEQ ID NO: 1370324 - RNA, 15 nt, Mycobacterium tuberculosis H37Rv
ccggacguucuggau

SEQ ID NO: 1370325 - RNA, 21 nt, Mycobacterium tuberculosis H37Rv
ccggacuccaaagccgugcca

SEQ ID NO: 1370326 - RNA, 15 nt, Mycobacterium tuberculosis H37Rv
ccggacugaagccgc

SEQ ID NO: 1370327 - RNA, 13 nt, Mycobacterium tuberculosis H37Rv
ccgcugagccccc

SEQ ID NO: 1370328 - RNA, 18 nt, Mycobacterium tuberculosis H37Rv
ccgcugagccccccgagc

SEQ ID NO: 1370329 - RNA, 16 nt, Mycobacterium tuberculosis H37Rv
ccgcugagcccugcgc

SEQ ID NO: 1370330 - RNA, 17 nt, Mycobacterium tuberculosis H37Rv
ccgcugaugagccgcag

SEQ ID NO: 1370331 - RNA, 15 nt, Mycobacterium tuberculosis H37Rv
ccgcugaucugccgc

SEQ ID NO: 1370332 - RNA, 16 nt, Mycobacterium tuberculosis H37Rv
ccgcugaugagccgca

SEQ ID NO: 1370333 - RNA, 20 nt, Mycobacterium tuberculosis H37Rv
ccgcugagguaauucgcggc

SEQ ID NO: 1370334 - RNA, 18 nt, Mycobacterium tuberculosis H37Rv
ccgcugccauugccuggg

SEQ ID NO: 1370335 - RNA, 15 nt, Mycobacterium tuberculosis H37Rv
ccgcugccaucgccu

SEQ ID NO: 1370336 - RNA, 23 nt, Mycobacterium tuberculosis H37Rv
ccgcugccaugcgggugucgggc

SEQ ID NO: 1370337 - RNA, 21 nt, Mycobacterium tuberculosis H37Rv
ccgcugcagugguaccggcgc

SEQ ID NO: 1370338 - RNA, 21 nt, Mycobacterium tuberculosis H37Rv
ccgcugcagacgccccuuccc

SEQ ID NO: 1370339 - RNA, 13 nt, Mycobacterium tuberculosis H37Rv
ccgcugaccccgg

SEQ ID NO: 1370340 - RNA, 20 nt, Mycobacterium tuberculosis H37Rv
ccgcugaccccggcagcgcc

SEQ ID NO: 1370341 - RNA, 20 nt, Mycobacterium tuberculosis H37Rv
ccgcucuucgacaucugagc

SEQ ID NO: 1370342 - RNA, 14 nt, Mycobacterium tuberculosis H37Rv
ccgcucggccgccg

SEQ ID NO: 1370343 - RNA, 15 nt, Mycobacterium tuberculosis H37Rv
ccgcucggccgccgg

SEQ ID NO: 1370344 - RNA, 19 nt, Mycobacterium tuberculosis H37Rv
ccgcucgucgccgguggca

SEQ ID NO: 1370345 - RNA, 19 nt, Mycobacterium tuberculosis H37Rv
ccgcugccgguagcacagc

SEQ ID NO: 1370346 - RNA, 19 nt, Mycobacterium tuberculosis H37Rv
ccgcugccggugucucccu

SEQ ID NO: 1370347 - RNA, 22 nt, Mycobacterium tuberculosis H37Rv
ccgcugccuucuuugccggcgc

SEQ ID NO: 1370348 - RNA, 14 nt, Mycobacterium tuberculosis H37Rv
ccgcugccgcccgc

SEQ ID NO: 1370349 - RNA, 13 nt, Mycobacterium tuberculosis H37Rv
ccgcugccgcccu

SEQ ID NO: 1370350 - RNA, 22 nt, Mycobacterium tuberculosis H37Rv
ccgcugccgcccuugccgcccg

SEQ ID NO: 1370351 - RNA, 13 nt, Mycobacterium tuberculosis H37Rv
ccgcugccgccgg

SEQ ID NO: 1370352 - RNA, 18 nt, Mycobacterium tuberculosis H37Rv
ccgcugccuuggcgcggc

SEQ ID NO: 1370353 - RNA, 20 nt, Mycobacterium tuberculosis H37Rv
ccgcugccuuggcgcggcac

SEQ ID NO: 1370354 - RNA, 13 nt, Mycobacterium tuberculosis H37Rv
ccgcuggcccgcc

SEQ ID NO: 1370355 - RNA, 23 nt, Mycobacterium tuberculosis H37Rv
ccgcuggccguauaggcccgggc

SEQ ID NO: 1370356 - RNA, 12 nt, Mycobacterium tuberculosis H37Rv
ccggccaccacg

SEQ ID NO: 1370357 - RNA, 12 nt, Mycobacterium tuberculosis H37Rv
ccggccaccagc

SEQ ID NO: 1370358 - RNA, 19 nt, Mycobacterium tuberculosis H37Rv
ccggccaauggccugcagc

SEQ ID NO: 1370359 - RNA, 19 nt, Mycobacterium tuberculosis H37Rv
ccggccaacugggccgagc

SEQ ID NO: 1370360 - RNA, 14 nt, Mycobacterium tuberculosis H37Rv
ccggccaacugggc

SEQ ID NO: 1370361 - RNA, 14 nt, Mycobacterium tuberculosis H37Rv
ccggauacagccac

SEQ ID NO: 1370362 - RNA, 20 nt, Mycobacterium tuberculosis H37Rv
ccggccaccagggccaccgc

SEQ ID NO: 1370363 - RNA, 14 nt, Mycobacterium tuberculosis H37Rv
ccggccaccaccgc

SEQ ID NO: 1370364 - RNA, 21 nt, Mycobacterium tuberculosis H37Rv
ccggccacuacggccuggcca

SEQ ID NO: 1370365 - RNA, 15 nt, Mycobacterium tuberculosis H37Rv
ccggccacgaccucg

SEQ ID NO: 1370366 - RNA, 20 nt, Mycobacterium tuberculosis H37Rv
ccggccauucuuggugaucg

SEQ ID NO: 1370367 - RNA, 21 nt, Mycobacterium tuberculosis H37Rv
ccggccaugccuucggugccg

SEQ ID NO: 1370368 - RNA, 18 nt, Mycobacterium tuberculosis H37Rv
ccggaguuuaagacgccc

SEQ ID NO: 1370369 - RNA, 14 nt, Mycobacterium tuberculosis H37Rv
ccggauaacccagc

SEQ ID NO: 1370370 - RNA, 21 nt, Mycobacterium tuberculosis H37Rv
ccggaguugguguuauugaug

SEQ ID NO: 1370371 - RNA, 15 nt, Mycobacterium tuberculosis H37Rv
ccggaguugaagaag

SEQ ID NO: 1370372 - RNA, 19 nt, Mycobacterium tuberculosis H37Rv
ccggaggaucgcugguugg

SEQ ID NO: 1370373 - RNA, 18 nt, Mycobacterium tuberculosis H37Rv
ccggagggguuagguugu

SEQ ID NO: 1370374 - RNA, 13 nt, Mycobacterium tuberculosis H37Rv
ccggaggucgggc

SEQ ID NO: 1370375 - RNA, 13 nt, Mycobacterium tuberculosis H37Rv
ccggagucggcgu

SEQ ID NO: 1370376 - RNA, 14 nt, Mycobacterium tuberculosis H37Rv
ccggaggcaagcaa

SEQ ID NO: 1370377 - RNA, 21 nt, Mycobacterium tuberculosis H37Rv
ccggaggcaauccgaucugga

SEQ ID NO: 1370378 - RNA, 15 nt, Mycobacterium tuberculosis H37Rv
ccggagcggucagcg

SEQ ID NO: 1370379 - RNA, 21 nt, Mycobacterium tuberculosis H37Rv
ccggagcgccgagcucggcgc

SEQ ID NO: 1370380 - RNA, 19 nt, Mycobacterium tuberculosis H37Rv
ccggagcuuguugcagcgg

SEQ ID NO: 1370381 - RNA, 14 nt, Mycobacterium tuberculosis H37Rv
ccggccucgccgaa

SEQ ID NO: 1370382 - RNA, 15 nt, Mycobacterium tuberculosis H37Rv
ccggccucgccgaag

SEQ ID NO: 1370383 - RNA, 22 nt, Mycobacterium tuberculosis H37Rv
ccggccugcgcgaccgaccagc

SEQ ID NO: 1370384 - RNA, 23 nt, Mycobacterium tuberculosis H37Rv
ccggccugcgcgaccgaccagcc

SEQ ID NO: 1370385 - RNA, 18 nt, Mycobacterium tuberculosis H37Rv
ccggccgcggcggccccg

SEQ ID NO: 1370386 - RNA, 23 nt, Mycobacterium tuberculosis H37Rv
ccggccgcgcacccguccgccgc

SEQ ID NO: 1370387 - RNA, 13 nt, Mycobacterium tuberculosis H37Rv
ccggccgccgaga

SEQ ID NO: 1370388 - RNA, 17 nt, Mycobacterium tuberculosis H37Rv
ccggccgcucaccccgc

SEQ ID NO: 1370389 - RNA, 18 nt, Mycobacterium tuberculosis H37Rv
ccggccggaacgcccggc

SEQ ID NO: 1370390 - RNA, 19 nt, Mycobacterium tuberculosis H37Rv
ccggccggaacgcccggcu

SEQ ID NO: 1370391 - RNA, 15 nt, Mycobacterium tuberculosis H37Rv
ccggcccaccaggcc

SEQ ID NO: 1370392 - RNA, 13 nt, Mycobacterium tuberculosis H37Rv
ccggcccaccgcc

SEQ ID NO: 1370393 - RNA, 21 nt, Mycobacterium tuberculosis H37Rv
ccggcccaaggaacggcgucg

SEQ ID NO: 1370394 - RNA, 13 nt, Mycobacterium tuberculosis H37Rv
ccggcccaccagc

SEQ ID NO: 1370395 - RNA, 21 nt, Mycobacterium tuberculosis H37Rv
ccggccauugcgggcucaaca

SEQ ID NO: 1370396 - RNA, 16 nt, Mycobacterium tuberculosis H37Rv
ccggccaucgcccgau

SEQ ID NO: 1370397 - RNA, 14 nt, Mycobacterium tuberculosis H37Rv
ccggccccaccggc

SEQ ID NO: 1370398 - RNA, 14 nt, Mycobacterium tuberculosis H37Rv
ccggccccaccggu

SEQ ID NO: 1370399 - RNA, 16 nt, Mycobacterium tuberculosis H37Rv
ccggccgagcgcacug

SEQ ID NO: 1370400 - RNA, 18 nt, Mycobacterium tuberculosis H37Rv
ccggccccgccggccccg

SEQ ID NO: 1370401 - RNA, 13 nt, Mycobacterium tuberculosis H37Rv
ccggccgacccgg

SEQ ID NO: 1370402 - RNA, 16 nt, Mycobacterium tuberculosis H37Rv
ccggccccgccggccc

SEQ ID NO: 1370403 - RNA, 19 nt, Mycobacterium tuberculosis H37Rv
ccggccccccgacuccggc

SEQ ID NO: 1370404 - RNA, 14 nt, Mycobacterium tuberculosis H37Rv
ccggccccgccggc

SEQ ID NO: 1370405 - RNA, 15 nt, Mycobacterium tuberculosis H37Rv
ccggcgacccgggua

SEQ ID NO: 1370406 - RNA, 22 nt, Mycobacterium tuberculosis H37Rv
ccggcgacgauauagggcuccu

SEQ ID NO: 1370407 - RNA, 23 nt, Mycobacterium tuberculosis H37Rv
ccggcgacgacccgggucggcac

SEQ ID NO: 1370408 - RNA, 13 nt, Mycobacterium tuberculosis H37Rv
ccggcgccaccgc

SEQ ID NO: 1370409 - RNA, 21 nt, Mycobacterium tuberculosis H37Rv
ccggcgcaguagccgaccagg

SEQ ID NO: 1370410 - RNA, 19 nt, Mycobacterium tuberculosis H37Rv
ccggcgcauaccggcgucg

SEQ ID NO: 1370411 - RNA, 20 nt, Mycobacterium tuberculosis H37Rv
ccggcgccaccggcgccgcc

SEQ ID NO: 1370412 - RNA, 17 nt, Mycobacterium tuberculosis H37Rv
ccggcgccagcgccgcc

SEQ ID NO: 1370413 - RNA, 19 nt, Mycobacterium tuberculosis H37Rv
ccggcgccagcgccgccac

SEQ ID NO: 1370414 - RNA, 21 nt, Mycobacterium tuberculosis H37Rv
ccggcgccagcgccgccaccg

SEQ ID NO: 1370415 - RNA, 20 nt, Mycobacterium tuberculosis H37Rv
ccggcgccauucgccccacc

SEQ ID NO: 1370416 - RNA, 13 nt, Mycobacterium tuberculosis H37Rv
ccggcgccaucgg

SEQ ID NO: 1370417 - RNA, 12 nt, Mycobacterium tuberculosis H37Rv
ccggcgccgccg

SEQ ID NO: 1370418 - RNA, 20 nt, Mycobacterium tuberculosis H37Rv
ccggcgccgccggcgccgcc

SEQ ID NO: 1370419 - RNA, 14 nt, Mycobacterium tuberculosis H37Rv
ccggcgccgccagc

SEQ ID NO: 1370420 - RNA, 17 nt, Mycobacterium tuberculosis H37Rv
ccggcgccgccagcacc

SEQ ID NO: 1370421 - RNA, 16 nt, Mycobacterium tuberculosis H37Rv
ccggcgccgccacugc

SEQ ID NO: 1370422 - RNA, 17 nt, Mycobacterium tuberculosis H37Rv
ccggcgcccagcgccuc

SEQ ID NO: 1370423 - RNA, 21 nt, Mycobacterium tuberculosis H37Rv
ccggcgccgcaaucagacggc

SEQ ID NO: 1370424 - RNA, 20 nt, Mycobacterium tuberculosis H37Rv
ccggcgcugcccgggcugcc

SEQ ID NO: 1370425 - RNA, 22 nt, Mycobacterium tuberculosis H37Rv
ccggcgcuccacugaccagguc

SEQ ID NO: 1370426 - RNA, 19 nt, Mycobacterium tuberculosis H37Rv
ccggcgcuccacugaccag

SEQ ID NO: 1370427 - RNA, 16 nt, Mycobacterium tuberculosis H37Rv
ccggcgcuagcgccgc

SEQ ID NO: 1370428 - RNA, 15 nt, Mycobacterium tuberculosis H37Rv
ccggcgcggucucgg

SEQ ID NO: 1370429 - RNA, 11 nt, Mycobacterium tuberculosis H37Rv
ccggcgcggcc

SEQ ID NO: 1370430 - RNA, 17 nt, Mycobacterium tuberculosis H37Rv
ccggcgcggccggccgc

SEQ ID NO: 1370431 - RNA, 17 nt, Mycobacterium tuberculosis H37Rv
ccggcgcggagugccca

SEQ ID NO: 1370432 - RNA, 13 nt, Mycobacterium tuberculosis H37Rv
ccggcgcgccccg

SEQ ID NO: 1370433 - RNA, 15 nt, Mycobacterium tuberculosis H37Rv
ccggcgcgccccacc

SEQ ID NO: 1370434 - RNA, 13 nt, Mycobacterium tuberculosis H37Rv
ccggcgcgcccca

SEQ ID NO: 1370435 - RNA, 19 nt, Mycobacterium tuberculosis H37Rv
ccggcgcgccgggcggcgc

SEQ ID NO: 1370436 - RNA, 15 nt, Mycobacterium tuberculosis H37Rv
ccggcgcgcaccccg

SEQ ID NO: 1370437 - RNA, 14 nt, Mycobacterium tuberculosis H37Rv
ccggcgcgaucccc

SEQ ID NO: 1370438 - RNA, 17 nt, Mycobacterium tuberculosis H37Rv
ccggcgcgcaccccggc

SEQ ID NO: 1370439 - RNA, 14 nt, Mycobacterium tuberculosis H37Rv
ccggcgccuccggc

SEQ ID NO: 1370440 - RNA, 15 nt, Mycobacterium tuberculosis H37Rv
ccggcgccugcugcg

SEQ ID NO: 1370441 - RNA, 17 nt, Mycobacterium tuberculosis H37Rv
ccggcgccggugccgcc

SEQ ID NO: 1370442 - RNA, 15 nt, Mycobacterium tuberculosis H37Rv
ccggcgccggcccgc

SEQ ID NO: 1370443 - RNA, 18 nt, Mycobacterium tuberculosis H37Rv
ccggcgccucaucggaca

SEQ ID NO: 1370444 - RNA, 13 nt, Mycobacterium tuberculosis H37Rv
ccggcgccgccau

SEQ ID NO: 1370445 - RNA, 13 nt, Mycobacterium tuberculosis H37Rv
ccggcgccgcccg

SEQ ID NO: 1370446 - RNA, 15 nt, Mycobacterium tuberculosis H37Rv
ccggcgccgccgucg

SEQ ID NO: 1370447 - RNA, 12 nt, Mycobacterium tuberculosis H37Rv
ccggcgccgcgg

SEQ ID NO: 1370448 - RNA, 23 nt, Mycobacterium tuberculosis H37Rv
ccggcgccggaguugaagaagcc

SEQ ID NO: 1370449 - RNA, 14 nt, Mycobacterium tuberculosis H37Rv
ccggcgccggcccg

SEQ ID NO: 1370450 - RNA, 14 nt, Mycobacterium tuberculosis H37Rv
ccgggcggacagga

SEQ ID NO: 1370451 - RNA, 17 nt, Mycobacterium tuberculosis H37Rv
ccgggcggaacgccggc

SEQ ID NO: 1370452 - RNA, 15 nt, Mycobacterium tuberculosis H37Rv
ccgggcggccucccg

SEQ ID NO: 1370453 - RNA, 19 nt, Mycobacterium tuberculosis H37Rv
ccgggcggccucccgggcc

SEQ ID NO: 1370454 - RNA, 16 nt, Mycobacterium tuberculosis H37Rv
ccgggcggccagcugc

SEQ ID NO: 1370455 - RNA, 15 nt, Mycobacterium tuberculosis H37Rv
ccgggcuuaggccgc

SEQ ID NO: 1370456 - RNA, 12 nt, Mycobacterium tuberculosis H37Rv
ccgggcgggcug

SEQ ID NO: 1370457 - RNA, 20 nt, Mycobacterium tuberculosis H37Rv
ccgggcggcggugcgucagc

SEQ ID NO: 1370458 - RNA, 23 nt, Mycobacterium tuberculosis H37Rv
ccgggcggcggugcgucagcugg

SEQ ID NO: 1370459 - RNA, 15 nt, Mycobacterium tuberculosis H37Rv
ccgggcggcgccggc

SEQ ID NO: 1370460 - RNA, 18 nt, Mycobacterium tuberculosis H37Rv
ccgggcggcgccggcgca

SEQ ID NO: 1370461 - RNA, 22 nt, Mycobacterium tuberculosis H37Rv
ccggggcucaagucucccggcc

SEQ ID NO: 1370462 - RNA, 15 nt, Mycobacterium tuberculosis H37Rv
ccgggggcgccgccg

SEQ ID NO: 1370463 - RNA, 15 nt, Mycobacterium tuberculosis H37Rv
ccggggcgcucgcgc

SEQ ID NO: 1370464 - RNA, 23 nt, Mycobacterium tuberculosis H37Rv
ccggggcgcucgcgcgcugggcg

SEQ ID NO: 1370465 - RNA, 18 nt, Mycobacterium tuberculosis H37Rv
ccggggcgcucgcgcgcu

SEQ ID NO: 1370466 - RNA, 19 nt, Mycobacterium tuberculosis H37Rv
ccggggcgcccggccaggu

SEQ ID NO: 1370467 - RNA, 13 nt, Mycobacterium tuberculosis H37Rv
ccggggcgcccgg

SEQ ID NO: 1370468 - RNA, 15 nt, Mycobacterium tuberculosis H37Rv
ccggggacgcgcccc

SEQ ID NO: 1370469 - RNA, 12 nt, Mycobacterium tuberculosis H37Rv
ccggggaaugag

SEQ ID NO: 1370470 - RNA, 15 nt, Mycobacterium tuberculosis H37Rv
ccggggccccaugcc

SEQ ID NO: 1370471 - RNA, 12 nt, Mycobacterium tuberculosis H37Rv
ccggggccgcaa

SEQ ID NO: 1370472 - RNA, 23 nt, Mycobacterium tuberculosis H37Rv
aaaccucuucgggugcagccaga

SEQ ID NO: 1370473 - RNA, 23 nt, Mycobacterium tuberculosis H37Rv
ccgggaucuagaugcggaacgcc

SEQ ID NO: 1370474 - RNA, 17 nt, Mycobacterium tuberculosis H37Rv
ccgggaggacaccagcu

SEQ ID NO: 1370475 - RNA, 16 nt, Mycobacterium tuberculosis H37Rv
ccgggaugccgccgcu

SEQ ID NO: 1370476 - RNA, 22 nt, Mycobacterium tuberculosis H37Rv
aaaccugcaugcccagaaaacc

SEQ ID NO: 1370477 - RNA, 16 nt, Mycobacterium tuberculosis H37Rv
ccgggccgccagggcc

SEQ ID NO: 1370478 - RNA, 20 nt, Mycobacterium tuberculosis H37Rv
ccgggccgccgcgauggccc

SEQ ID NO: 1370479 - RNA, 15 nt, Mycobacterium tuberculosis H37Rv
ccgggccgccgcgau

SEQ ID NO: 1370480 - RNA, 13 nt, Mycobacterium tuberculosis H37Rv
ccgggccgccgcc

SEQ ID NO: 1370481 - RNA, 14 nt, Mycobacterium tuberculosis H37Rv
ccgggccgccgccc

SEQ ID NO: 1370482 - RNA, 14 nt, Mycobacterium tuberculosis H37Rv
ccgggccgccgcga

SEQ ID NO: 1370483 - RNA, 18 nt, Mycobacterium tuberculosis H37Rv
ccgggccguguccgccgg

SEQ ID NO: 1370484 - RNA, 15 nt, Mycobacterium tuberculosis H37Rv
ccgggccggcgagcu

SEQ ID NO: 1370485 - RNA, 12 nt, Mycobacterium tuberculosis H37Rv
ccgggccgcgcg

SEQ ID NO: 1370486 - RNA, 15 nt, Mycobacterium tuberculosis H37Rv
ccgggccgcggcggc

SEQ ID NO: 1370487 - RNA, 16 nt, Mycobacterium tuberculosis H37Rv
ccggcuuuugcgccca

SEQ ID NO: 1370488 - RNA, 14 nt, Mycobacterium tuberculosis H37Rv
ccgggaaacaccgg

SEQ ID NO: 1370489 - RNA, 15 nt, Mycobacterium tuberculosis H37Rv
ccgggaaacaccggc

SEQ ID NO: 1370490 - RNA, 20 nt, Mycobacterium tuberculosis H37Rv
ccggcuugucgaccacgacc

SEQ ID NO: 1370491 - RNA, 22 nt, Mycobacterium tuberculosis H37Rv
ccggcuucggcgaacccuccgc

SEQ ID NO: 1370492 - RNA, 18 nt, Mycobacterium tuberculosis H37Rv
ccggcucucagcgacagc

SEQ ID NO: 1370493 - RNA, 22 nt, Mycobacterium tuberculosis H37Rv
ccggcugaccggggcgcccggc

SEQ ID NO: 1370494 - RNA, 20 nt, Mycobacterium tuberculosis H37Rv
ccggcuuaccggcgggcgaa

SEQ ID NO: 1370495 - RNA, 15 nt, Mycobacterium tuberculosis H37Rv
ccggcuucgccgcgc

SEQ ID NO: 1370496 - RNA, 16 nt, Mycobacterium tuberculosis H37Rv
ccgggaaggaaccggg

SEQ ID NO: 1370497 - RNA, 15 nt, Mycobacterium tuberculosis H37Rv
ccgggaaggaaccgg

SEQ ID NO: 1370498 - RNA, 14 nt, Mycobacterium tuberculosis H37Rv
ccgggaagucgcug

SEQ ID NO: 1370499 - RNA, 21 nt, Mycobacterium tuberculosis H37Rv
ccgggaccauagucgccgucg

SEQ ID NO: 1370500 - RNA, 20 nt, Mycobacterium tuberculosis H37Rv
ccgggacaaucucggccgca

SEQ ID NO: 1370501 - RNA, 18 nt, Mycobacterium tuberculosis H37Rv
ccgggaacgccucagggg

SEQ ID NO: 1370502 - RNA, 16 nt, Mycobacterium tuberculosis H37Rv
ccgggagugcgccggc

SEQ ID NO: 1370503 - RNA, 20 nt, Mycobacterium tuberculosis H37Rv
ccgggauagccgcgaccaga

SEQ ID NO: 1370504 - RNA, 13 nt, Mycobacterium tuberculosis H37Rv
ccggcggcccgau

SEQ ID NO: 1370505 - RNA, 13 nt, Mycobacterium tuberculosis H37Rv
ccggcggccgcca

SEQ ID NO: 1370506 - RNA, 15 nt, Mycobacterium tuberculosis H37Rv
ccggcggccaccagu

SEQ ID NO: 1370507 - RNA, 21 nt, Mycobacterium tuberculosis H37Rv
ccggcggcagcggcgccgccu

SEQ ID NO: 1370508 - RNA, 14 nt, Mycobacterium tuberculosis H37Rv
ccggcggcagguag

SEQ ID NO: 1370509 - RNA, 21 nt, Mycobacterium tuberculosis H37Rv
ccggcggacaccucgggcgcc

SEQ ID NO: 1370510 - RNA, 20 nt, Mycobacterium tuberculosis H37Rv
ccggcggaucugaucggcgc

SEQ ID NO: 1370511 - RNA, 11 nt, Mycobacterium tuberculosis H37Rv
ccggcggcagc

SEQ ID NO: 1370512 - RNA, 22 nt, Mycobacterium tuberculosis H37Rv
ccggcggacgcccggcgcacca

SEQ ID NO: 1370513 - RNA, 19 nt, Mycobacterium tuberculosis H37Rv
ccggcggagcgggccagca

SEQ ID NO: 1370514 - RNA, 21 nt, Mycobacterium tuberculosis H37Rv
ccggcggagcgggccagcacc

SEQ ID NO: 1370515 - RNA, 17 nt, Mycobacterium tuberculosis H37Rv
ccggcggacgacgucgg

SEQ ID NO: 1370516 - RNA, 20 nt, Mycobacterium tuberculosis H37Rv
ccggcggcaaagagcagccg

SEQ ID NO: 1370517 - RNA, 16 nt, Mycobacterium tuberculosis H37Rv
ccggcucguccgggca

SEQ ID NO: 1370518 - RNA, 22 nt, Mycobacterium tuberculosis H37Rv
ccggcucggugcgccagaucac

SEQ ID NO: 1370519 - RNA, 14 nt, Mycobacterium tuberculosis H37Rv
ccggcucgucgggc

SEQ ID NO: 1370520 - RNA, 19 nt, Mycobacterium tuberculosis H37Rv
ccggcucucuucgcgcgcu

SEQ ID NO: 1370521 - RNA, 19 nt, Mycobacterium tuberculosis H37Rv
ccggcucggaaaccgcccc

SEQ ID NO: 1370522 - RNA, 20 nt, Mycobacterium tuberculosis H37Rv
ccggugccguuggagccgcc

SEQ ID NO: 1370523 - RNA, 19 nt, Mycobacterium tuberculosis H37Rv
ccggugcgaucccacccuc

SEQ ID NO: 1370524 - RNA, 16 nt, Mycobacterium tuberculosis H37Rv
ccggugcgaucccacc

SEQ ID NO: 1370525 - RNA, 21 nt, Mycobacterium tuberculosis H37Rv
ccggugccgccugcgccgcca

SEQ ID NO: 1370526 - RNA, 13 nt, Mycobacterium tuberculosis H37Rv
ccggugccggcgg

SEQ ID NO: 1370527 - RNA, 21 nt, Mycobacterium tuberculosis H37Rv
ccggugccggcguugccgccg

SEQ ID NO: 1370528 - RNA, 20 nt, Mycobacterium tuberculosis H37Rv
ccggugccgggaugccgccg

SEQ ID NO: 1370529 - RNA, 23 nt, Mycobacterium tuberculosis H37Rv
ccggugccgccgcggccaccacc

SEQ ID NO: 1370530 - RNA, 15 nt, Mycobacterium tuberculosis H37Rv
ccggugccgccgucg

SEQ ID NO: 1370531 - RNA, 15 nt, Mycobacterium tuberculosis H37Rv
ccggugccgccgccu

SEQ ID NO: 1370532 - RNA, 17 nt, Mycobacterium tuberculosis H37Rv
ccggugagaagaagccc

SEQ ID NO: 1370533 - RNA, 21 nt, Mycobacterium tuberculosis H37Rv
ccggugccgcccgcgccgccg

SEQ ID NO: 1370534 - RNA, 21 nt, Mycobacterium tuberculosis H37Rv
ccggugacccgcugggccgca

SEQ ID NO: 1370535 - RNA, 13 nt, Mycobacterium tuberculosis H37Rv
ccggugacgccgu

SEQ ID NO: 1370536 - RNA, 15 nt, Mycobacterium tuberculosis H37Rv
ccggugacggggcug

SEQ ID NO: 1370537 - RNA, 13 nt, Mycobacterium tuberculosis H37Rv
ccggugacggugu

SEQ ID NO: 1370538 - RNA, 13 nt, Mycobacterium tuberculosis H37Rv
ccggugaacaggg

SEQ ID NO: 1370539 - RNA, 16 nt, Mycobacterium tuberculosis H37Rv
ccggugaacgguagca

SEQ ID NO: 1370540 - RNA, 17 nt, Mycobacterium tuberculosis H37Rv
ccggugacaaguggugc

SEQ ID NO: 1370541 - RNA, 18 nt, Mycobacterium tuberculosis H37Rv
ccggugacgacgucgccg

SEQ ID NO: 1370542 - RNA, 16 nt, Mycobacterium tuberculosis H37Rv
ccgguguaggccucgg

SEQ ID NO: 1370543 - RNA, 23 nt, Mycobacterium tuberculosis H37Rv
ccgguguagcagcgccagcagcu

SEQ ID NO: 1370544 - RNA, 21 nt, Mycobacterium tuberculosis H37Rv
ccgguggugccggcgccgcca

SEQ ID NO: 1370545 - RNA, 23 nt, Mycobacterium tuberculosis H37Rv
ccgguggugaggaucauggcguc

SEQ ID NO: 1370546 - RNA, 16 nt, Mycobacterium tuberculosis H37Rv
ccgguguaggggcgcc

SEQ ID NO: 1370547 - RNA, 20 nt, Mycobacterium tuberculosis H37Rv
ccggugucguucggcgagga

SEQ ID NO: 1370548 - RNA, 17 nt, Mycobacterium tuberculosis H37Rv
ccggugucucccuugcc

SEQ ID NO: 1370549 - RNA, 16 nt, Mycobacterium tuberculosis H37Rv
ccggugggggcggcgc

SEQ ID NO: 1370550 - RNA, 19 nt, Mycobacterium tuberculosis H37Rv
ccgguggggucggucuggc

SEQ ID NO: 1370551 - RNA, 21 nt, Mycobacterium tuberculosis H37Rv
ccgggguccaucggggccguc

SEQ ID NO: 1370552 - RNA, 15 nt, Mycobacterium tuberculosis H37Rv
ccgggguaucgaccc

SEQ ID NO: 1370553 - RNA, 16 nt, Mycobacterium tuberculosis H37Rv
ccggggggcugcugcu

SEQ ID NO: 1370554 - RNA, 14 nt, Mycobacterium tuberculosis H37Rv
ccggggcugggggc

SEQ ID NO: 1370555 - RNA, 23 nt, Mycobacterium tuberculosis H37Rv
ccgggguccaucggggccgucgg

SEQ ID NO: 1370556 - RNA, 12 nt, Mycobacterium tuberculosis H37Rv
ccggggucggcc

SEQ ID NO: 1370557 - RNA, 14 nt, Mycobacterium tuberculosis H37Rv
ccggggugcccccg

SEQ ID NO: 1370558 - RNA, 22 nt, Mycobacterium tuberculosis H37Rv
ccggggugcccccggugccgcc

SEQ ID NO: 1370559 - RNA, 18 nt, Mycobacterium tuberculosis H37Rv
ccggguagcggcgccgcc

SEQ ID NO: 1370560 - RNA, 19 nt, Mycobacterium tuberculosis H37Rv
ccggguagcggcgccgccc

SEQ ID NO: 1370561 - RNA, 20 nt, Mycobacterium tuberculosis H37Rv
ccggguagcggcgccgcccu

SEQ ID NO: 1370562 - RNA, 12 nt, Mycobacterium tuberculosis H37Rv
ccggguaccgag

SEQ ID NO: 1370563 - RNA, 17 nt, Mycobacterium tuberculosis H37Rv
ccgggguuggucgucgc

SEQ ID NO: 1370564 - RNA, 15 nt, Mycobacterium tuberculosis H37Rv
ccggggugugcgggc

SEQ ID NO: 1370565 - RNA, 12 nt, Mycobacterium tuberculosis H37Rv
ccgggguggcgc

SEQ ID NO: 1370566 - RNA, 19 nt, Mycobacterium tuberculosis H37Rv
ccggggugcugacauaggu

SEQ ID NO: 1370567 - RNA, 20 nt, Mycobacterium tuberculosis H37Rv
ccggguacggaugucggaca

SEQ ID NO: 1370568 - RNA, 19 nt, Mycobacterium tuberculosis H37Rv
ccgguccagcagcucggcc

SEQ ID NO: 1370569 - RNA, 17 nt, Mycobacterium tuberculosis H37Rv
ccgguccccgccggcgg

SEQ ID NO: 1370570 - RNA, 20 nt, Mycobacterium tuberculosis H37Rv
ccggucccgcgugccacucg

SEQ ID NO: 1370571 - RNA, 13 nt, Mycobacterium tuberculosis H37Rv
ccgguccccgccg

SEQ ID NO: 1370572 - RNA, 23 nt, Mycobacterium tuberculosis H37Rv
ccgguccgucaccaccgccgcca

SEQ ID NO: 1370573 - RNA, 19 nt, Mycobacterium tuberculosis H37Rv
ccgguccgucaccaccgcc

SEQ ID NO: 1370574 - RNA, 17 nt, Mycobacterium tuberculosis H37Rv
ccgguccucgucggcga

SEQ ID NO: 1370575 - RNA, 16 nt, Mycobacterium tuberculosis H37Rv
ccggucuacgccaccg

SEQ ID NO: 1370576 - RNA, 22 nt, Mycobacterium tuberculosis H37Rv
ccggucugcugggcacgauggc

SEQ ID NO: 1370577 - RNA, 19 nt, Mycobacterium tuberculosis H37Rv
ccggguagacaugggugaa

SEQ ID NO: 1370578 - RNA, 20 nt, Mycobacterium tuberculosis H37Rv
ccggucgagccagcggagca

SEQ ID NO: 1370579 - RNA, 16 nt, Mycobacterium tuberculosis H37Rv
ccggucgaggcccucg

SEQ ID NO: 1370580 - RNA, 17 nt, Mycobacterium tuberculosis H37Rv
ccgguccugggauccgg

SEQ ID NO: 1370581 - RNA, 22 nt, Mycobacterium tuberculosis H37Rv
ccgguccugggauccggcggca

SEQ ID NO: 1370582 - RNA, 19 nt, Mycobacterium tuberculosis H37Rv
ccgucaaccugcugcagaa

SEQ ID NO: 1370583 - RNA, 19 nt, Mycobacterium tuberculosis H37Rv
ccgucacaaugcccaggcu

SEQ ID NO: 1370584 - RNA, 17 nt, Mycobacterium tuberculosis H37Rv
ccguauugccaaagccc

SEQ ID NO: 1370585 - RNA, 17 nt, Mycobacterium tuberculosis H37Rv
ccguaugucccggugcg

SEQ ID NO: 1370586 - RNA, 16 nt, Mycobacterium tuberculosis H37Rv
ccguaucggggcacca

SEQ ID NO: 1370587 - RNA, 14 nt, Mycobacterium tuberculosis H37Rv
ccguaggccacagc

SEQ ID NO: 1370588 - RNA, 19 nt, Mycobacterium tuberculosis H37Rv
ccguagccagcaggaacgc

SEQ ID NO: 1370589 - RNA, 13 nt, Mycobacterium tuberculosis H37Rv
ccguaggccacag

SEQ ID NO: 1370590 - RNA, 16 nt, Mycobacterium tuberculosis H37Rv
ccguagcugcgcagcg

SEQ ID NO: 1370591 - RNA, 17 nt, Mycobacterium tuberculosis H37Rv
ccguagcguccgcgccc

SEQ ID NO: 1370592 - RNA, 15 nt, Mycobacterium tuberculosis H37Rv
ccguagcaccacauc

SEQ ID NO: 1370593 - RNA, 17 nt, Mycobacterium tuberculosis H37Rv
ccguagcgcagcgccuc

SEQ ID NO: 1370594 - RNA, 17 nt, Mycobacterium tuberculosis H37Rv
ccguagccggccggccc

SEQ ID NO: 1370595 - RNA, 22 nt, Mycobacterium tuberculosis H37Rv
ccguagugaacggcucgggcag

SEQ ID NO: 1370596 - RNA, 19 nt, Mycobacterium tuberculosis H37Rv
ccguagugcacgucggcgg

SEQ ID NO: 1370597 - RNA, 23 nt, Mycobacterium tuberculosis H37Rv
ccguagucgucaaacacucugau

SEQ ID NO: 1370598 - RNA, 23 nt, Mycobacterium tuberculosis H37Rv
ccguaguaaggagccgggccguc

SEQ ID NO: 1370599 - RNA, 14 nt, Mycobacterium tuberculosis H37Rv
ccguaguaguggcc

SEQ ID NO: 1370600 - RNA, 23 nt, Mycobacterium tuberculosis H37Rv
ccguaguaguggccgccacccgc

SEQ ID NO: 1370601 - RNA, 22 nt, Mycobacterium tuberculosis H37Rv
ccguaguaguucagccaggccg

SEQ ID NO: 1370602 - RNA, 14 nt, Mycobacterium tuberculosis H37Rv
ccguauagcgugac

SEQ ID NO: 1370603 - RNA, 15 nt, Mycobacterium tuberculosis H37Rv
ccguaguggccggcu

SEQ ID NO: 1370604 - RNA, 19 nt, Mycobacterium tuberculosis H37Rv
ccguaguugguccagguga

SEQ ID NO: 1370605 - RNA, 15 nt, Mycobacterium tuberculosis H37Rv
ccguaagcaccagcc

SEQ ID NO: 1370606 - RNA, 16 nt, Mycobacterium tuberculosis H37Rv
ccguaagcaccagcca

SEQ ID NO: 1370607 - RNA, 19 nt, Mycobacterium tuberculosis H37Rv
ccgguuugcacgcaccaca

SEQ ID NO: 1370608 - RNA, 15 nt, Mycobacterium tuberculosis H37Rv
ccgguuucuucuuca

SEQ ID NO: 1370609 - RNA, 19 nt, Mycobacterium tuberculosis H37Rv
ccguagacgccgagcaagg

SEQ ID NO: 1370610 - RNA, 19 nt, Mycobacterium tuberculosis H37Rv
ccguagagcaugccgcccg

SEQ ID NO: 1370611 - RNA, 14 nt, Mycobacterium tuberculosis H37Rv
ccguagcacaccgg

SEQ ID NO: 1370612 - RNA, 22 nt, Mycobacterium tuberculosis H37Rv
ccguagcacaccgguggacccg

SEQ ID NO: 1370613 - RNA, 19 nt, Mycobacterium tuberculosis H37Rv
ccguagaagcgcuccagcu

SEQ ID NO: 1370614 - RNA, 13 nt, Mycobacterium tuberculosis H37Rv
ccguagacccaca

SEQ ID NO: 1370615 - RNA, 15 nt, Mycobacterium tuberculosis H37Rv
ccguaccagcccguc

SEQ ID NO: 1370616 - RNA, 16 nt, Mycobacterium tuberculosis H37Rv
ccguacaaccacccac

SEQ ID NO: 1370617 - RNA, 22 nt, Mycobacterium tuberculosis H37Rv
ccgucaguucggugugcggcgc

SEQ ID NO: 1370618 - RNA, 19 nt, Mycobacterium tuberculosis H37Rv
ccgucaucgugcccgcguc

SEQ ID NO: 1370619 - RNA, 20 nt, Mycobacterium tuberculosis H37Rv
ccgucaucgaguaacacccc

SEQ ID NO: 1370620 - RNA, 12 nt, Mycobacterium tuberculosis H37Rv
ccgucagcgccg

SEQ ID NO: 1370621 - RNA, 19 nt, Mycobacterium tuberculosis H37Rv
ccgucaggaugaucugcgc

SEQ ID NO: 1370622 - RNA, 18 nt, Mycobacterium tuberculosis H37Rv
ccgucagcggcggccacg

SEQ ID NO: 1370623 - RNA, 21 nt, Mycobacterium tuberculosis H37Rv
ccgucagcgccgcugacuccu

SEQ ID NO: 1370624 - RNA, 19 nt, Mycobacterium tuberculosis H37Rv
ccgucacugaugggccggu

SEQ ID NO: 1370625 - RNA, 20 nt, Mycobacterium tuberculosis H37Rv
ccgucagaacaccggccagg

SEQ ID NO: 1370626 - RNA, 20 nt, Mycobacterium tuberculosis H37Rv
ccgucagcaccccgccgccu

SEQ ID NO: 1370627 - RNA, 15 nt, Mycobacterium tuberculosis H37Rv
ccgucagccaggugc

SEQ ID NO: 1370628 - RNA, 16 nt, Mycobacterium tuberculosis H37Rv
ccgucaccgcgacccc

SEQ ID NO: 1370629 - RNA, 19 nt, Mycobacterium tuberculosis H37Rv
ccgucaccgcugagccccc

SEQ ID NO: 1370630 - RNA, 21 nt, Mycobacterium tuberculosis H37Rv
ccgucaccgcugagccccccg

SEQ ID NO: 1370631 - RNA, 14 nt, Mycobacterium tuberculosis H37Rv
ccgucacccccgau

SEQ ID NO: 1370632 - RNA, 23 nt, Mycobacterium tuberculosis H37Rv
ccgucaccgaucgaacagugccu

SEQ ID NO: 1370633 - RNA, 17 nt, Mycobacterium tuberculosis H37Rv
ccgucaccgccgaccag

SEQ ID NO: 1370634 - RNA, 16 nt, Mycobacterium tuberculosis H37Rv
ccguccaauagcugac

SEQ ID NO: 1370635 - RNA, 12 nt, Mycobacterium tuberculosis H37Rv
ccgucauggcga

SEQ ID NO: 1370636 - RNA, 13 nt, Mycobacterium tuberculosis H37Rv
ccgucauggcccg

SEQ ID NO: 1370637 - RNA, 16 nt, Mycobacterium tuberculosis H37Rv
ccgucauggcccgauc

SEQ ID NO: 1370638 - RNA, 23 nt, Mycobacterium tuberculosis H37Rv
ccgucauggcgaaccgucagcgc

SEQ ID NO: 1370639 - RNA, 21 nt, Mycobacterium tuberculosis H37Rv
aaaccuugcggcagaccaagc

SEQ ID NO: 1370640 - RNA, 12 nt, Mycobacterium tuberculosis H37Rv
ccguccaggacg

SEQ ID NO: 1370641 - RNA, 22 nt, Mycobacterium tuberculosis H37Rv
ccguccagcaacagcgagcggu

SEQ ID NO: 1370642 - RNA, 20 nt, Mycobacterium tuberculosis H37Rv
ccguccaggcgcugcagcau

SEQ ID NO: 1370643 - RNA, 14 nt, Mycobacterium tuberculosis H37Rv
ccgucccggcucga

SEQ ID NO: 1370644 - RNA, 15 nt, Mycobacterium tuberculosis H37Rv
ccgucccgccggccc

SEQ ID NO: 1370645 - RNA, 20 nt, Mycobacterium tuberculosis H37Rv
ccgucccaggugcaagcggu

SEQ ID NO: 1370646 - RNA, 15 nt, Mycobacterium tuberculosis H37Rv
ccgucccacugaccg

SEQ ID NO: 1370647 - RNA, 14 nt, Mycobacterium tuberculosis H37Rv
ccgucccagcugac

SEQ ID NO: 1370648 - RNA, 22 nt, Mycobacterium tuberculosis H37Rv
ccguccgggcggccucccgggc

SEQ ID NO: 1370649 - RNA, 20 nt, Mycobacterium tuberculosis H37Rv
ccguccggccgggcccucca

SEQ ID NO: 1370650 - RNA, 19 nt, Mycobacterium tuberculosis H37Rv
ccguccggcgccugcugcg

SEQ ID NO: 1370651 - RNA, 16 nt, Mycobacterium tuberculosis H37Rv
ccguccucccacaggu

SEQ ID NO: 1370652 - RNA, 16 nt, Mycobacterium tuberculosis H37Rv
ccguccucggucagcu

SEQ ID NO: 1370653 - RNA, 22 nt, Mycobacterium tuberculosis H37Rv
ccguccucggucagcucgucgg

SEQ ID NO: 1370654 - RNA, 15 nt, Mycobacterium tuberculosis H37Rv
ccguccgggucacca

SEQ ID NO: 1370655 - RNA, 19 nt, Mycobacterium tuberculosis H37Rv
ccguccgguggaccgccga

SEQ ID NO: 1370656 - RNA, 19 nt, Mycobacterium tuberculosis H37Rv
ccgucgaaccagaggucac

SEQ ID NO: 1370657 - RNA, 22 nt, Mycobacterium tuberculosis H37Rv
ccgucgaagcgaacacccgguc

SEQ ID NO: 1370658 - RNA, 20 nt, Mycobacterium tuberculosis H37Rv
ccgucgauugcaggucggcc

SEQ ID NO: 1370659 - RNA, 18 nt, Mycobacterium tuberculosis H37Rv
ccgucgauguugcccagc

SEQ ID NO: 1370660 - RNA, 19 nt, Mycobacterium tuberculosis H37Rv
ccgucgauguggcgcuccg

SEQ ID NO: 1370661 - RNA, 20 nt, Mycobacterium tuberculosis H37Rv
ccgucgcagccagcugaaca

SEQ ID NO: 1370662 - RNA, 22 nt, Mycobacterium tuberculosis H37Rv
ccgucgauuucgacgaccaccu

SEQ ID NO: 1370663 - RNA, 14 nt, Mycobacterium tuberculosis H37Rv
ccgucgccaccggu

SEQ ID NO: 1370664 - RNA, 22 nt, Mycobacterium tuberculosis H37Rv
ccgucgccacgcccagcgcccg

SEQ ID NO: 1370665 - RNA, 22 nt, Mycobacterium tuberculosis H37Rv
ccgucgccgaacagcagcccgc

SEQ ID NO: 1370666 - RNA, 17 nt, Mycobacterium tuberculosis H37Rv
ccgugaccgccgcgccg

SEQ ID NO: 1370667 - RNA, 16 nt, Mycobacterium tuberculosis H37Rv
ccgugaccgccgcgcc

SEQ ID NO: 1370668 - RNA, 22 nt, Mycobacterium tuberculosis H37Rv
ccgugaauggcagcacgaccug

SEQ ID NO: 1370669 - RNA, 16 nt, Mycobacterium tuberculosis H37Rv
ccgugacguagggcag

SEQ ID NO: 1370670 - RNA, 14 nt, Mycobacterium tuberculosis H37Rv
ccgugagcaccagc

SEQ ID NO: 1370671 - RNA, 18 nt, Mycobacterium tuberculosis H37Rv
ccgugagcaccagcagca

SEQ ID NO: 1370672 - RNA, 21 nt, Mycobacterium tuberculosis H37Rv
ccgugagccuuucgugcaccg

SEQ ID NO: 1370673 - RNA, 23 nt, Mycobacterium tuberculosis H37Rv
ccgucuuuggugccgagcagcuu

SEQ ID NO: 1370674 - RNA, 21 nt, Mycobacterium tuberculosis H37Rv
ccgucuuugucacgcaccgcg

SEQ ID NO: 1370675 - RNA, 15 nt, Mycobacterium tuberculosis H37Rv
ccgucuuccagccag

SEQ ID NO: 1370676 - RNA, 14 nt, Mycobacterium tuberculosis H37Rv
ccgucuucgccgcc

SEQ ID NO: 1370677 - RNA, 14 nt, Mycobacterium tuberculosis H37Rv
ccgucuuggcccgg

SEQ ID NO: 1370678 - RNA, 18 nt, Mycobacterium tuberculosis H37Rv
ccgucgggcccagccgga

SEQ ID NO: 1370679 - RNA, 13 nt, Mycobacterium tuberculosis H37Rv
ccgucgggcccac

SEQ ID NO: 1370680 - RNA, 18 nt, Mycobacterium tuberculosis H37Rv
ccgucgggccgucgggug

SEQ ID NO: 1370681 - RNA, 19 nt, Mycobacterium tuberculosis H37Rv
ccgucggcgugcagcagcu

SEQ ID NO: 1370682 - RNA, 20 nt, Mycobacterium tuberculosis H37Rv
ccgucggcgcucgucgcggc

SEQ ID NO: 1370683 - RNA, 20 nt, Mycobacterium tuberculosis H37Rv
ccgucugcggggugagugac

SEQ ID NO: 1370684 - RNA, 21 nt, Mycobacterium tuberculosis H37Rv
ccgucugcggaccggcgcgcu

SEQ ID NO: 1370685 - RNA, 17 nt, Mycobacterium tuberculosis H37Rv
ccgucugcuggccgggu

SEQ ID NO: 1370686 - RNA, 18 nt, Mycobacterium tuberculosis H37Rv
ccgucggguaggccgccg

SEQ ID NO: 1370687 - RNA, 22 nt, Mycobacterium tuberculosis H37Rv
ccgucggugggugccagccggu

SEQ ID NO: 1370688 - RNA, 21 nt, Mycobacterium tuberculosis H37Rv
ccgucggugccggggcugccg

SEQ ID NO: 1370689 - RNA, 16 nt, Mycobacterium tuberculosis H37Rv
ccgucggugccgccgc

SEQ ID NO: 1370690 - RNA, 22 nt, Mycobacterium tuberculosis H37Rv
ccgucggugagcugcgccagaa

SEQ ID NO: 1370691 - RNA, 20 nt, Mycobacterium tuberculosis H37Rv
ccucaccgccugugccgccg

SEQ ID NO: 1370692 - RNA, 22 nt, Mycobacterium tuberculosis H37Rv
ccucaccggguuggaagccgca

SEQ ID NO: 1370693 - RNA, 12 nt, Mycobacterium tuberculosis H37Rv
ccucaagcgaag

SEQ ID NO: 1370694 - RNA, 23 nt, Mycobacterium tuberculosis H37Rv
ccucaagcgaagagcgcacugaa

SEQ ID NO: 1370695 - RNA, 18 nt, Mycobacterium tuberculosis H37Rv
ccucaacgaucgcgccgu

SEQ ID NO: 1370696 - RNA, 13 nt, Mycobacterium tuberculosis H37Rv
ccucaacaccagg

SEQ ID NO: 1370697 - RNA, 15 nt, Mycobacterium tuberculosis H37Rv
ccucaacaccaggcc

SEQ ID NO: 1370698 - RNA, 16 nt, Mycobacterium tuberculosis H37Rv
ccucaacaccaggccg

SEQ ID NO: 1370699 - RNA, 14 nt, Mycobacterium tuberculosis H37Rv
ccucacgggcgccg

SEQ ID NO: 1370700 - RNA, 18 nt, Mycobacterium tuberculosis H37Rv
ccucacguggacugaccu

SEQ ID NO: 1370701 - RNA, 15 nt, Mycobacterium tuberculosis H37Rv
ccucacugcggcgcc

SEQ ID NO: 1370702 - RNA, 11 nt, Mycobacterium tuberculosis H37Rv
ccucagcugcu

SEQ ID NO: 1370703 - RNA, 22 nt, Mycobacterium tuberculosis H37Rv
ccucagcugcucgucuuggcgg

SEQ ID NO: 1370704 - RNA, 21 nt, Mycobacterium tuberculosis H37Rv
ccucagcuagcgcgggcucac

SEQ ID NO: 1370705 - RNA, 12 nt, Mycobacterium tuberculosis H37Rv
ccgugccgccag

SEQ ID NO: 1370706 - RNA, 16 nt, Mycobacterium tuberculosis H37Rv
ccgugauugucggcga

SEQ ID NO: 1370707 - RNA, 19 nt, Mycobacterium tuberculosis H37Rv
ccgugccgccgacaccacc

SEQ ID NO: 1370708 - RNA, 21 nt, Mycobacterium tuberculosis H37Rv
ccgugccgguguguccagcgg

SEQ ID NO: 1370709 - RNA, 18 nt, Mycobacterium tuberculosis H37Rv
ccgugccuggccggugcg

SEQ ID NO: 1370710 - RNA, 12 nt, Mycobacterium tuberculosis H37Rv
ccgugccgucgg

SEQ ID NO: 1370711 - RNA, 15 nt, Mycobacterium tuberculosis H37Rv
ccgugccgcacagcg

SEQ ID NO: 1370712 - RNA, 18 nt, Mycobacterium tuberculosis H37Rv
ccgugcgaucgucaacga

SEQ ID NO: 1370713 - RNA, 16 nt, Mycobacterium tuberculosis H37Rv
ccuaugauucagccgg

SEQ ID NO: 1370714 - RNA, 18 nt, Mycobacterium tuberculosis H37Rv
ccuaugauucagccggcu

SEQ ID NO: 1370715 - RNA, 18 nt, Mycobacterium tuberculosis H37Rv
ccuccagcugcgcgggcg

SEQ ID NO: 1370716 - RNA, 19 nt, Mycobacterium tuberculosis H37Rv
ccuccagcacgccguccag

SEQ ID NO: 1370717 - RNA, 15 nt, Mycobacterium tuberculosis H37Rv
ccuccagcacccggu

SEQ ID NO: 1370718 - RNA, 20 nt, Mycobacterium tuberculosis H37Rv
ccuccagcaccacggcgcgc

SEQ ID NO: 1370719 - RNA, 19 nt, Mycobacterium tuberculosis H37Rv
ccuccagcaggucgccugc

SEQ ID NO: 1370720 - RNA, 20 nt, Mycobacterium tuberculosis H37Rv
ccuccgaggaauacagcuug

SEQ ID NO: 1370721 - RNA, 13 nt, Mycobacterium tuberculosis H37Rv
ccuccgagcacag

SEQ ID NO: 1370722 - RNA, 21 nt, Mycobacterium tuberculosis H37Rv
ccuccgaggaauacagcuuga

SEQ ID NO: 1370723 - RNA, 13 nt, Mycobacterium tuberculosis H37Rv
ccuccgaggccgc

SEQ ID NO: 1370724 - RNA, 14 nt, Mycobacterium tuberculosis H37Rv
ccuccgccaaggag

SEQ ID NO: 1370725 - RNA, 15 nt, Mycobacterium tuberculosis H37Rv
ccucccuuccgcgcu

SEQ ID NO: 1370726 - RNA, 19 nt, Mycobacterium tuberculosis H37Rv
ccucccucuagcgcccgaa

SEQ ID NO: 1370727 - RNA, 13 nt, Mycobacterium tuberculosis H37Rv
ccucccgggcccg

SEQ ID NO: 1370728 - RNA, 13 nt, Mycobacterium tuberculosis H37Rv
ccucccgggccgc

SEQ ID NO: 1370729 - RNA, 15 nt, Mycobacterium tuberculosis H37Rv
ccucccgggccgccg

SEQ ID NO: 1370730 - RNA, 15 nt, Mycobacterium tuberculosis H37Rv
ccucccgcggcaccu

SEQ ID NO: 1370731 - RNA, 19 nt, Mycobacterium tuberculosis H37Rv
ccucccgcagccgggcacc

SEQ ID NO: 1370732 - RNA, 16 nt, Mycobacterium tuberculosis H37Rv
ccucccgcagccgggc

SEQ ID NO: 1370733 - RNA, 23 nt, Mycobacterium tuberculosis H37Rv
ccucccgcaaugcgagcgcgccg

SEQ ID NO: 1370734 - RNA, 22 nt, Mycobacterium tuberculosis H37Rv
ccucauagauacagucgaccgg

SEQ ID NO: 1370735 - RNA, 21 nt, Mycobacterium tuberculosis H37Rv
ccucauagagcggcaccagau

SEQ ID NO: 1370736 - RNA, 18 nt, Mycobacterium tuberculosis H37Rv
ccucauagagcggcacca

SEQ ID NO: 1370737 - RNA, 21 nt, Mycobacterium tuberculosis H37Rv
ccucaugcacgccguagcauc

SEQ ID NO: 1370738 - RNA, 13 nt, Mycobacterium tuberculosis H37Rv
ccucaugcacgcc

SEQ ID NO: 1370739 - RNA, 20 nt, Mycobacterium tuberculosis H37Rv
aaacgccgucgccugcaagc

SEQ ID NO: 1370740 - RNA, 22 nt, Mycobacterium tuberculosis H37Rv
ccucgccacgcucggcggccag

SEQ ID NO: 1370741 - RNA, 23 nt, Mycobacterium tuberculosis H37Rv
ccucgccacgcucggcggccagc

SEQ ID NO: 1370742 - RNA, 19 nt, Mycobacterium tuberculosis H37Rv
ccucgcagguggugacacg

SEQ ID NO: 1370743 - RNA, 20 nt, Mycobacterium tuberculosis H37Rv
ccucgcacaauggcggcgcc

SEQ ID NO: 1370744 - RNA, 22 nt, Mycobacterium tuberculosis H37Rv
ccucgcacaauggcggcgccgu

SEQ ID NO: 1370745 - RNA, 16 nt, Mycobacterium tuberculosis H37Rv
ccucgccccaccggcc

SEQ ID NO: 1370746 - RNA, 16 nt, Mycobacterium tuberculosis H37Rv
ccuccuccgcaaucgc

SEQ ID NO: 1370747 - RNA, 16 nt, Mycobacterium tuberculosis H37Rv
ccuccgucagcgccgc

SEQ ID NO: 1370748 - RNA, 16 nt, Mycobacterium tuberculosis H37Rv
ccuccguugcccccau

SEQ ID NO: 1370749 - RNA, 23 nt, Mycobacterium tuberculosis H37Rv
ccuccucgauagcggcgccugac

SEQ ID NO: 1370750 - RNA, 21 nt, Mycobacterium tuberculosis H37Rv
ccuccucgcccauuggccagg

SEQ ID NO: 1370751 - RNA, 14 nt, Mycobacterium tuberculosis H37Rv
ccuccuccguuugg

SEQ ID NO: 1370752 - RNA, 24 nt, Mycobacterium tuberculosis H37Rv
ccuccguaacgccaagcucggccc

SEQ ID NO: 1370753 - RNA, 15 nt, Mycobacterium tuberculosis H37Rv
ccuccgcuagaacag

SEQ ID NO: 1370754 - RNA, 20 nt, Mycobacterium tuberculosis H37Rv
ccuccgccggcaccuccggc

SEQ ID NO: 1370755 - RNA, 17 nt, Mycobacterium tuberculosis H37Rv
ccuccgccugccccacc

SEQ ID NO: 1370756 - RNA, 23 nt, Mycobacterium tuberculosis H37Rv
ccucguacucaucgacguuccag

SEQ ID NO: 1370757 - RNA, 22 nt, Mycobacterium tuberculosis H37Rv
ccucguagaacgcuagcgccaa

SEQ ID NO: 1370758 - RNA, 22 nt, Mycobacterium tuberculosis H37Rv
ccucggugugcucgccgaccag

SEQ ID NO: 1370759 - RNA, 16 nt, Mycobacterium tuberculosis H37Rv
ccucggugccggccgc

SEQ ID NO: 1370760 - RNA, 22 nt, Mycobacterium tuberculosis H37Rv
ccucggcgaagucacgcacccg

SEQ ID NO: 1370761 - RNA, 21 nt, Mycobacterium tuberculosis H37Rv
ccucggcgaccugcucgcugg

SEQ ID NO: 1370762 - RNA, 18 nt, Mycobacterium tuberculosis H37Rv
ccucggcgagcacgucac

SEQ ID NO: 1370763 - RNA, 19 nt, Mycobacterium tuberculosis H37Rv
ccucggcgcgcucggccgg

SEQ ID NO: 1370764 - RNA, 17 nt, Mycobacterium tuberculosis H37Rv
ccucggccgccagcccc

SEQ ID NO: 1370765 - RNA, 19 nt, Mycobacterium tuberculosis H37Rv
ccucgcggagccgucgcau

SEQ ID NO: 1370766 - RNA, 17 nt, Mycobacterium tuberculosis H37Rv
ccucgcuaacuccccag

SEQ ID NO: 1370767 - RNA, 20 nt, Mycobacterium tuberculosis H37Rv
ccucgcguagggccagcgcc

SEQ ID NO: 1370768 - RNA, 16 nt, Mycobacterium tuberculosis H37Rv
ccucgcgcgccacggu

SEQ ID NO: 1370769 - RNA, 18 nt, Mycobacterium tuberculosis H37Rv
ccucgucgcgggccaccg

SEQ ID NO: 1370770 - RNA, 15 nt, Mycobacterium tuberculosis H37Rv
ccucgucgcgggcca

SEQ ID NO: 1370771 - RNA, 20 nt, Mycobacterium tuberculosis H37Rv
ccucgucgaucgccgcgaug

SEQ ID NO: 1370772 - RNA, 22 nt, Mycobacterium tuberculosis H37Rv
ccucgucgccgcgguagacgcc

SEQ ID NO: 1370773 - RNA, 17 nt, Mycobacterium tuberculosis H37Rv
ccucgucgugcaccucg

SEQ ID NO: 1370774 - RNA, 23 nt, Mycobacterium tuberculosis H37Rv
ccucgucggugugccagugcugc

SEQ ID NO: 1370775 - RNA, 22 nt, Mycobacterium tuberculosis H37Rv
ccucgucggugugccagugcug

SEQ ID NO: 1370776 - RNA, 21 nt, Mycobacterium tuberculosis H37Rv
ccucgucggccgacaccgcca

SEQ ID NO: 1370777 - RNA, 21 nt, Mycobacterium tuberculosis H37Rv
ccucgucggcgacggccagcg

SEQ ID NO: 1370778 - RNA, 23 nt, Mycobacterium tuberculosis H37Rv
ccucgucaaucaccaccgccagc

SEQ ID NO: 1370779 - RNA, 20 nt, Mycobacterium tuberculosis H37Rv
ccucguaugccguggccgcc

SEQ ID NO: 1370780 - RNA, 14 nt, Mycobacterium tuberculosis H37Rv
ccucguuguagccg

SEQ ID NO: 1370781 - RNA, 19 nt, Mycobacterium tuberculosis H37Rv
ccucguuaucgaccgccgc

SEQ ID NO: 1370782 - RNA, 14 nt, Mycobacterium tuberculosis H37Rv
ccucgugcggcgcu

SEQ ID NO: 1370783 - RNA, 14 nt, Mycobacterium tuberculosis H37Rv
ccucgugcagcacu

SEQ ID NO: 1370784 - RNA, 18 nt, Mycobacterium tuberculosis H37Rv
ccucgucguaccguucgg

SEQ ID NO: 1370785 - RNA, 18 nt, Mycobacterium tuberculosis H37Rv
ccucguuaucgaccgccg

SEQ ID NO: 1370786 - RNA, 17 nt, Mycobacterium tuberculosis H37Rv
ccucugcgaucaguucg

SEQ ID NO: 1370787 - RNA, 19 nt, Mycobacterium tuberculosis H37Rv
ccucucugucgcguugugg

SEQ ID NO: 1370788 - RNA, 21 nt, Mycobacterium tuberculosis H37Rv
ccucucuucccaaccgcccgu

SEQ ID NO: 1370789 - RNA, 15 nt, Mycobacterium tuberculosis H37Rv
ccucucugcgccagg

SEQ ID NO: 1370790 - RNA, 12 nt, Mycobacterium tuberculosis H37Rv
ccucucugcgcc

SEQ ID NO: 1370791 - RNA, 16 nt, Mycobacterium tuberculosis H37Rv
ccucuccguccucguc

SEQ ID NO: 1370792 - RNA, 14 nt, Mycobacterium tuberculosis H37Rv
ccucuagcgcccga

SEQ ID NO: 1370793 - RNA, 12 nt, Mycobacterium tuberculosis H37Rv
ccugacacccau

SEQ ID NO: 1370794 - RNA, 18 nt, Mycobacterium tuberculosis H37Rv
ccugacacgcccgcgagc

SEQ ID NO: 1370795 - RNA, 18 nt, Mycobacterium tuberculosis H37Rv
ccugaaugcggccuucgg

SEQ ID NO: 1370796 - RNA, 16 nt, Mycobacterium tuberculosis H37Rv
ccugacgaucauugca

SEQ ID NO: 1370797 - RNA, 18 nt, Mycobacterium tuberculosis H37Rv
ccugaccggucacccgug

SEQ ID NO: 1370798 - RNA, 18 nt, Mycobacterium tuberculosis H37Rv
ccugaccgaagucugcag

SEQ ID NO: 1370799 - RNA, 23 nt, Mycobacterium tuberculosis H37Rv
ccugacgguaaaugucgaacagg

SEQ ID NO: 1370800 - RNA, 19 nt, Mycobacterium tuberculosis H37Rv
ccugacgguacagcuccac

SEQ ID NO: 1370801 - RNA, 19 nt, Mycobacterium tuberculosis H37Rv
ccugacgaucauugcaccc

SEQ ID NO: 1370802 - RNA, 23 nt, Mycobacterium tuberculosis H37Rv
ccugacgccccgccacaauggac

SEQ ID NO: 1370803 - RNA, 23 nt, Mycobacterium tuberculosis H37Rv
ccugagucggcauugcugguugc

SEQ ID NO: 1370804 - RNA, 21 nt, Mycobacterium tuberculosis H37Rv
ccugauaccaauccggcugcg

SEQ ID NO: 1370805 - RNA, 17 nt, Mycobacterium tuberculosis H37Rv
ccugagcaccaagaccg

SEQ ID NO: 1370806 - RNA, 19 nt, Mycobacterium tuberculosis H37Rv
ccugagcaucuccucgccu

SEQ ID NO: 1370807 - RNA, 14 nt, Mycobacterium tuberculosis H37Rv
ccugagccaccaac

SEQ ID NO: 1370808 - RNA, 22 nt, Mycobacterium tuberculosis H37Rv
ccugagcgucgucgccggcgcu

SEQ ID NO: 1370809 - RNA, 20 nt, Mycobacterium tuberculosis H37Rv
ccucugguggcgcugaagcc

SEQ ID NO: 1370810 - RNA, 13 nt, Mycobacterium tuberculosis H37Rv
ccucugcucagcc

SEQ ID NO: 1370811 - RNA, 14 nt, Mycobacterium tuberculosis H37Rv
ccucugucuucagc

SEQ ID NO: 1370812 - RNA, 17 nt, Mycobacterium tuberculosis H37Rv
ccucuucgggugcagcc

SEQ ID NO: 1370813 - RNA, 18 nt, Mycobacterium tuberculosis H37Rv
ccucuucgggugcagcca

SEQ ID NO: 1370814 - RNA, 16 nt, Mycobacterium tuberculosis H37Rv
ccucuucgguguggca

SEQ ID NO: 1370815 - RNA, 14 nt, Mycobacterium tuberculosis H37Rv
ccugaaccggccgc

SEQ ID NO: 1370816 - RNA, 16 nt, Mycobacterium tuberculosis H37Rv
ccugaaacggcugcag

SEQ ID NO: 1370817 - RNA, 17 nt, Mycobacterium tuberculosis H37Rv
ccugaagccagcgcagc

SEQ ID NO: 1370818 - RNA, 20 nt, Mycobacterium tuberculosis H37Rv
ccugaagccgcgcugcgacu

SEQ ID NO: 1370819 - RNA, 14 nt, Mycobacterium tuberculosis H37Rv
ccugaagggccgcc

SEQ ID NO: 1370820 - RNA, 23 nt, Mycobacterium tuberculosis H37Rv
ccugcgcggcugccgucuccugg

SEQ ID NO: 1370821 - RNA, 22 nt, Mycobacterium tuberculosis H37Rv
ccugcgcgaccgaccagccgug

SEQ ID NO: 1370822 - RNA, 22 nt, Mycobacterium tuberculosis H37Rv
ccugcgccuuggucgccggcgu

SEQ ID NO: 1370823 - RNA, 24 nt, Mycobacterium tuberculosis H37Rv
ccugcgcggcgaucgcuccgcggc

SEQ ID NO: 1370824 - RNA, 22 nt, Mycobacterium tuberculosis H37Rv
ccugcgcggcgcgggucacgcc

SEQ ID NO: 1370825 - RNA, 13 nt, Mycobacterium tuberculosis H37Rv
ccugcgccgcagu

SEQ ID NO: 1370826 - RNA, 19 nt, Mycobacterium tuberculosis H37Rv
ccugcgcaucaccacuggc

SEQ ID NO: 1370827 - RNA, 20 nt, Mycobacterium tuberculosis H37Rv
ccugcgccgccagcgccgcc

SEQ ID NO: 1370828 - RNA, 13 nt, Mycobacterium tuberculosis H37Rv
ccugcgccgcgcg

SEQ ID NO: 1370829 - RNA, 18 nt, Mycobacterium tuberculosis H37Rv
ccugcgccgguaacuguc

SEQ ID NO: 1370830 - RNA, 15 nt, Mycobacterium tuberculosis H37Rv
ccugcgcagccgccu

SEQ ID NO: 1370831 - RNA, 16 nt, Mycobacterium tuberculosis H37Rv
ccugcgcagccgccuc

SEQ ID NO: 1370832 - RNA, 15 nt, Mycobacterium tuberculosis H37Rv
ccugcgccgaguugu

SEQ ID NO: 1370833 - RNA, 21 nt, Mycobacterium tuberculosis H37Rv
ccugccacgacgaacaccagc

SEQ ID NO: 1370834 - RNA, 14 nt, Mycobacterium tuberculosis H37Rv
ccugccgaucccgu

SEQ ID NO: 1370835 - RNA, 19 nt, Mycobacterium tuberculosis H37Rv
ccugccgaucccguggugg

SEQ ID NO: 1370836 - RNA, 22 nt, Mycobacterium tuberculosis H37Rv
ccugccgaucccgugguggcgc

SEQ ID NO: 1370837 - RNA, 20 nt, Mycobacterium tuberculosis H37Rv
ccugccggaccaccgggccg

SEQ ID NO: 1370838 - RNA, 15 nt, Mycobacterium tuberculosis H37Rv
ccugccggcagcggc

SEQ ID NO: 1370839 - RNA, 18 nt, Mycobacterium tuberculosis H37Rv
ccugccgggacauuccca

SEQ ID NO: 1370840 - RNA, 12 nt, Mycobacterium tuberculosis H37Rv
ccugccgggcca

SEQ ID NO: 1370841 - RNA, 20 nt, Mycobacterium tuberculosis H37Rv
ccugcaggccgccggccagc

SEQ ID NO: 1370842 - RNA, 12 nt, Mycobacterium tuberculosis H37Rv
ccugcagcuggc

SEQ ID NO: 1370843 - RNA, 18 nt, Mycobacterium tuberculosis H37Rv
ccugauccgccugccgac

SEQ ID NO: 1370844 - RNA, 22 nt, Mycobacterium tuberculosis H37Rv
ccugaucaaggaccgcucugcg

SEQ ID NO: 1370845 - RNA, 21 nt, Mycobacterium tuberculosis H37Rv
ccugauggcgcugcaccguag

SEQ ID NO: 1370846 - RNA, 21 nt, Mycobacterium tuberculosis H37Rv
ccugcaacgucacucccuggc

SEQ ID NO: 1370847 - RNA, 19 nt, Mycobacterium tuberculosis H37Rv
ccugcaagcuaagcgccug

SEQ ID NO: 1370848 - RNA, 13 nt, Mycobacterium tuberculosis H37Rv
ccugcaagaacca

SEQ ID NO: 1370849 - RNA, 22 nt, Mycobacterium tuberculosis H37Rv
ccugucauguccugggccgccg

SEQ ID NO: 1370850 - RNA, 19 nt, Mycobacterium tuberculosis H37Rv
ccugucauguccugggccg

SEQ ID NO: 1370851 - RNA, 23 nt, Mycobacterium tuberculosis H37Rv
ccuguccggcauaccgaacagca

SEQ ID NO: 1370852 - RNA, 13 nt, Mycobacterium tuberculosis H37Rv
ccuguccggcgcc

SEQ ID NO: 1370853 - RNA, 20 nt, Mycobacterium tuberculosis H37Rv
ccuguccggcgccgaggucg

SEQ ID NO: 1370854 - RNA, 20 nt, Mycobacterium tuberculosis H37Rv
ccuguaguucgaugacugaa

SEQ ID NO: 1370855 - RNA, 20 nt, Mycobacterium tuberculosis H37Rv
ccugcucgggggccgaccag

SEQ ID NO: 1370856 - RNA, 15 nt, Mycobacterium tuberculosis H37Rv
ccugcucgcugguga

SEQ ID NO: 1370857 - RNA, 19 nt, Mycobacterium tuberculosis H37Rv
ccugcugcagaaaggccaa

SEQ ID NO: 1370858 - RNA, 23 nt, Mycobacterium tuberculosis H37Rv
ccugcugcaaccgacuucgaugg

SEQ ID NO: 1370859 - RNA, 19 nt, Mycobacterium tuberculosis H37Rv
ccuggguuggcauccaaaa

SEQ ID NO: 1370860 - RNA, 19 nt, Mycobacterium tuberculosis H37Rv
ccugggugauggccgcgcc

SEQ ID NO: 1370861 - RNA, 20 nt, Mycobacterium tuberculosis H37Rv
ccugguccaggcccuggcca

SEQ ID NO: 1370862 - RNA, 14 nt, Mycobacterium tuberculosis H37Rv
ccuggucaaccgcg

SEQ ID NO: 1370863 - RNA, 13 nt, Mycobacterium tuberculosis H37Rv
ccuggucaccagc

SEQ ID NO: 1370864 - RNA, 17 nt, Mycobacterium tuberculosis H37Rv
ccugguagucgcccgug

SEQ ID NO: 1370865 - RNA, 20 nt, Mycobacterium tuberculosis H37Rv
ccugugccagcagcagcgcc

SEQ ID NO: 1370866 - RNA, 16 nt, Mycobacterium tuberculosis H37Rv
ccugugucgccgucgc

SEQ ID NO: 1370867 - RNA, 23 nt, Mycobacterium tuberculosis H37Rv
ccuguugacccaucaugguccgg

SEQ ID NO: 1370868 - RNA, 18 nt, Mycobacterium tuberculosis H37Rv
ccuguuccagcgugccug

SEQ ID NO: 1370869 - RNA, 16 nt, Mycobacterium tuberculosis H37Rv
ccuguucacccacucc

SEQ ID NO: 1370870 - RNA, 15 nt, Mycobacterium tuberculosis H37Rv
ccuugaugcgcccca

SEQ ID NO: 1370871 - RNA, 16 nt, Mycobacterium tuberculosis H37Rv
ccuugaugcggccgcg

SEQ ID NO: 1370872 - RNA, 15 nt, Mycobacterium tuberculosis H37Rv
ccuugauugccgcgu

SEQ ID NO: 1370873 - RNA, 22 nt, Mycobacterium tuberculosis H37Rv
ccuugcccacggcgaccacgcc

SEQ ID NO: 1370874 - RNA, 21 nt, Mycobacterium tuberculosis H37Rv
ccuucucguaacgcggcacca

SEQ ID NO: 1370875 - RNA, 14 nt, Mycobacterium tuberculosis H37Rv
ccuucucgccgugu

SEQ ID NO: 1370876 - RNA, 19 nt, Mycobacterium tuberculosis H37Rv
ccuucucguaacgcggcac

SEQ ID NO: 1370877 - RNA, 18 nt, Mycobacterium tuberculosis H37Rv
ccuucugacuaucucgcu

SEQ ID NO: 1370878 - RNA, 22 nt, Mycobacterium tuberculosis H37Rv
ccuugaucgagcagggugacca

SEQ ID NO: 1370879 - RNA, 17 nt, Mycobacterium tuberculosis H37Rv
ccuugaucgugcuggcg

SEQ ID NO: 1370880 - RNA, 17 nt, Mycobacterium tuberculosis H37Rv
ccuugaucgagcagggu

SEQ ID NO: 1370881 - RNA, 16 nt, Mycobacterium tuberculosis H37Rv
ccuugaggucacccau

SEQ ID NO: 1370882 - RNA, 16 nt, Mycobacterium tuberculosis H37Rv
ccuugcggaagaagug

SEQ ID NO: 1370883 - RNA, 14 nt, Mycobacterium tuberculosis H37Rv
ccuugcgcagcacc

SEQ ID NO: 1370884 - RNA, 22 nt, Mycobacterium tuberculosis H37Rv
ccuugcgauugcgcacacccug

SEQ ID NO: 1370885 - RNA, 23 nt, Mycobacterium tuberculosis H37Rv
ccuugcgcgccauuggcgccgcc

SEQ ID NO: 1370886 - RNA, 13 nt, Mycobacterium tuberculosis H37Rv
ccuugggcagcuu

SEQ ID NO: 1370887 - RNA, 20 nt, Mycobacterium tuberculosis H37Rv
ccuuggcuucgacgcuuccu

SEQ ID NO: 1370888 - RNA, 18 nt, Mycobacterium tuberculosis H37Rv
ccuugcggcagaccaagc

SEQ ID NO: 1370889 - RNA, 14 nt, Mycobacterium tuberculosis H37Rv
ccuugcggcagacc

SEQ ID NO: 1370890 - RNA, 16 nt, Mycobacterium tuberculosis H37Rv
ccuuggcgcggcaccc

SEQ ID NO: 1370891 - RNA, 17 nt, Mycobacterium tuberculosis H37Rv
ccuugccuagccgcagc

SEQ ID NO: 1370892 - RNA, 19 nt, Mycobacterium tuberculosis H37Rv
ccuugccuccggcgccgcc

SEQ ID NO: 1370893 - RNA, 17 nt, Mycobacterium tuberculosis H37Rv
ccuugccuuccgaccca

SEQ ID NO: 1370894 - RNA, 20 nt, Mycobacterium tuberculosis H37Rv
ccuugccgccguugccgccg

SEQ ID NO: 1370895 - RNA, 19 nt, Mycobacterium tuberculosis H37Rv
ccuugccgccggccccgcc

SEQ ID NO: 1370896 - RNA, 13 nt, Mycobacterium tuberculosis H37Rv
ccuugccgguggg

SEQ ID NO: 1370897 - RNA, 24 nt, Mycobacterium tuberculosis H37Rv
ccuuccgacccaacgaccaccacc

SEQ ID NO: 1370898 - RNA, 17 nt, Mycobacterium tuberculosis H37Rv
ccuucgucacauugcca

SEQ ID NO: 1370899 - RNA, 18 nt, Mycobacterium tuberculosis H37Rv
ccuucguagcggccgcag

SEQ ID NO: 1370900 - RNA, 23 nt, Mycobacterium tuberculosis H37Rv
ccuucguagcggccgcaggcgaa

SEQ ID NO: 1370901 - RNA, 22 nt, Mycobacterium tuberculosis H37Rv
ccuucggugccggaaacgccag

SEQ ID NO: 1370902 - RNA, 21 nt, Mycobacterium tuberculosis H37Rv
ccuucucccgcacggccgggu

SEQ ID NO: 1370903 - RNA, 13 nt, Mycobacterium tuberculosis H37Rv
ccuucucccgcac

SEQ ID NO: 1370904 - RNA, 12 nt, Mycobacterium tuberculosis H37Rv
ccuucucacgca

SEQ ID NO: 1370905 - RNA, 21 nt, Mycobacterium tuberculosis H37Rv
ccuucaucaacgacaccagau

SEQ ID NO: 1370906 - RNA, 15 nt, Mycobacterium tuberculosis H37Rv
ccuucaucaacgaca

SEQ ID NO: 1370907 - RNA, 21 nt, Mycobacterium tuberculosis H37Rv
ccuuagggucgccgcauugca

SEQ ID NO: 1370908 - RNA, 15 nt, Mycobacterium tuberculosis H37Rv
ccuuggucgccgccu

SEQ ID NO: 1370909 - RNA, 17 nt, Mycobacterium tuberculosis H37Rv
ccuuggucgccgccuuc

SEQ ID NO: 1370910 - RNA, 15 nt, Mycobacterium tuberculosis H37Rv
ccuuggucgccggcg

SEQ ID NO: 1370911 - RNA, 23 nt, Mycobacterium tuberculosis H37Rv
ccuuggucaccuucuuggcgggu

SEQ ID NO: 1370912 - RNA, 17 nt, Mycobacterium tuberculosis H37Rv
ccuuucugaagcugagc

SEQ ID NO: 1370913 - RNA, 20 nt, Mycobacterium tuberculosis H37Rv
ccuuugagcgcggccaccag

SEQ ID NO: 1370914 - RNA, 12 nt, Mycobacterium tuberculosis H37Rv
cgaaaacaaccc

SEQ ID NO: 1370915 - RNA, 21 nt, Mycobacterium tuberculosis H37Rv
cgaaaaccucggacugcagcg

SEQ ID NO: 1370916 - RNA, 14 nt, Mycobacterium tuberculosis H37Rv
cgaaaacugacccc

SEQ ID NO: 1370917 - RNA, 18 nt, Mycobacterium tuberculosis H37Rv
cgaaaaguagaccgagcc

SEQ ID NO: 1370918 - RNA, 22 nt, Mycobacterium tuberculosis H37Rv
cgaaaagggcgacagcggcgac

SEQ ID NO: 1370919 - RNA, 18 nt, Mycobacterium tuberculosis H37Rv
cgaaacaucucggcgcag

SEQ ID NO: 1370920 - RNA, 23 nt, Mycobacterium tuberculosis H37Rv
cgaaaccacuuccggcguggccc

SEQ ID NO: 1370921 - RNA, 16 nt, Mycobacterium tuberculosis H37Rv
cgaaaucucaucgauu

SEQ ID NO: 1370922 - RNA, 19 nt, Mycobacterium tuberculosis H37Rv
cgaaaucaguugcgcucca

SEQ ID NO: 1370923 - RNA, 16 nt, Mycobacterium tuberculosis H37Rv
cgaaaucaccgcugag

SEQ ID NO: 1370924 - RNA, 24 nt, Mycobacterium tuberculosis H37Rv
cgaaaucagcccgcgcagcggucc

SEQ ID NO: 1370925 - RNA, 15 nt, Mycobacterium tuberculosis H37Rv
cgaaaucccccgaca

SEQ ID NO: 1370926 - RNA, 20 nt, Mycobacterium tuberculosis H37Rv
cgaaauccccugcgcugcag

SEQ ID NO: 1370927 - RNA, 19 nt, Mycobacterium tuberculosis H37Rv
cgaaaucucaucgauuggc

SEQ ID NO: 1370928 - RNA, 20 nt, Mycobacterium tuberculosis H37Rv
cgaaagccaggcggcaagga

SEQ ID NO: 1370929 - RNA, 18 nt, Mycobacterium tuberculosis H37Rv
cgaaagugguggcaacgg

SEQ ID NO: 1370930 - RNA, 22 nt, Mycobacterium tuberculosis H37Rv
cgaaaguccugcagugcggcgu

SEQ ID NO: 1370931 - RNA, 22 nt, Mycobacterium tuberculosis H37Rv
cgaacaucaccgucgcccgggu

SEQ ID NO: 1370932 - RNA, 18 nt, Mycobacterium tuberculosis H37Rv
cgaacaguaggccuccgc

SEQ ID NO: 1370933 - RNA, 15 nt, Mycobacterium tuberculosis H37Rv
cgaacagucgaguga

SEQ ID NO: 1370934 - RNA, 17 nt, Mycobacterium tuberculosis H37Rv
cgaacagucgagugaag

SEQ ID NO: 1370935 - RNA, 16 nt, Mycobacterium tuberculosis H37Rv
cgaacaucgccagcgc

SEQ ID NO: 1370936 - RNA, 13 nt, Mycobacterium tuberculosis H37Rv
cgaacauugcgcc

SEQ ID NO: 1370937 - RNA, 13 nt, Mycobacterium tuberculosis H37Rv
cgaaccaccaccg

SEQ ID NO: 1370938 - RNA, 14 nt, Mycobacterium tuberculosis H37Rv
cgaaccaccgcguu

SEQ ID NO: 1370939 - RNA, 23 nt, Mycobacterium tuberculosis H37Rv
cgaaccacgcgcccgcaccaccg

SEQ ID NO: 1370940 - RNA, 19 nt, Mycobacterium tuberculosis H37Rv
cgaaccgggacaaccgcgc

SEQ ID NO: 1370941 - RNA, 23 nt, Mycobacterium tuberculosis H37Rv
cgaacgcccugacgguggugacc

SEQ ID NO: 1370942 - RNA, 13 nt, Mycobacterium tuberculosis H37Rv
cgaacccacugcc

SEQ ID NO: 1370943 - RNA, 14 nt, Mycobacterium tuberculosis H37Rv
cgaacccaggcaca

SEQ ID NO: 1370944 - RNA, 23 nt, Mycobacterium tuberculosis H37Rv
cgaacccgguguugagcgaaccc

SEQ ID NO: 1370945 - RNA, 18 nt, Mycobacterium tuberculosis H37Rv
cgaacccgccgucaccgc

SEQ ID NO: 1370946 - RNA, 22 nt, Mycobacterium tuberculosis H37Rv
cgaaauuccgggccuggccugc

SEQ ID NO: 1370947 - RNA, 13 nt, Mycobacterium tuberculosis H37Rv
cgaacaagaaaag

SEQ ID NO: 1370948 - RNA, 18 nt, Mycobacterium tuberculosis H37Rv
cgaacaaguggccagcgc

SEQ ID NO: 1370949 - RNA, 14 nt, Mycobacterium tuberculosis H37Rv
cgaacaauucacgc

SEQ ID NO: 1370950 - RNA, 20 nt, Mycobacterium tuberculosis H37Rv
cgaacaauucacgcaccaca

SEQ ID NO: 1370951 - RNA, 13 nt, Mycobacterium tuberculosis H37Rv
cgaacagcaccgc

SEQ ID NO: 1370952 - RNA, 21 nt, Mycobacterium tuberculosis H37Rv
cgaacagcaccgaacccgcca

SEQ ID NO: 1370953 - RNA, 20 nt, Mycobacterium tuberculosis H37Rv
cgaacacgucuaucuggucg

SEQ ID NO: 1370954 - RNA, 15 nt, Mycobacterium tuberculosis H37Rv
cgaacagccccaggg

SEQ ID NO: 1370955 - RNA, 15 nt, Mycobacterium tuberculosis H37Rv
cgaacaggccggccg

SEQ ID NO: 1370956 - RNA, 17 nt, Mycobacterium tuberculosis H37Rv
cgaacagggcugcgaug

SEQ ID NO: 1370957 - RNA, 14 nt, Mycobacterium tuberculosis H37Rv
cgaacagcucgaac

SEQ ID NO: 1370958 - RNA, 20 nt, Mycobacterium tuberculosis H37Rv
cgaacagcgggggcagcgcg

SEQ ID NO: 1370959 - RNA, 15 nt, Mycobacterium tuberculosis H37Rv
cgaagcggccaccgc

SEQ ID NO: 1370960 - RNA, 19 nt, Mycobacterium tuberculosis H37Rv
cgaagcgggaaggcucacc

SEQ ID NO: 1370961 - RNA, 13 nt, Mycobacterium tuberculosis H37Rv
cgaaggccgccaa

SEQ ID NO: 1370962 - RNA, 17 nt, Mycobacterium tuberculosis H37Rv
cgaaggccgccaaccgu

SEQ ID NO: 1370963 - RNA, 20 nt, Mycobacterium tuberculosis H37Rv
cgaaggggugcccggcggcc

SEQ ID NO: 1370964 - RNA, 23 nt, Mycobacterium tuberculosis H37Rv
cgaaggguaagaguucgcgcgcc

SEQ ID NO: 1370965 - RNA, 20 nt, Mycobacterium tuberculosis H37Rv
cgaagggcuugucgccggca

SEQ ID NO: 1370966 - RNA, 20 nt, Mycobacterium tuberculosis H37Rv
cgaaggcguucgacucgacc

SEQ ID NO: 1370967 - RNA, 21 nt, Mycobacterium tuberculosis H37Rv
cgaagucgacgaacucgccca

SEQ ID NO: 1370968 - RNA, 18 nt, Mycobacterium tuberculosis H37Rv
cgaagucgagugccgcgu

SEQ ID NO: 1370969 - RNA, 22 nt, Mycobacterium tuberculosis H37Rv
cgaagucguacugguagcacuc

SEQ ID NO: 1370970 - RNA, 15 nt, Mycobacterium tuberculosis H37Rv
cgaagucacgcaccc

SEQ ID NO: 1370971 - RNA, 21 nt, Mycobacterium tuberculosis H37Rv
cgaaggugaugaacaccggcg

SEQ ID NO: 1370972 - RNA, 16 nt, Mycobacterium tuberculosis H37Rv
cgaagguguccuccag

SEQ ID NO: 1370973 - RNA, 18 nt, Mycobacterium tuberculosis H37Rv
cgaagguguccuccagcu

SEQ ID NO: 1370974 - RNA, 19 nt, Mycobacterium tuberculosis H37Rv
cgaacgcgaucgaccuugg

SEQ ID NO: 1370975 - RNA, 16 nt, Mycobacterium tuberculosis H37Rv
cgaacgcguccagcgc

SEQ ID NO: 1370976 - RNA, 18 nt, Mycobacterium tuberculosis H37Rv
cgaagccuugcagcgccc

SEQ ID NO: 1370977 - RNA, 18 nt, Mycobacterium tuberculosis H37Rv
cgaagccggcgccggcuu

SEQ ID NO: 1370978 - RNA, 17 nt, Mycobacterium tuberculosis H37Rv
cgaagccuugcagcgcc

SEQ ID NO: 1370979 - RNA, 17 nt, Mycobacterium tuberculosis H37Rv
cgaagccgccgcgacca

SEQ ID NO: 1370980 - RNA, 20 nt, Mycobacterium tuberculosis H37Rv
cgaagaucgcgugccacagc

SEQ ID NO: 1370981 - RNA, 15 nt, Mycobacterium tuberculosis H37Rv
cgaagaggagaacga

SEQ ID NO: 1370982 - RNA, 18 nt, Mycobacterium tuberculosis H37Rv
caugucgguuuccucgag

SEQ ID NO: 1370983 - RNA, 19 nt, Mycobacterium tuberculosis H37Rv
caugucgguuuccucgagc

SEQ ID NO: 1370984 - RNA, 17 nt, Mycobacterium tuberculosis H37Rv
caugucggcgcgccgca

SEQ ID NO: 1370985 - RNA, 13 nt, Mycobacterium tuberculosis H37Rv
caugucggcgcgc

SEQ ID NO: 1370986 - RNA, 14 nt, Mycobacterium tuberculosis H37Rv
caugucggcgcgcc

SEQ ID NO: 1370987 - RNA, 14 nt, Mycobacterium tuberculosis H37Rv
caugucggccaggu

SEQ ID NO: 1370988 - RNA, 19 nt, Mycobacterium tuberculosis H37Rv
caugucgcugccgccgccg

SEQ ID NO: 1370989 - RNA, 15 nt, Mycobacterium tuberculosis H37Rv
caugucgcugccgcc

SEQ ID NO: 1370990 - RNA, 20 nt, Mycobacterium tuberculosis H37Rv
caugucgccgaacgccacca

SEQ ID NO: 1370991 - RNA, 17 nt, Mycobacterium tuberculosis H37Rv
cauguccgaccucugcg

SEQ ID NO: 1370992 - RNA, 15 nt, Mycobacterium tuberculosis H37Rv
cauguccgcagcggu

SEQ ID NO: 1370993 - RNA, 18 nt, Mycobacterium tuberculosis H37Rv
cauguccgcaguucgguc

SEQ ID NO: 1370994 - RNA, 18 nt, Mycobacterium tuberculosis H37Rv
caugucgaagaaccggcc

SEQ ID NO: 1370995 - RNA, 18 nt, Mycobacterium tuberculosis H37Rv
cauguccuuggagauguc

SEQ ID NO: 1370996 - RNA, 23 nt, Mycobacterium tuberculosis H37Rv
caugucgaucagcgcgacggucc

SEQ ID NO: 1370997 - RNA, 20 nt, Mycobacterium tuberculosis H37Rv
caugucgacggucagauggc

SEQ ID NO: 1370998 - RNA, 17 nt, Mycobacterium tuberculosis H37Rv
cauguccauguuuugcu

SEQ ID NO: 1370999 - RNA, 18 nt, Mycobacterium tuberculosis H37Rv
cauguccaucgcgcggcu

SEQ ID NO: 1371000 - RNA, 14 nt, Mycobacterium tuberculosis H37Rv
cauguccagugccg

SEQ ID NO: 1371001 - RNA, 15 nt, Mycobacterium tuberculosis H37Rv
cauguaauucaacaa

SEQ ID NO: 1371002 - RNA, 20 nt, Mycobacterium tuberculosis H37Rv
cauggccagcaucagcgcca

SEQ ID NO: 1371003 - RNA, 13 nt, Mycobacterium tuberculosis H37Rv
cauggcuugcucu

SEQ ID NO: 1371004 - RNA, 16 nt, Mycobacterium tuberculosis H37Rv
caugggucauggcgcu

SEQ ID NO: 1371005 - RNA, 19 nt, Mycobacterium tuberculosis H37Rv
caugggugaaucgacaggu

SEQ ID NO: 1371006 - RNA, 21 nt, Mycobacterium tuberculosis H37Rv
caugguccacagccggcggcu

SEQ ID NO: 1371007 - RNA, 22 nt, Mycobacterium tuberculosis H37Rv
cauggcacgcgggaagugcacc

SEQ ID NO: 1371008 - RNA, 15 nt, Mycobacterium tuberculosis H37Rv
cauggaacucacccu

SEQ ID NO: 1371009 - RNA, 15 nt, Mycobacterium tuberculosis H37Rv
caugcuggaccucgc

SEQ ID NO: 1371010 - RNA, 21 nt, Mycobacterium tuberculosis H37Rv
caugcucgucuugggccggga

SEQ ID NO: 1371011 - RNA, 19 nt, Mycobacterium tuberculosis H37Rv
caugcucgacgcccgccac

SEQ ID NO: 1371012 - RNA, 16 nt, Mycobacterium tuberculosis H37Rv
caugcucgacaaccgc

SEQ ID NO: 1371013 - RNA, 14 nt, Mycobacterium tuberculosis H37Rv
caugcucagggcag

SEQ ID NO: 1371014 - RNA, 21 nt, Mycobacterium tuberculosis H37Rv
caugcucagucgcucucgggc

SEQ ID NO: 1371015 - RNA, 15 nt, Mycobacterium tuberculosis H37Rv
caucuucggacgcca

SEQ ID NO: 1371016 - RNA, 16 nt, Mycobacterium tuberculosis H37Rv
caucuucggacgccag

SEQ ID NO: 1371017 - RNA, 17 nt, Mycobacterium tuberculosis H37Rv
caugugcgacauugguc

SEQ ID NO: 1371018 - RNA, 15 nt, Mycobacterium tuberculosis H37Rv
cauuagcagcacccg

SEQ ID NO: 1371019 - RNA, 13 nt, Mycobacterium tuberculosis H37Rv
cauuagcagcacc

SEQ ID NO: 1371020 - RNA, 20 nt, Mycobacterium tuberculosis H37Rv
cauuccguuuuuguugaccc

SEQ ID NO: 1371021 - RNA, 19 nt, Mycobacterium tuberculosis H37Rv
cauuccguaggccacagcc

SEQ ID NO: 1371022 - RNA, 15 nt, Mycobacterium tuberculosis H37Rv
cauucgcccggccgc

SEQ ID NO: 1371023 - RNA, 11 nt, Mycobacterium tuberculosis H37Rv
cauucgccggg

SEQ ID NO: 1371024 - RNA, 14 nt, Mycobacterium tuberculosis H37Rv
cauucgccccaccc

SEQ ID NO: 1371025 - RNA, 21 nt, Mycobacterium tuberculosis H37Rv
cauuccucgacgguguaacug

SEQ ID NO: 1371026 - RNA, 21 nt, Mycobacterium tuberculosis H37Rv
cauugcccguguuaaagaagc

SEQ ID NO: 1371027 - RNA, 20 nt, Mycobacterium tuberculosis H37Rv
cauugccgacgcgcggccag

SEQ ID NO: 1371028 - RNA, 19 nt, Mycobacterium tuberculosis H37Rv
cauugcgcccagcgacccg

SEQ ID NO: 1371029 - RNA, 19 nt, Mycobacterium tuberculosis H37Rv
cauugcccgagcccagcgc

SEQ ID NO: 1371030 - RNA, 20 nt, Mycobacterium tuberculosis H37Rv
cauugcccgagcccagcgcc

SEQ ID NO: 1371031 - RNA, 14 nt, Mycobacterium tuberculosis H37Rv
cauugcccauagcc

SEQ ID NO: 1371032 - RNA, 18 nt, Mycobacterium tuberculosis H37Rv
cauugcccauagccaggu

SEQ ID NO: 1371033 - RNA, 10 nt, Mycobacterium tuberculosis H37Rv
cauugccaua

SEQ ID NO: 1371034 - RNA, 21 nt, Mycobacterium tuberculosis H37Rv
cauugccauacagcaccccgc

SEQ ID NO: 1371035 - RNA, 17 nt, Mycobacterium tuberculosis H37Rv
cauucgcgacaacucgc

SEQ ID NO: 1371036 - RNA, 13 nt, Mycobacterium tuberculosis H37Rv
cauucgggcgccc

SEQ ID NO: 1371037 - RNA, 22 nt, Mycobacterium tuberculosis H37Rv
cauucgugggaaccaccagcac

SEQ ID NO: 1371038 - RNA, 13 nt, Mycobacterium tuberculosis H37Rv
cauuggcuccgaa

SEQ ID NO: 1371039 - RNA, 20 nt, Mycobacterium tuberculosis H37Rv
cauuggcggugcgcaccacc

SEQ ID NO: 1371040 - RNA, 23 nt, Mycobacterium tuberculosis H37Rv
cauuggcgucgacaacacgccgu

SEQ ID NO: 1371041 - RNA, 18 nt, Mycobacterium tuberculosis H37Rv
cauuggccuaggacaccg

SEQ ID NO: 1371042 - RNA, 13 nt, Mycobacterium tuberculosis H37Rv
cauuggcgccgcc

SEQ ID NO: 1371043 - RNA, 16 nt, Mycobacterium tuberculosis H37Rv
cauugggguggcaucg

SEQ ID NO: 1371044 - RNA, 17 nt, Mycobacterium tuberculosis H37Rv
cauuggguaaccagcgc

SEQ ID NO: 1371045 - RNA, 18 nt, Mycobacterium tuberculosis H37Rv
cauuggguaaccagcgcc

SEQ ID NO: 1371046 - RNA, 22 nt, Mycobacterium tuberculosis H37Rv
cauugguguggaauacgcugcu

SEQ ID NO: 1371047 - RNA, 17 nt, Mycobacterium tuberculosis H37Rv
cauugguguccaccacc

SEQ ID NO: 1371048 - RNA, 20 nt, Mycobacterium tuberculosis H37Rv
cauuucgucgucgcagugca

SEQ ID NO: 1371049 - RNA, 21 nt, Mycobacterium tuberculosis H37Rv
cauuucaacguauccccgacc

SEQ ID NO: 1371050 - RNA, 21 nt, Mycobacterium tuberculosis H37Rv
ccaacaggccuaggucgacgc

SEQ ID NO: 1371051 - RNA, 17 nt, Mycobacterium tuberculosis H37Rv
ccaacaacuccagcagg

SEQ ID NO: 1371052 - RNA, 20 nt, Mycobacterium tuberculosis H37Rv
ccaacaacaucagcgacagc

SEQ ID NO: 1371053 - RNA, 15 nt, Mycobacterium tuberculosis H37Rv
ccaaaggacgacacc

SEQ ID NO: 1371054 - RNA, 15 nt, Mycobacterium tuberculosis H37Rv
ccaaagggaguguuu

SEQ ID NO: 1371055 - RNA, 20 nt, Mycobacterium tuberculosis H37Rv
ccaaagcgccagcagccacc

SEQ ID NO: 1371056 - RNA, 24 nt, Mycobacterium tuberculosis H37Rv
ccaacggguaguucuuggucaggc

SEQ ID NO: 1371057 - RNA, 12 nt, Mycobacterium tuberculosis H37Rv
ccaacggcagcg

SEQ ID NO: 1371058 - RNA, 20 nt, Mycobacterium tuberculosis H37Rv
ccaacugcgaaacgccaccg

SEQ ID NO: 1371059 - RNA, 20 nt, Mycobacterium tuberculosis H37Rv
ccaacugaauggcaccgagg

SEQ ID NO: 1371060 - RNA, 16 nt, Mycobacterium tuberculosis H37Rv
ccaacugaaccgagug

SEQ ID NO: 1371061 - RNA, 19 nt, Mycobacterium tuberculosis H37Rv
ccaacgucgacuucagcgg

SEQ ID NO: 1371062 - RNA, 18 nt, Mycobacterium tuberculosis H37Rv
ccaacgucgccaggucau

SEQ ID NO: 1371063 - RNA, 23 nt, Mycobacterium tuberculosis H37Rv
ccaacucguggaacuccguccgc

SEQ ID NO: 1371064 - RNA, 16 nt, Mycobacterium tuberculosis H37Rv
ccaacgaccaccacca

SEQ ID NO: 1371065 - RNA, 21 nt, Mycobacterium tuberculosis H37Rv
ccaacgacuguggcgccgccg

SEQ ID NO: 1371066 - RNA, 14 nt, Mycobacterium tuberculosis H37Rv
ccaacgagucagug

SEQ ID NO: 1371067 - RNA, 13 nt, Mycobacterium tuberculosis H37Rv
ccaacgaccacca

SEQ ID NO: 1371068 - RNA, 13 nt, Mycobacterium tuberculosis H37Rv
ccaaccugggcca

SEQ ID NO: 1371069 - RNA, 22 nt, Mycobacterium tuberculosis H37Rv
ccaacgcucccuacgagcccac

SEQ ID NO: 1371070 - RNA, 14 nt, Mycobacterium tuberculosis H37Rv
ccaacgccaccguc

SEQ ID NO: 1371071 - RNA, 18 nt, Mycobacterium tuberculosis H37Rv
ccaaggacgaacgcgccg

SEQ ID NO: 1371072 - RNA, 15 nt, Mycobacterium tuberculosis H37Rv
ccaagcucggcccag

SEQ ID NO: 1371073 - RNA, 16 nt, Mycobacterium tuberculosis H37Rv
ccaagcucggcccagc

SEQ ID NO: 1371074 - RNA, 16 nt, Mycobacterium tuberculosis H37Rv
ccaacugggccgagcg

SEQ ID NO: 1371075 - RNA, 18 nt, Mycobacterium tuberculosis H37Rv
ccaacugggccgagcgcg

SEQ ID NO: 1371076 - RNA, 16 nt, Mycobacterium tuberculosis H37Rv
ccaacuggucgccaac

SEQ ID NO: 1371077 - RNA, 13 nt, Mycobacterium tuberculosis H37Rv
ccaacuucaccac

SEQ ID NO: 1371078 - RNA, 18 nt, Mycobacterium tuberculosis H37Rv
ccaacuucaccacccugu

SEQ ID NO: 1371079 - RNA, 22 nt, Mycobacterium tuberculosis H37Rv
ccaaguugcagcgggccacuga

SEQ ID NO: 1371080 - RNA, 14 nt, Mycobacterium tuberculosis H37Rv
ccaagucacagcuc

SEQ ID NO: 1371081 - RNA, 14 nt, Mycobacterium tuberculosis H37Rv
ccaagugcagggcu

SEQ ID NO: 1371082 - RNA, 18 nt, Mycobacterium tuberculosis H37Rv
ccaagucucgggcuuacu

SEQ ID NO: 1371083 - RNA, 23 nt, Mycobacterium tuberculosis H37Rv
ccaagucgacgguggcgccgucg

SEQ ID NO: 1371084 - RNA, 22 nt, Mycobacterium tuberculosis H37Rv
ccaauaggcgaaaauugcucca

SEQ ID NO: 1371085 - RNA, 15 nt, Mycobacterium tuberculosis H37Rv
ccaauaguccuugcg

SEQ ID NO: 1371086 - RNA, 22 nt, Mycobacterium tuberculosis H37Rv
ccaauaguccuugcgccagcgg

SEQ ID NO: 1371087 - RNA, 19 nt, Mycobacterium tuberculosis H37Rv
ccaauacgugauguagcug

SEQ ID NO: 1371088 - RNA, 14 nt, Mycobacterium tuberculosis H37Rv
ccaauacgugaugu

SEQ ID NO: 1371089 - RNA, 19 nt, Mycobacterium tuberculosis H37Rv
ccaauccggcgccagcagu

SEQ ID NO: 1371090 - RNA, 16 nt, Mycobacterium tuberculosis H37Rv
ccaauccggggcccgg

SEQ ID NO: 1371091 - RNA, 18 nt, Mycobacterium tuberculosis H37Rv
ccaaucgucggccagcag

SEQ ID NO: 1371092 - RNA, 18 nt, Mycobacterium tuberculosis H37Rv
ccaaucgggaucgcugcc

SEQ ID NO: 1371093 - RNA, 22 nt, Mycobacterium tuberculosis H37Rv
ccaaucaccguaauuucuucac

SEQ ID NO: 1371094 - RNA, 21 nt, Mycobacterium tuberculosis H37Rv
ccacacccagcgugcccgcca

SEQ ID NO: 1371095 - RNA, 14 nt, Mycobacterium tuberculosis H37Rv
ccacacccaaaccg

SEQ ID NO: 1371096 - RNA, 11 nt, Mycobacterium tuberculosis H37Rv
ccacagcaacg

SEQ ID NO: 1371097 - RNA, 13 nt, Mycobacterium tuberculosis H37Rv
ccacacacugccg

SEQ ID NO: 1371098 - RNA, 19 nt, Mycobacterium tuberculosis H37Rv
ccacacagucggugcagcg

SEQ ID NO: 1371099 - RNA, 14 nt, Mycobacterium tuberculosis H37Rv
ccacacacugugcu

SEQ ID NO: 1371100 - RNA, 23 nt, Mycobacterium tuberculosis H37Rv
ccacacagaucuugugccaggcg

SEQ ID NO: 1371101 - RNA, 14 nt, Mycobacterium tuberculosis H37Rv
ccacaccaaggccg

SEQ ID NO: 1371102 - RNA, 13 nt, Mycobacterium tuberculosis H37Rv
ccacaccaggccg

SEQ ID NO: 1371103 - RNA, 21 nt, Mycobacterium tuberculosis H37Rv
ccacagcuugcccgagcccag

SEQ ID NO: 1371104 - RNA, 22 nt, Mycobacterium tuberculosis H37Rv
ccaaugucagugccccgcccgg

SEQ ID NO: 1371105 - RNA, 15 nt, Mycobacterium tuberculosis H37Rv
ccaaugucagugccc

SEQ ID NO: 1371106 - RNA, 20 nt, Mycobacterium tuberculosis H37Rv
ccaauggccgcggcacccag

SEQ ID NO: 1371107 - RNA, 16 nt, Mycobacterium tuberculosis H37Rv
ccaauggccugcagcg

SEQ ID NO: 1371108 - RNA, 20 nt, Mycobacterium tuberculosis H37Rv
ccaauggcguucgucggcug

SEQ ID NO: 1371109 - RNA, 15 nt, Mycobacterium tuberculosis H37Rv
ccaccgacagcaccc

SEQ ID NO: 1371110 - RNA, 21 nt, Mycobacterium tuberculosis H37Rv
ccaccgacaagaauggccgcc

SEQ ID NO: 1371111 - RNA, 18 nt, Mycobacterium tuberculosis H37Rv
ccaccgaacgcggccacc

SEQ ID NO: 1371112 - RNA, 23 nt, Mycobacterium tuberculosis H37Rv
ccaccgaacgcggccaccgaccg

SEQ ID NO: 1371113 - RNA, 13 nt, Mycobacterium tuberculosis H37Rv
ccaccgaaaaguc

SEQ ID NO: 1371114 - RNA, 20 nt, Mycobacterium tuberculosis H37Rv
ccacccuguuguugccccgg

SEQ ID NO: 1371115 - RNA, 13 nt, Mycobacterium tuberculosis H37Rv
ccaccgccgccga

SEQ ID NO: 1371116 - RNA, 12 nt, Mycobacterium tuberculosis H37Rv
ccaccgccgccu

SEQ ID NO: 1371117 - RNA, 14 nt, Mycobacterium tuberculosis H37Rv
ccaccgccgcugcc

SEQ ID NO: 1371118 - RNA, 13 nt, Mycobacterium tuberculosis H37Rv
ccaccgccggccc

SEQ ID NO: 1371119 - RNA, 22 nt, Mycobacterium tuberculosis H37Rv
ccaccgccgccugcccggcccg

SEQ ID NO: 1371120 - RNA, 14 nt, Mycobacterium tuberculosis H37Rv
ccaccgccggcccg

SEQ ID NO: 1371121 - RNA, 15 nt, Mycobacterium tuberculosis H37Rv
ccaccgccggcccgc

SEQ ID NO: 1371122 - RNA, 16 nt, Mycobacterium tuberculosis H37Rv
ccaccucccacgccgc

SEQ ID NO: 1371123 - RNA, 17 nt, Mycobacterium tuberculosis H37Rv
ccaccuccgaggccgcc

SEQ ID NO: 1371124 - RNA, 15 nt, Mycobacterium tuberculosis H37Rv
ccaccgucacccccg

SEQ ID NO: 1371125 - RNA, 16 nt, Mycobacterium tuberculosis H37Rv
ccaccggugccgccgu

SEQ ID NO: 1371126 - RNA, 21 nt, Mycobacterium tuberculosis H37Rv
ccaccggugccgccguugcca

SEQ ID NO: 1371127 - RNA, 22 nt, Mycobacterium tuberculosis H37Rv
ccaccgguuaaccuccaggucg

SEQ ID NO: 1371128 - RNA, 23 nt, Mycobacterium tuberculosis H37Rv
ccaccgggcgcugcuugaggucc

SEQ ID NO: 1371129 - RNA, 20 nt, Mycobacterium tuberculosis H37Rv
ccaccgggcgucgucgguga

SEQ ID NO: 1371130 - RNA, 21 nt, Mycobacterium tuberculosis H37Rv
ccaccgggcgugcggcggccc

SEQ ID NO: 1371131 - RNA, 21 nt, Mycobacterium tuberculosis H37Rv
ccaccggggaagaucucggcc

SEQ ID NO: 1371132 - RNA, 19 nt, Mycobacterium tuberculosis H37Rv
ccaccgggcccgccguccc

SEQ ID NO: 1371133 - RNA, 14 nt, Mycobacterium tuberculosis H37Rv
ccaccgggcccgcc

SEQ ID NO: 1371134 - RNA, 15 nt, Mycobacterium tuberculosis H37Rv
ccaccgggcccgccg

SEQ ID NO: 1371135 - RNA, 20 nt, Mycobacterium tuberculosis H37Rv
ccaccggcgucugcccgccc

SEQ ID NO: 1371136 - RNA, 20 nt, Mycobacterium tuberculosis H37Rv
ccaccggcugauucgagcca

SEQ ID NO: 1371137 - RNA, 23 nt, Mycobacterium tuberculosis H37Rv
ccaccggcugauucgagccacau

SEQ ID NO: 1371138 - RNA, 21 nt, Mycobacterium tuberculosis H37Rv
ccaccggcuggugccuuacca

SEQ ID NO: 1371139 - RNA, 15 nt, Mycobacterium tuberculosis H37Rv
ccaccggcuggugcc

SEQ ID NO: 1371140 - RNA, 20 nt, Mycobacterium tuberculosis H37Rv
ccacgauggcggccaccguc

SEQ ID NO: 1371141 - RNA, 20 nt, Mycobacterium tuberculosis H37Rv
ccacgaucggcccagcccuu

SEQ ID NO: 1371142 - RNA, 23 nt, Mycobacterium tuberculosis H37Rv
ccacgaucggcugguuacucacc

SEQ ID NO: 1371143 - RNA, 20 nt, Mycobacterium tuberculosis H37Rv
ccacgaucuguggaagcccg

SEQ ID NO: 1371144 - RNA, 13 nt, Mycobacterium tuberculosis H37Rv
ccacgauccuugg

SEQ ID NO: 1371145 - RNA, 19 nt, Mycobacterium tuberculosis H37Rv
ccacgaucggcccagcccu

SEQ ID NO: 1371146 - RNA, 13 nt, Mycobacterium tuberculosis H37Rv
ccacgagcagccg

SEQ ID NO: 1371147 - RNA, 14 nt, Mycobacterium tuberculosis H37Rv
ccacgaguccgcgg

SEQ ID NO: 1371148 - RNA, 14 nt, Mycobacterium tuberculosis H37Rv
ccacgagugcaaga

SEQ ID NO: 1371149 - RNA, 18 nt, Mycobacterium tuberculosis H37Rv
ccaccucgacgagcacca

SEQ ID NO: 1371150 - RNA, 18 nt, Mycobacterium tuberculosis H37Rv
ccaccucuucucggacac

SEQ ID NO: 1371151 - RNA, 18 nt, Mycobacterium tuberculosis H37Rv
ccaccucggugaccaggc

SEQ ID NO: 1371152 - RNA, 15 nt, Mycobacterium tuberculosis H37Rv
ccaccucgucacagu

SEQ ID NO: 1371153 - RNA, 23 nt, Mycobacterium tuberculosis H37Rv
ccacgacaggucgcccggucucg

SEQ ID NO: 1371154 - RNA, 13 nt, Mycobacterium tuberculosis H37Rv
ccacgaccgccga

SEQ ID NO: 1371155 - RNA, 16 nt, Mycobacterium tuberculosis H37Rv
ccacgaccgcggcggc

SEQ ID NO: 1371156 - RNA, 15 nt, Mycobacterium tuberculosis H37Rv
ccacgacaggucgcc

SEQ ID NO: 1371157 - RNA, 15 nt, Mycobacterium tuberculosis H37Rv
ccacccgggugggcc

SEQ ID NO: 1371158 - RNA, 14 nt, Mycobacterium tuberculosis H37Rv
ccacccgggccucg

SEQ ID NO: 1371159 - RNA, 23 nt, Mycobacterium tuberculosis H37Rv
ccacccggcgggcggugggcagc

SEQ ID NO: 1371160 - RNA, 15 nt, Mycobacterium tuberculosis H37Rv
ccacccucgggucca

SEQ ID NO: 1371161 - RNA, 14 nt, Mycobacterium tuberculosis H37Rv
ccacccgguccugc

SEQ ID NO: 1371162 - RNA, 17 nt, Mycobacterium tuberculosis H37Rv
ccacccggugccgcagc

SEQ ID NO: 1371163 - RNA, 23 nt, Mycobacterium tuberculosis H37Rv
ccaccaucuguuccgugccagcu

SEQ ID NO: 1371164 - RNA, 15 nt, Mycobacterium tuberculosis H37Rv
ccaccaucgccucgg

SEQ ID NO: 1371165 - RNA, 13 nt, Mycobacterium tuberculosis H37Rv
ccaccaucgccgc

SEQ ID NO: 1371166 - RNA, 23 nt, Mycobacterium tuberculosis H37Rv
ccaccaucaccgccuuugccgcc

SEQ ID NO: 1371167 - RNA, 23 nt, Mycobacterium tuberculosis H37Rv
ccaccagggacgaugcccuccuc

SEQ ID NO: 1371168 - RNA, 13 nt, Mycobacterium tuberculosis H37Rv
ccaccaggcuguc

SEQ ID NO: 1371169 - RNA, 20 nt, Mycobacterium tuberculosis H37Rv
ccaccaggggaccgcggcgc

SEQ ID NO: 1371170 - RNA, 15 nt, Mycobacterium tuberculosis H37Rv
ccaccaucaccgccu

SEQ ID NO: 1371171 - RNA, 16 nt, Mycobacterium tuberculosis H37Rv
ccaccaucaccgccuu

SEQ ID NO: 1371172 - RNA, 22 nt, Mycobacterium tuberculosis H37Rv
ccaccagugcgggguccagcgg

SEQ ID NO: 1371173 - RNA, 22 nt, Mycobacterium tuberculosis H37Rv
ccaccaguccgaugggaaucag

SEQ ID NO: 1371174 - RNA, 23 nt, Mycobacterium tuberculosis H37Rv
ccaccaguccgaugggaaucagu

SEQ ID NO: 1371175 - RNA, 15 nt, Mycobacterium tuberculosis H37Rv
ccaccagucacgccc

SEQ ID NO: 1371176 - RNA, 21 nt, Mycobacterium tuberculosis H37Rv
ccacaggacaauggacaccaa

SEQ ID NO: 1371177 - RNA, 15 nt, Mycobacterium tuberculosis H37Rv
ccaccacccaggcca

SEQ ID NO: 1371178 - RNA, 18 nt, Mycobacterium tuberculosis H37Rv
ccaccaccgccggugccg

SEQ ID NO: 1371179 - RNA, 13 nt, Mycobacterium tuberculosis H37Rv
ccaccaccgccgc

SEQ ID NO: 1371180 - RNA, 13 nt, Mycobacterium tuberculosis H37Rv
ccaccacgcuccc

SEQ ID NO: 1371181 - RNA, 17 nt, Mycobacterium tuberculosis H37Rv
ccaccacgcuggccucg

SEQ ID NO: 1371182 - RNA, 19 nt, Mycobacterium tuberculosis H37Rv
ccaccacguggcccuccuc

SEQ ID NO: 1371183 - RNA, 17 nt, Mycobacterium tuberculosis H37Rv
ccaccacugcggccgcg

SEQ ID NO: 1371184 - RNA, 22 nt, Mycobacterium tuberculosis H37Rv
ccaccacugugacacccgaggg

SEQ ID NO: 1371185 - RNA, 14 nt, Mycobacterium tuberculosis H37Rv
ccaccacugcgccc

SEQ ID NO: 1371186 - RNA, 12 nt, Mycobacterium tuberculosis H37Rv
ccaccagaacca

SEQ ID NO: 1371187 - RNA, 19 nt, Mycobacterium tuberculosis H37Rv
ccacgguggccgcugccag

SEQ ID NO: 1371188 - RNA, 14 nt, Mycobacterium tuberculosis H37Rv
ccacggugucgucg

SEQ ID NO: 1371189 - RNA, 19 nt, Mycobacterium tuberculosis H37Rv
ccacgguccggcccaccag

SEQ ID NO: 1371190 - RNA, 16 nt, Mycobacterium tuberculosis H37Rv
ccacggucagcacgcu

SEQ ID NO: 1371191 - RNA, 15 nt, Mycobacterium tuberculosis H37Rv
ccacggucgaccagg

SEQ ID NO: 1371192 - RNA, 18 nt, Mycobacterium tuberculosis H37Rv
ccacggucgccgaccacu

SEQ ID NO: 1371193 - RNA, 18 nt, Mycobacterium tuberculosis H37Rv
ccacgguccggcccacca

SEQ ID NO: 1371194 - RNA, 23 nt, Mycobacterium tuberculosis H37Rv
ccacgucaucuggcgcugcuggc

SEQ ID NO: 1371195 - RNA, 18 nt, Mycobacterium tuberculosis H37Rv
ccacgucccagagaauca

SEQ ID NO: 1371196 - RNA, 22 nt, Mycobacterium tuberculosis H37Rv
ccacgguuggccaccagcuggc

SEQ ID NO: 1371197 - RNA, 15 nt, Mycobacterium tuberculosis H37Rv
ccacguaauucccca

SEQ ID NO: 1371198 - RNA, 17 nt, Mycobacterium tuberculosis H37Rv
ccacguaauuccccagg

SEQ ID NO: 1371199 - RNA, 20 nt, Mycobacterium tuberculosis H37Rv
ccacguacuccaccgcgccg

SEQ ID NO: 1371200 - RNA, 22 nt, Mycobacterium tuberculosis H37Rv
ccacguacuccaccgcgccguc

SEQ ID NO: 1371201 - RNA, 20 nt, Mycobacterium tuberculosis H37Rv
ccacguagcagcgccggcac

SEQ ID NO: 1371202 - RNA, 23 nt, Mycobacterium tuberculosis H37Rv
ccacguagcagcgccggcaccga

SEQ ID NO: 1371203 - RNA, 22 nt, Mycobacterium tuberculosis H37Rv
ccacgggcggccaccgcacgcu

SEQ ID NO: 1371204 - RNA, 14 nt, Mycobacterium tuberculosis H37Rv
ccacggggcugccg

SEQ ID NO: 1371205 - RNA, 21 nt, Mycobacterium tuberculosis H37Rv
ccacgggcggccaccgcacgc

SEQ ID NO: 1371206 - RNA, 13 nt, Mycobacterium tuberculosis H37Rv
ccacggguggugc

SEQ ID NO: 1371207 - RNA, 18 nt, Mycobacterium tuberculosis H37Rv
ccacggcugcggaauggg

SEQ ID NO: 1371208 - RNA, 15 nt, Mycobacterium tuberculosis H37Rv
ccacggcgggcgagc

SEQ ID NO: 1371209 - RNA, 16 nt, Mycobacterium tuberculosis H37Rv
ccacggcgccaccacc

SEQ ID NO: 1371210 - RNA, 17 nt, Mycobacterium tuberculosis H37Rv
ccacggcgggcgagcca

SEQ ID NO: 1371211 - RNA, 22 nt, Mycobacterium tuberculosis H37Rv
ccacggcgucggccacccgguc

SEQ ID NO: 1371212 - RNA, 21 nt, Mycobacterium tuberculosis H37Rv
ccacgucggcgaacgcgucca

SEQ ID NO: 1371213 - RNA, 19 nt, Mycobacterium tuberculosis H37Rv
ccacgucgagcacccgcuc

SEQ ID NO: 1371214 - RNA, 14 nt, Mycobacterium tuberculosis H37Rv
ccacguccucagcc

SEQ ID NO: 1371215 - RNA, 21 nt, Mycobacterium tuberculosis H37Rv
ccacguccucagccgugccca

SEQ ID NO: 1371216 - RNA, 17 nt, Mycobacterium tuberculosis H37Rv
ccacuaggucgccggcc

SEQ ID NO: 1371217 - RNA, 22 nt, Mycobacterium tuberculosis H37Rv
ccacgccgaucaacaugccggu

SEQ ID NO: 1371218 - RNA, 22 nt, Mycobacterium tuberculosis H37Rv
ccacgcggauaucuugcgcaug

SEQ ID NO: 1371219 - RNA, 21 nt, Mycobacterium tuberculosis H37Rv
ccacgccgaccaucucaccgg

SEQ ID NO: 1371220 - RNA, 17 nt, Mycobacterium tuberculosis H37Rv
ccacgcccgacgccagc

SEQ ID NO: 1371221 - RNA, 13 nt, Mycobacterium tuberculosis H37Rv
ccacgcacccggc

SEQ ID NO: 1371222 - RNA, 14 nt, Mycobacterium tuberculosis H37Rv
ccacgcacccggca

SEQ ID NO: 1371223 - RNA, 18 nt, Mycobacterium tuberculosis H37Rv
ccacgcaccgggugcagg

SEQ ID NO: 1371224 - RNA, 18 nt, Mycobacterium tuberculosis H37Rv
ccacgccaucgagcagca

SEQ ID NO: 1371225 - RNA, 19 nt, Mycobacterium tuberculosis H37Rv
ccacgcccacaggggcagc

SEQ ID NO: 1371226 - RNA, 19 nt, Mycobacterium tuberculosis H37Rv
ccacggcgaccaggagccu

SEQ ID NO: 1371227 - RNA, 18 nt, Mycobacterium tuberculosis H37Rv
ccacggcgaccacgccgc

SEQ ID NO: 1371228 - RNA, 12 nt, Mycobacterium tuberculosis H37Rv
ccacggcgcagu

SEQ ID NO: 1371229 - RNA, 15 nt, Mycobacterium tuberculosis H37Rv
ccacggccgccgcgu

SEQ ID NO: 1371230 - RNA, 20 nt, Mycobacterium tuberculosis H37Rv
ccacggccagaaacccggcg

SEQ ID NO: 1371231 - RNA, 21 nt, Mycobacterium tuberculosis H37Rv
ccacggcaagcgugacccgcc

SEQ ID NO: 1371232 - RNA, 14 nt, Mycobacterium tuberculosis H37Rv
ccacggcagcgccc

SEQ ID NO: 1371233 - RNA, 21 nt, Mycobacterium tuberculosis H37Rv
ccacggcaggcagggcagccc

SEQ ID NO: 1371234 - RNA, 18 nt, Mycobacterium tuberculosis H37Rv
ccacgcucggcggccagc

SEQ ID NO: 1371235 - RNA, 20 nt, Mycobacterium tuberculosis H37Rv
ccacgcugccgcaguucauc

SEQ ID NO: 1371236 - RNA, 16 nt, Mycobacterium tuberculosis H37Rv
ccacgcugcagaugga

SEQ ID NO: 1371237 - RNA, 22 nt, Mycobacterium tuberculosis H37Rv
ccacgcugcccacgggccggcc

SEQ ID NO: 1371238 - RNA, 14 nt, Mycobacterium tuberculosis H37Rv
ccacgcugguguug

SEQ ID NO: 1371239 - RNA, 18 nt, Mycobacterium tuberculosis H37Rv
ccacggaaguaucgccgg

SEQ ID NO: 1371240 - RNA, 17 nt, Mycobacterium tuberculosis H37Rv
cagugguuacagaugaa

SEQ ID NO: 1371241 - RNA, 17 nt, Mycobacterium tuberculosis H37Rv
caguggcgcgugcagcg

SEQ ID NO: 1371242 - RNA, 13 nt, Mycobacterium tuberculosis H37Rv
caguggcgacgag

SEQ ID NO: 1371243 - RNA, 17 nt, Mycobacterium tuberculosis H37Rv
caguggcagccagcggc

SEQ ID NO: 1371244 - RNA, 15 nt, Mycobacterium tuberculosis H37Rv
cagugggacgggcgc

SEQ ID NO: 1371245 - RNA, 14 nt, Mycobacterium tuberculosis H37Rv
caguggauccggca

SEQ ID NO: 1371246 - RNA, 17 nt, Mycobacterium tuberculosis H37Rv
caguggaugcauacacg

SEQ ID NO: 1371247 - RNA, 21 nt, Mycobacterium tuberculosis H37Rv
caguggcaacagcaacggcag

SEQ ID NO: 1371248 - RNA, 18 nt, Mycobacterium tuberculosis H37Rv
cagugcgguggcagguga

SEQ ID NO: 1371249 - RNA, 12 nt, Mycobacterium tuberculosis H37Rv
cagugccgugcu

SEQ ID NO: 1371250 - RNA, 20 nt, Mycobacterium tuberculosis H37Rv
cagugccguguccagcaugc

SEQ ID NO: 1371251 - RNA, 19 nt, Mycobacterium tuberculosis H37Rv
cagugcgcaacccagccgc

SEQ ID NO: 1371252 - RNA, 21 nt, Mycobacterium tuberculosis H37Rv
cagugcgcaacccagccgcgc

SEQ ID NO: 1371253 - RNA, 15 nt, Mycobacterium tuberculosis H37Rv
cagugcgcagaacac

SEQ ID NO: 1371254 - RNA, 21 nt, Mycobacterium tuberculosis H37Rv
cagugcgcagaacaccaccgc

SEQ ID NO: 1371255 - RNA, 17 nt, Mycobacterium tuberculosis H37Rv
cagugcgcaacccagcc

SEQ ID NO: 1371256 - RNA, 23 nt, Mycobacterium tuberculosis H37Rv
cagguagucgccggucaggcuca

SEQ ID NO: 1371257 - RNA, 15 nt, Mycobacterium tuberculosis H37Rv
cagugccacgccuga

SEQ ID NO: 1371258 - RNA, 20 nt, Mycobacterium tuberculosis H37Rv
cagugccagaacccggacag

SEQ ID NO: 1371259 - RNA, 19 nt, Mycobacterium tuberculosis H37Rv
cagugccaggugggugaac

SEQ ID NO: 1371260 - RNA, 14 nt, Mycobacterium tuberculosis H37Rv
cagugccccgcccg

SEQ ID NO: 1371261 - RNA, 17 nt, Mycobacterium tuberculosis H37Rv
cagugccccgccgagcg

SEQ ID NO: 1371262 - RNA, 17 nt, Mycobacterium tuberculosis H37Rv
cagugccccgcagcacu

SEQ ID NO: 1371263 - RNA, 14 nt, Mycobacterium tuberculosis H37Rv
cagugccaucuaca

SEQ ID NO: 1371264 - RNA, 14 nt, Mycobacterium tuberculosis H37Rv
cagugccaucgcca

SEQ ID NO: 1371265 - RNA, 16 nt, Mycobacterium tuberculosis H37Rv
cagugcccgcacugcc

SEQ ID NO: 1371266 - RNA, 19 nt, Mycobacterium tuberculosis H37Rv
cagugcccgcacugccgcc

SEQ ID NO: 1371267 - RNA, 21 nt, Mycobacterium tuberculosis H37Rv
caguguggcgaugaccacgcc

SEQ ID NO: 1371268 - RNA, 13 nt, Mycobacterium tuberculosis H37Rv
cagugugcgccgu

SEQ ID NO: 1371269 - RNA, 18 nt, Mycobacterium tuberculosis H37Rv
cagugucgauagcccgcc

SEQ ID NO: 1371270 - RNA, 17 nt, Mycobacterium tuberculosis H37Rv
caguucaucgggcacca

SEQ ID NO: 1371271 - RNA, 13 nt, Mycobacterium tuberculosis H37Rv
caguuccaccgcg

SEQ ID NO: 1371272 - RNA, 20 nt, Mycobacterium tuberculosis H37Rv
caguuccacccggugccgca

SEQ ID NO: 1371273 - RNA, 17 nt, Mycobacterium tuberculosis H37Rv
caguuccaccgcgcagg

SEQ ID NO: 1371274 - RNA, 20 nt, Mycobacterium tuberculosis H37Rv
caguugcacaccgaucggca

SEQ ID NO: 1371275 - RNA, 17 nt, Mycobacterium tuberculosis H37Rv
caguugcacaccgaucg

SEQ ID NO: 1371276 - RNA, 15 nt, Mycobacterium tuberculosis H37Rv
caguuggcaccagcc

SEQ ID NO: 1371277 - RNA, 14 nt, Mycobacterium tuberculosis H37Rv
caguuggcagcgcu

SEQ ID NO: 1371278 - RNA, 21 nt, Mycobacterium tuberculosis H37Rv
caguugcguuguccaccauca

SEQ ID NO: 1371279 - RNA, 20 nt, Mycobacterium tuberculosis H37Rv
caguucuugauuagccauua

SEQ ID NO: 1371280 - RNA, 12 nt, Mycobacterium tuberculosis H37Rv
caguugacccau

SEQ ID NO: 1371281 - RNA, 20 nt, Mycobacterium tuberculosis H37Rv
caguugaucaggccgaugcg

SEQ ID NO: 1371282 - RNA, 20 nt, Mycobacterium tuberculosis H37Rv
caguucggcggccgccgcgu

SEQ ID NO: 1371283 - RNA, 23 nt, Mycobacterium tuberculosis H37Rv
caguucguugguguuggaagcgc

SEQ ID NO: 1371284 - RNA, 14 nt, Mycobacterium tuberculosis H37Rv
caguucccagacca

SEQ ID NO: 1371285 - RNA, 17 nt, Mycobacterium tuberculosis H37Rv
caguucccagaccaccg

SEQ ID NO: 1371286 - RNA, 15 nt, Mycobacterium tuberculosis H37Rv
caguuccccgggcuc

SEQ ID NO: 1371287 - RNA, 13 nt, Mycobacterium tuberculosis H37Rv
caguucccggcca

SEQ ID NO: 1371288 - RNA, 16 nt, Mycobacterium tuberculosis H37Rv
caguuugugccgccgc

SEQ ID NO: 1371289 - RNA, 13 nt, Mycobacterium tuberculosis H37Rv
cauaccgccgcug

SEQ ID NO: 1371290 - RNA, 16 nt, Mycobacterium tuberculosis H37Rv
cauaccgccgcugcca

SEQ ID NO: 1371291 - RNA, 18 nt, Mycobacterium tuberculosis H37Rv
cauaccggcuggccaggu

SEQ ID NO: 1371292 - RNA, 17 nt, Mycobacterium tuberculosis H37Rv
cauacccgcgcgcacca

SEQ ID NO: 1371293 - RNA, 22 nt, Mycobacterium tuberculosis H37Rv
cauaccguucacccagcggaac

SEQ ID NO: 1371294 - RNA, 20 nt, Mycobacterium tuberculosis H37Rv
cauaccuaacgagccgucca

SEQ ID NO: 1371295 - RNA, 13 nt, Mycobacterium tuberculosis H37Rv
cauaccugaaugu

SEQ ID NO: 1371296 - RNA, 17 nt, Mycobacterium tuberculosis H37Rv
cauaccugccggaccac

SEQ ID NO: 1371297 - RNA, 15 nt, Mycobacterium tuberculosis H37Rv
cauacgccggccgcg

SEQ ID NO: 1371298 - RNA, 19 nt, Mycobacterium tuberculosis H37Rv
cauacgcccacuccagcag

SEQ ID NO: 1371299 - RNA, 18 nt, Mycobacterium tuberculosis H37Rv
cauacgcggcuuugacgc

SEQ ID NO: 1371300 - RNA, 21 nt, Mycobacterium tuberculosis H37Rv
cauacagcgggcgcuguaguc

SEQ ID NO: 1371301 - RNA, 12 nt, Mycobacterium tuberculosis H37Rv
cauacacgguag

SEQ ID NO: 1371302 - RNA, 16 nt, Mycobacterium tuberculosis H37Rv
cauacaaccccgcgcu

SEQ ID NO: 1371303 - RNA, 16 nt, Mycobacterium tuberculosis H37Rv
cauaagugaacagcag

SEQ ID NO: 1371304 - RNA, 19 nt, Mycobacterium tuberculosis H37Rv
cauaaagaucagcaugguc

SEQ ID NO: 1371305 - RNA, 23 nt, Mycobacterium tuberculosis H37Rv
cauaagcccccgcacgcacggcg

SEQ ID NO: 1371306 - RNA, 24 nt, Mycobacterium tuberculosis H37Rv
cauaagcccccgcacgcacggcgu

SEQ ID NO: 1371307 - RNA, 20 nt, Mycobacterium tuberculosis H37Rv
cauaagcccccgacacgccg

SEQ ID NO: 1371308 - RNA, 15 nt, Mycobacterium tuberculosis H37Rv
cauaagcccccgaca

SEQ ID NO: 1371309 - RNA, 18 nt, Mycobacterium tuberculosis H37Rv
cauaaggaaugauggcca

SEQ ID NO: 1371310 - RNA, 21 nt, Mycobacterium tuberculosis H37Rv
cauaaggaaugauggccagca

SEQ ID NO: 1371311 - RNA, 20 nt, Mycobacterium tuberculosis H37Rv
cauagucgaauggcaacaca

SEQ ID NO: 1371312 - RNA, 18 nt, Mycobacterium tuberculosis H37Rv
cauagugcggcugcaacg

SEQ ID NO: 1371313 - RNA, 14 nt, Mycobacterium tuberculosis H37Rv
cauaugccgccggc

SEQ ID NO: 1371314 - RNA, 21 nt, Mycobacterium tuberculosis H37Rv
caucaacgccggcgacggcgu

SEQ ID NO: 1371315 - RNA, 16 nt, Mycobacterium tuberculosis H37Rv
caucaacgacaccaga

SEQ ID NO: 1371316 - RNA, 22 nt, Mycobacterium tuberculosis H37Rv
caucaaaaacgaacccaggcac

SEQ ID NO: 1371317 - RNA, 13 nt, Mycobacterium tuberculosis H37Rv
caucagcggcgcc

SEQ ID NO: 1371318 - RNA, 19 nt, Mycobacterium tuberculosis H37Rv
caucagcucgccagggucg

SEQ ID NO: 1371319 - RNA, 12 nt, Mycobacterium tuberculosis H37Rv
caucagccgcac

SEQ ID NO: 1371320 - RNA, 15 nt, Mycobacterium tuberculosis H37Rv
caucagccgcugcgu

SEQ ID NO: 1371321 - RNA, 22 nt, Mycobacterium tuberculosis H37Rv
caucacggcggggaucgcuggc

SEQ ID NO: 1371322 - RNA, 16 nt, Mycobacterium tuberculosis H37Rv
caucacggcggggauc

SEQ ID NO: 1371323 - RNA, 18 nt, Mycobacterium tuberculosis H37Rv
caucagaaugccuggccc

SEQ ID NO: 1371324 - RNA, 16 nt, Mycobacterium tuberculosis H37Rv
caucagaaucaggcuc

SEQ ID NO: 1371325 - RNA, 18 nt, Mycobacterium tuberculosis H37Rv
caucaucggaaccguuug

SEQ ID NO: 1371326 - RNA, 14 nt, Mycobacterium tuberculosis H37Rv
caucaucucggugg

SEQ ID NO: 1371327 - RNA, 17 nt, Mycobacterium tuberculosis H37Rv
caucaucgcccugggcg

SEQ ID NO: 1371328 - RNA, 21 nt, Mycobacterium tuberculosis H37Rv
caucaucuuugcguacaacgc

SEQ ID NO: 1371329 - RNA, 16 nt, Mycobacterium tuberculosis H37Rv
caucagguuguacagg

SEQ ID NO: 1371330 - RNA, 16 nt, Mycobacterium tuberculosis H37Rv
caucaggugcgccugg

SEQ ID NO: 1371331 - RNA, 14 nt, Mycobacterium tuberculosis H37Rv
caucgaucagaugc

SEQ ID NO: 1371332 - RNA, 22 nt, Mycobacterium tuberculosis H37Rv
caucgaguucggcccgcaaaca

SEQ ID NO: 1371333 - RNA, 23 nt, Mycobacterium tuberculosis H37Rv
caucgacguagcgaagugcgcgc

SEQ ID NO: 1371334 - RNA, 17 nt, Mycobacterium tuberculosis H37Rv
caucgaguucggcccgc

SEQ ID NO: 1371335 - RNA, 17 nt, Mycobacterium tuberculosis H37Rv
caucgacggugaucagg

SEQ ID NO: 1371336 - RNA, 16 nt, Mycobacterium tuberculosis H37Rv
caucgaccgcccgcca

SEQ ID NO: 1371337 - RNA, 19 nt, Mycobacterium tuberculosis H37Rv
cauccugcagcucgggcag

SEQ ID NO: 1371338 - RNA, 12 nt, Mycobacterium tuberculosis H37Rv
cauccugcagcu

SEQ ID NO: 1371339 - RNA, 23 nt, Mycobacterium tuberculosis H37Rv
caucgcgacuagacgccgccgcu

SEQ ID NO: 1371340 - RNA, 22 nt, Mycobacterium tuberculosis H37Rv
caucgcgcaaccgggcggacag

SEQ ID NO: 1371341 - RNA, 15 nt, Mycobacterium tuberculosis H37Rv
caucgcgcacgcccu

SEQ ID NO: 1371342 - RNA, 20 nt, Mycobacterium tuberculosis H37Rv
caucgcgauuccggcggcca

SEQ ID NO: 1371343 - RNA, 16 nt, Mycobacterium tuberculosis H37Rv
caucgcgcgcggcucc

SEQ ID NO: 1371344 - RNA, 16 nt, Mycobacterium tuberculosis H37Rv
caucgcggcggcgcuc

SEQ ID NO: 1371345 - RNA, 13 nt, Mycobacterium tuberculosis H37Rv
caucgcggcggcg

SEQ ID NO: 1371346 - RNA, 22 nt, Mycobacterium tuberculosis H37Rv
caucgcggcaucgacgcggcca

SEQ ID NO: 1371347 - RNA, 14 nt, Mycobacterium tuberculosis H37Rv
caucgcacccacca

SEQ ID NO: 1371348 - RNA, 12 nt, Mycobacterium tuberculosis H37Rv
caucgcacagcg

SEQ ID NO: 1371349 - RNA, 17 nt, Mycobacterium tuberculosis H37Rv
caucgcacagcgccgcg

SEQ ID NO: 1371350 - RNA, 17 nt, Mycobacterium tuberculosis H37Rv
caucgccgccaaccacu

SEQ ID NO: 1371351 - RNA, 23 nt, Mycobacterium tuberculosis H37Rv
caucgccggcgucgacccugccc

SEQ ID NO: 1371352 - RNA, 20 nt, Mycobacterium tuberculosis H37Rv
caucgccggguagcuguaca

SEQ ID NO: 1371353 - RNA, 14 nt, Mycobacterium tuberculosis H37Rv
caucgccgcggcca

SEQ ID NO: 1371354 - RNA, 18 nt, Mycobacterium tuberculosis H37Rv
caucccuuucgcgccgcg

SEQ ID NO: 1371355 - RNA, 14 nt, Mycobacterium tuberculosis H37Rv
cauccgacagcagc

SEQ ID NO: 1371356 - RNA, 15 nt, Mycobacterium tuberculosis H37Rv
cauccgacacugcgg

SEQ ID NO: 1371357 - RNA, 24 nt, Mycobacterium tuberculosis H37Rv
cauccgacgggauagacgaccccg

SEQ ID NO: 1371358 - RNA, 12 nt, Mycobacterium tuberculosis H37Rv
cauccgcggcag

SEQ ID NO: 1371359 - RNA, 22 nt, Mycobacterium tuberculosis H37Rv
cauccgcggcagggccuggaac

SEQ ID NO: 1371360 - RNA, 13 nt, Mycobacterium tuberculosis H37Rv
caucccggcgccg

SEQ ID NO: 1371361 - RNA, 22 nt, Mycobacterium tuberculosis H37Rv
cauccgugucgagaucucacgu

SEQ ID NO: 1371362 - RNA, 23 nt, Mycobacterium tuberculosis H37Rv
cauccgggcgaccaccaccgccg

SEQ ID NO: 1371363 - RNA, 18 nt, Mycobacterium tuberculosis H37Rv
cauccggauauggaaagc

SEQ ID NO: 1371364 - RNA, 17 nt, Mycobacterium tuberculosis H37Rv
cauccgggcgaccacca

SEQ ID NO: 1371365 - RNA, 22 nt, Mycobacterium tuberculosis H37Rv
cauccgggccgagcgcaccacg

SEQ ID NO: 1371366 - RNA, 15 nt, Mycobacterium tuberculosis H37Rv
cauccugcacgaccc

SEQ ID NO: 1371367 - RNA, 15 nt, Mycobacterium tuberculosis H37Rv
cauccuccugcgccg

SEQ ID NO: 1371368 - RNA, 16 nt, Mycobacterium tuberculosis H37Rv
cauccucgagcugcug

SEQ ID NO: 1371369 - RNA, 18 nt, Mycobacterium tuberculosis H37Rv
cauccucgagcugcuggc

SEQ ID NO: 1371370 - RNA, 15 nt, Mycobacterium tuberculosis H37Rv
cauccucgauggacc

SEQ ID NO: 1371371 - RNA, 19 nt, Mycobacterium tuberculosis H37Rv
cauccucgacuugcuuggc

SEQ ID NO: 1371372 - RNA, 16 nt, Mycobacterium tuberculosis H37Rv
caucucaugcaucugc

SEQ ID NO: 1371373 - RNA, 20 nt, Mycobacterium tuberculosis H37Rv
caucuccaccgucgccgccg

SEQ ID NO: 1371374 - RNA, 15 nt, Mycobacterium tuberculosis H37Rv
caucucaccgggccc

SEQ ID NO: 1371375 - RNA, 14 nt, Mycobacterium tuberculosis H37Rv
caucuccgacucga

SEQ ID NO: 1371376 - RNA, 16 nt, Mycobacterium tuberculosis H37Rv
caucuccgccgguccc

SEQ ID NO: 1371377 - RNA, 20 nt, Mycobacterium tuberculosis H37Rv
caucucccgaccgccgagcg

SEQ ID NO: 1371378 - RNA, 16 nt, Mycobacterium tuberculosis H37Rv
caucgcgggcggcgcu

SEQ ID NO: 1371379 - RNA, 19 nt, Mycobacterium tuberculosis H37Rv
caucgcgucgucuucuucg

SEQ ID NO: 1371380 - RNA, 21 nt, Mycobacterium tuberculosis H37Rv
caucgcgggcgugccgaccag

SEQ ID NO: 1371381 - RNA, 16 nt, Mycobacterium tuberculosis H37Rv
caucguaggccggcau

SEQ ID NO: 1371382 - RNA, 15 nt, Mycobacterium tuberculosis H37Rv
caucguaggccggca

SEQ ID NO: 1371383 - RNA, 16 nt, Mycobacterium tuberculosis H37Rv
caucgucgaaagccug

SEQ ID NO: 1371384 - RNA, 21 nt, Mycobacterium tuberculosis H37Rv
caucgucgccacgaugccggc

SEQ ID NO: 1371385 - RNA, 15 nt, Mycobacterium tuberculosis H37Rv
caucgucgccgcgca

SEQ ID NO: 1371386 - RNA, 15 nt, Mycobacterium tuberculosis H37Rv
caucuccucgccugc

SEQ ID NO: 1371387 - RNA, 19 nt, Mycobacterium tuberculosis H37Rv
caucucgagcaugcccagc

SEQ ID NO: 1371388 - RNA, 13 nt, Mycobacterium tuberculosis H37Rv
caucucggcggcc

SEQ ID NO: 1371389 - RNA, 22 nt, Mycobacterium tuberculosis H37Rv
caucucggcggccaacagcacc

SEQ ID NO: 1371390 - RNA, 22 nt, Mycobacterium tuberculosis H37Rv
caucucggcuacgccucggcgu

SEQ ID NO: 1371391 - RNA, 21 nt, Mycobacterium tuberculosis H37Rv
caucucgucgucgcggccgcu

SEQ ID NO: 1371392 - RNA, 14 nt, Mycobacterium tuberculosis H37Rv
caucugccugccug

SEQ ID NO: 1371393 - RNA, 19 nt, Mycobacterium tuberculosis H37Rv
caucugcgaaaagccuuga

SEQ ID NO: 1371394 - RNA, 22 nt, Mycobacterium tuberculosis H37Rv
caucucuugcaaccuggacugc

SEQ ID NO: 1371395 - RNA, 21 nt, Mycobacterium tuberculosis H37Rv
caucuguuccgugccagcugc

SEQ ID NO: 1371396 - RNA, 22 nt, Mycobacterium tuberculosis H37Rv
caucuguuccgugccagcugcc

SEQ ID NO: 1371397 - RNA, 14 nt, Mycobacterium tuberculosis H37Rv
caucuggcgcugcu

SEQ ID NO: 1371398 - RNA, 15 nt, Mycobacterium tuberculosis H37Rv
caucuggcgcugcug

SEQ ID NO: 1371399 - RNA, 13 nt, Mycobacterium tuberculosis H37Rv
caucuggcgccgu

SEQ ID NO: 1371400 - RNA, 14 nt, Mycobacterium tuberculosis H37Rv
caucuggcgcgcca

SEQ ID NO: 1371401 - RNA, 23 nt, Mycobacterium tuberculosis H37Rv
caucuggcugagcagacugcccu

SEQ ID NO: 1371402 - RNA, 19 nt, Mycobacterium tuberculosis H37Rv
caucugguggaccuccgga

SEQ ID NO: 1371403 - RNA, 18 nt, Mycobacterium tuberculosis H37Rv
caucuguaaccuccucga

SEQ ID NO: 1371404 - RNA, 21 nt, Mycobacterium tuberculosis H37Rv
cacugaugggccgguuccuca

SEQ ID NO: 1371405 - RNA, 21 nt, Mycobacterium tuberculosis H37Rv
cacugaggagaugagcaccaa

SEQ ID NO: 1371406 - RNA, 21 nt, Mycobacterium tuberculosis H37Rv
cacugaccgaacgcaacagcc

SEQ ID NO: 1371407 - RNA, 13 nt, Mycobacterium tuberculosis H37Rv
cacugagauccag

SEQ ID NO: 1371408 - RNA, 20 nt, Mycobacterium tuberculosis H37Rv
cacugcggccugcucgacca

SEQ ID NO: 1371409 - RNA, 13 nt, Mycobacterium tuberculosis H37Rv
cacugcggcagcg

SEQ ID NO: 1371410 - RNA, 17 nt, Mycobacterium tuberculosis H37Rv
cacugcgccgugaccca

SEQ ID NO: 1371411 - RNA, 21 nt, Mycobacterium tuberculosis H37Rv
cacugcuagucgugccgcguc

SEQ ID NO: 1371412 - RNA, 17 nt, Mycobacterium tuberculosis H37Rv
cacugcucgucgcgcau

SEQ ID NO: 1371413 - RNA, 17 nt, Mycobacterium tuberculosis H37Rv
cacugcgagcgccggcu

SEQ ID NO: 1371414 - RNA, 16 nt, Mycobacterium tuberculosis H37Rv
cacugcgagcgccggc

SEQ ID NO: 1371415 - RNA, 17 nt, Mycobacterium tuberculosis H37Rv
cacugccguugccgccg

SEQ ID NO: 1371416 - RNA, 14 nt, Mycobacterium tuberculosis H37Rv
cacugcccagcaga

SEQ ID NO: 1371417 - RNA, 16 nt, Mycobacterium tuberculosis H37Rv
cacugcccagcagacc

SEQ ID NO: 1371418 - RNA, 17 nt, Mycobacterium tuberculosis H37Rv
cacugccccgcaucgcc

SEQ ID NO: 1371419 - RNA, 15 nt, Mycobacterium tuberculosis H37Rv
cacugccgcgcgccc

SEQ ID NO: 1371420 - RNA, 18 nt, Mycobacterium tuberculosis H37Rv
cacugccgcgcgcccgcc

SEQ ID NO: 1371421 - RNA, 15 nt, Mycobacterium tuberculosis H37Rv
cacugcccggggugc

SEQ ID NO: 1371422 - RNA, 23 nt, Mycobacterium tuberculosis H37Rv
cacucccggcucggccagccagc

SEQ ID NO: 1371423 - RNA, 17 nt, Mycobacterium tuberculosis H37Rv
cacuccaggagccgagg

SEQ ID NO: 1371424 - RNA, 14 nt, Mycobacterium tuberculosis H37Rv
cacucccauccgcc

SEQ ID NO: 1371425 - RNA, 12 nt, Mycobacterium tuberculosis H37Rv
cacuccgccgau

SEQ ID NO: 1371426 - RNA, 12 nt, Mycobacterium tuberculosis H37Rv
cacuccgccaac

SEQ ID NO: 1371427 - RNA, 13 nt, Mycobacterium tuberculosis H37Rv
cacuccugcacac

SEQ ID NO: 1371428 - RNA, 19 nt, Mycobacterium tuberculosis H37Rv
cacuccgguggccaacacc

SEQ ID NO: 1371429 - RNA, 18 nt, Mycobacterium tuberculosis H37Rv
cacucggugucggccgcg

SEQ ID NO: 1371430 - RNA, 15 nt, Mycobacterium tuberculosis H37Rv
cacucggcccggcag

SEQ ID NO: 1371431 - RNA, 15 nt, Mycobacterium tuberculosis H37Rv
cacucggcccggccc

SEQ ID NO: 1371432 - RNA, 19 nt, Mycobacterium tuberculosis H37Rv
cacucgcggauccgggcgu

SEQ ID NO: 1371433 - RNA, 19 nt, Mycobacterium tuberculosis H37Rv
cacucgcggguugccucgg

SEQ ID NO: 1371434 - RNA, 14 nt, Mycobacterium tuberculosis H37Rv
cacucucggcgcuc

SEQ ID NO: 1371435 - RNA, 21 nt, Mycobacterium tuberculosis H37Rv
cacucucggugaacgccgccc

SEQ ID NO: 1371436 - RNA, 22 nt, Mycobacterium tuberculosis H37Rv
cacucucggugaacgccgcccc

SEQ ID NO: 1371437 - RNA, 18 nt, Mycobacterium tuberculosis H37Rv
cacucguugaccggccgg

SEQ ID NO: 1371438 - RNA, 16 nt, Mycobacterium tuberculosis H37Rv
cacucguugaccggcc

SEQ ID NO: 1371439 - RNA, 21 nt, Mycobacterium tuberculosis H37Rv
cacucuggucacugguccaac

SEQ ID NO: 1371440 - RNA, 22 nt, Mycobacterium tuberculosis H37Rv
cacucugaucuguguuugcggc

SEQ ID NO: 1371441 - RNA, 22 nt, Mycobacterium tuberculosis H37Rv
cacugaaccguucgacccagcg

SEQ ID NO: 1371442 - RNA, 15 nt, Mycobacterium tuberculosis H37Rv
cacugaccccgccgc

SEQ ID NO: 1371443 - RNA, 19 nt, Mycobacterium tuberculosis H37Rv
cacuaaccgaauuguugua

SEQ ID NO: 1371444 - RNA, 12 nt, Mycobacterium tuberculosis H37Rv
cacuaauaggca

SEQ ID NO: 1371445 - RNA, 18 nt, Mycobacterium tuberculosis H37Rv
cacuacccgcaacgaggc

SEQ ID NO: 1371446 - RNA, 20 nt, Mycobacterium tuberculosis H37Rv
cacuacccgcaacgaggcaa

SEQ ID NO: 1371447 - RNA, 19 nt, Mycobacterium tuberculosis H37Rv
cacuacggccuggccaccu

SEQ ID NO: 1371448 - RNA, 21 nt, Mycobacterium tuberculosis H37Rv
cacuacggccuggccaccugg

SEQ ID NO: 1371449 - RNA, 22 nt, Mycobacterium tuberculosis H37Rv
cacgugaaggcgauggcaccgu

SEQ ID NO: 1371450 - RNA, 17 nt, Mycobacterium tuberculosis H37Rv
cacguggucggccaccc

SEQ ID NO: 1371451 - RNA, 14 nt, Mycobacterium tuberculosis H37Rv
cacguucggcugcg

SEQ ID NO: 1371452 - RNA, 23 nt, Mycobacterium tuberculosis H37Rv
cacguugccgaucccggcgagca

SEQ ID NO: 1371453 - RNA, 17 nt, Mycobacterium tuberculosis H37Rv
cacguugcacagcuugg

SEQ ID NO: 1371454 - RNA, 22 nt, Mycobacterium tuberculosis H37Rv
cacguuggccccgcggagcgca

SEQ ID NO: 1371455 - RNA, 18 nt, Mycobacterium tuberculosis H37Rv
cacuccaccgcuggcccg

SEQ ID NO: 1371456 - RNA, 20 nt, Mycobacterium tuberculosis H37Rv
cacuccagcagcucgccggc

SEQ ID NO: 1371457 - RNA, 16 nt, Mycobacterium tuberculosis H37Rv
cacucauuccccggaa

SEQ ID NO: 1371458 - RNA, 20 nt, Mycobacterium tuberculosis H37Rv
cacucaugaugccggacgcc

SEQ ID NO: 1371459 - RNA, 14 nt, Mycobacterium tuberculosis H37Rv
cacucacccgggca

SEQ ID NO: 1371460 - RNA, 12 nt, Mycobacterium tuberculosis H37Rv
cacucaccuugu

SEQ ID NO: 1371461 - RNA, 21 nt, Mycobacterium tuberculosis H37Rv
cacucacauuggccaggucgg

SEQ ID NO: 1371462 - RNA, 19 nt, Mycobacterium tuberculosis H37Rv
cacuacuccggucccgcau

SEQ ID NO: 1371463 - RNA, 22 nt, Mycobacterium tuberculosis H37Rv
cacuagacugcuggucaucggu

SEQ ID NO: 1371464 - RNA, 22 nt, Mycobacterium tuberculosis H37Rv
cacuagcauugucgccggaugc

SEQ ID NO: 1371465 - RNA, 19 nt, Mycobacterium tuberculosis H37Rv
cacuagcagggggacccgg

SEQ ID NO: 1371466 - RNA, 23 nt, Mycobacterium tuberculosis H37Rv
cacuaguucgagcugccaggccc

SEQ ID NO: 1371467 - RNA, 19 nt, Mycobacterium tuberculosis H37Rv
cacuaguucgagcugccag

SEQ ID NO: 1371468 - RNA, 12 nt, Mycobacterium tuberculosis H37Rv
cacuggugaucu

SEQ ID NO: 1371469 - RNA, 23 nt, Mycobacterium tuberculosis H37Rv
cacuggugcagcgccgacagccg

SEQ ID NO: 1371470 - RNA, 14 nt, Mycobacterium tuberculosis H37Rv
cacuggucaacggg

SEQ ID NO: 1371471 - RNA, 13 nt, Mycobacterium tuberculosis H37Rv
cacuggcgccggu

SEQ ID NO: 1371472 - RNA, 22 nt, Mycobacterium tuberculosis H37Rv
cacuggggccccgggaagugaa

SEQ ID NO: 1371473 - RNA, 23 nt, Mycobacterium tuberculosis H37Rv
cacuggggugcugcgcgcggcgg

SEQ ID NO: 1371474 - RNA, 22 nt, Mycobacterium tuberculosis H37Rv
cacugggugcgucgacccagcu

SEQ ID NO: 1371475 - RNA, 22 nt, Mycobacterium tuberculosis H37Rv
cacugggccggucgaggcccuc

SEQ ID NO: 1371476 - RNA, 17 nt, Mycobacterium tuberculosis H37Rv
cacuuaccgagccguca

SEQ ID NO: 1371477 - RNA, 22 nt, Mycobacterium tuberculosis H37Rv
cacuguuggugccgccaccacc

SEQ ID NO: 1371478 - RNA, 14 nt, Mycobacterium tuberculosis H37Rv
cacugugaggucau

SEQ ID NO: 1371479 - RNA, 18 nt, Mycobacterium tuberculosis H37Rv
cacuguuacggccacacc

SEQ ID NO: 1371480 - RNA, 19 nt, Mycobacterium tuberculosis H37Rv
cacuugaugccgcacccga

SEQ ID NO: 1371481 - RNA, 15 nt, Mycobacterium tuberculosis H37Rv
cacuuggacccggcc

SEQ ID NO: 1371482 - RNA, 21 nt, Mycobacterium tuberculosis H37Rv
cacuugcucggcgagccucuu

SEQ ID NO: 1371483 - RNA, 21 nt, Mycobacterium tuberculosis H37Rv
cacuugaaauugagccggccc

SEQ ID NO: 1371484 - RNA, 22 nt, Mycobacterium tuberculosis H37Rv
cacuuccgggcagcugggcagg

SEQ ID NO: 1371485 - RNA, 16 nt, Mycobacterium tuberculosis H37Rv
cacuuccagcccggca

SEQ ID NO: 1371486 - RNA, 15 nt, Mycobacterium tuberculosis H37Rv
cacuucggcgccgcg

SEQ ID NO: 1371487 - RNA, 12 nt, Mycobacterium tuberculosis H37Rv
cacuucggcgcc

SEQ ID NO: 1371488 - RNA, 14 nt, Mycobacterium tuberculosis H37Rv
cacuuccaagccga

SEQ ID NO: 1371489 - RNA, 20 nt, Mycobacterium tuberculosis H37Rv
cagaacucaccgacggauga

SEQ ID NO: 1371490 - RNA, 23 nt, Mycobacterium tuberculosis H37Rv
cagaaguagguuuucggcggcuc

SEQ ID NO: 1371491 - RNA, 16 nt, Mycobacterium tuberculosis H37Rv
cagaaccgacggccag

SEQ ID NO: 1371492 - RNA, 15 nt, Mycobacterium tuberculosis H37Rv
cagaaccgacggcca

SEQ ID NO: 1371493 - RNA, 18 nt, Mycobacterium tuberculosis H37Rv
cagaaccuggagccgugc

SEQ ID NO: 1371494 - RNA, 17 nt, Mycobacterium tuberculosis H37Rv
cagaaccggcucaagga

SEQ ID NO: 1371495 - RNA, 23 nt, Mycobacterium tuberculosis H37Rv
cagaacggcguugcggaaucagc

SEQ ID NO: 1371496 - RNA, 22 nt, Mycobacterium tuberculosis H37Rv
cagaacggaauucagcgacgcu

SEQ ID NO: 1371497 - RNA, 17 nt, Mycobacterium tuberculosis H37Rv
cacuuggucacccaauu

SEQ ID NO: 1371498 - RNA, 16 nt, Mycobacterium tuberculosis H37Rv
cacuugugacccggcg

SEQ ID NO: 1371499 - RNA, 16 nt, Mycobacterium tuberculosis H37Rv
cagaccuagcaccgcg

SEQ ID NO: 1371500 - RNA, 22 nt, Mycobacterium tuberculosis H37Rv
cagaccuagcaccgcgccgaac

SEQ ID NO: 1371501 - RNA, 14 nt, Mycobacterium tuberculosis H37Rv
cagaccgcaccauu

SEQ ID NO: 1371502 - RNA, 17 nt, Mycobacterium tuberculosis H37Rv
cagaccgccgacgccgu

SEQ ID NO: 1371503 - RNA, 17 nt, Mycobacterium tuberculosis H37Rv
cagaccgaacagcaccg

SEQ ID NO: 1371504 - RNA, 14 nt, Mycobacterium tuberculosis H37Rv
cagaccaaggcgaa

SEQ ID NO: 1371505 - RNA, 12 nt, Mycobacterium tuberculosis H37Rv
cagaccaagccc

SEQ ID NO: 1371506 - RNA, 19 nt, Mycobacterium tuberculosis H37Rv
cagaccaacaugaacguca

SEQ ID NO: 1371507 - RNA, 22 nt, Mycobacterium tuberculosis H37Rv
cagaccaaugaccgccagcagc

SEQ ID NO: 1371508 - RNA, 23 nt, Mycobacterium tuberculosis H37Rv
cagaccaaugaccgccagcagca

SEQ ID NO: 1371509 - RNA, 14 nt, Mycobacterium tuberculosis H37Rv
cagacggcucagcg

SEQ ID NO: 1371510 - RNA, 17 nt, Mycobacterium tuberculosis H37Rv
cagacgucaugcggaua

SEQ ID NO: 1371511 - RNA, 15 nt, Mycobacterium tuberculosis H37Rv
cagacggcugccacg

SEQ ID NO: 1371512 - RNA, 20 nt, Mycobacterium tuberculosis H37Rv
cagacggggucgcccggggc

SEQ ID NO: 1371513 - RNA, 18 nt, Mycobacterium tuberculosis H37Rv
cagaaucccgcucccaug

SEQ ID NO: 1371514 - RNA, 18 nt, Mycobacterium tuberculosis H37Rv
cagaauccugcgcugcac

SEQ ID NO: 1371515 - RNA, 20 nt, Mycobacterium tuberculosis H37Rv
cagaaucccaacuccuccaa

SEQ ID NO: 1371516 - RNA, 22 nt, Mycobacterium tuberculosis H37Rv
cagaaucaggcucgccgaugcu

SEQ ID NO: 1371517 - RNA, 14 nt, Mycobacterium tuberculosis H37Rv
cagaaugccuggcc

SEQ ID NO: 1371518 - RNA, 14 nt, Mycobacterium tuberculosis H37Rv
cagaaucugccucu

SEQ ID NO: 1371519 - RNA, 11 nt, Mycobacterium tuberculosis H37Rv
cagacauggca

SEQ ID NO: 1371520 - RNA, 21 nt, Mycobacterium tuberculosis H37Rv
cagacauggcaagucaacacc

SEQ ID NO: 1371521 - RNA, 16 nt, Mycobacterium tuberculosis H37Rv
cagacaucggagauca

SEQ ID NO: 1371522 - RNA, 16 nt, Mycobacterium tuberculosis H37Rv
cagacaacgccgucga

SEQ ID NO: 1371523 - RNA, 14 nt, Mycobacterium tuberculosis H37Rv
cagacaaacuccga

SEQ ID NO: 1371524 - RNA, 12 nt, Mycobacterium tuberculosis H37Rv
cagacaacaaca

SEQ ID NO: 1371525 - RNA, 14 nt, Mycobacterium tuberculosis H37Rv
cagagcggcaguca

SEQ ID NO: 1371526 - RNA, 17 nt, Mycobacterium tuberculosis H37Rv
cagaggucacgcagcac

SEQ ID NO: 1371527 - RNA, 17 nt, Mycobacterium tuberculosis H37Rv
cagaggucgccggcaca

SEQ ID NO: 1371528 - RNA, 12 nt, Mycobacterium tuberculosis H37Rv
cagagucaacag

SEQ ID NO: 1371529 - RNA, 12 nt, Mycobacterium tuberculosis H37Rv
cagagucaacau

SEQ ID NO: 1371530 - RNA, 15 nt, Mycobacterium tuberculosis H37Rv
cagagccgcgcgccg

SEQ ID NO: 1371531 - RNA, 20 nt, Mycobacterium tuberculosis H37Rv
cagagccgccguugccgccg

SEQ ID NO: 1371532 - RNA, 17 nt, Mycobacterium tuberculosis H37Rv
cagagccgcccuugccu

SEQ ID NO: 1371533 - RNA, 23 nt, Mycobacterium tuberculosis H37Rv
cagauaccaccgccgcugccggu

SEQ ID NO: 1371534 - RNA, 18 nt, Mycobacterium tuberculosis H37Rv
cagaucacgggugugccu

SEQ ID NO: 1371535 - RNA, 14 nt, Mycobacterium tuberculosis H37Rv
cagaucaccgccag

SEQ ID NO: 1371536 - RNA, 17 nt, Mycobacterium tuberculosis H37Rv
cagauauuugucggcgc

SEQ ID NO: 1371537 - RNA, 21 nt, Mycobacterium tuberculosis H37Rv
cagauaugacggcagaccaug

SEQ ID NO: 1371538 - RNA, 21 nt, Mycobacterium tuberculosis H37Rv
cagauaguccggcuuguccuc

SEQ ID NO: 1371539 - RNA, 20 nt, Mycobacterium tuberculosis H37Rv
cagauagucgccgccgucgu

SEQ ID NO: 1371540 - RNA, 15 nt, Mycobacterium tuberculosis H37Rv
aaaaucgccaucggu

SEQ ID NO: 1371541 - RNA, 15 nt, Mycobacterium tuberculosis H37Rv
aaaaucgcccaauuc

SEQ ID NO: 1371542 - RNA, 23 nt, Mycobacterium tuberculosis H37Rv
cagcaccuccguaacgccaagcu

SEQ ID NO: 1371543 - RNA, 12 nt, Mycobacterium tuberculosis H37Rv
cagcaccgccgg

SEQ ID NO: 1371544 - RNA, 16 nt, Mycobacterium tuberculosis H37Rv
cagcaccgccggugcg

SEQ ID NO: 1371545 - RNA, 14 nt, Mycobacterium tuberculosis H37Rv
cagcaccgccgcug

SEQ ID NO: 1371546 - RNA, 18 nt, Mycobacterium tuberculosis H37Rv
cagcaccgaacccgccac

SEQ ID NO: 1371547 - RNA, 15 nt, Mycobacterium tuberculosis H37Rv
cagcacccugcgggc

SEQ ID NO: 1371548 - RNA, 16 nt, Mycobacterium tuberculosis H37Rv
cagcaccgaacccgcc

SEQ ID NO: 1371549 - RNA, 13 nt, Mycobacterium tuberculosis H37Rv
cagcaccgacagc

SEQ ID NO: 1371550 - RNA, 17 nt, Mycobacterium tuberculosis H37Rv
cagcacggcacccaccc

SEQ ID NO: 1371551 - RNA, 13 nt, Mycobacterium tuberculosis H37Rv
cagcacggcaucg

SEQ ID NO: 1371552 - RNA, 15 nt, Mycobacterium tuberculosis H37Rv
cagcacggcgccgcc

SEQ ID NO: 1371553 - RNA, 16 nt, Mycobacterium tuberculosis H37Rv
cagcacggcggccacg

SEQ ID NO: 1371554 - RNA, 19 nt, Mycobacterium tuberculosis H37Rv
cagcacgcugaccacaacc

SEQ ID NO: 1371555 - RNA, 19 nt, Mycobacterium tuberculosis H37Rv
cagcaccagggcgcggauc

SEQ ID NO: 1371556 - RNA, 14 nt, Mycobacterium tuberculosis H37Rv
cagcaccacggcca

SEQ ID NO: 1371557 - RNA, 19 nt, Mycobacterium tuberculosis H37Rv
cagcaccacggccagcggg

SEQ ID NO: 1371558 - RNA, 13 nt, Mycobacterium tuberculosis H37Rv
cagcaccagcacg

SEQ ID NO: 1371559 - RNA, 17 nt, Mycobacterium tuberculosis H37Rv
cagcaccagcgccuuga

SEQ ID NO: 1371560 - RNA, 13 nt, Mycobacterium tuberculosis H37Rv
cagcaccagcgcc

SEQ ID NO: 1371561 - RNA, 14 nt, Mycobacterium tuberculosis H37Rv
cagcaccagcgccu

SEQ ID NO: 1371562 - RNA, 14 nt, Mycobacterium tuberculosis H37Rv
cagcaccaccgcgg

SEQ ID NO: 1371563 - RNA, 14 nt, Mycobacterium tuberculosis H37Rv
cagcaccaccagca

SEQ ID NO: 1371564 - RNA, 18 nt, Mycobacterium tuberculosis H37Rv
cagcacgugccccaugcg

SEQ ID NO: 1371565 - RNA, 15 nt, Mycobacterium tuberculosis H37Rv
cagcacguucaggug

SEQ ID NO: 1371566 - RNA, 19 nt, Mycobacterium tuberculosis H37Rv
cagcacuccaccgcuggcc

SEQ ID NO: 1371567 - RNA, 18 nt, Mycobacterium tuberculosis H37Rv
cagcacguaacgccgcuc

SEQ ID NO: 1371568 - RNA, 16 nt, Mycobacterium tuberculosis H37Rv
cagcacguaacgccgc

SEQ ID NO: 1371569 - RNA, 16 nt, Mycobacterium tuberculosis H37Rv
cagcacguaacccagu

SEQ ID NO: 1371570 - RNA, 22 nt, Mycobacterium tuberculosis H37Rv
cagcacguaaccuggggugaac

SEQ ID NO: 1371571 - RNA, 15 nt, Mycobacterium tuberculosis H37Rv
cagcacgucacgcaa

SEQ ID NO: 1371572 - RNA, 20 nt, Mycobacterium tuberculosis H37Rv
cagcacgucaaccucgccac

SEQ ID NO: 1371573 - RNA, 17 nt, Mycobacterium tuberculosis H37Rv
cagcacggcuucgacca

SEQ ID NO: 1371574 - RNA, 13 nt, Mycobacterium tuberculosis H37Rv
cagcacggcuucg

SEQ ID NO: 1371575 - RNA, 20 nt, Mycobacterium tuberculosis H37Rv
cagcacgggugagcaccacg

SEQ ID NO: 1371576 - RNA, 13 nt, Mycobacterium tuberculosis H37Rv
cagcagcaacgcg

SEQ ID NO: 1371577 - RNA, 22 nt, Mycobacterium tuberculosis H37Rv
cagcagcaaaacccgagccugg

SEQ ID NO: 1371578 - RNA, 13 nt, Mycobacterium tuberculosis H37Rv
cagcagauugucg

SEQ ID NO: 1371579 - RNA, 16 nt, Mycobacterium tuberculosis H37Rv
cagcagcagcgccgcg

SEQ ID NO: 1371580 - RNA, 15 nt, Mycobacterium tuberculosis H37Rv
cagcagcauccggcc

SEQ ID NO: 1371581 - RNA, 14 nt, Mycobacterium tuberculosis H37Rv
cagcagcagguugu

SEQ ID NO: 1371582 - RNA, 14 nt, Mycobacterium tuberculosis H37Rv
cagcagcaucggca

SEQ ID NO: 1371583 - RNA, 18 nt, Mycobacterium tuberculosis H37Rv
cagcaaaaaccagcgucc

SEQ ID NO: 1371584 - RNA, 16 nt, Mycobacterium tuberculosis H37Rv
cagcaaaaacgcugcc

SEQ ID NO: 1371585 - RNA, 22 nt, Mycobacterium tuberculosis H37Rv
cagauugccgagcccagguggu

SEQ ID NO: 1371586 - RNA, 16 nt, Mycobacterium tuberculosis H37Rv
cagauucgcgcuggcc

SEQ ID NO: 1371587 - RNA, 14 nt, Mycobacterium tuberculosis H37Rv
cagauccccgccac

SEQ ID NO: 1371588 - RNA, 18 nt, Mycobacterium tuberculosis H37Rv
cagcaacugggcggccug

SEQ ID NO: 1371589 - RNA, 13 nt, Mycobacterium tuberculosis H37Rv
cagcaacggcagc

SEQ ID NO: 1371590 - RNA, 20 nt, Mycobacterium tuberculosis H37Rv
aaaaugccuuggcagcccag

SEQ ID NO: 1371591 - RNA, 23 nt, Mycobacterium tuberculosis H37Rv
cagcaacaacgucugcagccucg

SEQ ID NO: 1371592 - RNA, 21 nt, Mycobacterium tuberculosis H37Rv
cagcugaacacgaauccggcc

SEQ ID NO: 1371593 - RNA, 23 nt, Mycobacterium tuberculosis H37Rv
cagcugaacacgaauccggccac

SEQ ID NO: 1371594 - RNA, 18 nt, Mycobacterium tuberculosis H37Rv
cagcucgucggcgauggc

SEQ ID NO: 1371595 - RNA, 13 nt, Mycobacterium tuberculosis H37Rv
cagcucgggcagg

SEQ ID NO: 1371596 - RNA, 19 nt, Mycobacterium tuberculosis H37Rv
cagcucgggcgcgcggcga

SEQ ID NO: 1371597 - RNA, 14 nt, Mycobacterium tuberculosis H37Rv
cagcucguccagcg

SEQ ID NO: 1371598 - RNA, 14 nt, Mycobacterium tuberculosis H37Rv
cagcucggugacaa

SEQ ID NO: 1371599 - RNA, 16 nt, Mycobacterium tuberculosis H37Rv
cagcuggacggccucc

SEQ ID NO: 1371600 - RNA, 19 nt, Mycobacterium tuberculosis H37Rv
cagcugcucggucaggcgg

SEQ ID NO: 1371601 - RNA, 11 nt, Mycobacterium tuberculosis H37Rv
cagcugcucgu

SEQ ID NO: 1371602 - RNA, 19 nt, Mycobacterium tuberculosis H37Rv
cagcugccgcacccccucc

SEQ ID NO: 1371603 - RNA, 23 nt, Mycobacterium tuberculosis H37Rv
cagcugccgcacccccuccgcga

SEQ ID NO: 1371604 - RNA, 22 nt, Mycobacterium tuberculosis H37Rv
cagcugccgaucaauggcaacg

SEQ ID NO: 1371605 - RNA, 22 nt, Mycobacterium tuberculosis H37Rv
cagcugcgggucgugccccggc

SEQ ID NO: 1371606 - RNA, 13 nt, Mycobacterium tuberculosis H37Rv
cagcugcgucccg

SEQ ID NO: 1371607 - RNA, 22 nt, Mycobacterium tuberculosis H37Rv
cagcugcggauacagccgccgc

SEQ ID NO: 1371608 - RNA, 23 nt, Mycobacterium tuberculosis H37Rv
cagcugcggauuaagucggcggc

SEQ ID NO: 1371609 - RNA, 14 nt, Mycobacterium tuberculosis H37Rv
cagcugcccggcgu

SEQ ID NO: 1371610 - RNA, 12 nt, Mycobacterium tuberculosis H37Rv
cagcugcccgcc

SEQ ID NO: 1371611 - RNA, 15 nt, Mycobacterium tuberculosis H37Rv
cagcugcccgccagc

SEQ ID NO: 1371612 - RNA, 21 nt, Mycobacterium tuberculosis H37Rv
cagcugcccgccagcgccgcc

SEQ ID NO: 1371613 - RNA, 13 nt, Mycobacterium tuberculosis H37Rv
cagcugcaccucc

SEQ ID NO: 1371614 - RNA, 15 nt, Mycobacterium tuberculosis H37Rv
cagcugcaccuccga

SEQ ID NO: 1371615 - RNA, 18 nt, Mycobacterium tuberculosis H37Rv
cagcugcacacagagguc

SEQ ID NO: 1371616 - RNA, 16 nt, Mycobacterium tuberculosis H37Rv
cagcugcaaugacugg

SEQ ID NO: 1371617 - RNA, 17 nt, Mycobacterium tuberculosis H37Rv
cagcugcacacagaggu

SEQ ID NO: 1371618 - RNA, 22 nt, Mycobacterium tuberculosis H37Rv
cagcugaucccagaucggcguu

SEQ ID NO: 1371619 - RNA, 13 nt, Mycobacterium tuberculosis H37Rv
cagcugagaugag

SEQ ID NO: 1371620 - RNA, 19 nt, Mycobacterium tuberculosis H37Rv
cagcugaucuuggcaagcc

SEQ ID NO: 1371621 - RNA, 22 nt, Mycobacterium tuberculosis H37Rv
cagcugaccagcguccagccgc

SEQ ID NO: 1371622 - RNA, 22 nt, Mycobacterium tuberculosis H37Rv
cagcugacacccgcagcugugg

SEQ ID NO: 1371623 - RNA, 16 nt, Mycobacterium tuberculosis H37Rv
cagcugacgggccgcu

SEQ ID NO: 1371624 - RNA, 18 nt, Mycobacterium tuberculosis H37Rv
cagcugacgggccgcugu

SEQ ID NO: 1371625 - RNA, 12 nt, Mycobacterium tuberculosis H37Rv
caggaagcccac

SEQ ID NO: 1371626 - RNA, 16 nt, Mycobacterium tuberculosis H37Rv
caggaagcccacgauc

SEQ ID NO: 1371627 - RNA, 14 nt, Mycobacterium tuberculosis H37Rv
cagcuucucagcac

SEQ ID NO: 1371628 - RNA, 20 nt, Mycobacterium tuberculosis H37Rv
cagcuugguggcguggcccu

SEQ ID NO: 1371629 - RNA, 23 nt, Mycobacterium tuberculosis H37Rv
cagcuuggcgucgaugcgggcca

SEQ ID NO: 1371630 - RNA, 21 nt, Mycobacterium tuberculosis H37Rv
cagcuuggacccugcgccgcc

SEQ ID NO: 1371631 - RNA, 22 nt, Mycobacterium tuberculosis H37Rv
cagcuuggacccugcgccgcca

SEQ ID NO: 1371632 - RNA, 17 nt, Mycobacterium tuberculosis H37Rv
cagcuggcgcagccugc

SEQ ID NO: 1371633 - RNA, 21 nt, Mycobacterium tuberculosis H37Rv
cagcuggcgaaugcgggccuc

SEQ ID NO: 1371634 - RNA, 21 nt, Mycobacterium tuberculosis H37Rv
cagcuggcgauacagcgacag

SEQ ID NO: 1371635 - RNA, 17 nt, Mycobacterium tuberculosis H37Rv
cagcugggcgaccacuu

SEQ ID NO: 1371636 - RNA, 20 nt, Mycobacterium tuberculosis H37Rv
cagcuggggcccggccgcca

SEQ ID NO: 1371637 - RNA, 22 nt, Mycobacterium tuberculosis H37Rv
cagcugggcagccagaucucca

SEQ ID NO: 1371638 - RNA, 20 nt, Mycobacterium tuberculosis H37Rv
cagcugggcaucaccgccgc

SEQ ID NO: 1371639 - RNA, 22 nt, Mycobacterium tuberculosis H37Rv
cagcuggucgugggccaccacc

SEQ ID NO: 1371640 - RNA, 17 nt, Mycobacterium tuberculosis H37Rv
cagcuucgccagguggc

SEQ ID NO: 1371641 - RNA, 19 nt, Mycobacterium tuberculosis H37Rv
caggauggugcggccgcgg

SEQ ID NO: 1371642 - RNA, 13 nt, Mycobacterium tuberculosis H37Rv
caggauccgaccc

SEQ ID NO: 1371643 - RNA, 18 nt, Mycobacterium tuberculosis H37Rv
caggaucccgguggcagc

SEQ ID NO: 1371644 - RNA, 14 nt, Mycobacterium tuberculosis H37Rv
caggaucgccugag

SEQ ID NO: 1371645 - RNA, 20 nt, Mycobacterium tuberculosis H37Rv
caggaucgcuacgucgaccg

SEQ ID NO: 1371646 - RNA, 20 nt, Mycobacterium tuberculosis H37Rv
caggaucggcuugggaaacc

SEQ ID NO: 1371647 - RNA, 21 nt, Mycobacterium tuberculosis H37Rv
caggaucgccugagcgccgcg

SEQ ID NO: 1371648 - RNA, 20 nt, Mycobacterium tuberculosis H37Rv
caggaucagcgacuugcugg

SEQ ID NO: 1371649 - RNA, 14 nt, Mycobacterium tuberculosis H37Rv
caggagugcgggca

SEQ ID NO: 1371650 - RNA, 11 nt, Mycobacterium tuberculosis H37Rv
caggaauugcc

SEQ ID NO: 1371651 - RNA, 21 nt, Mycobacterium tuberculosis H37Rv
caggacaauggacaccaaccc

SEQ ID NO: 1371652 - RNA, 17 nt, Mycobacterium tuberculosis H37Rv
caggaccagcaccgccg

SEQ ID NO: 1371653 - RNA, 18 nt, Mycobacterium tuberculosis H37Rv
caggagguugggaacagc

SEQ ID NO: 1371654 - RNA, 20 nt, Mycobacterium tuberculosis H37Rv
caggcaagccagcacugcca

SEQ ID NO: 1371655 - RNA, 19 nt, Mycobacterium tuberculosis H37Rv
caggcaccggaugaugugg

SEQ ID NO: 1371656 - RNA, 21 nt, Mycobacterium tuberculosis H37Rv
caggauucugcugaccaugac

SEQ ID NO: 1371657 - RNA, 19 nt, Mycobacterium tuberculosis H37Rv
caggauucugcugaccaug

SEQ ID NO: 1371658 - RNA, 13 nt, Mycobacterium tuberculosis H37Rv
caggcagcuccgc

SEQ ID NO: 1371659 - RNA, 14 nt, Mycobacterium tuberculosis H37Rv
caggcagcuccgcc

SEQ ID NO: 1371660 - RNA, 20 nt, Mycobacterium tuberculosis H37Rv
caggcacguccgaucggcgc

SEQ ID NO: 1371661 - RNA, 19 nt, Mycobacterium tuberculosis H37Rv
caggcacuccagcggcggg

SEQ ID NO: 1371662 - RNA, 13 nt, Mycobacterium tuberculosis H37Rv
caggcacuccagc

SEQ ID NO: 1371663 - RNA, 17 nt, Mycobacterium tuberculosis H37Rv
caggccuuuuggcgaac

SEQ ID NO: 1371664 - RNA, 20 nt, Mycobacterium tuberculosis H37Rv
caggccuuuuggcgaaccgc

SEQ ID NO: 1371665 - RNA, 15 nt, Mycobacterium tuberculosis H37Rv
caggccuccaagccc

SEQ ID NO: 1371666 - RNA, 23 nt, Mycobacterium tuberculosis H37Rv
caggccuaguccggcacugcggc

SEQ ID NO: 1371667 - RNA, 22 nt, Mycobacterium tuberculosis H37Rv
caggccguugcuauucgccagc

SEQ ID NO: 1371668 - RNA, 15 nt, Mycobacterium tuberculosis H37Rv
caggccaagguggcc

SEQ ID NO: 1371669 - RNA, 21 nt, Mycobacterium tuberculosis H37Rv
caggccaacuuggcggccagc

SEQ ID NO: 1371670 - RNA, 17 nt, Mycobacterium tuberculosis H37Rv
caggccaccccgaccuc

SEQ ID NO: 1371671 - RNA, 23 nt, Mycobacterium tuberculosis H37Rv
caggccaccccgaccucccggca

SEQ ID NO: 1371672 - RNA, 15 nt, Mycobacterium tuberculosis H37Rv
caggccaccccgacc

SEQ ID NO: 1371673 - RNA, 20 nt, Mycobacterium tuberculosis H37Rv
caggcgaguuaggccgccag

SEQ ID NO: 1371674 - RNA, 19 nt, Mycobacterium tuberculosis H37Rv
caggcgaguuaggccgcca

SEQ ID NO: 1371675 - RNA, 22 nt, Mycobacterium tuberculosis H37Rv
caggcgcauagggccaccgccg

SEQ ID NO: 1371676 - RNA, 19 nt, Mycobacterium tuberculosis H37Rv
caggcgcauagggccaccg

SEQ ID NO: 1371677 - RNA, 20 nt, Mycobacterium tuberculosis H37Rv
caggcgcauagggccaccgc

SEQ ID NO: 1371678 - RNA, 23 nt, Mycobacterium tuberculosis H37Rv
caggcgccacugcuuccggaaca

SEQ ID NO: 1371679 - RNA, 17 nt, Mycobacterium tuberculosis H37Rv
caggcgccacugcuucc

SEQ ID NO: 1371680 - RNA, 12 nt, Mycobacterium tuberculosis H37Rv
caggcgccgcua

SEQ ID NO: 1371681 - RNA, 15 nt, Mycobacterium tuberculosis H37Rv
caggcgcccacaaau

SEQ ID NO: 1371682 - RNA, 15 nt, Mycobacterium tuberculosis H37Rv
caggcgcgcaccacc

SEQ ID NO: 1371683 - RNA, 13 nt, Mycobacterium tuberculosis H37Rv
caggcgcgcacca

SEQ ID NO: 1371684 - RNA, 17 nt, Mycobacterium tuberculosis H37Rv
caggcgcgccgcacccg

SEQ ID NO: 1371685 - RNA, 19 nt, Mycobacterium tuberculosis H37Rv
caggcgcucgaaggccgca

SEQ ID NO: 1371686 - RNA, 14 nt, Mycobacterium tuberculosis H37Rv
caggcgcugcagca

SEQ ID NO: 1371687 - RNA, 20 nt, Mycobacterium tuberculosis H37Rv
caggcgcucaucacccagcg

SEQ ID NO: 1371688 - RNA, 16 nt, Mycobacterium tuberculosis H37Rv
caggcgcggcccaggu

SEQ ID NO: 1371689 - RNA, 15 nt, Mycobacterium tuberculosis H37Rv
caggcuugcggcacc

SEQ ID NO: 1371690 - RNA, 13 nt, Mycobacterium tuberculosis H37Rv
cagggaggggccg

SEQ ID NO: 1371691 - RNA, 20 nt, Mycobacterium tuberculosis H37Rv
caggcggcucaaccucuggc

SEQ ID NO: 1371692 - RNA, 15 nt, Mycobacterium tuberculosis H37Rv
caggcggcgaacugc

SEQ ID NO: 1371693 - RNA, 14 nt, Mycobacterium tuberculosis H37Rv
caggcggccgagcu

SEQ ID NO: 1371694 - RNA, 13 nt, Mycobacterium tuberculosis H37Rv
caggcggccgcca

SEQ ID NO: 1371695 - RNA, 13 nt, Mycobacterium tuberculosis H37Rv
caggcggccagcg

SEQ ID NO: 1371696 - RNA, 14 nt, Mycobacterium tuberculosis H37Rv
caggcgcugccggu

SEQ ID NO: 1371697 - RNA, 18 nt, Mycobacterium tuberculosis H37Rv
caggcgcugcagcauggc

SEQ ID NO: 1371698 - RNA, 20 nt, Mycobacterium tuberculosis H37Rv
caggcgcugcagcauggcuc

SEQ ID NO: 1371699 - RNA, 13 nt, Mycobacterium tuberculosis H37Rv
caggcggcuggcc

SEQ ID NO: 1371700 - RNA, 16 nt, Mycobacterium tuberculosis H37Rv
caggcgggcaacgcag

SEQ ID NO: 1371701 - RNA, 16 nt, Mycobacterium tuberculosis H37Rv
caggcgugcacagguc

SEQ ID NO: 1371702 - RNA, 22 nt, Mycobacterium tuberculosis H37Rv
caggcuaaucagccaggccagu

SEQ ID NO: 1371703 - RNA, 20 nt, Mycobacterium tuberculosis H37Rv
caggguauccacgccgggca

SEQ ID NO: 1371704 - RNA, 21 nt, Mycobacterium tuberculosis H37Rv
caggguauccacgccgggcaa

SEQ ID NO: 1371705 - RNA, 18 nt, Mycobacterium tuberculosis H37Rv
cagggucacaaacccagc

SEQ ID NO: 1371706 - RNA, 19 nt, Mycobacterium tuberculosis H37Rv
cagggucaccugcgggccc

SEQ ID NO: 1371707 - RNA, 13 nt, Mycobacterium tuberculosis H37Rv
cagggucagcugg

SEQ ID NO: 1371708 - RNA, 14 nt, Mycobacterium tuberculosis H37Rv
cagggucugcucau

SEQ ID NO: 1371709 - RNA, 16 nt, Mycobacterium tuberculosis H37Rv
cagggucugcgccgcc

SEQ ID NO: 1371710 - RNA, 20 nt, Mycobacterium tuberculosis H37Rv
cagggucgccccgaagcggg

SEQ ID NO: 1371711 - RNA, 23 nt, Mycobacterium tuberculosis H37Rv
cagggucgcgagcccgccacagc

SEQ ID NO: 1371712 - RNA, 14 nt, Mycobacterium tuberculosis H37Rv
cagggucagcuggg

SEQ ID NO: 1371713 - RNA, 17 nt, Mycobacterium tuberculosis H37Rv
cagggucgaguucgcag

SEQ ID NO: 1371714 - RNA, 20 nt, Mycobacterium tuberculosis H37Rv
cagggucccgccgccuggaa

SEQ ID NO: 1371715 - RNA, 20 nt, Mycobacterium tuberculosis H37Rv
cagggcgcggaucugcagca

SEQ ID NO: 1371716 - RNA, 17 nt, Mycobacterium tuberculosis H37Rv
cagggcuucgugcacca

SEQ ID NO: 1371717 - RNA, 13 nt, Mycobacterium tuberculosis H37Rv
caggggacgacca

SEQ ID NO: 1371718 - RNA, 15 nt, Mycobacterium tuberculosis H37Rv
caggggacccggggc

SEQ ID NO: 1371719 - RNA, 15 nt, Mycobacterium tuberculosis H37Rv
cagggguuggcguca

SEQ ID NO: 1371720 - RNA, 14 nt, Mycobacterium tuberculosis H37Rv
cagggcgacggcca

SEQ ID NO: 1371721 - RNA, 21 nt, Mycobacterium tuberculosis H37Rv
cagggcgcaaaccacccgcaa

SEQ ID NO: 1371722 - RNA, 18 nt, Mycobacterium tuberculosis H37Rv
cagggcgcaaaccacccg

SEQ ID NO: 1371723 - RNA, 21 nt, Mycobacterium tuberculosis H37Rv
cagggaucgauuuggaucggc

SEQ ID NO: 1371724 - RNA, 21 nt, Mycobacterium tuberculosis H37Rv
cagguaauugccgaccgccug

SEQ ID NO: 1371725 - RNA, 22 nt, Mycobacterium tuberculosis H37Rv
cagguaaugguggcguccaggg

SEQ ID NO: 1371726 - RNA, 15 nt, Mycobacterium tuberculosis H37Rv
cagguaagccacaua

SEQ ID NO: 1371727 - RNA, 13 nt, Mycobacterium tuberculosis H37Rv
cagguaagccaca

SEQ ID NO: 1371728 - RNA, 17 nt, Mycobacterium tuberculosis H37Rv
cagguaagcagccagca

SEQ ID NO: 1371729 - RNA, 13 nt, Mycobacterium tuberculosis H37Rv
cagguaagcagcc

SEQ ID NO: 1371730 - RNA, 14 nt, Mycobacterium tuberculosis H37Rv
cagguacgccaggu

SEQ ID NO: 1371731 - RNA, 18 nt, Mycobacterium tuberculosis H37Rv
cagguacuuugcgcccgg

SEQ ID NO: 1371732 - RNA, 14 nt, Mycobacterium tuberculosis H37Rv
cagguaggucuggg

SEQ ID NO: 1371733 - RNA, 13 nt, Mycobacterium tuberculosis H37Rv
caggguggccagc

SEQ ID NO: 1371734 - RNA, 15 nt, Mycobacterium tuberculosis H37Rv
cagggugucugugau

SEQ ID NO: 1371735 - RNA, 14 nt, Mycobacterium tuberculosis H37Rv
cagggugcgccggu

SEQ ID NO: 1371736 - RNA, 20 nt, Mycobacterium tuberculosis H37Rv
cagggugcgccgcagcaggu

SEQ ID NO: 1371737 - RNA, 17 nt, Mycobacterium tuberculosis H37Rv
cagggugcgccgcagca

SEQ ID NO: 1371738 - RNA, 14 nt, Mycobacterium tuberculosis H37Rv
caggguuggcagca

SEQ ID NO: 1371739 - RNA, 17 nt, Mycobacterium tuberculosis H37Rv
caggguugccaucaagg

SEQ ID NO: 1371740 - RNA, 18 nt, Mycobacterium tuberculosis H37Rv
cagccgcggggcccacac

SEQ ID NO: 1371741 - RNA, 21 nt, Mycobacterium tuberculosis H37Rv
cagccgcugaucugccgccgc

SEQ ID NO: 1371742 - RNA, 12 nt, Mycobacterium tuberculosis H37Rv
cagccgcugauc

SEQ ID NO: 1371743 - RNA, 20 nt, Mycobacterium tuberculosis H37Rv
cagccggcggcuggucucug

SEQ ID NO: 1371744 - RNA, 18 nt, Mycobacterium tuberculosis H37Rv
cagccggcgcacucccgg

SEQ ID NO: 1371745 - RNA, 16 nt, Mycobacterium tuberculosis H37Rv
cagccggccugucccg

SEQ ID NO: 1371746 - RNA, 17 nt, Mycobacterium tuberculosis H37Rv
cagccggccugucccgc

SEQ ID NO: 1371747 - RNA, 23 nt, Mycobacterium tuberculosis H37Rv
cagccggcgaaugcgguccucga

SEQ ID NO: 1371748 - RNA, 19 nt, Mycobacterium tuberculosis H37Rv
cagcccgucggcgccgaac

SEQ ID NO: 1371749 - RNA, 15 nt, Mycobacterium tuberculosis H37Rv
cagcccggugauggu

SEQ ID NO: 1371750 - RNA, 15 nt, Mycobacterium tuberculosis H37Rv
cagccgcgccgcggc

SEQ ID NO: 1371751 - RNA, 23 nt, Mycobacterium tuberculosis H37Rv
cagcccguccaggcgcugcagca

SEQ ID NO: 1371752 - RNA, 13 nt, Mycobacterium tuberculosis H37Rv
cagccgcgccggg

SEQ ID NO: 1371753 - RNA, 18 nt, Mycobacterium tuberculosis H37Rv
cagcccgggcagccccuc

SEQ ID NO: 1371754 - RNA, 14 nt, Mycobacterium tuberculosis H37Rv
cagcccgggcagcc

SEQ ID NO: 1371755 - RNA, 16 nt, Mycobacterium tuberculosis H37Rv
cagcccgggcagcccc

SEQ ID NO: 1371756 - RNA, 17 nt, Mycobacterium tuberculosis H37Rv
cagcccgggcagccccu

SEQ ID NO: 1371757 - RNA, 15 nt, Mycobacterium tuberculosis H37Rv
cagcccggcggccgc

SEQ ID NO: 1371758 - RNA, 16 nt, Mycobacterium tuberculosis H37Rv
cagcccggcggccgcu

SEQ ID NO: 1371759 - RNA, 15 nt, Mycobacterium tuberculosis H37Rv
cagcccggcgcgccg

SEQ ID NO: 1371760 - RNA, 20 nt, Mycobacterium tuberculosis H37Rv
cagcccggcgacgacccggg

SEQ ID NO: 1371761 - RNA, 13 nt, Mycobacterium tuberculosis H37Rv
cagcccggccuug

SEQ ID NO: 1371762 - RNA, 16 nt, Mycobacterium tuberculosis H37Rv
cagcccggccgccgag

SEQ ID NO: 1371763 - RNA, 15 nt, Mycobacterium tuberculosis H37Rv
cagccgggcgucgcu

SEQ ID NO: 1371764 - RNA, 14 nt, Mycobacterium tuberculosis H37Rv
cagccgggcacccu

SEQ ID NO: 1371765 - RNA, 13 nt, Mycobacterium tuberculosis H37Rv
cagccgggcacca

SEQ ID NO: 1371766 - RNA, 14 nt, Mycobacterium tuberculosis H37Rv
cagccgguccagac

SEQ ID NO: 1371767 - RNA, 14 nt, Mycobacterium tuberculosis H37Rv
cagccgguccagcg

SEQ ID NO: 1371768 - RNA, 15 nt, Mycobacterium tuberculosis H37Rv
cagccggguggacac

SEQ ID NO: 1371769 - RNA, 12 nt, Mycobacterium tuberculosis H37Rv
cagccguccggg

SEQ ID NO: 1371770 - RNA, 20 nt, Mycobacterium tuberculosis H37Rv
cagccgucagcgcgggcggg

SEQ ID NO: 1371771 - RNA, 21 nt, Mycobacterium tuberculosis H37Rv
cagccgucguccgcugacccg

SEQ ID NO: 1371772 - RNA, 18 nt, Mycobacterium tuberculosis H37Rv
cagccgucgccaccagag

SEQ ID NO: 1371773 - RNA, 23 nt, Mycobacterium tuberculosis H37Rv
cagccguagcugggcaccccguu

SEQ ID NO: 1371774 - RNA, 20 nt, Mycobacterium tuberculosis H37Rv
cagccgguggucugcgcggu

SEQ ID NO: 1371775 - RNA, 16 nt, Mycobacterium tuberculosis H37Rv
cagccguggcggcggg

SEQ ID NO: 1371776 - RNA, 24 nt, Mycobacterium tuberculosis H37Rv
cagccgugcccaggccaccggcug

SEQ ID NO: 1371777 - RNA, 20 nt, Mycobacterium tuberculosis H37Rv
cagccgugcccaggccaccg

SEQ ID NO: 1371778 - RNA, 13 nt, Mycobacterium tuberculosis H37Rv
cagccguucucgc

SEQ ID NO: 1371779 - RNA, 15 nt, Mycobacterium tuberculosis H37Rv
cagcgacgccggccc

SEQ ID NO: 1371780 - RNA, 16 nt, Mycobacterium tuberculosis H37Rv
cagcgacgccggcccg

SEQ ID NO: 1371781 - RNA, 17 nt, Mycobacterium tuberculosis H37Rv
cagcgacgcggccagcg

SEQ ID NO: 1371782 - RNA, 14 nt, Mycobacterium tuberculosis H37Rv
cagcgacgcuagga

SEQ ID NO: 1371783 - RNA, 15 nt, Mycobacterium tuberculosis H37Rv
cagcgacgacgccca

SEQ ID NO: 1371784 - RNA, 21 nt, Mycobacterium tuberculosis H37Rv
cagcgacgacgcccaccaggc

SEQ ID NO: 1371785 - RNA, 16 nt, Mycobacterium tuberculosis H37Rv
cagcgaccaguggugg

SEQ ID NO: 1371786 - RNA, 18 nt, Mycobacterium tuberculosis H37Rv
cagcgacgcuaggacggc

SEQ ID NO: 1371787 - RNA, 14 nt, Mycobacterium tuberculosis H37Rv
cagcgagacgucga

SEQ ID NO: 1371788 - RNA, 19 nt, Mycobacterium tuberculosis H37Rv
cagcgagaucagcaugccc

SEQ ID NO: 1371789 - RNA, 15 nt, Mycobacterium tuberculosis H37Rv
cagcgagcacacucc

SEQ ID NO: 1371790 - RNA, 19 nt, Mycobacterium tuberculosis H37Rv
cagcgagcauaccgccgcu

SEQ ID NO: 1371791 - RNA, 14 nt, Mycobacterium tuberculosis H37Rv
cagcgaggccagcg

SEQ ID NO: 1371792 - RNA, 15 nt, Mycobacterium tuberculosis H37Rv
cagcgaggagcaggg

SEQ ID NO: 1371793 - RNA, 18 nt, Mycobacterium tuberculosis H37Rv
cagccuuuccggccgccu

SEQ ID NO: 1371794 - RNA, 16 nt, Mycobacterium tuberculosis H37Rv
cagcgacagcgugccg

SEQ ID NO: 1371795 - RNA, 22 nt, Mycobacterium tuberculosis H37Rv
cagcgacagcgugccgaacagg

SEQ ID NO: 1371796 - RNA, 17 nt, Mycobacterium tuberculosis H37Rv
cagcgauaucggcggcu

SEQ ID NO: 1371797 - RNA, 17 nt, Mycobacterium tuberculosis H37Rv
cagcgaguugagcaugu

SEQ ID NO: 1371798 - RNA, 14 nt, Mycobacterium tuberculosis H37Rv
cagcgauccggggc

SEQ ID NO: 1371799 - RNA, 14 nt, Mycobacterium tuberculosis H37Rv
cagcgaggccaugu

SEQ ID NO: 1371800 - RNA, 16 nt, Mycobacterium tuberculosis H37Rv
cagcgaggccagcggu

SEQ ID NO: 1371801 - RNA, 15 nt, Mycobacterium tuberculosis H37Rv
cagcgcagccgaucg

SEQ ID NO: 1371802 - RNA, 21 nt, Mycobacterium tuberculosis H37Rv
cagcgcagccgaucgucucgg

SEQ ID NO: 1371803 - RNA, 20 nt, Mycobacterium tuberculosis H37Rv
cagcgcaggauucugcugac

SEQ ID NO: 1371804 - RNA, 22 nt, Mycobacterium tuberculosis H37Rv
cagcgcaacggccagcgcugcu

SEQ ID NO: 1371805 - RNA, 20 nt, Mycobacterium tuberculosis H37Rv
cagcgcaacgugauagccgg

SEQ ID NO: 1371806 - RNA, 20 nt, Mycobacterium tuberculosis H37Rv
cagcgcaaccuccgcgagca

SEQ ID NO: 1371807 - RNA, 14 nt, Mycobacterium tuberculosis H37Rv
cagcgaugcggcgu

SEQ ID NO: 1371808 - RNA, 18 nt, Mycobacterium tuberculosis H37Rv
cagcgaugcggcccucga

SEQ ID NO: 1371809 - RNA, 20 nt, Mycobacterium tuberculosis H37Rv
cagcgaugcgcucacugcag

SEQ ID NO: 1371810 - RNA, 18 nt, Mycobacterium tuberculosis H37Rv
cagcgaugcgcucacugc

SEQ ID NO: 1371811 - RNA, 15 nt, Mycobacterium tuberculosis H37Rv
cagcgaugacgacca

SEQ ID NO: 1371812 - RNA, 14 nt, Mycobacterium tuberculosis H37Rv
cagcgaugacgacc

SEQ ID NO: 1371813 - RNA, 19 nt, Mycobacterium tuberculosis H37Rv
cagcgauggguguugcugg

SEQ ID NO: 1371814 - RNA, 14 nt, Mycobacterium tuberculosis H37Rv
cagccagaugccgg

SEQ ID NO: 1371815 - RNA, 11 nt, Mycobacterium tuberculosis H37Rv
cagccagacca

SEQ ID NO: 1371816 - RNA, 13 nt, Mycobacterium tuberculosis H37Rv
cagccagaucucc

SEQ ID NO: 1371817 - RNA, 17 nt, Mycobacterium tuberculosis H37Rv
cagccagaucuccccga

SEQ ID NO: 1371818 - RNA, 19 nt, Mycobacterium tuberculosis H37Rv
cagccaguaaaaaggcagg

SEQ ID NO: 1371819 - RNA, 12 nt, Mycobacterium tuberculosis H37Rv
cagccagccacc

SEQ ID NO: 1371820 - RNA, 18 nt, Mycobacterium tuberculosis H37Rv
cagccagauucauuggcc

SEQ ID NO: 1371821 - RNA, 14 nt, Mycobacterium tuberculosis H37Rv
cagcagcccgggca

SEQ ID NO: 1371822 - RNA, 13 nt, Mycobacterium tuberculosis H37Rv
cagcagcccgccc

SEQ ID NO: 1371823 - RNA, 18 nt, Mycobacterium tuberculosis H37Rv
cagcagcccgguggugcu

SEQ ID NO: 1371824 - RNA, 21 nt, Mycobacterium tuberculosis H37Rv
cagcagcccgggcagccccuc

SEQ ID NO: 1371825 - RNA, 12 nt, Mycobacterium tuberculosis H37Rv
cagcagccgcga

SEQ ID NO: 1371826 - RNA, 20 nt, Mycobacterium tuberculosis H37Rv
cagcagcccgacaguggucc

SEQ ID NO: 1371827 - RNA, 16 nt, Mycobacterium tuberculosis H37Rv
cagcagcgacuccagc

SEQ ID NO: 1371828 - RNA, 15 nt, Mycobacterium tuberculosis H37Rv
cagcagcgacgguca

SEQ ID NO: 1371829 - RNA, 17 nt, Mycobacterium tuberculosis H37Rv
cagcagcgacuccagcg

SEQ ID NO: 1371830 - RNA, 20 nt, Mycobacterium tuberculosis H37Rv
cagcagcgacuccagcgccc

SEQ ID NO: 1371831 - RNA, 20 nt, Mycobacterium tuberculosis H37Rv
cagcagcgacgcugccgcca

SEQ ID NO: 1371832 - RNA, 14 nt, Mycobacterium tuberculosis H37Rv
cagccaaccggcgc

SEQ ID NO: 1371833 - RNA, 17 nt, Mycobacterium tuberculosis H37Rv
cagccaaaucagccagg

SEQ ID NO: 1371834 - RNA, 16 nt, Mycobacterium tuberculosis H37Rv
cagcccgccgcugaac

SEQ ID NO: 1371835 - RNA, 23 nt, Mycobacterium tuberculosis H37Rv
cagcccggacguaggcaccccgg

SEQ ID NO: 1371836 - RNA, 14 nt, Mycobacterium tuberculosis H37Rv
cagcccggccagcc

SEQ ID NO: 1371837 - RNA, 12 nt, Mycobacterium tuberculosis H37Rv
cagcccgaugcc

SEQ ID NO: 1371838 - RNA, 22 nt, Mycobacterium tuberculosis H37Rv
cagcccgaugaucccgccaccg

SEQ ID NO: 1371839 - RNA, 20 nt, Mycobacterium tuberculosis H37Rv
cagcccgaugaucccgccac

SEQ ID NO: 1371840 - RNA, 21 nt, Mycobacterium tuberculosis H37Rv
cagccccgcgcccaccccggc

SEQ ID NO: 1371841 - RNA, 16 nt, Mycobacterium tuberculosis H37Rv
cagccccugccgaucc

SEQ ID NO: 1371842 - RNA, 16 nt, Mycobacterium tuberculosis H37Rv
cagccccuccgcgccg

SEQ ID NO: 1371843 - RNA, 15 nt, Mycobacterium tuberculosis H37Rv
cagcccgagcucggg

SEQ ID NO: 1371844 - RNA, 17 nt, Mycobacterium tuberculosis H37Rv
cagcccgacguugcgua

SEQ ID NO: 1371845 - RNA, 22 nt, Mycobacterium tuberculosis H37Rv
cagccccgcgcccaccccggcc

SEQ ID NO: 1371846 - RNA, 17 nt, Mycobacterium tuberculosis H37Rv
cagccccgcggccagca

SEQ ID NO: 1371847 - RNA, 14 nt, Mycobacterium tuberculosis H37Rv
cagccccgacugcg

SEQ ID NO: 1371848 - RNA, 21 nt, Mycobacterium tuberculosis H37Rv
cagcccacaggcggcgcugca

SEQ ID NO: 1371849 - RNA, 17 nt, Mycobacterium tuberculosis H37Rv
cagcccacaggcggcgc

SEQ ID NO: 1371850 - RNA, 15 nt, Mycobacterium tuberculosis H37Rv
cagcccaaaucccag

SEQ ID NO: 1371851 - RNA, 19 nt, Mycobacterium tuberculosis H37Rv
cagcccaacucggccagcu

SEQ ID NO: 1371852 - RNA, 22 nt, Mycobacterium tuberculosis H37Rv
cagccauacuccgagggaacgg

SEQ ID NO: 1371853 - RNA, 15 nt, Mycobacterium tuberculosis H37Rv
cagccauagugcggc

SEQ ID NO: 1371854 - RNA, 20 nt, Mycobacterium tuberculosis H37Rv
cagcccacgagugcaagacc

SEQ ID NO: 1371855 - RNA, 16 nt, Mycobacterium tuberculosis H37Rv
cagcccaccggugccg

SEQ ID NO: 1371856 - RNA, 14 nt, Mycobacterium tuberculosis H37Rv
cagcccagcacgcu

SEQ ID NO: 1371857 - RNA, 19 nt, Mycobacterium tuberculosis H37Rv
cagcccagcacgcuggcgu

SEQ ID NO: 1371858 - RNA, 17 nt, Mycobacterium tuberculosis H37Rv
cagcccaggccuuagau

SEQ ID NO: 1371859 - RNA, 15 nt, Mycobacterium tuberculosis H37Rv
cagcccagcggcugg

SEQ ID NO: 1371860 - RNA, 13 nt, Mycobacterium tuberculosis H37Rv
cagcccagccggg

SEQ ID NO: 1371861 - RNA, 21 nt, Mycobacterium tuberculosis H37Rv
cagcccagccguucgucgcgg

SEQ ID NO: 1371862 - RNA, 22 nt, Mycobacterium tuberculosis H37Rv
cagcccagcagguuccacggcc

SEQ ID NO: 1371863 - RNA, 12 nt, Mycobacterium tuberculosis H37Rv
cagcccaugggg

SEQ ID NO: 1371864 - RNA, 15 nt, Mycobacterium tuberculosis H37Rv
cagccccagggugcg

SEQ ID NO: 1371865 - RNA, 14 nt, Mycobacterium tuberculosis H37Rv
cagcgcaucggcca

SEQ ID NO: 1371866 - RNA, 14 nt, Mycobacterium tuberculosis H37Rv
cagcgcaucgccgc

SEQ ID NO: 1371867 - RNA, 17 nt, Mycobacterium tuberculosis H37Rv
cagcgccugcgcccagc

SEQ ID NO: 1371868 - RNA, 15 nt, Mycobacterium tuberculosis H37Rv
cagcgccugcgccca

SEQ ID NO: 1371869 - RNA, 21 nt, Mycobacterium tuberculosis H37Rv
cagcgccuuguggcacacccg

SEQ ID NO: 1371870 - RNA, 19 nt, Mycobacterium tuberculosis H37Rv
cagcgccuuguggcacacc

SEQ ID NO: 1371871 - RNA, 20 nt, Mycobacterium tuberculosis H37Rv
cagcgccuuguggcacaccc

SEQ ID NO: 1371872 - RNA, 19 nt, Mycobacterium tuberculosis H37Rv
cagcgcggcacccaaccag

SEQ ID NO: 1371873 - RNA, 18 nt, Mycobacterium tuberculosis H37Rv
cagcgcgcugggaagcuc

SEQ ID NO: 1371874 - RNA, 14 nt, Mycobacterium tuberculosis H37Rv
cagcgcggccacca

SEQ ID NO: 1371875 - RNA, 14 nt, Mycobacterium tuberculosis H37Rv
cagcgcggccaccc

SEQ ID NO: 1371876 - RNA, 15 nt, Mycobacterium tuberculosis H37Rv
cagcgcggccacccg

SEQ ID NO: 1371877 - RNA, 16 nt, Mycobacterium tuberculosis H37Rv
cagcgcggccagugcu

SEQ ID NO: 1371878 - RNA, 18 nt, Mycobacterium tuberculosis H37Rv
cagcgcggcgcacaaccc

SEQ ID NO: 1371879 - RNA, 14 nt, Mycobacterium tuberculosis H37Rv
cagcgcggcgcccu

SEQ ID NO: 1371880 - RNA, 22 nt, Mycobacterium tuberculosis H37Rv
cagcgcggcgcccuggccgccc

SEQ ID NO: 1371881 - RNA, 20 nt, Mycobacterium tuberculosis H37Rv
cagcgcgucgccgaaagccu

SEQ ID NO: 1371882 - RNA, 17 nt, Mycobacterium tuberculosis H37Rv
cagcgcgucggagccgg

SEQ ID NO: 1371883 - RNA, 16 nt, Mycobacterium tuberculosis H37Rv
cagcgcgucgccgaaa

SEQ ID NO: 1371884 - RNA, 13 nt, Mycobacterium tuberculosis H37Rv
cagcgcguggaac

SEQ ID NO: 1371885 - RNA, 19 nt, Mycobacterium tuberculosis H37Rv
cagcggccagcagugcggu

SEQ ID NO: 1371886 - RNA, 22 nt, Mycobacterium tuberculosis H37Rv
cagcggcauccacaccgaccgc

SEQ ID NO: 1371887 - RNA, 15 nt, Mycobacterium tuberculosis H37Rv
cagcggcauugccag

SEQ ID NO: 1371888 - RNA, 14 nt, Mycobacterium tuberculosis H37Rv
cagcggccagcagu

SEQ ID NO: 1371889 - RNA, 16 nt, Mycobacterium tuberculosis H37Rv
cagcggccagcagugc

SEQ ID NO: 1371890 - RNA, 20 nt, Mycobacterium tuberculosis H37Rv
cagcggcaucgcgggcggcg

SEQ ID NO: 1371891 - RNA, 22 nt, Mycobacterium tuberculosis H37Rv
cagcggcaucgcgggcggcgcu

SEQ ID NO: 1371892 - RNA, 21 nt, Mycobacterium tuberculosis H37Rv
cagcggcaaggucggacuggc

SEQ ID NO: 1371893 - RNA, 15 nt, Mycobacterium tuberculosis H37Rv
cagcggcaauggcca

SEQ ID NO: 1371894 - RNA, 17 nt, Mycobacterium tuberculosis H37Rv
cagcggcaacgccuccg

SEQ ID NO: 1371895 - RNA, 17 nt, Mycobacterium tuberculosis H37Rv
cagcggcacacccauca

SEQ ID NO: 1371896 - RNA, 23 nt, Mycobacterium tuberculosis H37Rv
cagcggcaaggucaacgggaggu

SEQ ID NO: 1371897 - RNA, 21 nt, Mycobacterium tuberculosis H37Rv
cagcgggacugcggaagccac

SEQ ID NO: 1371898 - RNA, 12 nt, Mycobacterium tuberculosis H37Rv
cagcggcuggga

SEQ ID NO: 1371899 - RNA, 12 nt, Mycobacterium tuberculosis H37Rv
cagcggcugggc

SEQ ID NO: 1371900 - RNA, 20 nt, Mycobacterium tuberculosis H37Rv
cagcggcccgcugcgcggcc

SEQ ID NO: 1371901 - RNA, 18 nt, Mycobacterium tuberculosis H37Rv
cagcggcgcgaccgucug

SEQ ID NO: 1371902 - RNA, 15 nt, Mycobacterium tuberculosis H37Rv
cagcggcgccgccaa

SEQ ID NO: 1371903 - RNA, 18 nt, Mycobacterium tuberculosis H37Rv
cagcggcgccgccaaggg

SEQ ID NO: 1371904 - RNA, 17 nt, Mycobacterium tuberculosis H37Rv
cagcggcgacacaucgc

SEQ ID NO: 1371905 - RNA, 19 nt, Mycobacterium tuberculosis H37Rv
cagcggcgacacaucgccc

SEQ ID NO: 1371906 - RNA, 17 nt, Mycobacterium tuberculosis H37Rv
cagcggcgaucaggcgg

SEQ ID NO: 1371907 - RNA, 23 nt, Mycobacterium tuberculosis H37Rv
cagcggcgaucggaggcccgcca

SEQ ID NO: 1371908 - RNA, 22 nt, Mycobacterium tuberculosis H37Rv
cagcggccgguacacguccagu

SEQ ID NO: 1371909 - RNA, 17 nt, Mycobacterium tuberculosis H37Rv
cagcggccuccgggcca

SEQ ID NO: 1371910 - RNA, 13 nt, Mycobacterium tuberculosis H37Rv
cagcggccgcucc

SEQ ID NO: 1371911 - RNA, 17 nt, Mycobacterium tuberculosis H37Rv
cagcggccgcuccaccu

SEQ ID NO: 1371912 - RNA, 13 nt, Mycobacterium tuberculosis H37Rv
cagcgggcgcgcu

SEQ ID NO: 1371913 - RNA, 18 nt, Mycobacterium tuberculosis H37Rv
cagcgggccacugagcca

SEQ ID NO: 1371914 - RNA, 15 nt, Mycobacterium tuberculosis H37Rv
cagcgucaccucacc

SEQ ID NO: 1371915 - RNA, 21 nt, Mycobacterium tuberculosis H37Rv
cagcguaucucccaacggcag

SEQ ID NO: 1371916 - RNA, 23 nt, Mycobacterium tuberculosis H37Rv
cagcguaucucccaacggcagcg

SEQ ID NO: 1371917 - RNA, 17 nt, Mycobacterium tuberculosis H37Rv
cagcguaagaccugagu

SEQ ID NO: 1371918 - RNA, 17 nt, Mycobacterium tuberculosis H37Rv
cagcgguggcuugcccc

SEQ ID NO: 1371919 - RNA, 20 nt, Mycobacterium tuberculosis H37Rv
cagcggugcugguggcggca

SEQ ID NO: 1371920 - RNA, 14 nt, Mycobacterium tuberculosis H37Rv
cagcgguccgccgc

SEQ ID NO: 1371921 - RNA, 17 nt, Mycobacterium tuberculosis H37Rv
cagcggucagccggcca

SEQ ID NO: 1371922 - RNA, 16 nt, Mycobacterium tuberculosis H37Rv
cagcgguaucccccag

SEQ ID NO: 1371923 - RNA, 24 nt, Mycobacterium tuberculosis H37Rv
cagcgguaucccccagccgcggcg

SEQ ID NO: 1371924 - RNA, 21 nt, Mycobacterium tuberculosis H37Rv
cagcgggugaaucgacaccgc

SEQ ID NO: 1371925 - RNA, 18 nt, Mycobacterium tuberculosis H37Rv
cagcgggucgccgggccc

SEQ ID NO: 1371926 - RNA, 18 nt, Mycobacterium tuberculosis H37Rv
cagcggguggugccaggu

SEQ ID NO: 1371927 - RNA, 21 nt, Mycobacterium tuberculosis H37Rv
cagcguugucggguggcugcu

SEQ ID NO: 1371928 - RNA, 19 nt, Mycobacterium tuberculosis H37Rv
cagcguuaggucgccggcu

SEQ ID NO: 1371929 - RNA, 13 nt, Mycobacterium tuberculosis H37Rv
cagcguucccgcc

SEQ ID NO: 1371930 - RNA, 19 nt, Mycobacterium tuberculosis H37Rv
cagcguucccgccggcucc

SEQ ID NO: 1371931 - RNA, 18 nt, Mycobacterium tuberculosis H37Rv
cagcguggggccgccacc

SEQ ID NO: 1371932 - RNA, 17 nt, Mycobacterium tuberculosis H37Rv
cagcguggggccgccac

SEQ ID NO: 1371933 - RNA, 18 nt, Mycobacterium tuberculosis H37Rv
cagcguggacgcccgccc

SEQ ID NO: 1371934 - RNA, 19 nt, Mycobacterium tuberculosis H37Rv
cagcguggacgcccgcccg

SEQ ID NO: 1371935 - RNA, 23 nt, Mycobacterium tuberculosis H37Rv
cagcgugcggggcgccugaugcg

SEQ ID NO: 1371936 - RNA, 15 nt, Mycobacterium tuberculosis H37Rv
cagcgugcgcuggcu

SEQ ID NO: 1371937 - RNA, 21 nt, Mycobacterium tuberculosis H37Rv
cagcgugccgguggcgccgcc

SEQ ID NO: 1371938 - RNA, 16 nt, Mycobacterium tuberculosis H37Rv
cagcgugccugguucu

SEQ ID NO: 1371939 - RNA, 16 nt, Mycobacterium tuberculosis H37Rv
cagcgucugugucccg

SEQ ID NO: 1371940 - RNA, 16 nt, Mycobacterium tuberculosis H37Rv
cagcgugagugcagca

SEQ ID NO: 1371941 - RNA, 14 nt, Mycobacterium tuberculosis H37Rv
cagcgugcccgcca

SEQ ID NO: 1371942 - RNA, 15 nt, Mycobacterium tuberculosis H37Rv
cagcgugaucuggcc

SEQ ID NO: 1371943 - RNA, 20 nt, Mycobacterium tuberculosis H37Rv
cagcgucuucagguccaccg

SEQ ID NO: 1371944 - RNA, 16 nt, Mycobacterium tuberculosis H37Rv
cagcgucauccucguc

SEQ ID NO: 1371945 - RNA, 17 nt, Mycobacterium tuberculosis H37Rv
cagcguccagccgcccu

SEQ ID NO: 1371946 - RNA, 18 nt, Mycobacterium tuberculosis H37Rv
cagcguccagccgcccuc

SEQ ID NO: 1371947 - RNA, 19 nt, Mycobacterium tuberculosis H37Rv
cagcguccagccgcccucg

SEQ ID NO: 1371948 - RNA, 19 nt, Mycobacterium tuberculosis H37Rv
cagcguccaaaccuucaac

SEQ ID NO: 1371949 - RNA, 13 nt, Mycobacterium tuberculosis H37Rv
cagcgucaggugc

SEQ ID NO: 1371950 - RNA, 17 nt, Mycobacterium tuberculosis H37Rv
cagcgucagcgcggcgu

SEQ ID NO: 1371951 - RNA, 21 nt, Mycobacterium tuberculosis H37Rv
cagcgucgcaaggcccgcacc

SEQ ID NO: 1371952 - RNA, 23 nt, Mycobacterium tuberculosis H37Rv
cagcgucgcggccacggucagcc

SEQ ID NO: 1371953 - RNA, 16 nt, Mycobacterium tuberculosis H37Rv
cagcgucgcggccacg

SEQ ID NO: 1371954 - RNA, 17 nt, Mycobacterium tuberculosis H37Rv
cagcguccagcgccugc

SEQ ID NO: 1371955 - RNA, 16 nt, Mycobacterium tuberculosis H37Rv
cagcguccagccgccc

SEQ ID NO: 1371956 - RNA, 17 nt, Mycobacterium tuberculosis H37Rv
cagcguccgaaccaccu

SEQ ID NO: 1371957 - RNA, 18 nt, Mycobacterium tuberculosis H37Rv
cagcguccgaaccaccug

SEQ ID NO: 1371958 - RNA, 21 nt, Mycobacterium tuberculosis H37Rv
cagcguccuggcguagugcag

SEQ ID NO: 1371959 - RNA, 19 nt, Mycobacterium tuberculosis H37Rv
cagcguccgucgucggcgu

SEQ ID NO: 1371960 - RNA, 22 nt, Human
aacaauguaauaaaaagccucu

SEQ ID NO: 1371961 - RNA, 14 nt, Human
uaaugucugcagcu

SEQ ID NO: 1371962 - RNA, 16 nt, Human
guuccaguggcggcac

SEQ ID NO: 1371963 - RNA, 23 nt, Human
ggccacacguggcuggcggccuc

SEQ ID NO: 1371964 - RNA, 22 nt, Human
agccuuacaaagggaaagccuc

SEQ ID NO: 1371965 - RNA, 14 nt, Human
caggcacagcagcu

SEQ ID NO: 1371966 - RNA, 14 nt, Human
cuccauaucauuug

SEQ ID NO: 1371967 - RNA, 16 nt, Human
ugccuguaacaaugua

SEQ ID NO: 1371968 - RNA, 20 nt, Human
ggggugcucucucugagggg

SEQ ID NO: 1371969 - RNA, 22 nt, Human
ucgaaggggaggcacacuuucu

SEQ ID NO: 1371970 - RNA, 14 nt, Human
auuuugcuaacugg

SEQ ID NO: 1371971 - RNA, 20 nt, Human
ggguuaaauauuuugcuaac

SEQ ID NO: 1371972 - RNA, 17 nt, Human
gugcguucuccugaugu

SEQ ID NO: 1371973 - RNA, 19 nt, Human
cugagggggugggggugcc

SEQ ID NO: 1371974 - RNA, 14 nt, Human
gcaaacguuucuca

SEQ ID NO: 1371975 - RNA, 16 nt, Human
gccgcuuucucugagg

SEQ ID NO: 1371976 - RNA, 18 nt, Human
uaacaauguaauaaaaag

SEQ ID NO: 1371977 - RNA, 21 nt, Human
acuuucuggcaaacguuucuc

SEQ ID NO: 1371978 - RNA, 14 nt, Human
gggaaagccucugg

SEQ ID NO: 1371979 - RNA, 15 nt, Human
aauuuugcuaacugg

SEQ ID NO: 1371980 - RNA, 22 nt, Human
uguuuugccguggcuuggggau

SEQ ID NO: 1371981 - RNA, 18 nt, Human
ucucugaggggugggggu

SEQ ID NO: 1371982 - RNA, 14 nt, Human
gugccgcucucucu

SEQ ID NO: 1371983 - RNA, 16 nt, Human
ggugcucucucugagg

SEQ ID NO: 1371984 - RNA, 23 nt, Human
cauuacaacaguagagagggaac

SEQ ID NO: 1371985 - RNA, 14 nt, Human
agggggugggggug

SEQ ID NO: 1371986 - RNA, 23 nt, Human
ugagggugggggugcucucucug

SEQ ID NO: 1371987 - RNA, 18 nt, Human
ucaagggcuggcacuuuu

SEQ ID NO: 1371988 - RNA, 22 nt, Human
uggaaugccgcugucucugagg

SEQ ID NO: 1371989 - RNA, 15 nt, Human
gggggugggggugcc

SEQ ID NO: 1371990 - RNA, 12 nt, Human
gccgcucucucu

SEQ ID NO: 1371991 - RNA, 23 nt, Human
gggugccgcuuucucugaggggg

SEQ ID NO: 1371992 - RNA, 16 nt, Human
gcuuucucugaggggg

SEQ ID NO: 1371993 - RNA, 15 nt, Human
gagaugagugucugg

SEQ ID NO: 1371994 - RNA, 16 nt, Human
gcaggcacagcagcug

SEQ ID NO: 1371995 - RNA, 20 nt, Human
gucacucguggugaggcuga

SEQ ID NO: 1371996 - RNA, 12 nt, Human
aagacagaggaa

SEQ ID NO: 1371997 - RNA, 17 nt, Human
uguguacaaugugagau

SEQ ID NO: 1371998 - RNA, 13 nt, Human
aaauauuuugcua

SEQ ID NO: 1371999 - RNA, 16 nt, Human
uauuuugcuaacuggu

SEQ ID NO: 1372000 - RNA, 14 nt, Human
cauugccuguaaca

SEQ ID NO: 1372001 - RNA, 18 nt, Human
cugcgcuguguacaaugu

SEQ ID NO: 1372002 - RNA, 19 nt, Human
gcucacacauuacaacagu

SEQ ID NO: 1372003 - RNA, 20 nt, Human
gggugcucucucugaggggg

SEQ ID NO: 1372004 - RNA, 20 nt, Human
ugggggugccgcucucucug

SEQ ID NO: 1372005 - RNA, 14 nt, Human
cugagggggugggg

SEQ ID NO: 1372006 - RNA, 17 nt, Human
uugcuaacuggguuaaa

SEQ ID NO: 1372007 - RNA, 13 nt, Human
gaggggugggggu

SEQ ID NO: 1372008 - RNA, 19 nt, Human
agggugggggugcucucuc

SEQ ID NO: 1372009 - RNA, 17 nt, Human
uuuugagggugggggug

SEQ ID NO: 1372010 - RNA, 18 nt, Human
cguaaugcauugccugua

SEQ ID NO: 1372011 - RNA, 19 nt, Human
gcacguccuugggcgucuc

SEQ ID NO: 1372012 - RNA, 19 nt, Human
aggauuuugaggguggggg

SEQ ID NO: 1372013 - RNA, 17 nt, Human
uuacuaugcacaacaga

SEQ ID NO: 1372014 - RNA, 20 nt, Human
gcuggcggccucguuccagu

SEQ ID NO: 1372015 - RNA, 13 nt, Human
gcacucagauuua

SEQ ID NO: 1372016 - RNA, 22 nt, Human
cugguguuugguuucuucauuc

SEQ ID NO: 1372017 - RNA, 11 nt, Human
agggguggggg

SEQ ID NO: 1372018 - RNA, 17 nt, Human
gugccgcuuucucugag

SEQ ID NO: 1372019 - RNA, 14 nt, Human
cuuacaaagggaaa

SEQ ID NO: 1372020 - RNA, 19 nt, Human
ugagaucggugcguucucc

SEQ ID NO: 1372021 - RNA, 11 nt, Human
uguacaaugug

SEQ ID NO: 1372022 - RNA, 17 nt, Human
ucggugcguucuccuga

SEQ ID NO: 1372023 - RNA, 18 nt, Human
gaggcacacuuucuggca

SEQ ID NO: 1372024 - RNA, 14 nt, Human
augaaggucacucg

SEQ ID NO: 1372025 - RNA, 19 nt, Human
auuuacuaugcacaacaga

SEQ ID NO: 1372026 - RNA, 16 nt, Human
cucugagggguggggg

SEQ ID NO: 1372027 - RNA, 13 nt, Human
cugaggggugggg

SEQ ID NO: 1372028 - RNA, 16 nt, Human
ccgcugucucugaggg

SEQ ID NO: 1372029 - RNA, 15 nt, Human
ggccacacguggcug

SEQ ID NO: 1372030 - RNA, 21 nt, Human
aaucugcuucauccaauguga

SEQ ID NO: 1372031 - RNA, 23 nt, Human
gggugccgcucucucugaggggg

SEQ ID NO: 1372032 - RNA, 20 nt, Human
auuuugcuaacuggguuaaa

SEQ ID NO: 1372033 - RNA, 23 nt, Human
aaugcauugccuguaacaaugua

SEQ ID NO: 1372034 - RNA, 16 nt, Human
cuaacugguuaaacau

SEQ ID NO: 1372035 - RNA, 13 nt, Human
uaaauauaaaaau

SEQ ID NO: 1372036 - RNA, 16 nt, Human
agcucaagggcuggca

SEQ ID NO: 1372037 - RNA, 15 nt, Human
ugccgcucucucuga

SEQ ID NO: 1372038 - RNA, 13 nt, Human
ucucucugagggg

SEQ ID NO: 1372039 - RNA, 14 nt, Human
uucucugagggggu

SEQ ID NO: 1372040 - RNA, 16 nt, Human
ccuguucugcgcugug

SEQ ID NO: 1372041 - RNA, 19 nt, Human
ugcuaacugguuaaacauu

SEQ ID NO: 1372042 - RNA, 17 nt, Human
guuccuuucucugggcu

SEQ ID NO: 1372043 - RNA, 20 nt, Human
caauguaauaaaaagccucu

SEQ ID NO: 1372044 - RNA, 12 nt, Human
ccgcugucucug

SEQ ID NO: 1372045 - RNA, 15 nt, Human
cuguuccuuucucug

SEQ ID NO: 1372046 - RNA, 21 nt, Human
gggugccgcugucucugaggg

SEQ ID NO: 1372047 - RNA, 15 nt, Human
aaacguuucucaaau

SEQ ID NO: 1372048 - RNA, 13 nt, Human
ugccgcugucucu

SEQ ID NO: 1372049 - RNA, 23 nt, Human
aaaugacgguguuaauuuugcua

SEQ ID NO: 1372050 - RNA, 15 nt, Human
cgcugucucugaggg

SEQ ID NO: 1372051 - RNA, 22 nt, Human
ugacauucggggugauccuguu

SEQ ID NO: 1372052 - RNA, 16 nt, Human
uuuugagggugggggu

SEQ ID NO: 1372053 - RNA, 11 nt, Human
ccgcugucucu

SEQ ID NO: 1372054 - RNA, 11 nt, Human
uucucugaggg

SEQ ID NO: 1372055 - RNA, 20 nt, Human
guaggauuuugagggugggg

SEQ ID NO: 1372056 - RNA, 17 nt, Human
uaauuuugcuaacuggg

SEQ ID NO: 1372057 - RNA, 23 nt, Human
ccuggugcacgcaggcacagcag

SEQ ID NO: 1372058 - RNA, 11 nt, Human
ucucugagggg

SEQ ID NO: 1372059 - RNA, 14 nt, Human
aggaacuccagaga

SEQ ID NO: 1372060 - RNA, 11 nt, Human
auauuuugcua

SEQ ID NO: 1372061 - RNA, 17 nt, Human
gcugucucugaggggug

SEQ ID NO: 1372062 - RNA, 15 nt, Human
ucuuuacugcacuca

SEQ ID NO: 1372063 - RNA, 20 nt, Human
ugcagcauuuacuaugcaca

SEQ ID NO: 1372064 - RNA, 19 nt, Human
ugacauucggggugauccu

SEQ ID NO: 1372065 - RNA, 13 nt, Human
aggggugggggug

SEQ ID NO: 1372066 - RNA, 22 nt, Human
aggggugggggugccgcucucu

SEQ ID NO: 1372067 - RNA, 12 nt, Human
gccgcugucucu

SEQ ID NO: 1372068 - RNA, 15 nt, Human
gccgcuuucucugag

SEQ ID NO: 1372069 - RNA, 19 nt, Human
cauuuacuaugcacaacag

SEQ ID NO: 1372070 - RNA, 13 nt, Human
uguuaauuuugcu

SEQ ID NO: 1372071 - RNA, 23 nt, Human
cucacacauuacaacaguagaga

SEQ ID NO: 1372072 - RNA, 22 nt, Human
auaaaaauggguguuauuuuua

SEQ ID NO: 1372073 - RNA, 21 nt, Human
augcucacacauuacaacagu

SEQ ID NO: 1372074 - RNA, 16 nt, Human
ucugaggggguggggg

SEQ ID NO: 1372075 - RNA, 23 nt, Human
aaagccucuggccgucacacgua

SEQ ID NO: 1372076 - RNA, 19 nt, Human
cugcagcucaagggcuggc

SEQ ID NO: 1372077 - RNA, 19 nt, Human
cauucuuuacugcacucag

SEQ ID NO: 1372078 - RNA, 14 nt, Human
gagggggugggggu

SEQ ID NO: 1372079 - RNA, 21 nt, Human
gccgcugucucugaggggugg

SEQ ID NO: 1372080 - RNA, 14 nt, Human
guggcuggcggccu

SEQ ID NO: 1372081 - RNA, 23 nt, Human
aggacgggccacacguggcuggc

SEQ ID NO: 1372082 - RNA, 13 nt, Human
gaggggguggggg

SEQ ID NO: 1372083 - RNA, 12 nt, Human
uuuuuaaauaua

SEQ ID NO: 1372084 - RNA, 12 nt, Human
cagcuuuaaagg

SEQ ID NO: 1372085 - RNA, 12 nt, Human
ucucucugaggg

SEQ ID NO: 1372086 - RNA, 13 nt, Human
gagggugggggug

SEQ ID NO: 1372087 - RNA, 13 nt, Human
gccgcuuucucug

SEQ ID NO: 1372088 - RNA, 9 nt, Human
cucucucug

SEQ ID NO: 1372089 - RNA, 16 nt, Human
cgcugucucugagggg

SEQ ID NO: 1372090 - RNA, 13 nt, Human
cuuucucugaggg

SEQ ID NO: 1372091 - RNA, 10 nt, Human
ccgcucucuc

SEQ ID NO: 1372092 - RNA, 19 nt, Human
ucucugagggggugggggu

SEQ ID NO: 1372093 - RNA, 18 nt, Human
gggugcucucucugaggg

SEQ ID NO: 1372094 - RNA, 11 nt, Human
ccgcucucucu

SEQ ID NO: 1372095 - RNA, 15 nt, Human
acaguagagagggaa

SEQ ID NO: 1372096 - RNA, 14 nt, Human
uaaacauuaauauu

SEQ ID NO: 1372097 - RNA, 23 nt, Human
aaugacgguguuaauuuugcuaa

SEQ ID NO: 1372098 - RNA, 20 nt, Human
cuggugcacgcaggcacagc

SEQ ID NO: 1372099 - RNA, 16 nt, Human
gccgcugucucugagg

SEQ ID NO: 1372100 - RNA, 15 nt, Human
guaaagugauuuuug

SEQ ID NO: 1372101 - RNA, 16 nt, Human
uacuaugcacaacaga

SEQ ID NO: 1372102 - RNA, 10 nt, Human
aauuuugcua

SEQ ID NO: 1372103 - RNA, 19 nt, Human
cagcugcaggggccucugu

SEQ ID NO: 1372104 - RNA, 22 nt, Human
cagcauuuacuaugcacaacag

SEQ ID NO: 1372105 - RNA, 14 nt, Human
uuccaguggcggca

SEQ ID NO: 1372106 - RNA, 20 nt, Human
ccuggugcacgcaggcacag

SEQ ID NO: 1372107 - RNA, 14 nt, Human
aaauauuuugcuaa

SEQ ID NO: 1372108 - RNA, 17 nt, Human
cucugaggggguggggg

SEQ ID NO: 1372109 - RNA, 20 nt, Human
agggugggggugcucucucu

SEQ ID NO: 1372110 - RNA, 19 nt, Human
ugcuaacuggguuaaauau

SEQ ID NO: 1372111 - RNA, 19 nt, Human
gcagcugcaggggccucug

SEQ ID NO: 1372112 - RNA, 17 nt, Human
acacguggcuggcggcc

SEQ ID NO: 1372113 - RNA, 13 nt, Human
ggugccgcucucu

SEQ ID NO: 1372114 - RNA, 14 nt, Human
gcuucaguucagcu

SEQ ID NO: 1372115 - RNA, 14 nt, Human
ugccgcuuucucug

SEQ ID NO: 1372116 - RNA, 17 nt, Human
ugccgcuuucucugagg

SEQ ID NO: 1372117 - RNA, 13 nt, Human
gggggugggggug

SEQ ID NO: 1372118 - RNA, 22 nt, Human
aucgaaaugacgguguuaauuu

SEQ ID NO: 1372119 - RNA, 17 nt, Human
ugcauugccuguaacaa

SEQ ID NO: 1372120 - RNA, 21 nt, Human
ugcagcauuuacuaugcacaa

SEQ ID NO: 1372121 - RNA, 16 nt, Human
cgcucucucugagggg

SEQ ID NO: 1372122 - RNA, 12 nt, Human
gagggguggggg

SEQ ID NO: 1372123 - RNA, 13 nt, Human
cuguaacaaugua

SEQ ID NO: 1372124 - RNA, 16 nt, Human
cacgcaggcacagcag

SEQ ID NO: 1372125 - RNA, 14 nt, Human
gugccgcugucucu

SEQ ID NO: 1372126 - RNA, 17 nt, Human
gugccgcucucucugag

SEQ ID NO: 1372127 - RNA, 13 nt, Human
acgggaccagcuc

SEQ ID NO: 1372128 - RNA, 17 nt, Human
ugccgcugucucugagg

SEQ ID NO: 1372129 - RNA, 16 nt, Human
ucugcgcuguguacaa

SEQ ID NO: 1372130 - RNA, 21 nt, Human
cuguugacauucggggugauc

SEQ ID NO: 1372131 - RNA, 22 nt, Human
ugagggggugggggugccgcug

SEQ ID NO: 1372132 - RNA, 21 nt, Human
ccugucgaaggggaggcacac

SEQ ID NO: 1372133 - RNA, 18 nt, Human
caacaguagagagggaac

SEQ ID NO: 1372134 - RNA, 23 nt, Human
augucugcagcucaagggcuggc

SEQ ID NO: 1372135 - RNA, 13 nt, Human
ggugccgcugucu

SEQ ID NO: 1372136 - RNA, 14 nt, Human
aacauuaauauuua

SEQ ID NO: 1372137 - RNA, 18 nt, Human
gcucucuccgaggggugg

SEQ ID NO: 1372138 - RNA, 15 nt, Human
agcuuuaaaggccag

SEQ ID NO: 1372139 - RNA, 19 nt, Human
gcuaacuggguuaaauauu

SEQ ID NO: 1372140 - RNA, 12 nt, Human
gcucucucugag

SEQ ID NO: 1372141 - RNA, 13 nt, Human
uaaauauuuugcu

SEQ ID NO: 1372142 - RNA, 21 nt, Human
ggugccgcugucucugagggg

SEQ ID NO: 1372143 - RNA, 17 nt, Human
cuggagcgcuucaguuc

SEQ ID NO: 1372144 - RNA, 13 nt, Human
cucugaggggugg

SEQ ID NO: 1372145 - RNA, 18 nt, Human
cuaacuggguuaaauauu

SEQ ID NO: 1372146 - RNA, 12 nt, Human
ugucucugaggg

SEQ ID NO: 1372147 - RNA, 19 nt, Human
gacgggccacacguggcug

SEQ ID NO: 1372148 - RNA, 13 nt, Human
gcuguguacaaug

SEQ ID NO: 1372149 - RNA, 21 nt, Human
aaugccgcugucucugagggg

SEQ ID NO: 1372150 - RNA, 14 nt, Human
acugguuaaacauu

SEQ ID NO: 1372151 - RNA, 13 nt, Human
uuucucugagggg

SEQ ID NO: 1372152 - RNA, 19 nt, Human
gcuuucucugagggggugg

SEQ ID NO: 1372153 - RNA, 20 nt, Human
cgcaggcacagcagcugcag

SEQ ID NO: 1372154 - RNA, 14 nt, Human
cucucugagggggu

SEQ ID NO: 1372155 - RNA, 17 nt, Human
ugguguuugguuucuuc

SEQ ID NO: 1372156 - RNA, 18 nt, Human
acaugcucacacauuaca

SEQ ID NO: 1372157 - RNA, 23 nt, Human
aggggugggggugccgcucucuc

SEQ ID NO: 1372158 - RNA, 14 nt, Human
uguuccuuucucug

SEQ ID NO: 1372159 - RNA, 19 nt, Human
aggcacagcagcugcaggg

SEQ ID NO: 1372160 - RNA, 19 nt, Human
auaaaaauggguguuauuu

SEQ ID NO: 1372161 - RNA, 16 nt, Human
cucguuccaguggcgg

SEQ ID NO: 1372162 - RNA, 18 nt, Human
ugcgcuguguacaaugug

SEQ ID NO: 1372163 - RNA, 11 nt, Human
cgcuuucucug

SEQ ID NO: 1372164 - RNA, 17 nt, Human
cugcucucuccgagggg

SEQ ID NO: 1372165 - RNA, 14 nt, Human
gugccgcuuucucu

SEQ ID NO: 1372166 - RNA, 20 nt, Human
gcugcucucuccgaggggug

SEQ ID NO: 1372167 - RNA, 21 nt, Human
gugagaucggugcguucuccu

SEQ ID NO: 1372168 - RNA, 21 nt, Human
ggugccgcuuucucugagggg

SEQ ID NO: 1372169 - RNA, 15 nt, Human
gccgcugucucugag

SEQ ID NO: 1372170 - RNA, 21 nt, Human
uucugcgcuguguacaaugug

SEQ ID NO: 1372171 - RNA, 19 nt, Human
cuguucugcgcuguguaca

SEQ ID NO: 1372172 - RNA, 18 nt, Human
agggugggggugcucucu

SEQ ID NO: 1372173 - RNA, 22 nt, Human
acaauguaauaaaaagccucuu

SEQ ID NO: 1372174 - RNA, 15 nt, Human
gccucguuccagugg

SEQ ID NO: 1372175 - RNA, 17 nt, Human
cuggcacuuuuuuaaau

SEQ ID NO: 1372176 - RNA, 15 nt, Human
gccgcucucucugag

SEQ ID NO: 1372177 - RNA, 19 nt, Human
ugacgguguuaauuuugcu

SEQ ID NO: 1372178 - RNA, 15 nt, Human
gagggguggaaugcc

SEQ ID NO: 1372179 - RNA, 14 nt, Human
augcacaacagagu

SEQ ID NO: 1372180 - RNA, 15 nt, Human
agcagcugcaggggc

SEQ ID NO: 1372181 - RNA, 16 nt, Human
cgaaggggaggcacac

SEQ ID NO: 1372182 - RNA, 13 nt, Human
auauuuugcuaac

SEQ ID NO: 1372183 - RNA, 14 nt, Human
uguaaagugauuuu

SEQ ID NO: 1372184 - RNA, 11 nt, Human
cugcucucucc

SEQ ID NO: 1372185 - RNA, 21 nt, Human
uaauaaaaagccucuuucuuu

SEQ ID NO: 1372186 - RNA, 21 nt, Human
gggugccgcuuucucugaggg

SEQ ID NO: 1372187 - RNA, 19 nt, Human
gccucuguuccuuucucug

SEQ ID NO: 1372188 - RNA, 9 nt, Human
ccgcugucu

SEQ ID NO: 1372189 - RNA, 17 nt, Human
gcuaacugguuaaacau

SEQ ID NO: 1372190 - RNA, 14 nt, Human
ggugcugcucucuc

SEQ ID NO: 1372191 - RNA, 12 nt, Human
gugccgcucucu

SEQ ID NO: 1372192 - RNA, 15 nt, Human
gugggggugccgcuc

SEQ ID NO: 1372193 - RNA, 21 nt, Human
ugaggggugggggugccgcug

SEQ ID NO: 1372194 - RNA, 14 nt, Human
ggggauuguacacg

SEQ ID NO: 1372195 - RNA, 19 nt, Human
auuuugcuaacugguuaaa

SEQ ID NO: 1372196 - RNA, 12 nt, Human
uguacaauguga

SEQ ID NO: 1372197 - RNA, 16 nt, Human
acgcaggcacagcagc

SEQ ID NO: 1372198 - RNA, 18 nt, Human
uggaaugccgcugucucu

SEQ ID NO: 1372199 - RNA, 12 nt, Human
gcugcucucucc

SEQ ID NO: 1372200 - RNA, 19 nt, Human
aggguccugucgaagggga

SEQ ID NO: 1372201 - RNA, 14 nt, Human
cgggaccagcucac

SEQ ID NO: 1372202 - RNA, 21 nt, Human
gggugccgcucucucugaggg

SEQ ID NO: 1372203 - RNA, 19 nt, Human
gcgcuucaguucagcuuua

SEQ ID NO: 1372204 - RNA, 18 nt, Human
gcagcucaagggcuggca

SEQ ID NO: 1372205 - RNA, 16 nt, Human
cuuucucugagggggu

SEQ ID NO: 1372206 - RNA, 12 nt, Human
aggggguggggg

SEQ ID NO: 1372207 - RNA, 12 nt, Human
ugcucucucuga

SEQ ID NO: 1372208 - RNA, 19 nt, Human
cauccuaagacagaggaac

SEQ ID NO: 1372209 - RNA, 16 nt, Human
uuaaacauuaauauuu

SEQ ID NO: 1372210 - RNA, 14 nt, Human
agcugcaggggccu

SEQ ID NO: 1372211 - RNA, 22 nt, Human
ggaacauccuaagacagaggaa

SEQ ID NO: 1372212 - RNA, 20 nt, Human
ccugucgaaggggaggcaca

SEQ ID NO: 1372213 - RNA, 19 nt, Human
cuggagcgcuucaguucag

SEQ ID NO: 1372214 - RNA, 20 nt, Human
cugagggggugggggugcug

SEQ ID NO: 1372215 - RNA, 16 nt, Human
uggcaaacguuucuca

SEQ ID NO: 1372216 - RNA, 13 nt, Human
cuccgaggggugg

SEQ ID NO: 1372217 - RNA, 19 nt, Human
cgguguuaauuuugcuaac

SEQ ID NO: 1372218 - RNA, 16 nt, Human
ugaaguucaucuugca

SEQ ID NO: 1372219 - RNA, 21 nt, Human
agggugggggugcucucucug

SEQ ID NO: 1372220 - RNA, 13 nt, Human
ggggugggggugc

SEQ ID NO: 1372221 - RNA, 13 nt, Human
uaacuaucgaaau

SEQ ID NO: 1372222 - RNA, 23 nt, Human
ggucacucguggugaggcugaca

SEQ ID NO: 1372223 - RNA, 20 nt, Human
aguucaucuugcagcauuua

SEQ ID NO: 1372224 - RNA, 14 nt, Human
gugcucucucugag

SEQ ID NO: 1372225 - RNA, 18 nt, Human
cugaggggugggggugcc

SEQ ID NO: 1372226 - RNA, 15 nt, Human
aaaguaggauuuuga

SEQ ID NO: 1372227 - RNA, 12 nt, Human
ccgcucucucug

SEQ ID NO: 1372228 - RNA, 16 nt, Human
gcucucucugaggggg

SEQ ID NO: 1372229 - RNA, 16 nt, Human
gccgcucucucugagg

SEQ ID NO: 1372230 - RNA, 15 nt, Human
guuaauuuugcuaac

SEQ ID NO: 1372231 - RNA, 17 nt, Human
ucugaggggugggggug

SEQ ID NO: 1372232 - RNA, 15 nt, Human
gaacuccagagauga

SEQ ID NO: 1372233 - RNA, 18 nt, Human
aacuggguuaaauauuuu

SEQ ID NO: 1372234 - RNA, 16 nt, Human
uugcuaacugguuaaa

SEQ ID NO: 1372235 - RNA, 13 nt, Human
ccgcugucucuga

SEQ ID NO: 1372236 - RNA, 18 nt, Human
acaaagggaaagccucug

SEQ ID NO: 1372237 - RNA, 16 nt, Human
cugucgaaggggaggc

SEQ ID NO: 1372238 - RNA, 18 nt, Human
ugcuaacuggguuaaaua

SEQ ID NO: 1372239 - RNA, 15 nt, Human
acuggguuaaauauu

SEQ ID NO: 1372240 - RNA, 22 nt, Human
guccugucgaaggggaggcaca

SEQ ID NO: 1372241 - RNA, 15 nt, Human
acaugcucacacauu

SEQ ID NO: 1372242 - RNA, 18 nt, Human
cacucguggugaggcuga

SEQ ID NO: 1372243 - RNA, 13 nt, Human
acauuaauauuua

SEQ ID NO: 1372244 - RNA, 16 nt, Human
caucuugcagcauuua

SEQ ID NO: 1372245 - RNA, 17 nt, Human
ucacacauuacaacagu

SEQ ID NO: 1372246 - RNA, 14 nt, Human
ucuguuccuuucuc

SEQ ID NO: 1372247 - RNA, 11 nt, Human
cugcagcucaa

SEQ ID NO: 1372248 - RNA, 17 nt, Human
ugccgcucucucugagg

SEQ ID NO: 1372249 - RNA, 13 nt, Human
aaugccgcugucu

SEQ ID NO: 1372250 - RNA, 21 nt, Human
aaugcauugccuguaacaaug

SEQ ID NO: 1372251 - RNA, 23 nt, Human
ggaacuccagagaugagugucug

SEQ ID NO: 1372252 - RNA, 17 nt, Human
gggccacacguggcugg

SEQ ID NO: 1372253 - RNA, 21 nt, Human
ggugccgcucucucugagggg

SEQ ID NO: 1372254 - RNA, 15 nt, Human
ucugagggguggggg

SEQ ID NO: 1372255 - RNA, 23 nt, Human
cugcaggggccucuguuccuuuc

SEQ ID NO: 1372256 - RNA, 13 nt, Human
acauuacaacagu

SEQ ID NO: 1372257 - RNA, 13 nt, Human
gcucucucugagg

SEQ ID NO: 1372258 - RNA, 14 nt, Human
augccgcugucucu

SEQ ID NO: 1372259 - RNA, 11 nt, Human
ggugcugcucu

SEQ ID NO: 1372260 - RNA, 21 nt, Human
ccuuacaaagggaaagccucu

SEQ ID NO: 1372261 - RNA, 13 nt, Human
cucucucugaggg

SEQ ID NO: 1372262 - RNA, 14 nt, Human
ugccgcucucucug

SEQ ID NO: 1372263 - RNA, 18 nt, Human
ucugagggggugggggug

SEQ ID NO: 1372264 - RNA, 14 nt, Human
ugcucucucugagg

SEQ ID NO: 1372265 - RNA, 13 nt, Neisseria meningitidis MC58
uucagacggcauu

SEQ ID NO: 1372266 - RNA, 14 nt, Neisseria meningitidis MC58
guuuaugccgucug

SEQ ID NO: 1372267 - RNA, 13 nt, Neisseria meningitidis MC58
guuucagacggca

SEQ ID NO: 1372268 - RNA, 13 nt, Neisseria meningitidis MC58
gcuucagacggca

SEQ ID NO: 1372269 - RNA, 13 nt, Neisseria meningitidis MC58
uucagacggcaua

SEQ ID NO: 1372270 - RNA, 20 nt, Neisseria meningitidis MC58
aaugacgggauauggguuuc

SEQ ID NO: 1372271 - RNA, 19 nt, Neisseria meningitidis MC58
aaucuaggucugucgguuc

SEQ ID NO: 1372272 - RNA, 22 nt, Neisseria meningitidis MC58
aauccaguccguucaguuucgg

SEQ ID NO: 1372273 - RNA, 17 nt, Neisseria meningitidis MC58
accgaaaugccgucauu

SEQ ID NO: 1372274 - RNA, 19 nt, Neisseria meningitidis MC58
accgaaaugccgucauucc

SEQ ID NO: 1372275 - RNA, 22 nt, Neisseria meningitidis MC58
accccgucauucccgcgcaggc

SEQ ID NO: 1372276 - RNA, 14 nt, Neisseria meningitidis MC58
guuucagacggcau

SEQ ID NO: 1372277 - RNA, 13 nt, Neisseria meningitidis MC58
agaaaugccgucu

SEQ ID NO: 1372278 - RNA, 14 nt, Neisseria meningitidis MC58
agaaaugccgucug

SEQ ID NO: 1372279 - RNA, 17 nt, Neisseria meningitidis MC58
agaaaugccgucugaaa

SEQ ID NO: 1372280 - RNA, 13 nt, Neisseria meningitidis MC58
aggguuucagacg

SEQ ID NO: 1372281 - RNA, 21 nt, Neisseria meningitidis MC58
caaaaaucaggacaaggcgac

SEQ ID NO: 1372282 - RNA, 20 nt, Neisseria meningitidis MC58
auucccacuuuugugggaau

SEQ ID NO: 1372283 - RNA, 20 nt, Neisseria meningitidis MC58
auucccgcgcaggcgggaau

SEQ ID NO: 1372284 - RNA, 15 nt, Neisseria meningitidis MC58
auguuuaugccgucu

SEQ ID NO: 1372285 - RNA, 13 nt, Neisseria meningitidis MC58
augccgucugaaa

SEQ ID NO: 1372286 - RNA, 23 nt, Neisseria meningitidis MC58
ccaacccugcguucuagauuccc

SEQ ID NO: 1372287 - RNA, 23 nt, Neisseria meningitidis MC58
cagaauaucggcuucgaccgcuu

SEQ ID NO: 1372288 - RNA, 20 nt, Neisseria meningitidis MC58
cgaaaugccgucauucccgc

SEQ ID NO: 1372289 - RNA, 13 nt, Neisseria meningitidis MC58
ccgucauucccgc

SEQ ID NO: 1372290 - RNA, 20 nt, Neisseria meningitidis MC58
cgggaauccaguccguucag

SEQ ID NO: 1372291 - RNA, 19 nt, Neisseria meningitidis MC58
cugugucgggcuucagacg

SEQ ID NO: 1372292 - RNA, 16 nt, Neisseria meningitidis MC58
cugaaaggguuucaga

SEQ ID NO: 1372293 - RNA, 20 nt, Neisseria meningitidis MC58
gaaaggguuucagacggcau

SEQ ID NO: 1372294 - RNA, 21 nt, Neisseria meningitidis MC58
gcaacuuaaaaccccgucauu

SEQ ID NO: 1372295 - RNA, 14 nt, Neisseria meningitidis MC58
gccgucauucccgc

SEQ ID NO: 1372296 - RNA, 18 nt, Neisseria meningitidis MC58
gcgaggcaacgcuguacu

SEQ ID NO: 1372297 - RNA, 22 nt, Neisseria meningitidis MC58
aacaaaaaucaggacaaggcga

SEQ ID NO: 1372298 - RNA, 12 nt, Neisseria meningitidis MC58
ccgcgcaggcgg

SEQ ID NO: 1372299 - RNA, 20 nt, Neisseria meningitidis MC58
ccgaaaugccgucauucccg

SEQ ID NO: 1372300 - RNA, 20 nt, Neisseria meningitidis MC58
auguuuaugccgucugaaac

SEQ ID NO: 1372301 - RNA, 22 nt, Neisseria meningitidis MC58
augccgucauucccgcgcaggc

SEQ ID NO: 1372302 - RNA, 13 nt, Neisseria meningitidis MC58
aaaccccgucauu

SEQ ID NO: 1372303 - RNA, 18 nt, Neisseria meningitidis MC58
accgaaaugccgucauuc

SEQ ID NO: 1372304 - RNA, 20 nt, Neisseria meningitidis MC58
acccaaagccucgucauuuc

SEQ ID NO: 1372305 - RNA, 20 nt, Neisseria meningitidis MC58
aauccaguccguucaguuuc

SEQ ID NO: 1372306 - RNA, 19 nt, Neisseria meningitidis MC58
aacccaaagccucgucauu

SEQ ID NO: 1372307 - RNA, 21 nt, Neisseria meningitidis MC58
aacccaaagccucgucauuuc

SEQ ID NO: 1372308 - RNA, 15 nt, Neisseria meningitidis MC58
aaaugccgucugaaa

SEQ ID NO: 1372309 - RNA, 14 nt, Neisseria meningitidis MC58
uaaaaccccgucau

SEQ ID NO: 1372310 - RNA, 15 nt, Neisseria meningitidis MC58
ggcuucagacggcau

SEQ ID NO: 1372311 - RNA, 14 nt, Neisseria meningitidis MC58
gcuuuucauuucug

SEQ ID NO: 1372312 - RNA, 16 nt, Neisseria meningitidis MC58
ucauuucuggauuccc

SEQ ID NO: 1372313 - RNA, 16 nt, Neisseria meningitidis MC58
guuucggucauuuccg

SEQ ID NO: 1372314 - RNA, 19 nt, Neisseria meningitidis MC58
guggauuaacaaaaaucag

SEQ ID NO: 1372315 - RNA, 13 nt, Neisseria meningitidis MC58
uuucagacggcau

SEQ ID NO: 1372316 - RNA, 20 nt, Neisseria meningitidis MC58
uuaaaaccccgucauucccg

SEQ ID NO: 1372317 - RNA, 17 nt, Neisseria meningitidis MC58
acagaaaugccgucuga

SEQ ID NO: 1372318 - RNA, 18 nt, Neisseria meningitidis MC58
aucggauaaaacgguuuc

SEQ ID NO: 1372319 - RNA, 14 nt, Neisseria meningitidis MC58
auauggguuuccgu

SEQ ID NO: 1372320 - RNA, 10 nt, Neisseria meningitidis MC58
cagacggcau

SEQ ID NO: 1372321 - RNA, 13 nt, Neisseria meningitidis MC58
cagacaguacaga

SEQ ID NO: 1372322 - RNA, 13 nt, Neisseria meningitidis MC58
gaaaugccgucau

SEQ ID NO: 1372323 - RNA, 14 nt, Neisseria meningitidis MC58
gaaaugccgucauu

SEQ ID NO: 1372324 - RNA, 13 nt, Neisseria meningitidis MC58
gaaaugccgucug

SEQ ID NO: 1372325 - RNA, 22 nt, Neisseria meningitidis MC58
cuuuucauuucuggauucccac

SEQ ID NO: 1372326 - RNA, 16 nt, Neisseria meningitidis MC58
cgggaaugacggcgac

SEQ ID NO: 1372327 - RNA, 22 nt, Neisseria meningitidis MC58
aaaaccccgucauucccgcgca

SEQ ID NO: 1372328 - RNA, 15 nt, Neisseria meningitidis MC58
acagaaaugccgucu

SEQ ID NO: 1372329 - RNA, 20 nt, Neisseria meningitidis MC58
acagaaaugccgucugaaag

SEQ ID NO: 1372330 - RNA, 18 nt, Neisseria meningitidis MC58
aacuuaaaaccccgucau

SEQ ID NO: 1372331 - RNA, 20 nt, Neisseria meningitidis MC58
aacuuaaaaccccgucauuc

SEQ ID NO: 1372332 - RNA, 19 nt, Neisseria meningitidis MC58
acuuaaaaccccgucauuc

SEQ ID NO: 1372333 - RNA, 20 nt, Neisseria meningitidis MC58
acuuaaaaccccgucauucc

SEQ ID NO: 1372334 - RNA, 22 nt, Neisseria meningitidis MC58
acuuaaaaccccgucauucccg

SEQ ID NO: 1372335 - RNA, 12 nt, Neisseria meningitidis MC58
cuagauucccac

SEQ ID NO: 1372336 - RNA, 22 nt, Neisseria meningitidis MC58
gacggcauuuuuauggcugauu

SEQ ID NO: 1372337 - RNA, 23 nt, Neisseria meningitidis MC58
gaaaugccgucauucccgcgcag

SEQ ID NO: 1372338 - RNA, 14 nt, Neisseria meningitidis MC58
gcuucagacggcau

SEQ ID NO: 1372339 - RNA, 14 nt, Neisseria meningitidis MC58
ggguuucagacggc

SEQ ID NO: 1372340 - RNA, 16 nt, Neisseria meningitidis MC58
gucauucccgcgcagg

SEQ ID NO: 1372341 - RNA, 17 nt, Neisseria meningitidis MC58
gucgggcuucagacggc

SEQ ID NO: 1372342 - RNA, 19 nt, Neisseria meningitidis MC58
cgauguuuaugccgucuga

SEQ ID NO: 1372343 - RNA, 20 nt, Neisseria meningitidis MC58
cagauaguacggaaccgauu

SEQ ID NO: 1372344 - RNA, 20 nt, Neisseria meningitidis MC58
auuuccgccugcgcgggaau

SEQ ID NO: 1372345 - RNA, 20 nt, Neisseria meningitidis MC58
auucccacuuucgugggaau

SEQ ID NO: 1372346 - RNA, 16 nt, Neisseria meningitidis MC58
agcuaaggcgaggcaa

SEQ ID NO: 1372347 - RNA, 23 nt, Neisseria meningitidis MC58
ucuuugagcuaaggcgaggcaac

SEQ ID NO: 1372348 - RNA, 13 nt, Neisseria meningitidis MC58
ucgcccaguuccu

SEQ ID NO: 1372349 - RNA, 17 nt, Neisseria meningitidis MC58
ugcguucuagauuccca

SEQ ID NO: 1372350 - RNA, 18 nt, Neisseria meningitidis MC58
ugccgggguuggcgauuu

SEQ ID NO: 1372351 - RNA, 22 nt, Neisseria meningitidis MC58
uggcugauuaaaacgaaaauga

SEQ ID NO: 1372352 - RNA, 14 nt, Neisseria meningitidis MC58
uucccacuuucgug

SEQ ID NO: 1372353 - RNA, 14 nt, Neisseria meningitidis MC58
uucccgcgcaggcg

SEQ ID NO: 1372354 - RNA, 18 nt, Neisseria meningitidis MC58
uuccgaggcaacccaguu

SEQ ID NO: 1372355 - RNA, 14 nt, Neisseria meningitidis MC58
uuccucgaggauuu

SEQ ID NO: 1372356 - RNA, 12 nt, Neisseria meningitidis MC58
uucgugggaaug

SEQ ID NO: 1372357 - RNA, 14 nt, Neisseria meningitidis MC58
gcccaacggucuuu

SEQ ID NO: 1372358 - RNA, 18 nt, Neisseria meningitidis MC58
gcgggaaucuaggucugu

SEQ ID NO: 1372359 - RNA, 21 nt, Neisseria meningitidis MC58
gcgcaggcgggaaucuagguc

SEQ ID NO: 1372360 - RNA, 23 nt, Neisseria meningitidis MC58
ggcauauugcuucaaagcagguu

SEQ ID NO: 1372361 - RNA, 12 nt, Neisseria meningitidis MC58
uacugguuuuug

SEQ ID NO: 1372362 - RNA, 21 nt, Neisseria meningitidis MC58
uacugguuuuuguuaauccac

SEQ ID NO: 1372363 - RNA, 12 nt, Neisseria meningitidis MC58
uagauucccacu

SEQ ID NO: 1372364 - RNA, 14 nt, Neisseria meningitidis MC58
ucagacggcauauu

SEQ ID NO: 1372365 - RNA, 17 nt, Neisseria meningitidis MC58
ucagacggcauuuuuau

SEQ ID NO: 1372366 - RNA, 18 nt, Neisseria meningitidis MC58
ucacuuggugcuucagca

SEQ ID NO: 1372367 - RNA, 16 nt, Neisseria meningitidis MC58
ucacaacccaaagccu

SEQ ID NO: 1372368 - RNA, 15 nt, Neisseria meningitidis MC58
uauuuuccauuuuau

SEQ ID NO: 1372369 - RNA, 16 nt, Neisseria meningitidis MC58
guucuagauucccacu

SEQ ID NO: 1372370 - RNA, 20 nt, Neisseria meningitidis MC58
guuaauccacuauaaaucaa

SEQ ID NO: 1372371 - RNA, 21 nt, Neisseria meningitidis MC58
guuaauccacuauaaaucaau

SEQ ID NO: 1372372 - RNA, 11 nt, Neisseria meningitidis MC58
gugggaaugac

SEQ ID NO: 1372373 - RNA, 16 nt, Neisseria meningitidis MC58
ggugcuucagcaccuu

SEQ ID NO: 1372374 - RNA, 16 nt, Neisseria meningitidis MC58
cguucuagauucccac

SEQ ID NO: 1372375 - RNA, 13 nt, Neisseria meningitidis MC58
cuucgcccaguuc

SEQ ID NO: 1372376 - RNA, 15 nt, Neisseria meningitidis MC58
cugucgguucaggaa

SEQ ID NO: 1372377 - RNA, 15 nt, Neisseria meningitidis MC58
cuguacugguuuuug

SEQ ID NO: 1372378 - RNA, 23 nt, Neisseria meningitidis MC58
gacgauagccggguauuuuccau

SEQ ID NO: 1372379 - RNA, 13 nt, Neisseria meningitidis MC58
gacaguacagaua

SEQ ID NO: 1372380 - RNA, 20 nt, Neisseria meningitidis MC58
cuuucgugggaaugacggga

SEQ ID NO: 1372381 - RNA, 14 nt, Neisseria meningitidis MC58
gauguuuaugccgu

SEQ ID NO: 1372382 - RNA, 17 nt, Neisseria meningitidis MC58
gauuaacaaaaaucagg

SEQ ID NO: 1372383 - RNA, 16 nt, Neisseria meningitidis MC58
gcaacccaguucagaa

SEQ ID NO: 1372384 - RNA, 12 nt, Neisseria meningitidis MC58
gcagguuuuccg

SEQ ID NO: 1372385 - RNA, 15 nt, Neisseria meningitidis MC58
gccuucgcccaguuc

SEQ ID NO: 1372386 - RNA, 16 nt, Neisseria meningitidis MC58
gcugauuaaaacgaaa

SEQ ID NO: 1372387 - RNA, 16 nt, Neisseria meningitidis MC58
guuucagacggcauuu

SEQ ID NO: 1372388 - RNA, 23 nt, Neisseria meningitidis MC58
guuuaugccgucugaaacccauc

SEQ ID NO: 1372389 - RNA, 15 nt, Neisseria meningitidis MC58
guucuagauucccac

SEQ ID NO: 1372390 - RNA, 16 nt, Neisseria meningitidis MC58
guguucggauuuccgc

SEQ ID NO: 1372391 - RNA, 14 nt, Neisseria meningitidis MC58
guggauuaacaaaa

SEQ ID NO: 1372392 - RNA, 17 nt, Neisseria meningitidis MC58
gugggaaugacggcgga

SEQ ID NO: 1372393 - RNA, 17 nt, Neisseria meningitidis MC58
uaugcccuuucuuuaug

SEQ ID NO: 1372394 - RNA, 15 nt, Neisseria meningitidis MC58
uaugccgucugaaac

SEQ ID NO: 1372395 - RNA, 20 nt, Neisseria meningitidis MC58
uaguggauuaacaaaaauca

SEQ ID NO: 1372396 - RNA, 20 nt, Neisseria meningitidis MC58
uauaaaucaauguaauccau

SEQ ID NO: 1372397 - RNA, 14 nt, Neisseria meningitidis MC58
uccucacaacccaa

SEQ ID NO: 1372398 - RNA, 19 nt, Neisseria meningitidis MC58
uccugugucgggcuucaga

SEQ ID NO: 1372399 - RNA, 21 nt, Neisseria meningitidis MC58
uccaguugcgaaucgagcauc

SEQ ID NO: 1372400 - RNA, 12 nt, Neisseria meningitidis MC58
ucauuucuggau

SEQ ID NO: 1372401 - RNA, 19 nt, Neisseria meningitidis MC58
ucaguuucggucauuuccg

SEQ ID NO: 1372402 - RNA, 13 nt, Neisseria meningitidis MC58
ugccgucugaaag

SEQ ID NO: 1372403 - RNA, 19 nt, Neisseria meningitidis MC58
uggcgauuuugaccccgua

SEQ ID NO: 1372404 - RNA, 15 nt, Neisseria meningitidis MC58
uggauuaacaaaaau

SEQ ID NO: 1372405 - RNA, 12 nt, Neisseria meningitidis MC58
uucccacuuuug

SEQ ID NO: 1372406 - RNA, 20 nt, Neisseria meningitidis MC58
uucccgcgcaggcgggaauc

SEQ ID NO: 1372407 - RNA, 15 nt, Neisseria meningitidis MC58
uugacagaaaugccg

SEQ ID NO: 1372408 - RNA, 13 nt, Neisseria meningitidis MC58
uuuccacaaaaaa

SEQ ID NO: 1372409 - RNA, 22 nt, Neisseria meningitidis MC58
uuucauuucuggauucccacuu

SEQ ID NO: 1372410 - RNA, 17 nt, Neisseria meningitidis MC58
uuucagacggcauuuuu

SEQ ID NO: 1372411 - RNA, 20 nt, Neisseria meningitidis MC58
uuuauaguggauuaacaaaa

SEQ ID NO: 1372412 - RNA, 22 nt, Neisseria meningitidis MC58
uuuauaguggauuaacaaaaau

SEQ ID NO: 1372413 - RNA, 21 nt, Neisseria meningitidis MC58
uuugccgcgaccgaaaugccg

SEQ ID NO: 1372414 - RNA, 15 nt, Neisseria meningitidis MC58
uuucuggauucccac

SEQ ID NO: 1372415 - RNA, 16 nt, Neisseria meningitidis MC58
uuucuggauucccacu

SEQ ID NO: 1372416 - RNA, 21 nt, Neisseria meningitidis MC58
uuuugccgcgaccgaaaugcc

SEQ ID NO: 1372417 - RNA, 16 nt, Neisseria meningitidis MC58
uuuuguuaauccacua

SEQ ID NO: 1372418 - RNA, 23 nt, Neisseria meningitidis MC58
aaauuccuguugcuuuucauuuc

SEQ ID NO: 1372419 - RNA, 21 nt, Neisseria meningitidis MC58
uuuuuguuaauccacuauaaa

SEQ ID NO: 1372420 - RNA, 14 nt, Neisseria meningitidis MC58
aaggcgaggcaacg

SEQ ID NO: 1372421 - RNA, 12 nt, Neisseria meningitidis MC58
accgaaaugccg

SEQ ID NO: 1372422 - RNA, 17 nt, Neisseria meningitidis MC58
acccugcguucuagauu

SEQ ID NO: 1372423 - RNA, 14 nt, Neisseria meningitidis MC58
acggcauaugcccu

SEQ ID NO: 1372424 - RNA, 14 nt, Neisseria meningitidis MC58
acggcauauugcuu

SEQ ID NO: 1372425 - RNA, 17 nt, Neisseria meningitidis MC58
acggcauauugcuucaa

SEQ ID NO: 1372426 - RNA, 14 nt, Neisseria meningitidis MC58
acuuggugcuucag

SEQ ID NO: 1372427 - RNA, 16 nt, Neisseria meningitidis MC58
agccucgucauuucca

SEQ ID NO: 1372428 - RNA, 15 nt, Neisseria meningitidis MC58
agccggguauuuucc

SEQ ID NO: 1372429 - RNA, 19 nt, Neisseria meningitidis MC58
auaugcccuuucuuuaugc

SEQ ID NO: 1372430 - RNA, 19 nt, Neisseria meningitidis MC58
auccugugucgggcuucag

SEQ ID NO: 1372431 - RNA, 20 nt, Neisseria meningitidis MC58
auccugugucgggcuucaga

SEQ ID NO: 1372432 - RNA, 20 nt, Neisseria meningitidis MC58
auucccacuuuugugggaau

SEQ ID NO: 1372433 - RNA, 13 nt, Neisseria meningitidis MC58
auuuuccauuuua

SEQ ID NO: 1372434 - RNA, 14 nt, Neisseria meningitidis MC58
auuuuccauuuuau

SEQ ID NO: 1372435 - RNA, 23 nt, Neisseria meningitidis MC58
auuuuuauggcugauuaaaacga

SEQ ID NO: 1372436 - RNA, 19 nt, Neisseria meningitidis MC58
cauuuccgauaaauuccug

SEQ ID NO: 1372437 - RNA, 18 nt, Neisseria meningitidis MC58
cauguaauguccuuugcg

SEQ ID NO: 1372438 - RNA, 19 nt, Neisseria meningitidis MC58
caguuucggucauuuccga

SEQ ID NO: 1372439 - RNA, 17 nt, Neisseria meningitidis MC58
caguuucggucauuucc

SEQ ID NO: 1372440 - RNA, 21 nt, Neisseria meningitidis MC58
cagguuuuccgaggcaaccca

SEQ ID NO: 1372441 - RNA, 16 nt, Neisseria meningitidis MC58
cccacuuucgugggaa

SEQ ID NO: 1372442 - RNA, 15 nt, Neisseria meningitidis MC58
cgaagccgcagacag

SEQ ID NO: 1372443 - RNA, 17 nt, Neisseria meningitidis MC58
cgaaaugccgucauucc

SEQ ID NO: 1372444 - RNA, 15 nt, Neisseria meningitidis MC58
cgaggauuuccaguu

SEQ ID NO: 1372445 - RNA, 21 nt, Neisseria meningitidis MC58
ccgauucacuuggugcuucag

SEQ ID NO: 1372446 - RNA, 19 nt, Neisseria meningitidis MC58
cccugcguucuagauuccc

SEQ ID NO: 1372447 - RNA, 19 nt, Neisseria meningitidis MC58
cgcgggaaugacggcgaca

SEQ ID NO: 1372448 - RNA, 13 nt, Neisseria meningitidis MC58
cgucugaaaccca

SEQ ID NO: 1372449 - RNA, 16 nt, Neisseria meningitidis MC58
cguguucggauuuccg

SEQ ID NO: 1372450 - RNA, 12 nt, Neisseria meningitidis MC58
cgugggaaugac

SEQ ID NO: 1372451 - RNA, 16 nt, Neisseria meningitidis MC58
cuauaaaucaauguaa

SEQ ID NO: 1372452 - RNA, 17 nt, Neisseria meningitidis MC58
cugauuaaaacgaaaau

SEQ ID NO: 1372453 - RNA, 18 nt, Neisseria meningitidis MC58
cugcguucuagauuccca

SEQ ID NO: 1372454 - RNA, 14 nt, Neisseria meningitidis MC58
cugcuuucauguaa

SEQ ID NO: 1372455 - RNA, 23 nt, Neisseria meningitidis MC58
cugcuuucauguaauguccuuug

SEQ ID NO: 1372456 - RNA, 14 nt, Neisseria meningitidis MC58
cuuaucggauaaaa

SEQ ID NO: 1372457 - RNA, 10 nt, Neisseria meningitidis MC58
gaaacagcaa

SEQ ID NO: 1372458 - RNA, 22 nt, Neisseria meningitidis MC58
gaaacagcaacuuaaaaccccg

SEQ ID NO: 1372459 - RNA, 21 nt, Neisseria meningitidis MC58
cuuuucauuucuggauuccca

SEQ ID NO: 1372460 - RNA, 23 nt, Neisseria meningitidis MC58
aaacagcaacccgaaacagcaac

SEQ ID NO: 1372461 - RNA, 13 nt, Neisseria meningitidis MC58
aaagcagguuuuc

SEQ ID NO: 1372462 - RNA, 16 nt, Neisseria meningitidis MC58
aagccucgucauuucc

SEQ ID NO: 1372463 - RNA, 18 nt, Neisseria meningitidis MC58
aaugacggcggaaggggu

SEQ ID NO: 1372464 - RNA, 15 nt, Neisseria meningitidis MC58
aaugccgucauuccc

SEQ ID NO: 1372465 - RNA, 15 nt, Neisseria meningitidis MC58
aauccaguccguuca

SEQ ID NO: 1372466 - RNA, 20 nt, Neisseria meningitidis MC58
acuuaaaaccccgucauucc

SEQ ID NO: 1372467 - RNA, 22 nt, Neisseria meningitidis MC58
acggcggaagggguaaauccuc

SEQ ID NO: 1372468 - RNA, 23 nt, Neisseria meningitidis MC58
acccauccugugucgggcuucag

SEQ ID NO: 1372469 - RNA, 18 nt, Neisseria meningitidis MC58
agcuaaggcgaggcaacg

SEQ ID NO: 1372470 - RNA, 17 nt, Neisseria meningitidis MC58
aguggauuaacaaaaau

SEQ ID NO: 1372471 - RNA, 17 nt, Neisseria meningitidis MC58
aguuucggucauuuccg

SEQ ID NO: 1372472 - RNA, 21 nt, Neisseria meningitidis MC58
aguucagaauaucggcuucga

SEQ ID NO: 1372473 - RNA, 20 nt, Neisseria meningitidis MC58
auauugcuucaaagcagguu

SEQ ID NO: 1372474 - RNA, 12 nt, Neisseria meningitidis MC58
auuaacaaaaau

SEQ ID NO: 1372475 - RNA, 18 nt, Neisseria meningitidis MC58
auucacuuggugcuucag

SEQ ID NO: 1372476 - RNA, 14 nt, Neisseria meningitidis MC58
augccgucugaaac

SEQ ID NO: 1372477 - RNA, 20 nt, Neisseria meningitidis MC58
auucuguucccgauguuuau

SEQ ID NO: 1372478 - RNA, 20 nt, Neisseria meningitidis MC58
auucccacuuucgugggaau

SEQ ID NO: 1372479 - RNA, 20 nt, Neisseria meningitidis MC58
caaaaaacagcaacccgaaa

SEQ ID NO: 1372480 - RNA, 20 nt, Neisseria meningitidis MC58
auuuuuauggcugauuaaaa

SEQ ID NO: 1372481 - RNA, 20 nt, Neisseria meningitidis MC58
auuuccacaaaaaacagcaa

SEQ ID NO: 1372482 - RNA, 14 nt, Neisseria meningitidis MC58
auuuccacaaaaaa

SEQ ID NO: 1372483 - RNA, 23 nt, Neisseria meningitidis MC58
caacuuaaaaccccgucauuccc

SEQ ID NO: 1372484 - RNA, 15 nt, Neisseria meningitidis MC58
cacuuucgugggaau

SEQ ID NO: 1372485 - RNA, 15 nt, Neisseria meningitidis MC58
cacuuuugugggaau

SEQ ID NO: 1372486 - RNA, 18 nt, Neisseria meningitidis MC58
cagguuuuccgaggcaac

SEQ ID NO: 1372487 - RNA, 19 nt, Neisseria meningitidis MC58
cagguuuuccgaggcaacc

SEQ ID NO: 1372488 - RNA, 12 nt, Neisseria meningitidis MC58
cauucuguuccc

SEQ ID NO: 1372489 - RNA, 23 nt, Neisseria meningitidis MC58
cauucuguucccgauguuuaugc

SEQ ID NO: 1372490 - RNA, 24 nt, Neisseria meningitidis MC58
ccgucugaaacccauccugugucg

SEQ ID NO: 1372491 - RNA, 22 nt, Neisseria meningitidis MC58
cccgucauucccgcgcaggcgg

SEQ ID NO: 1372492 - RNA, 21 nt, Neisseria meningitidis MC58
cccugcguucuagauucccac

SEQ ID NO: 1372493 - RNA, 22 nt, Neisseria meningitidis MC58
cccugcguucuagauucccacu

SEQ ID NO: 1372494 - RNA, 17 nt, Neisseria meningitidis MC58
ccccgucauucccgcgc

SEQ ID NO: 1372495 - RNA, 16 nt, Neisseria meningitidis MC58
cccacuuuugugggaa

SEQ ID NO: 1372496 - RNA, 16 nt, Neisseria meningitidis MC58
ccaguccguucaguuu

SEQ ID NO: 1372497 - RNA, 21 nt, Neisseria meningitidis MC58
cgauguuuaugccgucugaaa

SEQ ID NO: 1372498 - RNA, 18 nt, Neisseria meningitidis MC58
cgccuucgcccaguuccu

SEQ ID NO: 1372499 - RNA, 12 nt, Neisseria meningitidis MC58
uuugugggaaug

SEQ ID NO: 1372500 - RNA, 18 nt, Neisseria meningitidis MC58
uugccgcgaccgaaaugc

SEQ ID NO: 1372501 - RNA, 14 nt, Neisseria meningitidis MC58
uuuacggcauaugc

SEQ ID NO: 1372502 - RNA, 20 nt, Neisseria meningitidis MC58
uccaacccugcguucuagau

SEQ ID NO: 1372503 - RNA, 18 nt, Neisseria meningitidis MC58
ucauuuccgauaaauucc

SEQ ID NO: 1372504 - RNA, 21 nt, Neisseria meningitidis MC58
ucccacuuucgugggaaugac

SEQ ID NO: 1372505 - RNA, 21 nt, Neisseria meningitidis MC58
ucccacuuuugugggaaugac

SEQ ID NO: 1372506 - RNA, 12 nt, Neisseria meningitidis MC58
uccgaggcaacc

SEQ ID NO: 1372507 - RNA, 19 nt, Neisseria meningitidis MC58
uccgaggcaacccaguuca

SEQ ID NO: 1372508 - RNA, 20 nt, Neisseria meningitidis MC58
uccgccugcgcgggaaugac

SEQ ID NO: 1372509 - RNA, 14 nt, Neisseria meningitidis MC58
ucuagauucccacu

SEQ ID NO: 1372510 - RNA, 13 nt, Neisseria meningitidis MC58
ucgucauuuccac

SEQ ID NO: 1372511 - RNA, 18 nt, Neisseria meningitidis MC58
ucgucauuuccacaaaaa

SEQ ID NO: 1372512 - RNA, 14 nt, Neisseria meningitidis MC58
ucuggauucccacu

SEQ ID NO: 1372513 - RNA, 13 nt, Neisseria meningitidis MC58
uggcgauuuugac

SEQ ID NO: 1372514 - RNA, 11 nt, Neisseria meningitidis MC58
uggauucccac

SEQ ID NO: 1372515 - RNA, 21 nt, Neisseria meningitidis MC58
uggauuaacaaaaaucaggac

SEQ ID NO: 1372516 - RNA, 17 nt, Neisseria meningitidis MC58
uggauuaacaaaaauca

SEQ ID NO: 1372517 - RNA, 16 nt, Neisseria meningitidis MC58
ugugucgggcuucaga

SEQ ID NO: 1372518 - RNA, 20 nt, Neisseria meningitidis MC58
uuauaguggauuaacaaaaa

SEQ ID NO: 1372519 - RNA, 22 nt, Neisseria meningitidis MC58
ugcguccggcguuugacagaaa

SEQ ID NO: 1372520 - RNA, 19 nt, Neisseria meningitidis MC58
ugccgucugaaacccaucc

SEQ ID NO: 1372521 - RNA, 19 nt, Neisseria meningitidis MC58
ugauuaaaacgaaaaugag

SEQ ID NO: 1372522 - RNA, 22 nt, Neisseria meningitidis MC58
gacggcggaagggguaaauccu

SEQ ID NO: 1372523 - RNA, 16 nt, Neisseria meningitidis MC58
gaggauuuccaguugc

SEQ ID NO: 1372524 - RNA, 15 nt, Neisseria meningitidis MC58
gaggcaacccaguuc

SEQ ID NO: 1372525 - RNA, 21 nt, Neisseria meningitidis MC58
gagcaucccugcuuucaugua

SEQ ID NO: 1372526 - RNA, 12 nt, Neisseria meningitidis MC58
gcaacccaguuc

SEQ ID NO: 1372527 - RNA, 20 nt, Neisseria meningitidis MC58
gcguuugacagaaaugccgu

SEQ ID NO: 1372528 - RNA, 16 nt, Neisseria meningitidis MC58
gccuucgcccaguucc

SEQ ID NO: 1372529 - RNA, 22 nt, Neisseria meningitidis MC58
uaauccacuauaaaucaaugua

SEQ ID NO: 1372530 - RNA, 23 nt, Neisseria meningitidis MC58
ggcaacgcuguacugguuuuugu

SEQ ID NO: 1372531 - RNA, 22 nt, Neisseria meningitidis MC58
ggauuaacaaaaaucaggacaa

SEQ ID NO: 1372532 - RNA, 19 nt, Neisseria meningitidis MC58
cugcgcgggaaugacggcg

SEQ ID NO: 1372533 - RNA, 14 nt, Neisseria meningitidis MC58
cucgucauuuccac

SEQ ID NO: 1372534 - RNA, 16 nt, Neisseria meningitidis MC58
cggguauuuuccauuu

SEQ ID NO: 1372535 - RNA, 18 nt, Neisseria meningitidis MC58
cuuuauaguggauuaaca

SEQ ID NO: 1372536 - RNA, 21 nt, Neisseria meningitidis MC58
cuuuauaguggauuaacaaaa

SEQ ID NO: 1372537 - RNA, 23 nt, Neisseria meningitidis MC58
cuuuauaguggauuaacaaaaau

SEQ ID NO: 1372538 - RNA, 16 nt, Neisseria meningitidis MC58
gaaaggguuucagacg

SEQ ID NO: 1372539 - RNA, 16 nt, Neisseria meningitidis MC58
gaggcaacccaguuca

SEQ ID NO: 1372540 - RNA, 14 nt, Neisseria meningitidis MC58
gcuuuucauuucug

SEQ ID NO: 1372541 - RNA, 22 nt, Neisseria meningitidis MC58
gcuuuucauuucuggauuccca

SEQ ID NO: 1372542 - RNA, 13 nt, Neisseria meningitidis MC58
gcgcgggaaugac

SEQ ID NO: 1372543 - RNA, 18 nt, Neisseria meningitidis MC58
gccgucauucccgcgcag

SEQ ID NO: 1372544 - RNA, 22 nt, Neisseria meningitidis MC58
gccgucauucccgcgcaggcgg

SEQ ID NO: 1372545 - RNA, 16 nt, Neisseria meningitidis MC58
gccgucauucccgcgc

SEQ ID NO: 1372546 - RNA, 21 nt, Neisseria meningitidis MC58
gccgggguuggcgauuuugac

SEQ ID NO: 1372547 - RNA, 11 nt, Neisseria meningitidis MC58
gucauuuccac

SEQ ID NO: 1372548 - RNA, 21 nt, Neisseria meningitidis MC58
gucauuuccgauaaauuccug

SEQ ID NO: 1372549 - RNA, 22 nt, Neisseria meningitidis MC58
guuuuccgaggcaacccaguuc

SEQ ID NO: 1372550 - RNA, 18 nt, Neisseria meningitidis MC58
uaaaaccccgucauuccc

SEQ ID NO: 1372551 - RNA, 20 nt, Neisseria meningitidis MC58
uaaaucaauguaauccauuc

SEQ ID NO: 1372552 - RNA, 23 nt, Neisseria meningitidis MC58
uacagauaguacggaaccgauuc

SEQ ID NO: 1372553 - RNA, 13 nt, Neisseria meningitidis MC58
uccacaaaaaaca

SEQ ID NO: 1372554 - RNA, 23 nt, Neisseria meningitidis MC58
uccacaaaaaacagcaacccgaa

SEQ ID NO: 1372555 - RNA, 16 nt, Neisseria meningitidis MC58
aaaugccgucauuccc

SEQ ID NO: 1372556 - RNA, 15 nt, Neisseria meningitidis MC58
ucuagauucccacuu

SEQ ID NO: 1372557 - RNA, 16 nt, Neisseria meningitidis MC58
ugugggaaugacggcg

SEQ ID NO: 1372558 - RNA, 18 nt, Neisseria meningitidis MC58
ugcguucuagauucccac

SEQ ID NO: 1372559 - RNA, 12 nt, Neisseria meningitidis MC58
uggauucccacu

SEQ ID NO: 1372560 - RNA, 18 nt, Neisseria meningitidis MC58
uucauuucuggauuccca

SEQ ID NO: 1372561 - RNA, 18 nt, Neisseria meningitidis MC58
uucuggauucccacuuuu

SEQ ID NO: 1372562 - RNA, 20 nt, Neisseria meningitidis MC58
uucuagauucccacuuucgu

SEQ ID NO: 1372563 - RNA, 14 nt, Neisseria meningitidis MC58
uuggugcuucagca

SEQ ID NO: 1372564 - RNA, 14 nt, Neisseria meningitidis MC58
aagggguaaauccu

SEQ ID NO: 1372565 - RNA, 19 nt, Neisseria meningitidis MC58
aaugccgucugaaaggguu

SEQ ID NO: 1372566 - RNA, 17 nt, Neisseria meningitidis MC58
aaugacgggauaugggu

SEQ ID NO: 1372567 - RNA, 20 nt, Neisseria meningitidis MC58
aaucuaggucugucgguuca

SEQ ID NO: 1372568 - RNA, 17 nt, Neisseria meningitidis MC58
aaucaggacaaggcgac

SEQ ID NO: 1372569 - RNA, 12 nt, Neisseria meningitidis MC58
aacccaaagccu

SEQ ID NO: 1372570 - RNA, 14 nt, Neisseria meningitidis MC58
aacccaaagccucg

SEQ ID NO: 1372571 - RNA, 13 nt, Neisseria meningitidis MC58
agauucccacuuu

SEQ ID NO: 1372572 - RNA, 12 nt, Neisseria meningitidis MC58
acggucuuuaua

SEQ ID NO: 1372573 - RNA, 13 nt, Neisseria meningitidis MC58
aggcaacccaguu

SEQ ID NO: 1372574 - RNA, 19 nt, Neisseria meningitidis MC58
aggcaacgcuguacugguu

SEQ ID NO: 1372575 - RNA, 16 nt, Neisseria meningitidis MC58
aucaauguaauccauu

SEQ ID NO: 1372576 - RNA, 16 nt, Neisseria meningitidis MC58
auaguggauuaacaaa

SEQ ID NO: 1372577 - RNA, 19 nt, Neisseria meningitidis MC58
auaguggauuaacaaaaau

SEQ ID NO: 1372578 - RNA, 22 nt, Neisseria meningitidis MC58
augcccuuucuuuaugcuuuuu

SEQ ID NO: 1372579 - RNA, 14 nt, Neisseria meningitidis MC58
augccgucugaaag

SEQ ID NO: 1372580 - RNA, 13 nt, Neisseria meningitidis MC58
caaaaaacagcaa

SEQ ID NO: 1372581 - RNA, 16 nt, Neisseria meningitidis MC58
caaaaaacagcaaccc

SEQ ID NO: 1372582 - RNA, 17 nt, Neisseria meningitidis MC58
caaaaaacagcaacccg

SEQ ID NO: 1372583 - RNA, 22 nt, Neisseria meningitidis MC58
caacccgaaacagcaacuuaaa

SEQ ID NO: 1372584 - RNA, 16 nt, Neisseria meningitidis MC58
cagcaacuuaaaaccc

SEQ ID NO: 1372585 - RNA, 20 nt, Neisseria meningitidis MC58
cagacggcauauugcuucaa

SEQ ID NO: 1372586 - RNA, 18 nt, Neisseria meningitidis MC58
cagaaaugccgucugaaa

SEQ ID NO: 1372587 - RNA, 16 nt, Neisseria meningitidis MC58
cacuuuugugggaaug

SEQ ID NO: 1372588 - RNA, 16 nt, Neisseria meningitidis MC58
cacuuucgugggaaug

SEQ ID NO: 1372589 - RNA, 23 nt, Neisseria meningitidis MC58
cauccugugucgggcuucagacg

SEQ ID NO: 1372590 - RNA, 18 nt, Neisseria meningitidis MC58
cccgucauucccgcgcag

SEQ ID NO: 1372591 - RNA, 13 nt, Neisseria meningitidis MC58
cccgcgcaggcgg

SEQ ID NO: 1372592 - RNA, 18 nt, Neisseria meningitidis MC58
cccgcgcaggcgggaauc

SEQ ID NO: 1372593 - RNA, 15 nt, Neisseria meningitidis MC58
cgccuucgcccaguu

SEQ ID NO: 1372594 - RNA, 19 nt, Neisseria meningitidis MC58
cugugucgggcuucagacg

SEQ ID NO: 1372595 - RNA, 18 nt, Neisseria meningitidis MC58
cugaaaggguuucagacg

SEQ ID NO: 1372596 - RNA, 15 nt, Neisseria meningitidis MC58
cuaaggcgaggcaac

SEQ ID NO: 1372597 - RNA, 18 nt, Neisseria meningitidis MC58
cgucauuuccacaaaaaa

SEQ ID NO: 1372598 - RNA, 16 nt, Neisseria meningitidis MC58
cgucauucccgcgcag

SEQ ID NO: 1372599 - RNA, 22 nt, Neisseria meningitidis MC58
aacagcaacuuaaaaccccguc

SEQ ID NO: 1372600 - RNA, 19 nt, Neisseria meningitidis MC58
acagcaacuuaaaaccccg

SEQ ID NO: 1372601 - RNA, 15 nt, Neisseria meningitidis MC58
acuuggugcuucagc

SEQ ID NO: 1372602 - RNA, 13 nt, Neisseria meningitidis MC58
agcaacuuaaaac

SEQ ID NO: 1372603 - RNA, 16 nt, Neisseria meningitidis MC58
acggcauauugcuuca

SEQ ID NO: 1372604 - RNA, 18 nt, Neisseria meningitidis MC58
acggcgacagaugcccaa

SEQ ID NO: 1372605 - RNA, 21 nt, Neisseria meningitidis MC58
accgauucacuuggugcuuca

SEQ ID NO: 1372606 - RNA, 17 nt, Neisseria meningitidis MC58
acccgaaacagcaacuu

SEQ ID NO: 1372607 - RNA, 20 nt, Neisseria meningitidis MC58
accgaaaugccgucauuccc

SEQ ID NO: 1372608 - RNA, 22 nt, Neisseria meningitidis MC58
aggucugucgguucaggaacuu

SEQ ID NO: 1372609 - RNA, 20 nt, Neisseria meningitidis MC58
auaaauuccuguugcuuuuc

SEQ ID NO: 1372610 - RNA, 21 nt, Neisseria meningitidis MC58
aaaacgguuucuccaacccug

SEQ ID NO: 1372611 - RNA, 18 nt, Neisseria meningitidis MC58
caaagccucgucauuucc

SEQ ID NO: 1372612 - RNA, 17 nt, Neisseria meningitidis MC58
cacaacccaaagccucg

SEQ ID NO: 1372613 - RNA, 19 nt, Neisseria meningitidis MC58
cacaacccaaagccucguc

SEQ ID NO: 1372614 - RNA, 12 nt, Neisseria meningitidis MC58
cacaacccaaag

SEQ ID NO: 1372615 - RNA, 22 nt, Neisseria meningitidis MC58
caauguaauccauucuguuccc

SEQ ID NO: 1372616 - RNA, 19 nt, Neisseria meningitidis MC58
auuucuggauucccacuuu

SEQ ID NO: 1372617 - RNA, 17 nt, Neisseria meningitidis MC58
auuuccgauaaauuccu

SEQ ID NO: 1372618 - RNA, 20 nt, Neisseria meningitidis MC58
cagcaacuuaaaaccccguc

SEQ ID NO: 1372619 - RNA, 18 nt, Neisseria meningitidis MC58
cauuuccgauaaauuccu

SEQ ID NO: 1372620 - RNA, 15 nt, Neisseria meningitidis MC58
cauuuccacaaaaaa

SEQ ID NO: 1372621 - RNA, 17 nt, Neisseria meningitidis MC58
cauuucuggauucccac

SEQ ID NO: 1372622 - RNA, 21 nt, Neisseria meningitidis MC58
ccugcgcgggaaugacggcga

SEQ ID NO: 1372623 - RNA, 21 nt, Neisseria meningitidis MC58
ccucgucauuuccacaaaaaa

SEQ ID NO: 1372624 - RNA, 15 nt, Neisseria meningitidis MC58
aaacgaaaaugagac

SEQ ID NO: 1372625 - RNA, 18 nt, Neisseria meningitidis MC58
ccgucauucccgcgcagg

SEQ ID NO: 1372626 - RNA, 21 nt, Neisseria meningitidis MC58
cggauaaaacgguuucuccaa

SEQ ID NO: 1372627 - RNA, 14 nt, Human
ccgcugucucugag

SEQ ID NO: 1372628 - RNA, 17 nt, Human
cauuuacuaugcacaac

SEQ ID NO: 1372629 - RNA, 23 nt, Human
cagcauuuacuaugcacaacaga

SEQ ID NO: 1372630 - RNA, 18 nt, Human
cugucgaaggggaggcac

SEQ ID NO: 1372631 - RNA, 10 nt, Human
ugccgcuguc

SEQ ID NO: 1372632 - RNA, 21 nt, Human
gugaaguucaucuugcagcau

SEQ ID NO: 1372633 - RNA, 14 nt, Human
ccgcucucucugag

SEQ ID NO: 1372634 - RNA, 14 nt, Human
ccgcuuucucugag

SEQ ID NO: 1372635 - RNA, 15 nt, Human
uccauaucauuugag

SEQ ID NO: 1372636 - RNA, 16 nt, Human
ggugccgcucucucug

SEQ ID NO: 1372637 - RNA, 13 nt, Human
ggugcucucucug

SEQ ID NO: 1372638 - RNA, 14 nt, Human
ucuuuacugcacuc

SEQ ID NO: 1372639 - RNA, 14 nt, Human
cacauuacaacagu

SEQ ID NO: 1372640 - RNA, 14 nt, Human
uuuggucuucuguu

SEQ ID NO: 1372641 - RNA, 19 nt, Human
uuugguuucuucauucuuu

SEQ ID NO: 1372642 - RNA, 22 nt, Human
ucuggagcgcuucaguucagcu

SEQ ID NO: 1372643 - RNA, 19 nt, Human
cucguuccaguggcggcac

SEQ ID NO: 1372644 - RNA, 12 nt, Human
aaugccgcuguc

SEQ ID NO: 1372645 - RNA, 14 nt, Human
caaagggaaagccu

SEQ ID NO: 1372646 - RNA, 12 nt, Human
uguacaauguga

SEQ ID NO: 1372647 - RNA, 23 nt, Human
ggaacuccagagaugagugucug

SEQ ID NO: 1372648 - RNA, 15 nt, Human
gccgcuuucucugag

SEQ ID NO: 1372649 - RNA, 15 nt, Human
ucuuuacugcacuca

SEQ ID NO: 1372650 - RNA, 13 nt, Human
aaugccgcugucu

SEQ ID NO: 1372651 - RNA, 14 nt, Human
ugcucucucugagg

SEQ ID NO: 1372652 - RNA, 13 nt, Human
acauuacaacagu

SEQ ID NO: 1372653 - RNA, 13 nt, Human
ggugccgcucucu

SEQ ID NO: 1372654 - RNA, 17 nt, Human
acacguggcuggcggcc

SEQ ID NO: 1372655 - RNA, 19 nt, Human
gcagcugcaggggccucug

SEQ ID NO: 1372656 - RNA, 14 nt, Human
gcuucaguucagcu

SEQ ID NO: 1372657 - RNA, 11 nt, Human
uucucugaggg

SEQ ID NO: 1372658 - RNA, 19 nt, Human
ugcuaacuggguuaaauau

SEQ ID NO: 1372659 - RNA, 17 nt, Human
ugccgcuuucucugagg

SEQ ID NO: 1372660 - RNA, 14 nt, Human
augccgcugucucu

SEQ ID NO: 1372661 - RNA, 14 nt, Human
ugccgcucucucug

SEQ ID NO: 1372662 - RNA, 16 nt, Human
caucuugcagcauuua

SEQ ID NO: 1372663 - RNA, 20 nt, Human
agggugggggugcucucucu

SEQ ID NO: 1372664 - RNA, 14 nt, Human
uuccaguggcggca

SEQ ID NO: 1372665 - RNA, 18 nt, Human
ucugagggggugggggug

SEQ ID NO: 1372666 - RNA, 17 nt, Human
cucugaggggguggggg

SEQ ID NO: 1372667 - RNA, 17 nt, Human
gggccacacguggcugg

SEQ ID NO: 1372668 - RNA, 14 nt, Human
aaauauuuugcuaa

SEQ ID NO: 1372669 - RNA, 23 nt, Human
aaagccucuggccgucacacgua

SEQ ID NO: 1372670 - RNA, 16 nt, Human
gccgcucucucugagg

SEQ ID NO: 1372671 - RNA, 21 nt, Human
ggugccgcucucucugagggg

SEQ ID NO: 1372672 - RNA, 17 nt, Human
ugccgcucucucugagg

SEQ ID NO: 1372673 - RNA, 21 nt, Human
aaugcauugccuguaacaaug

SEQ ID NO: 1372674 - RNA, 16 nt, Human
gccgcugucucugagg

SEQ ID NO: 1372675 - RNA, 11 nt, Human
ccgcugucucu

SEQ ID NO: 1372676 - RNA, 21 nt, Human
ccuuacaaagggaaagccucu

SEQ ID NO: 1372677 - RNA, 18 nt, Human
acaaagggaaagccucug

SEQ ID NO: 1372678 - RNA, 22 nt, Human
cagcauuuacuaugcacaacag

SEQ ID NO: 1372679 - RNA, 20 nt, Human
ccuggugcacgcaggcacag

SEQ ID NO: 1372680 - RNA, 11 nt, Human
ucucugagggg

SEQ ID NO: 1372681 - RNA, 22 nt, Human
guccugucgaaggggaggcaca

SEQ ID NO: 1372682 - RNA, 15 nt, Human
guaaagugauuuuug

SEQ ID NO: 1372683 - RNA, 11 nt, Human
cugcagcucaa

SEQ ID NO: 1372684 - RNA, 23 nt, Human
cugcaggggccucuguuccuuuc

SEQ ID NO: 1372685 - RNA, 22 nt, Human
ucgaaggggaggcacacuuucu

SEQ ID NO: 1372686 - RNA, 11 nt, Human
ccgcucucucu

SEQ ID NO: 1372687 - RNA, 15 nt, Human
acaguagagagggaa

SEQ ID NO: 1372688 - RNA, 20 nt, Human
cuggugcacgcaggcacagc

SEQ ID NO: 1372689 - RNA, 18 nt, Human
ugcuaacuggguuaaaua

SEQ ID NO: 1372690 - RNA, 13 nt, Human
cuuucucugaggg

SEQ ID NO: 1372691 - RNA, 13 nt, Human
cucucucugaggg

SEQ ID NO: 1372692 - RNA, 13 nt, Human
uuucucugagggg

SEQ ID NO: 1372693 - RNA, 16 nt, Human
gccgcuuucucugagg

SEQ ID NO: 1372694 - RNA, 16 nt, Human
uauuuugcuaacuggu

SEQ ID NO: 1372695 - RNA, 20 nt, Human
cgcaggcacagcagcugcag

SEQ ID NO: 1372696 - RNA, 19 nt, Human
agggugggggugcucucuc

SEQ ID NO: 1372697 - RNA, 19 nt, Human
gacgggccacacguggcug

SEQ ID NO: 1372698 - RNA, 13 nt, Human
aaauauuuugcua

SEQ ID NO: 1372699 - RNA, 16 nt, Human
gcuuucucugaggggg

SEQ ID NO: 1372700 - RNA, 22 nt, Human
ggaacauccuaagacagaggaa

SEQ ID NO: 1372701 - RNA, 22 nt, Human
uguuuugccguggcuuggggau

SEQ ID NO: 1372702 - RNA, 19 nt, Human
gcuuucucugagggggugg

SEQ ID NO: 1372703 - RNA, 13 nt, Human
cuguaacaaugua

SEQ ID NO: 1372704 - RNA, 18 nt, Human
cugaggggugggggugcc

SEQ ID NO: 1372705 - RNA, 20 nt, Human
ugggggugccgcucucucug

SEQ ID NO: 1372706 - RNA, 19 nt, Human
cugagggggugggggugcc

SEQ ID NO: 1372707 - RNA, 19 nt, Human
cuguucugcgcuguguaca

SEQ ID NO: 1372708 - RNA, 14 nt, Human
cucucugagggggu

SEQ ID NO: 1372709 - RNA, 18 nt, Human
ugcgcuguguacaaugug

SEQ ID NO: 1372710 - RNA, 13 nt, Human
gggggugggggug

SEQ ID NO: 1372711 - RNA, 14 nt, Human
acugguuaaacauu

SEQ ID NO: 1372712 - RNA, 23 nt, Human
aggacgggccacacguggcuggc

SEQ ID NO: 1372713 - RNA, 14 nt, Human
auuuugcuaacugg

SEQ ID NO: 1372714 - RNA, 17 nt, Human
ugcauugccuguaacaa

SEQ ID NO: 1372715 - RNA, 15 nt, Human
aaaguaggauuuuga

SEQ ID NO: 1372716 - RNA, 16 nt, Human
uugcuaacugguuaaa

SEQ ID NO: 1372717 - RNA, 18 nt, Human
cguaaugcauugccugua

SEQ ID NO: 1372718 - RNA, 12 nt, Human
gagggguggggg

SEQ ID NO: 1372719 - RNA, 15 nt, Human
aauuuugcuaacugg

SEQ ID NO: 1372720 - RNA, 22 nt, Human
cugguguuugguuucuucauuc

SEQ ID NO: 1372721 - RNA, 16 nt, Human
gcaggcacagcagcug

SEQ ID NO: 1372722 - RNA, 17 nt, Human
ucggugcguucuccuga

SEQ ID NO: 1372723 - RNA, 15 nt, Human
acaugcucacacauu

SEQ ID NO: 1372724 - RNA, 22 nt, Human
ugagggggugggggugccgcug

SEQ ID NO: 1372725 - RNA, 21 nt, Human
ccugucgaaggggaggcacac

SEQ ID NO: 1372726 - RNA, 18 nt, Human
caacaguagagagggaac

SEQ ID NO: 1372727 - RNA, 16 nt, Human
cucugagggguggggg

SEQ ID NO: 1372728 - RNA, 16 nt, Human
cgcucucucugagggg

SEQ ID NO: 1372729 - RNA, 23 nt, Human
cauuacaacaguagagagggaac

SEQ ID NO: 1372730 - RNA, 14 nt, Human
gagggggugggggu

SEQ ID NO: 1372731 - RNA, 12 nt, Human
uuuuuaaauaua

SEQ ID NO: 1372732 - RNA, 12 nt, Human
cagcuuuaaagg

SEQ ID NO: 1372733 - RNA, 23 nt, Human
augucugcagcucaagggcuggc

SEQ ID NO: 1372734 - RNA, 22 nt, Human
acaauguaauaaaaagccucuu

SEQ ID NO: 1372735 - RNA, 19 nt, Human
ugacgguguuaauuuugcu

SEQ ID NO: 1372736 - RNA, 15 nt, Human
gaacuccagagauga

SEQ ID NO: 1372737 - RNA, 17 nt, Human
cuggagcgcuucaguuc

SEQ ID NO: 1372738 - RNA, 14 nt, Human
gcaaacguuucuca

SEQ ID NO: 1372739 - RNA, 17 nt, Human
uguguacaaugugagau

SEQ ID NO: 1372740 - RNA, 15 nt, Human
gagaugagugucugg

SEQ ID NO: 1372741 - RNA, 12 nt, Human
gccgcucucucu

SEQ ID NO: 1372742 - RNA, 16 nt, Human
ggugcucucucugagg

SEQ ID NO: 1372743 - RNA, 18 nt, Human
uaacaauguaauaaaaag

SEQ ID NO: 1372744 - RNA, 15 nt, Human
cgcugucucugaggg

SEQ ID NO: 1372745 - RNA, 23 nt, Human
aaaugacgguguuaauuuugcua

SEQ ID NO: 1372746 - RNA, 16 nt, Human
agcucaagggcuggca

SEQ ID NO: 1372747 - RNA, 15 nt, Human
ugccgcucucucuga

SEQ ID NO: 1372748 - RNA, 17 nt, Human
gcuaacugguuaaacau

SEQ ID NO: 1372749 - RNA, 16 nt, Human
ccuguucugcgcugug

SEQ ID NO: 1372750 - RNA, 19 nt, Human
aggauuuugaggguggggg

SEQ ID NO: 1372751 - RNA, 13 nt, Human
ugccgcugucucu

SEQ ID NO: 1372752 - RNA, 21 nt, Human
aaucugcuucauccaauguga

SEQ ID NO: 1372753 - RNA, 16 nt, Human
cucguuccaguggcgg

SEQ ID NO: 1372754 - RNA, 20 nt, Human
gcuggcggccucguuccagu

SEQ ID NO: 1372755 - RNA, 17 nt, Human
gugccgcuuucucugag

SEQ ID NO: 1372756 - RNA, 11 nt, Human
cgcuuucucug

SEQ ID NO: 1372757 - RNA, 17 nt, Human
cugcucucuccgagggg

SEQ ID NO: 1372758 - RNA, 14 nt, Human
augcacaacagagu

SEQ ID NO: 1372759 - RNA, 16 nt, Human
uuuugagggugggggu

SEQ ID NO: 1372760 - RNA, 16 nt, Human
cuuucucugagggggu

SEQ ID NO: 1372761 - RNA, 17 nt, Human
uuacuaugcacaacaga

SEQ ID NO: 1372762 - RNA, 19 nt, Human
cauccuaagacagaggaac

SEQ ID NO: 1372763 - RNA, 14 nt, Human
cuuacaaagggaaa

SEQ ID NO: 1372764 - RNA, 18 nt, Human
gcagcucaagggcuggca

SEQ ID NO: 1372765 - RNA, 12 nt, Human
gcugcucucucc

SEQ ID NO: 1372766 - RNA, 19 nt, Human
gccucuguuccuuucucug

SEQ ID NO: 1372767 - RNA, 15 nt, Human
gccgcucucucugag

SEQ ID NO: 1372768 - RNA, 23 nt, Human
ugagggugggggugcucucucug

SEQ ID NO: 1372769 - RNA, 20 nt, Human
cugagggggugggggugcug

SEQ ID NO: 1372770 - RNA, 12 nt, Human
ugucucugaggg

SEQ ID NO: 1372771 - RNA, 23 nt, Human
aaugcauugccuguaacaaugua

SEQ ID NO: 1372772 - RNA, 14 nt, Human
agcugcaggggccu

SEQ ID NO: 1372773 - RNA, 21 nt, Human
ugcagcauuuacuaugcacaa

SEQ ID NO: 1372774 - RNA, 14 nt, Human
uguaaagugauuuu

SEQ ID NO: 1372775 - RNA, 20 nt, Human
gucacucguggugaggcuga

SEQ ID NO: 1372776 - RNA, 22 nt, Human
aggggugggggugccgcucucu

SEQ ID NO: 1372777 - RNA, 13 nt, Human
acgggaccagcuc

SEQ ID NO: 1372778 - RNA, 17 nt, Human
gcugucucugaggggug

SEQ ID NO: 1372779 - RNA, 15 nt, Human
gagggguggaaugcc

SEQ ID NO: 1372780 - RNA, 15 nt, Human
ggccacacguggcug

SEQ ID NO: 1372781 - RNA, 19 nt, Human
gcgcuucaguucagcuuua

SEQ ID NO: 1372782 - RNA, 14 nt, Human
cgggaccagcucac

SEQ ID NO: 1372783 - RNA, 14 nt, Human
uucucugagggggu

SEQ ID NO: 1372784 - RNA, 11 nt, Human
agggguggggg

SEQ ID NO: 1372785 - RNA, 13 nt, Human
uaaauauuuugcu

SEQ ID NO: 1372786 - RNA, 22 nt, Human
auaaaaauggguguuauuuuua

SEQ ID NO: 1372787 - RNA, 21 nt, Human
augcucacacauuacaacagu

SEQ ID NO: 1372788 - RNA, 17 nt, Human
uaauuuugcuaacuggg

SEQ ID NO: 1372789 - RNA, 21 nt, Human
agggugggggugcucucucug

SEQ ID NO: 1372790 - RNA, 18 nt, Human
cugcgcuguguacaaugu

SEQ ID NO: 1372791 - RNA, 13 nt, Human
gccgcuuucucug

SEQ ID NO: 1372792 - RNA, 17 nt, Human
ugguguuugguuucuuc

SEQ ID NO: 1372793 - RNA, 14 nt, Human
gugcucucucugag

SEQ ID NO: 1372794 - RNA, 19 nt, Human
cugcagcucaagggcuggc

SEQ ID NO: 1372795 - RNA, 21 nt, Human
ugaggggugggggugccgcug

SEQ ID NO: 1372796 - RNA, 16 nt, Human
uggcaaacguuucuca

SEQ ID NO: 1372797 - RNA, 13 nt, Human
gcuguguacaaug

SEQ ID NO: 1372798 - RNA, 14 nt, Human
uguuccuuucucug

SEQ ID NO: 1372799 - RNA, 13 nt, Human
gaggggguggggg

SEQ ID NO: 1372800 - RNA, 16 nt, Human
cgcugucucugagggg

SEQ ID NO: 1372801 - RNA, 19 nt, Human
cgguguuaauuuugcuaac

SEQ ID NO: 1372802 - RNA, 9 nt, Human
cucucucug

SEQ ID NO: 1372803 - RNA, 12 nt, Human
ucucucugaggg

SEQ ID NO: 1372804 - RNA, 16 nt, Human
cugucgaaggggaggc

SEQ ID NO: 1372805 - RNA, 20 nt, Human
gggugcucucucugaggggg

SEQ ID NO: 1372806 - RNA, 19 nt, Human
ucucugagggggugggggu

SEQ ID NO: 1372807 - RNA, 13 nt, Human
gaggggugggggu

SEQ ID NO: 1372808 - RNA, 21 nt, Human
cuguugacauucggggugauc

SEQ ID NO: 1372809 - RNA, 17 nt, Human
uuuugagggugggggug

SEQ ID NO: 1372810 - RNA, 21 nt, Human
uucugcgcuguguacaaugug

SEQ ID NO: 1372811 - RNA, 14 nt, Human
ucuguuccuuucuc

SEQ ID NO: 1372812 - RNA, 19 nt, Human
gcuaacuggguuaaauauu

SEQ ID NO: 1372813 - RNA, 21 nt, Human
ggugccgcuuucucugagggg

SEQ ID NO: 1372814 - RNA, 23 nt, Human
gggugccgcuuucucugaggggg

SEQ ID NO: 1372815 - RNA, 18 nt, Human
ucaagggcuggcacuuuu

SEQ ID NO: 1372816 - RNA, 18 nt, Human
cuaacuggguuaaauauu

SEQ ID NO: 1372817 - RNA, 19 nt, Human
cauucuuuacugcacucag

SEQ ID NO: 1372818 - RNA, 15 nt, Human
guuaauuuugcuaac

SEQ ID NO: 1372819 - RNA, 12 nt, Human
gugccgcucucu

SEQ ID NO: 1372820 - RNA, 17 nt, Human
ucugaggggugggggug

SEQ ID NO: 1372821 - RNA, 14 nt, Human
ugccgcuuucucug

SEQ ID NO: 1372822 - RNA, 10 nt, Human
aauuuugcua

SEQ ID NO: 1372823 - RNA, 11 nt, Human
ggugcugcucu

SEQ ID NO: 1372824 - RNA, 18 nt, Human
cacucguggugaggcuga

SEQ ID NO: 1372825 - RNA, 14 nt, Human
cuccauaucauuug

SEQ ID NO: 1372826 - RNA, 21 nt, Human
acuuucuggcaaacguuucuc

SEQ ID NO: 1372827 - RNA, 17 nt, Human
ugccgcugucucugagg

SEQ ID NO: 1372828 - RNA, 14 nt, Human
gugccgcugucucu

SEQ ID NO: 1372829 - RNA, 13 nt, Human
acauuaauauuua

SEQ ID NO: 1372830 - RNA, 14 nt, Human
uaaacauuaauauu

SEQ ID NO: 1372831 - RNA, 19 nt, Human
cagcugcaggggccucugu

SEQ ID NO: 1372832 - RNA, 13 nt, Human
gcucucucugagg

SEQ ID NO: 1372833 - RNA, 15 nt, Human
gggggugggggugcc

SEQ ID NO: 1372834 - RNA, 17 nt, Human
ucacacauuacaacagu

SEQ ID NO: 1372835 - RNA, 20 nt, Human
ccugucgaaggggaggcaca

SEQ ID NO: 1372836 - RNA, 19 nt, Human
cauuuacuaugcacaacag

SEQ ID NO: 1372837 - RNA, 10 nt, Human
ccgcucucuc

SEQ ID NO: 1372838 - RNA, 15 nt, Human
agcuuuaaaggccag

SEQ ID NO: 1372839 - RNA, 16 nt, Human
ucugaggggguggggg

SEQ ID NO: 1372840 - RNA, 16 nt, Human
ugaaguucaucuugca

SEQ ID NO: 1372841 - RNA, 19 nt, Human
gcucacacauuacaacagu

SEQ ID NO: 1372842 - RNA, 13 nt, Human
ggggugggggugc

SEQ ID NO: 1372843 - RNA, 12 nt, Human
aagacagaggaa

SEQ ID NO: 1372844 - RNA, 14 nt, Human
gugccgcucucucu

SEQ ID NO: 1372845 - RNA, 13 nt, Human
ggugccgcugucu

SEQ ID NO: 1372846 - RNA, 14 nt, Human
cauugccuguaaca

SEQ ID NO: 1372847 - RNA, 12 nt, Human
aggggguggggg

SEQ ID NO: 1372848 - RNA, 16 nt, Human
ugccuguaacaaugua

SEQ ID NO: 1372849 - RNA, 21 nt, Human
aaugccgcugucucugagggg

SEQ ID NO: 1372850 - RNA, 12 nt, Human
gccgcugucucu

SEQ ID NO: 1372851 - RNA, 18 nt, Human
ucucugaggggugggggu

SEQ ID NO: 1372852 - RNA, 21 nt, Human
ggugccgcugucucugagggg

SEQ ID NO: 1372853 - RNA, 19 nt, Human
cuggagcgcuucaguucag

SEQ ID NO: 1372854 - RNA, 13 nt, Human
uguuaauuuugcu

SEQ ID NO: 1372855 - RNA, 14 nt, Human
aacauuaauauuua

SEQ ID NO: 1372856 - RNA, 16 nt, Human
cacgcaggcacagcag

SEQ ID NO: 1372857 - RNA, 16 nt, Human
gcucucucugaggggg

SEQ ID NO: 1372858 - RNA, 12 nt, Human
gcucucucugag

SEQ ID NO: 1372859 - RNA, 13 nt, Human
cuccgaggggugg

SEQ ID NO: 1372860 - RNA, 13 nt, Human
cucugaggggugg

SEQ ID NO: 1372861 - RNA, 20 nt, Human
ggggugcucucucugagggg

SEQ ID NO: 1372862 - RNA, 17 nt, Human
gugcguucuccugaugu

SEQ ID NO: 1372863 - RNA, 16 nt, Human
ucugcgcuguguacaa

SEQ ID NO: 1372864 - RNA, 18 nt, Human
acaugcucacacauuaca

SEQ ID NO: 1372865 - RNA, 14 nt, Human
gggaaagccucugg

SEQ ID NO: 1372866 - RNA, 15 nt, Human
gccucguuccagugg

SEQ ID NO: 1372867 - RNA, 17 nt, Human
gugccgcucucucugag

SEQ ID NO: 1372868 - RNA, 17 nt, Human
guuccuuucucugggcu

SEQ ID NO: 1372869 - RNA, 16 nt, Human
ccgcugucucugaggg

SEQ ID NO: 1372870 - RNA, 13 nt, Human
ucucucugagggg

SEQ ID NO: 1372871 - RNA, 17 nt, Human
cuggcacuuuuuuaaau

SEQ ID NO: 1372872 - RNA, 19 nt, Human
ugcuaacugguuaaacauu

SEQ ID NO: 1372873 - RNA, 21 nt, Human
gggugccgcugucucugaggg

SEQ ID NO: 1372874 - RNA, 12 nt, Human
ccgcugucucug

SEQ ID NO: 1372875 - RNA, 21 nt, Human
gggugccgcuuucucugaggg

SEQ ID NO: 1372876 - RNA, 15 nt, Human
cuguuccuuucucug

SEQ ID NO: 1372877 - RNA, 13 nt, Human
uaaauauaaaaau

SEQ ID NO: 1372878 - RNA, 20 nt, Human
auuuugcuaacuggguuaaa

SEQ ID NO: 1372879 - RNA, 15 nt, Human
gccgcugucucugag

SEQ ID NO: 1372880 - RNA, 16 nt, Human
cuaacugguuaaacau

SEQ ID NO: 1372881 - RNA, 20 nt, Human
gcugcucucuccgaggggug

SEQ ID NO: 1372882 - RNA, 13 nt, Human
auauuuugcuaac

SEQ ID NO: 1372883 - RNA, 18 nt, Human
gaggcacacuuucuggca

SEQ ID NO: 1372884 - RNA, 15 nt, Human
aaacguuucucaaau

SEQ ID NO: 1372885 - RNA, 16 nt, Human
acgcaggcacagcagc

SEQ ID NO: 1372886 - RNA, 23 nt, Human
gggugccgcucucucugaggggg

SEQ ID NO: 1372887 - RNA, 21 nt, Human
uaauaaaaagccucuuucuuu

SEQ ID NO: 1372888 - RNA, 17 nt, Human
uugcuaacuggguuaaa

SEQ ID NO: 1372889 - RNA, 11 nt, Human
uguacaaugug

SEQ ID NO: 1372890 - RNA, 20 nt, Human
ggguuaaauauuuugcuaac

SEQ ID NO: 1372891 - RNA, 19 nt, Human
ugagaucggugcguucucc

SEQ ID NO: 1372892 - RNA, 20 nt, Human
caauguaauaaaaagccucu

SEQ ID NO: 1372893 - RNA, 19 nt, Human
gcacguccuugggcgucuc

SEQ ID NO: 1372894 - RNA, 20 nt, Human
guaggauuuugagggugggg

SEQ ID NO: 1372895 - RNA, 23 nt, Human
ccuggugcacgcaggcacagcag

SEQ ID NO: 1372896 - RNA, 18 nt, Human
agggugggggugcucucu

SEQ ID NO: 1372897 - RNA, 22 nt, Human
aucgaaaugacgguguuaauuu

SEQ ID NO: 1372898 - RNA, 15 nt, Human
agcagcugcaggggc

SEQ ID NO: 1372899 - RNA, 19 nt, Human
auaaaaauggguguuauuu

SEQ ID NO: 1372900 - RNA, 18 nt, Human
uggaaugccgcugucucu

SEQ ID NO: 1372901 - RNA, 14 nt, Human
gugccgcuuucucu

SEQ ID NO: 1372902 - RNA, 19 nt, Human
aggcacagcagcugcaggg

SEQ ID NO: 1372903 - RNA, 16 nt, Human
cgaaggggaggcacac

SEQ ID NO: 1372904 - RNA, 19 nt, Human
auuuacuaugcacaacaga

SEQ ID NO: 1372905 - RNA, 18 nt, Human
gcucucuccgaggggugg

SEQ ID NO: 1372906 - RNA, 20 nt, Human
ugcagcauuuacuaugcaca

SEQ ID NO: 1372907 - RNA, 12 nt, Human
ugcucucucuga

SEQ ID NO: 1372908 - RNA, 13 nt, Human
uaacuaucgaaau

SEQ ID NO: 1372909 - RNA, 20 nt, Human
aguucaucuugcagcauuua

SEQ ID NO: 1372910 - RNA, 14 nt, Human
cugagggggugggg

SEQ ID NO: 1372911 - RNA, 23 nt, Human
cucacacauuacaacaguagaga

SEQ ID NO: 1372912 - RNA, 23 nt, Human
aggggugggggugccgcucucuc

SEQ ID NO: 1372913 - RNA, 14 nt, Human
agggggugggggug

SEQ ID NO: 1372914 - RNA, 23 nt, Human
ggucacucguggugaggcugaca

SEQ ID NO: 1372915 - RNA, 22 nt, Human
uggaaugccgcugucucugagg

SEQ ID NO: 1372916 - RNA, 12 nt, Human
ccgcucucucug

SEQ ID NO: 1372917 - RNA, 15 nt, Human
gugggggugccgcuc

SEQ ID NO: 1372918 - RNA, 21 nt, Human
gccgcugucucugaggggugg

SEQ ID NO: 1372919 - RNA, 22 nt, Human
ugacauucggggugauccuguu

SEQ ID NO: 1372920 - RNA, 9 nt, Human
ccgcugucu

SEQ ID NO: 1372921 - RNA, 13 nt, Human
cugaggggugggg

SEQ ID NO: 1372922 - RNA, 19 nt, Human
aggguccugucgaagggga

SEQ ID NO: 1372923 - RNA, 14 nt, Human
ggggauuguacacg

SEQ ID NO: 1372924 - RNA, 13 nt, Human
ccgcugucucuga

SEQ ID NO: 1372925 - RNA, 21 nt, Human
gggugccgcucucucugaggg

SEQ ID NO: 1372926 - RNA, 19 nt, Human
auuuugcuaacugguuaaa

SEQ ID NO: 1372927 - RNA, 14 nt, Human
aggaacuccagaga

SEQ ID NO: 1372928 - RNA, 15 nt, Human
acuggguuaaauauu

SEQ ID NO: 1372929 - RNA, 11 nt, Human
auauuuugcua

SEQ ID NO: 1372930 - RNA, 18 nt, Human
aacuggguuaaauauuuu

SEQ ID NO: 1372931 - RNA, 13 nt, Human
gagggugggggug

SEQ ID NO: 1372932 - RNA, 21 nt, Human
gugagaucggugcguucuccu

SEQ ID NO: 1372933 - RNA, 14 nt, Human
guggcuggcggccu

SEQ ID NO: 1372934 - RNA, 18 nt, Human
gggugcucucucugaggg

SEQ ID NO: 1372935 - RNA, 14 nt, Human
augaaggucacucg

SEQ ID NO: 1372936 - RNA, 13 nt, Human
gcacucagauuua

SEQ ID NO: 1372937 - RNA, 15 nt, Human
ucugagggguggggg

SEQ ID NO: 1372938 - RNA, 14 nt, Human
ggugcugcucucuc

SEQ ID NO: 1372939 - RNA, 23 nt, Human
aaugacgguguuaauuuugcuaa

SEQ ID NO: 1372940 - RNA, 19 nt, Human
ugacauucggggugauccu

SEQ ID NO: 1372941 - RNA, 11 nt, Human
cugcucucucc

SEQ ID NO: 1372942 - RNA, 16 nt, Human
uuaaacauuaauauuu

SEQ ID NO: 1372943 - RNA, 16 nt, Human
uacuaugcacaacaga

SEQ ID NO: 1372944 - RNA, 13 nt, Human
aggggugggggug

SEQ ID NO: 1372945 - RNA, 10 nt, Neisseria meningitidis Z2491
uuuugcgcca

SEQ ID NO: 1372946 - RNA, 13 nt, Neisseria meningitidis Z2491
uuucggacggcau

SEQ ID NO: 1372947 - RNA, 14 nt, Neisseria meningitidis Z2491
uuugguuuucuguu

SEQ ID NO: 1372948 - RNA, 19 nt, Neisseria meningitidis Z2491
uuugguaaaaaaaugccgu

SEQ ID NO: 1372949 - RNA, 17 nt, Neisseria meningitidis Z2491
uuuggcuuuuuucuguu

SEQ ID NO: 1372950 - RNA, 16 nt, Neisseria meningitidis Z2491
uuugcgagaaugacgg

SEQ ID NO: 1372951 - RNA, 20 nt, Neisseria meningitidis Z2491
uuuguccauucggcuuaaac

SEQ ID NO: 1372952 - RNA, 20 nt, Neisseria meningitidis Z2491
uugguuugaaccagggauuu

SEQ ID NO: 1372953 - RNA, 13 nt, Neisseria meningitidis Z2491
uugguuuucaaaa

SEQ ID NO: 1372954 - RNA, 19 nt, Neisseria meningitidis Z2491
uuggggaagcguuggacga

SEQ ID NO: 1372955 - RNA, 20 nt, Neisseria meningitidis Z2491
uugugaaaauaacgggauuu

SEQ ID NO: 1372956 - RNA, 23 nt, Neisseria meningitidis Z2491
uuuccaauacaacaaaaugccgc

SEQ ID NO: 1372957 - RNA, 20 nt, Neisseria meningitidis Z2491
uuucaaguuccagacggcau

SEQ ID NO: 1372958 - RNA, 14 nt, Neisseria meningitidis Z2491
uuucaaaaugcaaa

SEQ ID NO: 1372959 - RNA, 19 nt, Neisseria meningitidis Z2491
uuuaaaguuaauccacuau

SEQ ID NO: 1372960 - RNA, 13 nt, Neisseria meningitidis Z2491
uuuauuuccugaa

SEQ ID NO: 1372961 - RNA, 18 nt, Neisseria meningitidis Z2491
uuccguuuuugcgggaag

SEQ ID NO: 1372962 - RNA, 17 nt, Neisseria meningitidis Z2491
uugaacguuugcaggac

SEQ ID NO: 1372963 - RNA, 13 nt, Neisseria meningitidis Z2491
uugagcuucgcga

SEQ ID NO: 1372964 - RNA, 12 nt, Neisseria meningitidis Z2491
uugagcauaaaa

SEQ ID NO: 1372965 - RNA, 20 nt, Neisseria meningitidis Z2491
uugagauggucaauacacaa

SEQ ID NO: 1372966 - RNA, 17 nt, Neisseria meningitidis Z2491
uugacuugaaggcgugu

SEQ ID NO: 1372967 - RNA, 17 nt, Neisseria meningitidis Z2491
uugacgaauucggauuu

SEQ ID NO: 1372968 - RNA, 14 nt, Neisseria meningitidis Z2491
uugcaacuuugcgu

SEQ ID NO: 1372969 - RNA, 14 nt, Neisseria meningitidis Z2491
uugccagcggguuu

SEQ ID NO: 1372970 - RNA, 22 nt, Neisseria meningitidis Z2491
uuggcaacaguguauucgacgc

SEQ ID NO: 1372971 - RNA, 15 nt, Neisseria meningitidis Z2491
uugcuugcgcggcau

SEQ ID NO: 1372972 - RNA, 15 nt, Neisseria meningitidis Z2491
uugcuguuuuccuga

SEQ ID NO: 1372973 - RNA, 14 nt, Neisseria meningitidis Z2491
uugccuuaucccga

SEQ ID NO: 1372974 - RNA, 13 nt, Neisseria meningitidis Z2491
uugccgcauaaau

SEQ ID NO: 1372975 - RNA, 19 nt, Neisseria meningitidis Z2491
uugcccguggcgacggcaa

SEQ ID NO: 1372976 - RNA, 12 nt, Neisseria meningitidis Z2491
uugcggcggcaa

SEQ ID NO: 1372977 - RNA, 13 nt, Neisseria meningitidis Z2491
uucagacggcauu

SEQ ID NO: 1372978 - RNA, 12 nt, Neisseria meningitidis Z2491
uucagacggcau

SEQ ID NO: 1372979 - RNA, 23 nt, Neisseria meningitidis Z2491
uucagugcugcgcccaaagcggu

SEQ ID NO: 1372980 - RNA, 18 nt, Neisseria meningitidis Z2491
uucacuauauuuucccga

SEQ ID NO: 1372981 - RNA, 17 nt, Neisseria meningitidis Z2491
uucaacggcacggcguu

SEQ ID NO: 1372982 - RNA, 13 nt, Neisseria meningitidis Z2491
uucaacagacggc

SEQ ID NO: 1372983 - RNA, 16 nt, Neisseria meningitidis Z2491
uucccgcgaaagcggg

SEQ ID NO: 1372984 - RNA, 19 nt, Neisseria meningitidis Z2491
uuacccgauaaguuuccgc

SEQ ID NO: 1372985 - RNA, 22 nt, Neisseria meningitidis Z2491
uguugcucccgauaaaugccgc

SEQ ID NO: 1372986 - RNA, 15 nt, Neisseria meningitidis Z2491
uguuucagacggccu

SEQ ID NO: 1372987 - RNA, 20 nt, Neisseria meningitidis Z2491
uguuugaauggaaaugccgu

SEQ ID NO: 1372988 - RNA, 20 nt, Neisseria meningitidis Z2491
uuaaauuuaaaccaguacag

SEQ ID NO: 1372989 - RNA, 19 nt, Neisseria meningitidis Z2491
uuaaauuuaaaucaguacg

SEQ ID NO: 1372990 - RNA, 23 nt, Neisseria meningitidis Z2491
uguuuucaaguuccagacggcau

SEQ ID NO: 1372991 - RNA, 20 nt, Neisseria meningitidis Z2491
uuaacuuuaaaccaguacgg

SEQ ID NO: 1372992 - RNA, 13 nt, Neisseria meningitidis Z2491
uguccgaaugccg

SEQ ID NO: 1372993 - RNA, 15 nt, Neisseria meningitidis Z2491
uguugaaaaugccgu

SEQ ID NO: 1372994 - RNA, 14 nt, Neisseria meningitidis Z2491
uguucagacggcau

SEQ ID NO: 1372995 - RNA, 19 nt, Neisseria meningitidis Z2491
uguuccgggccgaugccgg

SEQ ID NO: 1372996 - RNA, 22 nt, Neisseria meningitidis Z2491
uguggcugaugcggacggcuug

SEQ ID NO: 1372997 - RNA, 23 nt, Neisseria meningitidis Z2491
uguggcuaacguacaaaugccgu

SEQ ID NO: 1372998 - RNA, 13 nt, Neisseria meningitidis Z2491
uguguucgcgcgu

SEQ ID NO: 1372999 - RNA, 14 nt, Neisseria meningitidis Z2491
ugugaauccacuau

SEQ ID NO: 1373000 - RNA, 19 nt, Neisseria meningitidis Z2491
uggcaaauugaaaugccgu

SEQ ID NO: 1373001 - RNA, 21 nt, Neisseria meningitidis Z2491
uggauuaaauuuaaaucagua

SEQ ID NO: 1373002 - RNA, 20 nt, Neisseria meningitidis Z2491
uggauuaacaaaaaccggua

SEQ ID NO: 1373003 - RNA, 21 nt, Neisseria meningitidis Z2491
uggauuaacuuuaaaccagua

SEQ ID NO: 1373004 - RNA, 18 nt, Neisseria meningitidis Z2491
uggauucgucauucccgc

SEQ ID NO: 1373005 - RNA, 19 nt, Neisseria meningitidis Z2491
uggauagcgagacggcauc

SEQ ID NO: 1373006 - RNA, 12 nt, Neisseria meningitidis Z2491
uggaaaugccgu

SEQ ID NO: 1373007 - RNA, 19 nt, Neisseria meningitidis Z2491
uggaaggcgggcaggcagu

SEQ ID NO: 1373008 - RNA, 16 nt, Neisseria meningitidis Z2491
ugggaaugacgggauu

SEQ ID NO: 1373009 - RNA, 13 nt, Neisseria meningitidis Z2491
ugggaaaugccgu

SEQ ID NO: 1373010 - RNA, 20 nt, Neisseria meningitidis Z2491
ugggcguucagacggcauug

SEQ ID NO: 1373011 - RNA, 15 nt, Neisseria meningitidis Z2491
guuucagacggcauu

SEQ ID NO: 1373012 - RNA, 20 nt, Neisseria meningitidis Z2491
uaaaaggucuagauucccgc

SEQ ID NO: 1373013 - RNA, 14 nt, Neisseria meningitidis Z2491
uaaaaaugccgucu

SEQ ID NO: 1373014 - RNA, 16 nt, Neisseria meningitidis Z2491
uaaaaaugccgucuga

SEQ ID NO: 1373015 - RNA, 18 nt, Neisseria meningitidis Z2491
uaacgauacggcggcauu

SEQ ID NO: 1373016 - RNA, 23 nt, Neisseria meningitidis Z2491
uaauccgccugcgccacggcuuu

SEQ ID NO: 1373017 - RNA, 23 nt, Neisseria meningitidis Z2491
uaccgccgccgccaaugccgucu

SEQ ID NO: 1373018 - RNA, 22 nt, Neisseria meningitidis Z2491
uacccaaugcgccgauuuuccg

SEQ ID NO: 1373019 - RNA, 21 nt, Neisseria meningitidis Z2491
gugugaaauaaaaaaugccgu

SEQ ID NO: 1373020 - RNA, 22 nt, Neisseria meningitidis Z2491
gugcguuuguguucgcgcguga

SEQ ID NO: 1373021 - RNA, 14 nt, Neisseria meningitidis Z2491
guuccagacggcau

SEQ ID NO: 1373022 - RNA, 12 nt, Neisseria meningitidis Z2491
guucagacggca

SEQ ID NO: 1373023 - RNA, 13 nt, Neisseria meningitidis Z2491
guucagacggcau

SEQ ID NO: 1373024 - RNA, 19 nt, Neisseria meningitidis Z2491
guucaaaugccgucugaag

SEQ ID NO: 1373025 - RNA, 16 nt, Neisseria meningitidis Z2491
guucggcaaaauccgc

SEQ ID NO: 1373026 - RNA, 14 nt, Neisseria meningitidis Z2491
guucggauauuucc

SEQ ID NO: 1373027 - RNA, 18 nt, Neisseria meningitidis Z2491
guuuaaaggaaaugccgu

SEQ ID NO: 1373028 - RNA, 14 nt, Neisseria meningitidis Z2491
guugggcgauggcg

SEQ ID NO: 1373029 - RNA, 21 nt, Neisseria meningitidis Z2491
guugcucccgauaaaugccgc

SEQ ID NO: 1373030 - RNA, 15 nt, Neisseria meningitidis Z2491
uccccauaugccguc

SEQ ID NO: 1373031 - RNA, 21 nt, Neisseria meningitidis Z2491
uccgccauuuccaaacccaau

SEQ ID NO: 1373032 - RNA, 20 nt, Neisseria meningitidis Z2491
uccgauacguuuccgcaccg

SEQ ID NO: 1373033 - RNA, 20 nt, Neisseria meningitidis Z2491
uccgauggaaccguuuuccg

SEQ ID NO: 1373034 - RNA, 17 nt, Neisseria meningitidis Z2491
uccgauaaauuccuaaa

SEQ ID NO: 1373035 - RNA, 16 nt, Neisseria meningitidis Z2491
uccaccauuucuuugg

SEQ ID NO: 1373036 - RNA, 11 nt, Neisseria meningitidis Z2491
uccagacggca

SEQ ID NO: 1373037 - RNA, 19 nt, Neisseria meningitidis Z2491
ucaucgccguaaccgacga

SEQ ID NO: 1373038 - RNA, 14 nt, Neisseria meningitidis Z2491
ucauguucgugcau

SEQ ID NO: 1373039 - RNA, 13 nt, Neisseria meningitidis Z2491
ucauagacgguuu

SEQ ID NO: 1373040 - RNA, 16 nt, Neisseria meningitidis Z2491
ucacauaaauccguuc

SEQ ID NO: 1373041 - RNA, 16 nt, Neisseria meningitidis Z2491
ucagauaaucuuugaa

SEQ ID NO: 1373042 - RNA, 22 nt, Neisseria meningitidis Z2491
ucagauugauaaaagcacaaau

SEQ ID NO: 1373043 - RNA, 22 nt, Neisseria meningitidis Z2491
ucaaguggggggaauacgguuu

SEQ ID NO: 1373044 - RNA, 19 nt, Neisseria meningitidis Z2491
ucaaguuccagacggcauu

SEQ ID NO: 1373045 - RNA, 16 nt, Neisseria meningitidis Z2491
ucaacggcacggcguu

SEQ ID NO: 1373046 - RNA, 21 nt, Neisseria meningitidis Z2491
ucaacgaaccuggauucccgc

SEQ ID NO: 1373047 - RNA, 14 nt, Neisseria meningitidis Z2491
uauuuuugcccgac

SEQ ID NO: 1373048 - RNA, 19 nt, Neisseria meningitidis Z2491
uauuucccgucugcccauc

SEQ ID NO: 1373049 - RNA, 22 nt, Neisseria meningitidis Z2491
uaucgcuguaauaaacagcauu

SEQ ID NO: 1373050 - RNA, 12 nt, Neisseria meningitidis Z2491
uaugccgucuga

SEQ ID NO: 1373051 - RNA, 17 nt, Neisseria meningitidis Z2491
ugaaugaacucgauuuu

SEQ ID NO: 1373052 - RNA, 13 nt, Neisseria meningitidis Z2491
ugaauauugccgc

SEQ ID NO: 1373053 - RNA, 15 nt, Neisseria meningitidis Z2491
ugaauauugccgccg

SEQ ID NO: 1373054 - RNA, 20 nt, Neisseria meningitidis Z2491
ugaaugugcgccacgccauu

SEQ ID NO: 1373055 - RNA, 12 nt, Neisseria meningitidis Z2491
ugacaaucggcu

SEQ ID NO: 1373056 - RNA, 21 nt, Neisseria meningitidis Z2491
ugaagaaaccguuuuauccga

SEQ ID NO: 1373057 - RNA, 16 nt, Neisseria meningitidis Z2491
ugaaggcuucagacgg

SEQ ID NO: 1373058 - RNA, 12 nt, Neisseria meningitidis Z2491
ugaaacggcauc

SEQ ID NO: 1373059 - RNA, 20 nt, Neisseria meningitidis Z2491
ugaacauuucagacggcauu

SEQ ID NO: 1373060 - RNA, 15 nt, Neisseria meningitidis Z2491
ugaaaugccgucuga

SEQ ID NO: 1373061 - RNA, 23 nt, Neisseria meningitidis Z2491
ugaaaugccgucugaacagcauu

SEQ ID NO: 1373062 - RNA, 20 nt, Neisseria meningitidis Z2491
ugaaauguucagacggcauu

SEQ ID NO: 1373063 - RNA, 19 nt, Neisseria meningitidis Z2491
ugaaauucuagauucccgc

SEQ ID NO: 1373064 - RNA, 14 nt, Neisseria meningitidis Z2491
ugaaauuucagacg

SEQ ID NO: 1373065 - RNA, 23 nt, Neisseria meningitidis Z2491
ugaaauaugguucagacggcauu

SEQ ID NO: 1373066 - RNA, 21 nt, Neisseria meningitidis Z2491
ugaaauccuauuuucagaugg

SEQ ID NO: 1373067 - RNA, 16 nt, Neisseria meningitidis Z2491
ugacgaagcuauccgc

SEQ ID NO: 1373068 - RNA, 23 nt, Neisseria meningitidis Z2491
ugacgaaauuuuagauugcaggc

SEQ ID NO: 1373069 - RNA, 19 nt, Neisseria meningitidis Z2491
ugaguuucuagauucccgc

SEQ ID NO: 1373070 - RNA, 20 nt, Neisseria meningitidis Z2491
ugaguuucagucauucccga

SEQ ID NO: 1373071 - RNA, 13 nt, Neisseria meningitidis Z2491
ugaggucgcgagu

SEQ ID NO: 1373072 - RNA, 15 nt, Neisseria meningitidis Z2491
ugaugcggacggcgu

SEQ ID NO: 1373073 - RNA, 17 nt, Neisseria meningitidis Z2491
ugaggcugccgucauug

SEQ ID NO: 1373074 - RNA, 19 nt, Neisseria meningitidis Z2491
ugagcuucgcgacgguauu

SEQ ID NO: 1373075 - RNA, 20 nt, Neisseria meningitidis Z2491
ugagcuucgcgacgguauug

SEQ ID NO: 1373076 - RNA, 16 nt, Neisseria meningitidis Z2491
ugccuaggggcgguuu

SEQ ID NO: 1373077 - RNA, 18 nt, Neisseria meningitidis Z2491
ugcggaugaauuuaaaca

SEQ ID NO: 1373078 - RNA, 16 nt, Neisseria meningitidis Z2491
ugcggcaaaaccggau

SEQ ID NO: 1373079 - RNA, 20 nt, Neisseria meningitidis Z2491
ugccgcugacgaaaccagau

SEQ ID NO: 1373080 - RNA, 21 nt, Neisseria meningitidis Z2491
ugccggaaauaccgacggcgu

SEQ ID NO: 1373081 - RNA, 14 nt, Neisseria meningitidis Z2491
ucgagacucguuuc

SEQ ID NO: 1373082 - RNA, 19 nt, Neisseria meningitidis Z2491
ucgccccaaaaagaggcau

SEQ ID NO: 1373083 - RNA, 13 nt, Neisseria meningitidis Z2491
ucgcgaaagcggg

SEQ ID NO: 1373084 - RNA, 13 nt, Neisseria meningitidis Z2491
ucuagauucccgc

SEQ ID NO: 1373085 - RNA, 17 nt, Neisseria meningitidis Z2491
ucuaaggugcugaagca

SEQ ID NO: 1373086 - RNA, 13 nt, Neisseria meningitidis Z2491
ucgucauucccgc

SEQ ID NO: 1373087 - RNA, 13 nt, Neisseria meningitidis Z2491
ucgucauucccgu

SEQ ID NO: 1373088 - RNA, 21 nt, Neisseria meningitidis Z2491
ucgggcggcgguuugccgucu

SEQ ID NO: 1373089 - RNA, 16 nt, Neisseria meningitidis Z2491
ucguauaacgcggauu

SEQ ID NO: 1373090 - RNA, 18 nt, Neisseria meningitidis Z2491
ucgggagcaacugaaacc

SEQ ID NO: 1373091 - RNA, 19 nt, Neisseria meningitidis Z2491
ucgggcaauauucuuugaa

SEQ ID NO: 1373092 - RNA, 19 nt, Neisseria meningitidis Z2491
ucgggcaacucgauuuccg

SEQ ID NO: 1373093 - RNA, 22 nt, Neisseria meningitidis Z2491
ucgggcaaaagccagcggauug

SEQ ID NO: 1373094 - RNA, 21 nt, Neisseria meningitidis Z2491
ucgggaaugacugaaacucaa

SEQ ID NO: 1373095 - RNA, 15 nt, Neisseria meningitidis Z2491
gcuucagacggcauc

SEQ ID NO: 1373096 - RNA, 15 nt, Neisseria meningitidis Z2491
gcuucagacggcauu

SEQ ID NO: 1373097 - RNA, 16 nt, Neisseria meningitidis Z2491
gcuucagacggcauuu

SEQ ID NO: 1373098 - RNA, 14 nt, Neisseria meningitidis Z2491
gcuucagacgguau

SEQ ID NO: 1373099 - RNA, 16 nt, Neisseria meningitidis Z2491
gcuucaacagacggcg

SEQ ID NO: 1373100 - RNA, 20 nt, Neisseria meningitidis Z2491
gcuuaaacagcacugccucu

SEQ ID NO: 1373101 - RNA, 21 nt, Neisseria meningitidis Z2491
gcuguguuugaauauuccgcc

SEQ ID NO: 1373102 - RNA, 18 nt, Neisseria meningitidis Z2491
gcuguuccaaaagccgcc

SEQ ID NO: 1373103 - RNA, 22 nt, Neisseria meningitidis Z2491
gcuuucggguaugccagcgcga

SEQ ID NO: 1373104 - RNA, 16 nt, Neisseria meningitidis Z2491
ggaaaugaucaggcgg

SEQ ID NO: 1373105 - RNA, 16 nt, Neisseria meningitidis Z2491
ggaauacggcaacauc

SEQ ID NO: 1373106 - RNA, 12 nt, Neisseria meningitidis Z2491
ggaauucuucga

SEQ ID NO: 1373107 - RNA, 13 nt, Neisseria meningitidis Z2491
ggagaaugccguc

SEQ ID NO: 1373108 - RNA, 14 nt, Neisseria meningitidis Z2491
gcuccugacggcaa

SEQ ID NO: 1373109 - RNA, 19 nt, Neisseria meningitidis Z2491
gcuccugacggcaaacugc

SEQ ID NO: 1373110 - RNA, 13 nt, Neisseria meningitidis Z2491
gcgucauucccgc

SEQ ID NO: 1373111 - RNA, 21 nt, Neisseria meningitidis Z2491
gcguauugagcgacgaccauu

SEQ ID NO: 1373112 - RNA, 18 nt, Neisseria meningitidis Z2491
gcgucaaacagacggaau

SEQ ID NO: 1373113 - RNA, 15 nt, Neisseria meningitidis Z2491
gcguucagacggcau

SEQ ID NO: 1373114 - RNA, 17 nt, Neisseria meningitidis Z2491
gcguucaaaugccgucu

SEQ ID NO: 1373115 - RNA, 16 nt, Neisseria meningitidis Z2491
gcguucuucuucgacg

SEQ ID NO: 1373116 - RNA, 19 nt, Neisseria meningitidis Z2491
gcgggaagccagggcggau

SEQ ID NO: 1373117 - RNA, 22 nt, Neisseria meningitidis Z2491
gcggcucugaaaccauaccgcc

SEQ ID NO: 1373118 - RNA, 18 nt, Neisseria meningitidis Z2491
gcgggagucuggcggcau

SEQ ID NO: 1373119 - RNA, 20 nt, Neisseria meningitidis Z2491
gcgggaaucuagaccuuaga

SEQ ID NO: 1373120 - RNA, 19 nt, Neisseria meningitidis Z2491
gcgggaaucuaggucuuua

SEQ ID NO: 1373121 - RNA, 22 nt, Neisseria meningitidis Z2491
gcggcauuuugccgcgauuccg

SEQ ID NO: 1373122 - RNA, 16 nt, Neisseria meningitidis Z2491
gccuuucagacggcau

SEQ ID NO: 1373123 - RNA, 19 nt, Neisseria meningitidis Z2491
gcgaacggagccagcccgc

SEQ ID NO: 1373124 - RNA, 21 nt, Neisseria meningitidis Z2491
gccuuaucgguguaacggaua

SEQ ID NO: 1373125 - RNA, 15 nt, Neisseria meningitidis Z2491
gccuucaucagcauu

SEQ ID NO: 1373126 - RNA, 15 nt, Neisseria meningitidis Z2491
gccuucagacggcau

SEQ ID NO: 1373127 - RNA, 16 nt, Neisseria meningitidis Z2491
gccuucagacggcaua

SEQ ID NO: 1373128 - RNA, 17 nt, Neisseria meningitidis Z2491
gccuucagacggcauug

SEQ ID NO: 1373129 - RNA, 15 nt, Neisseria meningitidis Z2491
gccugccuuccccau

SEQ ID NO: 1373130 - RNA, 17 nt, Neisseria meningitidis Z2491
gccgucugaaacggcau

SEQ ID NO: 1373131 - RNA, 15 nt, Neisseria meningitidis Z2491
gccgucugaaaggcu

SEQ ID NO: 1373132 - RNA, 11 nt, Neisseria meningitidis Z2491
gccgucugaag

SEQ ID NO: 1373133 - RNA, 16 nt, Neisseria meningitidis Z2491
gccgucugaagcggaa

SEQ ID NO: 1373134 - RNA, 18 nt, Neisseria meningitidis Z2491
gccgucugaagcguauuu

SEQ ID NO: 1373135 - RNA, 18 nt, Neisseria meningitidis Z2491
gccguauccauugccgau

SEQ ID NO: 1373136 - RNA, 23 nt, Neisseria meningitidis Z2491
gccgguaacguauucgccguacu

SEQ ID NO: 1373137 - RNA, 16 nt, Neisseria meningitidis Z2491
gccggucaggacggcu

SEQ ID NO: 1373138 - RNA, 20 nt, Neisseria meningitidis Z2491
gccgggcgcgguaacgcgac

SEQ ID NO: 1373139 - RNA, 12 nt, Neisseria meningitidis Z2491
gcgcuucaaauc

SEQ ID NO: 1373140 - RNA, 16 nt, Neisseria meningitidis Z2491
gcgcgggaaugacggc

SEQ ID NO: 1373141 - RNA, 18 nt, Neisseria meningitidis Z2491
gcgcgggaaugacggcag

SEQ ID NO: 1373142 - RNA, 14 nt, Neisseria meningitidis Z2491
gcgcacgauuucac

SEQ ID NO: 1373143 - RNA, 16 nt, Neisseria meningitidis Z2491
gcgcacgauuucacgg

SEQ ID NO: 1373144 - RNA, 14 nt, Neisseria meningitidis Z2491
gcgcaccgcgcauu

SEQ ID NO: 1373145 - RNA, 21 nt, Neisseria meningitidis Z2491
gcgcccgcaccgugugcgaca

SEQ ID NO: 1373146 - RNA, 12 nt, Neisseria meningitidis Z2491
gucagacggcau

SEQ ID NO: 1373147 - RNA, 15 nt, Neisseria meningitidis Z2491
guccccgaaaccgaa

SEQ ID NO: 1373148 - RNA, 21 nt, Neisseria meningitidis Z2491
guccgaacgcgaaaaugccgu

SEQ ID NO: 1373149 - RNA, 21 nt, Neisseria meningitidis Z2491
guccggaagcggaaagccgcc

SEQ ID NO: 1373150 - RNA, 21 nt, Neisseria meningitidis Z2491
guccuccaccgucauucccgc

SEQ ID NO: 1373151 - RNA, 16 nt, Neisseria meningitidis Z2491
gucgaacgccgcuucg

SEQ ID NO: 1373152 - RNA, 12 nt, Neisseria meningitidis Z2491
gugaaugcggcg

SEQ ID NO: 1373153 - RNA, 17 nt, Neisseria meningitidis Z2491
gucguauaacgcggauu

SEQ ID NO: 1373154 - RNA, 18 nt, Neisseria meningitidis Z2491
gucgguuucaucgccgua

SEQ ID NO: 1373155 - RNA, 17 nt, Neisseria meningitidis Z2491
gugccgccaaagugcca

SEQ ID NO: 1373156 - RNA, 17 nt, Neisseria meningitidis Z2491
guacaaaugccgucuga

SEQ ID NO: 1373157 - RNA, 20 nt, Neisseria meningitidis Z2491
guaacgggcgagaugacggc

SEQ ID NO: 1373158 - RNA, 13 nt, Neisseria meningitidis Z2491
gguuguuaccgcg

SEQ ID NO: 1373159 - RNA, 12 nt, Neisseria meningitidis Z2491
gguuuuaacaau

SEQ ID NO: 1373160 - RNA, 23 nt, Neisseria meningitidis Z2491
gguuaacggccgggcgcgguaac

SEQ ID NO: 1373161 - RNA, 15 nt, Neisseria meningitidis Z2491
ggugcugcugccgcc

SEQ ID NO: 1373162 - RNA, 19 nt, Neisseria meningitidis Z2491
guaccguuucagacggcau

SEQ ID NO: 1373163 - RNA, 17 nt, Neisseria meningitidis Z2491
gguaaccacgacgcaga

SEQ ID NO: 1373164 - RNA, 15 nt, Neisseria meningitidis Z2491
gguaacggcaauauu

SEQ ID NO: 1373165 - RNA, 16 nt, Neisseria meningitidis Z2491
gguacaaccaaugcgg

SEQ ID NO: 1373166 - RNA, 16 nt, Neisseria meningitidis Z2491
ggguuucagacggcau

SEQ ID NO: 1373167 - RNA, 16 nt, Neisseria meningitidis Z2491
ggguucggacggcauu

SEQ ID NO: 1373168 - RNA, 17 nt, Neisseria meningitidis Z2491
ggguucggacggcauuu

SEQ ID NO: 1373169 - RNA, 17 nt, Neisseria meningitidis Z2491
gguauuggaugcggucg

SEQ ID NO: 1373170 - RNA, 17 nt, Neisseria meningitidis Z2491
ggucaaaaucggcauuc

SEQ ID NO: 1373171 - RNA, 19 nt, Neisseria meningitidis Z2491
gguagggcuguucgccgac

SEQ ID NO: 1373172 - RNA, 22 nt, Neisseria meningitidis Z2491
ggugcagauguucggcaagauc

SEQ ID NO: 1373173 - RNA, 20 nt, Neisseria meningitidis Z2491
ggucgaaccauugcgaacug

SEQ ID NO: 1373174 - RNA, 17 nt, Neisseria meningitidis Z2491
ggcaacaaaaugccguc

SEQ ID NO: 1373175 - RNA, 12 nt, Neisseria meningitidis Z2491
ggcaaacccgaa

SEQ ID NO: 1373176 - RNA, 19 nt, Neisseria meningitidis Z2491
ggcaaaacgccuucuucgc

SEQ ID NO: 1373177 - RNA, 11 nt, Neisseria meningitidis Z2491
ggauucccaca

SEQ ID NO: 1373178 - RNA, 11 nt, Neisseria meningitidis Z2491
ggauucccacu

SEQ ID NO: 1373179 - RNA, 22 nt, Neisseria meningitidis Z2491
ggauguuugaguccgaccgccg

SEQ ID NO: 1373180 - RNA, 17 nt, Neisseria meningitidis Z2491
ggcaauccgcucuucgg

SEQ ID NO: 1373181 - RNA, 16 nt, Neisseria meningitidis Z2491
ggcacgaaccgcauug

SEQ ID NO: 1373182 - RNA, 18 nt, Neisseria meningitidis Z2491
ggcacacgcauuccgaca

SEQ ID NO: 1373183 - RNA, 20 nt, Neisseria meningitidis Z2491
ggcaucgguuucuucuucgu

SEQ ID NO: 1373184 - RNA, 12 nt, Neisseria meningitidis Z2491
ggcaguaucaau

SEQ ID NO: 1373185 - RNA, 20 nt, Neisseria meningitidis Z2491
ggcauuuuccguugccugcg

SEQ ID NO: 1373186 - RNA, 17 nt, Neisseria meningitidis Z2491
ggcauuuuuuacacaau

SEQ ID NO: 1373187 - RNA, 21 nt, Neisseria meningitidis Z2491
ggcucugcgcguaccucauug

SEQ ID NO: 1373188 - RNA, 19 nt, Neisseria meningitidis Z2491
ggcuacuccugcugcggcg

SEQ ID NO: 1373189 - RNA, 16 nt, Neisseria meningitidis Z2491
gggauuuugcggcuug

SEQ ID NO: 1373190 - RNA, 18 nt, Neisseria meningitidis Z2491
cugaaaggcuucagacgg

SEQ ID NO: 1373191 - RNA, 20 nt, Neisseria meningitidis Z2491
cugaaaggcuucagacggca

SEQ ID NO: 1373192 - RNA, 13 nt, Neisseria meningitidis Z2491
cugaaauaucguc

SEQ ID NO: 1373193 - RNA, 18 nt, Neisseria meningitidis Z2491
cugaaauaugguucagac

SEQ ID NO: 1373194 - RNA, 22 nt, Neisseria meningitidis Z2491
cugaaagguuuucagacggcau

SEQ ID NO: 1373195 - RNA, 17 nt, Neisseria meningitidis Z2491
cugaaauguucagacgg

SEQ ID NO: 1373196 - RNA, 20 nt, Neisseria meningitidis Z2491
cugaaauucgucauucccgc

SEQ ID NO: 1373197 - RNA, 22 nt, Neisseria meningitidis Z2491
cugaacacggguucagacggca

SEQ ID NO: 1373198 - RNA, 23 nt, Neisseria meningitidis Z2491
cugaacacggguucagacggcau

SEQ ID NO: 1373199 - RNA, 19 nt, Neisseria meningitidis Z2491
cugaaaccggcuucagacg

SEQ ID NO: 1373200 - RNA, 23 nt, Neisseria meningitidis Z2491
cugaaaccuguaccguuucagac

SEQ ID NO: 1373201 - RNA, 18 nt, Neisseria meningitidis Z2491
cugaaacgcauucagacg

SEQ ID NO: 1373202 - RNA, 19 nt, Neisseria meningitidis Z2491
cugaaacgcauucagacgg

SEQ ID NO: 1373203 - RNA, 18 nt, Neisseria meningitidis Z2491
cucgggcugaaucgccaa

SEQ ID NO: 1373204 - RNA, 19 nt, Neisseria meningitidis Z2491
cugauuuuuguuaauccac

SEQ ID NO: 1373205 - RNA, 23 nt, Neisseria meningitidis Z2491
cugauuuaaaaccauaaggcuuu

SEQ ID NO: 1373206 - RNA, 20 nt, Neisseria meningitidis Z2491
cugauuuaaauuuaauccac

SEQ ID NO: 1373207 - RNA, 20 nt, Neisseria meningitidis Z2491
cugauuuaaauuuaauccgc

SEQ ID NO: 1373208 - RNA, 17 nt, Neisseria meningitidis Z2491
cugauuucguaauccgc

SEQ ID NO: 1373209 - RNA, 20 nt, Neisseria meningitidis Z2491
cugauggcugaugacggcag

SEQ ID NO: 1373210 - RNA, 22 nt, Neisseria meningitidis Z2491
cugaagcccacccuaccauugu

SEQ ID NO: 1373211 - RNA, 17 nt, Neisseria meningitidis Z2491
cugaagccuucagacgg

SEQ ID NO: 1373212 - RNA, 19 nt, Neisseria meningitidis Z2491
cugaagcccuuucagacgg

SEQ ID NO: 1373213 - RNA, 12 nt, Neisseria meningitidis Z2491
cugaagcguguu

SEQ ID NO: 1373214 - RNA, 16 nt, Neisseria meningitidis Z2491
cugagaacuucagacg

SEQ ID NO: 1373215 - RNA, 20 nt, Neisseria meningitidis Z2491
cucgcguauccagccgccau

SEQ ID NO: 1373216 - RNA, 23 nt, Neisseria meningitidis Z2491
cucgcuugcugguaacauuaacg

SEQ ID NO: 1373217 - RNA, 18 nt, Neisseria meningitidis Z2491
cuauuuucagauggccuu

SEQ ID NO: 1373218 - RNA, 22 nt, Neisseria meningitidis Z2491
cucaaaaaaacuagauucccac

SEQ ID NO: 1373219 - RNA, 21 nt, Neisseria meningitidis Z2491
cucaaaaaaccggauucccgc

SEQ ID NO: 1373220 - RNA, 21 nt, Neisseria meningitidis Z2491
cucaaaaaacuggauucccac

SEQ ID NO: 1373221 - RNA, 19 nt, Neisseria meningitidis Z2491
cucaaaaagcuggauuccc

SEQ ID NO: 1373222 - RNA, 23 nt, Neisseria meningitidis Z2491
cuaggggcgguuugcggcggcaa

SEQ ID NO: 1373223 - RNA, 18 nt, Neisseria meningitidis Z2491
cuauccgcacagaaaccu

SEQ ID NO: 1373224 - RNA, 18 nt, Neisseria meningitidis Z2491
cuaaucgcgucauuccca

SEQ ID NO: 1373225 - RNA, 18 nt, Neisseria meningitidis Z2491
cuaaucccgucauuccca

SEQ ID NO: 1373226 - RNA, 19 nt, Neisseria meningitidis Z2491
cuaaucccgucauucccac

SEQ ID NO: 1373227 - RNA, 22 nt, Neisseria meningitidis Z2491
cuaaggucuagauucccgccug

SEQ ID NO: 1373228 - RNA, 16 nt, Neisseria meningitidis Z2491
cguuccgaaaccaaga

SEQ ID NO: 1373229 - RNA, 18 nt, Neisseria meningitidis Z2491
cguuuccuccucgccguc

SEQ ID NO: 1373230 - RNA, 14 nt, Neisseria meningitidis Z2491
cguuugccgccaua

SEQ ID NO: 1373231 - RNA, 17 nt, Neisseria meningitidis Z2491
cuaaaggcuucagacgg

SEQ ID NO: 1373232 - RNA, 15 nt, Neisseria meningitidis Z2491
cuaaacuuucagaua

SEQ ID NO: 1373233 - RNA, 22 nt, Neisseria meningitidis Z2491
cuaaccagccaaccuuaacaau

SEQ ID NO: 1373234 - RNA, 21 nt, Neisseria meningitidis Z2491
cuaaaaucccgucauucccgc

SEQ ID NO: 1373235 - RNA, 20 nt, Neisseria meningitidis Z2491
cuaaaauccgucauucccgc

SEQ ID NO: 1373236 - RNA, 21 nt, Neisseria meningitidis Z2491
cuaaaagcaaaaaggccgucu

SEQ ID NO: 1373237 - RNA, 20 nt, Neisseria meningitidis Z2491
cuaaaauucgucauucccac

SEQ ID NO: 1373238 - RNA, 20 nt, Neisseria meningitidis Z2491
cuaaaauucgucauucccgc

SEQ ID NO: 1373239 - RNA, 14 nt, Neisseria meningitidis Z2491
cguuucagacggca

SEQ ID NO: 1373240 - RNA, 15 nt, Neisseria meningitidis Z2491
cguuucagacgguau

SEQ ID NO: 1373241 - RNA, 23 nt, Neisseria meningitidis Z2491
cgucugaaaggcuucagacggca

SEQ ID NO: 1373242 - RNA, 22 nt, Neisseria meningitidis Z2491
cgucugaacgcuucagacggca

SEQ ID NO: 1373243 - RNA, 22 nt, Neisseria meningitidis Z2491
cgucugaagccuucagacggca

SEQ ID NO: 1373244 - RNA, 22 nt, Neisseria meningitidis Z2491
cgucugaaggcuucagacggca

SEQ ID NO: 1373245 - RNA, 16 nt, Neisseria meningitidis Z2491
cgucgggauucagaug

SEQ ID NO: 1373246 - RNA, 17 nt, Neisseria meningitidis Z2491
cgugagcuuuugcagaa

SEQ ID NO: 1373247 - RNA, 21 nt, Neisseria meningitidis Z2491
cgucggcagucuguaccgcau

SEQ ID NO: 1373248 - RNA, 15 nt, Neisseria meningitidis Z2491
cguaucggcggcaag

SEQ ID NO: 1373249 - RNA, 16 nt, Neisseria meningitidis Z2491
cguacaucaggcggcg

SEQ ID NO: 1373250 - RNA, 20 nt, Neisseria meningitidis Z2491
cguaggaugccuagauggcg

SEQ ID NO: 1373251 - RNA, 22 nt, Neisseria meningitidis Z2491
cgguguaacggauaaaguuuga

SEQ ID NO: 1373252 - RNA, 17 nt, Neisseria meningitidis Z2491
cgguuacuggauucccg

SEQ ID NO: 1373253 - RNA, 18 nt, Neisseria meningitidis Z2491
cgguuuuuucugccaaua

SEQ ID NO: 1373254 - RNA, 12 nt, Neisseria meningitidis Z2491
cgguggcggcau

SEQ ID NO: 1373255 - RNA, 16 nt, Neisseria meningitidis Z2491
cggugcgguagccgcc

SEQ ID NO: 1373256 - RNA, 15 nt, Neisseria meningitidis Z2491
cugugguuugccgag

SEQ ID NO: 1373257 - RNA, 15 nt, Neisseria meningitidis Z2491
cuguguugcggauga

SEQ ID NO: 1373258 - RNA, 18 nt, Neisseria meningitidis Z2491
cugucucggcagcggcau

SEQ ID NO: 1373259 - RNA, 15 nt, Neisseria meningitidis Z2491
cuucaacagacggcg

SEQ ID NO: 1373260 - RNA, 23 nt, Neisseria meningitidis Z2491
cuguuggaaaaacugggcggauc

SEQ ID NO: 1373261 - RNA, 17 nt, Neisseria meningitidis Z2491
cuguuucagacggcauu

SEQ ID NO: 1373262 - RNA, 20 nt, Neisseria meningitidis Z2491
cuuaagauuuguggcggauu

SEQ ID NO: 1373263 - RNA, 21 nt, Neisseria meningitidis Z2491
cuucuuugcugacaaucggcu

SEQ ID NO: 1373264 - RNA, 15 nt, Neisseria meningitidis Z2491
cuucuucgagggcau

SEQ ID NO: 1373265 - RNA, 16 nt, Neisseria meningitidis Z2491
cuucgccgagucggcg

SEQ ID NO: 1373266 - RNA, 17 nt, Neisseria meningitidis Z2491
gaaaaaaugccgucuga

SEQ ID NO: 1373267 - RNA, 15 nt, Neisseria meningitidis Z2491
gaaaaaaaaucguuc

SEQ ID NO: 1373268 - RNA, 14 nt, Neisseria meningitidis Z2491
gaaaauaccguuga

SEQ ID NO: 1373269 - RNA, 19 nt, Neisseria meningitidis Z2491
gaaacagguuucagacggc

SEQ ID NO: 1373270 - RNA, 23 nt, Neisseria meningitidis Z2491
gaaaccguauauuucccgucugc

SEQ ID NO: 1373271 - RNA, 19 nt, Neisseria meningitidis Z2491
gaaacccgucauucccacg

SEQ ID NO: 1373272 - RNA, 15 nt, Neisseria meningitidis Z2491
cuuucacggcggcaa

SEQ ID NO: 1373273 - RNA, 14 nt, Neisseria meningitidis Z2491
cuuucagacggccu

SEQ ID NO: 1373274 - RNA, 21 nt, Neisseria meningitidis Z2491
cuuucccguuucagacggcau

SEQ ID NO: 1373275 - RNA, 21 nt, Neisseria meningitidis Z2491
cuuugcccguggcgacggcaa

SEQ ID NO: 1373276 - RNA, 17 nt, Neisseria meningitidis Z2491
cuuugaauauugccgcc

SEQ ID NO: 1373277 - RNA, 16 nt, Neisseria meningitidis Z2491
cuuugagcuaaggcga

SEQ ID NO: 1373278 - RNA, 21 nt, Neisseria meningitidis Z2491
cuuucgugggaaugacggcag

SEQ ID NO: 1373279 - RNA, 21 nt, Neisseria meningitidis Z2491
cuuucgugggaaugacgggau

SEQ ID NO: 1373280 - RNA, 21 nt, Neisseria meningitidis Z2491
cuuucgcgggaaugacgggau

SEQ ID NO: 1373281 - RNA, 21 nt, Neisseria meningitidis Z2491
cuuggagauucuagauucccg

SEQ ID NO: 1373282 - RNA, 19 nt, Neisseria meningitidis Z2491
cugcucuacgauaacgccg

SEQ ID NO: 1373283 - RNA, 19 nt, Neisseria meningitidis Z2491
cugcgcgggaaugacggau

SEQ ID NO: 1373284 - RNA, 20 nt, Neisseria meningitidis Z2491
cugcgcgggaaugacggcag

SEQ ID NO: 1373285 - RNA, 14 nt, Neisseria meningitidis Z2491
cugcggacguugug

SEQ ID NO: 1373286 - RNA, 22 nt, Neisseria meningitidis Z2491
cugcuuuggcagcacaggcaag

SEQ ID NO: 1373287 - RNA, 11 nt, Neisseria meningitidis Z2491
cuggauuccca

SEQ ID NO: 1373288 - RNA, 20 nt, Neisseria meningitidis Z2491
gaaugccgcaaaugccgucu

SEQ ID NO: 1373289 - RNA, 14 nt, Neisseria meningitidis Z2491
gaauauugccgucg

SEQ ID NO: 1373290 - RNA, 21 nt, Neisseria meningitidis Z2491
gaaucggguuucagacggcau

SEQ ID NO: 1373291 - RNA, 17 nt, Neisseria meningitidis Z2491
gaaguuucagacggcau

SEQ ID NO: 1373292 - RNA, 11 nt, Neisseria meningitidis Z2491
gacagacggcc

SEQ ID NO: 1373293 - RNA, 14 nt, Neisseria meningitidis Z2491
gaagcaucagcgga

SEQ ID NO: 1373294 - RNA, 19 nt, Neisseria meningitidis Z2491
gaagccuguuucagacggc

SEQ ID NO: 1373295 - RNA, 20 nt, Neisseria meningitidis Z2491
gaagccuguuucagacggca

SEQ ID NO: 1373296 - RNA, 20 nt, Neisseria meningitidis Z2491
gaagccgcuucagacggcau

SEQ ID NO: 1373297 - RNA, 19 nt, Neisseria meningitidis Z2491
gaagcucaaaaaaccggau

SEQ ID NO: 1373298 - RNA, 17 nt, Neisseria meningitidis Z2491
gaagcgguucagacggc

SEQ ID NO: 1373299 - RNA, 15 nt, Neisseria meningitidis Z2491
gaaaccugcaacguu

SEQ ID NO: 1373300 - RNA, 23 nt, Neisseria meningitidis Z2491
gaaaccuguaccguuucagacgg

SEQ ID NO: 1373301 - RNA, 21 nt, Neisseria meningitidis Z2491
gaaaccucguucggacggcau

SEQ ID NO: 1373302 - RNA, 18 nt, Neisseria meningitidis Z2491
gaaacgcauucagacggc

SEQ ID NO: 1373303 - RNA, 20 nt, Neisseria meningitidis Z2491
gaaacgcauucagacggcau

SEQ ID NO: 1373304 - RNA, 21 nt, Neisseria meningitidis Z2491
gaagacgauuugguugucagg

SEQ ID NO: 1373305 - RNA, 23 nt, Neisseria meningitidis Z2491
gaacgucgccccuuuaacggcaa

SEQ ID NO: 1373306 - RNA, 18 nt, Neisseria meningitidis Z2491
gacggugcgcggaugccg

SEQ ID NO: 1373307 - RNA, 22 nt, Neisseria meningitidis Z2491
gaccgccugcgcgcggacggau

SEQ ID NO: 1373308 - RNA, 23 nt, Neisseria meningitidis Z2491
gcauccguuuggaugccgucuga

SEQ ID NO: 1373309 - RNA, 15 nt, Neisseria meningitidis Z2491
gccaaugccgucuga

SEQ ID NO: 1373310 - RNA, 18 nt, Neisseria meningitidis Z2491
gccacgccgaacccgacu

SEQ ID NO: 1373311 - RNA, 15 nt, Neisseria meningitidis Z2491
gccccaguucuucga

SEQ ID NO: 1373312 - RNA, 22 nt, Neisseria meningitidis Z2491
gcccuguguuuauugagaaugc

SEQ ID NO: 1373313 - RNA, 20 nt, Neisseria meningitidis Z2491
gcccucucauuugccgaaca

SEQ ID NO: 1373314 - RNA, 13 nt, Neisseria meningitidis Z2491
gccgcacaaaccg

SEQ ID NO: 1373315 - RNA, 16 nt, Neisseria meningitidis Z2491
gccgacacacggauuu

SEQ ID NO: 1373316 - RNA, 13 nt, Neisseria meningitidis Z2491
gccgccgccgaca

SEQ ID NO: 1373317 - RNA, 13 nt, Neisseria meningitidis Z2491
gccgccuuugcca

SEQ ID NO: 1373318 - RNA, 22 nt, Neisseria meningitidis Z2491
gcaauauugcuccugacggcaa

SEQ ID NO: 1373319 - RNA, 12 nt, Neisseria meningitidis Z2491
gcaauacggcga

SEQ ID NO: 1373320 - RNA, 13 nt, Neisseria meningitidis Z2491
gcacagucggcau

SEQ ID NO: 1373321 - RNA, 19 nt, Neisseria meningitidis Z2491
gcaccacgucauucccacg

SEQ ID NO: 1373322 - RNA, 15 nt, Neisseria meningitidis Z2491
gcaucaucacgcuga

SEQ ID NO: 1373323 - RNA, 22 nt, Neisseria meningitidis Z2491
gcaggcgggaaucuagaaauga

SEQ ID NO: 1373324 - RNA, 21 nt, Neisseria meningitidis Z2491
gcagcuuuugcgccacggcau

SEQ ID NO: 1373325 - RNA, 15 nt, Neisseria meningitidis Z2491
gcagcuugacgacaa

SEQ ID NO: 1373326 - RNA, 15 nt, Neisseria meningitidis Z2491
gcaggcaaacgcgau

SEQ ID NO: 1373327 - RNA, 21 nt, Neisseria meningitidis Z2491
gcagcggaaaugguccgaacg

SEQ ID NO: 1373328 - RNA, 12 nt, Neisseria meningitidis Z2491
gcagcgacggau

SEQ ID NO: 1373329 - RNA, 17 nt, Neisseria meningitidis Z2491
gcaaaaaggccgucuga

SEQ ID NO: 1373330 - RNA, 13 nt, Neisseria meningitidis Z2491
gcaaaaccgccga

SEQ ID NO: 1373331 - RNA, 19 nt, Neisseria meningitidis Z2491
gcaaaaaaagaugccgucu

SEQ ID NO: 1373332 - RNA, 19 nt, Neisseria meningitidis Z2491
gcaaaacgccuucuucgca

SEQ ID NO: 1373333 - RNA, 14 nt, Neisseria meningitidis Z2491
gauuuucgacgcau

SEQ ID NO: 1373334 - RNA, 22 nt, Neisseria meningitidis Z2491
gaugccccacgccgauaccgau

SEQ ID NO: 1373335 - RNA, 11 nt, Neisseria meningitidis Z2491
gaugacggcag

SEQ ID NO: 1373336 - RNA, 15 nt, Neisseria meningitidis Z2491
gagcguucagacggc

SEQ ID NO: 1373337 - RNA, 20 nt, Neisseria meningitidis Z2491
gagcauaccguucaaacugc

SEQ ID NO: 1373338 - RNA, 16 nt, Neisseria meningitidis Z2491
gauaaggcaagcguuc

SEQ ID NO: 1373339 - RNA, 16 nt, Neisseria meningitidis Z2491
gaggaagcggcggcau

SEQ ID NO: 1373340 - RNA, 14 nt, Neisseria meningitidis Z2491
gaggaugacgguau

SEQ ID NO: 1373341 - RNA, 18 nt, Neisseria meningitidis Z2491
cgguaucaggcaguuuga

SEQ ID NO: 1373342 - RNA, 17 nt, Neisseria meningitidis Z2491
cggguucggacggcauu

SEQ ID NO: 1373343 - RNA, 13 nt, Neisseria meningitidis Z2491
cgggguaauccaa

SEQ ID NO: 1373344 - RNA, 12 nt, Neisseria meningitidis Z2491
cggguaacggca

SEQ ID NO: 1373345 - RNA, 16 nt, Neisseria meningitidis Z2491
cggcuucagacggcau

SEQ ID NO: 1373346 - RNA, 19 nt, Neisseria meningitidis Z2491
cggcuucaacagacggcgu

SEQ ID NO: 1373347 - RNA, 19 nt, Neisseria meningitidis Z2491
cggcugcugccuuggcgga

SEQ ID NO: 1373348 - RNA, 22 nt, Neisseria meningitidis Z2491
cggcugcugccuuggcggauaa

SEQ ID NO: 1373349 - RNA, 16 nt, Neisseria meningitidis Z2491
cggacuagauucccgc

SEQ ID NO: 1373350 - RNA, 19 nt, Neisseria meningitidis Z2491
cggagaggcuuucagacgg

SEQ ID NO: 1373351 - RNA, 21 nt, Neisseria meningitidis Z2491
cggagaggcuuucagacggcc

SEQ ID NO: 1373352 - RNA, 22 nt, Neisseria meningitidis Z2491
cggcauuuuuuauccucggcag

SEQ ID NO: 1373353 - RNA, 16 nt, Neisseria meningitidis Z2491
cggccaacaucagcau

SEQ ID NO: 1373354 - RNA, 23 nt, Neisseria meningitidis Z2491
cggcgaugccggaaauaccgacg

SEQ ID NO: 1373355 - RNA, 21 nt, Neisseria meningitidis Z2491
cgccccaaauaccgccuaauu

SEQ ID NO: 1373356 - RNA, 16 nt, Neisseria meningitidis Z2491
cgcguccaacacgcag

SEQ ID NO: 1373357 - RNA, 20 nt, Neisseria meningitidis Z2491
cgcguagccggccaacauca

SEQ ID NO: 1373358 - RNA, 19 nt, Neisseria meningitidis Z2491
cgcgucaaacagacggaau

SEQ ID NO: 1373359 - RNA, 16 nt, Neisseria meningitidis Z2491
cgcgcauuugguaaca

SEQ ID NO: 1373360 - RNA, 18 nt, Neisseria meningitidis Z2491
cgcgcaggguuuccacgu

SEQ ID NO: 1373361 - RNA, 22 nt, Neisseria meningitidis Z2491
cgcggcacacgcauuccgacag

SEQ ID NO: 1373362 - RNA, 11 nt, Neisseria meningitidis Z2491
cgcgcggauuc

SEQ ID NO: 1373363 - RNA, 13 nt, Neisseria meningitidis Z2491
ccgucauucccgc

SEQ ID NO: 1373364 - RNA, 18 nt, Neisseria meningitidis Z2491
ccgucagcacggggauuu

SEQ ID NO: 1373365 - RNA, 21 nt, Neisseria meningitidis Z2491
ccguauuugucuuccgccaaa

SEQ ID NO: 1373366 - RNA, 13 nt, Neisseria meningitidis Z2491
ccguaugccgccu

SEQ ID NO: 1373367 - RNA, 14 nt, Neisseria meningitidis Z2491
ccgucugaaaccgc

SEQ ID NO: 1373368 - RNA, 23 nt, Neisseria meningitidis Z2491
ccgucugaagccuucagacggca

SEQ ID NO: 1373369 - RNA, 23 nt, Neisseria meningitidis Z2491
ccguguuggguucuagauucccg

SEQ ID NO: 1373370 - RNA, 18 nt, Neisseria meningitidis Z2491
ccuccgccgucauucccg

SEQ ID NO: 1373371 - RNA, 18 nt, Neisseria meningitidis Z2491
ccuccaccgucauucccg

SEQ ID NO: 1373372 - RNA, 20 nt, Neisseria meningitidis Z2491
ccucagcuaugccugccgac

SEQ ID NO: 1373373 - RNA, 19 nt, Neisseria meningitidis Z2491
ccuacgaaccuacauuccg

SEQ ID NO: 1373374 - RNA, 20 nt, Neisseria meningitidis Z2491
ccugaacauuucagacggca

SEQ ID NO: 1373375 - RNA, 19 nt, Neisseria meningitidis Z2491
ccgauaagguuuauuugag

SEQ ID NO: 1373376 - RNA, 17 nt, Neisseria meningitidis Z2491
ccgacuucugacagcau

SEQ ID NO: 1373377 - RNA, 20 nt, Neisseria meningitidis Z2491
ccgacaaggcuggauucccg

SEQ ID NO: 1373378 - RNA, 20 nt, Neisseria meningitidis Z2491
ccgacggggcuggauucccg

SEQ ID NO: 1373379 - RNA, 21 nt, Neisseria meningitidis Z2491
ccgcguaucgcguaaggcaua

SEQ ID NO: 1373380 - RNA, 23 nt, Neisseria meningitidis Z2491
ccgcgauaaggcgcguccaacac

SEQ ID NO: 1373381 - RNA, 20 nt, Neisseria meningitidis Z2491
cgaaaugccgucauucccgc

SEQ ID NO: 1373382 - RNA, 17 nt, Neisseria meningitidis Z2491
cgaaccgucauucccgc

SEQ ID NO: 1373383 - RNA, 16 nt, Neisseria meningitidis Z2491
cgaaggcgaccgccug

SEQ ID NO: 1373384 - RNA, 15 nt, Neisseria meningitidis Z2491
cgaaucaacacgccu

SEQ ID NO: 1373385 - RNA, 13 nt, Neisseria meningitidis Z2491
cgacaaucaggcc

SEQ ID NO: 1373386 - RNA, 19 nt, Neisseria meningitidis Z2491
cgacagaccuagauucccg

SEQ ID NO: 1373387 - RNA, 17 nt, Neisseria meningitidis Z2491
ccuucgggcagcggcaa

SEQ ID NO: 1373388 - RNA, 16 nt, Neisseria meningitidis Z2491
ccuucagacggcauug

SEQ ID NO: 1373389 - RNA, 17 nt, Neisseria meningitidis Z2491
ccugucccccaccgccg

SEQ ID NO: 1373390 - RNA, 16 nt, Neisseria meningitidis Z2491
ccuuucgucauucccg

SEQ ID NO: 1373391 - RNA, 20 nt, Neisseria meningitidis Z2491
ccuuuccgccgucauucccg

SEQ ID NO: 1373392 - RNA, 14 nt, Neisseria meningitidis Z2491
cgaaauaucggcaa

SEQ ID NO: 1373393 - RNA, 21 nt, Neisseria meningitidis Z2491
ccuguaccguuucagacggca

SEQ ID NO: 1373394 - RNA, 21 nt, Neisseria meningitidis Z2491
ccugccguauuuauuuccgcc

SEQ ID NO: 1373395 - RNA, 20 nt, Neisseria meningitidis Z2491
cgacuucuuuuaagaacguc

SEQ ID NO: 1373396 - RNA, 10 nt, Neisseria meningitidis Z2491
cgagacggca

SEQ ID NO: 1373397 - RNA, 13 nt, Neisseria meningitidis Z2491
cgacgaagccgca

SEQ ID NO: 1373398 - RNA, 16 nt, Neisseria meningitidis Z2491
cgauuauaucggcaag

SEQ ID NO: 1373399 - RNA, 13 nt, Neisseria meningitidis Z2491
cgcaaccuugcca

SEQ ID NO: 1373400 - RNA, 16 nt, Neisseria meningitidis Z2491
cgauuucuuugccgcc

SEQ ID NO: 1373401 - RNA, 14 nt, Neisseria meningitidis Z2491
cgaguuuucagacg

SEQ ID NO: 1373402 - RNA, 15 nt, Neisseria meningitidis Z2491
cgcacuuagccuguu

SEQ ID NO: 1373403 - RNA, 17 nt, Neisseria meningitidis Z2491
cgcaccguuuuccaccg

SEQ ID NO: 1373404 - RNA, 19 nt, Neisseria meningitidis Z2491
cagauagcgcggacggcgg

SEQ ID NO: 1373405 - RNA, 21 nt, Neisseria meningitidis Z2491
cacgaagcccucagcuaugcc

SEQ ID NO: 1373406 - RNA, 17 nt, Neisseria meningitidis Z2491
cacuucaaccgcgaugu

SEQ ID NO: 1373407 - RNA, 17 nt, Neisseria meningitidis Z2491
cacggugugcaggcugc

SEQ ID NO: 1373408 - RNA, 24 nt, Neisseria meningitidis Z2491
cacggugugcaggcugccgcacaa

SEQ ID NO: 1373409 - RNA, 14 nt, Neisseria meningitidis Z2491
cacggguucagacg

SEQ ID NO: 1373410 - RNA, 11 nt, Neisseria meningitidis Z2491
caguucagacg

SEQ ID NO: 1373411 - RNA, 22 nt, Neisseria meningitidis Z2491
cagugccguuuugucugccgcc

SEQ ID NO: 1373412 - RNA, 21 nt, Neisseria meningitidis Z2491
cauaaaugcguuuugacaaaa

SEQ ID NO: 1373413 - RNA, 12 nt, Neisseria meningitidis Z2491
caguuuucaacc

SEQ ID NO: 1373414 - RNA, 15 nt, Neisseria meningitidis Z2491
cauacauagcaggca

SEQ ID NO: 1373415 - RNA, 18 nt, Neisseria meningitidis Z2491
caucauagaaaucagcgu

SEQ ID NO: 1373416 - RNA, 17 nt, Neisseria meningitidis Z2491
cauauccggcgcggcaa

SEQ ID NO: 1373417 - RNA, 21 nt, Neisseria meningitidis Z2491
cauauugacggacggcggcag

SEQ ID NO: 1373418 - RNA, 12 nt, Neisseria meningitidis Z2491
cauaugccgucu

SEQ ID NO: 1373419 - RNA, 14 nt, Neisseria meningitidis Z2491
cauaugccgucuga

SEQ ID NO: 1373420 - RNA, 16 nt, Neisseria meningitidis Z2491
caucacaauggcggaa

SEQ ID NO: 1373421 - RNA, 14 nt, Neisseria meningitidis Z2491
caguaaugccgccg

SEQ ID NO: 1373422 - RNA, 17 nt, Neisseria meningitidis Z2491
cagcuguacgcugaugu

SEQ ID NO: 1373423 - RNA, 21 nt, Neisseria meningitidis Z2491
cagcuuuugcgccacggcaua

SEQ ID NO: 1373424 - RNA, 23 nt, Neisseria meningitidis Z2491
cagcgugcggacguucaaacccu

SEQ ID NO: 1373425 - RNA, 19 nt, Neisseria meningitidis Z2491
ccaaaggccuggauucccg

SEQ ID NO: 1373426 - RNA, 17 nt, Neisseria meningitidis Z2491
ccaaaggucuggauucc

SEQ ID NO: 1373427 - RNA, 18 nt, Neisseria meningitidis Z2491
ccaaaggucuggauuccc

SEQ ID NO: 1373428 - RNA, 23 nt, Neisseria meningitidis Z2491
ccaaacccucggcauucccgcca

SEQ ID NO: 1373429 - RNA, 20 nt, Neisseria meningitidis Z2491
ccaaacccucgucauucucg

SEQ ID NO: 1373430 - RNA, 15 nt, Neisseria meningitidis Z2491
ccaaacagaacgcaa

SEQ ID NO: 1373431 - RNA, 17 nt, Neisseria meningitidis Z2491
cauugaaauucuagauu

SEQ ID NO: 1373432 - RNA, 18 nt, Neisseria meningitidis Z2491
cauucccacggaaguggg

SEQ ID NO: 1373433 - RNA, 23 nt, Neisseria meningitidis Z2491
cauucugcggauucugccaaacg

SEQ ID NO: 1373434 - RNA, 16 nt, Neisseria meningitidis Z2491
ccaacuggucaaucgu

SEQ ID NO: 1373435 - RNA, 14 nt, Neisseria meningitidis Z2491
caugauggcaacga

SEQ ID NO: 1373436 - RNA, 17 nt, Neisseria meningitidis Z2491
caucguccacuucaacc

SEQ ID NO: 1373437 - RNA, 21 nt, Neisseria meningitidis Z2491
caucguccacuucaaccgcga

SEQ ID NO: 1373438 - RNA, 18 nt, Neisseria meningitidis Z2491
ccacguucuagauucccg

SEQ ID NO: 1373439 - RNA, 21 nt, Neisseria meningitidis Z2491
ccagaccuuugggcggcggca

SEQ ID NO: 1373440 - RNA, 17 nt, Neisseria meningitidis Z2491
ccauuggacagcggcaa

SEQ ID NO: 1373441 - RNA, 14 nt, Neisseria meningitidis Z2491
cccaaugccgucug

SEQ ID NO: 1373442 - RNA, 15 nt, Neisseria meningitidis Z2491
ccaucgucauucccg

SEQ ID NO: 1373443 - RNA, 17 nt, Neisseria meningitidis Z2491
cccaucgucuagaggcc

SEQ ID NO: 1373444 - RNA, 20 nt, Neisseria meningitidis Z2491
cccacuuccgugggaaugac

SEQ ID NO: 1373445 - RNA, 15 nt, Neisseria meningitidis Z2491
ccccuuuaacggcaa

SEQ ID NO: 1373446 - RNA, 15 nt, Neisseria meningitidis Z2491
cccgauuuguccgac

SEQ ID NO: 1373447 - RNA, 17 nt, Neisseria meningitidis Z2491
ccgaaccgucauucccg

SEQ ID NO: 1373448 - RNA, 18 nt, Neisseria meningitidis Z2491
ccgaagcauaagccgcca

SEQ ID NO: 1373449 - RNA, 17 nt, Neisseria meningitidis Z2491
ccgaaagcgcggccuuu

SEQ ID NO: 1373450 - RNA, 15 nt, Neisseria meningitidis Z2491
ccgaaacauuccgcc

SEQ ID NO: 1373451 - RNA, 22 nt, Neisseria meningitidis Z2491
ccgaaaauacugaggaaaccau

SEQ ID NO: 1373452 - RNA, 20 nt, Neisseria meningitidis Z2491
cccuccugcgcgggaaugau

SEQ ID NO: 1373453 - RNA, 20 nt, Neisseria meningitidis Z2491
cccgcuuucacgggaaugac

SEQ ID NO: 1373454 - RNA, 15 nt, Neisseria meningitidis Z2491
cccgucccgaugccg

SEQ ID NO: 1373455 - RNA, 16 nt, Neisseria meningitidis Z2491
cccgucccgaugccgc

SEQ ID NO: 1373456 - RNA, 17 nt, Neisseria meningitidis Z2491
augccgucugaaaccgu

SEQ ID NO: 1373457 - RNA, 20 nt, Neisseria meningitidis Z2491
augccgucugaaacgggaau

SEQ ID NO: 1373458 - RNA, 18 nt, Neisseria meningitidis Z2491
augccgucugaacccgcc

SEQ ID NO: 1373459 - RNA, 22 nt, Neisseria meningitidis Z2491
augccgucauucccgcgaacgc

SEQ ID NO: 1373460 - RNA, 15 nt, Neisseria meningitidis Z2491
augccgaugucggcc

SEQ ID NO: 1373461 - RNA, 19 nt, Neisseria meningitidis Z2491
augccgcaaaugccgucug

SEQ ID NO: 1373462 - RNA, 15 nt, Neisseria meningitidis Z2491
augccuuuuucaaac

SEQ ID NO: 1373463 - RNA, 21 nt, Neisseria meningitidis Z2491
augccugcucaaauaggcauu

SEQ ID NO: 1373464 - RNA, 17 nt, Neisseria meningitidis Z2491
augcggacggcuuggau

SEQ ID NO: 1373465 - RNA, 18 nt, Neisseria meningitidis Z2491
augcguucaaaugccguc

SEQ ID NO: 1373466 - RNA, 21 nt, Neisseria meningitidis Z2491
aucugcagccgucauucccgc

SEQ ID NO: 1373467 - RNA, 14 nt, Neisseria meningitidis Z2491
augacggaguuuca

SEQ ID NO: 1373468 - RNA, 23 nt, Neisseria meningitidis Z2491
augacgggauauagguuuccgug

SEQ ID NO: 1373469 - RNA, 19 nt, Neisseria meningitidis Z2491
augcaaaaaauaugccguc

SEQ ID NO: 1373470 - RNA, 20 nt, Neisseria meningitidis Z2491
augauuuggguuucagacgg

SEQ ID NO: 1373471 - RNA, 17 nt, Neisseria meningitidis Z2491
augccauacugccugcc

SEQ ID NO: 1373472 - RNA, 20 nt, Neisseria meningitidis Z2491
auguuuuugcguucagacgg

SEQ ID NO: 1373473 - RNA, 21 nt, Neisseria meningitidis Z2491
auguuuuugcguucagacggc

SEQ ID NO: 1373474 - RNA, 17 nt, Neisseria meningitidis Z2491
auucaaaagccguguga

SEQ ID NO: 1373475 - RNA, 19 nt, Neisseria meningitidis Z2491
auggcugcuuuggcagcac

SEQ ID NO: 1373476 - RNA, 12 nt, Neisseria meningitidis Z2491
aucgaugccguu

SEQ ID NO: 1373477 - RNA, 13 nt, Neisseria meningitidis Z2491
aucgggcgggaau

SEQ ID NO: 1373478 - RNA, 22 nt, Neisseria meningitidis Z2491
aucggaggaguuugaugccguc

SEQ ID NO: 1373479 - RNA, 23 nt, Neisseria meningitidis Z2491
aucggaggaguuugaugccgucu

SEQ ID NO: 1373480 - RNA, 15 nt, Neisseria meningitidis Z2491
aucucauuuucaaaa

SEQ ID NO: 1373481 - RNA, 21 nt, Neisseria meningitidis Z2491
aucucgucccaaacaauccca

SEQ ID NO: 1373482 - RNA, 19 nt, Neisseria meningitidis Z2491
aucgugggacgguucggac

SEQ ID NO: 1373483 - RNA, 14 nt, Neisseria meningitidis Z2491
aucgucauucccgc

SEQ ID NO: 1373484 - RNA, 22 nt, Neisseria meningitidis Z2491
aucguauuggggcaaagcggca

SEQ ID NO: 1373485 - RNA, 18 nt, Neisseria meningitidis Z2491
auauugauacugccgucg

SEQ ID NO: 1373486 - RNA, 20 nt, Neisseria meningitidis Z2491
auccccgcgaaagcgggaau

SEQ ID NO: 1373487 - RNA, 15 nt, Neisseria meningitidis Z2491
auccccagcgaacgc

SEQ ID NO: 1373488 - RNA, 16 nt, Neisseria meningitidis Z2491
aucccgucauucccgc

SEQ ID NO: 1373489 - RNA, 15 nt, Neisseria meningitidis Z2491
auccgucauucccgc

SEQ ID NO: 1373490 - RNA, 20 nt, Neisseria meningitidis Z2491
auccgguuuuuugaguuuca

SEQ ID NO: 1373491 - RNA, 20 nt, Neisseria meningitidis Z2491
auccgguuuuuugaguuucc

SEQ ID NO: 1373492 - RNA, 15 nt, Neisseria meningitidis Z2491
auccagacauucaau

SEQ ID NO: 1373493 - RNA, 19 nt, Neisseria meningitidis Z2491
aucccauaaaaacgggaau

SEQ ID NO: 1373494 - RNA, 18 nt, Neisseria meningitidis Z2491
aucccacgggacuuugcg

SEQ ID NO: 1373495 - RNA, 13 nt, Neisseria meningitidis Z2491
auccauauccaaa

SEQ ID NO: 1373496 - RNA, 20 nt, Neisseria meningitidis Z2491
auucccgcgcaggcgggaau

SEQ ID NO: 1373497 - RNA, 20 nt, Neisseria meningitidis Z2491
auucccgcguucgcgggaau

SEQ ID NO: 1373498 - RNA, 20 nt, Neisseria meningitidis Z2491
auucccgcuuucgcgggaau

SEQ ID NO: 1373499 - RNA, 20 nt, Neisseria meningitidis Z2491
auucccgcuuuugcgagaau

SEQ ID NO: 1373500 - RNA, 20 nt, Neisseria meningitidis Z2491
auuuaaaucaguacggcguu

SEQ ID NO: 1373501 - RNA, 20 nt, Neisseria meningitidis Z2491
auuuaaauuuaauccacuau

SEQ ID NO: 1373502 - RNA, 20 nt, Neisseria meningitidis Z2491
auuuaaauuuaauccgcuau

SEQ ID NO: 1373503 - RNA, 20 nt, Neisseria meningitidis Z2491
auuuaaauuuaauucacuau

SEQ ID NO: 1373504 - RNA, 20 nt, Neisseria meningitidis Z2491
auucccacuuuugugggaau

SEQ ID NO: 1373505 - RNA, 22 nt, Neisseria meningitidis Z2491
auucccgccacacccccgucau

SEQ ID NO: 1373506 - RNA, 20 nt, Neisseria meningitidis Z2491
auucccgccugcgcgggaau

SEQ ID NO: 1373507 - RNA, 20 nt, Neisseria meningitidis Z2491
auucccgcgaaagagggaau

SEQ ID NO: 1373508 - RNA, 20 nt, Neisseria meningitidis Z2491
auucccgcgaaagcgggaau

SEQ ID NO: 1373509 - RNA, 20 nt, Neisseria meningitidis Z2491
auucccgcgaacgcgggaau

SEQ ID NO: 1373510 - RNA, 17 nt, Neisseria meningitidis Z2491
auuuagauaaugugcgg

SEQ ID NO: 1373511 - RNA, 12 nt, Neisseria meningitidis Z2491
auuucagacggc

SEQ ID NO: 1373512 - RNA, 15 nt, Neisseria meningitidis Z2491
auuucagacggcauu

SEQ ID NO: 1373513 - RNA, 18 nt, Neisseria meningitidis Z2491
auuucagauugcgggcau

SEQ ID NO: 1373514 - RNA, 22 nt, Neisseria meningitidis Z2491
auuucugauaaacccccgucau

SEQ ID NO: 1373515 - RNA, 19 nt, Neisseria meningitidis Z2491
auuucgcuuucgggcgcau

SEQ ID NO: 1373516 - RNA, 11 nt, Neisseria meningitidis Z2491
auuugucggca

SEQ ID NO: 1373517 - RNA, 18 nt, Neisseria meningitidis Z2491
caaaaagcuggauuccca

SEQ ID NO: 1373518 - RNA, 15 nt, Neisseria meningitidis Z2491
caaaaaucaggacaa

SEQ ID NO: 1373519 - RNA, 15 nt, Neisseria meningitidis Z2491
caaaaacagaaaccu

SEQ ID NO: 1373520 - RNA, 15 nt, Neisseria meningitidis Z2491
caaaaacaucagcca

SEQ ID NO: 1373521 - RNA, 14 nt, Neisseria meningitidis Z2491
caaaaacggcacgg

SEQ ID NO: 1373522 - RNA, 19 nt, Neisseria meningitidis Z2491
caaaaacggcacggcgcag

SEQ ID NO: 1373523 - RNA, 20 nt, Neisseria meningitidis Z2491
caaaaacgaagagcggcagg

SEQ ID NO: 1373524 - RNA, 18 nt, Neisseria meningitidis Z2491
caaaaaacuggauuccca

SEQ ID NO: 1373525 - RNA, 18 nt, Neisseria meningitidis Z2491
caaaaaaccguauucccg

SEQ ID NO: 1373526 - RNA, 22 nt, Neisseria meningitidis Z2491
auuuuuuggcuuugaagccgag

SEQ ID NO: 1373527 - RNA, 16 nt, Neisseria meningitidis Z2491
auuuuuuuauuuaaac

SEQ ID NO: 1373528 - RNA, 18 nt, Neisseria meningitidis Z2491
auuuuagauggcgggaau

SEQ ID NO: 1373529 - RNA, 16 nt, Neisseria meningitidis Z2491
auuuuauguuucaaac

SEQ ID NO: 1373530 - RNA, 21 nt, Neisseria meningitidis Z2491
caaaauaugccgucauucccg

SEQ ID NO: 1373531 - RNA, 22 nt, Neisseria meningitidis Z2491
caaaauaugccgucauucccgc

SEQ ID NO: 1373532 - RNA, 15 nt, Neisseria meningitidis Z2491
caaaaucagaaaccu

SEQ ID NO: 1373533 - RNA, 17 nt, Neisseria meningitidis Z2491
caaaaucggcauucucg

SEQ ID NO: 1373534 - RNA, 19 nt, Neisseria meningitidis Z2491
caaaaucggccauucccuc

SEQ ID NO: 1373535 - RNA, 19 nt, Neisseria meningitidis Z2491
caaaauccgcaaacggcag

SEQ ID NO: 1373536 - RNA, 16 nt, Neisseria meningitidis Z2491
caaaaaugccgucuga

SEQ ID NO: 1373537 - RNA, 20 nt, Neisseria meningitidis Z2491
caaaaaugccgucugaaacg

SEQ ID NO: 1373538 - RNA, 22 nt, Neisseria meningitidis Z2491
caaaaccgaugcagaacggcgg

SEQ ID NO: 1373539 - RNA, 19 nt, Neisseria meningitidis Z2491
caaacggguuucagacggc

SEQ ID NO: 1373540 - RNA, 23 nt, Neisseria meningitidis Z2491
caagauuuccgccgucauucccg

SEQ ID NO: 1373541 - RNA, 20 nt, Neisseria meningitidis Z2491
caaggaugccguuucagacg

SEQ ID NO: 1373542 - RNA, 22 nt, Neisseria meningitidis Z2491
caaggaugccguuucagacggc

SEQ ID NO: 1373543 - RNA, 17 nt, Neisseria meningitidis Z2491
caagccgccgaugcgga

SEQ ID NO: 1373544 - RNA, 13 nt, Neisseria meningitidis Z2491
caacugaaaccgc

SEQ ID NO: 1373545 - RNA, 19 nt, Neisseria meningitidis Z2491
caagaacaggcggcggcau

SEQ ID NO: 1373546 - RNA, 12 nt, Neisseria meningitidis Z2491
caacagacggcg

SEQ ID NO: 1373547 - RNA, 23 nt, Neisseria meningitidis Z2491
caacgcgcaucgcgcccaaggcu

SEQ ID NO: 1373548 - RNA, 22 nt, Neisseria meningitidis Z2491
caauucuucuuuauauucgacc

SEQ ID NO: 1373549 - RNA, 15 nt, Neisseria meningitidis Z2491
caaugaaaguuugcc

SEQ ID NO: 1373550 - RNA, 20 nt, Neisseria meningitidis Z2491
cacaaaagauacacacaccg

SEQ ID NO: 1373551 - RNA, 17 nt, Neisseria meningitidis Z2491
cacaaacgccagcacaa

SEQ ID NO: 1373552 - RNA, 16 nt, Neisseria meningitidis Z2491
cacauaauucaaaugc

SEQ ID NO: 1373553 - RNA, 22 nt, Neisseria meningitidis Z2491
cacagguuuucgucuauuuucg

SEQ ID NO: 1373554 - RNA, 19 nt, Neisseria meningitidis Z2491
aggcuucgagugcuucguc

SEQ ID NO: 1373555 - RNA, 14 nt, Neisseria meningitidis Z2491
aggcuucagacggc

SEQ ID NO: 1373556 - RNA, 15 nt, Neisseria meningitidis Z2491
aggcuucagacggca

SEQ ID NO: 1373557 - RNA, 17 nt, Neisseria meningitidis Z2491
aggcuucagacggcauu

SEQ ID NO: 1373558 - RNA, 12 nt, Neisseria meningitidis Z2491
aggcaagcguuc

SEQ ID NO: 1373559 - RNA, 16 nt, Neisseria meningitidis Z2491
aggcagugccgccaaa

SEQ ID NO: 1373560 - RNA, 22 nt, Neisseria meningitidis Z2491
agcuuuagagauucuggauucc

SEQ ID NO: 1373561 - RNA, 20 nt, Neisseria meningitidis Z2491
aggaaaaaacauaugccguc

SEQ ID NO: 1373562 - RNA, 20 nt, Neisseria meningitidis Z2491
agcuuuugcgccacggcaua

SEQ ID NO: 1373563 - RNA, 13 nt, Neisseria meningitidis Z2491
agcuucgucauuc

SEQ ID NO: 1373564 - RNA, 20 nt, Neisseria meningitidis Z2491
auauugacggacggcggcag

SEQ ID NO: 1373565 - RNA, 22 nt, Neisseria meningitidis Z2491
auauuccaccaucucuaagauu

SEQ ID NO: 1373566 - RNA, 22 nt, Neisseria meningitidis Z2491
auauaguggauuaaauuuaaac

SEQ ID NO: 1373567 - RNA, 18 nt, Neisseria meningitidis Z2491
auauacaaaaugccgucu

SEQ ID NO: 1373568 - RNA, 22 nt, Neisseria meningitidis Z2491
auaguugcgguaauuuccgacc

SEQ ID NO: 1373569 - RNA, 19 nt, Neisseria meningitidis Z2491
auagcgcggacggcggcag

SEQ ID NO: 1373570 - RNA, 13 nt, Neisseria meningitidis Z2491
auagaaucuuucc

SEQ ID NO: 1373571 - RNA, 18 nt, Neisseria meningitidis Z2491
auacgguuuuccgccuga

SEQ ID NO: 1373572 - RNA, 19 nt, Neisseria meningitidis Z2491
auaaccgccuucuuugccg

SEQ ID NO: 1373573 - RNA, 15 nt, Neisseria meningitidis Z2491
aguuugaugccgucu

SEQ ID NO: 1373574 - RNA, 20 nt, Neisseria meningitidis Z2491
auaauacaaaaaugccgucu

SEQ ID NO: 1373575 - RNA, 15 nt, Neisseria meningitidis Z2491
auaccaaacggcaua

SEQ ID NO: 1373576 - RNA, 16 nt, Neisseria meningitidis Z2491
auacaaaaaugccguc

SEQ ID NO: 1373577 - RNA, 15 nt, Neisseria meningitidis Z2491
auacaaaaugccguc

SEQ ID NO: 1373578 - RNA, 17 nt, Neisseria meningitidis Z2491
auacaaaugccgucuga

SEQ ID NO: 1373579 - RNA, 18 nt, Neisseria meningitidis Z2491
auaccugcaaugccgucu

SEQ ID NO: 1373580 - RNA, 18 nt, Neisseria meningitidis Z2491
auaccguuuggcggcauu

SEQ ID NO: 1373581 - RNA, 17 nt, Neisseria meningitidis Z2491
auacggacgggaaguuu

SEQ ID NO: 1373582 - RNA, 14 nt, Neisseria meningitidis Z2491
aguuucagucauuc

SEQ ID NO: 1373583 - RNA, 18 nt, Neisseria meningitidis Z2491
aguguuuucaagaacagg

SEQ ID NO: 1373584 - RNA, 14 nt, Neisseria meningitidis Z2491
agaaaugacugaaa

SEQ ID NO: 1373585 - RNA, 14 nt, Neisseria meningitidis Z2491
agaacuucagacgg

SEQ ID NO: 1373586 - RNA, 18 nt, Neisseria meningitidis Z2491
agaaugaaaaugccgucu

SEQ ID NO: 1373587 - RNA, 19 nt, Neisseria meningitidis Z2491
agacaaaugccgucugaaa

SEQ ID NO: 1373588 - RNA, 10 nt, Neisseria meningitidis Z2491
agacggcauc

SEQ ID NO: 1373589 - RNA, 20 nt, Neisseria meningitidis Z2491
agacggcauuuugauugccg

SEQ ID NO: 1373590 - RNA, 19 nt, Neisseria meningitidis Z2491
agacggcauuuuguugccg

SEQ ID NO: 1373591 - RNA, 22 nt, Neisseria meningitidis Z2491
agacggcauuuuguugccgucg

SEQ ID NO: 1373592 - RNA, 17 nt, Neisseria meningitidis Z2491
agauaaaaauaccgucu

SEQ ID NO: 1373593 - RNA, 19 nt, Neisseria meningitidis Z2491
agaccauuggacagcggca

SEQ ID NO: 1373594 - RNA, 19 nt, Neisseria meningitidis Z2491
agaccuucgggcagcggca

SEQ ID NO: 1373595 - RNA, 20 nt, Neisseria meningitidis Z2491
agacgacagagcgccgucuc

SEQ ID NO: 1373596 - RNA, 16 nt, Neisseria meningitidis Z2491
agcauugcaauccuca

SEQ ID NO: 1373597 - RNA, 17 nt, Neisseria meningitidis Z2491
agcaguuugaugccgug

SEQ ID NO: 1373598 - RNA, 18 nt, Neisseria meningitidis Z2491
agcaguuugaugccgugu

SEQ ID NO: 1373599 - RNA, 19 nt, Neisseria meningitidis Z2491
agcaaaauaaaaugccguc

SEQ ID NO: 1373600 - RNA, 19 nt, Neisseria meningitidis Z2491
agcaaaagaccgucugaac

SEQ ID NO: 1373601 - RNA, 15 nt, Neisseria meningitidis Z2491
agcaaaaaugccguc

SEQ ID NO: 1373602 - RNA, 23 nt, Neisseria meningitidis Z2491
agcaaacgguauuggaugcgguc

SEQ ID NO: 1373603 - RNA, 23 nt, Neisseria meningitidis Z2491
agcgguuucuguuuuuuccgaua

SEQ ID NO: 1373604 - RNA, 12 nt, Neisseria meningitidis Z2491
agcgagacggca

SEQ ID NO: 1373605 - RNA, 18 nt, Neisseria meningitidis Z2491
agccgcuucagacggcau

SEQ ID NO: 1373606 - RNA, 18 nt, Neisseria meningitidis Z2491
agcccuuucagacggcau

SEQ ID NO: 1373607 - RNA, 19 nt, Neisseria meningitidis Z2491
agcccuuucagacggcauu

SEQ ID NO: 1373608 - RNA, 18 nt, Neisseria meningitidis Z2491
agccggccaacaucagca

SEQ ID NO: 1373609 - RNA, 21 nt, Neisseria meningitidis Z2491
agccggcgauauuguguaccg

SEQ ID NO: 1373610 - RNA, 22 nt, Neisseria meningitidis Z2491
agccuguuggccgcuuucaaaa

SEQ ID NO: 1373611 - RNA, 14 nt, Neisseria meningitidis Z2491
agccuucagacggc

SEQ ID NO: 1373612 - RNA, 15 nt, Neisseria meningitidis Z2491
agccuucagacggca

SEQ ID NO: 1373613 - RNA, 14 nt, Neisseria meningitidis Z2491
guuucagacggcau

SEQ ID NO: 1373614 - RNA, 19 nt, Neisseria meningitidis Z2491
uaaaauucuagauuccugc

SEQ ID NO: 1373615 - RNA, 20 nt, Neisseria meningitidis Z2491
uaaaauuucaucauucccac

SEQ ID NO: 1373616 - RNA, 20 nt, Neisseria meningitidis Z2491
uaaaauuccguuauucccgc

SEQ ID NO: 1373617 - RNA, 17 nt, Neisseria meningitidis Z2491
uaaacagcacugccucu

SEQ ID NO: 1373618 - RNA, 19 nt, Neisseria meningitidis Z2491
uaaagaaccggauucccgc

SEQ ID NO: 1373619 - RNA, 16 nt, Neisseria meningitidis Z2491
uaaaggcuucagacgg

SEQ ID NO: 1373620 - RNA, 19 nt, Neisseria meningitidis Z2491
uaaauuuaaaccaguacgg

SEQ ID NO: 1373621 - RNA, 19 nt, Neisseria meningitidis Z2491
uaaauuuccagauucccgc

SEQ ID NO: 1373622 - RNA, 15 nt, Neisseria meningitidis Z2491
uaaauucaucgcgcu

SEQ ID NO: 1373623 - RNA, 19 nt, Neisseria meningitidis Z2491
uaaaucgggucgaaaccgg

SEQ ID NO: 1373624 - RNA, 14 nt, Neisseria meningitidis Z2491
uaauaaacgccaua

SEQ ID NO: 1373625 - RNA, 17 nt, Neisseria meningitidis Z2491
uaaucauguugccguca

SEQ ID NO: 1373626 - RNA, 20 nt, Neisseria meningitidis Z2491
uaaugacaugguuugcaguc

SEQ ID NO: 1373627 - RNA, 19 nt, Neisseria meningitidis Z2491
guugucggaacagcaucaa

SEQ ID NO: 1373628 - RNA, 23 nt, Neisseria meningitidis Z2491
guuggaaaaguacaaaaugccgu

SEQ ID NO: 1373629 - RNA, 23 nt, Neisseria meningitidis Z2491
guuggaaagcguguuccgcaucg

SEQ ID NO: 1373630 - RNA, 13 nt, Neisseria meningitidis Z2491
guucggacggcau

SEQ ID NO: 1373631 - RNA, 16 nt, Neisseria meningitidis Z2491
guucggcaaacggcag

SEQ ID NO: 1373632 - RNA, 17 nt, Neisseria meningitidis Z2491
guucguaggaaugacgu

SEQ ID NO: 1373633 - RNA, 16 nt, Neisseria meningitidis Z2491
guucgucaaccgugaa

SEQ ID NO: 1373634 - RNA, 17 nt, Neisseria meningitidis Z2491
guucgugggaaugacgg

SEQ ID NO: 1373635 - RNA, 15 nt, Neisseria meningitidis Z2491
guugaccagaccgau

SEQ ID NO: 1373636 - RNA, 15 nt, Neisseria meningitidis Z2491
guugaaugugcgcca

SEQ ID NO: 1373637 - RNA, 23 nt, Neisseria meningitidis Z2491
aaguguuuucaagaacaggcggc

SEQ ID NO: 1373638 - RNA, 13 nt, Neisseria meningitidis Z2491
guguaaucgacgg

SEQ ID NO: 1373639 - RNA, 14 nt, Neisseria meningitidis Z2491
gugucagacggcau

SEQ ID NO: 1373640 - RNA, 22 nt, Neisseria meningitidis Z2491
guggcuaacguacaaaugccgu

SEQ ID NO: 1373641 - RNA, 13 nt, Neisseria meningitidis Z2491
guggcgacggcaa

SEQ ID NO: 1373642 - RNA, 17 nt, Neisseria meningitidis Z2491
aaguggguucgucaaac

SEQ ID NO: 1373643 - RNA, 16 nt, Neisseria meningitidis Z2491
gucggcguaggcggcg

SEQ ID NO: 1373644 - RNA, 12 nt, Neisseria meningitidis Z2491
ucagacggcauu

SEQ ID NO: 1373645 - RNA, 19 nt, Neisseria meningitidis Z2491
aauacaaaaggccgucuga

SEQ ID NO: 1373646 - RNA, 22 nt, Neisseria meningitidis Z2491
aauacaacaaaaugccgccuga

SEQ ID NO: 1373647 - RNA, 21 nt, Neisseria meningitidis Z2491
ucagcauauagugguuuuccg

SEQ ID NO: 1373648 - RNA, 18 nt, Neisseria meningitidis Z2491
ucagcacggggauuuucg

SEQ ID NO: 1373649 - RNA, 20 nt, Neisseria meningitidis Z2491
ucaacgcacuggauucccgc

SEQ ID NO: 1373650 - RNA, 23 nt, Neisseria meningitidis Z2491
uccaaaaccgugcugucgguuuc

SEQ ID NO: 1373651 - RNA, 14 nt, Neisseria meningitidis Z2491
ucagucauucccga

SEQ ID NO: 1373652 - RNA, 19 nt, Neisseria meningitidis Z2491
ucagucauuuccgauaaau

SEQ ID NO: 1373653 - RNA, 18 nt, Neisseria meningitidis Z2491
ucaggcuucagacggcau

SEQ ID NO: 1373654 - RNA, 19 nt, Neisseria meningitidis Z2491
uaccgacggcguaauccgc

SEQ ID NO: 1373655 - RNA, 17 nt, Neisseria meningitidis Z2491
uacccgauaaguuuccg

SEQ ID NO: 1373656 - RNA, 17 nt, Neisseria meningitidis Z2491
uacaaaaugccgucuga

SEQ ID NO: 1373657 - RNA, 17 nt, Neisseria meningitidis Z2491
uacaaaaggccgucuga

SEQ ID NO: 1373658 - RNA, 18 nt, Neisseria meningitidis Z2491
uacaaaaaugccgucuga

SEQ ID NO: 1373659 - RNA, 20 nt, Neisseria meningitidis Z2491
uaccguuucagacggcauuu

SEQ ID NO: 1373660 - RNA, 10 nt, Neisseria meningitidis Z2491
uacuggauuc

SEQ ID NO: 1373661 - RNA, 12 nt, Neisseria meningitidis Z2491
uacuggauuccc

SEQ ID NO: 1373662 - RNA, 21 nt, Neisseria meningitidis Z2491
uacugguuuaaauuuaaucca

SEQ ID NO: 1373663 - RNA, 20 nt, Neisseria meningitidis Z2491
uauaacuugauauugcggcu

SEQ ID NO: 1373664 - RNA, 21 nt, Neisseria meningitidis Z2491
uauagccgccccaaugcggcg

SEQ ID NO: 1373665 - RNA, 21 nt, Neisseria meningitidis Z2491
uaguggauuaaauuuaaacca

SEQ ID NO: 1373666 - RNA, 21 nt, Neisseria meningitidis Z2491
uaguggauuaacuuuaaacca

SEQ ID NO: 1373667 - RNA, 21 nt, Neisseria meningitidis Z2491
uagugaacuaaauuuaaacca

SEQ ID NO: 1373668 - RNA, 21 nt, Neisseria meningitidis Z2491
uagugaauuaaauuuaaacca

SEQ ID NO: 1373669 - RNA, 15 nt, Neisseria meningitidis Z2491
ucaacaaaaugccgu

SEQ ID NO: 1373670 - RNA, 15 nt, Neisseria meningitidis Z2491
ucaaaagccguguga

SEQ ID NO: 1373671 - RNA, 13 nt, Neisseria meningitidis Z2491
ucaaaugccgucu

SEQ ID NO: 1373672 - RNA, 15 nt, Neisseria meningitidis Z2491
ucaaaugccgucuga

SEQ ID NO: 1373673 - RNA, 20 nt, Neisseria meningitidis Z2491
ucaaaaaaccguauucccgc

SEQ ID NO: 1373674 - RNA, 15 nt, Neisseria meningitidis Z2491
ucaaaaacgggcuuu

SEQ ID NO: 1373675 - RNA, 15 nt, Neisseria meningitidis Z2491
ucaacagacggcguu

SEQ ID NO: 1373676 - RNA, 20 nt, Neisseria meningitidis Z2491
uauuugccgcguaugcguuc

SEQ ID NO: 1373677 - RNA, 16 nt, Neisseria meningitidis Z2491
uauuugccggucggcu

SEQ ID NO: 1373678 - RNA, 18 nt, Neisseria meningitidis Z2491
uaugcguucaaaugccgu

SEQ ID NO: 1373679 - RNA, 18 nt, Neisseria meningitidis Z2491
ugagcuucgcgacgguau

SEQ ID NO: 1373680 - RNA, 13 nt, Neisseria meningitidis Z2491
ugaugccgucuga

SEQ ID NO: 1373681 - RNA, 22 nt, Neisseria meningitidis Z2491
ugacgguaaacguagcaacugc

SEQ ID NO: 1373682 - RNA, 19 nt, Neisseria meningitidis Z2491
ugauggcugaugacggcag

SEQ ID NO: 1373683 - RNA, 18 nt, Neisseria meningitidis Z2491
ugccacgccgaacccgac

SEQ ID NO: 1373684 - RNA, 18 nt, Neisseria meningitidis Z2491
ugaaaccgcucugccguc

SEQ ID NO: 1373685 - RNA, 16 nt, Neisseria meningitidis Z2491
ugaaaccuuugauuuc

SEQ ID NO: 1373686 - RNA, 17 nt, Neisseria meningitidis Z2491
ugaaacgcauucagacg

SEQ ID NO: 1373687 - RNA, 22 nt, Neisseria meningitidis Z2491
ugaaacgcauucagacggcauc

SEQ ID NO: 1373688 - RNA, 22 nt, Neisseria meningitidis Z2491
ugaaagggcuucagacggcauu

SEQ ID NO: 1373689 - RNA, 22 nt, Neisseria meningitidis Z2491
ugaaagccuuucagacggcauu

SEQ ID NO: 1373690 - RNA, 17 nt, Neisseria meningitidis Z2491
ugaaaggcuucagacgg

SEQ ID NO: 1373691 - RNA, 21 nt, Neisseria meningitidis Z2491
ugaaaggcuucagacggcauu

SEQ ID NO: 1373692 - RNA, 20 nt, Neisseria meningitidis Z2491
ugaaaggcuuuuucagacgg

SEQ ID NO: 1373693 - RNA, 14 nt, Neisseria meningitidis Z2491
ugaaccaaugccgu

SEQ ID NO: 1373694 - RNA, 19 nt, Neisseria meningitidis Z2491
ugaaauuucagacggcguu

SEQ ID NO: 1373695 - RNA, 19 nt, Neisseria meningitidis Z2491
ugaaauucgucauucccgc

SEQ ID NO: 1373696 - RNA, 13 nt, Neisseria meningitidis Z2491
ugaaaugccgucu

SEQ ID NO: 1373697 - RNA, 12 nt, Neisseria meningitidis Z2491
ugaaaucaacgg

SEQ ID NO: 1373698 - RNA, 15 nt, Neisseria meningitidis Z2491
ugaaaucaacggauu

SEQ ID NO: 1373699 - RNA, 19 nt, Neisseria meningitidis Z2491
ugaaauaugguucagacgg

SEQ ID NO: 1373700 - RNA, 19 nt, Neisseria meningitidis Z2491
ugaaauuccagauucccgc

SEQ ID NO: 1373701 - RNA, 16 nt, Neisseria meningitidis Z2491
ugaaauguucagacgg

SEQ ID NO: 1373702 - RNA, 16 nt, Neisseria meningitidis Z2491
ucugaacgcuucagac

SEQ ID NO: 1373703 - RNA, 22 nt, Neisseria meningitidis Z2491
ucugaacgcuucagacggcauu

SEQ ID NO: 1373704 - RNA, 16 nt, Neisseria meningitidis Z2491
ucugaagccuucagac

SEQ ID NO: 1373705 - RNA, 22 nt, Neisseria meningitidis Z2491
ucugaagccuucagacggcaua

SEQ ID NO: 1373706 - RNA, 17 nt, Neisseria meningitidis Z2491
ucugaagcgguucagac

SEQ ID NO: 1373707 - RNA, 19 nt, Neisseria meningitidis Z2491
ucugaaaagucuuucagac

SEQ ID NO: 1373708 - RNA, 18 nt, Neisseria meningitidis Z2491
ucugaacaucuuucagac

SEQ ID NO: 1373709 - RNA, 20 nt, Neisseria meningitidis Z2491
ucugaaaggcuuuuucagac

SEQ ID NO: 1373710 - RNA, 16 nt, Neisseria meningitidis Z2491
ucugaaauguucagac

SEQ ID NO: 1373711 - RNA, 22 nt, Neisseria meningitidis Z2491
ucugaaauguucagacggcauu

SEQ ID NO: 1373712 - RNA, 19 nt, Neisseria meningitidis Z2491
ucugaacacggguucagac

SEQ ID NO: 1373713 - RNA, 19 nt, Neisseria meningitidis Z2491
ucugaacaguguuucagac

SEQ ID NO: 1373714 - RNA, 18 nt, Neisseria meningitidis Z2491
ucugauuucguaauccgc

SEQ ID NO: 1373715 - RNA, 17 nt, Neisseria meningitidis Z2491
ucugccgucauucccgc

SEQ ID NO: 1373716 - RNA, 22 nt, Neisseria meningitidis Z2491
ucugcgaaagcgggaaugccga

SEQ ID NO: 1373717 - RNA, 20 nt, Neisseria meningitidis Z2491
ucgggucgaaaccggcuuug

SEQ ID NO: 1373718 - RNA, 23 nt, Neisseria meningitidis Z2491
ucgggcggcgguuugccgucuga

SEQ ID NO: 1373719 - RNA, 22 nt, Neisseria meningitidis Z2491
ucgggcaacucgauuuccgcga

SEQ ID NO: 1373720 - RNA, 18 nt, Neisseria meningitidis Z2491
ucgggaucgcgcggauuc

SEQ ID NO: 1373721 - RNA, 18 nt, Neisseria meningitidis Z2491
ucggcuuucagacggcau

SEQ ID NO: 1373722 - RNA, 17 nt, Neisseria meningitidis Z2491
uccgacaaauuccuaaa

SEQ ID NO: 1373723 - RNA, 20 nt, Neisseria meningitidis Z2491
uccgaaacaaugccgucuga

SEQ ID NO: 1373724 - RNA, 17 nt, Neisseria meningitidis Z2491
uccgccgucauucccgc

SEQ ID NO: 1373725 - RNA, 16 nt, Neisseria meningitidis Z2491
uccgcgucauucccgc

SEQ ID NO: 1373726 - RNA, 12 nt, Neisseria meningitidis Z2491
uccggauuuccu

SEQ ID NO: 1373727 - RNA, 22 nt, Neisseria meningitidis Z2491
ucccguugccaaaccggcauuc

SEQ ID NO: 1373728 - RNA, 13 nt, Neisseria meningitidis Z2491
ucccucgaaagcg

SEQ ID NO: 1373729 - RNA, 20 nt, Neisseria meningitidis Z2491
ucccguuucagacggcauuu

SEQ ID NO: 1373730 - RNA, 16 nt, Neisseria meningitidis Z2491
ucgaguaaaacgguuu

SEQ ID NO: 1373731 - RNA, 18 nt, Neisseria meningitidis Z2491
ucgagacucguuucccgc

SEQ ID NO: 1373732 - RNA, 15 nt, Neisseria meningitidis Z2491
ucgagacucguuuuc

SEQ ID NO: 1373733 - RNA, 18 nt, Neisseria meningitidis Z2491
ucgcgcgaaugugcgccg

SEQ ID NO: 1373734 - RNA, 17 nt, Neisseria meningitidis Z2491
aauacgaugccgucuga

SEQ ID NO: 1373735 - RNA, 13 nt, Neisseria meningitidis Z2491
ucggcauucccgc

SEQ ID NO: 1373736 - RNA, 19 nt, Neisseria meningitidis Z2491
acccauauaaggcugcaaa

SEQ ID NO: 1373737 - RNA, 19 nt, Neisseria meningitidis Z2491
acccugccgucauucccgc

SEQ ID NO: 1373738 - RNA, 13 nt, Neisseria meningitidis Z2491
accggauucccgc

SEQ ID NO: 1373739 - RNA, 15 nt, Neisseria meningitidis Z2491
acauuucagacggca

SEQ ID NO: 1373740 - RNA, 21 nt, Neisseria meningitidis Z2491
acauugcguucagacggcauu

SEQ ID NO: 1373741 - RNA, 17 nt, Neisseria meningitidis Z2491
accaagcccaaucccgc

SEQ ID NO: 1373742 - RNA, 12 nt, Neisseria meningitidis Z2491
accaaacggcau

SEQ ID NO: 1373743 - RNA, 22 nt, Neisseria meningitidis Z2491
acaaugccgucugaaacgaaca

SEQ ID NO: 1373744 - RNA, 18 nt, Neisseria meningitidis Z2491
acaaggcuggauucccgc

SEQ ID NO: 1373745 - RNA, 16 nt, Neisseria meningitidis Z2491
acaaaaugccgccuga

SEQ ID NO: 1373746 - RNA, 13 nt, Neisseria meningitidis Z2491
acaaaaugccguc

SEQ ID NO: 1373747 - RNA, 14 nt, Neisseria meningitidis Z2491
acaaaaugccgucu

SEQ ID NO: 1373748 - RNA, 19 nt, Neisseria meningitidis Z2491
acaaacaggcuucagacgg

SEQ ID NO: 1373749 - RNA, 14 nt, Neisseria meningitidis Z2491
acaaaaggccgucu

SEQ ID NO: 1373750 - RNA, 17 nt, Neisseria meningitidis Z2491
aaugugcauuucuaauu

SEQ ID NO: 1373751 - RNA, 14 nt, Neisseria meningitidis Z2491
aauguucagacggc

SEQ ID NO: 1373752 - RNA, 12 nt, Neisseria meningitidis Z2491
acaaaugccguc

SEQ ID NO: 1373753 - RNA, 13 nt, Neisseria meningitidis Z2491
acaaaugccgucu

SEQ ID NO: 1373754 - RNA, 20 nt, Neisseria meningitidis Z2491
acacaauucccaccguuucc

SEQ ID NO: 1373755 - RNA, 21 nt, Neisseria meningitidis Z2491
acacaggguucggacggcauu

SEQ ID NO: 1373756 - RNA, 23 nt, Neisseria meningitidis Z2491
acacugcccuuucacggcggcaa

SEQ ID NO: 1373757 - RNA, 12 nt, Neisseria meningitidis Z2491
acgcgcgggaau

SEQ ID NO: 1373758 - RNA, 22 nt, Neisseria meningitidis Z2491
acgaauuucaugucaucgcgga

SEQ ID NO: 1373759 - RNA, 15 nt, Neisseria meningitidis Z2491
acgaaucuuauccac

SEQ ID NO: 1373760 - RNA, 23 nt, Neisseria meningitidis Z2491
accuuucccguuucagacggcau

SEQ ID NO: 1373761 - RNA, 19 nt, Neisseria meningitidis Z2491
acgacgaccaucguccaac

SEQ ID NO: 1373762 - RNA, 16 nt, Neisseria meningitidis Z2491
accuguuucagacggc

SEQ ID NO: 1373763 - RNA, 15 nt, Neisseria meningitidis Z2491
accuguuuuucaaag

SEQ ID NO: 1373764 - RNA, 22 nt, Neisseria meningitidis Z2491
accugaaauaugguucagacgg

SEQ ID NO: 1373765 - RNA, 15 nt, Neisseria meningitidis Z2491
acugaaacucaacga

SEQ ID NO: 1373766 - RNA, 12 nt, Neisseria meningitidis Z2491
acugaucagaca

SEQ ID NO: 1373767 - RNA, 18 nt, Neisseria meningitidis Z2491
acguccaccugaacggca

SEQ ID NO: 1373768 - RNA, 15 nt, Neisseria meningitidis Z2491
acggguucagacggc

SEQ ID NO: 1373769 - RNA, 17 nt, Neisseria meningitidis Z2491
acggguucagacggcau

SEQ ID NO: 1373770 - RNA, 17 nt, Neisseria meningitidis Z2491
acggguucggacggcau

SEQ ID NO: 1373771 - RNA, 18 nt, Neisseria meningitidis Z2491
acggguuucagacggcau

SEQ ID NO: 1373772 - RNA, 20 nt, Neisseria meningitidis Z2491
acgggaaugacgaaagguug

SEQ ID NO: 1373773 - RNA, 16 nt, Neisseria meningitidis Z2491
acggcgcaggcaaacg

SEQ ID NO: 1373774 - RNA, 20 nt, Neisseria meningitidis Z2491
acggcauuuuguugccgucg

SEQ ID NO: 1373775 - RNA, 22 nt, Neisseria meningitidis Z2491
acggcauuuuuacaaggcagca

SEQ ID NO: 1373776 - RNA, 22 nt, Neisseria meningitidis Z2491
acggcauccuugaucugcgaaa

SEQ ID NO: 1373777 - RNA, 14 nt, Neisseria meningitidis Z2491
acggcagagcgguu

SEQ ID NO: 1373778 - RNA, 15 nt, Neisseria meningitidis Z2491
acgcuucagacggca

SEQ ID NO: 1373779 - RNA, 18 nt, Neisseria meningitidis Z2491
aauccagcaaugccgucu

SEQ ID NO: 1373780 - RNA, 15 nt, Neisseria meningitidis Z2491
uuggcauaaccgcuu

SEQ ID NO: 1373781 - RNA, 21 nt, Neisseria meningitidis Z2491
aaucccgcaacucuccgucau

SEQ ID NO: 1373782 - RNA, 18 nt, Neisseria meningitidis Z2491
uuggggauuuauucuguu

SEQ ID NO: 1373783 - RNA, 15 nt, Neisseria meningitidis Z2491
uuggggcaaagcggc

SEQ ID NO: 1373784 - RNA, 14 nt, Neisseria meningitidis Z2491
aauccgcaaacggc

SEQ ID NO: 1373785 - RNA, 21 nt, Neisseria meningitidis Z2491
aauccgccugcgccacggcuu

SEQ ID NO: 1373786 - RNA, 21 nt, Neisseria meningitidis Z2491
aauccgcucuucggcgcgcau

SEQ ID NO: 1373787 - RNA, 21 nt, Neisseria meningitidis Z2491
uugugcuguuucagacggcau

SEQ ID NO: 1373788 - RNA, 20 nt, Neisseria meningitidis Z2491
uugugcuucuucgagggcau

SEQ ID NO: 1373789 - RNA, 19 nt, Neisseria meningitidis Z2491
aaucaguuuuuucagcggc

SEQ ID NO: 1373790 - RNA, 20 nt, Neisseria meningitidis Z2491
uugccgucgcccaaaggccu

SEQ ID NO: 1373791 - RNA, 20 nt, Neisseria meningitidis Z2491
uugccgucugaagcguauuu

SEQ ID NO: 1373792 - RNA, 14 nt, Neisseria meningitidis Z2491
uugcgccacggcau

SEQ ID NO: 1373793 - RNA, 15 nt, Neisseria meningitidis Z2491
uugcgccacggcaua

SEQ ID NO: 1373794 - RNA, 23 nt, Neisseria meningitidis Z2491
uugccacaauauaaucaaacuca

SEQ ID NO: 1373795 - RNA, 21 nt, Neisseria meningitidis Z2491
uugcaccgucuccagcgguuu

SEQ ID NO: 1373796 - RNA, 19 nt, Neisseria meningitidis Z2491
uugaugucgugcagauggc

SEQ ID NO: 1373797 - RNA, 21 nt, Neisseria meningitidis Z2491
aaucuagaacccaacacggca

SEQ ID NO: 1373798 - RNA, 22 nt, Neisseria meningitidis Z2491
aaucuaguuuguuguucaaaua

SEQ ID NO: 1373799 - RNA, 17 nt, Neisseria meningitidis Z2491
aaugaaaaaugccgucu

SEQ ID NO: 1373800 - RNA, 23 nt, Neisseria meningitidis Z2491
aaucgcgugcugcaucggcguau

SEQ ID NO: 1373801 - RNA, 18 nt, Neisseria meningitidis Z2491
aaucggcuuucagacggc

SEQ ID NO: 1373802 - RNA, 13 nt, Neisseria meningitidis Z2491
aaugacggcggaa

SEQ ID NO: 1373803 - RNA, 15 nt, Neisseria meningitidis Z2491
aaugaucaggcggau

SEQ ID NO: 1373804 - RNA, 12 nt, Neisseria meningitidis Z2491
aaugucuagauu

SEQ ID NO: 1373805 - RNA, 15 nt, Neisseria meningitidis Z2491
aauguacuucuggaa

SEQ ID NO: 1373806 - RNA, 19 nt, Neisseria meningitidis Z2491
aaugucaaaauaugccguc

SEQ ID NO: 1373807 - RNA, 20 nt, Neisseria meningitidis Z2491
uuucggguuucagacggcau

SEQ ID NO: 1373808 - RNA, 16 nt, Neisseria meningitidis Z2491
uuucuucugaauaaac

SEQ ID NO: 1373809 - RNA, 19 nt, Neisseria meningitidis Z2491
uuugaaacucuaaucccgu

SEQ ID NO: 1373810 - RNA, 18 nt, Neisseria meningitidis Z2491
uuuccgauaaauuccuaa

SEQ ID NO: 1373811 - RNA, 20 nt, Neisseria meningitidis Z2491
uuugauauacaaaaugccgu

SEQ ID NO: 1373812 - RNA, 16 nt, Neisseria meningitidis Z2491
uuugaauauuacuguu

SEQ ID NO: 1373813 - RNA, 15 nt, Neisseria meningitidis Z2491
uuugggauuucuguu

SEQ ID NO: 1373814 - RNA, 14 nt, Neisseria meningitidis Z2491
uuuggguuucuguu

SEQ ID NO: 1373815 - RNA, 17 nt, Neisseria meningitidis Z2491
uuuggcuguuuucuguu

SEQ ID NO: 1373816 - RNA, 16 nt, Neisseria meningitidis Z2491
uuugcgggaaugacgg

SEQ ID NO: 1373817 - RNA, 13 nt, Neisseria meningitidis Z2491
uucagacggcaua

SEQ ID NO: 1373818 - RNA, 13 nt, Neisseria meningitidis Z2491
uucagacggcauc

SEQ ID NO: 1373819 - RNA, 21 nt, Neisseria meningitidis Z2491
uucagacggcauuuuugcgaa

SEQ ID NO: 1373820 - RNA, 17 nt, Neisseria meningitidis Z2491
uuccaccgaugucggcu

SEQ ID NO: 1373821 - RNA, 22 nt, Neisseria meningitidis Z2491
uucccacaaucauugcgggaau

SEQ ID NO: 1373822 - RNA, 19 nt, Neisseria meningitidis Z2491
uucccguuucagacggcau

SEQ ID NO: 1373823 - RNA, 20 nt, Neisseria meningitidis Z2491
uucccguuucagacggcauu

SEQ ID NO: 1373824 - RNA, 16 nt, Neisseria meningitidis Z2491
uucccucgaaagcggg

SEQ ID NO: 1373825 - RNA, 16 nt, Neisseria meningitidis Z2491
uucgcggggaugccgg

SEQ ID NO: 1373826 - RNA, 19 nt, Neisseria meningitidis Z2491
uucgcgggaaugacgggau

SEQ ID NO: 1373827 - RNA, 12 nt, Neisseria meningitidis Z2491
uucggacggcau

SEQ ID NO: 1373828 - RNA, 13 nt, Neisseria meningitidis Z2491
uucggaaaugcgu

SEQ ID NO: 1373829 - RNA, 21 nt, Neisseria meningitidis Z2491
uucggaugccugauggcugau

SEQ ID NO: 1373830 - RNA, 18 nt, Neisseria meningitidis Z2491
uucgucggucagcgguuu

SEQ ID NO: 1373831 - RNA, 15 nt, Neisseria meningitidis Z2491
uucguuuggggauuu

SEQ ID NO: 1373832 - RNA, 21 nt, Neisseria meningitidis Z2491
uuaccaaguuucagacggcau

SEQ ID NO: 1373833 - RNA, 15 nt, Neisseria meningitidis Z2491
uuacacggcgcggcu

SEQ ID NO: 1373834 - RNA, 18 nt, Neisseria meningitidis Z2491
uuaauauacuuggcaaaa

SEQ ID NO: 1373835 - RNA, 19 nt, Neisseria meningitidis Z2491
uuaaauuuaaaccaguacg

SEQ ID NO: 1373836 - RNA, 17 nt, Neisseria meningitidis Z2491
uuacccgauaaguuucc

SEQ ID NO: 1373837 - RNA, 16 nt, Neisseria meningitidis Z2491
uuacgcaauggcaaaa

SEQ ID NO: 1373838 - RNA, 19 nt, Neisseria meningitidis Z2491
uuaggguucugauuuuguu

SEQ ID NO: 1373839 - RNA, 22 nt, Neisseria meningitidis Z2491
uguucggguacaaccaaugcgg

SEQ ID NO: 1373840 - RNA, 14 nt, Neisseria meningitidis Z2491
ugugggaaugacgg

SEQ ID NO: 1373841 - RNA, 13 nt, Neisseria meningitidis Z2491
ugugccaaugccg

SEQ ID NO: 1373842 - RNA, 14 nt, Neisseria meningitidis Z2491
ugucagacggcauu

SEQ ID NO: 1373843 - RNA, 17 nt, Neisseria meningitidis Z2491
ugucucggcagcggcau

SEQ ID NO: 1373844 - RNA, 19 nt, Neisseria meningitidis Z2491
ugugaaauaaaaaaugccg

SEQ ID NO: 1373845 - RNA, 20 nt, Neisseria meningitidis Z2491
ugugaaauaaaaaaugccgu

SEQ ID NO: 1373846 - RNA, 16 nt, Neisseria meningitidis Z2491
uggaaaugccgucuga

SEQ ID NO: 1373847 - RNA, 17 nt, Neisseria meningitidis Z2491
ugcuucuucgagggcau

SEQ ID NO: 1373848 - RNA, 23 nt, Neisseria meningitidis Z2491
ugcuuucgcgagaacgacgggau

SEQ ID NO: 1373849 - RNA, 15 nt, Neisseria meningitidis Z2491
ugcuuauuugagcgg

SEQ ID NO: 1373850 - RNA, 15 nt, Neisseria meningitidis Z2491
ugcuuacaauccgcu

SEQ ID NO: 1373851 - RNA, 14 nt, Neisseria meningitidis Z2491
ugcgguucggcuug

SEQ ID NO: 1373852 - RNA, 17 nt, Neisseria meningitidis Z2491
ugcgaaaugccgucuga

SEQ ID NO: 1373853 - RNA, 17 nt, Neisseria meningitidis Z2491
ugccggucaggacggcu

SEQ ID NO: 1373854 - RNA, 18 nt, Neisseria meningitidis Z2491
ugccgucugaaacccgau

SEQ ID NO: 1373855 - RNA, 18 nt, Neisseria meningitidis Z2491
ugccgucugaaacggcau

SEQ ID NO: 1373856 - RNA, 17 nt, Neisseria meningitidis Z2491
aauaugguucagacggc

SEQ ID NO: 1373857 - RNA, 19 nt, Neisseria meningitidis Z2491
ugggcuucagacggcaucg

SEQ ID NO: 1373858 - RNA, 21 nt, Neisseria meningitidis Z2491
ugguuguucagaaaauccgcc

SEQ ID NO: 1373859 - RNA, 19 nt, Neisseria meningitidis Z2491
ugguuuauuugaauccgcg

SEQ ID NO: 1373860 - RNA, 22 nt, Neisseria meningitidis Z2491
uggugcagguuucugugcggau

SEQ ID NO: 1373861 - RNA, 14 nt, Neisseria meningitidis Z2491
uggucaauacacaa

SEQ ID NO: 1373862 - RNA, 18 nt, Neisseria meningitidis Z2491
aaaugccgucugaagccu

SEQ ID NO: 1373863 - RNA, 11 nt, Neisseria meningitidis Z2491
aaaugccgucu

SEQ ID NO: 1373864 - RNA, 12 nt, Neisseria meningitidis Z2491
aaaugccgucug

SEQ ID NO: 1373865 - RNA, 13 nt, Neisseria meningitidis Z2491
aaaugccgucuga

SEQ ID NO: 1373866 - RNA, 18 nt, Neisseria meningitidis Z2491
aaaugaaaaaugccgucu

SEQ ID NO: 1373867 - RNA, 16 nt, Neisseria meningitidis Z2491
aaaucuuccugcggca

SEQ ID NO: 1373868 - RNA, 20 nt, Neisseria meningitidis Z2491
aaaugcuguucagacggcau

SEQ ID NO: 1373869 - RNA, 16 nt, Neisseria meningitidis Z2491
aaaagaugccgucuga

SEQ ID NO: 1373870 - RNA, 18 nt, Neisseria meningitidis Z2491
aaauugaaaugccgucug

SEQ ID NO: 1373871 - RNA, 12 nt, Neisseria meningitidis Z2491
aaauucuagauu

SEQ ID NO: 1373872 - RNA, 16 nt, Neisseria meningitidis Z2491
aacagcacgauacaca

SEQ ID NO: 1373873 - RNA, 21 nt, Neisseria meningitidis Z2491
aacaaugcccgcaaucugaaa

SEQ ID NO: 1373874 - RNA, 22 nt, Neisseria meningitidis Z2491
aaacugcguuacauaauccggc

SEQ ID NO: 1373875 - RNA, 17 nt, Neisseria meningitidis Z2491
aaacguuucagacggca

SEQ ID NO: 1373876 - RNA, 20 nt, Neisseria meningitidis Z2491
aaacguuucagacggcauuu

SEQ ID NO: 1373877 - RNA, 20 nt, Neisseria meningitidis Z2491
aaacucaaaaagcuggauuc

SEQ ID NO: 1373878 - RNA, 21 nt, Neisseria meningitidis Z2491
aaacucaacgaaccuggauuc

SEQ ID NO: 1373879 - RNA, 20 nt, Neisseria meningitidis Z2491
aaacucaacgcacuggauuc

SEQ ID NO: 1373880 - RNA, 21 nt, Neisseria meningitidis Z2491
aaacuuggagauucuagauuc

SEQ ID NO: 1373881 - RNA, 14 nt, Neisseria meningitidis Z2491
aaagaugccgucug

SEQ ID NO: 1373882 - RNA, 17 nt, Neisseria meningitidis Z2491
aaacgaugacggcgaaa

SEQ ID NO: 1373883 - RNA, 14 nt, Neisseria meningitidis Z2491
aaacggucgaugug

SEQ ID NO: 1373884 - RNA, 18 nt, Neisseria meningitidis Z2491
aaauacaaaaggccgucu

SEQ ID NO: 1373885 - RNA, 13 nt, Neisseria meningitidis Z2491
aaauaugccgucu

SEQ ID NO: 1373886 - RNA, 13 nt, Neisseria meningitidis Z2491
aaaaauaccgucu

SEQ ID NO: 1373887 - RNA, 13 nt, Neisseria meningitidis Z2491
aaaaaugccgucu

SEQ ID NO: 1373888 - RNA, 15 nt, Neisseria meningitidis Z2491
aaaaaugccgucuga

SEQ ID NO: 1373889 - RNA, 16 nt, Neisseria meningitidis Z2491
aaaaaugccgucugaa

SEQ ID NO: 1373890 - RNA, 17 nt, Neisseria meningitidis Z2491
aaaaaugccgucugaaa

SEQ ID NO: 1373891 - RNA, 20 nt, Neisseria meningitidis Z2491
aaaaaugccgucugaacccu

SEQ ID NO: 1373892 - RNA, 18 nt, Neisseria meningitidis Z2491
aaagugggaaucuagaau

SEQ ID NO: 1373893 - RNA, 17 nt, Neisseria meningitidis Z2491
aaagugggaaucuaguu

SEQ ID NO: 1373894 - RNA, 23 nt, Neisseria meningitidis Z2491
aaagucugauucuaccgccccga

SEQ ID NO: 1373895 - RNA, 20 nt, Neisseria meningitidis Z2491
aaagucuuucagacggcauu

SEQ ID NO: 1373896 - RNA, 16 nt, Neisseria meningitidis Z2491
aaaggaaaugccgucu

SEQ ID NO: 1373897 - RNA, 14 nt, Neisseria meningitidis Z2491
aaaggccuggauuc

SEQ ID NO: 1373898 - RNA, 18 nt, Neisseria meningitidis Z2491
aaaggccuggauucccgc

SEQ ID NO: 1373899 - RNA, 16 nt, Neisseria meningitidis Z2491
aacccaaacacagguu

SEQ ID NO: 1373900 - RNA, 15 nt, Neisseria meningitidis Z2491
aaccaguacagcguu

SEQ ID NO: 1373901 - RNA, 17 nt, Neisseria meningitidis Z2491
aaccccauucggagcaa

SEQ ID NO: 1373902 - RNA, 20 nt, Neisseria meningitidis Z2491
aaccgaacagaccggauucc

SEQ ID NO: 1373903 - RNA, 14 nt, Neisseria meningitidis Z2491
aacccguaugccgc

SEQ ID NO: 1373904 - RNA, 17 nt, Neisseria meningitidis Z2491
aacccguaugccgccug

SEQ ID NO: 1373905 - RNA, 14 nt, Neisseria meningitidis Z2491
aaccgaugccguca

SEQ ID NO: 1373906 - RNA, 17 nt, Neisseria meningitidis Z2491
aacaucuuucagacggc

SEQ ID NO: 1373907 - RNA, 23 nt, Neisseria meningitidis Z2491
aaccacgcuucugaugccgucug

SEQ ID NO: 1373908 - RNA, 16 nt, Neisseria meningitidis Z2491
aacgcauucagacggc

SEQ ID NO: 1373909 - RNA, 13 nt, Neisseria meningitidis Z2491
aacgauacggcgg

SEQ ID NO: 1373910 - RNA, 19 nt, Neisseria meningitidis Z2491
aaccgccgacacacggauu

SEQ ID NO: 1373911 - RNA, 17 nt, Neisseria meningitidis Z2491
aaccgcucugccgucau

SEQ ID NO: 1373912 - RNA, 19 nt, Neisseria meningitidis Z2491
aacgguauuggaugcgguc

SEQ ID NO: 1373913 - RNA, 17 nt, Neisseria meningitidis Z2491
aacguacaaaugccguc

SEQ ID NO: 1373914 - RNA, 20 nt, Neisseria meningitidis Z2491
aacggcacaaacgccagcac

SEQ ID NO: 1373915 - RNA, 23 nt, Neisseria meningitidis Z2491
aaucccguugccaaaccggcauu

SEQ ID NO: 1373916 - RNA, 20 nt, Neisseria meningitidis Z2491
aaucaguuuuuucagcggcg

SEQ ID NO: 1373917 - RNA, 16 nt, Neisseria meningitidis Z2491
aaucaggccggcggag

SEQ ID NO: 1373918 - RNA, 22 nt, Neisseria meningitidis Z2491
aaucagaaaccuaaaaucccgu

SEQ ID NO: 1373919 - RNA, 21 nt, Neisseria meningitidis Z2491
aaucucaaaaaaugccgucug

SEQ ID NO: 1373920 - RNA, 21 nt, Neisseria meningitidis Z2491
aaucguuucugucgccagcau

SEQ ID NO: 1373921 - RNA, 18 nt, Neisseria meningitidis Z2491
aaucggguuucagacggc

SEQ ID NO: 1373922 - RNA, 23 nt, Neisseria meningitidis Z2491
aaucggguuucagacggcacuuu

SEQ ID NO: 1373923 - RNA, 22 nt, Neisseria meningitidis Z2491
aaucggguuucagacggcauuu

SEQ ID NO: 1373924 - RNA, 22 nt, Neisseria meningitidis Z2491
aauucuguuuggauaugccgua

SEQ ID NO: 1373925 - RNA, 15 nt, Neisseria meningitidis Z2491
aauugaaaugccguc

SEQ ID NO: 1373926 - RNA, 16 nt, Neisseria meningitidis Z2491
aauugaaaugccgucu

SEQ ID NO: 1373927 - RNA, 13 nt, Neisseria meningitidis Z2491
aauucaacuuggu

SEQ ID NO: 1373928 - RNA, 18 nt, Neisseria meningitidis Z2491
aauuaugaugcggacggc

SEQ ID NO: 1373929 - RNA, 16 nt, Neisseria meningitidis Z2491
aaugucuagauucccg

SEQ ID NO: 1373930 - RNA, 13 nt, Neisseria meningitidis Z2491
aaugccgccagcc

SEQ ID NO: 1373931 - RNA, 19 nt, Neisseria meningitidis Z2491
aaugccgcaaaugccgucu

SEQ ID NO: 1373932 - RNA, 21 nt, Neisseria meningitidis Z2491
aaugccgcaaaugccgucuga

SEQ ID NO: 1373933 - RNA, 20 nt, Neisseria meningitidis Z2491
aaucucuaaagcuucagcua

SEQ ID NO: 1373934 - RNA, 15 nt, Neisseria meningitidis Z2491
aaucuguggauaaac

SEQ ID NO: 1373935 - RNA, 21 nt, Neisseria meningitidis Z2491
aaugccgucugaaagccguau

SEQ ID NO: 1373936 - RNA, 22 nt, Neisseria meningitidis Z2491
aauggcaaaauuucagauugcg

SEQ ID NO: 1373937 - RNA, 17 nt, Neisseria meningitidis Z2491
aaguuucagacggcauc

SEQ ID NO: 1373938 - RNA, 20 nt, Neisseria meningitidis Z2491
aauacaaaaaugccgucuga

SEQ ID NO: 1373939 - RNA, 18 nt, Neisseria meningitidis Z2491
aagguuuucagacggcau

SEQ ID NO: 1373940 - RNA, 16 nt, Neisseria meningitidis Z2491
aaguaaucacaacggc

SEQ ID NO: 1373941 - RNA, 22 nt, Neisseria meningitidis Z2491
aaggcggcgagccgcagacggu

SEQ ID NO: 1373942 - RNA, 13 nt, Neisseria meningitidis Z2491
aaggcggcggcag

SEQ ID NO: 1373943 - RNA, 18 nt, Neisseria meningitidis Z2491
aaggcuuuuucagacggc

SEQ ID NO: 1373944 - RNA, 21 nt, Neisseria meningitidis Z2491
aaggcuuuuucagacggcauu

SEQ ID NO: 1373945 - RNA, 16 nt, Neisseria meningitidis Z2491
aagcuggauucccacu

SEQ ID NO: 1373946 - RNA, 22 nt, Neisseria meningitidis Z2491
aagcuuuagagauucuggauuc

SEQ ID NO: 1373947 - RNA, 17 nt, Neisseria meningitidis Z2491
aagcuuccaacucggca

SEQ ID NO: 1373948 - RNA, 16 nt, Neisseria meningitidis Z2491
aagccuucagacggca

SEQ ID NO: 1373949 - RNA, 17 nt, Neisseria meningitidis Z2491
aagccuucagacggcau

SEQ ID NO: 1373950 - RNA, 18 nt, Neisseria meningitidis Z2491
aagcugcaacugaaacca

SEQ ID NO: 1373951 - RNA, 16 nt, Neisseria meningitidis Z2491
accgaaaugccgucau

SEQ ID NO: 1373952 - RNA, 12 nt, Neisseria meningitidis Z2491
aaaaugccgucc

SEQ ID NO: 1373953 - RNA, 13 nt, Neisseria meningitidis Z2491
aaaaugccgucug

SEQ ID NO: 1373954 - RNA, 14 nt, Neisseria meningitidis Z2491
accgccauucccgc

SEQ ID NO: 1373955 - RNA, 15 nt, Neisseria meningitidis Z2491
accggcauucugcac

SEQ ID NO: 1373956 - RNA, 19 nt, Neisseria meningitidis Z2491
accaaauuauugccagcau

SEQ ID NO: 1373957 - RNA, 23 nt, Neisseria meningitidis Z2491
accaaaucggcuuucagacggca

SEQ ID NO: 1373958 - RNA, 17 nt, Neisseria meningitidis Z2491
acauuucagacggcauu

SEQ ID NO: 1373959 - RNA, 21 nt, Neisseria meningitidis Z2491
acaugccaccgucauucccgc

SEQ ID NO: 1373960 - RNA, 22 nt, Neisseria meningitidis Z2491
acagccaaaaaaaagccguccg

SEQ ID NO: 1373961 - RNA, 14 nt, Neisseria meningitidis Z2491
acaaaauaccgucu

SEQ ID NO: 1373962 - RNA, 12 nt, Neisseria meningitidis Z2491
acaaaaugccgc

SEQ ID NO: 1373963 - RNA, 18 nt, Neisseria meningitidis Z2491
acaaaaugccgccgucga

SEQ ID NO: 1373964 - RNA, 16 nt, Neisseria meningitidis Z2491
acaaaaugccguccga

SEQ ID NO: 1373965 - RNA, 16 nt, Neisseria meningitidis Z2491
acaaaaugccgucuga

SEQ ID NO: 1373966 - RNA, 18 nt, Neisseria meningitidis Z2491
acaaaaugccgucugaaa

SEQ ID NO: 1373967 - RNA, 18 nt, Neisseria meningitidis Z2491
acaaaaugccgucugaac

SEQ ID NO: 1373968 - RNA, 16 nt, Neisseria meningitidis Z2491
acgcauucagacggca

SEQ ID NO: 1373969 - RNA, 17 nt, Neisseria meningitidis Z2491
acgcauucagacggcau

SEQ ID NO: 1373970 - RNA, 20 nt, Neisseria meningitidis Z2491
acgcauaaaaaugcgccaaa

SEQ ID NO: 1373971 - RNA, 14 nt, Neisseria meningitidis Z2491
accugcugccgucg

SEQ ID NO: 1373972 - RNA, 21 nt, Neisseria meningitidis Z2491
accuguaccguuucagacggc

SEQ ID NO: 1373973 - RNA, 22 nt, Neisseria meningitidis Z2491
aaaccaaauuacgggacgacau

SEQ ID NO: 1373974 - RNA, 16 nt, Neisseria meningitidis Z2491
aaacaucugccguaug

SEQ ID NO: 1373975 - RNA, 16 nt, Neisseria meningitidis Z2491
aaaccaguacggcguu

SEQ ID NO: 1373976 - RNA, 18 nt, Neisseria meningitidis Z2491
acggggcuggauucccgc

SEQ ID NO: 1373977 - RNA, 21 nt, Neisseria meningitidis Z2491
acguccaccugaacggcacaa

SEQ ID NO: 1373978 - RNA, 12 nt, Neisseria meningitidis Z2491
acguucuagauu

SEQ ID NO: 1373979 - RNA, 12 nt, Neisseria meningitidis Z2491
acguucuggauu

SEQ ID NO: 1373980 - RNA, 20 nt, Neisseria meningitidis Z2491
acucaaucaaaucgggaauc

SEQ ID NO: 1373981 - RNA, 15 nt, Neisseria meningitidis Z2491
acuugaaggcguguu

SEQ ID NO: 1373982 - RNA, 10 nt, Neisseria meningitidis Z2491
acuggauucc

SEQ ID NO: 1373983 - RNA, 19 nt, Neisseria meningitidis Z2491
aaaccgacccugccgucug

SEQ ID NO: 1373984 - RNA, 16 nt, Neisseria meningitidis Z2491
aaaccgcgcaucgcca

SEQ ID NO: 1373985 - RNA, 15 nt, Neisseria meningitidis Z2491
aaaccgaugccguca

SEQ ID NO: 1373986 - RNA, 23 nt, Neisseria meningitidis Z2491
aaaccgcuccgccgucauucccg

SEQ ID NO: 1373987 - RNA, 20 nt, Neisseria meningitidis Z2491
aaaccggcuucagacggcau

SEQ ID NO: 1373988 - RNA, 16 nt, Neisseria meningitidis Z2491
agcaaaaaaugccguc

SEQ ID NO: 1373989 - RNA, 16 nt, Neisseria meningitidis Z2491
agcaaaugccgucuga

SEQ ID NO: 1373990 - RNA, 16 nt, Neisseria meningitidis Z2491
agcacaucgucugcaa

SEQ ID NO: 1373991 - RNA, 18 nt, Neisseria meningitidis Z2491
agccgcaaugccgucuga

SEQ ID NO: 1373992 - RNA, 22 nt, Neisseria meningitidis Z2491
aaaccguauauuucccgucugc

SEQ ID NO: 1373993 - RNA, 21 nt, Neisseria meningitidis Z2491
aaaccguguuucagacggcau

SEQ ID NO: 1373994 - RNA, 22 nt, Neisseria meningitidis Z2491
aaaccguguuucagacggcauu

SEQ ID NO: 1373995 - RNA, 13 nt, Neisseria meningitidis Z2491
aaaccugcaucac

SEQ ID NO: 1373996 - RNA, 24 nt, Neisseria meningitidis Z2491
aaaccuguaccguuucagacggca

SEQ ID NO: 1373997 - RNA, 21 nt, Neisseria meningitidis Z2491
aaaccucguucggacggcauu

SEQ ID NO: 1373998 - RNA, 22 nt, Neisseria meningitidis Z2491
agcagcuuuugcgccacggcau

SEQ ID NO: 1373999 - RNA, 21 nt, Neisseria meningitidis Z2491
agcguucugccgacugccaag

SEQ ID NO: 1374000 - RNA, 19 nt, Neisseria meningitidis Z2491
agcggguuuucgauuuccg

SEQ ID NO: 1374001 - RNA, 21 nt, Neisseria meningitidis Z2491
agcgcgucaaacagacggaau

SEQ ID NO: 1374002 - RNA, 21 nt, Neisseria meningitidis Z2491
agcgacacgaccgaccggcau

SEQ ID NO: 1374003 - RNA, 17 nt, Neisseria meningitidis Z2491
aaacggacaacggcacu

SEQ ID NO: 1374004 - RNA, 15 nt, Neisseria meningitidis Z2491
agccgucauucccgc

SEQ ID NO: 1374005 - RNA, 20 nt, Neisseria meningitidis Z2491
aucacagucggugugccgcu

SEQ ID NO: 1374006 - RNA, 14 nt, Neisseria meningitidis Z2491
aucacaacggcguu

SEQ ID NO: 1374007 - RNA, 14 nt, Neisseria meningitidis Z2491
auaugguucagacg

SEQ ID NO: 1374008 - RNA, 19 nt, Neisseria meningitidis Z2491
auaugguucagacggcauu

SEQ ID NO: 1374009 - RNA, 19 nt, Neisseria meningitidis Z2491
auagcuucgucauucccgc

SEQ ID NO: 1374010 - RNA, 20 nt, Neisseria meningitidis Z2491
auagccgcccaaugccgucu

SEQ ID NO: 1374011 - RNA, 13 nt, Neisseria meningitidis Z2491
auaguugccguca

SEQ ID NO: 1374012 - RNA, 20 nt, Neisseria meningitidis Z2491
auauggaaaaaucuguggau

SEQ ID NO: 1374013 - RNA, 17 nt, Neisseria meningitidis Z2491
auaucgccucauacagc

SEQ ID NO: 1374014 - RNA, 14 nt, Neisseria meningitidis Z2491
auauacaucgcgcc

SEQ ID NO: 1374015 - RNA, 12 nt, Neisseria meningitidis Z2491
auacugccgucg

SEQ ID NO: 1374016 - RNA, 18 nt, Neisseria meningitidis Z2491
auacugccgucggcguuu

SEQ ID NO: 1374017 - RNA, 17 nt, Neisseria meningitidis Z2491
auaccguuuggcggcau

SEQ ID NO: 1374018 - RNA, 17 nt, Neisseria meningitidis Z2491
auaccuaaagccguccg

SEQ ID NO: 1374019 - RNA, 19 nt, Neisseria meningitidis Z2491
auacaacaaaaugccgccu

SEQ ID NO: 1374020 - RNA, 15 nt, Neisseria meningitidis Z2491
auacaaaaggccguc

SEQ ID NO: 1374021 - RNA, 18 nt, Neisseria meningitidis Z2491
auacaaaaugccgucuga

SEQ ID NO: 1374022 - RNA, 14 nt, Neisseria meningitidis Z2491
auaccaaacggcau

SEQ ID NO: 1374023 - RNA, 14 nt, Neisseria meningitidis Z2491
auaauaugaaacca

SEQ ID NO: 1374024 - RNA, 16 nt, Neisseria meningitidis Z2491
aguuuucagacggcau

SEQ ID NO: 1374025 - RNA, 15 nt, Neisseria meningitidis Z2491
aguuucagacggcau

SEQ ID NO: 1374026 - RNA, 16 nt, Neisseria meningitidis Z2491
aguuugaugccgucug

SEQ ID NO: 1374027 - RNA, 17 nt, Neisseria meningitidis Z2491
aguuugaugccgucuga

SEQ ID NO: 1374028 - RNA, 15 nt, Neisseria meningitidis Z2491
aguuugaugccgugu

SEQ ID NO: 1374029 - RNA, 16 nt, Neisseria meningitidis Z2491
auaaaaaaugccgucc

SEQ ID NO: 1374030 - RNA, 15 nt, Neisseria meningitidis Z2491
auaaaaaacgccguc

SEQ ID NO: 1374031 - RNA, 14 nt, Neisseria meningitidis Z2491
auaacgggauuuca

SEQ ID NO: 1374032 - RNA, 12 nt, Neisseria meningitidis Z2491
agucuucggcaa

SEQ ID NO: 1374033 - RNA, 20 nt, Neisseria meningitidis Z2491
agugcgaugacgaagccgaa

SEQ ID NO: 1374034 - RNA, 13 nt, Neisseria meningitidis Z2491
aguuccagacggc

SEQ ID NO: 1374035 - RNA, 15 nt, Neisseria meningitidis Z2491
aguaaucacaacggc

SEQ ID NO: 1374036 - RNA, 18 nt, Neisseria meningitidis Z2491
agguuuucggacggcauu

SEQ ID NO: 1374037 - RNA, 17 nt, Neisseria meningitidis Z2491
agguuuucagacggcau

SEQ ID NO: 1374038 - RNA, 14 nt, Neisseria meningitidis Z2491
aguaaaugccgucu

SEQ ID NO: 1374039 - RNA, 13 nt, Neisseria meningitidis Z2491
aggucgacggcaa

SEQ ID NO: 1374040 - RNA, 19 nt, Neisseria meningitidis Z2491
aggcguauaaagauacaag

SEQ ID NO: 1374041 - RNA, 20 nt, Neisseria meningitidis Z2491
aggcuguaugccgucugaaa

SEQ ID NO: 1374042 - RNA, 13 nt, Neisseria meningitidis Z2491
aggcagaaaucca

SEQ ID NO: 1374043 - RNA, 23 nt, Neisseria meningitidis Z2491
aggcagcaccguuuaaaacagca

SEQ ID NO: 1374044 - RNA, 19 nt, Neisseria meningitidis Z2491
aggcagcaaaaaugccguc

SEQ ID NO: 1374045 - RNA, 14 nt, Neisseria meningitidis Z2491
aggcgagcuucgcc

SEQ ID NO: 1374046 - RNA, 20 nt, Neisseria meningitidis Z2491
augccgucugaaacggcauc

SEQ ID NO: 1374047 - RNA, 18 nt, Neisseria meningitidis Z2491
augccguuucagacggca

SEQ ID NO: 1374048 - RNA, 20 nt, Neisseria meningitidis Z2491
augccguuucagacggcauc

SEQ ID NO: 1374049 - RNA, 13 nt, Neisseria meningitidis Z2491
augauggcggcaa

SEQ ID NO: 1374050 - RNA, 17 nt, Neisseria meningitidis Z2491
augccgcaaaugccguc

SEQ ID NO: 1374051 - RNA, 22 nt, Neisseria meningitidis Z2491
augcggacggcgugaaugcguc

SEQ ID NO: 1374052 - RNA, 15 nt, Neisseria meningitidis Z2491
auggaaaugccgucu

SEQ ID NO: 1374053 - RNA, 20 nt, Neisseria meningitidis Z2491
auggaaaggcaaaugccguc

SEQ ID NO: 1374054 - RNA, 15 nt, Neisseria meningitidis Z2491
augucgguaaucgcc

SEQ ID NO: 1374055 - RNA, 19 nt, Neisseria meningitidis Z2491
auguuuuugcguucagacg

SEQ ID NO: 1374056 - RNA, 11 nt, Neisseria meningitidis Z2491
auguucagacg

SEQ ID NO: 1374057 - RNA, 18 nt, Neisseria meningitidis Z2491
auucaauuaaauaccguc

SEQ ID NO: 1374058 - RNA, 15 nt, Neisseria meningitidis Z2491
auuauaaaagacauu

SEQ ID NO: 1374059 - RNA, 21 nt, Neisseria meningitidis Z2491
auucuguuuggauaugccgua

SEQ ID NO: 1374060 - RNA, 16 nt, Neisseria meningitidis Z2491
auucuguccagacgga

SEQ ID NO: 1374061 - RNA, 13 nt, Neisseria meningitidis Z2491
auugacggacggc

SEQ ID NO: 1374062 - RNA, 14 nt, Neisseria meningitidis Z2491
auucggaggcgcau

SEQ ID NO: 1374063 - RNA, 20 nt, Neisseria meningitidis Z2491
auuccugccugcgcgggaau

SEQ ID NO: 1374064 - RNA, 23 nt, Neisseria meningitidis Z2491
auuccguugcaauguugucgccu

SEQ ID NO: 1374065 - RNA, 21 nt, Neisseria meningitidis Z2491
auuguauauuggcauccacau

SEQ ID NO: 1374066 - RNA, 20 nt, Neisseria meningitidis Z2491
auuuaaaccaguacggcguu

SEQ ID NO: 1374067 - RNA, 15 nt, Neisseria meningitidis Z2491
auugcuccugacggc

SEQ ID NO: 1374068 - RNA, 19 nt, Neisseria meningitidis Z2491
aucgagguuguucagcggu

SEQ ID NO: 1374069 - RNA, 19 nt, Neisseria meningitidis Z2491
aucgccuuacggauggcau

SEQ ID NO: 1374070 - RNA, 22 nt, Neisseria meningitidis Z2491
aucgucagaccccuuucggcau

SEQ ID NO: 1374071 - RNA, 16 nt, Neisseria meningitidis Z2491
aucuuucagacggcau

SEQ ID NO: 1374072 - RNA, 12 nt, Neisseria meningitidis Z2491
caaaugccgcca

SEQ ID NO: 1374073 - RNA, 14 nt, Neisseria meningitidis Z2491
caaaugccgucuga

SEQ ID NO: 1374074 - RNA, 20 nt, Neisseria meningitidis Z2491
caaaugccgucugaaaggcu

SEQ ID NO: 1374075 - RNA, 17 nt, Neisseria meningitidis Z2491
caaaucggcuucagaca

SEQ ID NO: 1374076 - RNA, 17 nt, Neisseria meningitidis Z2491
caaaucgucauucccgc

SEQ ID NO: 1374077 - RNA, 17 nt, Neisseria meningitidis Z2491
caaagcccccugcacgc

SEQ ID NO: 1374078 - RNA, 22 nt, Neisseria meningitidis Z2491
caacaugccaccgucauucccg

SEQ ID NO: 1374079 - RNA, 23 nt, Neisseria meningitidis Z2491
caacaugccaccgucauucccgc

SEQ ID NO: 1374080 - RNA, 20 nt, Neisseria meningitidis Z2491
caacauuccgucauucccgu

SEQ ID NO: 1374081 - RNA, 18 nt, Neisseria meningitidis Z2491
caacgcacuggauucccg

SEQ ID NO: 1374082 - RNA, 19 nt, Neisseria meningitidis Z2491
caacgaaccuggauucccg

SEQ ID NO: 1374083 - RNA, 18 nt, Neisseria meningitidis Z2491
caaccuguuuuucaaagc

SEQ ID NO: 1374084 - RNA, 20 nt, Neisseria meningitidis Z2491
caacgcgaaggcgaccgccu

SEQ ID NO: 1374085 - RNA, 13 nt, Neisseria meningitidis Z2491
caacgccguaccg

SEQ ID NO: 1374086 - RNA, 13 nt, Neisseria meningitidis Z2491
caacgcuguaccg

SEQ ID NO: 1374087 - RNA, 19 nt, Neisseria meningitidis Z2491
caaccgacaauacggcggc

SEQ ID NO: 1374088 - RNA, 13 nt, Neisseria meningitidis Z2491
caaccuugccaag

SEQ ID NO: 1374089 - RNA, 21 nt, Neisseria meningitidis Z2491
caaucucaaaucccgucauuc

SEQ ID NO: 1374090 - RNA, 24 nt, Neisseria meningitidis Z2491
caauucacuuggugcuucagcacc

SEQ ID NO: 1374091 - RNA, 11 nt, Neisseria meningitidis Z2491
caauucccacc

SEQ ID NO: 1374092 - RNA, 17 nt, Neisseria meningitidis Z2491
caacguuuuaccguuca

SEQ ID NO: 1374093 - RNA, 20 nt, Neisseria meningitidis Z2491
caacucuccgucauucccgc

SEQ ID NO: 1374094 - RNA, 12 nt, Neisseria meningitidis Z2491
caacugaaaccg

SEQ ID NO: 1374095 - RNA, 23 nt, Neisseria meningitidis Z2491
caacgcuugaaucuucauuccgc

SEQ ID NO: 1374096 - RNA, 14 nt, Neisseria meningitidis Z2491
caaggcagcaacga

SEQ ID NO: 1374097 - RNA, 19 nt, Neisseria meningitidis Z2491
caagccuucccguuccaca

SEQ ID NO: 1374098 - RNA, 18 nt, Neisseria meningitidis Z2491
caagacaggcggauggcg

SEQ ID NO: 1374099 - RNA, 18 nt, Neisseria meningitidis Z2491
ccauccauacggaaaccu

SEQ ID NO: 1374100 - RNA, 20 nt, Neisseria meningitidis Z2491
ccaucgcaaucauggcgcgu

SEQ ID NO: 1374101 - RNA, 20 nt, Neisseria meningitidis Z2491
cccacuuuugugggaaugac

SEQ ID NO: 1374102 - RNA, 20 nt, Neisseria meningitidis Z2491
cccacuuucgugggaaugac

SEQ ID NO: 1374103 - RNA, 14 nt, Neisseria meningitidis Z2491
ccaucagcacgccg

SEQ ID NO: 1374104 - RNA, 17 nt, Neisseria meningitidis Z2491
ccagugcgccggcauaa

SEQ ID NO: 1374105 - RNA, 18 nt, Neisseria meningitidis Z2491
cccgaaauaggcugcccg

SEQ ID NO: 1374106 - RNA, 14 nt, Neisseria meningitidis Z2491
cccgacugugccca

SEQ ID NO: 1374107 - RNA, 20 nt, Neisseria meningitidis Z2491
cccgccugcgcgggaaugac

SEQ ID NO: 1374108 - RNA, 20 nt, Neisseria meningitidis Z2491
cccgccuacgcgggaaugac

SEQ ID NO: 1374109 - RNA, 21 nt, Neisseria meningitidis Z2491
cccgauucgaacgggcggaua

SEQ ID NO: 1374110 - RNA, 13 nt, Neisseria meningitidis Z2491
ccgaaacauuccg

SEQ ID NO: 1374111 - RNA, 16 nt, Neisseria meningitidis Z2491
ccgaaacauuccgcca

SEQ ID NO: 1374112 - RNA, 18 nt, Neisseria meningitidis Z2491
cccuguuucgggcaaaag

SEQ ID NO: 1374113 - RNA, 22 nt, Neisseria meningitidis Z2491
cccgguuggaaggcggcggcaa

SEQ ID NO: 1374114 - RNA, 19 nt, Neisseria meningitidis Z2491
cccgugaaaaaaugccguc

SEQ ID NO: 1374115 - RNA, 17 nt, Neisseria meningitidis Z2491
ccagcagcccuugcccc

SEQ ID NO: 1374116 - RNA, 21 nt, Neisseria meningitidis Z2491
ccagcagcaacacauugccac

SEQ ID NO: 1374117 - RNA, 19 nt, Neisseria meningitidis Z2491
aaauaugguucagacggca

SEQ ID NO: 1374118 - RNA, 20 nt, Neisseria meningitidis Z2491
aaauaugccgucauucccgc

SEQ ID NO: 1374119 - RNA, 22 nt, Neisseria meningitidis Z2491
ccagccguauuugucuuccgcc

SEQ ID NO: 1374120 - RNA, 22 nt, Neisseria meningitidis Z2491
ccagaccauuggacagcggcaa

SEQ ID NO: 1374121 - RNA, 21 nt, Neisseria meningitidis Z2491
ccaccgacauuucauugccgc

SEQ ID NO: 1374122 - RNA, 20 nt, Neisseria meningitidis Z2491
aaaguuugagguucuagauu

SEQ ID NO: 1374123 - RNA, 19 nt, Neisseria meningitidis Z2491
aaauacaaaaggccgucug

SEQ ID NO: 1374124 - RNA, 17 nt, Neisseria meningitidis Z2491
ccacgccgacugccgcc

SEQ ID NO: 1374125 - RNA, 22 nt, Neisseria meningitidis Z2491
ccaauaccguccccgaaaccga

SEQ ID NO: 1374126 - RNA, 23 nt, Neisseria meningitidis Z2491
ccaauaccgccuuguucggaauc

SEQ ID NO: 1374127 - RNA, 17 nt, Neisseria meningitidis Z2491
ccaaaaccgugccgaca

SEQ ID NO: 1374128 - RNA, 19 nt, Neisseria meningitidis Z2491
ccaaaaucgaagaaagcau

SEQ ID NO: 1374129 - RNA, 17 nt, Neisseria meningitidis Z2491
ccaaaccgucauucccg

SEQ ID NO: 1374130 - RNA, 20 nt, Neisseria meningitidis Z2491
ccaaacccucggcauucccg

SEQ ID NO: 1374131 - RNA, 17 nt, Neisseria meningitidis Z2491
ccaaaccgccauucccg

SEQ ID NO: 1374132 - RNA, 15 nt, Neisseria meningitidis Z2491
ccaacucggcaaacg

SEQ ID NO: 1374133 - RNA, 16 nt, Neisseria meningitidis Z2491
cauuugcgcagccugc

SEQ ID NO: 1374134 - RNA, 14 nt, Neisseria meningitidis Z2491
cauuuggaaagccg

SEQ ID NO: 1374135 - RNA, 15 nt, Neisseria meningitidis Z2491
cauugcgaacugccu

SEQ ID NO: 1374136 - RNA, 18 nt, Neisseria meningitidis Z2491
cauucccacgaaaguggg

SEQ ID NO: 1374137 - RNA, 20 nt, Neisseria meningitidis Z2491
cauucagacggcauccgcuu

SEQ ID NO: 1374138 - RNA, 17 nt, Neisseria meningitidis Z2491
cauuaaauuuccagauu

SEQ ID NO: 1374139 - RNA, 16 nt, Neisseria meningitidis Z2491
caguucagacggcauu

SEQ ID NO: 1374140 - RNA, 23 nt, Neisseria meningitidis Z2491
caguucggacaaaccguccaaua

SEQ ID NO: 1374141 - RNA, 22 nt, Neisseria meningitidis Z2491
caguucuacacccaaauccgcc

SEQ ID NO: 1374142 - RNA, 19 nt, Neisseria meningitidis Z2491
caggugcugggugguggca

SEQ ID NO: 1374143 - RNA, 20 nt, Neisseria meningitidis Z2491
cagggacagcggacgcguug

SEQ ID NO: 1374144 - RNA, 17 nt, Neisseria meningitidis Z2491
cauaguuuggacggcgg

SEQ ID NO: 1374145 - RNA, 13 nt, Neisseria meningitidis Z2491
caguuuaaucccu

SEQ ID NO: 1374146 - RNA, 13 nt, Neisseria meningitidis Z2491
caguuuugcagau

SEQ ID NO: 1374147 - RNA, 21 nt, Neisseria meningitidis Z2491
cauaaucacaccgaucaggcu

SEQ ID NO: 1374148 - RNA, 16 nt, Neisseria meningitidis Z2491
cauaaaugccgucuga

SEQ ID NO: 1374149 - RNA, 19 nt, Neisseria meningitidis Z2491
cauaaaauaugccgucuga

SEQ ID NO: 1374150 - RNA, 17 nt, Neisseria meningitidis Z2491
cauaaaaugccgucuga

SEQ ID NO: 1374151 - RNA, 20 nt, Neisseria meningitidis Z2491
caucaugcggaagaagugcg

SEQ ID NO: 1374152 - RNA, 15 nt, Neisseria meningitidis Z2491
caucauaugcaucag

SEQ ID NO: 1374153 - RNA, 13 nt, Neisseria meningitidis Z2491
caucauucccaca

SEQ ID NO: 1374154 - RNA, 17 nt, Neisseria meningitidis Z2491
caggaacacggcggcac

SEQ ID NO: 1374155 - RNA, 20 nt, Neisseria meningitidis Z2491
cagcuuuugcgccacggcau

SEQ ID NO: 1374156 - RNA, 16 nt, Neisseria meningitidis Z2491
caggacaaggcaacga

SEQ ID NO: 1374157 - RNA, 14 nt, Neisseria meningitidis Z2491
cagcauacggaugu

SEQ ID NO: 1374158 - RNA, 13 nt, Neisseria meningitidis Z2491
aaacugggcggau

SEQ ID NO: 1374159 - RNA, 14 nt, Neisseria meningitidis Z2491
cacggcagcacuga

SEQ ID NO: 1374160 - RNA, 21 nt, Neisseria meningitidis Z2491
cagaaacagcgaagacaggca

SEQ ID NO: 1374161 - RNA, 20 nt, Neisseria meningitidis Z2491
cagaaaccgcucugccguca

SEQ ID NO: 1374162 - RNA, 13 nt, Neisseria meningitidis Z2491
cacugucucggca

SEQ ID NO: 1374163 - RNA, 20 nt, Neisseria meningitidis Z2491
ccgaaaugccgucauucccg

SEQ ID NO: 1374164 - RNA, 20 nt, Neisseria meningitidis Z2491
ccgaacagaccggauucccg

SEQ ID NO: 1374165 - RNA, 18 nt, Neisseria meningitidis Z2491
ccgcaaagccgccgccga

SEQ ID NO: 1374166 - RNA, 13 nt, Neisseria meningitidis Z2491
ccgcaaccgccga

SEQ ID NO: 1374167 - RNA, 22 nt, Neisseria meningitidis Z2491
ccgcaacucuccgucauucccg

SEQ ID NO: 1374168 - RNA, 19 nt, Neisseria meningitidis Z2491
ccgccaaccguuccaacgc

SEQ ID NO: 1374169 - RNA, 19 nt, Neisseria meningitidis Z2491
aaauguucagacggcauuu

SEQ ID NO: 1374170 - RNA, 21 nt, Neisseria meningitidis Z2491
aaauucaucgcgcugccgucg

SEQ ID NO: 1374171 - RNA, 16 nt, Neisseria meningitidis Z2491
ccgcuguauuugcgcc

SEQ ID NO: 1374172 - RNA, 16 nt, Neisseria meningitidis Z2491
aaauucuagauucccg

SEQ ID NO: 1374173 - RNA, 17 nt, Neisseria meningitidis Z2491
ccggcuucagacggcau

SEQ ID NO: 1374174 - RNA, 18 nt, Neisseria meningitidis Z2491
ccggcuucagacggcaua

SEQ ID NO: 1374175 - RNA, 15 nt, Neisseria meningitidis Z2491
ccggcgcggcaaaag

SEQ ID NO: 1374176 - RNA, 12 nt, Neisseria meningitidis Z2491
ccucauugccgc

SEQ ID NO: 1374177 - RNA, 20 nt, Neisseria meningitidis Z2491
ccuaaaauucgucauuccca

SEQ ID NO: 1374178 - RNA, 21 nt, Neisseria meningitidis Z2491
ccuaaaaucccgucauucccg

SEQ ID NO: 1374179 - RNA, 20 nt, Neisseria meningitidis Z2491
ccuaaaauccgucauucccg

SEQ ID NO: 1374180 - RNA, 14 nt, Neisseria meningitidis Z2491
ccguuucccauccu

SEQ ID NO: 1374181 - RNA, 16 nt, Neisseria meningitidis Z2491
ccguuucagacggcau

SEQ ID NO: 1374182 - RNA, 17 nt, Neisseria meningitidis Z2491
ccguuucagacggcauc

SEQ ID NO: 1374183 - RNA, 17 nt, Neisseria meningitidis Z2491
ccguuucagacggcauu

SEQ ID NO: 1374184 - RNA, 20 nt, Neisseria meningitidis Z2491
cgcaggcagcagaucgaccg

SEQ ID NO: 1374185 - RNA, 16 nt, Neisseria meningitidis Z2491
cgcauucagacggcau

SEQ ID NO: 1374186 - RNA, 15 nt, Neisseria meningitidis Z2491
cgcaaugccgucuga

SEQ ID NO: 1374187 - RNA, 21 nt, Neisseria meningitidis Z2491
cgcaaugacgcugcccgccga

SEQ ID NO: 1374188 - RNA, 18 nt, Neisseria meningitidis Z2491
cgcaaaugcguaugcccc

SEQ ID NO: 1374189 - RNA, 15 nt, Neisseria meningitidis Z2491
cgcagcaguauuaga

SEQ ID NO: 1374190 - RNA, 14 nt, Neisseria meningitidis Z2491
cgauagauucccgu

SEQ ID NO: 1374191 - RNA, 18 nt, Neisseria meningitidis Z2491
cgaugccgucauucccgc

SEQ ID NO: 1374192 - RNA, 12 nt, Neisseria meningitidis Z2491
cgaugccguuca

SEQ ID NO: 1374193 - RNA, 22 nt, Neisseria meningitidis Z2491
cgaaauaacucaucaucggcgu

SEQ ID NO: 1374194 - RNA, 18 nt, Neisseria meningitidis Z2491
cgaacagaccggauuccc

SEQ ID NO: 1374195 - RNA, 20 nt, Neisseria meningitidis Z2491
cgaacagaccggauucccgc

SEQ ID NO: 1374196 - RNA, 17 nt, Neisseria meningitidis Z2491
cgaaccuggauucccgc

SEQ ID NO: 1374197 - RNA, 16 nt, Neisseria meningitidis Z2491
cgaaccgaaacggcgc

SEQ ID NO: 1374198 - RNA, 17 nt, Neisseria meningitidis Z2491
cgaaguuucagacggca

SEQ ID NO: 1374199 - RNA, 23 nt, Neisseria meningitidis Z2491
cgaaucuuccaagaaaagccgua

SEQ ID NO: 1374200 - RNA, 19 nt, Neisseria meningitidis Z2491
ccuuugggcgacggcaaua

SEQ ID NO: 1374201 - RNA, 19 nt, Neisseria meningitidis Z2491
ccuuugggcggcggcaaua

SEQ ID NO: 1374202 - RNA, 15 nt, Neisseria meningitidis Z2491
ccuuucagacggcau

SEQ ID NO: 1374203 - RNA, 16 nt, Neisseria meningitidis Z2491
cgaaaaugccgucuga

SEQ ID NO: 1374204 - RNA, 13 nt, Neisseria meningitidis Z2491
cgaaacauuccgc

SEQ ID NO: 1374205 - RNA, 14 nt, Neisseria meningitidis Z2491
ccuucagacggcau

SEQ ID NO: 1374206 - RNA, 19 nt, Neisseria meningitidis Z2491
ccuucgggcagcggcaaua

SEQ ID NO: 1374207 - RNA, 19 nt, Neisseria meningitidis Z2491
ccugucgccgucauucccg

SEQ ID NO: 1374208 - RNA, 12 nt, Neisseria meningitidis Z2491
cgaauugcgccg

SEQ ID NO: 1374209 - RNA, 18 nt, Neisseria meningitidis Z2491
cgacgagaauuuaucaga

SEQ ID NO: 1374210 - RNA, 21 nt, Neisseria meningitidis Z2491
aacaaguugcccaauaccguc

SEQ ID NO: 1374211 - RNA, 18 nt, Neisseria meningitidis Z2491
aacacaaaugccgucuga

SEQ ID NO: 1374212 - RNA, 19 nt, Neisseria meningitidis Z2491
cgacggcguaauccgccug

SEQ ID NO: 1374213 - RNA, 16 nt, Neisseria meningitidis Z2491
aacaugccaccgucau

SEQ ID NO: 1374214 - RNA, 10 nt, Neisseria meningitidis Z2491
cgggaaugac

SEQ ID NO: 1374215 - RNA, 19 nt, Neisseria meningitidis Z2491
cggcugcgggcgcguuuga

SEQ ID NO: 1374216 - RNA, 12 nt, Neisseria meningitidis Z2491
cggcuugccgcc

SEQ ID NO: 1374217 - RNA, 16 nt, Neisseria meningitidis Z2491
cggcuuucagacggca

SEQ ID NO: 1374218 - RNA, 19 nt, Neisseria meningitidis Z2491
cgggaagccagggcggauu

SEQ ID NO: 1374219 - RNA, 18 nt, Neisseria meningitidis Z2491
cgggcugaaucgccaaug

SEQ ID NO: 1374220 - RNA, 19 nt, Neisseria meningitidis Z2491
cggcggcaauaauggcaac

SEQ ID NO: 1374221 - RNA, 19 nt, Neisseria meningitidis Z2491
cggcgaaaaaauggugucc

SEQ ID NO: 1374222 - RNA, 20 nt, Neisseria meningitidis Z2491
cggauguauucggauucccu

SEQ ID NO: 1374223 - RNA, 17 nt, Neisseria meningitidis Z2491
cggauguucaaacacgg

SEQ ID NO: 1374224 - RNA, 16 nt, Neisseria meningitidis Z2491
cggauuuucaauccgu

SEQ ID NO: 1374225 - RNA, 23 nt, Neisseria meningitidis Z2491
cggcaacauaaacaaagccggcg

SEQ ID NO: 1374226 - RNA, 21 nt, Neisseria meningitidis Z2491
cggacuggauucccgccugcg

SEQ ID NO: 1374227 - RNA, 22 nt, Neisseria meningitidis Z2491
cggauagcuucgucauucccgc

SEQ ID NO: 1374228 - RNA, 18 nt, Neisseria meningitidis Z2491
cggcaggucuucgggcag

SEQ ID NO: 1374229 - RNA, 16 nt, Neisseria meningitidis Z2491
cggcaggaacacggcg

SEQ ID NO: 1374230 - RNA, 16 nt, Neisseria meningitidis Z2491
cggcauuucugcgaaa

SEQ ID NO: 1374231 - RNA, 17 nt, Neisseria meningitidis Z2491
cggcauucugcacgccg

SEQ ID NO: 1374232 - RNA, 20 nt, Neisseria meningitidis Z2491
cggcauugacauauccggcu

SEQ ID NO: 1374233 - RNA, 18 nt, Neisseria meningitidis Z2491
cggccgguugcguaucaa

SEQ ID NO: 1374234 - RNA, 16 nt, Neisseria meningitidis Z2491
cggccugcccugccaa

SEQ ID NO: 1374235 - RNA, 20 nt, Neisseria meningitidis Z2491
cgcgccaaaucauagaggcg

SEQ ID NO: 1374236 - RNA, 13 nt, Neisseria meningitidis Z2491
cgcgcgccgucca

SEQ ID NO: 1374237 - RNA, 18 nt, Neisseria meningitidis Z2491
cgcgccguguucgagcag

SEQ ID NO: 1374238 - RNA, 16 nt, Neisseria meningitidis Z2491
cgcgggcguucagauu

SEQ ID NO: 1374239 - RNA, 20 nt, Neisseria meningitidis Z2491
cgcgggaaugacgaauuuca

SEQ ID NO: 1374240 - RNA, 18 nt, Neisseria meningitidis Z2491
cgcgggaaugacggcgga

SEQ ID NO: 1374241 - RNA, 15 nt, Neisseria meningitidis Z2491
cgccugagcaaaugc

SEQ ID NO: 1374242 - RNA, 18 nt, Neisseria meningitidis Z2491
cgccggucuguccgaccu

SEQ ID NO: 1374243 - RNA, 23 nt, Neisseria meningitidis Z2491
cgcccguuaccagcagugccgca

SEQ ID NO: 1374244 - RNA, 12 nt, Neisseria meningitidis Z2491
gcgagacggcau

SEQ ID NO: 1374245 - RNA, 20 nt, Neisseria meningitidis Z2491
gcgacacgaccgaccggcau

SEQ ID NO: 1374246 - RNA, 15 nt, Neisseria meningitidis Z2491
aagcccuuucagacg

SEQ ID NO: 1374247 - RNA, 20 nt, Neisseria meningitidis Z2491
aagcccuuucagacggcauu

SEQ ID NO: 1374248 - RNA, 19 nt, Neisseria meningitidis Z2491
gcgcaaccuugccaagguu

SEQ ID NO: 1374249 - RNA, 14 nt, Neisseria meningitidis Z2491
gccgucauucccgc

SEQ ID NO: 1374250 - RNA, 19 nt, Neisseria meningitidis Z2491
gccguauucccguccggca

SEQ ID NO: 1374251 - RNA, 15 nt, Neisseria meningitidis Z2491
gccguaucgccgacg

SEQ ID NO: 1374252 - RNA, 20 nt, Neisseria meningitidis Z2491
gccguauccauugccgauac

SEQ ID NO: 1374253 - RNA, 23 nt, Neisseria meningitidis Z2491
gccgucuuucaggaagucgggca

SEQ ID NO: 1374254 - RNA, 18 nt, Neisseria meningitidis Z2491
gccucgccuugccguacu

SEQ ID NO: 1374255 - RNA, 18 nt, Neisseria meningitidis Z2491
gccugcgcgcggacggau

SEQ ID NO: 1374256 - RNA, 13 nt, Neisseria meningitidis Z2491
gccggcgaugccg

SEQ ID NO: 1374257 - RNA, 18 nt, Neisseria meningitidis Z2491
gccgcuucaccgacaccg

SEQ ID NO: 1374258 - RNA, 17 nt, Neisseria meningitidis Z2491
gcgguccaaaacggcgg

SEQ ID NO: 1374259 - RNA, 18 nt, Neisseria meningitidis Z2491
gcggggcaacgccguacc

SEQ ID NO: 1374260 - RNA, 15 nt, Neisseria meningitidis Z2491
gcgggaaugacggau

SEQ ID NO: 1374261 - RNA, 16 nt, Neisseria meningitidis Z2491
gcgggaaugacggcag

SEQ ID NO: 1374262 - RNA, 16 nt, Neisseria meningitidis Z2491
gcgggaaugacgggau

SEQ ID NO: 1374263 - RNA, 22 nt, Neisseria meningitidis Z2491
gcgggaaugaugggguuuuuaa

SEQ ID NO: 1374264 - RNA, 20 nt, Neisseria meningitidis Z2491
gcggcagauaaauacccaua

SEQ ID NO: 1374265 - RNA, 13 nt, Neisseria meningitidis Z2491
aagccuucagacg

SEQ ID NO: 1374266 - RNA, 15 nt, Neisseria meningitidis Z2491
aagccuucagacggc

SEQ ID NO: 1374267 - RNA, 18 nt, Neisseria meningitidis Z2491
aagccuucagacggcaua

SEQ ID NO: 1374268 - RNA, 18 nt, Neisseria meningitidis Z2491
aagccuucagacggcauu

SEQ ID NO: 1374269 - RNA, 22 nt, Neisseria meningitidis Z2491
gcggcagggucggcgacggcgu

SEQ ID NO: 1374270 - RNA, 19 nt, Neisseria meningitidis Z2491
gcggcaaauuccgucagca

SEQ ID NO: 1374271 - RNA, 13 nt, Neisseria meningitidis Z2491
gcggcaaugccgu

SEQ ID NO: 1374272 - RNA, 15 nt, Neisseria meningitidis Z2491
aagccgcccggcauu

SEQ ID NO: 1374273 - RNA, 15 nt, Neisseria meningitidis Z2491
aagccggcggcaaca

SEQ ID NO: 1374274 - RNA, 22 nt, Neisseria meningitidis Z2491
gcggaaaaaucauaagacggau

SEQ ID NO: 1374275 - RNA, 16 nt, Neisseria meningitidis Z2491
gcugcgggaaugacgg

SEQ ID NO: 1374276 - RNA, 18 nt, Neisseria meningitidis Z2491
gcgucaucaaggcgacgg

SEQ ID NO: 1374277 - RNA, 16 nt, Neisseria meningitidis Z2491
gcguaggucagcccgg

SEQ ID NO: 1374278 - RNA, 22 nt, Neisseria meningitidis Z2491
gcguuuuuuauauggcggauuu

SEQ ID NO: 1374279 - RNA, 12 nt, Neisseria meningitidis Z2491
gcguucgugcag

SEQ ID NO: 1374280 - RNA, 19 nt, Neisseria meningitidis Z2491
gcguucgcgggaaugacgg

SEQ ID NO: 1374281 - RNA, 19 nt, Neisseria meningitidis Z2491
gucaagcaaaaaaugccgu

SEQ ID NO: 1374282 - RNA, 21 nt, Neisseria meningitidis Z2491
guaugcguucaaaugccgucu

SEQ ID NO: 1374283 - RNA, 14 nt, Neisseria meningitidis Z2491
guauccauugccga

SEQ ID NO: 1374284 - RNA, 12 nt, Neisseria meningitidis Z2491
guaugugcgccg

SEQ ID NO: 1374285 - RNA, 14 nt, Neisseria meningitidis Z2491
gucagaaucgccuc

SEQ ID NO: 1374286 - RNA, 20 nt, Neisseria meningitidis Z2491
guaagcggagguugacggcu

SEQ ID NO: 1374287 - RNA, 18 nt, Neisseria meningitidis Z2491
gguuuucagacggcauuu

SEQ ID NO: 1374288 - RNA, 14 nt, Neisseria meningitidis Z2491
gguuuuaacaaugu

SEQ ID NO: 1374289 - RNA, 19 nt, Neisseria meningitidis Z2491
guacaaaugccgucugaaa

SEQ ID NO: 1374290 - RNA, 18 nt, Neisseria meningitidis Z2491
guaccugaugaucgccga

SEQ ID NO: 1374291 - RNA, 17 nt, Neisseria meningitidis Z2491
guauauuucccgucugc

SEQ ID NO: 1374292 - RNA, 22 nt, Neisseria meningitidis Z2491
guccgaaugccgcaaaugccgu

SEQ ID NO: 1374293 - RNA, 14 nt, Neisseria meningitidis Z2491
guccgguuuccguu

SEQ ID NO: 1374294 - RNA, 19 nt, Neisseria meningitidis Z2491
gucgauauagaaaugccgu

SEQ ID NO: 1374295 - RNA, 17 nt, Neisseria meningitidis Z2491
aaguacaaaaugccguc

SEQ ID NO: 1374296 - RNA, 15 nt, Neisseria meningitidis Z2491
ggguucggacggcau

SEQ ID NO: 1374297 - RNA, 18 nt, Neisseria meningitidis Z2491
gguauuuuuuauccggcg

SEQ ID NO: 1374298 - RNA, 16 nt, Neisseria meningitidis Z2491
gggcuucagacggcau

SEQ ID NO: 1374299 - RNA, 13 nt, Neisseria meningitidis Z2491
gggcaaagcggca

SEQ ID NO: 1374300 - RNA, 11 nt, Neisseria meningitidis Z2491
gggauggcggg

SEQ ID NO: 1374301 - RNA, 16 nt, Neisseria meningitidis Z2491
gggcagcggcaauauu

SEQ ID NO: 1374302 - RNA, 18 nt, Neisseria meningitidis Z2491
ggacacgcccucaaacgg

SEQ ID NO: 1374303 - RNA, 19 nt, Neisseria meningitidis Z2491
ggaaggaugggguuucaga

SEQ ID NO: 1374304 - RNA, 20 nt, Neisseria meningitidis Z2491
ggaaucuagaaccucuaaac

SEQ ID NO: 1374305 - RNA, 19 nt, Neisseria meningitidis Z2491
ggaaucuaggucuuuaaac

SEQ ID NO: 1374306 - RNA, 18 nt, Neisseria meningitidis Z2491
ggagaggcuuucagacgg

SEQ ID NO: 1374307 - RNA, 12 nt, Neisseria meningitidis Z2491
aaggaugccguu

SEQ ID NO: 1374308 - RNA, 21 nt, Neisseria meningitidis Z2491
aaggaugccguuucagacggc

SEQ ID NO: 1374309 - RNA, 19 nt, Neisseria meningitidis Z2491
aaggcagcaacgacagcag

SEQ ID NO: 1374310 - RNA, 19 nt, Neisseria meningitidis Z2491
ggcaacaucauagaaauca

SEQ ID NO: 1374311 - RNA, 17 nt, Neisseria meningitidis Z2491
ggcagugauuucccguc

SEQ ID NO: 1374312 - RNA, 15 nt, Neisseria meningitidis Z2491
ggcagcaacgacagc

SEQ ID NO: 1374313 - RNA, 16 nt, Neisseria meningitidis Z2491
ggcgaccgccgccgca

SEQ ID NO: 1374314 - RNA, 15 nt, Neisseria meningitidis Z2491
aaggcuucagacggc

SEQ ID NO: 1374315 - RNA, 18 nt, Neisseria meningitidis Z2491
aaggcuucagacggcauc

SEQ ID NO: 1374316 - RNA, 16 nt, Neisseria meningitidis Z2491
aaggcuuucagacggc

SEQ ID NO: 1374317 - RNA, 15 nt, Neisseria meningitidis Z2491
aaggcuggauucccg

SEQ ID NO: 1374318 - RNA, 15 nt, Neisseria meningitidis Z2491
ggcgacggcaauauu

SEQ ID NO: 1374319 - RNA, 17 nt, Neisseria meningitidis Z2491
aaggcggcgagccgcag

SEQ ID NO: 1374320 - RNA, 13 nt, Neisseria meningitidis Z2491
aaggcggcggcaa

SEQ ID NO: 1374321 - RNA, 19 nt, Neisseria meningitidis Z2491
aaggcgcggcacacgcauu

SEQ ID NO: 1374322 - RNA, 16 nt, Neisseria meningitidis Z2491
aaggucggcggcggau

SEQ ID NO: 1374323 - RNA, 14 nt, Neisseria meningitidis Z2491
ggcgguuugccguc

SEQ ID NO: 1374324 - RNA, 17 nt, Neisseria meningitidis Z2491
ggcggcaacaaugccgu

SEQ ID NO: 1374325 - RNA, 17 nt, Neisseria meningitidis Z2491
gcaacuuugcguuucua

SEQ ID NO: 1374326 - RNA, 20 nt, Neisseria meningitidis Z2491
gcaacuuugcguuucuagau

SEQ ID NO: 1374327 - RNA, 22 nt, Neisseria meningitidis Z2491
gcaacucuccgucauucccacg

SEQ ID NO: 1374328 - RNA, 23 nt, Neisseria meningitidis Z2491
gcaacugaaccgucauucccacg

SEQ ID NO: 1374329 - RNA, 23 nt, Neisseria meningitidis Z2491
gcaagcugugguuugccgaguuu

SEQ ID NO: 1374330 - RNA, 19 nt, Neisseria meningitidis Z2491
gcaagcguucacgccagca

SEQ ID NO: 1374331 - RNA, 19 nt, Neisseria meningitidis Z2491
gcaacguuucagacgguau

SEQ ID NO: 1374332 - RNA, 16 nt, Neisseria meningitidis Z2491
gcaaucagugcggcau

SEQ ID NO: 1374333 - RNA, 22 nt, Neisseria meningitidis Z2491
gcaaucguuucugucgccagca

SEQ ID NO: 1374334 - RNA, 14 nt, Neisseria meningitidis Z2491
gcaaugccgucuga

SEQ ID NO: 1374335 - RNA, 16 nt, Neisseria meningitidis Z2491
gauucugccaaacggc

SEQ ID NO: 1374336 - RNA, 17 nt, Neisseria meningitidis Z2491
gauuugaacgacgguau

SEQ ID NO: 1374337 - RNA, 15 nt, Neisseria meningitidis Z2491
gauuaucugaaaguu

SEQ ID NO: 1374338 - RNA, 21 nt, Neisseria meningitidis Z2491
gauucccguuucagacggcau

SEQ ID NO: 1374339 - RNA, 17 nt, Neisseria meningitidis Z2491
gcaaaaaugccgucuga

SEQ ID NO: 1374340 - RNA, 21 nt, Neisseria meningitidis Z2491
gcaaaaaaagaugccgucuga

SEQ ID NO: 1374341 - RNA, 18 nt, Neisseria meningitidis Z2491
gcaaaaaaugccgucuga

SEQ ID NO: 1374342 - RNA, 16 nt, Neisseria meningitidis Z2491
gcaaaaugccgucuga

SEQ ID NO: 1374343 - RNA, 16 nt, Neisseria meningitidis Z2491
gcaaaagaccgucuga

SEQ ID NO: 1374344 - RNA, 21 nt, Neisseria meningitidis Z2491
gcaaaauaaaaugccgucuga

SEQ ID NO: 1374345 - RNA, 21 nt, Neisseria meningitidis Z2491
gcaaauugaaaugccgucuga

SEQ ID NO: 1374346 - RNA, 23 nt, Neisseria meningitidis Z2491
gcaaauuucagucugucgccguc

SEQ ID NO: 1374347 - RNA, 15 nt, Neisseria meningitidis Z2491
gaugguuuugccgcu

SEQ ID NO: 1374348 - RNA, 22 nt, Neisseria meningitidis Z2491
gcaccguuaacgauacggcggc

SEQ ID NO: 1374349 - RNA, 17 nt, Neisseria meningitidis Z2491
gcacgcgcuucaaaucg

SEQ ID NO: 1374350 - RNA, 14 nt, Neisseria meningitidis Z2491
gauaaguuuccgua

SEQ ID NO: 1374351 - RNA, 14 nt, Neisseria meningitidis Z2491
gauaaguuuccgug

SEQ ID NO: 1374352 - RNA, 19 nt, Neisseria meningitidis Z2491
gauaaguuuccgugcggac

SEQ ID NO: 1374353 - RNA, 12 nt, Neisseria meningitidis Z2491
gauaccgucuga

SEQ ID NO: 1374354 - RNA, 17 nt, Neisseria meningitidis Z2491
gaguuuucagacggcau

SEQ ID NO: 1374355 - RNA, 14 nt, Neisseria meningitidis Z2491
gagucuggcggcau

SEQ ID NO: 1374356 - RNA, 17 nt, Neisseria meningitidis Z2491
gaggaacaaaaugccgc

SEQ ID NO: 1374357 - RNA, 18 nt, Neisseria meningitidis Z2491
gaggaacaaaaugccgcc

SEQ ID NO: 1374358 - RNA, 21 nt, Neisseria meningitidis Z2491
gaggaacaaaaugccgccguc

SEQ ID NO: 1374359 - RNA, 15 nt, Neisseria meningitidis Z2491
aacguuucagacggu

SEQ ID NO: 1374360 - RNA, 21 nt, Neisseria meningitidis Z2491
aacucaaaaaaacuagauucc

SEQ ID NO: 1374361 - RNA, 20 nt, Neisseria meningitidis Z2491
aacucaaaaaaccggauucc

SEQ ID NO: 1374362 - RNA, 20 nt, Neisseria meningitidis Z2491
gacuugccauacaaacaggc

SEQ ID NO: 1374363 - RNA, 15 nt, Neisseria meningitidis Z2491
gacugaauaaacagc

SEQ ID NO: 1374364 - RNA, 19 nt, Neisseria meningitidis Z2491
gacguuuuggaagcggaaa

SEQ ID NO: 1374365 - RNA, 23 nt, Neisseria meningitidis Z2491
gagcagauugacccaaugugcgc

SEQ ID NO: 1374366 - RNA, 19 nt, Neisseria meningitidis Z2491
gagauuuuacguucuagau

SEQ ID NO: 1374367 - RNA, 17 nt, Neisseria meningitidis Z2491
gcccguggcgacggcaa

SEQ ID NO: 1374368 - RNA, 11 nt, Neisseria meningitidis Z2491
aagaugccguc

SEQ ID NO: 1374369 - RNA, 15 nt, Neisseria meningitidis Z2491
aagauugguaucaac

SEQ ID NO: 1374370 - RNA, 14 nt, Neisseria meningitidis Z2491
gccgccaaagugcc

SEQ ID NO: 1374371 - RNA, 20 nt, Neisseria meningitidis Z2491
gccgcagacaguacaaauag

SEQ ID NO: 1374372 - RNA, 14 nt, Neisseria meningitidis Z2491
gccgcaaaugccgu

SEQ ID NO: 1374373 - RNA, 14 nt, Neisseria meningitidis Z2491
gccgcacaaaccgc

SEQ ID NO: 1374374 - RNA, 20 nt, Neisseria meningitidis Z2491
gccauaugcaggucgugcgc

SEQ ID NO: 1374375 - RNA, 19 nt, Neisseria meningitidis Z2491
gccauaaugcccaaaccgc

SEQ ID NO: 1374376 - RNA, 12 nt, Neisseria meningitidis Z2491
gccagcggauug

SEQ ID NO: 1374377 - RNA, 20 nt, Neisseria meningitidis Z2491
gcauccgguuguaaugcgaa

SEQ ID NO: 1374378 - RNA, 16 nt, Neisseria meningitidis Z2491
gcauauagccgagcau

SEQ ID NO: 1374379 - RNA, 20 nt, Neisseria meningitidis Z2491
gcauacgguuuuccgccuga

SEQ ID NO: 1374380 - RNA, 12 nt, Neisseria meningitidis Z2491
gcaguuccaaag

SEQ ID NO: 1374381 - RNA, 15 nt, Neisseria meningitidis Z2491
gcauucagacggcau

SEQ ID NO: 1374382 - RNA, 20 nt, Neisseria meningitidis Z2491
gcauggcgacaaucucgucc

SEQ ID NO: 1374383 - RNA, 17 nt, Neisseria meningitidis Z2491
gccacaagucuucggca

SEQ ID NO: 1374384 - RNA, 12 nt, Neisseria meningitidis Z2491
gccaaugccguc

SEQ ID NO: 1374385 - RNA, 17 nt, Neisseria meningitidis Z2491
gccaaugccgucugaag

SEQ ID NO: 1374386 - RNA, 19 nt, Neisseria meningitidis Z2491
gccaaccguuccaacgcga

SEQ ID NO: 1374387 - RNA, 17 nt, Neisseria meningitidis Z2491
gcauuucauuauccgcc

SEQ ID NO: 1374388 - RNA, 15 nt, Neisseria meningitidis Z2491
gccaaaaaugcggcc

SEQ ID NO: 1374389 - RNA, 20 nt, Neisseria meningitidis Z2491
gaaagguuuucagacggcau

SEQ ID NO: 1374390 - RNA, 15 nt, Neisseria meningitidis Z2491
gaaagcggaaaucca

SEQ ID NO: 1374391 - RNA, 20 nt, Neisseria meningitidis Z2491
gaaaggcuuuuucagacggc

SEQ ID NO: 1374392 - RNA, 21 nt, Neisseria meningitidis Z2491
gaaaccggcuucagacggcau

SEQ ID NO: 1374393 - RNA, 16 nt, Neisseria meningitidis Z2491
gaaaccguauauuucc

SEQ ID NO: 1374394 - RNA, 20 nt, Neisseria meningitidis Z2491
gaaaccguuucagacggcau

SEQ ID NO: 1374395 - RNA, 16 nt, Neisseria meningitidis Z2491
gaaacgaugacggcga

SEQ ID NO: 1374396 - RNA, 21 nt, Neisseria meningitidis Z2491
gaaaccuguuucagacggcau

SEQ ID NO: 1374397 - RNA, 20 nt, Neisseria meningitidis Z2491
gaacaggcuucagacggcau

SEQ ID NO: 1374398 - RNA, 20 nt, Neisseria meningitidis Z2491
gaaagugauuuugucggcaa

SEQ ID NO: 1374399 - RNA, 18 nt, Neisseria meningitidis Z2491
gaacauuucagacggcau

SEQ ID NO: 1374400 - RNA, 18 nt, Neisseria meningitidis Z2491
gaacaucuuucagacggc

SEQ ID NO: 1374401 - RNA, 15 nt, Neisseria meningitidis Z2491
gaacgaaugccgucu

SEQ ID NO: 1374402 - RNA, 22 nt, Neisseria meningitidis Z2491
gaacgcgucuuccgucugcggc

SEQ ID NO: 1374403 - RNA, 13 nt, Neisseria meningitidis Z2491
gaaucuagaccuu

SEQ ID NO: 1374404 - RNA, 15 nt, Neisseria meningitidis Z2491
gaauccaauccgucc

SEQ ID NO: 1374405 - RNA, 21 nt, Neisseria meningitidis Z2491
gaaggcggggcggucagcggu

SEQ ID NO: 1374406 - RNA, 17 nt, Neisseria meningitidis Z2491
gaaggcuucagacggca

SEQ ID NO: 1374407 - RNA, 18 nt, Neisseria meningitidis Z2491
gaaggcuucagacggcau

SEQ ID NO: 1374408 - RNA, 14 nt, Neisseria meningitidis Z2491
gaagcggaaaucgu

SEQ ID NO: 1374409 - RNA, 16 nt, Neisseria meningitidis Z2491
gaagccuucagacggc

SEQ ID NO: 1374410 - RNA, 18 nt, Neisseria meningitidis Z2491
gaagccuucagacggcau

SEQ ID NO: 1374411 - RNA, 23 nt, Neisseria meningitidis Z2491
gaagcguguuuguuucagacggc

SEQ ID NO: 1374412 - RNA, 18 nt, Neisseria meningitidis Z2491
gaagcguauguggucagg

SEQ ID NO: 1374413 - RNA, 19 nt, Neisseria meningitidis Z2491
gaagcccuuucagacggca

SEQ ID NO: 1374414 - RNA, 20 nt, Neisseria meningitidis Z2491
gaagcccuuucagacggcau

SEQ ID NO: 1374415 - RNA, 15 nt, Neisseria meningitidis Z2491
aacgaaugccgucug

SEQ ID NO: 1374416 - RNA, 15 nt, Neisseria meningitidis Z2491
gacagcauuuccaca

SEQ ID NO: 1374417 - RNA, 19 nt, Neisseria meningitidis Z2491
aacgacuuuggucaguguu

SEQ ID NO: 1374418 - RNA, 20 nt, Neisseria meningitidis Z2491
aacgcgaaaaugccgucuga

SEQ ID NO: 1374419 - RNA, 22 nt, Neisseria meningitidis Z2491
gaccagcucccaaucccgauaa

SEQ ID NO: 1374420 - RNA, 12 nt, Neisseria meningitidis Z2491
aacgggauuuca

SEQ ID NO: 1374421 - RNA, 15 nt, Neisseria meningitidis Z2491
aacgcuucagacggc

SEQ ID NO: 1374422 - RNA, 19 nt, Neisseria meningitidis Z2491
gaccgaagcauaagccgcc

SEQ ID NO: 1374423 - RNA, 23 nt, Neisseria meningitidis Z2491
aacggcgcaaccgccggcagugu

SEQ ID NO: 1374424 - RNA, 12 nt, Neisseria meningitidis Z2491
cuggauucccgc

SEQ ID NO: 1374425 - RNA, 15 nt, Neisseria meningitidis Z2491
aaccgcucugccguc

SEQ ID NO: 1374426 - RNA, 23 nt, Neisseria meningitidis Z2491
aaccgcucccccuccgccgucau

SEQ ID NO: 1374427 - RNA, 16 nt, Neisseria meningitidis Z2491
cugcucggccugcccu

SEQ ID NO: 1374428 - RNA, 12 nt, Neisseria meningitidis Z2491
cugcugccgccc

SEQ ID NO: 1374429 - RNA, 16 nt, Neisseria meningitidis Z2491
cugcugcugaccgccg

SEQ ID NO: 1374430 - RNA, 20 nt, Neisseria meningitidis Z2491
cugcguuacauaauccggcu

SEQ ID NO: 1374431 - RNA, 20 nt, Neisseria meningitidis Z2491
cugaacacggguucagacgg

SEQ ID NO: 1374432 - RNA, 20 nt, Neisseria meningitidis Z2491
cugaaauaucgucauucccg

SEQ ID NO: 1374433 - RNA, 21 nt, Neisseria meningitidis Z2491
cugaaauaucgucauucccgc

SEQ ID NO: 1374434 - RNA, 21 nt, Neisseria meningitidis Z2491
cugaaaggcuuuuucagacgg

SEQ ID NO: 1374435 - RNA, 23 nt, Neisseria meningitidis Z2491
cugaaaggcuuuuucagacggca

SEQ ID NO: 1374436 - RNA, 21 nt, Neisseria meningitidis Z2491
cugaaaccccauccuucccgc

SEQ ID NO: 1374437 - RNA, 18 nt, Neisseria meningitidis Z2491
cugaaaccggcuucagac

SEQ ID NO: 1374438 - RNA, 20 nt, Neisseria meningitidis Z2491
cugaaacuucgccauucccg

SEQ ID NO: 1374439 - RNA, 21 nt, Neisseria meningitidis Z2491
cugaaacuucgccauucccgu

SEQ ID NO: 1374440 - RNA, 16 nt, Neisseria meningitidis Z2491
cugccgucugaaaccg

SEQ ID NO: 1374441 - RNA, 16 nt, Neisseria meningitidis Z2491
cugccgucauucccgc

SEQ ID NO: 1374442 - RNA, 13 nt, Neisseria meningitidis Z2491
cugcgggaaugac

SEQ ID NO: 1374443 - RNA, 16 nt, Neisseria meningitidis Z2491
cugcgcgcggacggau

SEQ ID NO: 1374444 - RNA, 18 nt, Neisseria meningitidis Z2491
cuucgccgaccagcggcg

SEQ ID NO: 1374445 - RNA, 10 nt, Neisseria meningitidis Z2491
cuugccgccg

SEQ ID NO: 1374446 - RNA, 21 nt, Neisseria meningitidis Z2491
cuugaguuucagucauucccg

SEQ ID NO: 1374447 - RNA, 20 nt, Neisseria meningitidis Z2491
cuuauagucugagacggcgg

SEQ ID NO: 1374448 - RNA, 20 nt, Neisseria meningitidis Z2491
cugguuuuuguuaauccgcu

SEQ ID NO: 1374449 - RNA, 12 nt, Neisseria meningitidis Z2491
cugucugaaacc

SEQ ID NO: 1374450 - RNA, 14 nt, Neisseria meningitidis Z2491
cuggucgccguuca

SEQ ID NO: 1374451 - RNA, 21 nt, Neisseria meningitidis Z2491
cugguuuaaauuuaauccacu

SEQ ID NO: 1374452 - RNA, 20 nt, Neisseria meningitidis Z2491
cugguuuaaauuuaauccau

SEQ ID NO: 1374453 - RNA, 20 nt, Neisseria meningitidis Z2491
cugguuuaaauuuaauucac

SEQ ID NO: 1374454 - RNA, 18 nt, Neisseria meningitidis Z2491
cguaggucuucagcuuga

SEQ ID NO: 1374455 - RNA, 15 nt, Neisseria meningitidis Z2491
cguaauagccugaca

SEQ ID NO: 1374456 - RNA, 14 nt, Neisseria meningitidis Z2491
cgguuuaauccgcc

SEQ ID NO: 1374457 - RNA, 18 nt, Neisseria meningitidis Z2491
cgguuuuuuugcgaauaa

SEQ ID NO: 1374458 - RNA, 19 nt, Neisseria meningitidis Z2491
cgguuuaaaguuaauccac

SEQ ID NO: 1374459 - RNA, 20 nt, Neisseria meningitidis Z2491
cgguuuaaauuuaauccacu

SEQ ID NO: 1374460 - RNA, 22 nt, Neisseria meningitidis Z2491
cggugugcauccgacaggcaaa

SEQ ID NO: 1374461 - RNA, 15 nt, Neisseria meningitidis Z2491
cggugcgguacggca

SEQ ID NO: 1374462 - RNA, 16 nt, Neisseria meningitidis Z2491
cggugcugcugccgcc

SEQ ID NO: 1374463 - RNA, 21 nt, Neisseria meningitidis Z2491
cggucgggcgcguacacgacg

SEQ ID NO: 1374464 - RNA, 17 nt, Neisseria meningitidis Z2491
cguuugccaaggcggcg

SEQ ID NO: 1374465 - RNA, 15 nt, Neisseria meningitidis Z2491
cguuuggaugccguc

SEQ ID NO: 1374466 - RNA, 13 nt, Neisseria meningitidis Z2491
cguuuuucagacg

SEQ ID NO: 1374467 - RNA, 14 nt, Neisseria meningitidis Z2491
cguuuuucagacgg

SEQ ID NO: 1374468 - RNA, 17 nt, Neisseria meningitidis Z2491
cuaaauagcugaaacuc

SEQ ID NO: 1374469 - RNA, 13 nt, Neisseria meningitidis Z2491
cuaaagaaaccgu

SEQ ID NO: 1374470 - RNA, 21 nt, Neisseria meningitidis Z2491
cuaaaauuucgucauucccgc

SEQ ID NO: 1374471 - RNA, 21 nt, Neisseria meningitidis Z2491
cuaaaaucucgucauucucgc

SEQ ID NO: 1374472 - RNA, 20 nt, Neisseria meningitidis Z2491
cuaaauacaaaaggccgucu

SEQ ID NO: 1374473 - RNA, 23 nt, Neisseria meningitidis Z2491
cuaaaugccaaucucuuaaccau

SEQ ID NO: 1374474 - RNA, 20 nt, Neisseria meningitidis Z2491
cuaacguacaaaugccgucu

SEQ ID NO: 1374475 - RNA, 11 nt, Neisseria meningitidis Z2491
cguuucagacg

SEQ ID NO: 1374476 - RNA, 12 nt, Neisseria meningitidis Z2491
cguuucagacgg

SEQ ID NO: 1374477 - RNA, 15 nt, Neisseria meningitidis Z2491
cguuucagacggcau

SEQ ID NO: 1374478 - RNA, 16 nt, Neisseria meningitidis Z2491
cguuucagacggcauu

SEQ ID NO: 1374479 - RNA, 17 nt, Neisseria meningitidis Z2491
cuaaggucuagauuccc

SEQ ID NO: 1374480 - RNA, 18 nt, Neisseria meningitidis Z2491
cuaaggucuagauucccg

SEQ ID NO: 1374481 - RNA, 19 nt, Neisseria meningitidis Z2491
cuaaggucuagauucccgc

SEQ ID NO: 1374482 - RNA, 12 nt, Neisseria meningitidis Z2491
cuaagaaaccgu

SEQ ID NO: 1374483 - RNA, 19 nt, Neisseria meningitidis Z2491
cuaaucgcgucauucccac

SEQ ID NO: 1374484 - RNA, 18 nt, Neisseria meningitidis Z2491
cuaauucgugauucccga

SEQ ID NO: 1374485 - RNA, 21 nt, Neisseria meningitidis Z2491
cguggauagcgagacggcauc

SEQ ID NO: 1374486 - RNA, 18 nt, Neisseria meningitidis Z2491
cguucggcaaaauccgca

SEQ ID NO: 1374487 - RNA, 22 nt, Neisseria meningitidis Z2491
cucgaaagcgggaauucagguu

SEQ ID NO: 1374488 - RNA, 13 nt, Neisseria meningitidis Z2491
cuccugacggcaa

SEQ ID NO: 1374489 - RNA, 19 nt, Neisseria meningitidis Z2491
cucgauuuuguauccgucg

SEQ ID NO: 1374490 - RNA, 21 nt, Neisseria meningitidis Z2491
cucggcguuuuucagacggcc

SEQ ID NO: 1374491 - RNA, 13 nt, Neisseria meningitidis Z2491
cucgucuucggca

SEQ ID NO: 1374492 - RNA, 12 nt, Neisseria meningitidis Z2491
uugaaaugccgu

SEQ ID NO: 1374493 - RNA, 18 nt, Neisseria meningitidis Z2491
uugggcgacggcgaggcu

SEQ ID NO: 1374494 - RNA, 19 nt, Neisseria meningitidis Z2491
uuguacugucugcggcuuu

SEQ ID NO: 1374495 - RNA, 16 nt, Neisseria meningitidis Z2491
uuguuucagacggcau

SEQ ID NO: 1374496 - RNA, 15 nt, Neisseria meningitidis Z2491
uuguucagacggcau

SEQ ID NO: 1374497 - RNA, 22 nt, Neisseria meningitidis Z2491
uuuacgauaugcaaaugcacgg

SEQ ID NO: 1374498 - RNA, 22 nt, Neisseria meningitidis Z2491
uuuaucgggaaugacugaaacu

SEQ ID NO: 1374499 - RNA, 14 nt, Neisseria meningitidis Z2491
uuugacgcauaaaa

SEQ ID NO: 1374500 - RNA, 16 nt, Neisseria meningitidis Z2491
uuugagcaaaugccgu

SEQ ID NO: 1374501 - RNA, 19 nt, Neisseria meningitidis Z2491
uuugagcuucgcgacggua

SEQ ID NO: 1374502 - RNA, 16 nt, Neisseria meningitidis Z2491
uuugagggaaugacgg

SEQ ID NO: 1374503 - RNA, 16 nt, Neisseria meningitidis Z2491
uuugaauauugcuguu

SEQ ID NO: 1374504 - RNA, 23 nt, Neisseria meningitidis Z2491
uuugcgccgcccgaaaaugucgg

SEQ ID NO: 1374505 - RNA, 18 nt, Neisseria meningitidis Z2491
uuugcgccacggcauaac

SEQ ID NO: 1374506 - RNA, 20 nt, Neisseria meningitidis Z2491
uuuggaugccgucugaaacg

SEQ ID NO: 1374507 - RNA, 17 nt, Neisseria meningitidis Z2491
uuucgugggaaugacgg

SEQ ID NO: 1374508 - RNA, 15 nt, Neisseria meningitidis Z2491
uuuggcaaaauccgg

SEQ ID NO: 1374509 - RNA, 14 nt, Neisseria meningitidis Z2491
uuccgcaaacgccu

SEQ ID NO: 1374510 - RNA, 22 nt, Neisseria meningitidis Z2491
uuccgauaaauucuugaggcau

SEQ ID NO: 1374511 - RNA, 14 nt, Neisseria meningitidis Z2491
uuccgauagauucc

SEQ ID NO: 1374512 - RNA, 14 nt, Neisseria meningitidis Z2491
uuccgaagcgguuu

SEQ ID NO: 1374513 - RNA, 13 nt, Neisseria meningitidis Z2491
uucggacggcauu

SEQ ID NO: 1374514 - RNA, 13 nt, Neisseria meningitidis Z2491
uucgcgacgguau

SEQ ID NO: 1374515 - RNA, 16 nt, Neisseria meningitidis Z2491
uucgcgggaaugacgg

SEQ ID NO: 1374516 - RNA, 23 nt, Neisseria meningitidis Z2491
uucgcgguagguauuuugcgccg

SEQ ID NO: 1374517 - RNA, 18 nt, Neisseria meningitidis Z2491
uucgccgacuuugguuuc

SEQ ID NO: 1374518 - RNA, 21 nt, Neisseria meningitidis Z2491
uucgcaucguaaaaaugccgu

SEQ ID NO: 1374519 - RNA, 22 nt, Neisseria meningitidis Z2491
uucgccgccuguuccccguugc

SEQ ID NO: 1374520 - RNA, 15 nt, Neisseria meningitidis Z2491
uucggucauuuccga

SEQ ID NO: 1374521 - RNA, 21 nt, Neisseria meningitidis Z2491
uucggcuucaacagacggcgu

SEQ ID NO: 1374522 - RNA, 23 nt, Neisseria meningitidis Z2491
uucguuuuugggauggcgggaaa

SEQ ID NO: 1374523 - RNA, 13 nt, Neisseria meningitidis Z2491
uucugcaccgcuu

SEQ ID NO: 1374524 - RNA, 16 nt, Neisseria meningitidis Z2491
uucugccaaacggcga

SEQ ID NO: 1374525 - RNA, 17 nt, Neisseria meningitidis Z2491
uuauccgauaaguuucc

SEQ ID NO: 1374526 - RNA, 19 nt, Neisseria meningitidis Z2491
uuaucccauaaaaacggga

SEQ ID NO: 1374527 - RNA, 21 nt, Neisseria meningitidis Z2491
ugugcuguuucagacggcauu

SEQ ID NO: 1374528 - RNA, 21 nt, Neisseria meningitidis Z2491
uucaacuugguggucggcauu

SEQ ID NO: 1374529 - RNA, 17 nt, Neisseria meningitidis Z2491
uucaauaccuugagcca

SEQ ID NO: 1374530 - RNA, 19 nt, Neisseria meningitidis Z2491
uucaaaucguuuugcgcca

SEQ ID NO: 1374531 - RNA, 21 nt, Neisseria meningitidis Z2491
uucaaaucuuccugcggcauu

SEQ ID NO: 1374532 - RNA, 22 nt, Neisseria meningitidis Z2491
uucaaaguauguaccaagcggu

SEQ ID NO: 1374533 - RNA, 22 nt, Neisseria meningitidis Z2491
uuccaguugcgggccuuuggcg

SEQ ID NO: 1374534 - RNA, 20 nt, Neisseria meningitidis Z2491
uuccaucaacaaaaugccgu

SEQ ID NO: 1374535 - RNA, 21 nt, Neisseria meningitidis Z2491
uuccaaacccaaugcuucaac

SEQ ID NO: 1374536 - RNA, 24 nt, Neisseria meningitidis Z2491
uucagcgacacgaccgaccggcau

SEQ ID NO: 1374537 - RNA, 15 nt, Neisseria meningitidis Z2491
ugucggggaauccgg

SEQ ID NO: 1374538 - RNA, 18 nt, Neisseria meningitidis Z2491
uguaugccgucugaaacc

SEQ ID NO: 1374539 - RNA, 19 nt, Neisseria meningitidis Z2491
uggucggaguggcagccua

SEQ ID NO: 1374540 - RNA, 15 nt, Neisseria meningitidis Z2491
uguaaaaaugccguc

SEQ ID NO: 1374541 - RNA, 22 nt, Neisseria meningitidis Z2491
ugguuuucaaaacauccgcaac

SEQ ID NO: 1374542 - RNA, 17 nt, Neisseria meningitidis Z2491
ugguucagacggcauuu

SEQ ID NO: 1374543 - RNA, 14 nt, Neisseria meningitidis Z2491
ugguguuugcagau

SEQ ID NO: 1374544 - RNA, 12 nt, Neisseria meningitidis Z2491
uggcgacggcaa

SEQ ID NO: 1374545 - RNA, 20 nt, Neisseria meningitidis Z2491
ugguagagcgcaaccuugcc

SEQ ID NO: 1374546 - RNA, 18 nt, Neisseria meningitidis Z2491
ugggcuucagacggcauc

SEQ ID NO: 1374547 - RNA, 23 nt, Neisseria meningitidis Z2491
uggcgggaagccagggcggauug

SEQ ID NO: 1374548 - RNA, 15 nt, Neisseria meningitidis Z2491
uggcgggaaugccga

SEQ ID NO: 1374549 - RNA, 20 nt, Neisseria meningitidis Z2491
uaaaagacccgucauucccg

SEQ ID NO: 1374550 - RNA, 21 nt, Neisseria meningitidis Z2491
uaaaagacccgucauucccgc

SEQ ID NO: 1374551 - RNA, 17 nt, Neisseria meningitidis Z2491
uaaaaaacgccguccga

SEQ ID NO: 1374552 - RNA, 17 nt, Neisseria meningitidis Z2491
uaaagcggcaaugccgu

SEQ ID NO: 1374553 - RNA, 11 nt, Neisseria meningitidis Z2491
uaacguauucg

SEQ ID NO: 1374554 - RNA, 20 nt, Neisseria meningitidis Z2491
uaagaaaccguuuuauccga

SEQ ID NO: 1374555 - RNA, 23 nt, Neisseria meningitidis Z2491
uaaauuuaaaccaguacggcguu

SEQ ID NO: 1374556 - RNA, 17 nt, Neisseria meningitidis Z2491
uaaggcugcaaagcggc

SEQ ID NO: 1374557 - RNA, 12 nt, Neisseria meningitidis Z2491
uaauuuccaaau

SEQ ID NO: 1374558 - RNA, 23 nt, Neisseria meningitidis Z2491
uacacuuaaaaauaccuaaagcc

SEQ ID NO: 1374559 - RNA, 16 nt, Neisseria meningitidis Z2491
uacaaaugccgucuga

SEQ ID NO: 1374560 - RNA, 15 nt, Neisseria meningitidis Z2491
guuuucagacggcau

SEQ ID NO: 1374561 - RNA, 18 nt, Neisseria meningitidis Z2491
guuuggcgggaaugccga

SEQ ID NO: 1374562 - RNA, 22 nt, Neisseria meningitidis Z2491
guuugggcaacacaaaugccgu

SEQ ID NO: 1374563 - RNA, 21 nt, Neisseria meningitidis Z2491
guuugcggcggcaaauuccgu

SEQ ID NO: 1374564 - RNA, 15 nt, Neisseria meningitidis Z2491
guuugccgaguuugc

SEQ ID NO: 1374565 - RNA, 11 nt, Neisseria meningitidis Z2491
guuugccgucu

SEQ ID NO: 1374566 - RNA, 13 nt, Neisseria meningitidis Z2491
guuugccgucuga

SEQ ID NO: 1374567 - RNA, 19 nt, Neisseria meningitidis Z2491
guuugaauggaaaugccgu

SEQ ID NO: 1374568 - RNA, 17 nt, Neisseria meningitidis Z2491
guuuccguucauacgga

SEQ ID NO: 1374569 - RNA, 20 nt, Neisseria meningitidis Z2491
guugcaaucacgggcaaacg

SEQ ID NO: 1374570 - RNA, 19 nt, Neisseria meningitidis Z2491
guugcuugagcauaccggc

SEQ ID NO: 1374571 - RNA, 17 nt, Neisseria meningitidis Z2491
guucguaagaaugacgg

SEQ ID NO: 1374572 - RNA, 14 nt, Neisseria meningitidis Z2491
guugaaaaugccgu

SEQ ID NO: 1374573 - RNA, 21 nt, Neisseria meningitidis Z2491
uaguggauuaaauuuaaauca

SEQ ID NO: 1374574 - RNA, 21 nt, Neisseria meningitidis Z2491
uaguggcuuaaauuuaaacca

SEQ ID NO: 1374575 - RNA, 17 nt, Neisseria meningitidis Z2491
uauaaugcccauuccca

SEQ ID NO: 1374576 - RNA, 17 nt, Neisseria meningitidis Z2491
uaguuuuuugaguuuca

SEQ ID NO: 1374577 - RNA, 19 nt, Neisseria meningitidis Z2491
uauuccaccgaugucggcu

SEQ ID NO: 1374578 - RNA, 15 nt, Neisseria meningitidis Z2491
uagauugcaggcauu

SEQ ID NO: 1374579 - RNA, 14 nt, Neisseria meningitidis Z2491
uagcgagacggcau

SEQ ID NO: 1374580 - RNA, 18 nt, Neisseria meningitidis Z2491
uaggacaaaugccgccag

SEQ ID NO: 1374581 - RNA, 17 nt, Neisseria meningitidis Z2491
uagaaaaugccgucuga

SEQ ID NO: 1374582 - RNA, 16 nt, Neisseria meningitidis Z2491
uagaaaugccgucuga

SEQ ID NO: 1374583 - RNA, 19 nt, Neisseria meningitidis Z2491
uacggugucagacggcauu

SEQ ID NO: 1374584 - RNA, 19 nt, Neisseria meningitidis Z2491
uacggggaggaaaguccgg

SEQ ID NO: 1374585 - RNA, 18 nt, Neisseria meningitidis Z2491
uaccguuucagacggcau

SEQ ID NO: 1374586 - RNA, 19 nt, Neisseria meningitidis Z2491
uaccguuucagacggcauu

SEQ ID NO: 1374587 - RNA, 14 nt, Neisseria meningitidis Z2491
uccuucacgccauu

SEQ ID NO: 1374588 - RNA, 14 nt, Neisseria meningitidis Z2491
uccuguuuucagac

SEQ ID NO: 1374589 - RNA, 16 nt, Neisseria meningitidis Z2491
ucgaaaugccgucuga

SEQ ID NO: 1374590 - RNA, 17 nt, Neisseria meningitidis Z2491
uccugaccuuugcagaa

SEQ ID NO: 1374591 - RNA, 22 nt, Neisseria meningitidis Z2491
uccugauuuaaauuuaauccgc

SEQ ID NO: 1374592 - RNA, 22 nt, Neisseria meningitidis Z2491
uccugaugugccaaugccgucu

SEQ ID NO: 1374593 - RNA, 17 nt, Neisseria meningitidis Z2491
ucgaccugcuguuugag

SEQ ID NO: 1374594 - RNA, 14 nt, Neisseria meningitidis Z2491
uccgaggcggcuuu

SEQ ID NO: 1374595 - RNA, 22 nt, Neisseria meningitidis Z2491
uccgaauaugccagaccgucua

SEQ ID NO: 1374596 - RNA, 13 nt, Neisseria meningitidis Z2491
uccgaacggcuug

SEQ ID NO: 1374597 - RNA, 17 nt, Neisseria meningitidis Z2491
uccaacucuacggguuu

SEQ ID NO: 1374598 - RNA, 23 nt, Neisseria meningitidis Z2491
uccagcaaugcgucuuccaacgc

SEQ ID NO: 1374599 - RNA, 14 nt, Neisseria meningitidis Z2491
uccacuauaucguc

SEQ ID NO: 1374600 - RNA, 21 nt, Neisseria meningitidis Z2491
ucaguuccaaaaccgugcugu

SEQ ID NO: 1374601 - RNA, 17 nt, Neisseria meningitidis Z2491
ucauugagcagcacauc

SEQ ID NO: 1374602 - RNA, 23 nt, Neisseria meningitidis Z2491
uccaaaugaauguggucguucaa

SEQ ID NO: 1374603 - RNA, 22 nt, Neisseria meningitidis Z2491
uccaaaugccgcaaaugccguc

SEQ ID NO: 1374604 - RNA, 13 nt, Neisseria meningitidis Z2491
ucacgauugagac

SEQ ID NO: 1374605 - RNA, 20 nt, Neisseria meningitidis Z2491
uauuuguacugucugcggcu

SEQ ID NO: 1374606 - RNA, 21 nt, Neisseria meningitidis Z2491
ucagacauugacgguugcagc

SEQ ID NO: 1374607 - RNA, 19 nt, Neisseria meningitidis Z2491
ucagacggcauuucgagga

SEQ ID NO: 1374608 - RNA, 21 nt, Neisseria meningitidis Z2491
ucagacggcauuugacccauu

SEQ ID NO: 1374609 - RNA, 22 nt, Neisseria meningitidis Z2491
ucagacgguauuuuuuauccgg

SEQ ID NO: 1374610 - RNA, 13 nt, Neisseria meningitidis Z2491
ucagcucuuugag

SEQ ID NO: 1374611 - RNA, 14 nt, Neisseria meningitidis Z2491
ucaggcacgaagcc

SEQ ID NO: 1374612 - RNA, 21 nt, Neisseria meningitidis Z2491
ucaggacaaggcgacgaagcc

SEQ ID NO: 1374613 - RNA, 13 nt, Neisseria meningitidis Z2491
ucaggacggcuuu

SEQ ID NO: 1374614 - RNA, 15 nt, Neisseria meningitidis Z2491
ugcuccugacggcaa

SEQ ID NO: 1374615 - RNA, 17 nt, Neisseria meningitidis Z2491
ugcgguucggacggcau

SEQ ID NO: 1374616 - RNA, 15 nt, Neisseria meningitidis Z2491
ugcguucaaaugccg

SEQ ID NO: 1374617 - RNA, 17 nt, Neisseria meningitidis Z2491
ugcguucagacggcauc

SEQ ID NO: 1374618 - RNA, 14 nt, Neisseria meningitidis Z2491
ugcugccgugaugc

SEQ ID NO: 1374619 - RNA, 19 nt, Neisseria meningitidis Z2491
ugcuguuucagacggcauu

SEQ ID NO: 1374620 - RNA, 20 nt, Neisseria meningitidis Z2491
ugcuguuucagacggcauuu

SEQ ID NO: 1374621 - RNA, 14 nt, Neisseria meningitidis Z2491
ugcuugcgcggcau

SEQ ID NO: 1374622 - RNA, 17 nt, Neisseria meningitidis Z2491
ugcuugcguaauuccgg

SEQ ID NO: 1374623 - RNA, 15 nt, Neisseria meningitidis Z2491
ugcgaagacuuuaau

SEQ ID NO: 1374624 - RNA, 20 nt, Neisseria meningitidis Z2491
ugcgaaagcgggaaugccga

SEQ ID NO: 1374625 - RNA, 15 nt, Neisseria meningitidis Z2491
ugcgaauaagugcgg

SEQ ID NO: 1374626 - RNA, 14 nt, Neisseria meningitidis Z2491
ugcgccacggcaua

SEQ ID NO: 1374627 - RNA, 18 nt, Neisseria meningitidis Z2491
ugccguuucagacggcau

SEQ ID NO: 1374628 - RNA, 16 nt, Neisseria meningitidis Z2491
ugccgucugaaaggcu

SEQ ID NO: 1374629 - RNA, 17 nt, Neisseria meningitidis Z2491
ugccgucugaaagggcu

SEQ ID NO: 1374630 - RNA, 17 nt, Neisseria meningitidis Z2491
ugccguauuuauuuccg

SEQ ID NO: 1374631 - RNA, 16 nt, Neisseria meningitidis Z2491
ugcgguaagcggcuug

SEQ ID NO: 1374632 - RNA, 14 nt, Neisseria meningitidis Z2491
ugcggaagaagugc

SEQ ID NO: 1374633 - RNA, 19 nt, Neisseria meningitidis Z2491
ugcgcgggaaugacggcag

SEQ ID NO: 1374634 - RNA, 19 nt, Neisseria meningitidis Z2491
ugccgcgaccgaaaugccg

SEQ ID NO: 1374635 - RNA, 19 nt, Neisseria meningitidis Z2491
ugcccgcuuuugaguuucg

SEQ ID NO: 1374636 - RNA, 18 nt, Neisseria meningitidis Z2491
ugcccguggcgacggcaa

SEQ ID NO: 1374637 - RNA, 17 nt, Neisseria meningitidis Z2491
ugcagcuuugaguuucu

SEQ ID NO: 1374638 - RNA, 14 nt, Neisseria meningitidis Z2491
ugccaaugccgucu

SEQ ID NO: 1374639 - RNA, 18 nt, Neisseria meningitidis Z2491
ugauauacaaaaugccgu

SEQ ID NO: 1374640 - RNA, 20 nt, Neisseria meningitidis Z2491
ugauagccgcccaaugccgu

SEQ ID NO: 1374641 - RNA, 14 nt, Neisseria meningitidis Z2491
ugagguuagcggau

SEQ ID NO: 1374642 - RNA, 19 nt, Neisseria meningitidis Z2491
ugagguucuagauucccgu

SEQ ID NO: 1374643 - RNA, 16 nt, Neisseria meningitidis Z2491
ugaacgcuucagacgg

SEQ ID NO: 1374644 - RNA, 18 nt, Neisseria meningitidis Z2491
ugaagcccuuucagacgg

SEQ ID NO: 1374645 - RNA, 19 nt, Neisseria meningitidis Z2491
ugaagccuucagacggcau

SEQ ID NO: 1374646 - RNA, 20 nt, Neisseria meningitidis Z2491
ugaagccuucagacggcaua

SEQ ID NO: 1374647 - RNA, 14 nt, Neisseria meningitidis Z2491
ugagcaaaugccgu

SEQ ID NO: 1374648 - RNA, 15 nt, Neisseria meningitidis Z2491
ugagcaaaugccuua

SEQ ID NO: 1374649 - RNA, 15 nt, Neisseria meningitidis Z2491
ugagauugcggcauu

SEQ ID NO: 1374650 - RNA, 14 nt, Neisseria meningitidis Z2491
ugagaacuucagac

SEQ ID NO: 1374651 - RNA, 22 nt, Neisseria meningitidis Z2491
ugauuuggguuucagacggcau

SEQ ID NO: 1374652 - RNA, 22 nt, Neisseria meningitidis Z2491
ugauugguuuauuugaauccgc

SEQ ID NO: 1374653 - RNA, 18 nt, Neisseria meningitidis Z2491
ugauguccagugcggcau

SEQ ID NO: 1374654 - RNA, 16 nt, Neisseria meningitidis Z2491
ugaacacauugcguuc

SEQ ID NO: 1374655 - RNA, 19 nt, Neisseria meningitidis Z2491
ugaacacggguucagacgg

SEQ ID NO: 1374656 - RNA, 19 nt, Neisseria meningitidis Z2491
ugaacacuucuucgggcgu

SEQ ID NO: 1374657 - RNA, 16 nt, Neisseria meningitidis Z2491
ugaacauaaaugccgu

SEQ ID NO: 1374658 - RNA, 16 nt, Neisseria meningitidis Z2491
ugaacauuucagacgg

SEQ ID NO: 1374659 - RNA, 19 nt, Neisseria meningitidis Z2491
ugaaaacggguucggacgg

SEQ ID NO: 1374660 - RNA, 13 nt, Neisseria meningitidis Z2491
ugaaaaugccguc

SEQ ID NO: 1374661 - RNA, 16 nt, Neisseria meningitidis Z2491
ugaaaaugccgucuga

SEQ ID NO: 1374662 - RNA, 23 nt, Neisseria meningitidis Z2491
ugaaaccucguucggacggcauu

SEQ ID NO: 1374663 - RNA, 16 nt, Neisseria meningitidis Z2491
ucuugggaaaugccgu

SEQ ID NO: 1374664 - RNA, 14 nt, Neisseria meningitidis Z2491
ugaaaaaaugccgu

SEQ ID NO: 1374665 - RNA, 15 nt, Neisseria meningitidis Z2491
ugaaaaaaugccguc

SEQ ID NO: 1374666 - RNA, 16 nt, Neisseria meningitidis Z2491
ucuuuuauuuucaaac

SEQ ID NO: 1374667 - RNA, 16 nt, Neisseria meningitidis Z2491
ucuucggcaaugcccg

SEQ ID NO: 1374668 - RNA, 22 nt, Neisseria meningitidis Z2491
ucuucgaggaacaaaaugccgc

SEQ ID NO: 1374669 - RNA, 20 nt, Neisseria meningitidis Z2491
ucuuccgucaaaaaugccug

SEQ ID NO: 1374670 - RNA, 20 nt, Neisseria meningitidis Z2491
ucuuaaaaacaaaaugccgu

SEQ ID NO: 1374671 - RNA, 18 nt, Neisseria meningitidis Z2491
ucuguuuuuccgacaaau

SEQ ID NO: 1374672 - RNA, 17 nt, Neisseria meningitidis Z2491
ucugacaaaaaugccgu

SEQ ID NO: 1374673 - RNA, 17 nt, Neisseria meningitidis Z2491
ucugacaaaacgcccuu

SEQ ID NO: 1374674 - RNA, 16 nt, Neisseria meningitidis Z2491
ucugaaggcuucagac

SEQ ID NO: 1374675 - RNA, 21 nt, Neisseria meningitidis Z2491
ucugaagccuucagacggcau

SEQ ID NO: 1374676 - RNA, 22 nt, Neisseria meningitidis Z2491
ucugaagccuucagacggcauu

SEQ ID NO: 1374677 - RNA, 22 nt, Neisseria meningitidis Z2491
ucugaacacauugcguucagac

SEQ ID NO: 1374678 - RNA, 14 nt, Neisseria meningitidis Z2491
ucugaaacggcauc

SEQ ID NO: 1374679 - RNA, 18 nt, Neisseria meningitidis Z2491
ucugaaagccuuucagac

SEQ ID NO: 1374680 - RNA, 17 nt, Neisseria meningitidis Z2491
ucugaaaggcuucagac

SEQ ID NO: 1374681 - RNA, 23 nt, Neisseria meningitidis Z2491
ucugaaaggcuucagacggcauu

SEQ ID NO: 1374682 - RNA, 18 nt, Neisseria meningitidis Z2491
ucugauuuuguuuuugag

SEQ ID NO: 1374683 - RNA, 22 nt, Neisseria meningitidis Z2491
ucugauagccgcccaaugccgu

SEQ ID NO: 1374684 - RNA, 14 nt, Neisseria meningitidis Z2491
ucguucucuuugag

SEQ ID NO: 1374685 - RNA, 15 nt, Neisseria meningitidis Z2491
ucgucgggcugccaa

SEQ ID NO: 1374686 - RNA, 21 nt, Neisseria meningitidis Z2491
ucggaaaugacugaaacucaa

SEQ ID NO: 1374687 - RNA, 22 nt, Neisseria meningitidis Z2491
ucggaaaugaucaggcggauuu

SEQ ID NO: 1374688 - RNA, 16 nt, Neisseria meningitidis Z2491
ucggauaaucuuugaa

SEQ ID NO: 1374689 - RNA, 16 nt, Neisseria meningitidis Z2491
ucggcagugauuuccc

SEQ ID NO: 1374690 - RNA, 13 nt, Neisseria meningitidis Z2491
ucgccauucccgu

SEQ ID NO: 1374691 - RNA, 16 nt, Neisseria meningitidis Z2491
ucgccgucauucccgc

SEQ ID NO: 1374692 - RNA, 19 nt, Neisseria meningitidis Z2491
gcuuuugaggcugccguca

SEQ ID NO: 1374693 - RNA, 15 nt, Neisseria meningitidis Z2491
gcuuucagacggcau

SEQ ID NO: 1374694 - RNA, 16 nt, Neisseria meningitidis Z2491
gcuuucagacggcauu

SEQ ID NO: 1374695 - RNA, 17 nt, Neisseria meningitidis Z2491
gcuguuucagacggcau

SEQ ID NO: 1374696 - RNA, 18 nt, Neisseria meningitidis Z2491
gcuguuucagacggcauu

SEQ ID NO: 1374697 - RNA, 19 nt, Neisseria meningitidis Z2491
ggaaucuagaaccucaaac

SEQ ID NO: 1374698 - RNA, 17 nt, Neisseria meningitidis Z2491
ggaaaacagcuguacgc

SEQ ID NO: 1374699 - RNA, 18 nt, Neisseria meningitidis Z2491
ggaaaaaucauaagacgg

SEQ ID NO: 1374700 - RNA, 16 nt, Neisseria meningitidis Z2491
ggacagcggcaauauu

SEQ ID NO: 1374701 - RNA, 20 nt, Neisseria meningitidis Z2491
ggauaaggucgagcaggaug

SEQ ID NO: 1374702 - RNA, 19 nt, Neisseria meningitidis Z2491
ggauaaacauuuuugcgua

SEQ ID NO: 1374703 - RNA, 19 nt, Neisseria meningitidis Z2491
ggaggaguuugaugccguc

SEQ ID NO: 1374704 - RNA, 23 nt, Neisseria meningitidis Z2491
ggauauucccccgcgcaggcggu

SEQ ID NO: 1374705 - RNA, 19 nt, Neisseria meningitidis Z2491
ggaugacgguaucgccguu

SEQ ID NO: 1374706 - RNA, 10 nt, Neisseria meningitidis Z2491
gcugaaacuc

SEQ ID NO: 1374707 - RNA, 14 nt, Neisseria meningitidis Z2491
gcuacggcuugcua

SEQ ID NO: 1374708 - RNA, 11 nt, Neisseria meningitidis Z2491
gcuccaaguuu

SEQ ID NO: 1374709 - RNA, 17 nt, Neisseria meningitidis Z2491
gcuccaaucuaccguuu

SEQ ID NO: 1374710 - RNA, 21 nt, Neisseria meningitidis Z2491
gcucaguugguagagcgcaac

SEQ ID NO: 1374711 - RNA, 19 nt, Neisseria meningitidis Z2491
gcguuaacggucaacccgu

SEQ ID NO: 1374712 - RNA, 22 nt, Neisseria meningitidis Z2491
gcguguuuguuucagacggcau

SEQ ID NO: 1374713 - RNA, 23 nt, Neisseria meningitidis Z2491
gcguuacacuuugggcuucgacg

SEQ ID NO: 1374714 - RNA, 23 nt, Neisseria meningitidis Z2491
gcguuaccucgccuugccguacu

SEQ ID NO: 1374715 - RNA, 16 nt, Neisseria meningitidis Z2491
gcguguuugccgcgau

SEQ ID NO: 1374716 - RNA, 14 nt, Neisseria meningitidis Z2491
gcgugcaggcgcau

SEQ ID NO: 1374717 - RNA, 15 nt, Neisseria meningitidis Z2491
gcgggugaugccgac

SEQ ID NO: 1374718 - RNA, 17 nt, Neisseria meningitidis Z2491
gcgguaauuuccgacca

SEQ ID NO: 1374719 - RNA, 16 nt, Neisseria meningitidis Z2491
gcggagguugacggcu

SEQ ID NO: 1374720 - RNA, 21 nt, Neisseria meningitidis Z2491
gcggagaacaagguuccgaua

SEQ ID NO: 1374721 - RNA, 19 nt, Neisseria meningitidis Z2491
gcggaauacggcaacauca

SEQ ID NO: 1374722 - RNA, 22 nt, Neisseria meningitidis Z2491
gcggaacgcgucuuccgucugc

SEQ ID NO: 1374723 - RNA, 18 nt, Neisseria meningitidis Z2491
gcgccaaaucggacggau

SEQ ID NO: 1374724 - RNA, 14 nt, Neisseria meningitidis Z2491
gcgcgaaugugcgc

SEQ ID NO: 1374725 - RNA, 22 nt, Neisseria meningitidis Z2491
gccuuuacucauucaauccuca

SEQ ID NO: 1374726 - RNA, 13 nt, Neisseria meningitidis Z2491
gcgaggccaguuu

SEQ ID NO: 1374727 - RNA, 16 nt, Neisseria meningitidis Z2491
gcgagaugcggugcgc

SEQ ID NO: 1374728 - RNA, 22 nt, Neisseria meningitidis Z2491
gcgcaauccgcccucucauuug

SEQ ID NO: 1374729 - RNA, 13 nt, Neisseria meningitidis Z2491
gcgaugccgguaa

SEQ ID NO: 1374730 - RNA, 14 nt, Neisseria meningitidis Z2491
gccugccaaaaucg

SEQ ID NO: 1374731 - RNA, 21 nt, Neisseria meningitidis Z2491
gccuuccgauuauaucggcaa

SEQ ID NO: 1374732 - RNA, 16 nt, Neisseria meningitidis Z2491
gccuuacggauggcau

SEQ ID NO: 1374733 - RNA, 22 nt, Neisseria meningitidis Z2491
gccugauggcugaugacggcag

SEQ ID NO: 1374734 - RNA, 18 nt, Neisseria meningitidis Z2491
gccgguuuucagacggca

SEQ ID NO: 1374735 - RNA, 15 nt, Neisseria meningitidis Z2491
gccguacugguuuaa

SEQ ID NO: 1374736 - RNA, 12 nt, Neisseria meningitidis Z2491
gccuaacccgac

SEQ ID NO: 1374737 - RNA, 20 nt, Neisseria meningitidis Z2491
gccguguuggguucuagauu

SEQ ID NO: 1374738 - RNA, 17 nt, Neisseria meningitidis Z2491
ggcuucagacggcauuu

SEQ ID NO: 1374739 - RNA, 12 nt, Neisseria meningitidis Z2491
gggaacggcauc

SEQ ID NO: 1374740 - RNA, 16 nt, Neisseria meningitidis Z2491
gggcaacggcaauauu

SEQ ID NO: 1374741 - RNA, 22 nt, Neisseria meningitidis Z2491
gggguggucuugugccgcgaug

SEQ ID NO: 1374742 - RNA, 16 nt, Neisseria meningitidis Z2491
ggggauuuucgccgug

SEQ ID NO: 1374743 - RNA, 19 nt, Neisseria meningitidis Z2491
ggcgggaagccagggcgga

SEQ ID NO: 1374744 - RNA, 15 nt, Neisseria meningitidis Z2491
ggcguaacgcgguaa

SEQ ID NO: 1374745 - RNA, 15 nt, Neisseria meningitidis Z2491
ggcguucuucuucga

SEQ ID NO: 1374746 - RNA, 15 nt, Neisseria meningitidis Z2491
ggcggcggcaauauu

SEQ ID NO: 1374747 - RNA, 19 nt, Neisseria meningitidis Z2491
ggcauucugcacgccgacu

SEQ ID NO: 1374748 - RNA, 17 nt, Neisseria meningitidis Z2491
ggcagccaccucgccgc

SEQ ID NO: 1374749 - RNA, 18 nt, Neisseria meningitidis Z2491
ggcagagcggauucuguu

SEQ ID NO: 1374750 - RNA, 22 nt, Neisseria meningitidis Z2491
ggcgagccaauagccgccggug

SEQ ID NO: 1374751 - RNA, 20 nt, Neisseria meningitidis Z2491
gguugaggucgcgaguucga

SEQ ID NO: 1374752 - RNA, 14 nt, Neisseria meningitidis Z2491
gguucggacggcau

SEQ ID NO: 1374753 - RNA, 15 nt, Neisseria meningitidis Z2491
gguucggacggcauu

SEQ ID NO: 1374754 - RNA, 13 nt, Neisseria meningitidis Z2491
gguucagacggca

SEQ ID NO: 1374755 - RNA, 15 nt, Neisseria meningitidis Z2491
gguucagacggcauu

SEQ ID NO: 1374756 - RNA, 13 nt, Neisseria meningitidis Z2491
gguuuaauccgcc

SEQ ID NO: 1374757 - RNA, 23 nt, Neisseria meningitidis Z2491
gguuuauuugagcaaaugccguc

SEQ ID NO: 1374758 - RNA, 17 nt, Neisseria meningitidis Z2491
guaaaaaugccgucuga

SEQ ID NO: 1374759 - RNA, 20 nt, Neisseria meningitidis Z2491
ggugcggaaacguaucggau

SEQ ID NO: 1374760 - RNA, 22 nt, Neisseria meningitidis Z2491
guaaucgccuuacggauggcau

SEQ ID NO: 1374761 - RNA, 23 nt, Neisseria meningitidis Z2491
guagcguggauagcgagacggca

SEQ ID NO: 1374762 - RNA, 15 nt, Neisseria meningitidis Z2491
guaucggcagcccgu

SEQ ID NO: 1374763 - RNA, 21 nt, Neisseria meningitidis Z2491
guaucgcguaaggcauacggg

SEQ ID NO: 1374764 - RNA, 15 nt, Neisseria meningitidis Z2491
guaucggauugccgu

SEQ ID NO: 1374765 - RNA, 14 nt, Neisseria meningitidis Z2491
guccaaaucggcaa

SEQ ID NO: 1374766 - RNA, 12 nt, Neisseria meningitidis Z2491
gucauucccacg

SEQ ID NO: 1374767 - RNA, 17 nt, Neisseria meningitidis Z2491
gucaucaccgcagccgc

SEQ ID NO: 1374768 - RNA, 16 nt, Neisseria meningitidis Z2491
gugcuguuucagacgg

SEQ ID NO: 1374769 - RNA, 14 nt, Neisseria meningitidis Z2491
guggauauugccgu

SEQ ID NO: 1374770 - RNA, 23 nt, Neisseria meningitidis Z2491
gucugaaaggcuucagacggcau

SEQ ID NO: 1374771 - RNA, 22 nt, Neisseria meningitidis Z2491
gucugaaauccuauuuucagau

SEQ ID NO: 1374772 - RNA, 19 nt, Neisseria meningitidis Z2491
gucugaaaccaaaucggcu

SEQ ID NO: 1374773 - RNA, 15 nt, Neisseria meningitidis Z2491
gucuaugaaucggcu

SEQ ID NO: 1374774 - RNA, 14 nt, Neisseria meningitidis Z2491
gucggcgacggcgu

SEQ ID NO: 1374775 - RNA, 16 nt, Neisseria meningitidis Z2491
gucggacaaaaugccu

SEQ ID NO: 1374776 - RNA, 11 nt, Neisseria meningitidis Z2491
gucgacggcaa

SEQ ID NO: 1374777 - RNA, 14 nt, Neisseria meningitidis Z2491
cgggaaugacaaaa

SEQ ID NO: 1374778 - RNA, 21 nt, Neisseria meningitidis Z2491
cgggaaugacggcagagcggu

SEQ ID NO: 1374779 - RNA, 21 nt, Neisseria meningitidis Z2491
cgguacauccaauaauccgcc

SEQ ID NO: 1374780 - RNA, 13 nt, Neisseria meningitidis Z2491
cggguuucagacg

SEQ ID NO: 1374781 - RNA, 18 nt, Neisseria meningitidis Z2491
cggguuucagacggcauu

SEQ ID NO: 1374782 - RNA, 16 nt, Neisseria meningitidis Z2491
cggguucagacggcau

SEQ ID NO: 1374783 - RNA, 12 nt, Neisseria meningitidis Z2491
cggguuacgccg

SEQ ID NO: 1374784 - RNA, 16 nt, Neisseria meningitidis Z2491
cgggugaugccgacgu

SEQ ID NO: 1374785 - RNA, 19 nt, Neisseria meningitidis Z2491
cggggaauuaugaugcgga

SEQ ID NO: 1374786 - RNA, 21 nt, Neisseria meningitidis Z2491
cggauagcuucgucauucccg

SEQ ID NO: 1374787 - RNA, 15 nt, Neisseria meningitidis Z2491
cggaucggcagcuuu

SEQ ID NO: 1374788 - RNA, 16 nt, Neisseria meningitidis Z2491
cggaguuucaggcggc

SEQ ID NO: 1374789 - RNA, 23 nt, Neisseria meningitidis Z2491
cggcacuuucauucacacggccg

SEQ ID NO: 1374790 - RNA, 14 nt, Neisseria meningitidis Z2491
cggcacuugccgca

SEQ ID NO: 1374791 - RNA, 23 nt, Neisseria meningitidis Z2491
cggcacaagaugccccacgccga

SEQ ID NO: 1374792 - RNA, 18 nt, Neisseria meningitidis Z2491
cggcauuaaaauuuggcu

SEQ ID NO: 1374793 - RNA, 14 nt, Neisseria meningitidis Z2491
cggcgcaaccgccg

SEQ ID NO: 1374794 - RNA, 18 nt, Neisseria meningitidis Z2491
cggaaaccaaucaggcgu

SEQ ID NO: 1374795 - RNA, 14 nt, Neisseria meningitidis Z2491
cggaaaguggaaca

SEQ ID NO: 1374796 - RNA, 16 nt, Neisseria meningitidis Z2491
cggaaaugaucaggcg

SEQ ID NO: 1374797 - RNA, 21 nt, Neisseria meningitidis Z2491
cggaacgcgucuuccgucugc

SEQ ID NO: 1374798 - RNA, 22 nt, Neisseria meningitidis Z2491
cggaauaagguuugagcaguuu

SEQ ID NO: 1374799 - RNA, 23 nt, Neisseria meningitidis Z2491
cgcuugaaucuucauuccgcgca

SEQ ID NO: 1374800 - RNA, 17 nt, Neisseria meningitidis Z2491
cgcguucgugcagauaa

SEQ ID NO: 1374801 - RNA, 19 nt, Neisseria meningitidis Z2491
cgcugaugaugauggcggc

SEQ ID NO: 1374802 - RNA, 19 nt, Neisseria meningitidis Z2491
cgcgccugccacgaugggc

SEQ ID NO: 1374803 - RNA, 23 nt, Neisseria meningitidis Z2491
cgccgguacccaaacuuccaaau

SEQ ID NO: 1374804 - RNA, 16 nt, Neisseria meningitidis Z2491
cgccguccguaccgcg

SEQ ID NO: 1374805 - RNA, 23 nt, Neisseria meningitidis Z2491
cgccugaacauuucagacggcau

SEQ ID NO: 1374806 - RNA, 13 nt, Neisseria meningitidis Z2491
cgccuuugagcgc

SEQ ID NO: 1374807 - RNA, 23 nt, Neisseria meningitidis Z2491
cgccuuugccaccaauaccgccu

SEQ ID NO: 1374808 - RNA, 17 nt, Neisseria meningitidis Z2491
cgcgaugucgcugccca

SEQ ID NO: 1374809 - RNA, 17 nt, Neisseria meningitidis Z2491
cgccgaacgagccguaa

SEQ ID NO: 1374810 - RNA, 14 nt, Neisseria meningitidis Z2491
ccucacugccgcca

SEQ ID NO: 1374811 - RNA, 17 nt, Neisseria meningitidis Z2491
ccucacugccgccaauc

SEQ ID NO: 1374812 - RNA, 21 nt, Neisseria meningitidis Z2491
ccucaaaucccgucauucccg

SEQ ID NO: 1374813 - RNA, 21 nt, Neisseria meningitidis Z2491
ccuaaaaucucgucauucucg

SEQ ID NO: 1374814 - RNA, 14 nt, Neisseria meningitidis Z2491
ccguuugcggguuu

SEQ ID NO: 1374815 - RNA, 20 nt, Neisseria meningitidis Z2491
ccuaaaauucgucauucccg

SEQ ID NO: 1374816 - RNA, 21 nt, Neisseria meningitidis Z2491
ccuaaaauuucgucauucccg

SEQ ID NO: 1374817 - RNA, 19 nt, Neisseria meningitidis Z2491
ccguuuuucauggcgacga

SEQ ID NO: 1374818 - RNA, 14 nt, Neisseria meningitidis Z2491
ccguuucccaucau

SEQ ID NO: 1374819 - RNA, 15 nt, Neisseria meningitidis Z2491
ccguuucagacggca

SEQ ID NO: 1374820 - RNA, 20 nt, Neisseria meningitidis Z2491
ccguugcagccaugcggcaa

SEQ ID NO: 1374821 - RNA, 21 nt, Neisseria meningitidis Z2491
ccugcugcugguuuuucggca

SEQ ID NO: 1374822 - RNA, 14 nt, Neisseria meningitidis Z2491
ccugcguuugccgc

SEQ ID NO: 1374823 - RNA, 20 nt, Neisseria meningitidis Z2491
ccugcaccgcgucauuccca

SEQ ID NO: 1374824 - RNA, 23 nt, Neisseria meningitidis Z2491
ccugauaaaugccgcaaucucaa

SEQ ID NO: 1374825 - RNA, 18 nt, Neisseria meningitidis Z2491
ccucguucggacggcauu

SEQ ID NO: 1374826 - RNA, 20 nt, Neisseria meningitidis Z2491
ccucggauggggugcggcac

SEQ ID NO: 1374827 - RNA, 19 nt, Neisseria meningitidis Z2491
ccgucccagccaguccgga

SEQ ID NO: 1374828 - RNA, 20 nt, Neisseria meningitidis Z2491
ccgcaaagccgccgccgaca

SEQ ID NO: 1374829 - RNA, 21 nt, Neisseria meningitidis Z2491
ccgcuuuguccaaaucggcaa

SEQ ID NO: 1374830 - RNA, 20 nt, Neisseria meningitidis Z2491
ccgcuugacgcuaccgcaua

SEQ ID NO: 1374831 - RNA, 14 nt, Neisseria meningitidis Z2491
ccgcuucggaaacg

SEQ ID NO: 1374832 - RNA, 17 nt, Neisseria meningitidis Z2491
ccgcuucaaggcgguuu

SEQ ID NO: 1374833 - RNA, 15 nt, Neisseria meningitidis Z2491
cgauaacggcggcaa

SEQ ID NO: 1374834 - RNA, 13 nt, Neisseria meningitidis Z2491
cgauagauucccg

SEQ ID NO: 1374835 - RNA, 22 nt, Neisseria meningitidis Z2491
cgcaaacuaacuuauacacacg

SEQ ID NO: 1374836 - RNA, 22 nt, Neisseria meningitidis Z2491
cgcaaccaaaaucaucacgccg

SEQ ID NO: 1374837 - RNA, 19 nt, Neisseria meningitidis Z2491
cgcaaucgaaaaagccgcc

SEQ ID NO: 1374838 - RNA, 13 nt, Neisseria meningitidis Z2491
cgcaauggcaaaa

SEQ ID NO: 1374839 - RNA, 13 nt, Neisseria meningitidis Z2491
cgcacccaaacgg

SEQ ID NO: 1374840 - RNA, 13 nt, Neisseria meningitidis Z2491
cgcaccccgaccg

SEQ ID NO: 1374841 - RNA, 22 nt, Neisseria meningitidis Z2491
cgcaccccgaccgacacccuga

SEQ ID NO: 1374842 - RNA, 15 nt, Neisseria meningitidis Z2491
cgcauucagacggca

SEQ ID NO: 1374843 - RNA, 17 nt, Neisseria meningitidis Z2491
cgcauucagacggcauc

SEQ ID NO: 1374844 - RNA, 13 nt, Neisseria meningitidis Z2491
cgccacggcauaa

SEQ ID NO: 1374845 - RNA, 14 nt, Neisseria meningitidis Z2491
cgccauaaugccca

SEQ ID NO: 1374846 - RNA, 23 nt, Neisseria meningitidis Z2491
cgccauaugcaggucgugcgccg

SEQ ID NO: 1374847 - RNA, 18 nt, Neisseria meningitidis Z2491
cgccauauucgcacgcau

SEQ ID NO: 1374848 - RNA, 23 nt, Neisseria meningitidis Z2491
ccuguuugaauggaaaugccguc

SEQ ID NO: 1374849 - RNA, 16 nt, Neisseria meningitidis Z2491
ccuucccgcgccaauu

SEQ ID NO: 1374850 - RNA, 23 nt, Neisseria meningitidis Z2491
cgacaguuucgcuggaugccgcg

SEQ ID NO: 1374851 - RNA, 20 nt, Neisseria meningitidis Z2491
cuuuugagccgucauucccg

SEQ ID NO: 1374852 - RNA, 21 nt, Neisseria meningitidis Z2491
cuuuugcgggaaugacggcag

SEQ ID NO: 1374853 - RNA, 21 nt, Neisseria meningitidis Z2491
gaaaacggguucggacggcau

SEQ ID NO: 1374854 - RNA, 21 nt, Neisseria meningitidis Z2491
gaaaacuuggagauucuagau

SEQ ID NO: 1374855 - RNA, 17 nt, Neisseria meningitidis Z2491
gaaaauuugguaaugca

SEQ ID NO: 1374856 - RNA, 23 nt, Neisseria meningitidis Z2491
gaaacaaaauguucagacggcau

SEQ ID NO: 1374857 - RNA, 16 nt, Neisseria meningitidis Z2491
gaaaaugccgucugaa

SEQ ID NO: 1374858 - RNA, 17 nt, Neisseria meningitidis Z2491
gaaaaugccgucugaaa

SEQ ID NO: 1374859 - RNA, 15 nt, Neisseria meningitidis Z2491
cuuuuucagacggca

SEQ ID NO: 1374860 - RNA, 18 nt, Neisseria meningitidis Z2491
gaaagccuuucagacggc

SEQ ID NO: 1374861 - RNA, 19 nt, Neisseria meningitidis Z2491
gaaagccuuucagacggca

SEQ ID NO: 1374862 - RNA, 20 nt, Neisseria meningitidis Z2491
gaaagccuuucagacggcau

SEQ ID NO: 1374863 - RNA, 20 nt, Neisseria meningitidis Z2491
gaaaguuugagguucuagau

SEQ ID NO: 1374864 - RNA, 18 nt, Neisseria meningitidis Z2491
gaaaggcuuucagacggc

SEQ ID NO: 1374865 - RNA, 19 nt, Neisseria meningitidis Z2491
gaaaggcuuucagacggca

SEQ ID NO: 1374866 - RNA, 22 nt, Neisseria meningitidis Z2491
gaaaggcuuuuucagacggcau

SEQ ID NO: 1374867 - RNA, 18 nt, Neisseria meningitidis Z2491
gaaagguuuucagacggc

SEQ ID NO: 1374868 - RNA, 17 nt, Neisseria meningitidis Z2491
gaaaggcuucagacggc

SEQ ID NO: 1374869 - RNA, 19 nt, Neisseria meningitidis Z2491
gaaaggcuucagacggcau

SEQ ID NO: 1374870 - RNA, 20 nt, Neisseria meningitidis Z2491
cuuuaauuuugucauucccg

SEQ ID NO: 1374871 - RNA, 21 nt, Neisseria meningitidis Z2491
cuuuaauuuugucauucccgc

SEQ ID NO: 1374872 - RNA, 21 nt, Neisseria meningitidis Z2491
cuuuaaucccgucauucccac

SEQ ID NO: 1374873 - RNA, 21 nt, Neisseria meningitidis Z2491
cuuuagagauucuggauuccc

SEQ ID NO: 1374874 - RNA, 18 nt, Neisseria meningitidis Z2491
cuuggucgcgcacgauuu

SEQ ID NO: 1374875 - RNA, 14 nt, Neisseria meningitidis Z2491
gaaaugccgucuga

SEQ ID NO: 1374876 - RNA, 16 nt, Neisseria meningitidis Z2491
gaaaugccgucugaaa

SEQ ID NO: 1374877 - RNA, 16 nt, Neisseria meningitidis Z2491
gaaaugccgucugaag

SEQ ID NO: 1374878 - RNA, 18 nt, Neisseria meningitidis Z2491
gaaauguucagacggcau

SEQ ID NO: 1374879 - RNA, 23 nt, Neisseria meningitidis Z2491
gaaaugguuuaagagcucgccgc

SEQ ID NO: 1374880 - RNA, 21 nt, Neisseria meningitidis Z2491
gaacacggguucagacggcau

SEQ ID NO: 1374881 - RNA, 20 nt, Neisseria meningitidis Z2491
gaacaucuuucagacggcau

SEQ ID NO: 1374882 - RNA, 16 nt, Neisseria meningitidis Z2491
gaacaggcggcggcau

SEQ ID NO: 1374883 - RNA, 20 nt, Neisseria meningitidis Z2491
gaacggcacaaacgccagca

SEQ ID NO: 1374884 - RNA, 11 nt, Neisseria meningitidis Z2491
cuuauaucguc

SEQ ID NO: 1374885 - RNA, 12 nt, Neisseria meningitidis Z2491
cuucagacggca

SEQ ID NO: 1374886 - RNA, 13 nt, Neisseria meningitidis Z2491
cuucagacggcau

SEQ ID NO: 1374887 - RNA, 14 nt, Neisseria meningitidis Z2491
cuucgauugccaag

SEQ ID NO: 1374888 - RNA, 19 nt, Neisseria meningitidis Z2491
cuuccaucgucauucccgc

SEQ ID NO: 1374889 - RNA, 20 nt, Neisseria meningitidis Z2491
cuguaaaucgucauucccgc

SEQ ID NO: 1374890 - RNA, 20 nt, Neisseria meningitidis Z2491
cugguuuaaauuuaauccac

SEQ ID NO: 1374891 - RNA, 19 nt, Neisseria meningitidis Z2491
cugguuuuugugaauccac

SEQ ID NO: 1374892 - RNA, 20 nt, Neisseria meningitidis Z2491
cugguuuuugugaauccacu

SEQ ID NO: 1374893 - RNA, 19 nt, Neisseria meningitidis Z2491
cugguuuuuguuaauccac

SEQ ID NO: 1374894 - RNA, 20 nt, Neisseria meningitidis Z2491
cugguuuuuguuaauccacu

SEQ ID NO: 1374895 - RNA, 19 nt, Neisseria meningitidis Z2491
cugguuuuuguuaauccgc

SEQ ID NO: 1374896 - RNA, 15 nt, Neisseria meningitidis Z2491
cuguacgaauccgcc

SEQ ID NO: 1374897 - RNA, 19 nt, Neisseria meningitidis Z2491
cugucgccgucauucccgc

SEQ ID NO: 1374898 - RNA, 11 nt, Neisseria meningitidis Z2491
cuguugcagau

SEQ ID NO: 1374899 - RNA, 22 nt, Neisseria meningitidis Z2491
cuguuugaauggaaaugccguc

SEQ ID NO: 1374900 - RNA, 22 nt, Neisseria meningitidis Z2491
cuguugcggcccgaauugcgcc

SEQ ID NO: 1374901 - RNA, 17 nt, Neisseria meningitidis Z2491
cuguugaaaaugccguc

SEQ ID NO: 1374902 - RNA, 21 nt, Neisseria meningitidis Z2491
cuguuuucgcgggaauccggu

SEQ ID NO: 1374903 - RNA, 18 nt, Neisseria meningitidis Z2491
cuguuuguuaaagccgua

SEQ ID NO: 1374904 - RNA, 19 nt, Neisseria meningitidis Z2491
cuguuuuugugggaaugac

SEQ ID NO: 1374905 - RNA, 17 nt, Neisseria meningitidis Z2491
cugucgggcuucagacg

SEQ ID NO: 1374906 - RNA, 12 nt, Neisseria meningitidis Z2491
cugugcggauag

SEQ ID NO: 1374907 - RNA, 15 nt, Neisseria meningitidis Z2491
cuguucagacggcau

SEQ ID NO: 1374908 - RNA, 15 nt, Neisseria meningitidis Z2491
gacugggcauacagc

SEQ ID NO: 1374909 - RNA, 11 nt, Neisseria meningitidis Z2491
gacugaaacuc

SEQ ID NO: 1374910 - RNA, 18 nt, Neisseria meningitidis Z2491
gagauucuagauucccgc

SEQ ID NO: 1374911 - RNA, 19 nt, Neisseria meningitidis Z2491
gacggcguauuguuccgau

SEQ ID NO: 1374912 - RNA, 21 nt, Neisseria meningitidis Z2491
gacggauucgcgguugccguc

SEQ ID NO: 1374913 - RNA, 20 nt, Neisseria meningitidis Z2491
gacggaguuucaggcggcau

SEQ ID NO: 1374914 - RNA, 19 nt, Neisseria meningitidis Z2491
gaccuucggguaacggcaa

SEQ ID NO: 1374915 - RNA, 19 nt, Neisseria meningitidis Z2491
gaccuuugggcggcggcaa

SEQ ID NO: 1374916 - RNA, 22 nt, Neisseria meningitidis Z2491
gacacagguauuguucagcgac

SEQ ID NO: 1374917 - RNA, 12 nt, Neisseria meningitidis Z2491
gaaugacggcag

SEQ ID NO: 1374918 - RNA, 18 nt, Neisseria meningitidis Z2491
gaaugacggcagagcggu

SEQ ID NO: 1374919 - RNA, 16 nt, Neisseria meningitidis Z2491
gaauaagucagcgugc

SEQ ID NO: 1374920 - RNA, 15 nt, Neisseria meningitidis Z2491
gaaugacgaaaaguu

SEQ ID NO: 1374921 - RNA, 20 nt, Neisseria meningitidis Z2491
gaaucuagaaacgcaaagcu

SEQ ID NO: 1374922 - RNA, 23 nt, Neisseria meningitidis Z2491
gaaucuagaacccaacacggcaa

SEQ ID NO: 1374923 - RNA, 14 nt, Neisseria meningitidis Z2491
gacagcaucgccgc

SEQ ID NO: 1374924 - RNA, 17 nt, Neisseria meningitidis Z2491
cuacguucuagauuccc

SEQ ID NO: 1374925 - RNA, 19 nt, Neisseria meningitidis Z2491
cuacguucuagauucccgc

SEQ ID NO: 1374926 - RNA, 20 nt, Neisseria meningitidis Z2491
cuacauuccgucauucccac

SEQ ID NO: 1374927 - RNA, 18 nt, Neisseria meningitidis Z2491
cucaacgcacuggauucc

SEQ ID NO: 1374928 - RNA, 19 nt, Neisseria meningitidis Z2491
cucaacgaaccuggauucc

SEQ ID NO: 1374929 - RNA, 20 nt, Neisseria meningitidis Z2491
cucaaaucccgucauucccg

SEQ ID NO: 1374930 - RNA, 21 nt, Neisseria meningitidis Z2491
cucaaaucccgucauucccgc

SEQ ID NO: 1374931 - RNA, 14 nt, Neisseria meningitidis Z2491
cucaaauaggcauu

SEQ ID NO: 1374932 - RNA, 15 nt, Neisseria meningitidis Z2491
cucaaacuuucagau

SEQ ID NO: 1374933 - RNA, 19 nt, Neisseria meningitidis Z2491
cuaugccugccgaccccga

SEQ ID NO: 1374934 - RNA, 17 nt, Neisseria meningitidis Z2491
cuauaucgucauucccg

SEQ ID NO: 1374935 - RNA, 18 nt, Neisseria meningitidis Z2491
cuauaucgucauucccgc

SEQ ID NO: 1374936 - RNA, 21 nt, Neisseria meningitidis Z2491
cuauaugaaucgucauucccg

SEQ ID NO: 1374937 - RNA, 11 nt, Neisseria meningitidis Z2491
cuagauucccg

SEQ ID NO: 1374938 - RNA, 12 nt, Neisseria meningitidis Z2491
cuagauucccgc

SEQ ID NO: 1374939 - RNA, 14 nt, Neisseria meningitidis Z2491
cuccgagcaucaag

SEQ ID NO: 1374940 - RNA, 17 nt, Neisseria meningitidis Z2491
cucggcaauuuccgccg

SEQ ID NO: 1374941 - RNA, 19 nt, Neisseria meningitidis Z2491
cugcagccgucauucccgc

SEQ ID NO: 1374942 - RNA, 18 nt, Neisseria meningitidis Z2491
cugccuguaaaaccaagu

SEQ ID NO: 1374943 - RNA, 15 nt, Neisseria meningitidis Z2491
cugacggacacgccc

SEQ ID NO: 1374944 - RNA, 14 nt, Neisseria meningitidis Z2491
cugauccaaaccgu

SEQ ID NO: 1374945 - RNA, 13 nt, Neisseria meningitidis Z2491
cugaugacggcag

SEQ ID NO: 1374946 - RNA, 14 nt, Neisseria meningitidis Z2491
cucuaaaccgucau

SEQ ID NO: 1374947 - RNA, 15 nt, Neisseria meningitidis Z2491
cugaacauuucagac

SEQ ID NO: 1374948 - RNA, 17 nt, Neisseria meningitidis Z2491
cugaacauuucagacgg

SEQ ID NO: 1374949 - RNA, 19 nt, Neisseria meningitidis Z2491
cugaacauuucagacggca

SEQ ID NO: 1374950 - RNA, 17 nt, Neisseria meningitidis Z2491
cugaaccgucauuccca

SEQ ID NO: 1374951 - RNA, 22 nt, Neisseria meningitidis Z2491
cugaacaucguguucagacggu

SEQ ID NO: 1374952 - RNA, 17 nt, Neisseria meningitidis Z2491
cugaaaaaaugccgucu

SEQ ID NO: 1374953 - RNA, 23 nt, Neisseria meningitidis Z2491
cugaaaaaaugccgucugaaacg

SEQ ID NO: 1374954 - RNA, 13 nt, Neisseria meningitidis Z2491
cugaagaaaccgu

SEQ ID NO: 1374955 - RNA, 20 nt, Neisseria meningitidis Z2491
cugaaccuguguucagacgg

SEQ ID NO: 1374956 - RNA, 20 nt, Neisseria meningitidis Z2491
cugacaggaaauuuccaaau

SEQ ID NO: 1374957 - RNA, 18 nt, Neisseria meningitidis Z2491
cgugcaauacggcgacgg

SEQ ID NO: 1374958 - RNA, 14 nt, Neisseria meningitidis Z2491
cgucugaaacggcg

SEQ ID NO: 1374959 - RNA, 22 nt, Neisseria meningitidis Z2491
cguuaccaaguuucagacggca

SEQ ID NO: 1374960 - RNA, 21 nt, Neisseria meningitidis Z2491
cguguuugccgcgauucagcc

SEQ ID NO: 1374961 - RNA, 17 nt, Neisseria meningitidis Z2491
cgugugcgacaacggcg

SEQ ID NO: 1374962 - RNA, 16 nt, Neisseria meningitidis Z2491
cguucgcugacgguau

SEQ ID NO: 1374963 - RNA, 18 nt, Neisseria meningitidis Z2491
cguucgcugacgguauag

SEQ ID NO: 1374964 - RNA, 14 nt, Neisseria meningitidis Z2491
cguucggacggcau

SEQ ID NO: 1374965 - RNA, 13 nt, Neisseria meningitidis Z2491
cguucagacggca

SEQ ID NO: 1374966 - RNA, 16 nt, Neisseria meningitidis Z2491
cguucagacggcauug

SEQ ID NO: 1374967 - RNA, 12 nt, Neisseria meningitidis Z2491
cgugggaaugac

SEQ ID NO: 1374968 - RNA, 19 nt, Neisseria meningitidis Z2491
cgguuuaaauuuaauccac

SEQ ID NO: 1374969 - RNA, 19 nt, Neisseria meningitidis Z2491
cguauuugagugcggcaag

SEQ ID NO: 1374970 - RNA, 17 nt, Neisseria meningitidis Z2491
cguaugccgccugccug

SEQ ID NO: 1374971 - RNA, 14 nt, Neisseria meningitidis Z2491
cguccaauacggcg

SEQ ID NO: 1374972 - RNA, 11 nt, Neisseria meningitidis Z2491
cgucauucccg

SEQ ID NO: 1374973 - RNA, 12 nt, Neisseria meningitidis Z2491
cgucauucccgc

SEQ ID NO: 1374974 - RNA, 12 nt, Neisseria meningitidis Z2491
cgucauucccgu

SEQ ID NO: 1374975 - RNA, 21 nt, Neisseria meningitidis Z2491
cgucauucccgugcaggcggg

SEQ ID NO: 1374976 - RNA, 21 nt, Neisseria meningitidis Z2491
cguccccgaaaccgaaugcca

SEQ ID NO: 1374977 - RNA, 17 nt, Neisseria meningitidis Z2491
gccccaaaaagaggcau

SEQ ID NO: 1374978 - RNA, 18 nt, Neisseria meningitidis Z2491
gcccgaauugcgccgaca

SEQ ID NO: 1374979 - RNA, 19 nt, Neisseria meningitidis Z2491
gccagcggauuguucggau

SEQ ID NO: 1374980 - RNA, 17 nt, Neisseria meningitidis Z2491
gccauccagcaaacggu

SEQ ID NO: 1374981 - RNA, 20 nt, Neisseria meningitidis Z2491
gccgcagacgguacaaauag

SEQ ID NO: 1374982 - RNA, 18 nt, Neisseria meningitidis Z2491
gccgaugcagcgacggau

SEQ ID NO: 1374983 - RNA, 13 nt, Neisseria meningitidis Z2491
gccgauuucuucg

SEQ ID NO: 1374984 - RNA, 18 nt, Neisseria meningitidis Z2491
gccgccccuuaugccuuu

SEQ ID NO: 1374985 - RNA, 20 nt, Neisseria meningitidis Z2491
gccgcauaaaucaacagcag

SEQ ID NO: 1374986 - RNA, 20 nt, Neisseria meningitidis Z2491
gccggaaauaccgacggcgu

SEQ ID NO: 1374987 - RNA, 18 nt, Neisseria meningitidis Z2491
gcaugauggcaacgauga

SEQ ID NO: 1374988 - RNA, 16 nt, Neisseria meningitidis Z2491
gcauucucgucgggca

SEQ ID NO: 1374989 - RNA, 22 nt, Neisseria meningitidis Z2491
gcauuaaugcgaaaugccgucu

SEQ ID NO: 1374990 - RNA, 15 nt, Neisseria meningitidis Z2491
gccaaaguauccgcg

SEQ ID NO: 1374991 - RNA, 15 nt, Neisseria meningitidis Z2491
gcauuuuugccgugu

SEQ ID NO: 1374992 - RNA, 14 nt, Neisseria meningitidis Z2491
gcauuuugccgugu

SEQ ID NO: 1374993 - RNA, 17 nt, Neisseria meningitidis Z2491
gcauuuuguugccgucg

SEQ ID NO: 1374994 - RNA, 22 nt, Neisseria meningitidis Z2491
gccaaacggguucggacggcgu

SEQ ID NO: 1374995 - RNA, 23 nt, Neisseria meningitidis Z2491
gccaaacggguuucagacggcau

SEQ ID NO: 1374996 - RNA, 22 nt, Neisseria meningitidis Z2491
gcauuugcacacguuugccguu

SEQ ID NO: 1374997 - RNA, 17 nt, Neisseria meningitidis Z2491
gcaguugaaaucaacag

SEQ ID NO: 1374998 - RNA, 13 nt, Neisseria meningitidis Z2491
gcaucacgacggu

SEQ ID NO: 1374999 - RNA, 13 nt, Neisseria meningitidis Z2491
gcaggucgacggc

SEQ ID NO: 1375000 - RNA, 15 nt, Neisseria meningitidis Z2491
gcaggucgacggcaa

SEQ ID NO: 1375001 - RNA, 22 nt, Neisseria meningitidis Z2491
gcagcgugaugauguccgacug

SEQ ID NO: 1375002 - RNA, 15 nt, Neisseria meningitidis Z2491
gcaggcagaaaucca

SEQ ID NO: 1375003 - RNA, 18 nt, Neisseria meningitidis Z2491
gcagccgccauaucgucc

SEQ ID NO: 1375004 - RNA, 14 nt, Neisseria meningitidis Z2491
gcagcaacgacagc

SEQ ID NO: 1375005 - RNA, 20 nt, Neisseria meningitidis Z2491
gcaccgugugcgacaacggc

SEQ ID NO: 1375006 - RNA, 20 nt, Neisseria meningitidis Z2491
gcaauuuaucggaaaugacu

SEQ ID NO: 1375007 - RNA, 20 nt, Neisseria meningitidis Z2491
gcaagaccgauaacggcggc

SEQ ID NO: 1375008 - RNA, 20 nt, Neisseria meningitidis Z2491
gcaaauuccagcaaugcguc

SEQ ID NO: 1375009 - RNA, 18 nt, Neisseria meningitidis Z2491
gcaaauugaaaugccguc

SEQ ID NO: 1375010 - RNA, 13 nt, Neisseria meningitidis Z2491
gcaaaugccgucu

SEQ ID NO: 1375011 - RNA, 21 nt, Neisseria meningitidis Z2491
gcaaauaauugaaaucaacag

SEQ ID NO: 1375012 - RNA, 18 nt, Neisseria meningitidis Z2491
gcaaagccgccgccgaca

SEQ ID NO: 1375013 - RNA, 18 nt, Neisseria meningitidis Z2491
gauuugagauugcggcau

SEQ ID NO: 1375014 - RNA, 15 nt, Neisseria meningitidis Z2491
gauuugaacgacggu

SEQ ID NO: 1375015 - RNA, 19 nt, Neisseria meningitidis Z2491
gauuuccucuuucaacggc

SEQ ID NO: 1375016 - RNA, 15 nt, Neisseria meningitidis Z2491
gauuauccgaaaguu

SEQ ID NO: 1375017 - RNA, 20 nt, Neisseria meningitidis Z2491
gauuccuguuuucagacggc

SEQ ID NO: 1375018 - RNA, 20 nt, Neisseria meningitidis Z2491
gaugccguuucagacggcau

SEQ ID NO: 1375019 - RNA, 23 nt, Neisseria meningitidis Z2491
gaugccggaaauaccgacggcgu

SEQ ID NO: 1375020 - RNA, 12 nt, Neisseria meningitidis Z2491
gaugccgucuga

SEQ ID NO: 1375021 - RNA, 20 nt, Neisseria meningitidis Z2491
gaugccgucugaaacggcau

SEQ ID NO: 1375022 - RNA, 12 nt, Neisseria meningitidis Z2491
gaugccgucugu

SEQ ID NO: 1375023 - RNA, 14 nt, Neisseria meningitidis Z2491
gagguugacggcuu

SEQ ID NO: 1375024 - RNA, 18 nt, Neisseria meningitidis Z2491
gauaaaaauaccgucuga

SEQ ID NO: 1375025 - RNA, 19 nt, Neisseria meningitidis Z2491
gauaaaaaaugccgucuga

SEQ ID NO: 1375026 - RNA, 13 nt, Neisseria meningitidis Z2491
gauacugccgucg

SEQ ID NO: 1375027 - RNA, 19 nt, Neisseria meningitidis Z2491
gauaccugcaaugccgucu

SEQ ID NO: 1375028 - RNA, 21 nt, Neisseria meningitidis Z2491
gauagccgcccaaugccgucu

SEQ ID NO: 1375029 - RNA, 14 nt, Neisseria meningitidis Z2491
gauagcgagacggc

SEQ ID NO: 1375030 - RNA, 16 nt, Neisseria meningitidis Z2491
gauagcgagacggcau

SEQ ID NO: 1375031 - RNA, 14 nt, Neisseria meningitidis Z2491
gauaguugccguca

SEQ ID NO: 1375032 - RNA, 16 nt, Neisseria meningitidis Z2491
gauauagguuuccgug

SEQ ID NO: 1375033 - RNA, 13 nt, Neisseria meningitidis Z2491
cagacaguacaga

SEQ ID NO: 1375034 - RNA, 13 nt, Neisseria meningitidis Z2491
cagacaggauucg

SEQ ID NO: 1375035 - RNA, 21 nt, Neisseria meningitidis Z2491
cagaccuucggguaacggcaa

SEQ ID NO: 1375036 - RNA, 17 nt, Neisseria meningitidis Z2491
cagaccuagauucccgc

SEQ ID NO: 1375037 - RNA, 18 nt, Neisseria meningitidis Z2491
cagacggcauccgcuuaa

SEQ ID NO: 1375038 - RNA, 20 nt, Neisseria meningitidis Z2491
cagacggcauuugacuuuca

SEQ ID NO: 1375039 - RNA, 20 nt, Neisseria meningitidis Z2491
cagacggcauuuuguugccg

SEQ ID NO: 1375040 - RNA, 15 nt, Neisseria meningitidis Z2491
cagacggcacuuuca

SEQ ID NO: 1375041 - RNA, 19 nt, Neisseria meningitidis Z2491
cacuauaccaaacggcaua

SEQ ID NO: 1375042 - RNA, 21 nt, Neisseria meningitidis Z2491
cacgggaaugacgaaagguug

SEQ ID NO: 1375043 - RNA, 14 nt, Neisseria meningitidis Z2491
cacgccgacugccg

SEQ ID NO: 1375044 - RNA, 21 nt, Neisseria meningitidis Z2491
cagcacguguuccaaacgccg

SEQ ID NO: 1375045 - RNA, 21 nt, Neisseria meningitidis Z2491
caucagcaccacuguugccac

SEQ ID NO: 1375046 - RNA, 22 nt, Neisseria meningitidis Z2491
cauccgcuuaaaaaacaacuga

SEQ ID NO: 1375047 - RNA, 21 nt, Neisseria meningitidis Z2491
caucccaaaaacgaagagcgg

SEQ ID NO: 1375048 - RNA, 19 nt, Neisseria meningitidis Z2491
cagucuuuaaauucaacuu

SEQ ID NO: 1375049 - RNA, 21 nt, Neisseria meningitidis Z2491
cauacaaacaggcuucagacg

SEQ ID NO: 1375050 - RNA, 14 nt, Neisseria meningitidis Z2491
caguucggcaaacg

SEQ ID NO: 1375051 - RNA, 14 nt, Neisseria meningitidis Z2491
caguguuucagacg

SEQ ID NO: 1375052 - RNA, 16 nt, Neisseria meningitidis Z2491
cagcuugagauuucgc

SEQ ID NO: 1375053 - RNA, 16 nt, Neisseria meningitidis Z2491
caggcuucagacggca

SEQ ID NO: 1375054 - RNA, 17 nt, Neisseria meningitidis Z2491
caggcuucagacggcau

SEQ ID NO: 1375055 - RNA, 13 nt, Neisseria meningitidis Z2491
caggcggcggcau

SEQ ID NO: 1375056 - RNA, 16 nt, Neisseria meningitidis Z2491
ccacaauauccgacca

SEQ ID NO: 1375057 - RNA, 13 nt, Neisseria meningitidis Z2491
ccacaacauuccg

SEQ ID NO: 1375058 - RNA, 12 nt, Neisseria meningitidis Z2491
ccaaggcagcaa

SEQ ID NO: 1375059 - RNA, 19 nt, Neisseria meningitidis Z2491
ccaaggcaguaaugccgcc

SEQ ID NO: 1375060 - RNA, 11 nt, Neisseria meningitidis Z2491
cauuucagacg

SEQ ID NO: 1375061 - RNA, 15 nt, Neisseria meningitidis Z2491
cauuuuuuuaccaaa

SEQ ID NO: 1375062 - RNA, 15 nt, Neisseria meningitidis Z2491
cauuuuuuucauacc

SEQ ID NO: 1375063 - RNA, 15 nt, Neisseria meningitidis Z2491
ccaaaaugcccgcca

SEQ ID NO: 1375064 - RNA, 16 nt, Neisseria meningitidis Z2491
cauguucgugcaucau

SEQ ID NO: 1375065 - RNA, 17 nt, Neisseria meningitidis Z2491
cauuaaaauucuagauu

SEQ ID NO: 1375066 - RNA, 13 nt, Neisseria meningitidis Z2491
cauuccgucauuc

SEQ ID NO: 1375067 - RNA, 14 nt, Neisseria meningitidis Z2491
cauucagacggcau

SEQ ID NO: 1375068 - RNA, 18 nt, Neisseria meningitidis Z2491
ccagcucccaaucccgau

SEQ ID NO: 1375069 - RNA, 20 nt, Neisseria meningitidis Z2491
ccacgcucaaacacccccga

SEQ ID NO: 1375070 - RNA, 11 nt, Neisseria meningitidis Z2491
ccagauucccg

SEQ ID NO: 1375071 - RNA, 19 nt, Neisseria meningitidis Z2491
ccauaccguuuggcggcau

SEQ ID NO: 1375072 - RNA, 15 nt, Neisseria meningitidis Z2491
ccauccucaucaacg

SEQ ID NO: 1375073 - RNA, 21 nt, Neisseria meningitidis Z2491
ccauucccguaauuaccgaaa

SEQ ID NO: 1375074 - RNA, 13 nt, Neisseria meningitidis Z2491
cccauaugccguc

SEQ ID NO: 1375075 - RNA, 15 nt, Neisseria meningitidis Z2491
cccauaugccgucug

SEQ ID NO: 1375076 - RNA, 20 nt, Neisseria meningitidis Z2491
cccgcguucgcgggaaugac

SEQ ID NO: 1375077 - RNA, 20 nt, Neisseria meningitidis Z2491
cccgccuucgcgggaaugac

SEQ ID NO: 1375078 - RNA, 21 nt, Neisseria meningitidis Z2491
ccgaccgccccgucauucccg

SEQ ID NO: 1375079 - RNA, 16 nt, Neisseria meningitidis Z2491
cccguuucagacggca

SEQ ID NO: 1375080 - RNA, 21 nt, Neisseria meningitidis Z2491
cccuaaaggcuucagacggca

SEQ ID NO: 1375081 - RNA, 22 nt, Neisseria meningitidis Z2491
ccgaacggacuagauucccgcc

SEQ ID NO: 1375082 - RNA, 15 nt, Neisseria meningitidis Z2491
cccuuucagacggca

SEQ ID NO: 1375083 - RNA, 17 nt, Neisseria meningitidis Z2491
cccuuucagacggcauu

SEQ ID NO: 1375084 - RNA, 17 nt, Neisseria meningitidis Z2491
auauggauaccgucuga

SEQ ID NO: 1375085 - RNA, 16 nt, Neisseria meningitidis Z2491
auaugguucagacggc

SEQ ID NO: 1375086 - RNA, 20 nt, Neisseria meningitidis Z2491
auaugcuucaaggcgcggca

SEQ ID NO: 1375087 - RNA, 11 nt, Neisseria meningitidis Z2491
auaugccgucu

SEQ ID NO: 1375088 - RNA, 16 nt, Neisseria meningitidis Z2491
auauccgacugugccg

SEQ ID NO: 1375089 - RNA, 16 nt, Neisseria meningitidis Z2491
auagcgagacggcauc

SEQ ID NO: 1375090 - RNA, 13 nt, Neisseria meningitidis Z2491
auaucaugccgcu

SEQ ID NO: 1375091 - RNA, 14 nt, Neisseria meningitidis Z2491
aucaacgcgggaau

SEQ ID NO: 1375092 - RNA, 13 nt, Neisseria meningitidis Z2491
aucaacguuucua

SEQ ID NO: 1375093 - RNA, 18 nt, Neisseria meningitidis Z2491
aucaacaaaaugccgucu

SEQ ID NO: 1375094 - RNA, 12 nt, Neisseria meningitidis Z2491
auagauucccgu

SEQ ID NO: 1375095 - RNA, 16 nt, Neisseria meningitidis Z2491
auacauagcaggcauu

SEQ ID NO: 1375096 - RNA, 19 nt, Neisseria meningitidis Z2491
auaaucuuugaauauugcc

SEQ ID NO: 1375097 - RNA, 16 nt, Neisseria meningitidis Z2491
auaaauuccugccgcu

SEQ ID NO: 1375098 - RNA, 18 nt, Neisseria meningitidis Z2491
auaaucaucacuccgucu

SEQ ID NO: 1375099 - RNA, 21 nt, Neisseria meningitidis Z2491
aguuuaaaggaaaugccgucu

SEQ ID NO: 1375100 - RNA, 14 nt, Neisseria meningitidis Z2491
aguuuucagacggc

SEQ ID NO: 1375101 - RNA, 18 nt, Neisseria meningitidis Z2491
auaaaaaacgccguccga

SEQ ID NO: 1375102 - RNA, 16 nt, Neisseria meningitidis Z2491
auaaaaaaugccgucu

SEQ ID NO: 1375103 - RNA, 14 nt, Neisseria meningitidis Z2491
auaaaaugccgucu

SEQ ID NO: 1375104 - RNA, 21 nt, Neisseria meningitidis Z2491
auaaacccccgucauucccgc

SEQ ID NO: 1375105 - RNA, 20 nt, Neisseria meningitidis Z2491
aguucuacacccaaauccgc

SEQ ID NO: 1375106 - RNA, 16 nt, Neisseria meningitidis Z2491
aguccuucacgccauu

SEQ ID NO: 1375107 - RNA, 16 nt, Neisseria meningitidis Z2491
aguuccagacggcauu

SEQ ID NO: 1375108 - RNA, 16 nt, Neisseria meningitidis Z2491
agguuuccgugcggau

SEQ ID NO: 1375109 - RNA, 16 nt, Neisseria meningitidis Z2491
agguucuagauucccg

SEQ ID NO: 1375110 - RNA, 22 nt, Neisseria meningitidis Z2491
agguucagcaggaaggcggcaa

SEQ ID NO: 1375111 - RNA, 17 nt, Neisseria meningitidis Z2491
aguccgauaaaauccgg

SEQ ID NO: 1375112 - RNA, 18 nt, Neisseria meningitidis Z2491
aggggucugacgaugcca

SEQ ID NO: 1375113 - RNA, 15 nt, Neisseria meningitidis Z2491
agggcacagucggca

SEQ ID NO: 1375114 - RNA, 17 nt, Neisseria meningitidis Z2491
aggucgaacugccugcc

SEQ ID NO: 1375115 - RNA, 13 nt, Neisseria meningitidis Z2491
aggucgucugaaa

SEQ ID NO: 1375116 - RNA, 20 nt, Neisseria meningitidis Z2491
agcugcgggaaugacgggau

SEQ ID NO: 1375117 - RNA, 19 nt, Neisseria meningitidis Z2491
aggaugccguuucagacgg

SEQ ID NO: 1375118 - RNA, 23 nt, Neisseria meningitidis Z2491
aggaugccguuucagacggcauc

SEQ ID NO: 1375119 - RNA, 18 nt, Neisseria meningitidis Z2491
aggcuuuuucagacggca

SEQ ID NO: 1375120 - RNA, 19 nt, Neisseria meningitidis Z2491
aggcuuuuucagacggcau

SEQ ID NO: 1375121 - RNA, 20 nt, Neisseria meningitidis Z2491
aggcuuuuucagacggcauu

SEQ ID NO: 1375122 - RNA, 13 nt, Neisseria meningitidis Z2491
aggcuuucagacg

SEQ ID NO: 1375123 - RNA, 16 nt, Neisseria meningitidis Z2491
aggcuuucagacggca

SEQ ID NO: 1375124 - RNA, 18 nt, Neisseria meningitidis Z2491
aggccgucugaaauccua

SEQ ID NO: 1375125 - RNA, 12 nt, Neisseria meningitidis Z2491
agcaaugcgucu

SEQ ID NO: 1375126 - RNA, 22 nt, Neisseria meningitidis Z2491
agauucccguuucagacggcau

SEQ ID NO: 1375127 - RNA, 14 nt, Neisseria meningitidis Z2491
agauuccggcggcu

SEQ ID NO: 1375128 - RNA, 19 nt, Neisseria meningitidis Z2491
agauuccacguucuagauu

SEQ ID NO: 1375129 - RNA, 13 nt, Neisseria meningitidis Z2491
agcaaaugccguc

SEQ ID NO: 1375130 - RNA, 14 nt, Neisseria meningitidis Z2491
agcaaaugccgucu

SEQ ID NO: 1375131 - RNA, 22 nt, Neisseria meningitidis Z2491
agauucaacgcaagcggcgcau

SEQ ID NO: 1375132 - RNA, 21 nt, Neisseria meningitidis Z2491
agauguauuguccgccgucuu

SEQ ID NO: 1375133 - RNA, 17 nt, Neisseria meningitidis Z2491
agaucaaggaugccguu

SEQ ID NO: 1375134 - RNA, 19 nt, Neisseria meningitidis Z2491
agaugccgucugaaacggc

SEQ ID NO: 1375135 - RNA, 18 nt, Neisseria meningitidis Z2491
agagguucuagauucccg

SEQ ID NO: 1375136 - RNA, 18 nt, Neisseria meningitidis Z2491
agagauucuggauuccca

SEQ ID NO: 1375137 - RNA, 18 nt, Neisseria meningitidis Z2491
agaaaccacccugccguc

SEQ ID NO: 1375138 - RNA, 19 nt, Neisseria meningitidis Z2491
agaaaccacccugccguca

SEQ ID NO: 1375139 - RNA, 18 nt, Neisseria meningitidis Z2491
agaaaccgcucugccguc

SEQ ID NO: 1375140 - RNA, 19 nt, Neisseria meningitidis Z2491
agaaaccuaaaaucccguc

SEQ ID NO: 1375141 - RNA, 17 nt, Neisseria meningitidis Z2491
agccgcccaaugccguc

SEQ ID NO: 1375142 - RNA, 20 nt, Neisseria meningitidis Z2491
agccgcccaaugccgucuga

SEQ ID NO: 1375143 - RNA, 23 nt, Neisseria meningitidis Z2491
agccuuuagggguuucagacggc

SEQ ID NO: 1375144 - RNA, 16 nt, Neisseria meningitidis Z2491
agccgccuccgaacgg

SEQ ID NO: 1375145 - RNA, 12 nt, Neisseria meningitidis Z2491
agcggaaaucca

SEQ ID NO: 1375146 - RNA, 15 nt, Neisseria meningitidis Z2491
agcguucugccgacu

SEQ ID NO: 1375147 - RNA, 24 nt, Neisseria meningitidis Z2491
agcguuggcucgccuugccguacu

SEQ ID NO: 1375148 - RNA, 15 nt, Neisseria meningitidis Z2491
aucggccauucccuc

SEQ ID NO: 1375149 - RNA, 16 nt, Neisseria meningitidis Z2491
aucgcgcugccgucga

SEQ ID NO: 1375150 - RNA, 18 nt, Neisseria meningitidis Z2491
auccgaccgccccgucau

SEQ ID NO: 1375151 - RNA, 16 nt, Neisseria meningitidis Z2491
auccgccaaaaacggc

SEQ ID NO: 1375152 - RNA, 18 nt, Neisseria meningitidis Z2491
auccguuuggaugccguc

SEQ ID NO: 1375153 - RNA, 21 nt, Neisseria meningitidis Z2491
auccguuuggaugccgucuga

SEQ ID NO: 1375154 - RNA, 23 nt, Neisseria meningitidis Z2491
aucucgaauuuuuuccauacgga

SEQ ID NO: 1375155 - RNA, 15 nt, Neisseria meningitidis Z2491
aucuagacauucaau

SEQ ID NO: 1375156 - RNA, 20 nt, Neisseria meningitidis Z2491
augaguccgaggcuguggag

SEQ ID NO: 1375157 - RNA, 17 nt, Neisseria meningitidis Z2491
augacgagucagaaguu

SEQ ID NO: 1375158 - RNA, 13 nt, Neisseria meningitidis Z2491
augacgaauuuca

SEQ ID NO: 1375159 - RNA, 14 nt, Neisseria meningitidis Z2491
augaaaaugccguc

SEQ ID NO: 1375160 - RNA, 15 nt, Neisseria meningitidis Z2491
augaaaaugccgucu

SEQ ID NO: 1375161 - RNA, 16 nt, Neisseria meningitidis Z2491
aucuuguuuuucaauc

SEQ ID NO: 1375162 - RNA, 15 nt, Neisseria meningitidis Z2491
auugccgcaaucgcc

SEQ ID NO: 1375163 - RNA, 13 nt, Neisseria meningitidis Z2491
auucuugaggcau

SEQ ID NO: 1375164 - RNA, 14 nt, Neisseria meningitidis Z2491
auucuugaggcauu

SEQ ID NO: 1375165 - RNA, 18 nt, Neisseria meningitidis Z2491
auugagggcacagucggc

SEQ ID NO: 1375166 - RNA, 20 nt, Neisseria meningitidis Z2491
auugacggacggcggcagau

SEQ ID NO: 1375167 - RNA, 23 nt, Neisseria meningitidis Z2491
auugucggaaugugguuucagac

SEQ ID NO: 1375168 - RNA, 23 nt, Neisseria meningitidis Z2491
auuggcgguagguuugcaggaau

SEQ ID NO: 1375169 - RNA, 16 nt, Neisseria meningitidis Z2491
auuggauucagacggc

SEQ ID NO: 1375170 - RNA, 18 nt, Neisseria meningitidis Z2491
auucccguuuucacggga

SEQ ID NO: 1375171 - RNA, 20 nt, Neisseria meningitidis Z2491
auucccuccugcgcgggaau

SEQ ID NO: 1375172 - RNA, 20 nt, Neisseria meningitidis Z2491
auucccucgaaagcgggaau

SEQ ID NO: 1375173 - RNA, 19 nt, Neisseria meningitidis Z2491
auucaucgcgcugccgucg

SEQ ID NO: 1375174 - RNA, 13 nt, Neisseria meningitidis Z2491
auucagacggcau

SEQ ID NO: 1375175 - RNA, 23 nt, Neisseria meningitidis Z2491
auuaugacaagacgacaggcggc

SEQ ID NO: 1375176 - RNA, 17 nt, Neisseria meningitidis Z2491
auucgcgguugccguca

SEQ ID NO: 1375177 - RNA, 20 nt, Neisseria meningitidis Z2491
auuccuguuuucgcgggaau

SEQ ID NO: 1375178 - RNA, 15 nt, Neisseria meningitidis Z2491
auucugccaaacggc

SEQ ID NO: 1375179 - RNA, 20 nt, Neisseria meningitidis Z2491
auucucgcgaaagcgggaau

SEQ ID NO: 1375180 - RNA, 20 nt, Neisseria meningitidis Z2491
auucucgcgcaggcgggaau

SEQ ID NO: 1375181 - RNA, 14 nt, Neisseria meningitidis Z2491
auggaaaugccguc

SEQ ID NO: 1375182 - RNA, 19 nt, Neisseria meningitidis Z2491
auggauucgucauucccgc

SEQ ID NO: 1375183 - RNA, 20 nt, Neisseria meningitidis Z2491
auggccuuuacucauucaau

SEQ ID NO: 1375184 - RNA, 14 nt, Neisseria meningitidis Z2491
auguucagacggca

SEQ ID NO: 1375185 - RNA, 16 nt, Neisseria meningitidis Z2491
auguucagacggcauu

SEQ ID NO: 1375186 - RNA, 13 nt, Neisseria meningitidis Z2491
auguucagacggu

SEQ ID NO: 1375187 - RNA, 19 nt, Neisseria meningitidis Z2491
augugugccaguucggcaa

SEQ ID NO: 1375188 - RNA, 18 nt, Neisseria meningitidis Z2491
caaaggcagugccgccaa

SEQ ID NO: 1375189 - RNA, 22 nt, Neisseria meningitidis Z2491
caaaggccuggauucccgccug

SEQ ID NO: 1375190 - RNA, 22 nt, Neisseria meningitidis Z2491
caaaccgaugccgucauucccg

SEQ ID NO: 1375191 - RNA, 19 nt, Neisseria meningitidis Z2491
caaacccuuuuucugccgc

SEQ ID NO: 1375192 - RNA, 15 nt, Neisseria meningitidis Z2491
caaacuagauucccg

SEQ ID NO: 1375193 - RNA, 21 nt, Neisseria meningitidis Z2491
auuguuuguuuuuuucaggcc

SEQ ID NO: 1375194 - RNA, 16 nt, Neisseria meningitidis Z2491
auuuaaaucaguacgg

SEQ ID NO: 1375195 - RNA, 20 nt, Neisseria meningitidis Z2491
auuuaaaagggaacggcauc

SEQ ID NO: 1375196 - RNA, 19 nt, Neisseria meningitidis Z2491
caaaccauacuggaugucg

SEQ ID NO: 1375197 - RNA, 15 nt, Neisseria meningitidis Z2491
caaaaugccgccuga

SEQ ID NO: 1375198 - RNA, 13 nt, Neisseria meningitidis Z2491
caaaaugccgucu

SEQ ID NO: 1375199 - RNA, 15 nt, Neisseria meningitidis Z2491
caaaaugccgucuga

SEQ ID NO: 1375200 - RNA, 19 nt, Neisseria meningitidis Z2491
caaaaugccgucugaaacc

SEQ ID NO: 1375201 - RNA, 17 nt, Neisseria meningitidis Z2491
caaaucuggauucccgc

SEQ ID NO: 1375202 - RNA, 15 nt, Neisseria meningitidis Z2491
caaaucggauaggca

SEQ ID NO: 1375203 - RNA, 23 nt, Neisseria meningitidis Z2491
caaaucggcuuucagacggcauu

SEQ ID NO: 1375204 - RNA, 20 nt, Neisseria meningitidis Z2491
caaaugcgccuuugccgccu

SEQ ID NO: 1375205 - RNA, 18 nt, Neisseria meningitidis Z2491
caaaugcugucugaaacc

SEQ ID NO: 1375206 - RNA, 16 nt, Neisseria meningitidis Z2491
caaaucuugcaaaccc

SEQ ID NO: 1375207 - RNA, 15 nt, Neisseria meningitidis Z2491
caaauauccggcaag

SEQ ID NO: 1375208 - RNA, 16 nt, Neisseria meningitidis Z2491
caaauaguacggcaag

SEQ ID NO: 1375209 - RNA, 20 nt, Neisseria meningitidis Z2491
caacguucagggauucaacc

SEQ ID NO: 1375210 - RNA, 16 nt, Neisseria meningitidis Z2491
caaggcuggauucccg

SEQ ID NO: 1375211 - RNA, 13 nt, Neisseria meningitidis Z2491
caagucuucggca

SEQ ID NO: 1375212 - RNA, 21 nt, Neisseria meningitidis Z2491
caauacacuguuuccaagccg

SEQ ID NO: 1375213 - RNA, 12 nt, Neisseria meningitidis Z2491
caaguuucagcc

SEQ ID NO: 1375214 - RNA, 14 nt, Neisseria meningitidis Z2491
caaucagaucggca

SEQ ID NO: 1375215 - RNA, 18 nt, Neisseria meningitidis Z2491
caaucagaucggcaaacc

SEQ ID NO: 1375216 - RNA, 16 nt, Neisseria meningitidis Z2491
caaucccguugccaaa

SEQ ID NO: 1375217 - RNA, 12 nt, Neisseria meningitidis Z2491
cacaauggcgga

SEQ ID NO: 1375218 - RNA, 16 nt, Neisseria meningitidis Z2491
cacaaggcggcggcag

SEQ ID NO: 1375219 - RNA, 13 nt, Neisseria meningitidis Z2491
caaugccgucuga

SEQ ID NO: 1375220 - RNA, 17 nt, Neisseria meningitidis Z2491
caaugccgucugaaacc

SEQ ID NO: 1375221 - RNA, 22 nt, Neisseria meningitidis Z2491
caaugccgucugaacccgccug

SEQ ID NO: 1375222 - RNA, 19 nt, Neisseria meningitidis Z2491
caccgcuuuguccaaaucg

SEQ ID NO: 1375223 - RNA, 22 nt, Neisseria meningitidis Z2491
caccgacagaccuagauucccg

SEQ ID NO: 1375224 - RNA, 19 nt, Neisseria meningitidis Z2491
caccgacauuucauugccg

SEQ ID NO: 1375225 - RNA, 23 nt, Neisseria meningitidis Z2491
caccgacauuucauugccgccca

SEQ ID NO: 1375226 - RNA, 14 nt, Neisseria meningitidis Z2491
acagcaaccugaaa

SEQ ID NO: 1375227 - RNA, 19 nt, Neisseria meningitidis Z2491
acaggcuucagacggcauu

SEQ ID NO: 1375228 - RNA, 21 nt, Neisseria meningitidis Z2491
acaucaaguuaccggucuaaa

SEQ ID NO: 1375229 - RNA, 17 nt, Neisseria meningitidis Z2491
acaucaggggcgguaau

SEQ ID NO: 1375230 - RNA, 19 nt, Neisseria meningitidis Z2491
acccgacuucugacagcau

SEQ ID NO: 1375231 - RNA, 15 nt, Neisseria meningitidis Z2491
accgauucacuuggu

SEQ ID NO: 1375232 - RNA, 19 nt, Neisseria meningitidis Z2491
accgccccgucauucccgc

SEQ ID NO: 1375233 - RNA, 21 nt, Neisseria meningitidis Z2491
accgccgccgccaaugccguc

SEQ ID NO: 1375234 - RNA, 14 nt, Neisseria meningitidis Z2491
accgucauucccgc

SEQ ID NO: 1375235 - RNA, 21 nt, Neisseria meningitidis Z2491
accgucaaaccgaugccguca

SEQ ID NO: 1375236 - RNA, 20 nt, Neisseria meningitidis Z2491
accggucuaaaugccgucaa

SEQ ID NO: 1375237 - RNA, 21 nt, Neisseria meningitidis Z2491
acuuuaaucauguugccguca

SEQ ID NO: 1375238 - RNA, 14 nt, Neisseria meningitidis Z2491
acuuuguuucaaaa

SEQ ID NO: 1375239 - RNA, 19 nt, Neisseria meningitidis Z2491
agaaaaccugcaucccguc

SEQ ID NO: 1375240 - RNA, 13 nt, Neisseria meningitidis Z2491
agaaaacgccguc

SEQ ID NO: 1375241 - RNA, 14 nt, Neisseria meningitidis Z2491
agaaaacgccgucu

SEQ ID NO: 1375242 - RNA, 16 nt, Neisseria meningitidis Z2491
acuuguucggguguca

SEQ ID NO: 1375243 - RNA, 22 nt, Neisseria meningitidis Z2491
acuugguggucggcauucaaac

SEQ ID NO: 1375244 - RNA, 19 nt, Neisseria meningitidis Z2491
acuuggcaaaaucuggauu

SEQ ID NO: 1375245 - RNA, 22 nt, Neisseria meningitidis Z2491
acuucaaguccgaacauacggc

SEQ ID NO: 1375246 - RNA, 13 nt, Neisseria meningitidis Z2491
acuggauucccgc

SEQ ID NO: 1375247 - RNA, 22 nt, Neisseria meningitidis Z2491
acggagccagcccgcugccgaa

SEQ ID NO: 1375248 - RNA, 19 nt, Neisseria meningitidis Z2491
acgggaggaccucaaacga

SEQ ID NO: 1375249 - RNA, 17 nt, Neisseria meningitidis Z2491
acggugucagacggcau

SEQ ID NO: 1375250 - RNA, 12 nt, Neisseria meningitidis Z2491
acgagcaauauu

SEQ ID NO: 1375251 - RNA, 22 nt, Neisseria meningitidis Z2491
accguuuccuccucgccgucuu

SEQ ID NO: 1375252 - RNA, 22 nt, Neisseria meningitidis Z2491
accguugcagccaugcggcaaa

SEQ ID NO: 1375253 - RNA, 15 nt, Neisseria meningitidis Z2491
accuaaaauccguca

SEQ ID NO: 1375254 - RNA, 20 nt, Neisseria meningitidis Z2491
accuguaccguuucagacgg

SEQ ID NO: 1375255 - RNA, 17 nt, Neisseria meningitidis Z2491
acgaaaaugccgucuga

SEQ ID NO: 1375256 - RNA, 22 nt, Neisseria meningitidis Z2491
acgauuuggaaauuacccgaaa

SEQ ID NO: 1375257 - RNA, 22 nt, Neisseria meningitidis Z2491
acgaugcuggcggggcuuucga

SEQ ID NO: 1375258 - RNA, 20 nt, Neisseria meningitidis Z2491
acgcggugcugcgccaucag

SEQ ID NO: 1375259 - RNA, 22 nt, Neisseria meningitidis Z2491
acgcguagccugccaaaaucga

SEQ ID NO: 1375260 - RNA, 17 nt, Neisseria meningitidis Z2491
acgcgguagggcaguuc

SEQ ID NO: 1375261 - RNA, 22 nt, Neisseria meningitidis Z2491
acgcggcugaaaaaaugccguc

SEQ ID NO: 1375262 - RNA, 20 nt, Neisseria meningitidis Z2491
acgcgcugcgccuaugcaau

SEQ ID NO: 1375263 - RNA, 23 nt, Neisseria meningitidis Z2491
uguuuuugagggaaugacgggau

SEQ ID NO: 1375264 - RNA, 22 nt, Neisseria meningitidis Z2491
uguuuuugcguucagacggcau

SEQ ID NO: 1375265 - RNA, 15 nt, Neisseria meningitidis Z2491
uguuucagacggcau

SEQ ID NO: 1375266 - RNA, 17 nt, Neisseria meningitidis Z2491
uguuucagacggcauuu

SEQ ID NO: 1375267 - RNA, 15 nt, Neisseria meningitidis Z2491
uguuuuaaaguccga

SEQ ID NO: 1375268 - RNA, 18 nt, Neisseria meningitidis Z2491
uuaaaagggaacggcauc

SEQ ID NO: 1375269 - RNA, 17 nt, Neisseria meningitidis Z2491
uguuguuuuuugguuuc

SEQ ID NO: 1375270 - RNA, 21 nt, Neisseria meningitidis Z2491
uguugcucccgauaaaugccg

SEQ ID NO: 1375271 - RNA, 21 nt, Neisseria meningitidis Z2491
uguugcuccugauaaaugccg

SEQ ID NO: 1375272 - RNA, 21 nt, Neisseria meningitidis Z2491
ugucggaacagcaucaaacca

SEQ ID NO: 1375273 - RNA, 16 nt, Neisseria meningitidis Z2491
uguucagacggcauuu

SEQ ID NO: 1375274 - RNA, 21 nt, Neisseria meningitidis Z2491
uguguuccgggccgaugccgg

SEQ ID NO: 1375275 - RNA, 15 nt, Neisseria meningitidis Z2491
uuauauggcggauuu

SEQ ID NO: 1375276 - RNA, 19 nt, Neisseria meningitidis Z2491
uucaaguuccagacggcau

SEQ ID NO: 1375277 - RNA, 22 nt, Neisseria meningitidis Z2491
uucaaggcgcggcacacgcauu

SEQ ID NO: 1375278 - RNA, 16 nt, Neisseria meningitidis Z2491
uucaaacuuuauccgu

SEQ ID NO: 1375279 - RNA, 16 nt, Neisseria meningitidis Z2491
uucaacagacggcguu

SEQ ID NO: 1375280 - RNA, 17 nt, Neisseria meningitidis Z2491
uucaagccuucccguuc

SEQ ID NO: 1375281 - RNA, 20 nt, Neisseria meningitidis Z2491
uugaggucgcgaguucgaga

SEQ ID NO: 1375282 - RNA, 12 nt, Neisseria meningitidis Z2491
uugagcuucgcg

SEQ ID NO: 1375283 - RNA, 19 nt, Neisseria meningitidis Z2491
uugagcguucagacggcau

SEQ ID NO: 1375284 - RNA, 22 nt, Neisseria meningitidis Z2491
uugagcgcgucaaacagacgga

SEQ ID NO: 1375285 - RNA, 17 nt, Neisseria meningitidis Z2491
uugaaaacaucggguuu

SEQ ID NO: 1375286 - RNA, 13 nt, Neisseria meningitidis Z2491
uugaaaaugccgu

SEQ ID NO: 1375287 - RNA, 14 nt, Neisseria meningitidis Z2491
uuccgguucgacga

SEQ ID NO: 1375288 - RNA, 13 nt, Neisseria meningitidis Z2491
uuccugcggcauu

SEQ ID NO: 1375289 - RNA, 16 nt, Neisseria meningitidis Z2491
uucccgcaaaagcggg

SEQ ID NO: 1375290 - RNA, 16 nt, Neisseria meningitidis Z2491
uucccgcgaaagcgga

SEQ ID NO: 1375291 - RNA, 16 nt, Neisseria meningitidis Z2491
uucauaaguuucccga

SEQ ID NO: 1375292 - RNA, 19 nt, Neisseria meningitidis Z2491
uucgcgagaacgacgggau

SEQ ID NO: 1375293 - RNA, 14 nt, Neisseria meningitidis Z2491
uucgcugacgguau

SEQ ID NO: 1375294 - RNA, 19 nt, Neisseria meningitidis Z2491
uucgcaaugcugcggaugu

SEQ ID NO: 1375295 - RNA, 23 nt, Neisseria meningitidis Z2491
uucgacguuuuuacgcgugauuu

SEQ ID NO: 1375296 - RNA, 13 nt, Neisseria meningitidis Z2491
uuucagacggcau

SEQ ID NO: 1375297 - RNA, 15 nt, Neisseria meningitidis Z2491
uuucagacggcauuu

SEQ ID NO: 1375298 - RNA, 11 nt, Neisseria meningitidis Z2491
uuucagacggu

SEQ ID NO: 1375299 - RNA, 11 nt, Neisseria meningitidis Z2491
uuucagacggc

SEQ ID NO: 1375300 - RNA, 22 nt, Neisseria meningitidis Z2491
uuucagucugucgccgucggcu

SEQ ID NO: 1375301 - RNA, 18 nt, Neisseria meningitidis Z2491
uuucaggaauuugcggca

SEQ ID NO: 1375302 - RNA, 19 nt, Neisseria meningitidis Z2491
uuuccaaagugauuuccgc

SEQ ID NO: 1375303 - RNA, 20 nt, Neisseria meningitidis Z2491
aaucgaagaaagcauacggc

SEQ ID NO: 1375304 - RNA, 19 nt, Neisseria meningitidis Z2491
uuuagaaacaacugaaacc

SEQ ID NO: 1375305 - RNA, 14 nt, Neisseria meningitidis Z2491
uugggaaaugccgu

SEQ ID NO: 1375306 - RNA, 14 nt, Neisseria meningitidis Z2491
uuggacggcggauu

SEQ ID NO: 1375307 - RNA, 13 nt, Neisseria meningitidis Z2491
uuggcggcggcag

SEQ ID NO: 1375308 - RNA, 18 nt, Neisseria meningitidis Z2491
uugcgggaaugacggcag

SEQ ID NO: 1375309 - RNA, 17 nt, Neisseria meningitidis Z2491
uugcguucagacggcau

SEQ ID NO: 1375310 - RNA, 16 nt, Neisseria meningitidis Z2491
uugcuccugacggcaa

SEQ ID NO: 1375311 - RNA, 20 nt, Neisseria meningitidis Z2491
aauuucaugucaucgcggau

SEQ ID NO: 1375312 - RNA, 18 nt, Neisseria meningitidis Z2491
aauuuaaaccaguacggc

SEQ ID NO: 1375313 - RNA, 18 nt, Neisseria meningitidis Z2491
aauuuaaaucaguacggc

SEQ ID NO: 1375314 - RNA, 18 nt, Neisseria meningitidis Z2491
aauugaaaugccgucuga

SEQ ID NO: 1375315 - RNA, 20 nt, Neisseria meningitidis Z2491
aauucaucgcgcugccgucg

SEQ ID NO: 1375316 - RNA, 10 nt, Neisseria meningitidis Z2491
aaugccgucu

SEQ ID NO: 1375317 - RNA, 12 nt, Neisseria meningitidis Z2491
aaugccgucuga

SEQ ID NO: 1375318 - RNA, 14 nt, Neisseria meningitidis Z2491
aaugccgucugaua

SEQ ID NO: 1375319 - RNA, 15 nt, Neisseria meningitidis Z2491
aaucucaaaucccgu

SEQ ID NO: 1375320 - RNA, 19 nt, Neisseria meningitidis Z2491
aaucucggacuuucagaua

SEQ ID NO: 1375321 - RNA, 21 nt, Neisseria meningitidis Z2491
aaucugcugcaaaccgucugc

SEQ ID NO: 1375322 - RNA, 20 nt, Neisseria meningitidis Z2491
uuuugcgggaaugacggcag

SEQ ID NO: 1375323 - RNA, 19 nt, Neisseria meningitidis Z2491
uuuucaugguguuuccuaa

SEQ ID NO: 1375324 - RNA, 17 nt, Neisseria meningitidis Z2491
uuuucaaaaugcaaaac

SEQ ID NO: 1375325 - RNA, 14 nt, Neisseria meningitidis Z2491
ugcguugaguuuca

SEQ ID NO: 1375326 - RNA, 22 nt, Neisseria meningitidis Z2491
ugcguuucguguuauaauccgc

SEQ ID NO: 1375327 - RNA, 15 nt, Neisseria meningitidis Z2491
ugcguauaaaccgau

SEQ ID NO: 1375328 - RNA, 18 nt, Neisseria meningitidis Z2491
uggauagcgagacggcau

SEQ ID NO: 1375329 - RNA, 21 nt, Neisseria meningitidis Z2491
uggauuaaauuuaaaccagua

SEQ ID NO: 1375330 - RNA, 20 nt, Neisseria meningitidis Z2491
uggauuaacaaaaaccagua

SEQ ID NO: 1375331 - RNA, 13 nt, Neisseria meningitidis Z2491
uggcaggcaucua

SEQ ID NO: 1375332 - RNA, 22 nt, Neisseria meningitidis Z2491
ugccguaccggucagaaucgcc

SEQ ID NO: 1375333 - RNA, 20 nt, Neisseria meningitidis Z2491
ugccgcgcuuuauaguggau

SEQ ID NO: 1375334 - RNA, 18 nt, Neisseria meningitidis Z2491
ugcggacaaaucuggauu

SEQ ID NO: 1375335 - RNA, 16 nt, Neisseria meningitidis Z2491
ugcgcgggaaugacgg

SEQ ID NO: 1375336 - RNA, 18 nt, Neisseria meningitidis Z2491
ugcgcgggaaugacggau

SEQ ID NO: 1375337 - RNA, 15 nt, Neisseria meningitidis Z2491
ugcgcgcggacggau

SEQ ID NO: 1375338 - RNA, 19 nt, Neisseria meningitidis Z2491
ugcgcgaacagcgacaccc

SEQ ID NO: 1375339 - RNA, 15 nt, Neisseria meningitidis Z2491
ugguucagacggcau

SEQ ID NO: 1375340 - RNA, 12 nt, Neisseria meningitidis Z2491
ugguucggcuug

SEQ ID NO: 1375341 - RNA, 22 nt, Neisseria meningitidis Z2491
aaucacagucggugugccgcug

SEQ ID NO: 1375342 - RNA, 14 nt, Neisseria meningitidis Z2491
uguccgaaugccgc

SEQ ID NO: 1375343 - RNA, 14 nt, Neisseria meningitidis Z2491
uguccagugcggca

SEQ ID NO: 1375344 - RNA, 20 nt, Neisseria meningitidis Z2491
uguccauucggcuuaaaccu

SEQ ID NO: 1375345 - RNA, 20 nt, Neisseria meningitidis Z2491
ugggucagccccaugcguuc

SEQ ID NO: 1375346 - RNA, 14 nt, Neisseria meningitidis Z2491
ugggaaaugccguc

SEQ ID NO: 1375347 - RNA, 17 nt, Neisseria meningitidis Z2491
ugggaaaugccgucuga

SEQ ID NO: 1375348 - RNA, 21 nt, Neisseria meningitidis Z2491
uggcuuaaauuuaaaccagua

SEQ ID NO: 1375349 - RNA, 16 nt, Neisseria meningitidis Z2491
uggcugaugacggcag

SEQ ID NO: 1375350 - RNA, 11 nt, Neisseria meningitidis Z2491
aauaugccguc

SEQ ID NO: 1375351 - RNA, 13 nt, Neisseria meningitidis Z2491
aauaugccgucau

SEQ ID NO: 1375352 - RNA, 12 nt, Neisseria meningitidis Z2491
aauaugccgucu

SEQ ID NO: 1375353 - RNA, 12 nt, Neisseria meningitidis Z2491
uggcaucgcgca

SEQ ID NO: 1375354 - RNA, 20 nt, Neisseria meningitidis Z2491
uggcgagcgauucuucgaca

SEQ ID NO: 1375355 - RNA, 14 nt, Neisseria meningitidis Z2491
guucagacggcauu

SEQ ID NO: 1375356 - RNA, 15 nt, Neisseria meningitidis Z2491
guucagaaaauccgc

SEQ ID NO: 1375357 - RNA, 16 nt, Neisseria meningitidis Z2491
guguuggguucuagau

SEQ ID NO: 1375358 - RNA, 16 nt, Neisseria meningitidis Z2491
guuccgaaaucaucca

SEQ ID NO: 1375359 - RNA, 21 nt, Neisseria meningitidis Z2491
guuugagaaugaaaaugccgu

SEQ ID NO: 1375360 - RNA, 21 nt, Neisseria meningitidis Z2491
guuugauauacaaaaugccgu

SEQ ID NO: 1375361 - RNA, 21 nt, Neisseria meningitidis Z2491
guuugaaacauaaaaugccgu

SEQ ID NO: 1375362 - RNA, 20 nt, Neisseria meningitidis Z2491
guuuggaauggaaaugccgu

SEQ ID NO: 1375363 - RNA, 15 nt, Neisseria meningitidis Z2491
guuuggauaugccgu

SEQ ID NO: 1375364 - RNA, 13 nt, Neisseria meningitidis Z2491
guuuggaugccgu

SEQ ID NO: 1375365 - RNA, 13 nt, Neisseria meningitidis Z2491
guuuuucagacgg

SEQ ID NO: 1375366 - RNA, 16 nt, Neisseria meningitidis Z2491
guuuucagacggcauu

SEQ ID NO: 1375367 - RNA, 15 nt, Neisseria meningitidis Z2491
guuuuaccugcccga

SEQ ID NO: 1375368 - RNA, 14 nt, Neisseria meningitidis Z2491
guuuucaaauccgu

SEQ ID NO: 1375369 - RNA, 14 nt, Neisseria meningitidis Z2491
guugaguuucagcu

SEQ ID NO: 1375370 - RNA, 16 nt, Neisseria meningitidis Z2491
guugcaagaaugacgg

SEQ ID NO: 1375371 - RNA, 15 nt, Neisseria meningitidis Z2491
uaaucacaacggcgu

SEQ ID NO: 1375372 - RNA, 18 nt, Neisseria meningitidis Z2491
uaaggucuagauucccgc

SEQ ID NO: 1375373 - RNA, 19 nt, Neisseria meningitidis Z2491
uaaacccccgucauucccg

SEQ ID NO: 1375374 - RNA, 20 nt, Neisseria meningitidis Z2491
uaaacccccgucauucccgc

SEQ ID NO: 1375375 - RNA, 17 nt, Neisseria meningitidis Z2491
uccaagacaggcggaug

SEQ ID NO: 1375376 - RNA, 17 nt, Neisseria meningitidis Z2491
ucauucucgcgaaagcg

SEQ ID NO: 1375377 - RNA, 21 nt, Neisseria meningitidis Z2491
ucauacguuuugguugcgccg

SEQ ID NO: 1375378 - RNA, 20 nt, Neisseria meningitidis Z2491
uccagaacguaaaaucucaa

SEQ ID NO: 1375379 - RNA, 20 nt, Neisseria meningitidis Z2491
uccagaacguaaaaucugaa

SEQ ID NO: 1375380 - RNA, 14 nt, Neisseria meningitidis Z2491
uccagcaaugccgu

SEQ ID NO: 1375381 - RNA, 13 nt, Neisseria meningitidis Z2491
uccagauucccgc

SEQ ID NO: 1375382 - RNA, 19 nt, Neisseria meningitidis Z2491
ucaggaauuugcggcaaau

SEQ ID NO: 1375383 - RNA, 15 nt, Neisseria meningitidis Z2491
ucaccgcagccgcca

SEQ ID NO: 1375384 - RNA, 20 nt, Neisseria meningitidis Z2491
ucacuauaccaaacggcaua

SEQ ID NO: 1375385 - RNA, 13 nt, Neisseria meningitidis Z2491
uagggacgaaaau

SEQ ID NO: 1375386 - RNA, 19 nt, Neisseria meningitidis Z2491
uaucagacggacgagguua

SEQ ID NO: 1375387 - RNA, 18 nt, Neisseria meningitidis Z2491
ucaagcaaaaaaugccgu

SEQ ID NO: 1375388 - RNA, 21 nt, Neisseria meningitidis Z2491
ucaauaacgguugcacgguuu

SEQ ID NO: 1375389 - RNA, 19 nt, Neisseria meningitidis Z2491
ucaauaagucugcgaaaca

SEQ ID NO: 1375390 - RNA, 12 nt, Neisseria meningitidis Z2491
ucaaaugccguc

SEQ ID NO: 1375391 - RNA, 18 nt, Neisseria meningitidis Z2491
ucaacuuauugcggcuuu

SEQ ID NO: 1375392 - RNA, 20 nt, Neisseria meningitidis Z2491
uacgaaaaaaugccgucuga

SEQ ID NO: 1375393 - RNA, 13 nt, Neisseria meningitidis Z2491
uacggcggcauuc

SEQ ID NO: 1375394 - RNA, 13 nt, Neisseria meningitidis Z2491
uacggucgcaccg

SEQ ID NO: 1375395 - RNA, 22 nt, Neisseria meningitidis Z2491
uacgcggcugaaaaaaugccgu

SEQ ID NO: 1375396 - RNA, 19 nt, Neisseria meningitidis Z2491
uagcaaaauaaaaugccgu

SEQ ID NO: 1375397 - RNA, 17 nt, Neisseria meningitidis Z2491
aauaaaaugccgucuga

SEQ ID NO: 1375398 - RNA, 19 nt, Neisseria meningitidis Z2491
aauaaaaaaugccgucuga

SEQ ID NO: 1375399 - RNA, 18 nt, Neisseria meningitidis Z2491
ucggcagugauuucccgu

SEQ ID NO: 1375400 - RNA, 18 nt, Neisseria meningitidis Z2491
ucggaaaugacugaaacu

SEQ ID NO: 1375401 - RNA, 21 nt, Neisseria meningitidis Z2491
ucggaaaugaucaggcggauu

SEQ ID NO: 1375402 - RNA, 18 nt, Neisseria meningitidis Z2491
ucgccgaacgccaucacg

SEQ ID NO: 1375403 - RNA, 13 nt, Neisseria meningitidis Z2491
ucgaaaugccguc

SEQ ID NO: 1375404 - RNA, 20 nt, Neisseria meningitidis Z2491
ucgaugcgguugaucauuuc

SEQ ID NO: 1375405 - RNA, 22 nt, Neisseria meningitidis Z2491
ucgagcaggcagcguucgacga

SEQ ID NO: 1375406 - RNA, 18 nt, Neisseria meningitidis Z2491
uccgucaggcacgaagcc

SEQ ID NO: 1375407 - RNA, 14 nt, Neisseria meningitidis Z2491
uccgucauucccgc

SEQ ID NO: 1375408 - RNA, 14 nt, Neisseria meningitidis Z2491
uccguuauucccgc

SEQ ID NO: 1375409 - RNA, 20 nt, Neisseria meningitidis Z2491
uccuccucgccgucuuucag

SEQ ID NO: 1375410 - RNA, 16 nt, Neisseria meningitidis Z2491
uccgcuugccgaaagc

SEQ ID NO: 1375411 - RNA, 21 nt, Neisseria meningitidis Z2491
uccgcgccaaaucggacggau

SEQ ID NO: 1375412 - RNA, 23 nt, Neisseria meningitidis Z2491
uccgacaggcaaaugcugucuga

SEQ ID NO: 1375413 - RNA, 17 nt, Neisseria meningitidis Z2491
uccgauaaauucuugag

SEQ ID NO: 1375414 - RNA, 15 nt, Neisseria meningitidis Z2491
uccgauaaguuuccg

SEQ ID NO: 1375415 - RNA, 14 nt, Neisseria meningitidis Z2491
uccgccauucccgu

SEQ ID NO: 1375416 - RNA, 14 nt, Neisseria meningitidis Z2491
ucccgaugccgcaa

SEQ ID NO: 1375417 - RNA, 11 nt, Neisseria meningitidis Z2491
ucccaccguuu

SEQ ID NO: 1375418 - RNA, 14 nt, Neisseria meningitidis Z2491
ugcaacuuugcguu

SEQ ID NO: 1375419 - RNA, 14 nt, Neisseria meningitidis Z2491
ugcaaaccgucugc

SEQ ID NO: 1375420 - RNA, 16 nt, Neisseria meningitidis Z2491
ugcaaaauuuauccga

SEQ ID NO: 1375421 - RNA, 21 nt, Neisseria meningitidis Z2491
ugauagccgcccaaugccguc

SEQ ID NO: 1375422 - RNA, 16 nt, Neisseria meningitidis Z2491
ugagauugcggcauuu

SEQ ID NO: 1375423 - RNA, 22 nt, Neisseria meningitidis Z2491
ugcccucggauggggugcggca

SEQ ID NO: 1375424 - RNA, 17 nt, Neisseria meningitidis Z2491
ugccgauuucuucgcgg

SEQ ID NO: 1375425 - RNA, 20 nt, Neisseria meningitidis Z2491
ugccgccaauccugccuuca

SEQ ID NO: 1375426 - RNA, 15 nt, Neisseria meningitidis Z2491
ugccgcaaaugccgu

SEQ ID NO: 1375427 - RNA, 16 nt, Neisseria meningitidis Z2491
ucuaaaaauccaacgc

SEQ ID NO: 1375428 - RNA, 15 nt, Neisseria meningitidis Z2491
ucuaaagcuucagcu

SEQ ID NO: 1375429 - RNA, 13 nt, Neisseria meningitidis Z2491
ucuaaacgguauu

SEQ ID NO: 1375430 - RNA, 17 nt, Neisseria meningitidis Z2491
ucuaaauagcugaaacu

SEQ ID NO: 1375431 - RNA, 19 nt, Neisseria meningitidis Z2491
ucuagaacguggaaucuaa

SEQ ID NO: 1375432 - RNA, 13 nt, Neisseria meningitidis Z2491
ucuagauucccgu

SEQ ID NO: 1375433 - RNA, 22 nt, Neisseria meningitidis Z2491
ucguugugcggcaaaacgccuu

SEQ ID NO: 1375434 - RNA, 23 nt, Neisseria meningitidis Z2491
ucguguuugggguggucgaacaa

SEQ ID NO: 1375435 - RNA, 13 nt, Neisseria meningitidis Z2491
ucgugauucccga

SEQ ID NO: 1375436 - RNA, 15 nt, Neisseria meningitidis Z2491
ucguaaaaaugccgu

SEQ ID NO: 1375437 - RNA, 22 nt, Neisseria meningitidis Z2491
ucguaaaaaugccgucugaaaa

SEQ ID NO: 1375438 - RNA, 14 nt, Neisseria meningitidis Z2491
ucguccuccaccgu

SEQ ID NO: 1375439 - RNA, 16 nt, Neisseria meningitidis Z2491
aauacggcggcggcag

SEQ ID NO: 1375440 - RNA, 14 nt, Neisseria meningitidis Z2491
ucuuccugacggac

SEQ ID NO: 1375441 - RNA, 14 nt, Neisseria meningitidis Z2491
ucuuccugcggcau

SEQ ID NO: 1375442 - RNA, 16 nt, Neisseria meningitidis Z2491
ucuuccugcggcauuu

SEQ ID NO: 1375443 - RNA, 16 nt, Neisseria meningitidis Z2491
ugaaaauaacgggauu

SEQ ID NO: 1375444 - RNA, 18 nt, Neisseria meningitidis Z2491
ugaaaaaaugccgucuga

SEQ ID NO: 1375445 - RNA, 19 nt, Neisseria meningitidis Z2491
ugaaguucuagauucccgu

SEQ ID NO: 1375446 - RNA, 16 nt, Neisseria meningitidis Z2491
ugaagccuucagacgg

SEQ ID NO: 1375447 - RNA, 20 nt, Neisseria meningitidis Z2491
ugaagccuucagacggcauu

SEQ ID NO: 1375448 - RNA, 22 nt, Neisseria meningitidis Z2491
ugaagcccuuucagacggcauu

SEQ ID NO: 1375449 - RNA, 23 nt, Neisseria meningitidis Z2491
ugaagcaggcguuuuucagacgg

SEQ ID NO: 1375450 - RNA, 20 nt, Neisseria meningitidis Z2491
ugaacucaggcuucagacgg

SEQ ID NO: 1375451 - RNA, 23 nt, Neisseria meningitidis Z2491
ugaacucaggcuucagacggcau

SEQ ID NO: 1375452 - RNA, 19 nt, Neisseria meningitidis Z2491
ugaaugucuagauucccgc

SEQ ID NO: 1375453 - RNA, 21 nt, Neisseria meningitidis Z2491
ugaauuaaauuuaaaccagua

SEQ ID NO: 1375454 - RNA, 17 nt, Neisseria meningitidis Z2491
ugaaucgucauucccgc

SEQ ID NO: 1375455 - RNA, 23 nt, Neisseria meningitidis Z2491
agcguguuuguuucagacggcau

SEQ ID NO: 1375456 - RNA, 16 nt, Neisseria meningitidis Z2491
agcggaaaucguacca

SEQ ID NO: 1375457 - RNA, 18 nt, Neisseria meningitidis Z2491
agcggaauuuacggugca

SEQ ID NO: 1375458 - RNA, 21 nt, Neisseria meningitidis Z2491
agcuuccaacucggcaaacgc

SEQ ID NO: 1375459 - RNA, 20 nt, Neisseria meningitidis Z2491
aggaaucggguuucagacgg

SEQ ID NO: 1375460 - RNA, 17 nt, Neisseria meningitidis Z2491
aggaaugcccgaaccgu

SEQ ID NO: 1375461 - RNA, 14 nt, Neisseria meningitidis Z2491
aggaaaugccgucu

SEQ ID NO: 1375462 - RNA, 17 nt, Neisseria meningitidis Z2491
aaacggcggcagccuga

SEQ ID NO: 1375463 - RNA, 19 nt, Neisseria meningitidis Z2491
aaacggguucggacggcau

SEQ ID NO: 1375464 - RNA, 20 nt, Neisseria meningitidis Z2491
aaacggguucggacggcauu

SEQ ID NO: 1375465 - RNA, 20 nt, Neisseria meningitidis Z2491
aaacggguucggacggcguu

SEQ ID NO: 1375466 - RNA, 20 nt, Neisseria meningitidis Z2491
aaacggguuucagacggcau

SEQ ID NO: 1375467 - RNA, 20 nt, Neisseria meningitidis Z2491
aggaguuugaugccgucuga

SEQ ID NO: 1375468 - RNA, 16 nt, Neisseria meningitidis Z2491
aggauaugaucgacgg

SEQ ID NO: 1375469 - RNA, 19 nt, Neisseria meningitidis Z2491
aggcaaaugcugucugaaa

SEQ ID NO: 1375470 - RNA, 20 nt, Neisseria meningitidis Z2491
aggcaaaaaaagaugccguc

SEQ ID NO: 1375471 - RNA, 18 nt, Neisseria meningitidis Z2491
aggcaauccacgcaauca

SEQ ID NO: 1375472 - RNA, 18 nt, Neisseria meningitidis Z2491
agauucggauaccugcaa

SEQ ID NO: 1375473 - RNA, 15 nt, Neisseria meningitidis Z2491
agauuuguggcggau

SEQ ID NO: 1375474 - RNA, 15 nt, Neisseria meningitidis Z2491
agcaguuuuucaaau

SEQ ID NO: 1375475 - RNA, 18 nt, Neisseria meningitidis Z2491
agccaaaaaaaagccguc

SEQ ID NO: 1375476 - RNA, 20 nt, Neisseria meningitidis Z2491
aaacgcauucagacggcauc

SEQ ID NO: 1375477 - RNA, 17 nt, Neisseria meningitidis Z2491
agcccuuucagacggca

SEQ ID NO: 1375478 - RNA, 13 nt, Neisseria meningitidis Z2491
agccuucaaacgc

SEQ ID NO: 1375479 - RNA, 16 nt, Neisseria meningitidis Z2491
agccuucagacggcau

SEQ ID NO: 1375480 - RNA, 13 nt, Neisseria meningitidis Z2491
agcgagacggcau

SEQ ID NO: 1375481 - RNA, 13 nt, Neisseria meningitidis Z2491
auccauugccgau

SEQ ID NO: 1375482 - RNA, 20 nt, Neisseria meningitidis Z2491
auccaguuucuugaguuuca

SEQ ID NO: 1375483 - RNA, 21 nt, Neisseria meningitidis Z2491
auccagguucguugaguuucg

SEQ ID NO: 1375484 - RNA, 18 nt, Neisseria meningitidis Z2491
aucccggacuuucagaua

SEQ ID NO: 1375485 - RNA, 17 nt, Neisseria meningitidis Z2491
auccagcaaacgguauu

SEQ ID NO: 1375486 - RNA, 14 nt, Neisseria meningitidis Z2491
aucgaaaugccguc

SEQ ID NO: 1375487 - RNA, 17 nt, Neisseria meningitidis Z2491
auccucgaaaugccguc

SEQ ID NO: 1375488 - RNA, 20 nt, Neisseria meningitidis Z2491
auccguuuggaugccgucug

SEQ ID NO: 1375489 - RNA, 18 nt, Neisseria meningitidis Z2491
auccgaccagagcggcau

SEQ ID NO: 1375490 - RNA, 19 nt, Neisseria meningitidis Z2491
auccgaccagagcggcauu

SEQ ID NO: 1375491 - RNA, 18 nt, Neisseria meningitidis Z2491
auccgauaaguuuccgug

SEQ ID NO: 1375492 - RNA, 22 nt, Neisseria meningitidis Z2491
auccgcagacguucggcaaaau

SEQ ID NO: 1375493 - RNA, 15 nt, Neisseria meningitidis Z2491
aucaucacuccgucu

SEQ ID NO: 1375494 - RNA, 15 nt, Neisseria meningitidis Z2491
aucaaggaugccguu

SEQ ID NO: 1375495 - RNA, 14 nt, Neisseria meningitidis Z2491
aucaaaaugccguc

SEQ ID NO: 1375496 - RNA, 18 nt, Neisseria meningitidis Z2491
auauuguucagacggcau

SEQ ID NO: 1375497 - RNA, 19 nt, Neisseria meningitidis Z2491
auauugcuccugacggcaa

SEQ ID NO: 1375498 - RNA, 18 nt, Neisseria meningitidis Z2491
auaugccgucauucccgc

SEQ ID NO: 1375499 - RNA, 13 nt, Neisseria meningitidis Z2491
auaugccgucuga

SEQ ID NO: 1375500 - RNA, 19 nt, Neisseria meningitidis Z2491
auauccgaccagagcggca

SEQ ID NO: 1375501 - RNA, 12 nt, Neisseria meningitidis Z2491
auaucagacgga

SEQ ID NO: 1375502 - RNA, 16 nt, Neisseria meningitidis Z2491
auacccaaugcgccga

SEQ ID NO: 1375503 - RNA, 17 nt, Neisseria meningitidis Z2491
auaaugcccauucccac

SEQ ID NO: 1375504 - RNA, 17 nt, Neisseria meningitidis Z2491
auaauguucaaugaacg

SEQ ID NO: 1375505 - RNA, 17 nt, Neisseria meningitidis Z2491
auaaugaaaugccgucu

SEQ ID NO: 1375506 - RNA, 23 nt, Neisseria meningitidis Z2491
auaaucuuugaauauugccgucg

SEQ ID NO: 1375507 - RNA, 13 nt, Neisseria meningitidis Z2491
auaaaugccgucu

SEQ ID NO: 1375508 - RNA, 17 nt, Neisseria meningitidis Z2491
auaaauuuuugccgugu

SEQ ID NO: 1375509 - RNA, 22 nt, Neisseria meningitidis Z2491
auaaaagacccgucauucccgc

SEQ ID NO: 1375510 - RNA, 20 nt, Neisseria meningitidis Z2491
auaaaacgguuucuuagauu

SEQ ID NO: 1375511 - RNA, 21 nt, Neisseria meningitidis Z2491
auaaacauuuuugcguauucg

SEQ ID NO: 1375512 - RNA, 16 nt, Neisseria meningitidis Z2491
auaaaauaugccgucu

SEQ ID NO: 1375513 - RNA, 14 nt, Neisseria meningitidis Z2491
aguguuucagacgg

SEQ ID NO: 1375514 - RNA, 15 nt, Neisseria meningitidis Z2491
aguguuucagacggc

SEQ ID NO: 1375515 - RNA, 16 nt, Neisseria meningitidis Z2491
aguguuucagacggcc

SEQ ID NO: 1375516 - RNA, 20 nt, Neisseria meningitidis Z2491
aguccugccugcgcgagaau

SEQ ID NO: 1375517 - RNA, 21 nt, Neisseria meningitidis Z2491
agguucagcaggaaggcggca

SEQ ID NO: 1375518 - RNA, 20 nt, Neisseria meningitidis Z2491
agguuagcugaagcuuuaga

SEQ ID NO: 1375519 - RNA, 19 nt, Neisseria meningitidis Z2491
aguacaaaaugccgucuga

SEQ ID NO: 1375520 - RNA, 20 nt, Neisseria meningitidis Z2491
aguacaaaaugccgucugaa

SEQ ID NO: 1375521 - RNA, 22 nt, Neisseria meningitidis Z2491
aggucucagacuauuucggcac

SEQ ID NO: 1375522 - RNA, 12 nt, Neisseria meningitidis Z2491
aggcugccguca

SEQ ID NO: 1375523 - RNA, 16 nt, Neisseria meningitidis Z2491
aggcuucagacggcau

SEQ ID NO: 1375524 - RNA, 17 nt, Neisseria meningitidis Z2491
aggcuuucagacggcau

SEQ ID NO: 1375525 - RNA, 16 nt, Neisseria meningitidis Z2491
aggcuuucagacggcc

SEQ ID NO: 1375526 - RNA, 17 nt, Neisseria meningitidis Z2491
aggcuuuuucagacggc

SEQ ID NO: 1375527 - RNA, 21 nt, Neisseria meningitidis Z2491
agggaaagcccgucagcacgg

SEQ ID NO: 1375528 - RNA, 18 nt, Neisseria meningitidis Z2491
agggguuucagacggcau

SEQ ID NO: 1375529 - RNA, 20 nt, Neisseria meningitidis Z2491
auucccacuuucgugggaau

SEQ ID NO: 1375530 - RNA, 20 nt, Neisseria meningitidis Z2491
auucccacggaagugggaau

SEQ ID NO: 1375531 - RNA, 20 nt, Neisseria meningitidis Z2491
auucccacuuccgugggaau

SEQ ID NO: 1375532 - RNA, 20 nt, Neisseria meningitidis Z2491
auucccacgaaagugggaau

SEQ ID NO: 1375533 - RNA, 15 nt, Neisseria meningitidis Z2491
auucccacgaaccca

SEQ ID NO: 1375534 - RNA, 20 nt, Neisseria meningitidis Z2491
auucccacgcaggcgggaau

SEQ ID NO: 1375535 - RNA, 22 nt, Neisseria meningitidis Z2491
auuccaucaacaaaaugccguc

SEQ ID NO: 1375536 - RNA, 20 nt, Neisseria meningitidis Z2491
auuccccggcaucacggcuu

SEQ ID NO: 1375537 - RNA, 20 nt, Neisseria meningitidis Z2491
auucccgccuacgcgggaau

SEQ ID NO: 1375538 - RNA, 20 nt, Neisseria meningitidis Z2491
auucccgccuucgcgggaau

SEQ ID NO: 1375539 - RNA, 20 nt, Neisseria meningitidis Z2491
auucccgcaaaagcgggaau

SEQ ID NO: 1375540 - RNA, 20 nt, Neisseria meningitidis Z2491
auucccgcaaaagcgggagu

SEQ ID NO: 1375541 - RNA, 21 nt, Neisseria meningitidis Z2491
aaacucaaaaaaacuagauuc

SEQ ID NO: 1375542 - RNA, 20 nt, Neisseria meningitidis Z2491
aaacucaaaaaaccggauuc

SEQ ID NO: 1375543 - RNA, 20 nt, Neisseria meningitidis Z2491
aaacucaaaaaacuggauuc

SEQ ID NO: 1375544 - RNA, 14 nt, Neisseria meningitidis Z2491
auucagacggcauc

SEQ ID NO: 1375545 - RNA, 14 nt, Neisseria meningitidis Z2491
auucaggcuuuccg

SEQ ID NO: 1375546 - RNA, 20 nt, Neisseria meningitidis Z2491
auucccgcgaaagcggaaau

SEQ ID NO: 1375547 - RNA, 20 nt, Neisseria meningitidis Z2491
auucccgcgaaagugggaau

SEQ ID NO: 1375548 - RNA, 20 nt, Neisseria meningitidis Z2491
auucccgcucaggcgggaau

SEQ ID NO: 1375549 - RNA, 18 nt, Neisseria meningitidis Z2491
auucccgcuuucacggga

SEQ ID NO: 1375550 - RNA, 20 nt, Neisseria meningitidis Z2491
auucccgcuuucacgggaau

SEQ ID NO: 1375551 - RNA, 20 nt, Neisseria meningitidis Z2491
auucccgcuuucgcggggau

SEQ ID NO: 1375552 - RNA, 20 nt, Neisseria meningitidis Z2491
auucccgcuuuugcgggaau

SEQ ID NO: 1375553 - RNA, 23 nt, Neisseria meningitidis Z2491
auuccgcacugcggguuuugccg

SEQ ID NO: 1375554 - RNA, 20 nt, Neisseria meningitidis Z2491
auucccguuuucacgggaau

SEQ ID NO: 1375555 - RNA, 20 nt, Neisseria meningitidis Z2491
auucccguuuuuacgggaau

SEQ ID NO: 1375556 - RNA, 20 nt, Neisseria meningitidis Z2491
auucccgugaaaacgggaau

SEQ ID NO: 1375557 - RNA, 20 nt, Neisseria meningitidis Z2491
auucccgugcaggcgggaau

SEQ ID NO: 1375558 - RNA, 14 nt, Neisseria meningitidis Z2491
auucgacggcggaa

SEQ ID NO: 1375559 - RNA, 19 nt, Neisseria meningitidis Z2491
auuccgcgcaggcggaaau

SEQ ID NO: 1375560 - RNA, 16 nt, Neisseria meningitidis Z2491
auuuccgccgucauuc

SEQ ID NO: 1375561 - RNA, 18 nt, Neisseria meningitidis Z2491
auuuauacccucucaaac

SEQ ID NO: 1375562 - RNA, 14 nt, Neisseria meningitidis Z2491
auuuaauccacuau

SEQ ID NO: 1375563 - RNA, 14 nt, Neisseria meningitidis Z2491
auucgugggcgcau

SEQ ID NO: 1375564 - RNA, 16 nt, Neisseria meningitidis Z2491
auugcguucagacggc

SEQ ID NO: 1375565 - RNA, 16 nt, Neisseria meningitidis Z2491
auuuugucauucccgc

SEQ ID NO: 1375566 - RNA, 18 nt, Neisseria meningitidis Z2491
caaaaaaaagccguccga

SEQ ID NO: 1375567 - RNA, 13 nt, Neisseria meningitidis Z2491
auuuuuuucauac

SEQ ID NO: 1375568 - RNA, 21 nt, Neisseria meningitidis Z2491
caaaaaaugccgucugaaacc

SEQ ID NO: 1375569 - RNA, 18 nt, Neisseria meningitidis Z2491
caaaaaaccggauucccg

SEQ ID NO: 1375570 - RNA, 19 nt, Neisseria meningitidis Z2491
caaaaaaccguauucccgc

SEQ ID NO: 1375571 - RNA, 16 nt, Neisseria meningitidis Z2491
caaaaauaccgucuga

SEQ ID NO: 1375572 - RNA, 20 nt, Neisseria meningitidis Z2491
caaaaauaccgucugaaacc

SEQ ID NO: 1375573 - RNA, 12 nt, Neisseria meningitidis Z2491
caaaaaucagga

SEQ ID NO: 1375574 - RNA, 22 nt, Neisseria meningitidis Z2491
caaaaccacuuucaucgcuuga

SEQ ID NO: 1375575 - RNA, 16 nt, Neisseria meningitidis Z2491
caaaacuuuucugauu

SEQ ID NO: 1375576 - RNA, 14 nt, Neisseria meningitidis Z2491
caaaagccguguga

SEQ ID NO: 1375577 - RNA, 19 nt, Neisseria meningitidis Z2491
auuugaaguuucuccacau

SEQ ID NO: 1375578 - RNA, 20 nt, Neisseria meningitidis Z2491
auuucugcgaaagcgggaau

SEQ ID NO: 1375579 - RNA, 20 nt, Neisseria meningitidis Z2491
auuucugcgcaggcgggaau

SEQ ID NO: 1375580 - RNA, 22 nt, Neisseria meningitidis Z2491
auuucuccgccagccuuucaac

SEQ ID NO: 1375581 - RNA, 23 nt, Neisseria meningitidis Z2491
auuucuccgucgggauucagaug

SEQ ID NO: 1375582 - RNA, 21 nt, Neisseria meningitidis Z2491
auuuggguuucagacggcauu

SEQ ID NO: 1375583 - RNA, 18 nt, Neisseria meningitidis Z2491
auuugcacacguuugccg

SEQ ID NO: 1375584 - RNA, 18 nt, Neisseria meningitidis Z2491
caaauugaaaugccgucu

SEQ ID NO: 1375585 - RNA, 19 nt, Neisseria meningitidis Z2491
caaaggccuggauucccgc

SEQ ID NO: 1375586 - RNA, 18 nt, Neisseria meningitidis Z2491
caaaucccgucauucccg

SEQ ID NO: 1375587 - RNA, 19 nt, Neisseria meningitidis Z2491
caaaucccgucauucccgc

SEQ ID NO: 1375588 - RNA, 17 nt, Neisseria meningitidis Z2491
caaauaguacggcaagg

SEQ ID NO: 1375589 - RNA, 21 nt, Neisseria meningitidis Z2491
caaacgccgcaaaccuuccgc

SEQ ID NO: 1375590 - RNA, 16 nt, Neisseria meningitidis Z2491
caaacuagauucccgc

SEQ ID NO: 1375591 - RNA, 20 nt, Neisseria meningitidis Z2491
caaacccucggcauucccgc

SEQ ID NO: 1375592 - RNA, 20 nt, Neisseria meningitidis Z2491
caaaccggcauucugcacgc

SEQ ID NO: 1375593 - RNA, 17 nt, Neisseria meningitidis Z2491
caaaccgccauucccgc

SEQ ID NO: 1375594 - RNA, 17 nt, Neisseria meningitidis Z2491
caaaccgucauucccgc

SEQ ID NO: 1375595 - RNA, 22 nt, Neisseria meningitidis Z2491
caaacaucugccguaauaggca

SEQ ID NO: 1375596 - RNA, 21 nt, Neisseria meningitidis Z2491
caaacagacggaauaggacaa

SEQ ID NO: 1375597 - RNA, 23 nt, Neisseria meningitidis Z2491
caaaaucagaaaccuaaaauccg

SEQ ID NO: 1375598 - RNA, 14 nt, Neisseria meningitidis Z2491
caaaaucagcacaa

SEQ ID NO: 1375599 - RNA, 15 nt, Neisseria meningitidis Z2491
caaaaggccgucuga

SEQ ID NO: 1375600 - RNA, 15 nt, Neisseria meningitidis Z2491
caaaauguucagacg

SEQ ID NO: 1375601 - RNA, 17 nt, Neisseria meningitidis Z2491
caaaaugccgccgucga

SEQ ID NO: 1375602 - RNA, 20 nt, Neisseria meningitidis Z2491
caaaaugccgucugaaaacc

SEQ ID NO: 1375603 - RNA, 20 nt, Neisseria meningitidis Z2491
augacaaaauuaaaguuuca

SEQ ID NO: 1375604 - RNA, 16 nt, Neisseria meningitidis Z2491
augaaaguuugccgac

SEQ ID NO: 1375605 - RNA, 15 nt, Neisseria meningitidis Z2491
augaaaaaugccguc

SEQ ID NO: 1375606 - RNA, 20 nt, Neisseria meningitidis Z2491
augacgggauuagaguuuca

SEQ ID NO: 1375607 - RNA, 17 nt, Neisseria meningitidis Z2491
aucguaaaaaugccguc

SEQ ID NO: 1375608 - RNA, 18 nt, Neisseria meningitidis Z2491
aucguaaaaaugccgucu

SEQ ID NO: 1375609 - RNA, 14 nt, Neisseria meningitidis Z2491
aucuggauucccgc

SEQ ID NO: 1375610 - RNA, 18 nt, Neisseria meningitidis Z2491
augucaaaauaugccguc

SEQ ID NO: 1375611 - RNA, 19 nt, Neisseria meningitidis Z2491
augggcuucagacggcauc

SEQ ID NO: 1375612 - RNA, 17 nt, Neisseria meningitidis Z2491
augccgccgcaacugcc

SEQ ID NO: 1375613 - RNA, 15 nt, Neisseria meningitidis Z2491
augcgaaaugccguc

SEQ ID NO: 1375614 - RNA, 22 nt, Neisseria meningitidis Z2491
caaggucguauuucgcuucgga

SEQ ID NO: 1375615 - RNA, 12 nt, Neisseria meningitidis Z2491
caagcgaugccg

SEQ ID NO: 1375616 - RNA, 22 nt, Neisseria meningitidis Z2491
caacuuuuccgcgucauucccg

SEQ ID NO: 1375617 - RNA, 23 nt, Neisseria meningitidis Z2491
caacuuuuccgcgucauucccgc

SEQ ID NO: 1375618 - RNA, 15 nt, Neisseria meningitidis Z2491
caagcauaucgggca

SEQ ID NO: 1375619 - RNA, 21 nt, Neisseria meningitidis Z2491
caauuucaaaucccgucauuc

SEQ ID NO: 1375620 - RNA, 20 nt, Neisseria meningitidis Z2491
caauacaacaaaaugccgcc

SEQ ID NO: 1375621 - RNA, 17 nt, Neisseria meningitidis Z2491
caauacggcggcggcag

SEQ ID NO: 1375622 - RNA, 11 nt, Neisseria meningitidis Z2491
caaugccgucu

SEQ ID NO: 1375623 - RNA, 17 nt, Neisseria meningitidis Z2491
cacaucguucaaaccgu

SEQ ID NO: 1375624 - RNA, 20 nt, Neisseria meningitidis Z2491
cacgccgacuucgauugcca

SEQ ID NO: 1375625 - RNA, 14 nt, Neisseria meningitidis Z2491
caccgccgccguaa

SEQ ID NO: 1375626 - RNA, 22 nt, Neisseria meningitidis Z2491
cagauagucgccgagcagauug

SEQ ID NO: 1375627 - RNA, 19 nt, Neisseria meningitidis Z2491
cagaggcggaaucgaaccg

SEQ ID NO: 1375628 - RNA, 22 nt, Neisseria meningitidis Z2491
cagacaguacaaauaguacaga

SEQ ID NO: 1375629 - RNA, 13 nt, Neisseria meningitidis Z2491
aaagaugccgucu

SEQ ID NO: 1375630 - RNA, 15 nt, Neisseria meningitidis Z2491
aaagaugccgucuga

SEQ ID NO: 1375631 - RNA, 22 nt, Neisseria meningitidis Z2491
cagaacggcggguucggcaaug

SEQ ID NO: 1375632 - RNA, 23 nt, Neisseria meningitidis Z2491
cagcauuaauauacuuggcaaaa

SEQ ID NO: 1375633 - RNA, 15 nt, Neisseria meningitidis Z2491
cagcaucgcagauuc

SEQ ID NO: 1375634 - RNA, 21 nt, Neisseria meningitidis Z2491
cagcaagacuuuuucgcgcac

SEQ ID NO: 1375635 - RNA, 21 nt, Neisseria meningitidis Z2491
cauaugguguugaugccgucc

SEQ ID NO: 1375636 - RNA, 20 nt, Neisseria meningitidis Z2491
caucgcgguccaaaacggcg

SEQ ID NO: 1375637 - RNA, 19 nt, Neisseria meningitidis Z2491
caggcacgcgcugcggcau

SEQ ID NO: 1375638 - RNA, 22 nt, Neisseria meningitidis Z2491
caggcgggaauccagacauuca

SEQ ID NO: 1375639 - RNA, 22 nt, Neisseria meningitidis Z2491
caggcgggaaucuagacauuca

SEQ ID NO: 1375640 - RNA, 18 nt, Neisseria meningitidis Z2491
cagggcaaguuugccgcc

SEQ ID NO: 1375641 - RNA, 18 nt, Neisseria meningitidis Z2491
caggcuucagacggcauu

SEQ ID NO: 1375642 - RNA, 15 nt, Neisseria meningitidis Z2491
caggcggcggcauau

SEQ ID NO: 1375643 - RNA, 12 nt, Neisseria meningitidis Z2491
cagucauucccg

SEQ ID NO: 1375644 - RNA, 14 nt, Neisseria meningitidis Z2491
cagucccaucccgc

SEQ ID NO: 1375645 - RNA, 14 nt, Neisseria meningitidis Z2491
caggucgacggcaa

SEQ ID NO: 1375646 - RNA, 21 nt, Neisseria meningitidis Z2491
cccguuccacaauauccgacc

SEQ ID NO: 1375647 - RNA, 20 nt, Neisseria meningitidis Z2491
cccguuuuuacgggaaugac

SEQ ID NO: 1375648 - RNA, 20 nt, Neisseria meningitidis Z2491
cccguuuucacgggaaugac

SEQ ID NO: 1375649 - RNA, 22 nt, Neisseria meningitidis Z2491
ccgacagaccuagauucccgcc

SEQ ID NO: 1375650 - RNA, 20 nt, Neisseria meningitidis Z2491
ccgacagcagcuuuugcgcc

SEQ ID NO: 1375651 - RNA, 21 nt, Neisseria meningitidis Z2491
ccgacagccuacuugcccgcc

SEQ ID NO: 1375652 - RNA, 22 nt, Neisseria meningitidis Z2491
ccgacacaaugaaaguuugccg

SEQ ID NO: 1375653 - RNA, 16 nt, Neisseria meningitidis Z2491
ccgaccagagcggcau

SEQ ID NO: 1375654 - RNA, 18 nt, Neisseria meningitidis Z2491
ccgacggggcuggauucc

SEQ ID NO: 1375655 - RNA, 20 nt, Neisseria meningitidis Z2491
cccauaugguguugaugccg

SEQ ID NO: 1375656 - RNA, 13 nt, Neisseria meningitidis Z2491
cccauuacggcaa

SEQ ID NO: 1375657 - RNA, 17 nt, Neisseria meningitidis Z2491
ccaguacgguguugccu

SEQ ID NO: 1375658 - RNA, 16 nt, Neisseria meningitidis Z2491
cccgacaauaccguaa

SEQ ID NO: 1375659 - RNA, 20 nt, Neisseria meningitidis Z2491
cccgcuuucgcgggaaugac

SEQ ID NO: 1375660 - RNA, 20 nt, Neisseria meningitidis Z2491
cccgcuuuugcgggaaugac

SEQ ID NO: 1375661 - RNA, 12 nt, Neisseria meningitidis Z2491
aaaucaggacaa

SEQ ID NO: 1375662 - RNA, 18 nt, Neisseria meningitidis Z2491
aaauccgugcgccguccg

SEQ ID NO: 1375663 - RNA, 19 nt, Neisseria meningitidis Z2491
aaagucuuucagacggcau

SEQ ID NO: 1375664 - RNA, 16 nt, Neisseria meningitidis Z2491
ccaccugaacggcaca

SEQ ID NO: 1375665 - RNA, 13 nt, Neisseria meningitidis Z2491
aaaggccgucuga

SEQ ID NO: 1375666 - RNA, 17 nt, Neisseria meningitidis Z2491
aaaggucuagauucccg

SEQ ID NO: 1375667 - RNA, 17 nt, Neisseria meningitidis Z2491
aaaggcuucagacggca

SEQ ID NO: 1375668 - RNA, 18 nt, Neisseria meningitidis Z2491
aaaggcuucagacggcau

SEQ ID NO: 1375669 - RNA, 19 nt, Neisseria meningitidis Z2491
aaaggcuucagacggcauu

SEQ ID NO: 1375670 - RNA, 21 nt, Neisseria meningitidis Z2491
aaaggcuuuuucagacggcau

SEQ ID NO: 1375671 - RNA, 11 nt, Neisseria meningitidis Z2491
ccagauuccca

SEQ ID NO: 1375672 - RNA, 22 nt, Neisseria meningitidis Z2491
ccagaccuucgggcagcggcaa

SEQ ID NO: 1375673 - RNA, 23 nt, Neisseria meningitidis Z2491
aaaggcagcaaaaaugccgucug

SEQ ID NO: 1375674 - RNA, 19 nt, Neisseria meningitidis Z2491
ccaaaggucuggauuccca

SEQ ID NO: 1375675 - RNA, 18 nt, Neisseria meningitidis Z2491
ccaaaggcagugccgcca

SEQ ID NO: 1375676 - RNA, 17 nt, Neisseria meningitidis Z2491
ccaaaggccuggauucc

SEQ ID NO: 1375677 - RNA, 18 nt, Neisseria meningitidis Z2491
ccaaaggccuggauuccc

SEQ ID NO: 1375678 - RNA, 21 nt, Neisseria meningitidis Z2491
ccaaccaagaagcggcggcau

SEQ ID NO: 1375679 - RNA, 22 nt, Neisseria meningitidis Z2491
ccaaaucggcuuucagacggca

SEQ ID NO: 1375680 - RNA, 17 nt, Neisseria meningitidis Z2491
ccaaaucgucauucccg

SEQ ID NO: 1375681 - RNA, 12 nt, Neisseria meningitidis Z2491
ccaaauccgcca

SEQ ID NO: 1375682 - RNA, 13 nt, Neisseria meningitidis Z2491
ccaaugccgucug

SEQ ID NO: 1375683 - RNA, 18 nt, Neisseria meningitidis Z2491
aaagcgggaaucuagaau

SEQ ID NO: 1375684 - RNA, 13 nt, Neisseria meningitidis Z2491
cgauuaauccgcu

SEQ ID NO: 1375685 - RNA, 14 nt, Neisseria meningitidis Z2491
cgauuaauccgcuu

SEQ ID NO: 1375686 - RNA, 16 nt, Neisseria meningitidis Z2491
cgauucuucgacauag

SEQ ID NO: 1375687 - RNA, 16 nt, Neisseria meningitidis Z2491
cgcaaaccuuccgccg

SEQ ID NO: 1375688 - RNA, 17 nt, Neisseria meningitidis Z2491
cgauuuugugccguucc

SEQ ID NO: 1375689 - RNA, 16 nt, Neisseria meningitidis Z2491
cgauuggauucagacg

SEQ ID NO: 1375690 - RNA, 18 nt, Neisseria meningitidis Z2491
cgauguggguaaacggca

SEQ ID NO: 1375691 - RNA, 14 nt, Neisseria meningitidis Z2491
cgauauuacgaaca

SEQ ID NO: 1375692 - RNA, 22 nt, Neisseria meningitidis Z2491
cgaugccgcaaccaacgaaaca

SEQ ID NO: 1375693 - RNA, 16 nt, Neisseria meningitidis Z2491
cgcacuggauucccgc

SEQ ID NO: 1375694 - RNA, 19 nt, Neisseria meningitidis Z2491
cgccacggcuuucgcgccg

SEQ ID NO: 1375695 - RNA, 17 nt, Neisseria meningitidis Z2491
cgccauccagcaaacgg

SEQ ID NO: 1375696 - RNA, 20 nt, Neisseria meningitidis Z2491
cgccaucaacauuugcgcag

SEQ ID NO: 1375697 - RNA, 14 nt, Neisseria meningitidis Z2491
cgccauuuccaaac

SEQ ID NO: 1375698 - RNA, 16 nt, Neisseria meningitidis Z2491
cgaagauauagauuuc

SEQ ID NO: 1375699 - RNA, 18 nt, Neisseria meningitidis Z2491
cgaauccgacacggcuua

SEQ ID NO: 1375700 - RNA, 19 nt, Neisseria meningitidis Z2491
cgaauugaaucaugccgcu

SEQ ID NO: 1375701 - RNA, 20 nt, Neisseria meningitidis Z2491
cgacaaggcuggauucccgc

SEQ ID NO: 1375702 - RNA, 14 nt, Neisseria meningitidis Z2491
aacaaaaugccguc

SEQ ID NO: 1375703 - RNA, 17 nt, Neisseria meningitidis Z2491
aacaaaaugccgucuga

SEQ ID NO: 1375704 - RNA, 18 nt, Neisseria meningitidis Z2491
cgagauaacugccgauuu

SEQ ID NO: 1375705 - RNA, 20 nt, Neisseria meningitidis Z2491
cgagauaacugccgauuucu

SEQ ID NO: 1375706 - RNA, 16 nt, Neisseria meningitidis Z2491
cgagccaauagccgcc

SEQ ID NO: 1375707 - RNA, 16 nt, Neisseria meningitidis Z2491
ccgugaugccccaaua

SEQ ID NO: 1375708 - RNA, 14 nt, Neisseria meningitidis Z2491
ccgucugaaaccgg

SEQ ID NO: 1375709 - RNA, 14 nt, Neisseria meningitidis Z2491
ccgucugaaaccgu

SEQ ID NO: 1375710 - RNA, 17 nt, Neisseria meningitidis Z2491
ccgucugaaacgccaaa

SEQ ID NO: 1375711 - RNA, 19 nt, Neisseria meningitidis Z2491
ccgucugaaacgccaaacg

SEQ ID NO: 1375712 - RNA, 17 nt, Neisseria meningitidis Z2491
ccgucugaaacggcauc

SEQ ID NO: 1375713 - RNA, 19 nt, Neisseria meningitidis Z2491
ccgucugaaagucuuucag

SEQ ID NO: 1375714 - RNA, 23 nt, Neisseria meningitidis Z2491
ccgucugaaauguucagacggca

SEQ ID NO: 1375715 - RNA, 23 nt, Neisseria meningitidis Z2491
ccgucagcacguguuccaaacgc

SEQ ID NO: 1375716 - RNA, 15 nt, Neisseria meningitidis Z2491
ccguauccgccagua

SEQ ID NO: 1375717 - RNA, 16 nt, Neisseria meningitidis Z2491
ccguaucgaugccguu

SEQ ID NO: 1375718 - RNA, 23 nt, Neisseria meningitidis Z2491
ccugaaauaugguucagacggca

SEQ ID NO: 1375719 - RNA, 20 nt, Neisseria meningitidis Z2491
ccugaaauucgucauucccg

SEQ ID NO: 1375720 - RNA, 15 nt, Neisseria meningitidis Z2491
ccugacaaauucccg

SEQ ID NO: 1375721 - RNA, 18 nt, Neisseria meningitidis Z2491
ccugacaaauucccgcca

SEQ ID NO: 1375722 - RNA, 20 nt, Neisseria meningitidis Z2491
ccugcaccacgucauuccca

SEQ ID NO: 1375723 - RNA, 16 nt, Neisseria meningitidis Z2491
ccugauaguugccguc

SEQ ID NO: 1375724 - RNA, 22 nt, Neisseria meningitidis Z2491
ccugcugcugguuuuucggcac

SEQ ID NO: 1375725 - RNA, 16 nt, Neisseria meningitidis Z2491
ccugcggcauuucguc

SEQ ID NO: 1375726 - RNA, 16 nt, Neisseria meningitidis Z2491
ccugccgucauucccg

SEQ ID NO: 1375727 - RNA, 21 nt, Neisseria meningitidis Z2491
ccugcgcgggaaugacggcag

SEQ ID NO: 1375728 - RNA, 20 nt, Neisseria meningitidis Z2491
ccugccugcgcgggaaugac

SEQ ID NO: 1375729 - RNA, 18 nt, Neisseria meningitidis Z2491
aaaugccgucauucccgc

SEQ ID NO: 1375730 - RNA, 11 nt, Neisseria meningitidis Z2491
aaaugccgucc

SEQ ID NO: 1375731 - RNA, 18 nt, Neisseria meningitidis Z2491
aaaugccgucugaaaccu

SEQ ID NO: 1375732 - RNA, 21 nt, Neisseria meningitidis Z2491
aaaugccgucugaacagcauu

SEQ ID NO: 1375733 - RNA, 21 nt, Neisseria meningitidis Z2491
aaaugcaaaacuuuucugauu

SEQ ID NO: 1375734 - RNA, 19 nt, Neisseria meningitidis Z2491
aaaugcucccuaucgccgc

SEQ ID NO: 1375735 - RNA, 19 nt, Neisseria meningitidis Z2491
aaaugcgccuuugccgccu

SEQ ID NO: 1375736 - RNA, 11 nt, Neisseria meningitidis Z2491
ccggacuuuca

SEQ ID NO: 1375737 - RNA, 17 nt, Neisseria meningitidis Z2491
aacagggaaagcagcag

SEQ ID NO: 1375738 - RNA, 20 nt, Neisseria meningitidis Z2491
cggcauuuguccauucggcu

SEQ ID NO: 1375739 - RNA, 12 nt, Neisseria meningitidis Z2491
cggcagcggcau

SEQ ID NO: 1375740 - RNA, 20 nt, Neisseria meningitidis Z2491
aacaucggguuucagacggc

SEQ ID NO: 1375741 - RNA, 15 nt, Neisseria meningitidis Z2491
cggguuuucgauuuc

SEQ ID NO: 1375742 - RNA, 23 nt, Neisseria meningitidis Z2491
cggguuugcuuucgcugccgccg

SEQ ID NO: 1375743 - RNA, 20 nt, Neisseria meningitidis Z2491
cggucaacccguaugccgcc

SEQ ID NO: 1375744 - RNA, 15 nt, Neisseria meningitidis Z2491
aaccaguacgguguu

SEQ ID NO: 1375745 - RNA, 16 nt, Neisseria meningitidis Z2491
cggguucggacggcau

SEQ ID NO: 1375746 - RNA, 17 nt, Neisseria meningitidis Z2491
cggguucagacggcauc

SEQ ID NO: 1375747 - RNA, 19 nt, Neisseria meningitidis Z2491
cggguucagacggcaucag

SEQ ID NO: 1375748 - RNA, 16 nt, Neisseria meningitidis Z2491
cggcugaacauuccgu

SEQ ID NO: 1375749 - RNA, 21 nt, Neisseria meningitidis Z2491
cgggcaacacgcccaagcggu

SEQ ID NO: 1375750 - RNA, 12 nt, Neisseria meningitidis Z2491
cgggcaacggca

SEQ ID NO: 1375751 - RNA, 23 nt, Neisseria meningitidis Z2491
cgcuuuugcgggaaugacggcag

SEQ ID NO: 1375752 - RNA, 22 nt, Neisseria meningitidis Z2491
cggaaaaaaggcuucagacggu

SEQ ID NO: 1375753 - RNA, 22 nt, Neisseria meningitidis Z2491
cggaagaucauaccuaccgccu

SEQ ID NO: 1375754 - RNA, 16 nt, Neisseria meningitidis Z2491
cgcuucggucggaugu

SEQ ID NO: 1375755 - RNA, 15 nt, Neisseria meningitidis Z2491
cgcuucagacggcau

SEQ ID NO: 1375756 - RNA, 15 nt, Neisseria meningitidis Z2491
cgcggcugccgaccg

SEQ ID NO: 1375757 - RNA, 18 nt, Neisseria meningitidis Z2491
cgcggacacgguucugca

SEQ ID NO: 1375758 - RNA, 18 nt, Neisseria meningitidis Z2491
cgcggauucgacggcgga

SEQ ID NO: 1375759 - RNA, 18 nt, Neisseria meningitidis Z2491
cgcgccgaucgcgaugcc

SEQ ID NO: 1375760 - RNA, 18 nt, Neisseria meningitidis Z2491
cgccuuacggauggcaua

SEQ ID NO: 1375761 - RNA, 19 nt, Neisseria meningitidis Z2491
cgccuuacggauggcauag

SEQ ID NO: 1375762 - RNA, 14 nt, Neisseria meningitidis Z2491
cgccgcagauuccg

SEQ ID NO: 1375763 - RNA, 16 nt, Neisseria meningitidis Z2491
gucugucggugcggaa

SEQ ID NO: 1375764 - RNA, 17 nt, Neisseria meningitidis Z2491
gucugucggugcggaaa

SEQ ID NO: 1375765 - RNA, 15 nt, Neisseria meningitidis Z2491
gucguugugcggcaa

SEQ ID NO: 1375766 - RNA, 22 nt, Neisseria meningitidis Z2491
gucugaaauguucagacggcau

SEQ ID NO: 1375767 - RNA, 19 nt, Neisseria meningitidis Z2491
guccaaacaaaaaugccgu

SEQ ID NO: 1375768 - RNA, 17 nt, Neisseria meningitidis Z2491
ggguuucagacggcauu

SEQ ID NO: 1375769 - RNA, 16 nt, Neisseria meningitidis Z2491
ggguuuggaaugcgcg

SEQ ID NO: 1375770 - RNA, 16 nt, Neisseria meningitidis Z2491
ggguucagacggcauc

SEQ ID NO: 1375771 - RNA, 19 nt, Neisseria meningitidis Z2491
ggguacaaccaaugcggca

SEQ ID NO: 1375772 - RNA, 16 nt, Neisseria meningitidis Z2491
ggugaacacuucuucg

SEQ ID NO: 1375773 - RNA, 15 nt, Neisseria meningitidis Z2491
guaaccgacgaaggc

SEQ ID NO: 1375774 - RNA, 21 nt, Neisseria meningitidis Z2491
guaacgggcgagaugacggcu

SEQ ID NO: 1375775 - RNA, 16 nt, Neisseria meningitidis Z2491
guagcggugugcgccg

SEQ ID NO: 1375776 - RNA, 16 nt, Neisseria meningitidis Z2491
gguuucagacggcauu

SEQ ID NO: 1375777 - RNA, 15 nt, Neisseria meningitidis Z2491
gguguuugcagauaa

SEQ ID NO: 1375778 - RNA, 15 nt, Neisseria meningitidis Z2491
gguucggcuuggaau

SEQ ID NO: 1375779 - RNA, 14 nt, Neisseria meningitidis Z2491
gguucagacggcau

SEQ ID NO: 1375780 - RNA, 20 nt, Neisseria meningitidis Z2491
gguucaaacuuuauccguua

SEQ ID NO: 1375781 - RNA, 18 nt, Neisseria meningitidis Z2491
ggcuuuuucagacggcau

SEQ ID NO: 1375782 - RNA, 23 nt, Neisseria meningitidis Z2491
ggcuuucagacggccuuuggaau

SEQ ID NO: 1375783 - RNA, 23 nt, Neisseria meningitidis Z2491
ggcuugaacaaaccuguggauaa

SEQ ID NO: 1375784 - RNA, 11 nt, Neisseria meningitidis Z2491
ggcucuuggau

SEQ ID NO: 1375785 - RNA, 22 nt, Neisseria meningitidis Z2491
ggcguuaauaaaaguaccgcag

SEQ ID NO: 1375786 - RNA, 22 nt, Neisseria meningitidis Z2491
ggcguugccucgccuugccgua

SEQ ID NO: 1375787 - RNA, 18 nt, Neisseria meningitidis Z2491
ggcguuuuucagacggcc

SEQ ID NO: 1375788 - RNA, 15 nt, Neisseria meningitidis Z2491
ggcgcaucccgcaaa

SEQ ID NO: 1375789 - RNA, 15 nt, Neisseria meningitidis Z2491
ggaacaaaaugccgc

SEQ ID NO: 1375790 - RNA, 12 nt, Neisseria meningitidis Z2491
ggcaaccgucag

SEQ ID NO: 1375791 - RNA, 19 nt, Neisseria meningitidis Z2491
ggcaaaaaaagaugccguc

SEQ ID NO: 1375792 - RNA, 11 nt, Neisseria meningitidis Z2491
ggcaaugccgu

SEQ ID NO: 1375793 - RNA, 14 nt, Neisseria meningitidis Z2491
ggcauuuuuuucgg

SEQ ID NO: 1375794 - RNA, 13 nt, Neisseria meningitidis Z2491
ggcaguuuccaau

SEQ ID NO: 1375795 - RNA, 14 nt, Neisseria meningitidis Z2491
ggcaguaaugccgc

SEQ ID NO: 1375796 - RNA, 22 nt, Neisseria meningitidis Z2491
ggcagauguauuguccgccguc

SEQ ID NO: 1375797 - RNA, 18 nt, Neisseria meningitidis Z2491
ggcagcggcaucgcgguc

SEQ ID NO: 1375798 - RNA, 13 nt, Neisseria meningitidis Z2491
ggccacgccgacu

SEQ ID NO: 1375799 - RNA, 16 nt, Neisseria meningitidis Z2491
ggccgcgcccgcaccg

SEQ ID NO: 1375800 - RNA, 14 nt, Neisseria meningitidis Z2491
gcuucagacggcau

SEQ ID NO: 1375801 - RNA, 18 nt, Neisseria meningitidis Z2491
gcuguugaaaaugccguc

SEQ ID NO: 1375802 - RNA, 16 nt, Neisseria meningitidis Z2491
gcuguaugccgucuga

SEQ ID NO: 1375803 - RNA, 22 nt, Neisseria meningitidis Z2491
gcugggauauugauacugccgu

SEQ ID NO: 1375804 - RNA, 15 nt, Neisseria meningitidis Z2491
gcuucgcgacgguau

SEQ ID NO: 1375805 - RNA, 18 nt, Neisseria meningitidis Z2491
gcuucguaggcaucgucc

SEQ ID NO: 1375806 - RNA, 17 nt, Neisseria meningitidis Z2491
gcuuccagaccagccgc

SEQ ID NO: 1375807 - RNA, 23 nt, Neisseria meningitidis Z2491
gcuuccauaccguuuggcggcau

SEQ ID NO: 1375808 - RNA, 23 nt, Neisseria meningitidis Z2491
gcuugcccacgcacccaaacggc

SEQ ID NO: 1375809 - RNA, 18 nt, Neisseria meningitidis Z2491
gcuuuuucagacggcauu

SEQ ID NO: 1375810 - RNA, 20 nt, Neisseria meningitidis Z2491
ggaaaaccguguuucagacg

SEQ ID NO: 1375811 - RNA, 21 nt, Neisseria meningitidis Z2491
ggaaagugauuuugucggcaa

SEQ ID NO: 1375812 - RNA, 14 nt, Neisseria meningitidis Z2491
gcugaugacggcag

SEQ ID NO: 1375813 - RNA, 23 nt, Neisseria meningitidis Z2491
gcucggcguuuuucagacggccu

SEQ ID NO: 1375814 - RNA, 16 nt, Neisseria meningitidis Z2491
gcugaaaaaaugccgu

SEQ ID NO: 1375815 - RNA, 18 nt, Neisseria meningitidis Z2491
gcugaaaaaaugccgucu

SEQ ID NO: 1375816 - RNA, 18 nt, Neisseria meningitidis Z2491
gcguuccacaaauccgcc

SEQ ID NO: 1375817 - RNA, 14 nt, Neisseria meningitidis Z2491
gcguaaagcgguuu

SEQ ID NO: 1375818 - RNA, 16 nt, Neisseria meningitidis Z2491
gcguucaaaugccguc

SEQ ID NO: 1375819 - RNA, 19 nt, Neisseria meningitidis Z2491
gcgugcgguguucagcauu

SEQ ID NO: 1375820 - RNA, 15 nt, Neisseria meningitidis Z2491
gcguauccagccgcc

SEQ ID NO: 1375821 - RNA, 11 nt, Neisseria meningitidis Z2491
gcggcggauuc

SEQ ID NO: 1375822 - RNA, 15 nt, Neisseria meningitidis Z2491
gcggccgcgcccgca

SEQ ID NO: 1375823 - RNA, 20 nt, Neisseria meningitidis Z2491
aagcggcugggcaugcagca

SEQ ID NO: 1375824 - RNA, 16 nt, Neisseria meningitidis Z2491
aagcggcaaugccguc

SEQ ID NO: 1375825 - RNA, 18 nt, Neisseria meningitidis Z2491
aagcggcaaugccgucug

SEQ ID NO: 1375826 - RNA, 15 nt, Neisseria meningitidis Z2491
aagcggaauacggca

SEQ ID NO: 1375827 - RNA, 21 nt, Neisseria meningitidis Z2491
gccuuugccaccaauaccgcc

SEQ ID NO: 1375828 - RNA, 18 nt, Neisseria meningitidis Z2491
gccuuugggcgacggcaa

SEQ ID NO: 1375829 - RNA, 20 nt, Neisseria meningitidis Z2491
gccuuguaaaaaugccgucu

SEQ ID NO: 1375830 - RNA, 16 nt, Neisseria meningitidis Z2491
gccuucagacggcauu

SEQ ID NO: 1375831 - RNA, 18 nt, Neisseria meningitidis Z2491
gcgaacugccugcaacgc

SEQ ID NO: 1375832 - RNA, 18 nt, Neisseria meningitidis Z2491
gcgagacaacgccguacu

SEQ ID NO: 1375833 - RNA, 14 nt, Neisseria meningitidis Z2491
gcgagaacgacggg

SEQ ID NO: 1375834 - RNA, 19 nt, Neisseria meningitidis Z2491
aagcccuaaauacggcaau

SEQ ID NO: 1375835 - RNA, 12 nt, Neisseria meningitidis Z2491
gcgacgacgugg

SEQ ID NO: 1375836 - RNA, 22 nt, Neisseria meningitidis Z2491
gccugaacauuucagacggcau

SEQ ID NO: 1375837 - RNA, 23 nt, Neisseria meningitidis Z2491
gccugaacauuucagacggcauu

SEQ ID NO: 1375838 - RNA, 13 nt, Neisseria meningitidis Z2491
gccucuauccugc

SEQ ID NO: 1375839 - RNA, 15 nt, Neisseria meningitidis Z2491
gccgugugccggaug

SEQ ID NO: 1375840 - RNA, 17 nt, Neisseria meningitidis Z2491
gccguuucagacggcau

SEQ ID NO: 1375841 - RNA, 17 nt, Neisseria meningitidis Z2491
gcgcaggcaaacgcgau

SEQ ID NO: 1375842 - RNA, 18 nt, Neisseria meningitidis Z2491
gcgcccaaccgugcggca

SEQ ID NO: 1375843 - RNA, 22 nt, Neisseria meningitidis Z2491
gcgcgggugaugccgacguaca

SEQ ID NO: 1375844 - RNA, 12 nt, Neisseria meningitidis Z2491
gaaaugccgucu

SEQ ID NO: 1375845 - RNA, 23 nt, Neisseria meningitidis Z2491
gaaauugcguucgcugacgguau

SEQ ID NO: 1375846 - RNA, 12 nt, Neisseria meningitidis Z2491
gaaauucuagau

SEQ ID NO: 1375847 - RNA, 19 nt, Neisseria meningitidis Z2491
gaacacggguucagacggc

SEQ ID NO: 1375848 - RNA, 15 nt, Neisseria meningitidis Z2491
gaaacggacaacggc

SEQ ID NO: 1375849 - RNA, 20 nt, Neisseria meningitidis Z2491
gaaacgcgccuucaugcggc

SEQ ID NO: 1375850 - RNA, 19 nt, Neisseria meningitidis Z2491
gaaacguuucagacggcau

SEQ ID NO: 1375851 - RNA, 20 nt, Neisseria meningitidis Z2491
gaaaguuugaaguucuagau

SEQ ID NO: 1375852 - RNA, 21 nt, Neisseria meningitidis Z2491
gaaaguuuagagguucuagau

SEQ ID NO: 1375853 - RNA, 21 nt, Neisseria meningitidis Z2491
gaaauacuuaacaaugcccgc

SEQ ID NO: 1375854 - RNA, 21 nt, Neisseria meningitidis Z2491
gaaauaugguucagacggcau

SEQ ID NO: 1375855 - RNA, 21 nt, Neisseria meningitidis Z2491
gaaacagguuucagacggcau

SEQ ID NO: 1375856 - RNA, 15 nt, Neisseria meningitidis Z2491
gaaaaugccgucuga

SEQ ID NO: 1375857 - RNA, 14 nt, Neisseria meningitidis Z2491
gaaaauuucuugau

SEQ ID NO: 1375858 - RNA, 21 nt, Neisseria meningitidis Z2491
aaccuguguucagacggcaua

SEQ ID NO: 1375859 - RNA, 16 nt, Neisseria meningitidis Z2491
aaccuuucagacggca

SEQ ID NO: 1375860 - RNA, 17 nt, Neisseria meningitidis Z2491
aaccuuucagacggcau

SEQ ID NO: 1375861 - RNA, 15 nt, Neisseria meningitidis Z2491
aaccuuccgccguau

SEQ ID NO: 1375862 - RNA, 19 nt, Neisseria meningitidis Z2491
aaccguuucagacggcauu

SEQ ID NO: 1375863 - RNA, 17 nt, Neisseria meningitidis Z2491
gaaaauacggacgggaa

SEQ ID NO: 1375864 - RNA, 15 nt, Neisseria meningitidis Z2491
aaccugcaucccguc

SEQ ID NO: 1375865 - RNA, 18 nt, Neisseria meningitidis Z2491
aaccugcaccacgucauu

SEQ ID NO: 1375866 - RNA, 15 nt, Neisseria meningitidis Z2491
aaccucaaaucccgu

SEQ ID NO: 1375867 - RNA, 18 nt, Neisseria meningitidis Z2491
aaccucaaaucccgucau

SEQ ID NO: 1375868 - RNA, 20 nt, Neisseria meningitidis Z2491
aaccucguucggacggcauu

SEQ ID NO: 1375869 - RNA, 16 nt, Neisseria meningitidis Z2491
aaccuaaaaucccguc

SEQ ID NO: 1375870 - RNA, 18 nt, Neisseria meningitidis Z2491
aaccuaaaaucccgucau

SEQ ID NO: 1375871 - RNA, 15 nt, Neisseria meningitidis Z2491
aaccuaaaauccguc

SEQ ID NO: 1375872 - RNA, 17 nt, Neisseria meningitidis Z2491
aaccuacauuccgucau

SEQ ID NO: 1375873 - RNA, 13 nt, Neisseria meningitidis Z2491
gaacccaaaccgu

SEQ ID NO: 1375874 - RNA, 19 nt, Neisseria meningitidis Z2491
gaacgucgggcaacggcaa

SEQ ID NO: 1375875 - RNA, 21 nt, Neisseria meningitidis Z2491
gaacgaguuuucagacggcau

SEQ ID NO: 1375876 - RNA, 16 nt, Neisseria meningitidis Z2491
cuuuuuccaauucgcu

SEQ ID NO: 1375877 - RNA, 19 nt, Neisseria meningitidis Z2491
cuuuuugcgccagcggcac

SEQ ID NO: 1375878 - RNA, 23 nt, Neisseria meningitidis Z2491
gaaaacgcuguuuuuuguugccu

SEQ ID NO: 1375879 - RNA, 15 nt, Neisseria meningitidis Z2491
gaaaacgccgucuga

SEQ ID NO: 1375880 - RNA, 12 nt, Neisseria meningitidis Z2491
cuuuuucagacg

SEQ ID NO: 1375881 - RNA, 16 nt, Neisseria meningitidis Z2491
cuuuuucagacggcau

SEQ ID NO: 1375882 - RNA, 19 nt, Neisseria meningitidis Z2491
cuuuucaucgucauucccg

SEQ ID NO: 1375883 - RNA, 16 nt, Neisseria meningitidis Z2491
cuuugaauauugccgc

SEQ ID NO: 1375884 - RNA, 16 nt, Neisseria meningitidis Z2491
cuuugaauauugccgu

SEQ ID NO: 1375885 - RNA, 15 nt, Neisseria meningitidis Z2491
cuuuggcggcggcag

SEQ ID NO: 1375886 - RNA, 15 nt, Neisseria meningitidis Z2491
cuuugcucagcccga

SEQ ID NO: 1375887 - RNA, 20 nt, Neisseria meningitidis Z2491
cuuucccucccgacagccga

SEQ ID NO: 1375888 - RNA, 17 nt, Neisseria meningitidis Z2491
cuuucccguuucagacg

SEQ ID NO: 1375889 - RNA, 16 nt, Neisseria meningitidis Z2491
cuuuccgccgucauuc

SEQ ID NO: 1375890 - RNA, 21 nt, Neisseria meningitidis Z2491
cuuucgcgagaacgacgggau

SEQ ID NO: 1375891 - RNA, 12 nt, Neisseria meningitidis Z2491
cuuucgucauuc

SEQ ID NO: 1375892 - RNA, 22 nt, Neisseria meningitidis Z2491
aaccgucaaacaaaaugccguc

SEQ ID NO: 1375893 - RNA, 22 nt, Neisseria meningitidis Z2491
aaccgucggcacgaaccgcauu

SEQ ID NO: 1375894 - RNA, 20 nt, Neisseria meningitidis Z2491
aaccguugcagccaugcggc

SEQ ID NO: 1375895 - RNA, 14 nt, Neisseria meningitidis Z2491
cuuucagacggcau

SEQ ID NO: 1375896 - RNA, 12 nt, Neisseria meningitidis Z2491
cuuucaacggca

SEQ ID NO: 1375897 - RNA, 13 nt, Neisseria meningitidis Z2491
cuuucaacggcac

SEQ ID NO: 1375898 - RNA, 17 nt, Neisseria meningitidis Z2491
cuuuaaucauguugccg

SEQ ID NO: 1375899 - RNA, 20 nt, Neisseria meningitidis Z2491
cuuuaaucccgucauuccca

SEQ ID NO: 1375900 - RNA, 17 nt, Neisseria meningitidis Z2491
cuuaacagggaaagcag

SEQ ID NO: 1375901 - RNA, 19 nt, Neisseria meningitidis Z2491
cuguuuuugagggaaugac

SEQ ID NO: 1375902 - RNA, 17 nt, Neisseria meningitidis Z2491
cuguuuuuccgacaaau

SEQ ID NO: 1375903 - RNA, 21 nt, Neisseria meningitidis Z2491
cuuaaaauuucaucauuccca

SEQ ID NO: 1375904 - RNA, 21 nt, Neisseria meningitidis Z2491
cuuaaaaccucgucauucccg

SEQ ID NO: 1375905 - RNA, 22 nt, Neisseria meningitidis Z2491
cuuaaaaccucgucauucccgc

SEQ ID NO: 1375906 - RNA, 16 nt, Neisseria meningitidis Z2491
cuuaaaccuuauccau

SEQ ID NO: 1375907 - RNA, 16 nt, Neisseria meningitidis Z2491
cuguuguuucggauaa

SEQ ID NO: 1375908 - RNA, 16 nt, Neisseria meningitidis Z2491
cuguuucagacggcau

SEQ ID NO: 1375909 - RNA, 23 nt, Neisseria meningitidis Z2491
cuguuucggguuucagacggcau

SEQ ID NO: 1375910 - RNA, 20 nt, Neisseria meningitidis Z2491
cuguaugccgucugaaaccu

SEQ ID NO: 1375911 - RNA, 17 nt, Neisseria meningitidis Z2491
cuguaccguuucagacg

SEQ ID NO: 1375912 - RNA, 21 nt, Neisseria meningitidis Z2491
cuguaccguuucagacggcau

SEQ ID NO: 1375913 - RNA, 20 nt, Neisseria meningitidis Z2491
cuucaaaucguuuugcgcca

SEQ ID NO: 1375914 - RNA, 19 nt, Neisseria meningitidis Z2491
cuucaacaccugcagauug

SEQ ID NO: 1375915 - RNA, 20 nt, Neisseria meningitidis Z2491
cuucauuccgcgcaggcgga

SEQ ID NO: 1375916 - RNA, 17 nt, Neisseria meningitidis Z2491
cuuccgauuauaucggc

SEQ ID NO: 1375917 - RNA, 23 nt, Neisseria meningitidis Z2491
gacggcauuuucuauuuuacagc

SEQ ID NO: 1375918 - RNA, 19 nt, Neisseria meningitidis Z2491
gacggauucgcgguugccg

SEQ ID NO: 1375919 - RNA, 19 nt, Neisseria meningitidis Z2491
gacggacgcaggugcagau

SEQ ID NO: 1375920 - RNA, 15 nt, Neisseria meningitidis Z2491
gacggcggcagauaa

SEQ ID NO: 1375921 - RNA, 18 nt, Neisseria meningitidis Z2491
gacgggauuagaguuuca

SEQ ID NO: 1375922 - RNA, 18 nt, Neisseria meningitidis Z2491
gacggcuuggauuugccg

SEQ ID NO: 1375923 - RNA, 19 nt, Neisseria meningitidis Z2491
gaccuucgggcagcggcaa

SEQ ID NO: 1375924 - RNA, 17 nt, Neisseria meningitidis Z2491
gaccuuagaacaacagu

SEQ ID NO: 1375925 - RNA, 14 nt, Neisseria meningitidis Z2491
aacggcacggcguu

SEQ ID NO: 1375926 - RNA, 22 nt, Neisseria meningitidis Z2491
gacgagaauuuaucagaaauga

SEQ ID NO: 1375927 - RNA, 19 nt, Neisseria meningitidis Z2491
aacguacaaaugccgucug

SEQ ID NO: 1375928 - RNA, 13 nt, Neisseria meningitidis Z2491
aacguaucggaua

SEQ ID NO: 1375929 - RNA, 18 nt, Neisseria meningitidis Z2491
gacacgaccgaccggcau

SEQ ID NO: 1375930 - RNA, 21 nt, Neisseria meningitidis Z2491
gaacugcgguucggacggcau

SEQ ID NO: 1375931 - RNA, 17 nt, Neisseria meningitidis Z2491
gaauggaaaugccgucu

SEQ ID NO: 1375932 - RNA, 18 nt, Neisseria meningitidis Z2491
gacccacgccaaaccgau

SEQ ID NO: 1375933 - RNA, 14 nt, Neisseria meningitidis Z2491
aacggagauucccg

SEQ ID NO: 1375934 - RNA, 13 nt, Neisseria meningitidis Z2491
cuagauucccacu

SEQ ID NO: 1375935 - RNA, 12 nt, Neisseria meningitidis Z2491
cuagauucccgu

SEQ ID NO: 1375936 - RNA, 11 nt, Neisseria meningitidis Z2491
cuagauuccca

SEQ ID NO: 1375937 - RNA, 18 nt, Neisseria meningitidis Z2491
cuauaccaaacggcauau

SEQ ID NO: 1375938 - RNA, 22 nt, Neisseria meningitidis Z2491
cguugccugcgaacuagcggcg

SEQ ID NO: 1375939 - RNA, 18 nt, Neisseria meningitidis Z2491
cuacguucuagauucccg

SEQ ID NO: 1375940 - RNA, 19 nt, Neisseria meningitidis Z2491
cucaaaaaacuggauuccc

SEQ ID NO: 1375941 - RNA, 21 nt, Neisseria meningitidis Z2491
cucaaaaagcuggauucccac

SEQ ID NO: 1375942 - RNA, 13 nt, Neisseria meningitidis Z2491
cucauuugccgaa

SEQ ID NO: 1375943 - RNA, 19 nt, Neisseria meningitidis Z2491
cucacccugcaaggcggcg

SEQ ID NO: 1375944 - RNA, 13 nt, Neisseria meningitidis Z2491
cucaagaaaccgu

SEQ ID NO: 1375945 - RNA, 22 nt, Neisseria meningitidis Z2491
cucacacucuucgucauucccg

SEQ ID NO: 1375946 - RNA, 23 nt, Neisseria meningitidis Z2491
cucacacucuucgucauucccgu

SEQ ID NO: 1375947 - RNA, 17 nt, Neisseria meningitidis Z2491
cucaaucgcggcggcac

SEQ ID NO: 1375948 - RNA, 15 nt, Neisseria meningitidis Z2491
cugacaaauucccgc

SEQ ID NO: 1375949 - RNA, 18 nt, Neisseria meningitidis Z2491
cugacagcauuuccacau

SEQ ID NO: 1375950 - RNA, 22 nt, Neisseria meningitidis Z2491
cugaagccagccccaccauugu

SEQ ID NO: 1375951 - RNA, 23 nt, Neisseria meningitidis Z2491
cugaacgaguuuucagacggcau

SEQ ID NO: 1375952 - RNA, 21 nt, Neisseria meningitidis Z2491
cugaacucaggcuucagacgg

SEQ ID NO: 1375953 - RNA, 16 nt, Neisseria meningitidis Z2491
cugaacgcuucagacg

SEQ ID NO: 1375954 - RNA, 17 nt, Neisseria meningitidis Z2491
cugaacgcuucagacgg

SEQ ID NO: 1375955 - RNA, 19 nt, Neisseria meningitidis Z2491
cugaacgcuucagacggca

SEQ ID NO: 1375956 - RNA, 20 nt, Neisseria meningitidis Z2491
cugaacgcuucagacggcau

SEQ ID NO: 1375957 - RNA, 15 nt, Neisseria meningitidis Z2491
cugaaaaucggguuu

SEQ ID NO: 1375958 - RNA, 13 nt, Neisseria meningitidis Z2491
cucuuuucagaca

SEQ ID NO: 1375959 - RNA, 20 nt, Neisseria meningitidis Z2491
cugaacaguguuucagacgg

SEQ ID NO: 1375960 - RNA, 22 nt, Neisseria meningitidis Z2491
cugaacaguguuucagacggcc

SEQ ID NO: 1375961 - RNA, 22 nt, Neisseria meningitidis Z2491
cugaacaucuuucagacggcau

SEQ ID NO: 1375962 - RNA, 21 nt, Neisseria meningitidis Z2491
cugaacaggcuucagacggca

SEQ ID NO: 1375963 - RNA, 20 nt, Neisseria meningitidis Z2491
cugcaucccgucauucccgc

SEQ ID NO: 1375964 - RNA, 15 nt, Neisseria meningitidis Z2491
cugauucuaccgccc

SEQ ID NO: 1375965 - RNA, 21 nt, Neisseria meningitidis Z2491
cugauuuaaauuuaauccgcu

SEQ ID NO: 1375966 - RNA, 18 nt, Neisseria meningitidis Z2491
cugauuucguaauccgca

SEQ ID NO: 1375967 - RNA, 20 nt, Neisseria meningitidis Z2491
cugauuuuuguuaauccacu

SEQ ID NO: 1375968 - RNA, 19 nt, Neisseria meningitidis Z2491
cugcaacguuucagacggu

SEQ ID NO: 1375969 - RNA, 18 nt, Neisseria meningitidis Z2491
cugcagccgucauucccg

SEQ ID NO: 1375970 - RNA, 13 nt, Neisseria meningitidis Z2491
aaccgaugccguc

SEQ ID NO: 1375971 - RNA, 15 nt, Neisseria meningitidis Z2491
aaccgaugccgucau

SEQ ID NO: 1375972 - RNA, 22 nt, Neisseria meningitidis Z2491
aacccugaacauaaaugccguc

SEQ ID NO: 1375973 - RNA, 17 nt, Neisseria meningitidis Z2491
aacccugucgccgucau

SEQ ID NO: 1375974 - RNA, 19 nt, Neisseria meningitidis Z2491
cgucuugggaaaugccguc

SEQ ID NO: 1375975 - RNA, 23 nt, Neisseria meningitidis Z2491
cgucugaagcgguucagacggca

SEQ ID NO: 1375976 - RNA, 22 nt, Neisseria meningitidis Z2491
cgucugaaauguucagacggca

SEQ ID NO: 1375977 - RNA, 23 nt, Neisseria meningitidis Z2491
cgucugaaauguucagacggcau

SEQ ID NO: 1375978 - RNA, 14 nt, Neisseria meningitidis Z2491
cgugcaauacggcg

SEQ ID NO: 1375979 - RNA, 16 nt, Neisseria meningitidis Z2491
cguuaacgauacggcg

SEQ ID NO: 1375980 - RNA, 16 nt, Neisseria meningitidis Z2491
cguuaagcgcggauac

SEQ ID NO: 1375981 - RNA, 11 nt, Neisseria meningitidis Z2491
cguucagacgg

SEQ ID NO: 1375982 - RNA, 14 nt, Neisseria meningitidis Z2491
cguucagacggcau

SEQ ID NO: 1375983 - RNA, 15 nt, Neisseria meningitidis Z2491
cguucagacggcauc

SEQ ID NO: 1375984 - RNA, 16 nt, Neisseria meningitidis Z2491
cguguuuguuucagac

SEQ ID NO: 1375985 - RNA, 16 nt, Neisseria meningitidis Z2491
cgugcgaacaaccgga

SEQ ID NO: 1375986 - RNA, 23 nt, Neisseria meningitidis Z2491
aaccgcauugccgcaaucgccgg

SEQ ID NO: 1375987 - RNA, 16 nt, Neisseria meningitidis Z2491
aaccgcgcagcaguuu

SEQ ID NO: 1375988 - RNA, 19 nt, Neisseria meningitidis Z2491
cgucaaaccgaugccguca

SEQ ID NO: 1375989 - RNA, 12 nt, Neisseria meningitidis Z2491
cguaggaaugac

SEQ ID NO: 1375990 - RNA, 21 nt, Neisseria meningitidis Z2491
aacccgacuucugacagcauu

SEQ ID NO: 1375991 - RNA, 16 nt, Neisseria meningitidis Z2491
cgguucggacacgccc

SEQ ID NO: 1375992 - RNA, 13 nt, Neisseria meningitidis Z2491
cgguuuucagacg

SEQ ID NO: 1375993 - RNA, 14 nt, Neisseria meningitidis Z2491
cgguuugccgucug

SEQ ID NO: 1375994 - RNA, 15 nt, Neisseria meningitidis Z2491
cgguuugccgucuga

SEQ ID NO: 1375995 - RNA, 21 nt, Neisseria meningitidis Z2491
cgucauucccgcgcaggcggg

SEQ ID NO: 1375996 - RNA, 21 nt, Neisseria meningitidis Z2491
aacugcgguucggacggcaua

SEQ ID NO: 1375997 - RNA, 17 nt, Neisseria meningitidis Z2491
gauuccacguucuagau

SEQ ID NO: 1375998 - RNA, 13 nt, Neisseria meningitidis Z2491
gcaaaccgucugc

SEQ ID NO: 1375999 - RNA, 21 nt, Neisseria meningitidis Z2491
gcaaaugcacgguuacacaaa

SEQ ID NO: 1376000 - RNA, 12 nt, Neisseria meningitidis Z2491
gcaaaugccguc

SEQ ID NO: 1376001 - RNA, 15 nt, Neisseria meningitidis Z2491
gcaaaugccgucuga

SEQ ID NO: 1376002 - RNA, 17 nt, Neisseria meningitidis Z2491
gcaaaugccgucugaaa

SEQ ID NO: 1376003 - RNA, 15 nt, Neisseria meningitidis Z2491
gcaaaugcugucuga

SEQ ID NO: 1376004 - RNA, 13 nt, Neisseria meningitidis Z2491
aacuucagacggc

SEQ ID NO: 1376005 - RNA, 17 nt, Neisseria meningitidis Z2491
gauggccgguaaacagc

SEQ ID NO: 1376006 - RNA, 14 nt, Neisseria meningitidis Z2491
gaucaggcggauuu

SEQ ID NO: 1376007 - RNA, 14 nt, Neisseria meningitidis Z2491
gauaguugcgguaa

SEQ ID NO: 1376008 - RNA, 17 nt, Neisseria meningitidis Z2491
gaucaaacgauaaugcg

SEQ ID NO: 1376009 - RNA, 18 nt, Neisseria meningitidis Z2491
gagcgggcgcacuucaag

SEQ ID NO: 1376010 - RNA, 19 nt, Neisseria meningitidis Z2491
gaggauaaaaaaugccguc

SEQ ID NO: 1376011 - RNA, 16 nt, Neisseria meningitidis Z2491
gagggaaugacgggau

SEQ ID NO: 1376012 - RNA, 14 nt, Neisseria meningitidis Z2491
gcaguaaugccgcc

SEQ ID NO: 1376013 - RNA, 18 nt, Neisseria meningitidis Z2491
gcagguuucugugcggau

SEQ ID NO: 1376014 - RNA, 22 nt, Neisseria meningitidis Z2491
gcaggcuuuugaggcugccguc

SEQ ID NO: 1376015 - RNA, 19 nt, Neisseria meningitidis Z2491
gcaggcacaccgacggaau

SEQ ID NO: 1376016 - RNA, 20 nt, Neisseria meningitidis Z2491
gcagcgcgcccgacaaaucg

SEQ ID NO: 1376017 - RNA, 22 nt, Neisseria meningitidis Z2491
gcagcuccgaaccgaaacggcg

SEQ ID NO: 1376018 - RNA, 16 nt, Neisseria meningitidis Z2491
gcaccuuagacaaucg

SEQ ID NO: 1376019 - RNA, 20 nt, Neisseria meningitidis Z2491
gcacagucggcauacacggc

SEQ ID NO: 1376020 - RNA, 20 nt, Neisseria meningitidis Z2491
gcaauuuaucgggaaugacu

SEQ ID NO: 1376021 - RNA, 19 nt, Neisseria meningitidis Z2491
gcacaaaaaugccgucuga

SEQ ID NO: 1376022 - RNA, 19 nt, Neisseria meningitidis Z2491
aagcagaaaccgcuccgcc

SEQ ID NO: 1376023 - RNA, 17 nt, Neisseria meningitidis Z2491
gcccuuucagacggcau

SEQ ID NO: 1376024 - RNA, 16 nt, Neisseria meningitidis Z2491
gccgccguaaccgcac

SEQ ID NO: 1376025 - RNA, 21 nt, Neisseria meningitidis Z2491
gccgcguaugcguucaaaugc

SEQ ID NO: 1376026 - RNA, 16 nt, Neisseria meningitidis Z2491
gcccaaugccgucuga

SEQ ID NO: 1376027 - RNA, 18 nt, Neisseria meningitidis Z2491
gcccaaugccgucugaau

SEQ ID NO: 1376028 - RNA, 13 nt, Neisseria meningitidis Z2491
gccaccacgucca

SEQ ID NO: 1376029 - RNA, 22 nt, Neisseria meningitidis Z2491
gcagucuuccaacccuccgccg

SEQ ID NO: 1376030 - RNA, 14 nt, Neisseria meningitidis Z2491
gccagggcggauug

SEQ ID NO: 1376031 - RNA, 15 nt, Neisseria meningitidis Z2491
gccagccgccgagca

SEQ ID NO: 1376032 - RNA, 23 nt, Neisseria meningitidis Z2491
gccacuuuuugcgccagcggcac

SEQ ID NO: 1376033 - RNA, 16 nt, Neisseria meningitidis Z2491
gccagcagcagcccgu

SEQ ID NO: 1376034 - RNA, 19 nt, Neisseria meningitidis Z2491
acugaaaaauacgaugccg

SEQ ID NO: 1376035 - RNA, 18 nt, Neisseria meningitidis Z2491
acuauaaaaaaucccugu

SEQ ID NO: 1376036 - RNA, 14 nt, Neisseria meningitidis Z2491
acuauaucagacgg

SEQ ID NO: 1376037 - RNA, 19 nt, Neisseria meningitidis Z2491
acugauuguuuuucagaga

SEQ ID NO: 1376038 - RNA, 19 nt, Neisseria meningitidis Z2491
agaaaccgcucugccguca

SEQ ID NO: 1376039 - RNA, 18 nt, Neisseria meningitidis Z2491
agaaaccuaaaauccguc

SEQ ID NO: 1376040 - RNA, 19 nt, Neisseria meningitidis Z2491
agaaaccucaaaucccguc

SEQ ID NO: 1376041 - RNA, 14 nt, Neisseria meningitidis Z2491
agaaaaucggacgg

SEQ ID NO: 1376042 - RNA, 18 nt, Neisseria meningitidis Z2491
agaaaacgccgucugaaa

SEQ ID NO: 1376043 - RNA, 18 nt, Neisseria meningitidis Z2491
agaaaaggucgucugaaa

SEQ ID NO: 1376044 - RNA, 14 nt, Neisseria meningitidis Z2491
acuuugucgcccaa

SEQ ID NO: 1376045 - RNA, 16 nt, Neisseria meningitidis Z2491
acuuuugagccgucau

SEQ ID NO: 1376046 - RNA, 19 nt, Neisseria meningitidis Z2491
acuuuuugcgccagcggca

SEQ ID NO: 1376047 - RNA, 17 nt, Neisseria meningitidis Z2491
acuuugcucagcccgaa

SEQ ID NO: 1376048 - RNA, 18 nt, Neisseria meningitidis Z2491
acuuugcguuucuagauu

SEQ ID NO: 1376049 - RNA, 20 nt, Neisseria meningitidis Z2491
agauguauuguccgccgucu

SEQ ID NO: 1376050 - RNA, 10 nt, Neisseria meningitidis Z2491
agacggcauu

SEQ ID NO: 1376051 - RNA, 19 nt, Neisseria meningitidis Z2491
agacaaccgacaauacggc

SEQ ID NO: 1376052 - RNA, 19 nt, Neisseria meningitidis Z2491
agaccgucuaaacgguauu

SEQ ID NO: 1376053 - RNA, 15 nt, Neisseria meningitidis Z2491
agaccuagauucccg

SEQ ID NO: 1376054 - RNA, 19 nt, Neisseria meningitidis Z2491
agacgacagagcgccgucu

SEQ ID NO: 1376055 - RNA, 21 nt, Neisseria meningitidis Z2491
agaccuucggguaacggcaau

SEQ ID NO: 1376056 - RNA, 19 nt, Neisseria meningitidis Z2491
acggcaaaaauuuauccga

SEQ ID NO: 1376057 - RNA, 23 nt, Neisseria meningitidis Z2491
acggcauaucccgacagaacaga

SEQ ID NO: 1376058 - RNA, 13 nt, Neisseria meningitidis Z2491
acggacacccgau

SEQ ID NO: 1376059 - RNA, 22 nt, Neisseria meningitidis Z2491
acggacuagauucccgccugcg

SEQ ID NO: 1376060 - RNA, 16 nt, Neisseria meningitidis Z2491
acgcgaaaaugccguc

SEQ ID NO: 1376061 - RNA, 22 nt, Neisseria meningitidis Z2491
aaacacuucuucauuacggauu

SEQ ID NO: 1376062 - RNA, 20 nt, Neisseria meningitidis Z2491
aaacagcaggucgacggcaa

SEQ ID NO: 1376063 - RNA, 21 nt, Neisseria meningitidis Z2491
aaacagguugaagucgaugcg

SEQ ID NO: 1376064 - RNA, 20 nt, Neisseria meningitidis Z2491
acgcuccagcuccggccaaa

SEQ ID NO: 1376065 - RNA, 13 nt, Neisseria meningitidis Z2491
acuagauucccgc

SEQ ID NO: 1376066 - RNA, 14 nt, Neisseria meningitidis Z2491
acgguauucuuucg

SEQ ID NO: 1376067 - RNA, 16 nt, Neisseria meningitidis Z2491
accauuaccgcuuuaa

SEQ ID NO: 1376068 - RNA, 15 nt, Neisseria meningitidis Z2491
acauaaaugccgucu

SEQ ID NO: 1376069 - RNA, 20 nt, Neisseria meningitidis Z2491
accgaugccgucauucccgc

SEQ ID NO: 1376070 - RNA, 14 nt, Neisseria meningitidis Z2491
accgcagccgaacc

SEQ ID NO: 1376071 - RNA, 22 nt, Neisseria meningitidis Z2491
accgccugcgcgcggacggauu

SEQ ID NO: 1376072 - RNA, 13 nt, Neisseria meningitidis Z2491
accgcuguuuccg

SEQ ID NO: 1376073 - RNA, 18 nt, Neisseria meningitidis Z2491
accgcuucggaacguuga

SEQ ID NO: 1376074 - RNA, 13 nt, Neisseria meningitidis Z2491
accucguucggac

SEQ ID NO: 1376075 - RNA, 18 nt, Neisseria meningitidis Z2491
accucguucggacggcau

SEQ ID NO: 1376076 - RNA, 19 nt, Neisseria meningitidis Z2491
accucguucggacggcauu

SEQ ID NO: 1376077 - RNA, 14 nt, Neisseria meningitidis Z2491
accuagauucccgc

SEQ ID NO: 1376078 - RNA, 14 nt, Neisseria meningitidis Z2491
accuacagauuccg

SEQ ID NO: 1376079 - RNA, 16 nt, Neisseria meningitidis Z2491
accguuucagacggca

SEQ ID NO: 1376080 - RNA, 17 nt, Neisseria meningitidis Z2491
accguuucagacggcau

SEQ ID NO: 1376081 - RNA, 18 nt, Neisseria meningitidis Z2491
accguuucagacggcauu

SEQ ID NO: 1376082 - RNA, 13 nt, Neisseria meningitidis Z2491
accguuucccauc

SEQ ID NO: 1376083 - RNA, 12 nt, Neisseria meningitidis Z2491
accgugucggcg

SEQ ID NO: 1376084 - RNA, 22 nt, Neisseria meningitidis Z2491
accuuucccguuucagacggca

SEQ ID NO: 1376085 - RNA, 12 nt, Neisseria meningitidis Z2491
acgaagccgcag

SEQ ID NO: 1376086 - RNA, 18 nt, Neisseria meningitidis Z2491
acgaagccgcagacagua

SEQ ID NO: 1376087 - RNA, 18 nt, Neisseria meningitidis Z2491
aaacaaaaugccgucuga

SEQ ID NO: 1376088 - RNA, 20 nt, Neisseria meningitidis Z2491
aaacaaaaugccgucugaaa

SEQ ID NO: 1376089 - RNA, 16 nt, Neisseria meningitidis Z2491
aaacaaugccgucuga

SEQ ID NO: 1376090 - RNA, 16 nt, Neisseria meningitidis Z2491
aaacaacagccguuug

SEQ ID NO: 1376091 - RNA, 14 nt, Neisseria meningitidis Z2491
aacuuccaaaccgc

SEQ ID NO: 1376092 - RNA, 20 nt, Neisseria meningitidis Z2491
aacucgauuuuguauccguc

SEQ ID NO: 1376093 - RNA, 19 nt, Neisseria meningitidis Z2491
aacucaggcuucagacggc

SEQ ID NO: 1376094 - RNA, 19 nt, Neisseria meningitidis Z2491
aacucaaaaaacuggauuc

SEQ ID NO: 1376095 - RNA, 19 nt, Neisseria meningitidis Z2491
aacucaaaaagcuggauuc

SEQ ID NO: 1376096 - RNA, 20 nt, Neisseria meningitidis Z2491
aacucaacgaaccuggauuc

SEQ ID NO: 1376097 - RNA, 19 nt, Neisseria meningitidis Z2491
aacucaacgcacuggauuc

SEQ ID NO: 1376098 - RNA, 21 nt, Neisseria meningitidis Z2491
aacgccucaaucgcggcggca

SEQ ID NO: 1376099 - RNA, 19 nt, Neisseria meningitidis Z2491
aacgccagcacaaacagca

SEQ ID NO: 1376100 - RNA, 18 nt, Neisseria meningitidis Z2491
aacgcgucuuccgucugc

SEQ ID NO: 1376101 - RNA, 14 nt, Neisseria meningitidis Z2491
aaccugcugccguc

SEQ ID NO: 1376102 - RNA, 14 nt, Neisseria meningitidis Z2491
aaccugcaucccgu

SEQ ID NO: 1376103 - RNA, 17 nt, Neisseria meningitidis Z2491
aaccugcaucccgucau

SEQ ID NO: 1376104 - RNA, 19 nt, Neisseria meningitidis Z2491
aaccucguucggacggcau

SEQ ID NO: 1376105 - RNA, 20 nt, Neisseria meningitidis Z2491
aaccucuaaacuuucagaua

SEQ ID NO: 1376106 - RNA, 17 nt, Neisseria meningitidis Z2491
aaccugcaccgcgucau

SEQ ID NO: 1376107 - RNA, 23 nt, Neisseria meningitidis Z2491
aaccuauccgccggcauccccgc

SEQ ID NO: 1376108 - RNA, 19 nt, Neisseria meningitidis Z2491
aaccucaaacuuucagaua

SEQ ID NO: 1376109 - RNA, 19 nt, Neisseria meningitidis Z2491
aaccucaaacuuucggaua

SEQ ID NO: 1376110 - RNA, 16 nt, Neisseria meningitidis Z2491
aaccucaaaucccguc

SEQ ID NO: 1376111 - RNA, 15 nt, Neisseria meningitidis Z2491
aaccuacauuccguc

SEQ ID NO: 1376112 - RNA, 17 nt, Neisseria meningitidis Z2491
aacacgcagccgagcag

SEQ ID NO: 1376113 - RNA, 18 nt, Neisseria meningitidis Z2491
aaguugcuugcgcggcau

SEQ ID NO: 1376114 - RNA, 13 nt, Neisseria meningitidis Z2491
aaggugcgguaag

SEQ ID NO: 1376115 - RNA, 16 nt, Neisseria meningitidis Z2491
aaguucuagauucccg

SEQ ID NO: 1376116 - RNA, 17 nt, Neisseria meningitidis Z2491
aagccacgcgccgaaua

SEQ ID NO: 1376117 - RNA, 20 nt, Neisseria meningitidis Z2491
aagccgcuucagacggcauu

SEQ ID NO: 1376118 - RNA, 13 nt, Neisseria meningitidis Z2491
aagccggcggcaa

SEQ ID NO: 1376119 - RNA, 12 nt, Neisseria meningitidis Z2491
aagcggcggcau

SEQ ID NO: 1376120 - RNA, 19 nt, Neisseria meningitidis Z2491
aaggaugggguuucagauu

SEQ ID NO: 1376121 - RNA, 16 nt, Neisseria meningitidis Z2491
aaggcaauuucucgga

SEQ ID NO: 1376122 - RNA, 18 nt, Neisseria meningitidis Z2491
aaggcgacaaagccgcag

SEQ ID NO: 1376123 - RNA, 15 nt, Neisseria meningitidis Z2491
aaggcgaggcaacgc

SEQ ID NO: 1376124 - RNA, 12 nt, Neisseria meningitidis Z2491
aaggucuggauu

SEQ ID NO: 1376125 - RNA, 13 nt, Neisseria meningitidis Z2491
aaggucuggauuc

SEQ ID NO: 1376126 - RNA, 12 nt, Neisseria meningitidis Z2491
aaggucuagauu

SEQ ID NO: 1376127 - RNA, 13 nt, Neisseria meningitidis Z2491
aaggcuucagacg

SEQ ID NO: 1376128 - RNA, 18 nt, Neisseria meningitidis Z2491
aaggcuucagacggcauu

SEQ ID NO: 1376129 - RNA, 16 nt, Neisseria meningitidis Z2491
acacgucguagccguc

SEQ ID NO: 1376130 - RNA, 14 nt, Neisseria meningitidis Z2491
acaggcggcggcau

SEQ ID NO: 1376131 - RNA, 20 nt, Neisseria meningitidis Z2491
acacggguucagacggcauc

SEQ ID NO: 1376132 - RNA, 20 nt, Neisseria meningitidis Z2491
acacccgccccgccgaucug

SEQ ID NO: 1376133 - RNA, 21 nt, Neisseria meningitidis Z2491
aauucaucgcgcugccgucga

SEQ ID NO: 1376134 - RNA, 17 nt, Neisseria meningitidis Z2491
aaugggcuucagacggc

SEQ ID NO: 1376135 - RNA, 17 nt, Neisseria meningitidis Z2491
aauguucggacggcaua

SEQ ID NO: 1376136 - RNA, 19 nt, Neisseria meningitidis Z2491
aaucacuauaccaaacggc

SEQ ID NO: 1376137 - RNA, 18 nt, Neisseria meningitidis Z2491
aaucuugaaacccgucau

SEQ ID NO: 1376138 - RNA, 21 nt, Neisseria meningitidis Z2491
aaugacggaguuucaggcggc

SEQ ID NO: 1376139 - RNA, 13 nt, Neisseria meningitidis Z2491
aaugacggcggag

SEQ ID NO: 1376140 - RNA, 18 nt, Neisseria meningitidis Z2491
aaugaaaaugccgucuga

SEQ ID NO: 1376141 - RNA, 17 nt, Neisseria meningitidis Z2491
aaugcuguucagacggc

SEQ ID NO: 1376142 - RNA, 18 nt, Neisseria meningitidis Z2491
aauggaaaugccgucuga

SEQ ID NO: 1376143 - RNA, 17 nt, Neisseria meningitidis Z2491
aaugcccgaaccgucau

SEQ ID NO: 1376144 - RNA, 18 nt, Neisseria meningitidis Z2491
acacaaaaaagccagcag

SEQ ID NO: 1376145 - RNA, 14 nt, Neisseria meningitidis Z2491
acaaggcuggauuc

SEQ ID NO: 1376146 - RNA, 12 nt, Neisseria meningitidis Z2491
acaaauucccgc

SEQ ID NO: 1376147 - RNA, 15 nt, Neisseria meningitidis Z2491
acaaaaaugccgucu

SEQ ID NO: 1376148 - RNA, 15 nt, Neisseria meningitidis Z2491
aauuucgggcaacgc

SEQ ID NO: 1376149 - RNA, 14 nt, Neisseria meningitidis Z2491
acaaaaauaccguc

SEQ ID NO: 1376150 - RNA, 17 nt, Neisseria meningitidis Z2491
acaaaaauaccgucuga

SEQ ID NO: 1376151 - RNA, 17 nt, Neisseria meningitidis Z2491
aaaacaaaaugccgucu

SEQ ID NO: 1376152 - RNA, 20 nt, Neisseria meningitidis Z2491
aaaguuugaaguucuagauu

SEQ ID NO: 1376153 - RNA, 15 nt, Neisseria meningitidis Z2491
aaaugacugaaacuc

SEQ ID NO: 1376154 - RNA, 15 nt, Neisseria meningitidis Z2491
aaaugccgccgucga

SEQ ID NO: 1376155 - RNA, 10 nt, Neisseria meningitidis Z2491
aaaugccguc

SEQ ID NO: 1376156 - RNA, 20 nt, Neisseria meningitidis Z2491
aaaugccgcaaaugccgucu

SEQ ID NO: 1376157 - RNA, 22 nt, Neisseria meningitidis Z2491
aaaugccgcaaaugccgucuga

SEQ ID NO: 1376158 - RNA, 13 nt, Neisseria meningitidis Z2491
aaaucggacggau

SEQ ID NO: 1376159 - RNA, 21 nt, Neisseria meningitidis Z2491
aaaucggcuuucagacggcau

SEQ ID NO: 1376160 - RNA, 20 nt, Neisseria meningitidis Z2491
aaauccagcaaugccgucug

SEQ ID NO: 1376161 - RNA, 19 nt, Neisseria meningitidis Z2491
aaauccuucaccaucggca

SEQ ID NO: 1376162 - RNA, 19 nt, Neisseria meningitidis Z2491
aacaaaaugccgccgucga

SEQ ID NO: 1376163 - RNA, 12 nt, Neisseria meningitidis Z2491
aaauuucuagaa

SEQ ID NO: 1376164 - RNA, 18 nt, Neisseria meningitidis Z2491
aaauguucagacggcauu

SEQ ID NO: 1376165 - RNA, 21 nt, Neisseria meningitidis Z2491
aaaccguauauuucccgucug

SEQ ID NO: 1376166 - RNA, 20 nt, Neisseria meningitidis Z2491
aaaccguguuucagacggca

SEQ ID NO: 1376167 - RNA, 20 nt, Neisseria meningitidis Z2491
aaaccguuucagacggcauu

SEQ ID NO: 1376168 - RNA, 19 nt, Neisseria meningitidis Z2491
aaaccuguuucagacggca

SEQ ID NO: 1376169 - RNA, 20 nt, Neisseria meningitidis Z2491
aaaccuguuucagacggcau

SEQ ID NO: 1376170 - RNA, 17 nt, Neisseria meningitidis Z2491
aaaccuuucagacggca

SEQ ID NO: 1376171 - RNA, 19 nt, Neisseria meningitidis Z2491
aaaccugcaccacgucauu

SEQ ID NO: 1376172 - RNA, 18 nt, Neisseria meningitidis Z2491
aaaccaccgccaucagga

SEQ ID NO: 1376173 - RNA, 17 nt, Neisseria meningitidis Z2491
aaaccgcucugccguca

SEQ ID NO: 1376174 - RNA, 23 nt, Neisseria meningitidis Z2491
aaaccgcucugccgucauucccg

SEQ ID NO: 1376175 - RNA, 20 nt, Neisseria meningitidis Z2491
aaaccgacccugccgucuga

SEQ ID NO: 1376176 - RNA, 16 nt, Neisseria meningitidis Z2491
aaacccuccgccucug

SEQ ID NO: 1376177 - RNA, 20 nt, Neisseria meningitidis Z2491
aaaccgaacagaccggauuc

SEQ ID NO: 1376178 - RNA, 22 nt, Neisseria meningitidis Z2491
aaacagguuucagacggcauuu

SEQ ID NO: 1376179 - RNA, 20 nt, Neisseria meningitidis Z2491
aaacaggcuucagacggcau

SEQ ID NO: 1376180 - RNA, 21 nt, Neisseria meningitidis Z2491
aaacaggcuucagacggcauu

SEQ ID NO: 1376181 - RNA, 21 nt, Neisseria meningitidis Z2491
aaacaaguuuuccggcagcuu

SEQ ID NO: 1376182 - RNA, 18 nt, Neisseria meningitidis Z2491
aaacaaugccgucugaaa

SEQ ID NO: 1376183 - RNA, 19 nt, Neisseria meningitidis Z2491
aaacaaaaaugccgucuga

SEQ ID NO: 1376184 - RNA, 16 nt, Neisseria meningitidis Z2491
aaaauugcugcaucac

SEQ ID NO: 1376185 - RNA, 14 nt, Neisseria meningitidis Z2491
aaagccggcggcaa

SEQ ID NO: 1376186 - RNA, 22 nt, Neisseria meningitidis Z2491
aaagccagcagcagcccgucua

SEQ ID NO: 1376187 - RNA, 13 nt, Neisseria meningitidis Z2491
aaaggucuagauu

SEQ ID NO: 1376188 - RNA, 18 nt, Neisseria meningitidis Z2491
aaaggucuagauucccgc

SEQ ID NO: 1376189 - RNA, 18 nt, Neisseria meningitidis Z2491
aaaggucuggauucccac

SEQ ID NO: 1376190 - RNA, 21 nt, Neisseria meningitidis Z2491
aaaguuuagagguucuagauu

SEQ ID NO: 1376191 - RNA, 21 nt, Neisseria meningitidis Z2491
aaaggcuuugcuguucgcggc

SEQ ID NO: 1376192 - RNA, 15 nt, Neisseria meningitidis Z2491
aaagggaacggcauc

SEQ ID NO: 1376193 - RNA, 20 nt, Neisseria meningitidis Z2491
aaaggcuucagacggcauuu

SEQ ID NO: 1376194 - RNA, 20 nt, Neisseria meningitidis Z2491
aaagcggcaaugccgucuga

SEQ ID NO: 1376195 - RNA, 14 nt, Neisseria meningitidis Z2491
aaagcgucgcccua

SEQ ID NO: 1376196 - RNA, 16 nt, Neisseria meningitidis Z2491
aaagaggcauaccguu

SEQ ID NO: 1376197 - RNA, 23 nt, Neisseria meningitidis Z2491
aaacggcaggaacacggcggcac

SEQ ID NO: 1376198 - RNA, 12 nt, Neisseria meningitidis Z2491
aaacggcaguuu

SEQ ID NO: 1376199 - RNA, 13 nt, Neisseria meningitidis Z2491
aaacgccguccga

SEQ ID NO: 1376200 - RNA, 12 nt, Neisseria meningitidis Z2491
aaacgccgucug

SEQ ID NO: 1376201 - RNA, 13 nt, Neisseria meningitidis Z2491
aaacgccgucuga

SEQ ID NO: 1376202 - RNA, 20 nt, Neisseria meningitidis Z2491
aaacgcgauuuucgacgcau

SEQ ID NO: 1376203 - RNA, 21 nt, Neisseria meningitidis Z2491
aaacgcggugaggucgucuga

SEQ ID NO: 1376204 - RNA, 16 nt, Neisseria meningitidis Z2491
aaaacauaugccgucu

SEQ ID NO: 1376205 - RNA, 23 nt, Neisseria meningitidis Z2491
aaaaccuuucccguuucagacgg

SEQ ID NO: 1376206 - RNA, 14 nt, Neisseria meningitidis Z2491
aaaacaaacaggca

SEQ ID NO: 1376207 - RNA, 15 nt, Neisseria meningitidis Z2491
aaaacaaugccgucu

SEQ ID NO: 1376208 - RNA, 20 nt, Neisseria meningitidis Z2491
aaaacgccaauuuguauuca

SEQ ID NO: 1376209 - RNA, 17 nt, Neisseria meningitidis Z2491
aaaacuaagccguuuca

SEQ ID NO: 1376210 - RNA, 15 nt, Neisseria meningitidis Z2491
aaaaauaccgucuga

SEQ ID NO: 1376211 - RNA, 12 nt, Neisseria meningitidis Z2491
aaaaaugccguc

SEQ ID NO: 1376212 - RNA, 14 nt, Neisseria meningitidis Z2491
aaaaagccguccga

SEQ ID NO: 1376213 - RNA, 22 nt, Neisseria meningitidis Z2491
aaaaacggcacggcgcaggcaa

SEQ ID NO: 1376214 - RNA, 17 nt, Neisseria meningitidis Z2491
aaaaagaugccgucuga

SEQ ID NO: 1376215 - RNA, 19 nt, Neisseria meningitidis Z2491
aaaaagaugccgucugaaa

SEQ ID NO: 1376216 - RNA, 15 nt, Neisseria meningitidis Z2491
aaaaacgccguccga

SEQ ID NO: 1376217 - RNA, 12 nt, Neisseria meningitidis Z2491
aaaaugccgucu

SEQ ID NO: 1376218 - RNA, 14 nt, Neisseria meningitidis Z2491
aaaaugccgucuga

SEQ ID NO: 1376219 - RNA, 19 nt, Neisseria meningitidis Z2491
aaaaugccgucugaaaccc

SEQ ID NO: 1376220 - RNA, 14 nt, Neisseria meningitidis Z2491
aaaagaugccgucu

SEQ ID NO: 1376221 - RNA, 19 nt, Neisseria meningitidis Z2491
aaaauaccgucugaaaccg

SEQ ID NO: 1376222 - RNA, 21 nt, Neisseria meningitidis Z2491
aaaauauuugcacaucaggcg

SEQ ID NO: 1376223 - RNA, 13 nt, Neisseria meningitidis Z2491
uuuuuucaagccu

SEQ ID NO: 1376224 - RNA, 12 nt, Neisseria meningitidis Z2491
uuuuuuccuguu

SEQ ID NO: 1376225 - RNA, 13 nt, Neisseria meningitidis Z2491
uuuuuucaggccu

SEQ ID NO: 1376226 - RNA, 18 nt, Neisseria meningitidis Z2491
uuuuuuccgauaaauucc

SEQ ID NO: 1376227 - RNA, 18 nt, Neisseria meningitidis Z2491
uuuuuuccgguaaauacc

SEQ ID NO: 1376228 - RNA, 16 nt, Neisseria meningitidis Z2491
uuuuguucauccacua

SEQ ID NO: 1376229 - RNA, 22 nt, Neisseria meningitidis Z2491
uuuugccguguuggguucuaga

SEQ ID NO: 1376230 - RNA, 21 nt, Neisseria meningitidis Z2491
uuuugccgcgaccgaaaugcc

SEQ ID NO: 1376231 - RNA, 13 nt, Neisseria meningitidis Z2491
uuuuucagcggcg

SEQ ID NO: 1376232 - RNA, 20 nt, Neisseria meningitidis Z2491
uuuuucagauuauuuauuaa

SEQ ID NO: 1376233 - RNA, 12 nt, Neisseria meningitidis Z2491
uuuuucaaagcc

SEQ ID NO: 1376234 - RNA, 20 nt, Neisseria meningitidis Z2491
uuuuuacacaauucccaccg

SEQ ID NO: 1376235 - RNA, 15 nt, Neisseria meningitidis Z2491
uuuuuaauuucuucu

SEQ ID NO: 1376236 - RNA, 15 nt, Neisseria meningitidis Z2491
uuuuuaaacaacaaa

SEQ ID NO: 1376237 - RNA, 15 nt, Neisseria meningitidis Z2491
uuuuccguugccugc

SEQ ID NO: 1376238 - RNA, 19 nt, Neisseria meningitidis Z2491
uuuuccgguaaauuccuaa

SEQ ID NO: 1376239 - RNA, 17 nt, Neisseria meningitidis Z2491
uuuucaugguguuuccu

SEQ ID NO: 1376240 - RNA, 15 nt, Neisseria meningitidis Z2491
uuuuccgauaaauuc

SEQ ID NO: 1376241 - RNA, 21 nt, Neisseria meningitidis Z2491
uuuuccuacuuuuugcucaau

SEQ ID NO: 1376242 - RNA, 18 nt, Neisseria meningitidis Z2491
uuuuccuuucugacaaaa

SEQ ID NO: 1376243 - RNA, 18 nt, Neisseria meningitidis Z2491
uuuuccucgauuugaaau

SEQ ID NO: 1376244 - RNA, 12 nt, Neisseria meningitidis Z2491
uuuucaaaaugc

SEQ ID NO: 1376245 - RNA, 13 nt, Neisseria meningitidis Z2491
uuuucaaaaugca

SEQ ID NO: 1376246 - RNA, 20 nt, Neisseria meningitidis Z2491
uuuucaaaaugcaaaacuuu

SEQ ID NO: 1376247 - RNA, 20 nt, Neisseria meningitidis Z2491
uuuucaaacauuacugaaau

SEQ ID NO: 1376248 - RNA, 13 nt, Neisseria meningitidis Z2491
uuuucacggggaa

SEQ ID NO: 1376249 - RNA, 15 nt, Neisseria meningitidis Z2491
uuuucgauaugaaaa

SEQ ID NO: 1376250 - RNA, 13 nt, Neisseria meningitidis Z2491
uuuucgccagcau

SEQ ID NO: 1376251 - RNA, 17 nt, Neisseria meningitidis Z2491
uuuucugaaaaauuuau

SEQ ID NO: 1376252 - RNA, 10 nt, Neisseria meningitidis Z2491
uuuucucuau

SEQ ID NO: 1376253 - RNA, 15 nt, Neisseria meningitidis Z2491
uuuucugcucuucgc

SEQ ID NO: 1376254 - RNA, 23 nt, Neisseria meningitidis Z2491
uuuucugaauugcuugagauggu

SEQ ID NO: 1376255 - RNA, 16 nt, Neisseria meningitidis Z2491
uuuugcccgauuuaaa

SEQ ID NO: 1376256 - RNA, 12 nt, Neisseria meningitidis Z2491
uuuugcagguag

SEQ ID NO: 1376257 - RNA, 14 nt, Neisseria meningitidis Z2491
uuuugccagcgggu

SEQ ID NO: 1376258 - RNA, 21 nt, Neisseria meningitidis Z2491
uuuugcagcccugauaaaaaa

SEQ ID NO: 1376259 - RNA, 11 nt, Neisseria meningitidis Z2491
uuuugacaaaa

SEQ ID NO: 1376260 - RNA, 14 nt, Neisseria meningitidis Z2491
uuuugacaaaauca

SEQ ID NO: 1376261 - RNA, 13 nt, Neisseria meningitidis Z2491
uucgugcagauaa

SEQ ID NO: 1376262 - RNA, 22 nt, Neisseria meningitidis Z2491
uucgugauucccgagaaaacag

SEQ ID NO: 1376263 - RNA, 16 nt, Neisseria meningitidis Z2491
uucgucgucuuuggca

SEQ ID NO: 1376264 - RNA, 12 nt, Neisseria meningitidis Z2491
uucguccuugcu

SEQ ID NO: 1376265 - RNA, 14 nt, Neisseria meningitidis Z2491
uucgucgccuuguc

SEQ ID NO: 1376266 - RNA, 20 nt, Neisseria meningitidis Z2491
uucuaacaaauaauguucaa

SEQ ID NO: 1376267 - RNA, 21 nt, Neisseria meningitidis Z2491
uucuaaauagcugaaacucaa

SEQ ID NO: 1376268 - RNA, 14 nt, Neisseria meningitidis Z2491
uucggauauuuccg

SEQ ID NO: 1376269 - RNA, 23 nt, Neisseria meningitidis Z2491
uucggacggcauuaaaauuuggc

SEQ ID NO: 1376270 - RNA, 22 nt, Neisseria meningitidis Z2491
uucggcaaggucguauuucgcu

SEQ ID NO: 1376271 - RNA, 23 nt, Neisseria meningitidis Z2491
uucggcaaaauccgcaaacggca

SEQ ID NO: 1376272 - RNA, 23 nt, Neisseria meningitidis Z2491
uucgucaugcaccugcauaauca

SEQ ID NO: 1376273 - RNA, 14 nt, Neisseria meningitidis Z2491
uucguaauuuuucu

SEQ ID NO: 1376274 - RNA, 12 nt, Neisseria meningitidis Z2491
uucguccagcag

SEQ ID NO: 1376275 - RNA, 14 nt, Neisseria meningitidis Z2491
uucuauaaagccua

SEQ ID NO: 1376276 - RNA, 22 nt, Neisseria meningitidis Z2491
uucuauaaagccuaaauacaaa

SEQ ID NO: 1376277 - RNA, 15 nt, Neisseria meningitidis Z2491
uucuagauucccgcc

SEQ ID NO: 1376278 - RNA, 18 nt, Neisseria meningitidis Z2491
uucuagauucccgccugc

SEQ ID NO: 1376279 - RNA, 21 nt, Neisseria meningitidis Z2491
uucuugaggcauugaaauucc

SEQ ID NO: 1376280 - RNA, 23 nt, Neisseria meningitidis Z2491
uucugcugcgaaguaccguuuuu

SEQ ID NO: 1376281 - RNA, 20 nt, Neisseria meningitidis Z2491
uucucuaaggugcugaagca

SEQ ID NO: 1376282 - RNA, 19 nt, Neisseria meningitidis Z2491
uucucgauauggcaggcau

SEQ ID NO: 1376283 - RNA, 18 nt, Neisseria meningitidis Z2491
uucugacagcauuuccac

SEQ ID NO: 1376284 - RNA, 14 nt, Neisseria meningitidis Z2491
uugcaauaacauag

SEQ ID NO: 1376285 - RNA, 20 nt, Neisseria meningitidis Z2491
uugcaagcaguugaaaucaa

SEQ ID NO: 1376286 - RNA, 22 nt, Neisseria meningitidis Z2491
uugcaagcaguugaaaucaaca

SEQ ID NO: 1376287 - RNA, 20 nt, Neisseria meningitidis Z2491
uugaugaugucgaaggcgcg

SEQ ID NO: 1376288 - RNA, 19 nt, Neisseria meningitidis Z2491
uugaguuucagucauuccc

SEQ ID NO: 1376289 - RNA, 21 nt, Neisseria meningitidis Z2491
uugaguuuccgucauuucuga

SEQ ID NO: 1376290 - RNA, 13 nt, Neisseria meningitidis Z2491
uugaguuucgguc

SEQ ID NO: 1376291 - RNA, 13 nt, Neisseria meningitidis Z2491
uugagcauaaaau

SEQ ID NO: 1376292 - RNA, 12 nt, Neisseria meningitidis Z2491
uugagcguucag

SEQ ID NO: 1376293 - RNA, 20 nt, Neisseria meningitidis Z2491
uugauauggcguugacaaac

SEQ ID NO: 1376294 - RNA, 16 nt, Neisseria meningitidis Z2491
uucuugucaaaccaac

SEQ ID NO: 1376295 - RNA, 21 nt, Neisseria meningitidis Z2491
uucuuugaaaacagguuuaag

SEQ ID NO: 1376296 - RNA, 24 nt, Neisseria meningitidis Z2491
uucuuugacggcgggcaggcggcu

SEQ ID NO: 1376297 - RNA, 19 nt, Neisseria meningitidis Z2491
uucuugcaaaauagaaaac

SEQ ID NO: 1376298 - RNA, 14 nt, Neisseria meningitidis Z2491
uugaaccauuucca

SEQ ID NO: 1376299 - RNA, 21 nt, Neisseria meningitidis Z2491
uugaaccagggauuuuucaaa

SEQ ID NO: 1376300 - RNA, 19 nt, Neisseria meningitidis Z2491
uugaaacggacaacggcac

SEQ ID NO: 1376301 - RNA, 20 nt, Neisseria meningitidis Z2491
uugaaaaugccgucugaaac

SEQ ID NO: 1376302 - RNA, 21 nt, Neisseria meningitidis Z2491
uugacaaacauccauaucuuu

SEQ ID NO: 1376303 - RNA, 13 nt, Neisseria meningitidis Z2491
uugaauuuuauug

SEQ ID NO: 1376304 - RNA, 19 nt, Neisseria meningitidis Z2491
uugagaaaucugugaaaau

SEQ ID NO: 1376305 - RNA, 22 nt, Neisseria meningitidis Z2491
uugagaaaucugugaaaaucag

SEQ ID NO: 1376306 - RNA, 19 nt, Neisseria meningitidis Z2491
uugacuuuggaacaaaaaa

SEQ ID NO: 1376307 - RNA, 23 nt, Neisseria meningitidis Z2491
uugacggacggcggcagauaaau

SEQ ID NO: 1376308 - RNA, 13 nt, Neisseria meningitidis Z2491
uuguucaaauauc

SEQ ID NO: 1376309 - RNA, 21 nt, Neisseria meningitidis Z2491
uuguuggaaaaguacaaaaug

SEQ ID NO: 1376310 - RNA, 22 nt, Neisseria meningitidis Z2491
uuguuucagacggcauuugacu

SEQ ID NO: 1376311 - RNA, 18 nt, Neisseria meningitidis Z2491
uugugaucgacugcagua

SEQ ID NO: 1376312 - RNA, 15 nt, Neisseria meningitidis Z2491
uugugggaauccaga

SEQ ID NO: 1376313 - RNA, 17 nt, Neisseria meningitidis Z2491
uuguccugauuuaaauu

SEQ ID NO: 1376314 - RNA, 18 nt, Neisseria meningitidis Z2491
uuguccugauuuaaauuu

SEQ ID NO: 1376315 - RNA, 21 nt, Neisseria meningitidis Z2491
uugucaaacgggguugccugc

SEQ ID NO: 1376316 - RNA, 15 nt, Neisseria meningitidis Z2491
uuguauuuuuauuau

SEQ ID NO: 1376317 - RNA, 16 nt, Neisseria meningitidis Z2491
uuguauuuuuauuauu

SEQ ID NO: 1376318 - RNA, 22 nt, Neisseria meningitidis Z2491
uuguaaaggaaguuuugucaaa

SEQ ID NO: 1376319 - RNA, 13 nt, Neisseria meningitidis Z2491
uuuaccagaaaaa

SEQ ID NO: 1376320 - RNA, 16 nt, Neisseria meningitidis Z2491
uuuaccagaaaaaaca

SEQ ID NO: 1376321 - RNA, 16 nt, Neisseria meningitidis Z2491
uuuaagacguggugcu

SEQ ID NO: 1376322 - RNA, 11 nt, Neisseria meningitidis Z2491
uuuaaauuuaa

SEQ ID NO: 1376323 - RNA, 17 nt, Neisseria meningitidis Z2491
uuuaaauuuaauccacu

SEQ ID NO: 1376324 - RNA, 15 nt, Neisseria meningitidis Z2491
uuuaaauuuaauuca

SEQ ID NO: 1376325 - RNA, 11 nt, Neisseria meningitidis Z2491
uuuaaauaaau

SEQ ID NO: 1376326 - RNA, 22 nt, Neisseria meningitidis Z2491
uuuaaacacgggguuuaucuga

SEQ ID NO: 1376327 - RNA, 18 nt, Neisseria meningitidis Z2491
uuuaaacacuucuucauu

SEQ ID NO: 1376328 - RNA, 17 nt, Neisseria meningitidis Z2491
uuuaaaaauuccuguuu

SEQ ID NO: 1376329 - RNA, 23 nt, Neisseria meningitidis Z2491
uuuaaaaauuccuguuuuuauag

SEQ ID NO: 1376330 - RNA, 15 nt, Neisseria meningitidis Z2491
uuggucgcugccuuu

SEQ ID NO: 1376331 - RNA, 13 nt, Neisseria meningitidis Z2491
uugguaaaaaaau

SEQ ID NO: 1376332 - RNA, 20 nt, Neisseria meningitidis Z2491
uugguugucaggugcgguaa

SEQ ID NO: 1376333 - RNA, 22 nt, Neisseria meningitidis Z2491
uugguuuauuuuugggaaguaa

SEQ ID NO: 1376334 - RNA, 18 nt, Neisseria meningitidis Z2491
uugguuugaaagagaaaa

SEQ ID NO: 1376335 - RNA, 16 nt, Neisseria meningitidis Z2491
uuggcuguuuucuguu

SEQ ID NO: 1376336 - RNA, 16 nt, Neisseria meningitidis Z2491
uuggcuuuuuucuguu

SEQ ID NO: 1376337 - RNA, 11 nt, Neisseria meningitidis Z2491
uugggaaucaa

SEQ ID NO: 1376338 - RNA, 17 nt, Neisseria meningitidis Z2491
uugcuugagauggucaa

SEQ ID NO: 1376339 - RNA, 18 nt, Neisseria meningitidis Z2491
uugcugcuguauuuuucc

SEQ ID NO: 1376340 - RNA, 21 nt, Neisseria meningitidis Z2491
uugcuggaagcauugaccacu

SEQ ID NO: 1376341 - RNA, 15 nt, Neisseria meningitidis Z2491
uuggcaauuuucuuc

SEQ ID NO: 1376342 - RNA, 17 nt, Neisseria meningitidis Z2491
uuggauuugucuucaaa

SEQ ID NO: 1376343 - RNA, 19 nt, Neisseria meningitidis Z2491
uuggaagccucccaauguu

SEQ ID NO: 1376344 - RNA, 16 nt, Neisseria meningitidis Z2491
uugccagccugcccau

SEQ ID NO: 1376345 - RNA, 20 nt, Neisseria meningitidis Z2491
uugcauaaucaauuaaaaac

SEQ ID NO: 1376346 - RNA, 22 nt, Neisseria meningitidis Z2491
uugcauaaucaauuaaaaacaa

SEQ ID NO: 1376347 - RNA, 11 nt, Neisseria meningitidis Z2491
uugcaggaauc

SEQ ID NO: 1376348 - RNA, 17 nt, Neisseria meningitidis Z2491
uugcccacgcacccaaa

SEQ ID NO: 1376349 - RNA, 23 nt, Neisseria meningitidis Z2491
uugccgucugaagcguauuucua

SEQ ID NO: 1376350 - RNA, 15 nt, Neisseria meningitidis Z2491
uugccguugaugacg

SEQ ID NO: 1376351 - RNA, 14 nt, Neisseria meningitidis Z2491
uugccugauccaaa

SEQ ID NO: 1376352 - RNA, 18 nt, Neisseria meningitidis Z2491
uugcgcagccugcagcag

SEQ ID NO: 1376353 - RNA, 23 nt, Neisseria meningitidis Z2491
uugcgcagccugcagcagagcug

SEQ ID NO: 1376354 - RNA, 14 nt, Neisseria meningitidis Z2491
uugcggaaucaaac

SEQ ID NO: 1376355 - RNA, 15 nt, Neisseria meningitidis Z2491
uuccuccgcaaacac

SEQ ID NO: 1376356 - RNA, 22 nt, Neisseria meningitidis Z2491
uuccuaaucgguuuguauguuu

SEQ ID NO: 1376357 - RNA, 12 nt, Neisseria meningitidis Z2491
uuccuacuuuuu

SEQ ID NO: 1376358 - RNA, 17 nt, Neisseria meningitidis Z2491
uuccuacuuuuugcuca

SEQ ID NO: 1376359 - RNA, 20 nt, Neisseria meningitidis Z2491
uuccguacuaucuguacugu

SEQ ID NO: 1376360 - RNA, 19 nt, Neisseria meningitidis Z2491
uuccguguccugcuggcag

SEQ ID NO: 1376361 - RNA, 15 nt, Neisseria meningitidis Z2491
uuccguucggaacac

SEQ ID NO: 1376362 - RNA, 23 nt, Neisseria meningitidis Z2491
uuccguucggaacacaaaaaacu

SEQ ID NO: 1376363 - RNA, 22 nt, Neisseria meningitidis Z2491
uuccgucaggcacgaagcccuc

SEQ ID NO: 1376364 - RNA, 21 nt, Neisseria meningitidis Z2491
uuccuaauauugagcaaaaag

SEQ ID NO: 1376365 - RNA, 16 nt, Neisseria meningitidis Z2491
uuccuaaccgaaaaaa

SEQ ID NO: 1376366 - RNA, 20 nt, Neisseria meningitidis Z2491
uuccuaaccgaaaaaauaau

SEQ ID NO: 1376367 - RNA, 18 nt, Neisseria meningitidis Z2491
uuccuaaaacuuaaaauu

SEQ ID NO: 1376368 - RNA, 15 nt, Neisseria meningitidis Z2491
uuccugcgccaaugc

SEQ ID NO: 1376369 - RNA, 13 nt, Neisseria meningitidis Z2491
uuccugcagguag

SEQ ID NO: 1376370 - RNA, 19 nt, Neisseria meningitidis Z2491
uuccugcuguugaaaaugc

SEQ ID NO: 1376371 - RNA, 14 nt, Neisseria meningitidis Z2491
uuccugccacauuu

SEQ ID NO: 1376372 - RNA, 19 nt, Neisseria meningitidis Z2491
uuccuguaaaaacaaaaaa

SEQ ID NO: 1376373 - RNA, 23 nt, Neisseria meningitidis Z2491
uuccuguucaaggcgacagccgc

SEQ ID NO: 1376374 - RNA, 23 nt, Neisseria meningitidis Z2491
uuccuuauaaggcagggagcgga

SEQ ID NO: 1376375 - RNA, 18 nt, Neisseria meningitidis Z2491
uuccuuuaaacucuuaaa

SEQ ID NO: 1376376 - RNA, 13 nt, Neisseria meningitidis Z2491
uuccuuuuuaaag

SEQ ID NO: 1376377 - RNA, 20 nt, Neisseria meningitidis Z2491
uuccuuuuuaaagguuugca

SEQ ID NO: 1376378 - RNA, 21 nt, Neisseria meningitidis Z2491
uuccuuucugacaaaaaugcc

SEQ ID NO: 1376379 - RNA, 12 nt, Neisseria meningitidis Z2491
uuccuucugaaa

SEQ ID NO: 1376380 - RNA, 15 nt, Neisseria meningitidis Z2491
uucgcaaucuucaaa

SEQ ID NO: 1376381 - RNA, 18 nt, Neisseria meningitidis Z2491
uucgcaaccguugcagcc

SEQ ID NO: 1376382 - RNA, 15 nt, Neisseria meningitidis Z2491
uucgauugccaaggu

SEQ ID NO: 1376383 - RNA, 19 nt, Neisseria meningitidis Z2491
uucgaugugguagagaaaa

SEQ ID NO: 1376384 - RNA, 21 nt, Neisseria meningitidis Z2491
uucgcgguuuuccgcuuuuuu

SEQ ID NO: 1376385 - RNA, 20 nt, Neisseria meningitidis Z2491
uucgccuuaaaaaacaaaca

SEQ ID NO: 1376386 - RNA, 17 nt, Neisseria meningitidis Z2491
uucggaacacaaaaaac

SEQ ID NO: 1376387 - RNA, 22 nt, Neisseria meningitidis Z2491
uucggaagggguuacgccccuc

SEQ ID NO: 1376388 - RNA, 21 nt, Neisseria meningitidis Z2491
uucgcccaauacgaauaaucc

SEQ ID NO: 1376389 - RNA, 15 nt, Neisseria meningitidis Z2491
uucgcaguuggaaca

SEQ ID NO: 1376390 - RNA, 19 nt, Neisseria meningitidis Z2491
uuccgauaaauuccuaaaa

SEQ ID NO: 1376391 - RNA, 22 nt, Neisseria meningitidis Z2491
uuccgauaaggcaagcguucac

SEQ ID NO: 1376392 - RNA, 22 nt, Neisseria meningitidis Z2491
uuccgauacgcucggcguuuuu

SEQ ID NO: 1376393 - RNA, 18 nt, Neisseria meningitidis Z2491
uuccgacaaauuccuaaa

SEQ ID NO: 1376394 - RNA, 19 nt, Neisseria meningitidis Z2491
uuccgacaaauuccuaaaa

SEQ ID NO: 1376395 - RNA, 20 nt, Neisseria meningitidis Z2491
uuccgaaaucauccacagcc

SEQ ID NO: 1376396 - RNA, 23 nt, Neisseria meningitidis Z2491
uuccgacagccuacuugcccgcc

SEQ ID NO: 1376397 - RNA, 23 nt, Neisseria meningitidis Z2491
uuccgacaggucgggguggucuu

SEQ ID NO: 1376398 - RNA, 21 nt, Neisseria meningitidis Z2491
uuccgcgccgauguuuuccug

SEQ ID NO: 1376399 - RNA, 20 nt, Neisseria meningitidis Z2491
uucccgcgcaggcgggaauc

SEQ ID NO: 1376400 - RNA, 20 nt, Neisseria meningitidis Z2491
uucccgcgaaagcgggaauc

SEQ ID NO: 1376401 - RNA, 19 nt, Neisseria meningitidis Z2491
uucccuugcaaauaauuga

SEQ ID NO: 1376402 - RNA, 22 nt, Neisseria meningitidis Z2491
uucccuugcaaauaauugaaau

SEQ ID NO: 1376403 - RNA, 22 nt, Neisseria meningitidis Z2491
uucccuugcaagcaguugaaau

SEQ ID NO: 1376404 - RNA, 16 nt, Neisseria meningitidis Z2491
uuccgaagcgguuuuu

SEQ ID NO: 1376405 - RNA, 22 nt, Neisseria meningitidis Z2491
uucccucucccgugggagaggg

SEQ ID NO: 1376406 - RNA, 21 nt, Neisseria meningitidis Z2491
uuccccgguauaaaaaagauu

SEQ ID NO: 1376407 - RNA, 15 nt, Neisseria meningitidis Z2491
uucccgaaauuccaa

SEQ ID NO: 1376408 - RNA, 13 nt, Neisseria meningitidis Z2491
uucccgcaaaagc

SEQ ID NO: 1376409 - RNA, 20 nt, Neisseria meningitidis Z2491
uucccgcaaaagcgggaauc

SEQ ID NO: 1376410 - RNA, 20 nt, Neisseria meningitidis Z2491
uucccacgaaagugggaauc

SEQ ID NO: 1376411 - RNA, 13 nt, Neisseria meningitidis Z2491
uuccauuugagcc

SEQ ID NO: 1376412 - RNA, 23 nt, Neisseria meningitidis Z2491
uuccaugcuuaaacagcacugcc

SEQ ID NO: 1376413 - RNA, 20 nt, Neisseria meningitidis Z2491
uuccauaccguuuggcggca

SEQ ID NO: 1376414 - RNA, 17 nt, Neisseria meningitidis Z2491
uuccacuaaaugcucac

SEQ ID NO: 1376415 - RNA, 13 nt, Neisseria meningitidis Z2491
uuccaauuccugu

SEQ ID NO: 1376416 - RNA, 22 nt, Neisseria meningitidis Z2491
uuccaauucgcugaauuugaaa

SEQ ID NO: 1376417 - RNA, 16 nt, Neisseria meningitidis Z2491
uuccaauacauuuuug

SEQ ID NO: 1376418 - RNA, 18 nt, Neisseria meningitidis Z2491
uuccaacucgacauuuuc

SEQ ID NO: 1376419 - RNA, 22 nt, Neisseria meningitidis Z2491
uuccaacucuacggguuugccg

SEQ ID NO: 1376420 - RNA, 20 nt, Neisseria meningitidis Z2491
uuccaagauggcgagcgauu

SEQ ID NO: 1376421 - RNA, 23 nt, Neisseria meningitidis Z2491
uuccaacccuccgccgcacaaac

SEQ ID NO: 1376422 - RNA, 19 nt, Neisseria meningitidis Z2491
uuccaagccgcauuguccc

SEQ ID NO: 1376423 - RNA, 12 nt, Neisseria meningitidis Z2491
uucacuuccaac

SEQ ID NO: 1376424 - RNA, 17 nt, Neisseria meningitidis Z2491
uucaccgugauuuuacc

SEQ ID NO: 1376425 - RNA, 21 nt, Neisseria meningitidis Z2491
uucagauaaucuuugaauauu

SEQ ID NO: 1376426 - RNA, 23 nt, Neisseria meningitidis Z2491
uucagauugugggcauuaucagu

SEQ ID NO: 1376427 - RNA, 16 nt, Neisseria meningitidis Z2491
uucagcaauaaaauaa

SEQ ID NO: 1376428 - RNA, 13 nt, Neisseria meningitidis Z2491
uucacuuggugcu

SEQ ID NO: 1376429 - RNA, 18 nt, Neisseria meningitidis Z2491
uucacuuggugcuucagc

SEQ ID NO: 1376430 - RNA, 14 nt, Neisseria meningitidis Z2491
uucagacggcauca

SEQ ID NO: 1376431 - RNA, 18 nt, Neisseria meningitidis Z2491
uucagacggcauccgcuu

SEQ ID NO: 1376432 - RNA, 17 nt, Neisseria meningitidis Z2491
uucagacggcauuugac

SEQ ID NO: 1376433 - RNA, 17 nt, Neisseria meningitidis Z2491
uucagacggcauuuguc

SEQ ID NO: 1376434 - RNA, 17 nt, Neisseria meningitidis Z2491
uucagacggcauuuugc

SEQ ID NO: 1376435 - RNA, 22 nt, Neisseria meningitidis Z2491
uucagacggcauuuuguuuuua

SEQ ID NO: 1376436 - RNA, 17 nt, Neisseria meningitidis Z2491
uucagacggcauuuuua

SEQ ID NO: 1376437 - RNA, 17 nt, Neisseria meningitidis Z2491
uucagacggcauuuuug

SEQ ID NO: 1376438 - RNA, 21 nt, Neisseria meningitidis Z2491
uucagacggccuuuuugcuuu

SEQ ID NO: 1376439 - RNA, 21 nt, Neisseria meningitidis Z2491
uucagacggcacuuucauuca

SEQ ID NO: 1376440 - RNA, 12 nt, Neisseria meningitidis Z2491
uucagacaggau

SEQ ID NO: 1376441 - RNA, 18 nt, Neisseria meningitidis Z2491
uucaauaccuugagccaa

SEQ ID NO: 1376442 - RNA, 21 nt, Neisseria meningitidis Z2491
uucaagccuucccguuccaca

SEQ ID NO: 1376443 - RNA, 16 nt, Neisseria meningitidis Z2491
uucaauccguugcucu

SEQ ID NO: 1376444 - RNA, 17 nt, Neisseria meningitidis Z2491
uucaauauacugcucgc

SEQ ID NO: 1376445 - RNA, 13 nt, Neisseria meningitidis Z2491
uucaaucaaugug

SEQ ID NO: 1376446 - RNA, 18 nt, Neisseria meningitidis Z2491
uucaauuucaacugauug

SEQ ID NO: 1376447 - RNA, 16 nt, Neisseria meningitidis Z2491
uucacaaaaacagaaa

SEQ ID NO: 1376448 - RNA, 20 nt, Neisseria meningitidis Z2491
uucacaaaaacagaaaacca

SEQ ID NO: 1376449 - RNA, 16 nt, Neisseria meningitidis Z2491
uucauggcguucaaca

SEQ ID NO: 1376450 - RNA, 22 nt, Neisseria meningitidis Z2491
uucaugcggcgggcuuggaaau

SEQ ID NO: 1376451 - RNA, 17 nt, Neisseria meningitidis Z2491
uucauuaaagugccauu

SEQ ID NO: 1376452 - RNA, 17 nt, Neisseria meningitidis Z2491
uucauuauccgcccguu

SEQ ID NO: 1376453 - RNA, 18 nt, Neisseria meningitidis Z2491
uucauuucuagauuccca

SEQ ID NO: 1376454 - RNA, 18 nt, Neisseria meningitidis Z2491
uucauuucuggauuccca

SEQ ID NO: 1376455 - RNA, 15 nt, Neisseria meningitidis Z2491
uucaucauuccuaca

SEQ ID NO: 1376456 - RNA, 16 nt, Neisseria meningitidis Z2491
uucaucauaugcauca

SEQ ID NO: 1376457 - RNA, 18 nt, Neisseria meningitidis Z2491
uucaguuguuuuacugau

SEQ ID NO: 1376458 - RNA, 22 nt, Neisseria meningitidis Z2491
uucagugcugcgcccaaagcgg

SEQ ID NO: 1376459 - RNA, 13 nt, Neisseria meningitidis Z2491
uucauaaguuucc

SEQ ID NO: 1376460 - RNA, 19 nt, Neisseria meningitidis Z2491
uucauacacagccaaaaaa

SEQ ID NO: 1376461 - RNA, 22 nt, Neisseria meningitidis Z2491
uucauacacagccaaaaaaaag

SEQ ID NO: 1376462 - RNA, 14 nt, Neisseria meningitidis Z2491
uucauaccucccaa

SEQ ID NO: 1376463 - RNA, 21 nt, Neisseria meningitidis Z2491
uucagcggcgggaaguuguug

SEQ ID NO: 1376464 - RNA, 12 nt, Neisseria meningitidis Z2491
uucagguaaaac

SEQ ID NO: 1376465 - RNA, 14 nt, Neisseria meningitidis Z2491
uggcugauaagguu

SEQ ID NO: 1376466 - RNA, 21 nt, Neisseria meningitidis Z2491
uggcugcuuuggcagcacagg

SEQ ID NO: 1376467 - RNA, 22 nt, Neisseria meningitidis Z2491
ugggaaggauggguuuuagguu

SEQ ID NO: 1376468 - RNA, 19 nt, Neisseria meningitidis Z2491
ugggaaucuagaaauuuaa

SEQ ID NO: 1376469 - RNA, 14 nt, Neisseria meningitidis Z2491
ugggaaucuagaau

SEQ ID NO: 1376470 - RNA, 14 nt, Neisseria meningitidis Z2491
ugggaaucuggaaa

SEQ ID NO: 1376471 - RNA, 18 nt, Neisseria meningitidis Z2491
ugggaaucuggaaaccaa

SEQ ID NO: 1376472 - RNA, 14 nt, Neisseria meningitidis Z2491
ugggaaugacggag

SEQ ID NO: 1376473 - RNA, 14 nt, Neisseria meningitidis Z2491
ugggaaugacggca

SEQ ID NO: 1376474 - RNA, 20 nt, Neisseria meningitidis Z2491
ugggaaugacguggugcagg

SEQ ID NO: 1376475 - RNA, 14 nt, Neisseria meningitidis Z2491
ugggaaacuuuuca

SEQ ID NO: 1376476 - RNA, 17 nt, Neisseria meningitidis Z2491
ugggaaagauuugcaau

SEQ ID NO: 1376477 - RNA, 16 nt, Neisseria meningitidis Z2491
uggcuuccuuuuuaaa

SEQ ID NO: 1376478 - RNA, 22 nt, Neisseria meningitidis Z2491
uggggaaagaucaauaacgguu

SEQ ID NO: 1376479 - RNA, 22 nt, Neisseria meningitidis Z2491
uggcguaaaacgguguggagag

SEQ ID NO: 1376480 - RNA, 13 nt, Neisseria meningitidis Z2491
uggcgggaaugcc

SEQ ID NO: 1376481 - RNA, 18 nt, Neisseria meningitidis Z2491
uggcggcugaccgcgccg

SEQ ID NO: 1376482 - RNA, 22 nt, Neisseria meningitidis Z2491
ugguugaaguccauggaaacca

SEQ ID NO: 1376483 - RNA, 20 nt, Neisseria meningitidis Z2491
ugguucugacggucugcaaa

SEQ ID NO: 1376484 - RNA, 14 nt, Neisseria meningitidis Z2491
ugguuuaaauuuaa

SEQ ID NO: 1376485 - RNA, 15 nt, Neisseria meningitidis Z2491
ugguuuaaauuuaau

SEQ ID NO: 1376486 - RNA, 21 nt, Neisseria meningitidis Z2491
ugguuugccgaguuuuuggua

SEQ ID NO: 1376487 - RNA, 20 nt, Neisseria meningitidis Z2491
uguaaucagggaugcucagu

SEQ ID NO: 1376488 - RNA, 14 nt, Neisseria meningitidis Z2491
uguaaaaacaaaaa

SEQ ID NO: 1376489 - RNA, 15 nt, Neisseria meningitidis Z2491
uguaaaaacaaaaaa

SEQ ID NO: 1376490 - RNA, 16 nt, Neisseria meningitidis Z2491
uguaaaaacaaaaaau

SEQ ID NO: 1376491 - RNA, 21 nt, Neisseria meningitidis Z2491
ugguuuucaaaacauccgcaa

SEQ ID NO: 1376492 - RNA, 17 nt, Neisseria meningitidis Z2491
uguaaauuuuuaaauuu

SEQ ID NO: 1376493 - RNA, 13 nt, Neisseria meningitidis Z2491
ugguaacauuaac

SEQ ID NO: 1376494 - RNA, 13 nt, Neisseria meningitidis Z2491
ugguagagaaaau

SEQ ID NO: 1376495 - RNA, 13 nt, Neisseria meningitidis Z2491
ugguaaugcaaaa

SEQ ID NO: 1376496 - RNA, 15 nt, Neisseria meningitidis Z2491
uggucaacucuucca

SEQ ID NO: 1376497 - RNA, 19 nt, Neisseria meningitidis Z2491
uggucaauacacaagguua

SEQ ID NO: 1376498 - RNA, 23 nt, Neisseria meningitidis Z2491
uggucggcaaucauuucugucug

SEQ ID NO: 1376499 - RNA, 13 nt, Neisseria meningitidis Z2491
uguucggaaucac

SEQ ID NO: 1376500 - RNA, 15 nt, Neisseria meningitidis Z2491
uguuccaauuccugu

SEQ ID NO: 1376501 - RNA, 14 nt, Neisseria meningitidis Z2491
uguucgccaacaau

SEQ ID NO: 1376502 - RNA, 23 nt, Neisseria meningitidis Z2491
uguucuucauguucgugcaucau

SEQ ID NO: 1376503 - RNA, 22 nt, Neisseria meningitidis Z2491
uguuaauccacuauaaagaccg

SEQ ID NO: 1376504 - RNA, 19 nt, Neisseria meningitidis Z2491
uguuaauccacuauauuaa

SEQ ID NO: 1376505 - RNA, 22 nt, Neisseria meningitidis Z2491
uguuacgcggcguuuuuucugu

SEQ ID NO: 1376506 - RNA, 14 nt, Neisseria meningitidis Z2491
uguuauuuuuauuu

SEQ ID NO: 1376507 - RNA, 14 nt, Neisseria meningitidis Z2491
uguuauuuucacaa

SEQ ID NO: 1376508 - RNA, 12 nt, Neisseria meningitidis Z2491
uguucaauagga

SEQ ID NO: 1376509 - RNA, 13 nt, Neisseria meningitidis Z2491
uguggauaaacau

SEQ ID NO: 1376510 - RNA, 17 nt, Neisseria meningitidis Z2491
ugugcugucagaauuga

SEQ ID NO: 1376511 - RNA, 13 nt, Neisseria meningitidis Z2491
ugugcauuucuaa

SEQ ID NO: 1376512 - RNA, 14 nt, Neisseria meningitidis Z2491
ugugcaaagaaaaa

SEQ ID NO: 1376513 - RNA, 16 nt, Neisseria meningitidis Z2491
ugucuucaaaaaacaa

SEQ ID NO: 1376514 - RNA, 14 nt, Neisseria meningitidis Z2491
ugucuucaauuccu

SEQ ID NO: 1376515 - RNA, 13 nt, Neisseria meningitidis Z2491
ugucuguuucuuu

SEQ ID NO: 1376516 - RNA, 23 nt, Neisseria meningitidis Z2491
ugucuuuucccuugcaaauaauu

SEQ ID NO: 1376517 - RNA, 18 nt, Neisseria meningitidis Z2491
ugucuuguacguggccuu

SEQ ID NO: 1376518 - RNA, 22 nt, Neisseria meningitidis Z2491
ugucuuguacguggccuuuucu

SEQ ID NO: 1376519 - RNA, 22 nt, Neisseria meningitidis Z2491
ugucugaaaacuuggagauucu

SEQ ID NO: 1376520 - RNA, 15 nt, Neisseria meningitidis Z2491
ugucguugucaacca

SEQ ID NO: 1376521 - RNA, 19 nt, Neisseria meningitidis Z2491
ugucggcuuuugacagcag

SEQ ID NO: 1376522 - RNA, 16 nt, Neisseria meningitidis Z2491
ugucggggaauccggu

SEQ ID NO: 1376523 - RNA, 21 nt, Neisseria meningitidis Z2491
ugucggguucggauauuuccg

SEQ ID NO: 1376524 - RNA, 14 nt, Neisseria meningitidis Z2491
ugucgaguucuuuu

SEQ ID NO: 1376525 - RNA, 18 nt, Neisseria meningitidis Z2491
uguccugaccuuugcaga

SEQ ID NO: 1376526 - RNA, 14 nt, Neisseria meningitidis Z2491
uguccugauuuaaa

SEQ ID NO: 1376527 - RNA, 15 nt, Neisseria meningitidis Z2491
uguccugauuuuugu

SEQ ID NO: 1376528 - RNA, 20 nt, Neisseria meningitidis Z2491
uguccggcugaacauuccgu

SEQ ID NO: 1376529 - RNA, 23 nt, Neisseria meningitidis Z2491
uguccgaccguuccgaaaccaag

SEQ ID NO: 1376530 - RNA, 13 nt, Neisseria meningitidis Z2491
uguccauuuuucu

SEQ ID NO: 1376531 - RNA, 23 nt, Neisseria meningitidis Z2491
uguccagugcggcaucggaaaca

SEQ ID NO: 1376532 - RNA, 20 nt, Neisseria meningitidis Z2491
uguaugccgucugaaaccug

SEQ ID NO: 1376533 - RNA, 19 nt, Neisseria meningitidis Z2491
uguauugggaugauuuugu

SEQ ID NO: 1376534 - RNA, 22 nt, Neisseria meningitidis Z2491
uguaugcggcuugggcgacggc

SEQ ID NO: 1376535 - RNA, 17 nt, Neisseria meningitidis Z2491
uguacagguuugagccg

SEQ ID NO: 1376536 - RNA, 23 nt, Neisseria meningitidis Z2491
uuauccgcacacgaacugccucc

SEQ ID NO: 1376537 - RNA, 18 nt, Neisseria meningitidis Z2491
uuauccgaaacaacaaaa

SEQ ID NO: 1376538 - RNA, 13 nt, Neisseria meningitidis Z2491
uuaucccaacaag

SEQ ID NO: 1376539 - RNA, 14 nt, Neisseria meningitidis Z2491
uuaucccauaaaaa

SEQ ID NO: 1376540 - RNA, 15 nt, Neisseria meningitidis Z2491
uuaucccauaaaaac

SEQ ID NO: 1376541 - RNA, 16 nt, Neisseria meningitidis Z2491
uuauccauacaagaac

SEQ ID NO: 1376542 - RNA, 15 nt, Neisseria meningitidis Z2491
uuauccauauccaaa

SEQ ID NO: 1376543 - RNA, 21 nt, Neisseria meningitidis Z2491
uuauccaucccauauuccaca

SEQ ID NO: 1376544 - RNA, 18 nt, Neisseria meningitidis Z2491
uuaucagggcugcaaaau

SEQ ID NO: 1376545 - RNA, 21 nt, Neisseria meningitidis Z2491
uuaucagggcugcaaaauuua

SEQ ID NO: 1376546 - RNA, 11 nt, Neisseria meningitidis Z2491
uuauacacacg

SEQ ID NO: 1376547 - RNA, 17 nt, Neisseria meningitidis Z2491
uuauccggcuuuccaug

SEQ ID NO: 1376548 - RNA, 19 nt, Neisseria meningitidis Z2491
uuaucuaaaggaaugguug

SEQ ID NO: 1376549 - RNA, 17 nt, Neisseria meningitidis Z2491
uuaucgggaaaaacggu

SEQ ID NO: 1376550 - RNA, 15 nt, Neisseria meningitidis Z2491
uuaucgggaaaaaua

SEQ ID NO: 1376551 - RNA, 15 nt, Neisseria meningitidis Z2491
uuaucggaaaugacu

SEQ ID NO: 1376552 - RNA, 14 nt, Neisseria meningitidis Z2491
uuaucugaaaguuu

SEQ ID NO: 1376553 - RNA, 13 nt, Neisseria meningitidis Z2491
uuauguauauaau

SEQ ID NO: 1376554 - RNA, 13 nt, Neisseria meningitidis Z2491
uuaugugcuguca

SEQ ID NO: 1376555 - RNA, 18 nt, Neisseria meningitidis Z2491
uuaugcucaaucucauuu

SEQ ID NO: 1376556 - RNA, 10 nt, Neisseria meningitidis Z2491
uuaugccuuu

SEQ ID NO: 1376557 - RNA, 15 nt, Neisseria meningitidis Z2491
uuauggggauuuauu

SEQ ID NO: 1376558 - RNA, 15 nt, Neisseria meningitidis Z2491
uuaugaugcguucaa

SEQ ID NO: 1376559 - RNA, 13 nt, Neisseria meningitidis Z2491
uuaucuuucagca

SEQ ID NO: 1376560 - RNA, 18 nt, Neisseria meningitidis Z2491
uuauugaagauggcugaa

SEQ ID NO: 1376561 - RNA, 12 nt, Neisseria meningitidis Z2491
uuauuauguaua

SEQ ID NO: 1376562 - RNA, 15 nt, Neisseria meningitidis Z2491
uuauugugcuaugca

SEQ ID NO: 1376563 - RNA, 16 nt, Neisseria meningitidis Z2491
uuauuuucaaaaugca

SEQ ID NO: 1376564 - RNA, 13 nt, Neisseria meningitidis Z2491
uuauuugaacgau

SEQ ID NO: 1376565 - RNA, 12 nt, Neisseria meningitidis Z2491
uucaagcagcaa

SEQ ID NO: 1376566 - RNA, 19 nt, Neisseria meningitidis Z2491
uucaacgccgauuaauccg

SEQ ID NO: 1376567 - RNA, 11 nt, Neisseria meningitidis Z2491
uucaaaugccg

SEQ ID NO: 1376568 - RNA, 21 nt, Neisseria meningitidis Z2491
uucaacagcagcgaaggcgcg

SEQ ID NO: 1376569 - RNA, 17 nt, Neisseria meningitidis Z2491
uucaacagguucaaaca

SEQ ID NO: 1376570 - RNA, 12 nt, Neisseria meningitidis Z2491
uuauuuuccaua

SEQ ID NO: 1376571 - RNA, 19 nt, Neisseria meningitidis Z2491
uuauuuuccauaaaauaca

SEQ ID NO: 1376572 - RNA, 11 nt, Neisseria meningitidis Z2491
uucaaaaacag

SEQ ID NO: 1376573 - RNA, 11 nt, Neisseria meningitidis Z2491
uucaaaaaacc

SEQ ID NO: 1376574 - RNA, 12 nt, Neisseria meningitidis Z2491
uucaaaaaaccg

SEQ ID NO: 1376575 - RNA, 13 nt, Neisseria meningitidis Z2491
uucaaaauuuauu

SEQ ID NO: 1376576 - RNA, 19 nt, Neisseria meningitidis Z2491
uucaaaccccuucaaacca

SEQ ID NO: 1376577 - RNA, 16 nt, Neisseria meningitidis Z2491
uucaaaccucauucaa

SEQ ID NO: 1376578 - RNA, 14 nt, Neisseria meningitidis Z2491
uucaaaaugcaaaa

SEQ ID NO: 1376579 - RNA, 22 nt, Neisseria meningitidis Z2491
uucaaacgggacugccuacaca

SEQ ID NO: 1376580 - RNA, 14 nt, Neisseria meningitidis Z2491
uucaaacgguuuuu

SEQ ID NO: 1376581 - RNA, 15 nt, Neisseria meningitidis Z2491
uuaagauguuuuucc

SEQ ID NO: 1376582 - RNA, 15 nt, Neisseria meningitidis Z2491
uuaagaaaaccugca

SEQ ID NO: 1376583 - RNA, 13 nt, Neisseria meningitidis Z2491
uuaagaaacaaag

SEQ ID NO: 1376584 - RNA, 17 nt, Neisseria meningitidis Z2491
uuaacagacuauuuuug

SEQ ID NO: 1376585 - RNA, 23 nt, Neisseria meningitidis Z2491
uuaacaaugcccgcaaucugaaa

SEQ ID NO: 1376586 - RNA, 20 nt, Neisseria meningitidis Z2491
uguugcccuguguagcagcc

SEQ ID NO: 1376587 - RNA, 17 nt, Neisseria meningitidis Z2491
uuaaauuuuuaaaaccg

SEQ ID NO: 1376588 - RNA, 17 nt, Neisseria meningitidis Z2491
uuaaauuuaguucacua

SEQ ID NO: 1376589 - RNA, 18 nt, Neisseria meningitidis Z2491
uuaacaaaaaucaggaca

SEQ ID NO: 1376590 - RNA, 21 nt, Neisseria meningitidis Z2491
uuaacaaaaaucaggacaagg

SEQ ID NO: 1376591 - RNA, 13 nt, Neisseria meningitidis Z2491
uuaaauucaacuu

SEQ ID NO: 1376592 - RNA, 20 nt, Neisseria meningitidis Z2491
uuaaauuuaauccacuauaa

SEQ ID NO: 1376593 - RNA, 23 nt, Neisseria meningitidis Z2491
uuaaauuuaauccacuauaauga

SEQ ID NO: 1376594 - RNA, 20 nt, Neisseria meningitidis Z2491
uuacagcggauuaaaauauc

SEQ ID NO: 1376595 - RNA, 18 nt, Neisseria meningitidis Z2491
uuacacuuugggcuucga

SEQ ID NO: 1376596 - RNA, 15 nt, Neisseria meningitidis Z2491
uuaaugcgaaaugcc

SEQ ID NO: 1376597 - RNA, 18 nt, Neisseria meningitidis Z2491
uuacgccccucccaaaua

SEQ ID NO: 1376598 - RNA, 17 nt, Neisseria meningitidis Z2491
uuacccaaugacugccc

SEQ ID NO: 1376599 - RNA, 19 nt, Neisseria meningitidis Z2491
uuacggucagaaaauuucu

SEQ ID NO: 1376600 - RNA, 11 nt, Neisseria meningitidis Z2491
uuacuaaaauu

SEQ ID NO: 1376601 - RNA, 18 nt, Neisseria meningitidis Z2491
uuagaaugaauagucagg

SEQ ID NO: 1376602 - RNA, 13 nt, Neisseria meningitidis Z2491
uuacugucuuauu

SEQ ID NO: 1376603 - RNA, 13 nt, Neisseria meningitidis Z2491
uuacuguuguucu

SEQ ID NO: 1376604 - RNA, 20 nt, Neisseria meningitidis Z2491
ugccgcgauucagccauugu

SEQ ID NO: 1376605 - RNA, 16 nt, Neisseria meningitidis Z2491
ugccgcguaugcguuc

SEQ ID NO: 1376606 - RNA, 18 nt, Neisseria meningitidis Z2491
ugccgcguguccgcgcgu

SEQ ID NO: 1376607 - RNA, 14 nt, Neisseria meningitidis Z2491
ugccucuucccaau

SEQ ID NO: 1376608 - RNA, 20 nt, Neisseria meningitidis Z2491
ugccucuucccaauucuccc

SEQ ID NO: 1376609 - RNA, 18 nt, Neisseria meningitidis Z2491
ugccguuuuccuuucuga

SEQ ID NO: 1376610 - RNA, 14 nt, Neisseria meningitidis Z2491
ugccuacacaucgu

SEQ ID NO: 1376611 - RNA, 16 nt, Neisseria meningitidis Z2491
ugccucuauuuaaaaa

SEQ ID NO: 1376612 - RNA, 14 nt, Neisseria meningitidis Z2491
ugccguuucagacg

SEQ ID NO: 1376613 - RNA, 12 nt, Neisseria meningitidis Z2491
ugcccgaaccgu

SEQ ID NO: 1376614 - RNA, 20 nt, Neisseria meningitidis Z2491
ugcccgaaccgucauucccg

SEQ ID NO: 1376615 - RNA, 22 nt, Neisseria meningitidis Z2491
ugcccgaaccgucauucccgcc

SEQ ID NO: 1376616 - RNA, 13 nt, Neisseria meningitidis Z2491
ugccccaguucuu

SEQ ID NO: 1376617 - RNA, 15 nt, Neisseria meningitidis Z2491
ugccccaauaccaac

SEQ ID NO: 1376618 - RNA, 19 nt, Neisseria meningitidis Z2491
ugcccgacggggugaaaaa

SEQ ID NO: 1376619 - RNA, 16 nt, Neisseria meningitidis Z2491
ugccgcaccuaaaggg

SEQ ID NO: 1376620 - RNA, 23 nt, Neisseria meningitidis Z2491
ugccgcaccaccagccacaacac

SEQ ID NO: 1376621 - RNA, 16 nt, Neisseria meningitidis Z2491
ugccgauauagagucc

SEQ ID NO: 1376622 - RNA, 23 nt, Neisseria meningitidis Z2491
ugccgcccgucccgaugccgcaa

SEQ ID NO: 1376623 - RNA, 12 nt, Neisseria meningitidis Z2491
ugccgccaaagu

SEQ ID NO: 1376624 - RNA, 14 nt, Neisseria meningitidis Z2491
ugccgccugccugu

SEQ ID NO: 1376625 - RNA, 15 nt, Neisseria meningitidis Z2491
ugccgccugccuguu

SEQ ID NO: 1376626 - RNA, 15 nt, Neisseria meningitidis Z2491
ugccgccugaacauu

SEQ ID NO: 1376627 - RNA, 19 nt, Neisseria meningitidis Z2491
ugccgccgcaacugccuuu

SEQ ID NO: 1376628 - RNA, 16 nt, Neisseria meningitidis Z2491
ugccaucaggacucga

SEQ ID NO: 1376629 - RNA, 20 nt, Neisseria meningitidis Z2491
ugccaaugccgucugaaacc

SEQ ID NO: 1376630 - RNA, 19 nt, Neisseria meningitidis Z2491
ugccaauucaaaaaccugc

SEQ ID NO: 1376631 - RNA, 15 nt, Neisseria meningitidis Z2491
ugccaccgugcgcug

SEQ ID NO: 1376632 - RNA, 18 nt, Neisseria meningitidis Z2491
ugcauuuugaaaaugaga

SEQ ID NO: 1376633 - RNA, 19 nt, Neisseria meningitidis Z2491
ugcauuuuuaauuucuucu

SEQ ID NO: 1376634 - RNA, 16 nt, Neisseria meningitidis Z2491
ugccaaaccggcauuc

SEQ ID NO: 1376635 - RNA, 18 nt, Neisseria meningitidis Z2491
ugcauacgguuuuccgcc

SEQ ID NO: 1376636 - RNA, 17 nt, Neisseria meningitidis Z2491
ugcauaucggcaaucac

SEQ ID NO: 1376637 - RNA, 18 nt, Neisseria meningitidis Z2491
ugcaucacgucauuccua

SEQ ID NO: 1376638 - RNA, 16 nt, Neisseria meningitidis Z2491
ugcaucacguucugaa

SEQ ID NO: 1376639 - RNA, 22 nt, Neisseria meningitidis Z2491
ugcaucacguucugaaaaauau

SEQ ID NO: 1376640 - RNA, 19 nt, Neisseria meningitidis Z2491
ugcauaaucaauuaaaaac

SEQ ID NO: 1376641 - RNA, 23 nt, Neisseria meningitidis Z2491
ugcauaaucaguuugcuuuguaa

SEQ ID NO: 1376642 - RNA, 18 nt, Neisseria meningitidis Z2491
ugcacugcgcgaugcaua

SEQ ID NO: 1376643 - RNA, 14 nt, Neisseria meningitidis Z2491
ugcacuacuucauu

SEQ ID NO: 1376644 - RNA, 22 nt, Neisseria meningitidis Z2491
ugcaucagcaguucguucugca

SEQ ID NO: 1376645 - RNA, 16 nt, Neisseria meningitidis Z2491
ugcauccgacaggcaa

SEQ ID NO: 1376646 - RNA, 14 nt, Neisseria meningitidis Z2491
ugcgucugccuucu

SEQ ID NO: 1376647 - RNA, 15 nt, Neisseria meningitidis Z2491
ugcgucugccuucuu

SEQ ID NO: 1376648 - RNA, 17 nt, Neisseria meningitidis Z2491
ugcgucugccuucuucu

SEQ ID NO: 1376649 - RNA, 16 nt, Neisseria meningitidis Z2491
ugcggucaaaauuuac

SEQ ID NO: 1376650 - RNA, 19 nt, Neisseria meningitidis Z2491
ugcgcgccuuuuuguuuuc

SEQ ID NO: 1376651 - RNA, 17 nt, Neisseria meningitidis Z2491
ugcgcgggaaugacaaa

SEQ ID NO: 1376652 - RNA, 13 nt, Neisseria meningitidis Z2491
ugcgcgcuuuuag

SEQ ID NO: 1376653 - RNA, 12 nt, Neisseria meningitidis Z2491
ugcgccuugccc

SEQ ID NO: 1376654 - RNA, 20 nt, Neisseria meningitidis Z2491
ugcgccgauuuuccggcguu

SEQ ID NO: 1376655 - RNA, 15 nt, Neisseria meningitidis Z2491
ugcgccgacagcagc

SEQ ID NO: 1376656 - RNA, 21 nt, Neisseria meningitidis Z2491
ugcgccacggcuuucgcgccg

SEQ ID NO: 1376657 - RNA, 14 nt, Neisseria meningitidis Z2491
ugcuuugguaaaaa

SEQ ID NO: 1376658 - RNA, 21 nt, Neisseria meningitidis Z2491
ugcuuuggucgcugccuuuga

SEQ ID NO: 1376659 - RNA, 13 nt, Neisseria meningitidis Z2491
ugcuuuggcuucg

SEQ ID NO: 1376660 - RNA, 19 nt, Neisseria meningitidis Z2491
ugcuucaaggcgcggcaca

SEQ ID NO: 1376661 - RNA, 12 nt, Neisseria meningitidis Z2491
ugcuucaaccac

SEQ ID NO: 1376662 - RNA, 14 nt, Neisseria meningitidis Z2491
ugcuuauuuguuca

SEQ ID NO: 1376663 - RNA, 20 nt, Neisseria meningitidis Z2491
ugcuucagcaccuuagagaa

SEQ ID NO: 1376664 - RNA, 15 nt, Neisseria meningitidis Z2491
ugcuguugcaaagcc

SEQ ID NO: 1376665 - RNA, 16 nt, Neisseria meningitidis Z2491
ugcuguugaaaaugcc

SEQ ID NO: 1376666 - RNA, 11 nt, Neisseria meningitidis Z2491
ugcugguuuuu

SEQ ID NO: 1376667 - RNA, 17 nt, Neisseria meningitidis Z2491
ugcugccggcaggauaa

SEQ ID NO: 1376668 - RNA, 13 nt, Neisseria meningitidis Z2491
ugcugccgcccca

SEQ ID NO: 1376669 - RNA, 18 nt, Neisseria meningitidis Z2491
ugcugccgugaugcccca

SEQ ID NO: 1376670 - RNA, 19 nt, Neisseria meningitidis Z2491
ugcugccgugaugccccaa

SEQ ID NO: 1376671 - RNA, 18 nt, Neisseria meningitidis Z2491
ugcugcuguauuuuucga

SEQ ID NO: 1376672 - RNA, 19 nt, Neisseria meningitidis Z2491
ugcugcuuuucauuucuag

SEQ ID NO: 1376673 - RNA, 15 nt, Neisseria meningitidis Z2491
ugcuggaagcauuga

SEQ ID NO: 1376674 - RNA, 21 nt, Neisseria meningitidis Z2491
ugcuggaagcauugaccacuu

SEQ ID NO: 1376675 - RNA, 21 nt, Neisseria meningitidis Z2491
ugcucgaagcguggcaguaca

SEQ ID NO: 1376676 - RNA, 23 nt, Neisseria meningitidis Z2491
ugcuccaaucuaccguuuccucc

SEQ ID NO: 1376677 - RNA, 21 nt, Neisseria meningitidis Z2491
ugcucaaucuuauuuucaaaa

SEQ ID NO: 1376678 - RNA, 20 nt, Neisseria meningitidis Z2491
ugcucauucacguaauucuc

SEQ ID NO: 1376679 - RNA, 13 nt, Neisseria meningitidis Z2491
ugcucaauauuag

SEQ ID NO: 1376680 - RNA, 18 nt, Neisseria meningitidis Z2491
ugcguuucuagauuccca

SEQ ID NO: 1376681 - RNA, 17 nt, Neisseria meningitidis Z2491
ugcugaagcaccaagug

SEQ ID NO: 1376682 - RNA, 20 nt, Neisseria meningitidis Z2491
ugcugaagcaccaagugaau

SEQ ID NO: 1376683 - RNA, 13 nt, Neisseria meningitidis Z2491
ugcugaagcaccg

SEQ ID NO: 1376684 - RNA, 18 nt, Neisseria meningitidis Z2491
ugaauuuuauugauucaa

SEQ ID NO: 1376685 - RNA, 17 nt, Neisseria meningitidis Z2491
ugacaaucaggaaaaca

SEQ ID NO: 1376686 - RNA, 19 nt, Neisseria meningitidis Z2491
ugacaaucaggaaaacagc

SEQ ID NO: 1376687 - RNA, 20 nt, Neisseria meningitidis Z2491
ugaauuaaaugcuaaauauc

SEQ ID NO: 1376688 - RNA, 15 nt, Neisseria meningitidis Z2491
ugaauuaaauuuaaa

SEQ ID NO: 1376689 - RNA, 22 nt, Neisseria meningitidis Z2491
ugaaugccuuucucuguuuuuc

SEQ ID NO: 1376690 - RNA, 21 nt, Neisseria meningitidis Z2491
ugaaucagguugaaaaugccg

SEQ ID NO: 1376691 - RNA, 17 nt, Neisseria meningitidis Z2491
ugaagucgugaauuaaa

SEQ ID NO: 1376692 - RNA, 20 nt, Neisseria meningitidis Z2491
ugaagucgugaauuaaaugc

SEQ ID NO: 1376693 - RNA, 22 nt, Neisseria meningitidis Z2491
ugaagucgugaauuaaaugcua

SEQ ID NO: 1376694 - RNA, 17 nt, Neisseria meningitidis Z2491
ugaauagucaggcugcc

SEQ ID NO: 1376695 - RNA, 20 nt, Neisseria meningitidis Z2491
ugaauaaacuucuaacaaau

SEQ ID NO: 1376696 - RNA, 20 nt, Neisseria meningitidis Z2491
ugaagauggcugaaauucaa

SEQ ID NO: 1376697 - RNA, 21 nt, Neisseria meningitidis Z2491
ugaagauggcugaaauugaaa

SEQ ID NO: 1376698 - RNA, 15 nt, Neisseria meningitidis Z2491
ugaagcccacccuac

SEQ ID NO: 1376699 - RNA, 18 nt, Neisseria meningitidis Z2491
ugaagcccacccuaccau

SEQ ID NO: 1376700 - RNA, 19 nt, Neisseria meningitidis Z2491
ugaagcccacccuaccauu

SEQ ID NO: 1376701 - RNA, 19 nt, Neisseria meningitidis Z2491
ugaagcaggcguuuuucag

SEQ ID NO: 1376702 - RNA, 18 nt, Neisseria meningitidis Z2491
ugaagccagccccaccau

SEQ ID NO: 1376703 - RNA, 19 nt, Neisseria meningitidis Z2491
ugaagccagccccaccauu

SEQ ID NO: 1376704 - RNA, 22 nt, Neisseria meningitidis Z2491
ugaagccuucagacaacaagcc

SEQ ID NO: 1376705 - RNA, 18 nt, Neisseria meningitidis Z2491
ugaagccuucagacggca

SEQ ID NO: 1376706 - RNA, 16 nt, Neisseria meningitidis Z2491
ugaagcgagcagcuuc

SEQ ID NO: 1376707 - RNA, 18 nt, Neisseria meningitidis Z2491
ugaaggcuucagacggca

SEQ ID NO: 1376708 - RNA, 15 nt, Neisseria meningitidis Z2491
ugaagcucaaaaaac

SEQ ID NO: 1376709 - RNA, 16 nt, Neisseria meningitidis Z2491
ugaagcucaaaaaacc

SEQ ID NO: 1376710 - RNA, 22 nt, Neisseria meningitidis Z2491
ugaacgcgcgggaauagcucag

SEQ ID NO: 1376711 - RNA, 20 nt, Neisseria meningitidis Z2491
ugacggcgggcaggcggcug

SEQ ID NO: 1376712 - RNA, 13 nt, Neisseria meningitidis Z2491
ugacgcauaaaaa

SEQ ID NO: 1376713 - RNA, 14 nt, Neisseria meningitidis Z2491
ugaccgcgcugcuc

SEQ ID NO: 1376714 - RNA, 15 nt, Neisseria meningitidis Z2491
ugacgaaaauuuauc

SEQ ID NO: 1376715 - RNA, 16 nt, Neisseria meningitidis Z2491
ugacgaaaauuuaucc

SEQ ID NO: 1376716 - RNA, 13 nt, Neisseria meningitidis Z2491
ugacgaaaccaga

SEQ ID NO: 1376717 - RNA, 14 nt, Neisseria meningitidis Z2491
ugacgaauuucagg

SEQ ID NO: 1376718 - RNA, 17 nt, Neisseria meningitidis Z2491
ugacgaagcuauccgca

SEQ ID NO: 1376719 - RNA, 19 nt, Neisseria meningitidis Z2491
ugacacaaagccuucuucu

SEQ ID NO: 1376720 - RNA, 17 nt, Neisseria meningitidis Z2491
ugacaugguuugcaguc

SEQ ID NO: 1376721 - RNA, 19 nt, Neisseria meningitidis Z2491
ugacauuaagauguuuuuc

SEQ ID NO: 1376722 - RNA, 22 nt, Neisseria meningitidis Z2491
ugaccgcagccgaacccaacag

SEQ ID NO: 1376723 - RNA, 15 nt, Neisseria meningitidis Z2491
ugaccgaaaaauaau

SEQ ID NO: 1376724 - RNA, 20 nt, Neisseria meningitidis Z2491
ugaccgacccauucugacaa

SEQ ID NO: 1376725 - RNA, 13 nt, Neisseria meningitidis Z2491
ugagcaaaugccg

SEQ ID NO: 1376726 - RNA, 15 nt, Neisseria meningitidis Z2491
ugagcaaaugccuua

SEQ ID NO: 1376727 - RNA, 19 nt, Neisseria meningitidis Z2491
ugagaacaagccuguuuuc

SEQ ID NO: 1376728 - RNA, 12 nt, Neisseria meningitidis Z2491
ugacugaaacuc

SEQ ID NO: 1376729 - RNA, 18 nt, Neisseria meningitidis Z2491
ugacugaaacucaaaaaa

SEQ ID NO: 1376730 - RNA, 20 nt, Neisseria meningitidis Z2491
ugacugaaacucaaaaaacu

SEQ ID NO: 1376731 - RNA, 12 nt, Neisseria meningitidis Z2491
ugacugaaauuc

SEQ ID NO: 1376732 - RNA, 18 nt, Neisseria meningitidis Z2491
ugacugaaauucaaaaaa

SEQ ID NO: 1376733 - RNA, 17 nt, Neisseria meningitidis Z2491
ugacuaaccgaaaauaa

SEQ ID NO: 1376734 - RNA, 22 nt, Neisseria meningitidis Z2491
ugacuaaccgaaaauaauugcc

SEQ ID NO: 1376735 - RNA, 15 nt, Neisseria meningitidis Z2491
ugacggucaggaaga

SEQ ID NO: 1376736 - RNA, 16 nt, Neisseria meningitidis Z2491
ugcaacacuaguguau

SEQ ID NO: 1376737 - RNA, 14 nt, Neisseria meningitidis Z2491
ugcaacguuuuacc

SEQ ID NO: 1376738 - RNA, 14 nt, Neisseria meningitidis Z2491
ugcaacugaaacca

SEQ ID NO: 1376739 - RNA, 21 nt, Neisseria meningitidis Z2491
ugcaacuuugcguuucuagau

SEQ ID NO: 1376740 - RNA, 16 nt, Neisseria meningitidis Z2491
ugcaagaacagcagca

SEQ ID NO: 1376741 - RNA, 16 nt, Neisseria meningitidis Z2491
ugcaagaauuuaucgg

SEQ ID NO: 1376742 - RNA, 20 nt, Neisseria meningitidis Z2491
ugcaccgcgucauucccacg

SEQ ID NO: 1376743 - RNA, 19 nt, Neisseria meningitidis Z2491
ugauugacuauuuuuuaau

SEQ ID NO: 1376744 - RNA, 19 nt, Neisseria meningitidis Z2491
ugauucccgagaaaacaga

SEQ ID NO: 1376745 - RNA, 22 nt, Neisseria meningitidis Z2491
ugcaaaacuuuucugauuuuuc

SEQ ID NO: 1376746 - RNA, 12 nt, Neisseria meningitidis Z2491
ugcaaaaauuua

SEQ ID NO: 1376747 - RNA, 17 nt, Neisseria meningitidis Z2491
ugcaaaauagaaaaccg

SEQ ID NO: 1376748 - RNA, 18 nt, Neisseria meningitidis Z2491
ugcaaauaauugaaauca

SEQ ID NO: 1376749 - RNA, 19 nt, Neisseria meningitidis Z2491
ugcaaauaauugaaaucaa

SEQ ID NO: 1376750 - RNA, 13 nt, Neisseria meningitidis Z2491
ugaucauuucagg

SEQ ID NO: 1376751 - RNA, 17 nt, Neisseria meningitidis Z2491
ugaugaugucgaaggcg

SEQ ID NO: 1376752 - RNA, 20 nt, Neisseria meningitidis Z2491
ugaugccccaauaccaacac

SEQ ID NO: 1376753 - RNA, 20 nt, Neisseria meningitidis Z2491
ugaucaggcggauuucuccg

SEQ ID NO: 1376754 - RNA, 17 nt, Neisseria meningitidis Z2491
ugaucaaaaccgcaccg

SEQ ID NO: 1376755 - RNA, 23 nt, Neisseria meningitidis Z2491
ugauaucggaggaguuugaugcc

SEQ ID NO: 1376756 - RNA, 15 nt, Neisseria meningitidis Z2491
ugaguugauaauaug

SEQ ID NO: 1376757 - RNA, 14 nt, Neisseria meningitidis Z2491
ugaguuucggucau

SEQ ID NO: 1376758 - RNA, 12 nt, Neisseria meningitidis Z2491
ugagcauagacg

SEQ ID NO: 1376759 - RNA, 15 nt, Neisseria meningitidis Z2491
ugaguccgaggcugu

SEQ ID NO: 1376760 - RNA, 13 nt, Neisseria meningitidis Z2491
ugauaauaugaaa

SEQ ID NO: 1376761 - RNA, 16 nt, Neisseria meningitidis Z2491
ugauaagcaagcaaua

SEQ ID NO: 1376762 - RNA, 17 nt, Neisseria meningitidis Z2491
ugauacgggcggcucuc

SEQ ID NO: 1376763 - RNA, 20 nt, Neisseria meningitidis Z2491
ugauacgggcggcucucaaa

SEQ ID NO: 1376764 - RNA, 13 nt, Neisseria meningitidis Z2491
ucgccccaaauac

SEQ ID NO: 1376765 - RNA, 15 nt, Neisseria meningitidis Z2491
ucgccccaaauaccu

SEQ ID NO: 1376766 - RNA, 19 nt, Neisseria meningitidis Z2491
ucgcccguuaccagcagug

SEQ ID NO: 1376767 - RNA, 13 nt, Neisseria meningitidis Z2491
ucgccuuaaaaaa

SEQ ID NO: 1376768 - RNA, 21 nt, Neisseria meningitidis Z2491
ucgccgcgcuggucggcagua

SEQ ID NO: 1376769 - RNA, 17 nt, Neisseria meningitidis Z2491
ucgcacauuuuuuucau

SEQ ID NO: 1376770 - RNA, 21 nt, Neisseria meningitidis Z2491
ucgcacauuuuuuucauaccc

SEQ ID NO: 1376771 - RNA, 18 nt, Neisseria meningitidis Z2491
ucgauauccgacugugcc

SEQ ID NO: 1376772 - RNA, 13 nt, Neisseria meningitidis Z2491
ucgauaucgccuc

SEQ ID NO: 1376773 - RNA, 17 nt, Neisseria meningitidis Z2491
ucgauaugaaaagaccg

SEQ ID NO: 1376774 - RNA, 19 nt, Neisseria meningitidis Z2491
ucgagcugccuuuuaccuu

SEQ ID NO: 1376775 - RNA, 14 nt, Neisseria meningitidis Z2491
ucgaggaugucgga

SEQ ID NO: 1376776 - RNA, 12 nt, Neisseria meningitidis Z2491
uccuuucugaca

SEQ ID NO: 1376777 - RNA, 13 nt, Neisseria meningitidis Z2491
uccuuucuguauc

SEQ ID NO: 1376778 - RNA, 13 nt, Neisseria meningitidis Z2491
uccuuuuuaaagg

SEQ ID NO: 1376779 - RNA, 14 nt, Neisseria meningitidis Z2491
ucgaaacuuaaaaa

SEQ ID NO: 1376780 - RNA, 18 nt, Neisseria meningitidis Z2491
ucgaaauauugccagccc

SEQ ID NO: 1376781 - RNA, 14 nt, Neisseria meningitidis Z2491
ucgaaucuucuuuu

SEQ ID NO: 1376782 - RNA, 12 nt, Neisseria meningitidis Z2491
ucgacagcagcc

SEQ ID NO: 1376783 - RNA, 22 nt, Neisseria meningitidis Z2491
ucgaacagccuguccaaagccu

SEQ ID NO: 1376784 - RNA, 14 nt, Neisseria meningitidis Z2491
ucgaaaugccgucu

SEQ ID NO: 1376785 - RNA, 23 nt, Neisseria meningitidis Z2491
ucgaacgaucgaauuauuuaauc

SEQ ID NO: 1376786 - RNA, 16 nt, Neisseria meningitidis Z2491
uccugugguuuuucgg

SEQ ID NO: 1376787 - RNA, 22 nt, Neisseria meningitidis Z2491
uccugugguuuuucgguuacug

SEQ ID NO: 1376788 - RNA, 19 nt, Neisseria meningitidis Z2491
uccugcguguucgggcguu

SEQ ID NO: 1376789 - RNA, 20 nt, Neisseria meningitidis Z2491
uccugcugcugguuuuucgg

SEQ ID NO: 1376790 - RNA, 18 nt, Neisseria meningitidis Z2491
uccugcagguagcggcug

SEQ ID NO: 1376791 - RNA, 19 nt, Neisseria meningitidis Z2491
uccugcaggcguaugccuu

SEQ ID NO: 1376792 - RNA, 20 nt, Neisseria meningitidis Z2491
uccugcaucagcuucauacc

SEQ ID NO: 1376793 - RNA, 19 nt, Neisseria meningitidis Z2491
uccugccaaugccuuuucc

SEQ ID NO: 1376794 - RNA, 14 nt, Neisseria meningitidis Z2491
uccuucugaaauau

SEQ ID NO: 1376795 - RNA, 12 nt, Neisseria meningitidis Z2491
uccuuccaaaag

SEQ ID NO: 1376796 - RNA, 22 nt, Neisseria meningitidis Z2491
uccuucccgcaaaaacggaaaa

SEQ ID NO: 1376797 - RNA, 12 nt, Neisseria meningitidis Z2491
uccuuccaucac

SEQ ID NO: 1376798 - RNA, 17 nt, Neisseria meningitidis Z2491
uccuuaucggcaaaaaa

SEQ ID NO: 1376799 - RNA, 15 nt, Neisseria meningitidis Z2491
uccuuauuucugcuu

SEQ ID NO: 1376800 - RNA, 15 nt, Neisseria meningitidis Z2491
ucguuacaaauuuaa

SEQ ID NO: 1376801 - RNA, 17 nt, Neisseria meningitidis Z2491
ucguuacaaauuuaaac

SEQ ID NO: 1376802 - RNA, 13 nt, Neisseria meningitidis Z2491
ucguuauuuccac

SEQ ID NO: 1376803 - RNA, 13 nt, Neisseria meningitidis Z2491
ucguucaacagca

SEQ ID NO: 1376804 - RNA, 14 nt, Neisseria meningitidis Z2491
ucguuaacagacua

SEQ ID NO: 1376805 - RNA, 18 nt, Neisseria meningitidis Z2491
ucguuaacagacuauuuu

SEQ ID NO: 1376806 - RNA, 15 nt, Neisseria meningitidis Z2491
ucguuuuucauuucu

SEQ ID NO: 1376807 - RNA, 20 nt, Neisseria meningitidis Z2491
ucuacaaaauaaucuuccuu

SEQ ID NO: 1376808 - RNA, 16 nt, Neisseria meningitidis Z2491
ucguuuuuuuccugcc

SEQ ID NO: 1376809 - RNA, 22 nt, Neisseria meningitidis Z2491
ucguccgacaauuucuccgcca

SEQ ID NO: 1376810 - RNA, 16 nt, Neisseria meningitidis Z2491
ucguccagcagcaaca

SEQ ID NO: 1376811 - RNA, 23 nt, Neisseria meningitidis Z2491
ucguccagcagcaacacauugcc

SEQ ID NO: 1376812 - RNA, 23 nt, Neisseria meningitidis Z2491
ucguauugcuaaauuucuagaag

SEQ ID NO: 1376813 - RNA, 16 nt, Neisseria meningitidis Z2491
ucguacggcaaggcga

SEQ ID NO: 1376814 - RNA, 21 nt, Neisseria meningitidis Z2491
ucguacacguccauacccaau

SEQ ID NO: 1376815 - RNA, 21 nt, Neisseria meningitidis Z2491
ucgguauagugaacuaaauuu

SEQ ID NO: 1376816 - RNA, 18 nt, Neisseria meningitidis Z2491
ucggucauagccagagag

SEQ ID NO: 1376817 - RNA, 22 nt, Neisseria meningitidis Z2491
ucggucauuuccgauaaauucc

SEQ ID NO: 1376818 - RNA, 15 nt, Neisseria meningitidis Z2491
ucgguuuucuauuuu

SEQ ID NO: 1376819 - RNA, 13 nt, Neisseria meningitidis Z2491
ucgguuuuuuccg

SEQ ID NO: 1376820 - RNA, 21 nt, Neisseria meningitidis Z2491
ucgggcgggaauagcucaguu

SEQ ID NO: 1376821 - RNA, 18 nt, Neisseria meningitidis Z2491
ucggggguuucuguuuuu

SEQ ID NO: 1376822 - RNA, 22 nt, Neisseria meningitidis Z2491
ucggguaacggcaauauucaaa

SEQ ID NO: 1376823 - RNA, 23 nt, Neisseria meningitidis Z2491
ucggguaacggcaauauucaaaa

SEQ ID NO: 1376824 - RNA, 18 nt, Neisseria meningitidis Z2491
ucggguauccggagagga

SEQ ID NO: 1376825 - RNA, 22 nt, Neisseria meningitidis Z2491
ucgggcaaugccgacgcgcugc

SEQ ID NO: 1376826 - RNA, 18 nt, Neisseria meningitidis Z2491
ucgggaaugacugaaacu

SEQ ID NO: 1376827 - RNA, 22 nt, Neisseria meningitidis Z2491
ucgggcaacggcaauauucaaa

SEQ ID NO: 1376828 - RNA, 16 nt, Neisseria meningitidis Z2491
ucgggcaaaagccagc

SEQ ID NO: 1376829 - RNA, 18 nt, Neisseria meningitidis Z2491
ucggcucgccgccuuugc

SEQ ID NO: 1376830 - RNA, 22 nt, Neisseria meningitidis Z2491
ucggcugucgggagggaaggga

SEQ ID NO: 1376831 - RNA, 18 nt, Neisseria meningitidis Z2491
ucggcuucgcgggcugcg

SEQ ID NO: 1376832 - RNA, 12 nt, Neisseria meningitidis Z2491
ucggagcaagac

SEQ ID NO: 1376833 - RNA, 19 nt, Neisseria meningitidis Z2491
ucggauaaaacagaaauua

SEQ ID NO: 1376834 - RNA, 16 nt, Neisseria meningitidis Z2491
ucgcuguuuucuguuu

SEQ ID NO: 1376835 - RNA, 19 nt, Neisseria meningitidis Z2491
ucgcuguuuucuguuuggc

SEQ ID NO: 1376836 - RNA, 20 nt, Neisseria meningitidis Z2491
ucggcaaacccuucgggaaa

SEQ ID NO: 1376837 - RNA, 23 nt, Neisseria meningitidis Z2491
ucuuugagcuaaggcgaggcaac

SEQ ID NO: 1376838 - RNA, 15 nt, Neisseria meningitidis Z2491
ucuuugagcuaaggc

SEQ ID NO: 1376839 - RNA, 18 nt, Neisseria meningitidis Z2491
ucuuugacaaaauccagu

SEQ ID NO: 1376840 - RNA, 22 nt, Neisseria meningitidis Z2491
ucuuugccguagaauguuucca

SEQ ID NO: 1376841 - RNA, 15 nt, Neisseria meningitidis Z2491
ucuuugcuggaagca

SEQ ID NO: 1376842 - RNA, 20 nt, Neisseria meningitidis Z2491
ucuuuggcaaccgucaguac

SEQ ID NO: 1376843 - RNA, 14 nt, Neisseria meningitidis Z2491
ucuuuuaauuucaa

SEQ ID NO: 1376844 - RNA, 17 nt, Neisseria meningitidis Z2491
ucuuuuaauuucaauac

SEQ ID NO: 1376845 - RNA, 23 nt, Neisseria meningitidis Z2491
ucuuuuaaccauacuucauuaaa

SEQ ID NO: 1376846 - RNA, 14 nt, Neisseria meningitidis Z2491
ucuuuucuaaaaua

SEQ ID NO: 1376847 - RNA, 14 nt, Neisseria meningitidis Z2491
ucuuuuuugccguc

SEQ ID NO: 1376848 - RNA, 16 nt, Neisseria meningitidis Z2491
ucuuucgggcugcccu

SEQ ID NO: 1376849 - RNA, 20 nt, Neisseria meningitidis Z2491
ucuuucgggucgagucccag

SEQ ID NO: 1376850 - RNA, 15 nt, Neisseria meningitidis Z2491
ucuuuccauccauca

SEQ ID NO: 1376851 - RNA, 13 nt, Neisseria meningitidis Z2491
ucuuucacauccu

SEQ ID NO: 1376852 - RNA, 18 nt, Neisseria meningitidis Z2491
ucuuucagcaauaaaaua

SEQ ID NO: 1376853 - RNA, 17 nt, Neisseria meningitidis Z2491
ucuugcuguuggaaaaa

SEQ ID NO: 1376854 - RNA, 15 nt, Neisseria meningitidis Z2491
ucuugggaaaugccg

SEQ ID NO: 1376855 - RNA, 20 nt, Neisseria meningitidis Z2491
ugaaaucugauuucguaauc

SEQ ID NO: 1376856 - RNA, 15 nt, Neisseria meningitidis Z2491
ugaaaucaacagauu

SEQ ID NO: 1376857 - RNA, 19 nt, Neisseria meningitidis Z2491
ugaaaugccgucugaaaac

SEQ ID NO: 1376858 - RNA, 16 nt, Neisseria meningitidis Z2491
ugaaauucaaaaaacc

SEQ ID NO: 1376859 - RNA, 12 nt, Neisseria meningitidis Z2491
ugaaauuuugcc

SEQ ID NO: 1376860 - RNA, 14 nt, Neisseria meningitidis Z2491
ugaacaucuuucag

SEQ ID NO: 1376861 - RNA, 17 nt, Neisseria meningitidis Z2491
ugaacacggguucagac

SEQ ID NO: 1376862 - RNA, 18 nt, Neisseria meningitidis Z2491
ugaacacaggguucggac

SEQ ID NO: 1376863 - RNA, 14 nt, Neisseria meningitidis Z2491
ugaacaacaaacua

SEQ ID NO: 1376864 - RNA, 21 nt, Neisseria meningitidis Z2491
ugaacgacgguauaaaccaaa

SEQ ID NO: 1376865 - RNA, 15 nt, Neisseria meningitidis Z2491
ugaacgaguuuucag

SEQ ID NO: 1376866 - RNA, 18 nt, Neisseria meningitidis Z2491
ugaaccggcacaggcuca

SEQ ID NO: 1376867 - RNA, 20 nt, Neisseria meningitidis Z2491
ugaaccuuauaguggauuaa

SEQ ID NO: 1376868 - RNA, 18 nt, Neisseria meningitidis Z2491
ugaaccagggauuuuuca

SEQ ID NO: 1376869 - RNA, 11 nt, Neisseria meningitidis Z2491
ugaacauuccg

SEQ ID NO: 1376870 - RNA, 13 nt, Neisseria meningitidis Z2491
ugaacauuucaga

SEQ ID NO: 1376871 - RNA, 22 nt, Neisseria meningitidis Z2491
ugaaaaugugcauuucuaauuu

SEQ ID NO: 1376872 - RNA, 23 nt, Neisseria meningitidis Z2491
ugaaacaaacccccgcuuuugcg

SEQ ID NO: 1376873 - RNA, 12 nt, Neisseria meningitidis Z2491
ugaaaaauuuau

SEQ ID NO: 1376874 - RNA, 19 nt, Neisseria meningitidis Z2491
ugaaaaaugccgucuggaa

SEQ ID NO: 1376875 - RNA, 14 nt, Neisseria meningitidis Z2491
ugaaaaauuuucag

SEQ ID NO: 1376876 - RNA, 23 nt, Neisseria meningitidis Z2491
ugaaaagcaagacguagcguggg

SEQ ID NO: 1376877 - RNA, 20 nt, Neisseria meningitidis Z2491
ugaaaguuacagaaauuuau

SEQ ID NO: 1376878 - RNA, 18 nt, Neisseria meningitidis Z2491
ugaaauaaaaaaugccgu

SEQ ID NO: 1376879 - RNA, 20 nt, Neisseria meningitidis Z2491
ugaaagucuuucagacggca

SEQ ID NO: 1376880 - RNA, 16 nt, Neisseria meningitidis Z2491
ugaaaggcuucagacg

SEQ ID NO: 1376881 - RNA, 19 nt, Neisseria meningitidis Z2491
ugaaacggugggucaacau

SEQ ID NO: 1376882 - RNA, 20 nt, Neisseria meningitidis Z2491
ugaaacgguuguucaaaucg

SEQ ID NO: 1376883 - RNA, 17 nt, Neisseria meningitidis Z2491
ugaaacggguaguccuu

SEQ ID NO: 1376884 - RNA, 17 nt, Neisseria meningitidis Z2491
ugaaacggacaaaccgc

SEQ ID NO: 1376885 - RNA, 16 nt, Neisseria meningitidis Z2491
ugaaacgaacaaaccc

SEQ ID NO: 1376886 - RNA, 17 nt, Neisseria meningitidis Z2491
ugaaacccgauuccugu

SEQ ID NO: 1376887 - RNA, 17 nt, Neisseria meningitidis Z2491
ugaaacccggaaaaaag

SEQ ID NO: 1376888 - RNA, 20 nt, Neisseria meningitidis Z2491
ugaaacccgucauucccacg

SEQ ID NO: 1376889 - RNA, 17 nt, Neisseria meningitidis Z2491
ugaaacucaaaaaaacu

SEQ ID NO: 1376890 - RNA, 15 nt, Neisseria meningitidis Z2491
ugaaacucaaaaaac

SEQ ID NO: 1376891 - RNA, 16 nt, Neisseria meningitidis Z2491
ugaaacucaaaaaacu

SEQ ID NO: 1376892 - RNA, 19 nt, Neisseria meningitidis Z2491
ugaaacucaaaaaacugga

SEQ ID NO: 1376893 - RNA, 15 nt, Neisseria meningitidis Z2491
ugaaacucaauauaa

SEQ ID NO: 1376894 - RNA, 14 nt, Neisseria meningitidis Z2491
ucuucaauuccugc

SEQ ID NO: 1376895 - RNA, 15 nt, Neisseria meningitidis Z2491
ucuucaauuccugcg

SEQ ID NO: 1376896 - RNA, 14 nt, Neisseria meningitidis Z2491
ucuucaaaaucauc

SEQ ID NO: 1376897 - RNA, 13 nt, Neisseria meningitidis Z2491
ucuucaacaccug

SEQ ID NO: 1376898 - RNA, 19 nt, Neisseria meningitidis Z2491
ucuucagauuuuacguucu

SEQ ID NO: 1376899 - RNA, 22 nt, Neisseria meningitidis Z2491
ucuuaugccuauuuuuuaauca

SEQ ID NO: 1376900 - RNA, 14 nt, Neisseria meningitidis Z2491
ucuuauccauccca

SEQ ID NO: 1376901 - RNA, 13 nt, Neisseria meningitidis Z2491
ucugcugccaucu

SEQ ID NO: 1376902 - RNA, 15 nt, Neisseria meningitidis Z2491
ucugcugccaucuca

SEQ ID NO: 1376903 - RNA, 18 nt, Neisseria meningitidis Z2491
ucugcggcucgccgccuu

SEQ ID NO: 1376904 - RNA, 19 nt, Neisseria meningitidis Z2491
ucugcggcuucgucgccuu

SEQ ID NO: 1376905 - RNA, 19 nt, Neisseria meningitidis Z2491
ucugcggcuuugccgccuu

SEQ ID NO: 1376906 - RNA, 14 nt, Neisseria meningitidis Z2491
ucugcacgccgacu

SEQ ID NO: 1376907 - RNA, 12 nt, Neisseria meningitidis Z2491
ucuguaaagaaa

SEQ ID NO: 1376908 - RNA, 18 nt, Neisseria meningitidis Z2491
ucuccaucaggccgcugg

SEQ ID NO: 1376909 - RNA, 15 nt, Neisseria meningitidis Z2491
ucuccugaucuaaaa

SEQ ID NO: 1376910 - RNA, 23 nt, Neisseria meningitidis Z2491
ucucuaaggugcugaagcaccaa

SEQ ID NO: 1376911 - RNA, 13 nt, Neisseria meningitidis Z2491
ucucuauuuguuc

SEQ ID NO: 1376912 - RNA, 14 nt, Neisseria meningitidis Z2491
ucugaagcccuguu

SEQ ID NO: 1376913 - RNA, 19 nt, Neisseria meningitidis Z2491
ucugaagccagccccacca

SEQ ID NO: 1376914 - RNA, 20 nt, Neisseria meningitidis Z2491
ucugaagccagccccaccau

SEQ ID NO: 1376915 - RNA, 23 nt, Neisseria meningitidis Z2491
ucugaagccuucagacaacaagc

SEQ ID NO: 1376916 - RNA, 18 nt, Neisseria meningitidis Z2491
ucugaagcguauuucuag

SEQ ID NO: 1376917 - RNA, 15 nt, Neisseria meningitidis Z2491
ucugaaaacaguuuu

SEQ ID NO: 1376918 - RNA, 15 nt, Neisseria meningitidis Z2491
ucugaaaagaugccu

SEQ ID NO: 1376919 - RNA, 23 nt, Neisseria meningitidis Z2491
ucugagaccuuugcaaaaauaau

SEQ ID NO: 1376920 - RNA, 14 nt, Neisseria meningitidis Z2491
ucugagaacuucag

SEQ ID NO: 1376921 - RNA, 18 nt, Neisseria meningitidis Z2491
ucugauuuugguuuucug

SEQ ID NO: 1376922 - RNA, 21 nt, Neisseria meningitidis Z2491
ucugauuuuuccuacuuuuug

SEQ ID NO: 1376923 - RNA, 19 nt, Neisseria meningitidis Z2491
ucugauuuuucuuuuauuu

SEQ ID NO: 1376924 - RNA, 23 nt, Neisseria meningitidis Z2491
ucugauuuuucuuuuauuuucaa

SEQ ID NO: 1376925 - RNA, 22 nt, Neisseria meningitidis Z2491
ggugcuucagcaccuuagagaa

SEQ ID NO: 1376926 - RNA, 15 nt, Neisseria meningitidis Z2491
gguuacuaaaauuuu

SEQ ID NO: 1376927 - RNA, 12 nt, Neisseria meningitidis Z2491
gguuaugcccuu

SEQ ID NO: 1376928 - RNA, 17 nt, Neisseria meningitidis Z2491
gguucaaauauggugga

SEQ ID NO: 1376929 - RNA, 20 nt, Neisseria meningitidis Z2491
gguuccguacuaucuguacu

SEQ ID NO: 1376930 - RNA, 13 nt, Neisseria meningitidis Z2491
gguuguuggaaaa

SEQ ID NO: 1376931 - RNA, 15 nt, Neisseria meningitidis Z2491
gguugucugaaaacu

SEQ ID NO: 1376932 - RNA, 16 nt, Neisseria meningitidis Z2491
gguuggaaggcggcgg

SEQ ID NO: 1376933 - RNA, 17 nt, Neisseria meningitidis Z2491
gguuggaaggcggcggc

SEQ ID NO: 1376934 - RNA, 16 nt, Neisseria meningitidis Z2491
gguucggauauuuccg

SEQ ID NO: 1376935 - RNA, 19 nt, Neisseria meningitidis Z2491
gguuuuccucgauuugaaa

SEQ ID NO: 1376936 - RNA, 21 nt, Neisseria meningitidis Z2491
gguuuuccccuguaaacagau

SEQ ID NO: 1376937 - RNA, 19 nt, Neisseria meningitidis Z2491
gguuuuguuuuuccaaacg

SEQ ID NO: 1376938 - RNA, 15 nt, Neisseria meningitidis Z2491
guaaaaaacuauaaa

SEQ ID NO: 1376939 - RNA, 13 nt, Neisseria meningitidis Z2491
gguuuuuugaguu

SEQ ID NO: 1376940 - RNA, 20 nt, Neisseria meningitidis Z2491
guaaaaaugccgucugaaaa

SEQ ID NO: 1376941 - RNA, 15 nt, Neisseria meningitidis Z2491
gguuuccgggcggug

SEQ ID NO: 1376942 - RNA, 12 nt, Neisseria meningitidis Z2491
gguuuaucagaa

SEQ ID NO: 1376943 - RNA, 21 nt, Neisseria meningitidis Z2491
gguuugccgcugacgaaacca

SEQ ID NO: 1376944 - RNA, 14 nt, Neisseria meningitidis Z2491
gguuugacagcgca

SEQ ID NO: 1376945 - RNA, 15 nt, Neisseria meningitidis Z2491
gguuucuugagauuu

SEQ ID NO: 1376946 - RNA, 20 nt, Neisseria meningitidis Z2491
ggucgcgaguucgagacucg

SEQ ID NO: 1376947 - RNA, 23 nt, Neisseria meningitidis Z2491
ggucucuuccuaaccgaaaaaau

SEQ ID NO: 1376948 - RNA, 19 nt, Neisseria meningitidis Z2491
ggucuaaccauggcauacu

SEQ ID NO: 1376949 - RNA, 14 nt, Neisseria meningitidis Z2491
ggugauggagcugu

SEQ ID NO: 1376950 - RNA, 21 nt, Neisseria meningitidis Z2491
ggucauuuccgauaaauuccu

SEQ ID NO: 1376951 - RNA, 23 nt, Neisseria meningitidis Z2491
ggucauuucugauaaacccccgu

SEQ ID NO: 1376952 - RNA, 21 nt, Neisseria meningitidis Z2491
gguccaaaacggcggcagccu

SEQ ID NO: 1376953 - RNA, 23 nt, Neisseria meningitidis Z2491
gguauucuuucgcuugugaaaau

SEQ ID NO: 1376954 - RNA, 18 nt, Neisseria meningitidis Z2491
gguauuuggguagaauua

SEQ ID NO: 1376955 - RNA, 19 nt, Neisseria meningitidis Z2491
ggggauuuggguagaauua

SEQ ID NO: 1376956 - RNA, 12 nt, Neisseria meningitidis Z2491
gggcugaagccc

SEQ ID NO: 1376957 - RNA, 17 nt, Neisseria meningitidis Z2491
gggcggcggcaauauuc

SEQ ID NO: 1376958 - RNA, 20 nt, Neisseria meningitidis Z2491
gggcggcucucaaaauauuc

SEQ ID NO: 1376959 - RNA, 18 nt, Neisseria meningitidis Z2491
ggguaauuuccaaaucgu

SEQ ID NO: 1376960 - RNA, 19 nt, Neisseria meningitidis Z2491
gggugauacuuauagugaa

SEQ ID NO: 1376961 - RNA, 16 nt, Neisseria meningitidis Z2491
gggguauuugcugacg

SEQ ID NO: 1376962 - RNA, 15 nt, Neisseria meningitidis Z2491
gggggugaagcaggc

SEQ ID NO: 1376963 - RNA, 16 nt, Neisseria meningitidis Z2491
gggagcaacugaaacc

SEQ ID NO: 1376964 - RNA, 16 nt, Neisseria meningitidis Z2491
gggauauuuucuuccg

SEQ ID NO: 1376965 - RNA, 19 nt, Neisseria meningitidis Z2491
gggcaacgcuugaaucuuc

SEQ ID NO: 1376966 - RNA, 17 nt, Neisseria meningitidis Z2491
gggcagcggcaauauuc

SEQ ID NO: 1376967 - RNA, 15 nt, Neisseria meningitidis Z2491
ggcuugagcgacagc

SEQ ID NO: 1376968 - RNA, 22 nt, Neisseria meningitidis Z2491
ggcuuucagauagcgcggacgg

SEQ ID NO: 1376969 - RNA, 20 nt, Neisseria meningitidis Z2491
ggcuuacucguucggcagcc

SEQ ID NO: 1376970 - RNA, 21 nt, Neisseria meningitidis Z2491
ggcuuacucguucggcagccu

SEQ ID NO: 1376971 - RNA, 12 nt, Neisseria meningitidis Z2491
ggcuucaucucg

SEQ ID NO: 1376972 - RNA, 23 nt, Neisseria meningitidis Z2491
ggcugucggggauuuugcggcuu

SEQ ID NO: 1376973 - RNA, 20 nt, Neisseria meningitidis Z2491
gggaaugacgaaaaguugca

SEQ ID NO: 1376974 - RNA, 21 nt, Neisseria meningitidis Z2491
gggaaugacgaagagcugcgg

SEQ ID NO: 1376975 - RNA, 18 nt, Neisseria meningitidis Z2491
gggaaugacgaugaaaag

SEQ ID NO: 1376976 - RNA, 18 nt, Neisseria meningitidis Z2491
gggaaucuagaaacgcaa

SEQ ID NO: 1376977 - RNA, 17 nt, Neisseria meningitidis Z2491
gggaaucuagaaaugaa

SEQ ID NO: 1376978 - RNA, 18 nt, Neisseria meningitidis Z2491
gggaaucuagaaaugaaa

SEQ ID NO: 1376979 - RNA, 19 nt, Neisseria meningitidis Z2491
gggaaucuagaaccucaaa

SEQ ID NO: 1376980 - RNA, 21 nt, Neisseria meningitidis Z2491
gggaaucuagacauucaaugc

SEQ ID NO: 1376981 - RNA, 17 nt, Neisseria meningitidis Z2491
gggaaucuggaaaccaa

SEQ ID NO: 1376982 - RNA, 22 nt, Neisseria meningitidis Z2491
gggaaucuggaaaccaaaaaac

SEQ ID NO: 1376983 - RNA, 12 nt, Neisseria meningitidis Z2491
ggcuuuugacag

SEQ ID NO: 1376984 - RNA, 17 nt, Neisseria meningitidis Z2491
ggcuuugccguuuuuca

SEQ ID NO: 1376985 - RNA, 21 nt, Neisseria meningitidis Z2491
gggacugccuacacaucgugu

SEQ ID NO: 1376986 - RNA, 19 nt, Neisseria meningitidis Z2491
gggacauucuuaagaugaa

SEQ ID NO: 1376987 - RNA, 12 nt, Neisseria meningitidis Z2491
gggaauccagug

SEQ ID NO: 1376988 - RNA, 16 nt, Neisseria meningitidis Z2491
gggaauuaugaugcgg

SEQ ID NO: 1376989 - RNA, 20 nt, Neisseria meningitidis Z2491
gggacagacggccaaacaca

SEQ ID NO: 1376990 - RNA, 21 nt, Neisseria meningitidis Z2491
gggacagacggccaaacacau

SEQ ID NO: 1376991 - RNA, 18 nt, Neisseria meningitidis Z2491
gucuagauucccgccugc

SEQ ID NO: 1376992 - RNA, 15 nt, Neisseria meningitidis Z2491
gucuaagaaaaccac

SEQ ID NO: 1376993 - RNA, 22 nt, Neisseria meningitidis Z2491
gucucagggcuggcaaaaccgu

SEQ ID NO: 1376994 - RNA, 19 nt, Neisseria meningitidis Z2491
gucucaacagcuuaaaauc

SEQ ID NO: 1376995 - RNA, 18 nt, Neisseria meningitidis Z2491
gucuaugaaucggcuggg

SEQ ID NO: 1376996 - RNA, 22 nt, Neisseria meningitidis Z2491
gucuauuuucgccccaaauacc

SEQ ID NO: 1376997 - RNA, 19 nt, Neisseria meningitidis Z2491
gucguacagauaguugcgg

SEQ ID NO: 1376998 - RNA, 23 nt, Neisseria meningitidis Z2491
gucggucggcaucgaugauguga

SEQ ID NO: 1376999 - RNA, 20 nt, Neisseria meningitidis Z2491
gucgucugaaaaauuuucag

SEQ ID NO: 1377000 - RNA, 15 nt, Neisseria meningitidis Z2491
gucggagaggucuug

SEQ ID NO: 1377001 - RNA, 13 nt, Neisseria meningitidis Z2491
gucggaguggcag

SEQ ID NO: 1377002 - RNA, 19 nt, Neisseria meningitidis Z2491
gucggcauacacggcagca

SEQ ID NO: 1377003 - RNA, 20 nt, Neisseria meningitidis Z2491
gucggcaaucauuucugucu

SEQ ID NO: 1377004 - RNA, 18 nt, Neisseria meningitidis Z2491
gucgagccaugcgugccc

SEQ ID NO: 1377005 - RNA, 14 nt, Neisseria meningitidis Z2491
gucgauguuuuugu

SEQ ID NO: 1377006 - RNA, 17 nt, Neisseria meningitidis Z2491
guccgagacagaacccg

SEQ ID NO: 1377007 - RNA, 17 nt, Neisseria meningitidis Z2491
guccgaccauuugcuua

SEQ ID NO: 1377008 - RNA, 13 nt, Neisseria meningitidis Z2491
gucccugccgguu

SEQ ID NO: 1377009 - RNA, 17 nt, Neisseria meningitidis Z2491
guccgacaauuucuccg

SEQ ID NO: 1377010 - RNA, 20 nt, Neisseria meningitidis Z2491
gucccaaauauuggcgggcg

SEQ ID NO: 1377011 - RNA, 17 nt, Neisseria meningitidis Z2491
gucgaaggcgcggcugc

SEQ ID NO: 1377012 - RNA, 19 nt, Neisseria meningitidis Z2491
gucgaccugcuguuugagc

SEQ ID NO: 1377013 - RNA, 15 nt, Neisseria meningitidis Z2491
gucgaaguggcuggc

SEQ ID NO: 1377014 - RNA, 16 nt, Neisseria meningitidis Z2491
guccacaagccgccga

SEQ ID NO: 1377015 - RNA, 15 nt, Neisseria meningitidis Z2491
gucaucgccgcaaau

SEQ ID NO: 1377016 - RNA, 14 nt, Neisseria meningitidis Z2491
guauuucagacagg

SEQ ID NO: 1377017 - RNA, 16 nt, Neisseria meningitidis Z2491
guauuuuuaucuuuua

SEQ ID NO: 1377018 - RNA, 14 nt, Neisseria meningitidis Z2491
guauuuuuauuauu

SEQ ID NO: 1377019 - RNA, 21 nt, Neisseria meningitidis Z2491
guauuggcacacaagcgcaug

SEQ ID NO: 1377020 - RNA, 15 nt, Neisseria meningitidis Z2491
guauucaagcagcaa

SEQ ID NO: 1377021 - RNA, 15 nt, Neisseria meningitidis Z2491
guauuagaaaugacu

SEQ ID NO: 1377022 - RNA, 22 nt, Neisseria meningitidis Z2491
gucaacacaaaauaaaaaacaa

SEQ ID NO: 1377023 - RNA, 22 nt, Neisseria meningitidis Z2491
gucaaaggcuucgagugcuucg

SEQ ID NO: 1377024 - RNA, 23 nt, Neisseria meningitidis Z2491
gucaauacacaagguuauuuucu

SEQ ID NO: 1377025 - RNA, 21 nt, Neisseria meningitidis Z2491
guaucucaaccuguuuuucaa

SEQ ID NO: 1377026 - RNA, 22 nt, Neisseria meningitidis Z2491
guaucugccccguuuuacccuc

SEQ ID NO: 1377027 - RNA, 17 nt, Neisseria meningitidis Z2491
guaucuuuaaacagcau

SEQ ID NO: 1377028 - RNA, 22 nt, Neisseria meningitidis Z2491
guaugccccacauaaacagcac

SEQ ID NO: 1377029 - RNA, 19 nt, Neisseria meningitidis Z2491
guaugcaaaaacaacccug

SEQ ID NO: 1377030 - RNA, 19 nt, Neisseria meningitidis Z2491
guaugcgaaucugcugcaa

SEQ ID NO: 1377031 - RNA, 12 nt, Neisseria meningitidis Z2491
guauguaccaag

SEQ ID NO: 1377032 - RNA, 22 nt, Neisseria meningitidis Z2491
guauccaaagucagggcggacg

SEQ ID NO: 1377033 - RNA, 21 nt, Neisseria meningitidis Z2491
guauccagccgccauccagca

SEQ ID NO: 1377034 - RNA, 16 nt, Neisseria meningitidis Z2491
guaucaggcaguuuga

SEQ ID NO: 1377035 - RNA, 13 nt, Neisseria meningitidis Z2491
guaucaaacaaga

SEQ ID NO: 1377036 - RNA, 14 nt, Neisseria meningitidis Z2491
guauaguaauaaau

SEQ ID NO: 1377037 - RNA, 16 nt, Neisseria meningitidis Z2491
guacgcgggcaaacaa

SEQ ID NO: 1377038 - RNA, 19 nt, Neisseria meningitidis Z2491
guaauuuauccgaaauaac

SEQ ID NO: 1377039 - RNA, 12 nt, Neisseria meningitidis Z2491
guacaaaaugcc

SEQ ID NO: 1377040 - RNA, 21 nt, Neisseria meningitidis Z2491
guacaaaaugccgucugaagc

SEQ ID NO: 1377041 - RNA, 11 nt, Neisseria meningitidis Z2491
guaauuuugaa

SEQ ID NO: 1377042 - RNA, 23 nt, Neisseria meningitidis Z2491
guaauuuugaacaucuugugcca

SEQ ID NO: 1377043 - RNA, 23 nt, Neisseria meningitidis Z2491
guacagguuugagccguauuuuu

SEQ ID NO: 1377044 - RNA, 11 nt, Neisseria meningitidis Z2491
guacaggaaag

SEQ ID NO: 1377045 - RNA, 23 nt, Neisseria meningitidis Z2491
guacaggaaaguaguuucccugu

SEQ ID NO: 1377046 - RNA, 18 nt, Neisseria meningitidis Z2491
guaaucauaauaggcugu

SEQ ID NO: 1377047 - RNA, 18 nt, Neisseria meningitidis Z2491
guaaaacgccaauuugua

SEQ ID NO: 1377048 - RNA, 16 nt, Neisseria meningitidis Z2491
guaauuccggcagccu

SEQ ID NO: 1377049 - RNA, 14 nt, Neisseria meningitidis Z2491
guaauuaggcuccu

SEQ ID NO: 1377050 - RNA, 17 nt, Neisseria meningitidis Z2491
guaaucuugaaacccgu

SEQ ID NO: 1377051 - RNA, 21 nt, Neisseria meningitidis Z2491
guaauccugaaugcccauuug

SEQ ID NO: 1377052 - RNA, 11 nt, Neisseria meningitidis Z2491
gugggaaugac

SEQ ID NO: 1377053 - RNA, 15 nt, Neisseria meningitidis Z2491
gugggaaugacggaa

SEQ ID NO: 1377054 - RNA, 20 nt, Neisseria meningitidis Z2491
gugggaaucuggaaaccaaa

SEQ ID NO: 1377055 - RNA, 17 nt, Neisseria meningitidis Z2491
guggcguauccauagau

SEQ ID NO: 1377056 - RNA, 16 nt, Neisseria meningitidis Z2491
gugggcauuaucagua

SEQ ID NO: 1377057 - RNA, 12 nt, Neisseria meningitidis Z2491
guggaacagaaa

SEQ ID NO: 1377058 - RNA, 13 nt, Neisseria meningitidis Z2491
gugcuuuggcuuc

SEQ ID NO: 1377059 - RNA, 15 nt, Neisseria meningitidis Z2491
guggagcaugaguuc

SEQ ID NO: 1377060 - RNA, 14 nt, Neisseria meningitidis Z2491
guggagggacagcg

SEQ ID NO: 1377061 - RNA, 18 nt, Neisseria meningitidis Z2491
guuaauccgcuauaacag

SEQ ID NO: 1377062 - RNA, 20 nt, Neisseria meningitidis Z2491
guuaauccgcuauauauucu

SEQ ID NO: 1377063 - RNA, 20 nt, Neisseria meningitidis Z2491
guuaaggcagagauaaaagc

SEQ ID NO: 1377064 - RNA, 14 nt, Neisseria meningitidis Z2491
guuaagaaaaccug

SEQ ID NO: 1377065 - RNA, 18 nt, Neisseria meningitidis Z2491
guguucauuauaguggau

SEQ ID NO: 1377066 - RNA, 14 nt, Neisseria meningitidis Z2491
guguucgcauuuug

SEQ ID NO: 1377067 - RNA, 21 nt, Neisseria meningitidis Z2491
guguuauaauccgcgccgcac

SEQ ID NO: 1377068 - RNA, 20 nt, Neisseria meningitidis Z2491
gugucaggaugucugccuga

SEQ ID NO: 1377069 - RNA, 21 nt, Neisseria meningitidis Z2491
guucugcaccgcuucggucgg

SEQ ID NO: 1377070 - RNA, 21 nt, Neisseria meningitidis Z2491
guucugcauauaggcaagcag

SEQ ID NO: 1377071 - RNA, 18 nt, Neisseria meningitidis Z2491
guuccgcaucgucgggaa

SEQ ID NO: 1377072 - RNA, 22 nt, Neisseria meningitidis Z2491
guuccgcauaagcgcaaaugcg

SEQ ID NO: 1377073 - RNA, 14 nt, Neisseria meningitidis Z2491
guuaauuaaaauac

SEQ ID NO: 1377074 - RNA, 12 nt, Neisseria meningitidis Z2491
guuaucccaaca

SEQ ID NO: 1377075 - RNA, 16 nt, Neisseria meningitidis Z2491
guucaauugcuuauuu

SEQ ID NO: 1377076 - RNA, 20 nt, Neisseria meningitidis Z2491
guucaaugaacguuuuaucu

SEQ ID NO: 1377077 - RNA, 22 nt, Neisseria meningitidis Z2491
guuauuuucacaaaaacagaaa

SEQ ID NO: 1377078 - RNA, 17 nt, Neisseria meningitidis Z2491
guuauuuuuaucguguu

SEQ ID NO: 1377079 - RNA, 20 nt, Neisseria meningitidis Z2491
guucaaaugccgucugaagc

SEQ ID NO: 1377080 - RNA, 22 nt, Neisseria meningitidis Z2491
guucaaauccuccaccauuucu

SEQ ID NO: 1377081 - RNA, 14 nt, Neisseria meningitidis Z2491
guucaaacugcccg

SEQ ID NO: 1377082 - RNA, 13 nt, Neisseria meningitidis Z2491
guuauuauuuucc

SEQ ID NO: 1377083 - RNA, 13 nt, Neisseria meningitidis Z2491
guuauucccccga

SEQ ID NO: 1377084 - RNA, 14 nt, Neisseria meningitidis Z2491
gugcaaagaaaaac

SEQ ID NO: 1377085 - RNA, 16 nt, Neisseria meningitidis Z2491
gugcauccgacaggca

SEQ ID NO: 1377086 - RNA, 18 nt, Neisseria meningitidis Z2491
gugcagguuucugugcgg

SEQ ID NO: 1377087 - RNA, 18 nt, Neisseria meningitidis Z2491
gugcaggcauuauuuuuc

SEQ ID NO: 1377088 - RNA, 17 nt, Neisseria meningitidis Z2491
gugcccacggggugcgg

SEQ ID NO: 1377089 - RNA, 13 nt, Neisseria meningitidis Z2491
gugccucuuccca

SEQ ID NO: 1377090 - RNA, 14 nt, Neisseria meningitidis Z2491
gugccucuucccaa

SEQ ID NO: 1377091 - RNA, 15 nt, Neisseria meningitidis Z2491
gugagggagagggca

SEQ ID NO: 1377092 - RNA, 15 nt, Neisseria meningitidis Z2491
gucuuuggcuuccag

SEQ ID NO: 1377093 - RNA, 18 nt, Neisseria meningitidis Z2491
gucuucgacgaaggcuau

SEQ ID NO: 1377094 - RNA, 15 nt, Neisseria meningitidis Z2491
gucuucgggcagggu

SEQ ID NO: 1377095 - RNA, 18 nt, Neisseria meningitidis Z2491
gucuucuuuggcuuuguu

SEQ ID NO: 1377096 - RNA, 17 nt, Neisseria meningitidis Z2491
gucuuccaacccuccgc

SEQ ID NO: 1377097 - RNA, 15 nt, Neisseria meningitidis Z2491
gucuucaaaaaacaa

SEQ ID NO: 1377098 - RNA, 21 nt, Neisseria meningitidis Z2491
gucugcuuaccgaccaacugc

SEQ ID NO: 1377099 - RNA, 16 nt, Neisseria meningitidis Z2491
gucuguaccgcaucuu

SEQ ID NO: 1377100 - RNA, 14 nt, Neisseria meningitidis Z2491
gucugaaaaauuuu

SEQ ID NO: 1377101 - RNA, 14 nt, Neisseria meningitidis Z2491
gucugaaaacagca

SEQ ID NO: 1377102 - RNA, 18 nt, Neisseria meningitidis Z2491
gucugaaaacaguuuuuu

SEQ ID NO: 1377103 - RNA, 14 nt, Neisseria meningitidis Z2491
gucugaagccuuca

SEQ ID NO: 1377104 - RNA, 14 nt, Neisseria meningitidis Z2491
gucugaaaccugua

SEQ ID NO: 1377105 - RNA, 15 nt, Neisseria meningitidis Z2491
gucugaaacgccaaa

SEQ ID NO: 1377106 - RNA, 15 nt, Neisseria meningitidis Z2491
gucugaaaggcuuca

SEQ ID NO: 1377107 - RNA, 14 nt, Neisseria meningitidis Z2491
gucugaaagguuuu

SEQ ID NO: 1377108 - RNA, 11 nt, Neisseria meningitidis Z2491
gucugaaauuu

SEQ ID NO: 1377109 - RNA, 17 nt, Neisseria meningitidis Z2491
gucugaacagcauuugc

SEQ ID NO: 1377110 - RNA, 14 nt, Neisseria meningitidis Z2491
gucugaaggcuuca

SEQ ID NO: 1377111 - RNA, 13 nt, Neisseria meningitidis Z2491
gucugccgcccga

SEQ ID NO: 1377112 - RNA, 13 nt, Neisseria meningitidis Z2491
gucugcggcggga

SEQ ID NO: 1377113 - RNA, 15 nt, Neisseria meningitidis Z2491
gucugcggcucgccg

SEQ ID NO: 1377114 - RNA, 13 nt, Neisseria meningitidis Z2491
uaaaucaacagca

SEQ ID NO: 1377115 - RNA, 14 nt, Neisseria meningitidis Z2491
uaaaugcucaccuu

SEQ ID NO: 1377116 - RNA, 14 nt, Neisseria meningitidis Z2491
uaaauaaaauuuaa

SEQ ID NO: 1377117 - RNA, 13 nt, Neisseria meningitidis Z2491
uaaaguuuguccc

SEQ ID NO: 1377118 - RNA, 15 nt, Neisseria meningitidis Z2491
uaaauagcugaaacu

SEQ ID NO: 1377119 - RNA, 19 nt, Neisseria meningitidis Z2491
uaaacuucgguuuuuuccg

SEQ ID NO: 1377120 - RNA, 18 nt, Neisseria meningitidis Z2491
uaaacgguauucauaccu

SEQ ID NO: 1377121 - RNA, 22 nt, Neisseria meningitidis Z2491
uaaacauuuuugcguauucgcc

SEQ ID NO: 1377122 - RNA, 15 nt, Neisseria meningitidis Z2491
uaaaccaaaaugccc

SEQ ID NO: 1377123 - RNA, 18 nt, Neisseria meningitidis Z2491
uaacccgacaaaauaccg

SEQ ID NO: 1377124 - RNA, 19 nt, Neisseria meningitidis Z2491
uaaccauacuucauuaaag

SEQ ID NO: 1377125 - RNA, 15 nt, Neisseria meningitidis Z2491
uaacagcaacccugu

SEQ ID NO: 1377126 - RNA, 14 nt, Neisseria meningitidis Z2491
uaaccuuugaauau

SEQ ID NO: 1377127 - RNA, 17 nt, Neisseria meningitidis Z2491
uaaccgcuucaaggcgg

SEQ ID NO: 1377128 - RNA, 13 nt, Neisseria meningitidis Z2491
uaaccgaaaaaau

SEQ ID NO: 1377129 - RNA, 14 nt, Neisseria meningitidis Z2491
uaaccgaaaaaaua

SEQ ID NO: 1377130 - RNA, 20 nt, Neisseria meningitidis Z2491
uaaccgaaaauaauugccuu

SEQ ID NO: 1377131 - RNA, 21 nt, Neisseria meningitidis Z2491
uaaccgaaaccugacaguaac

SEQ ID NO: 1377132 - RNA, 19 nt, Neisseria meningitidis Z2491
uaaccguaucaaacaagaa

SEQ ID NO: 1377133 - RNA, 14 nt, Neisseria meningitidis Z2491
uaaccguuuaauuu

SEQ ID NO: 1377134 - RNA, 22 nt, Neisseria meningitidis Z2491
uaacaaugcccgcaaucugaaa

SEQ ID NO: 1377135 - RNA, 16 nt, Neisseria meningitidis Z2491
uaaauucaacuuggua

SEQ ID NO: 1377136 - RNA, 15 nt, Neisseria meningitidis Z2491
uaaauuuaaaccagu

SEQ ID NO: 1377137 - RNA, 19 nt, Neisseria meningitidis Z2491
uaaauuuaaaccaguacag

SEQ ID NO: 1377138 - RNA, 15 nt, Neisseria meningitidis Z2491
uaaauuuaauccacu

SEQ ID NO: 1377139 - RNA, 20 nt, Neisseria meningitidis Z2491
uaaauuuaauccacuauaau

SEQ ID NO: 1377140 - RNA, 18 nt, Neisseria meningitidis Z2491
uaaauuguccauuuuucu

SEQ ID NO: 1377141 - RNA, 19 nt, Neisseria meningitidis Z2491
guuuucuucgccgguuuca

SEQ ID NO: 1377142 - RNA, 23 nt, Neisseria meningitidis Z2491
guuuuuggcguaaaacggugugg

SEQ ID NO: 1377143 - RNA, 11 nt, Neisseria meningitidis Z2491
guuuuugucuu

SEQ ID NO: 1377144 - RNA, 13 nt, Neisseria meningitidis Z2491
guuuuugccaagu

SEQ ID NO: 1377145 - RNA, 21 nt, Neisseria meningitidis Z2491
guuuuuccgacaaauuccuaa

SEQ ID NO: 1377146 - RNA, 20 nt, Neisseria meningitidis Z2491
guuuuucgcgcucugccagc

SEQ ID NO: 1377147 - RNA, 16 nt, Neisseria meningitidis Z2491
uaaaaaauccaaaaau

SEQ ID NO: 1377148 - RNA, 17 nt, Neisseria meningitidis Z2491
uaaaaaauccaaaaaua

SEQ ID NO: 1377149 - RNA, 12 nt, Neisseria meningitidis Z2491
uaaaaaaugccg

SEQ ID NO: 1377150 - RNA, 22 nt, Neisseria meningitidis Z2491
uaaaaaauauggaucagacauu

SEQ ID NO: 1377151 - RNA, 13 nt, Neisseria meningitidis Z2491
uaaaaaauacauu

SEQ ID NO: 1377152 - RNA, 11 nt, Neisseria meningitidis Z2491
uaaaaaauaga

SEQ ID NO: 1377153 - RNA, 12 nt, Neisseria meningitidis Z2491
uaaaaaauagaa

SEQ ID NO: 1377154 - RNA, 13 nt, Neisseria meningitidis Z2491
uaaaaaauagaaa

SEQ ID NO: 1377155 - RNA, 13 nt, Neisseria meningitidis Z2491
guuuuuugaguuu

SEQ ID NO: 1377156 - RNA, 16 nt, Neisseria meningitidis Z2491
guuuuuugaguuucag

SEQ ID NO: 1377157 - RNA, 15 nt, Neisseria meningitidis Z2491
guuuuuugaguuucc

SEQ ID NO: 1377158 - RNA, 24 nt, Neisseria meningitidis Z2491
guuuuuguuaauccacuauacugu

SEQ ID NO: 1377159 - RNA, 20 nt, Neisseria meningitidis Z2491
uaaaaaaaugccgucugaaa

SEQ ID NO: 1377160 - RNA, 10 nt, Neisseria meningitidis Z2491
uaaaaaaaug

SEQ ID NO: 1377161 - RNA, 15 nt, Neisseria meningitidis Z2491
uaaaaacaaaauagu

SEQ ID NO: 1377162 - RNA, 15 nt, Neisseria meningitidis Z2491
uaaaaacaauuuuau

SEQ ID NO: 1377163 - RNA, 20 nt, Neisseria meningitidis Z2491
uaaaaacaaaaaaucaaaaa

SEQ ID NO: 1377164 - RNA, 22 nt, Neisseria meningitidis Z2491
uaaaaauccaacgcugcaaaaa

SEQ ID NO: 1377165 - RNA, 11 nt, Neisseria meningitidis Z2491
uaaaaaucucc

SEQ ID NO: 1377166 - RNA, 21 nt, Neisseria meningitidis Z2491
uaaaauacgacccuuauccca

SEQ ID NO: 1377167 - RNA, 18 nt, Neisseria meningitidis Z2491
uaaaauaaaaauacuuau

SEQ ID NO: 1377168 - RNA, 20 nt, Neisseria meningitidis Z2491
guuuucaugguguuuccuaa

SEQ ID NO: 1377169 - RNA, 14 nt, Neisseria meningitidis Z2491
guuuucaagccuuc

SEQ ID NO: 1377170 - RNA, 22 nt, Neisseria meningitidis Z2491
guuuuaggcaauugaaaauuuu

SEQ ID NO: 1377171 - RNA, 12 nt, Neisseria meningitidis Z2491
guuuuauauucu

SEQ ID NO: 1377172 - RNA, 18 nt, Neisseria meningitidis Z2491
guuuuauccgauaaguuu

SEQ ID NO: 1377173 - RNA, 18 nt, Neisseria meningitidis Z2491
guuuuacccgauaaguuu

SEQ ID NO: 1377174 - RNA, 16 nt, Neisseria meningitidis Z2491
guuugcauucugcgga

SEQ ID NO: 1377175 - RNA, 17 nt, Neisseria meningitidis Z2491
guuugccaaggcggcgg

SEQ ID NO: 1377176 - RNA, 18 nt, Neisseria meningitidis Z2491
guuugccaaggcggcggg

SEQ ID NO: 1377177 - RNA, 19 nt, Neisseria meningitidis Z2491
guuugccgaguuuuuggua

SEQ ID NO: 1377178 - RNA, 20 nt, Neisseria meningitidis Z2491
guuugccgggaaggcggggc

SEQ ID NO: 1377179 - RNA, 18 nt, Neisseria meningitidis Z2491
guuugccugauccaaacc

SEQ ID NO: 1377180 - RNA, 16 nt, Neisseria meningitidis Z2491
guuucuugaguuucag

SEQ ID NO: 1377181 - RNA, 15 nt, Neisseria meningitidis Z2491
guuucuucagauuuu

SEQ ID NO: 1377182 - RNA, 15 nt, Neisseria meningitidis Z2491
guuucugauuuuggu

SEQ ID NO: 1377183 - RNA, 23 nt, Neisseria meningitidis Z2491
guuucuguauuuguauaguggau

SEQ ID NO: 1377184 - RNA, 22 nt, Neisseria meningitidis Z2491
guuucuguuguuucggauaaau

SEQ ID NO: 1377185 - RNA, 23 nt, Neisseria meningitidis Z2491
guuuguuguucaaauaaauucug

SEQ ID NO: 1377186 - RNA, 20 nt, Neisseria meningitidis Z2491
guuuggaugcguuucagagc

SEQ ID NO: 1377187 - RNA, 21 nt, Neisseria meningitidis Z2491
guuuggaugcguuucagagca

SEQ ID NO: 1377188 - RNA, 23 nt, Neisseria meningitidis Z2491
guuugguaaucaguuuuuucagc

SEQ ID NO: 1377189 - RNA, 18 nt, Neisseria meningitidis Z2491
guuuggcuguuuucuguu

SEQ ID NO: 1377190 - RNA, 21 nt, Neisseria meningitidis Z2491
guugucgcuucggauaaauuu

SEQ ID NO: 1377191 - RNA, 15 nt, Neisseria meningitidis Z2491
guucuggauucccac

SEQ ID NO: 1377192 - RNA, 18 nt, Neisseria meningitidis Z2491
guucuggauucccacuuu

SEQ ID NO: 1377193 - RNA, 18 nt, Neisseria meningitidis Z2491
guugugccguguuucauc

SEQ ID NO: 1377194 - RNA, 13 nt, Neisseria meningitidis Z2491
guuguucagaaaa

SEQ ID NO: 1377195 - RNA, 21 nt, Neisseria meningitidis Z2491
guuuaagacguggugcuaaaa

SEQ ID NO: 1377196 - RNA, 16 nt, Neisseria meningitidis Z2491
guuucaaggcggcggc

SEQ ID NO: 1377197 - RNA, 18 nt, Neisseria meningitidis Z2491
guuuccaauacaacaaaa

SEQ ID NO: 1377198 - RNA, 20 nt, Neisseria meningitidis Z2491
guuucgggcaaaagccagcg

SEQ ID NO: 1377199 - RNA, 18 nt, Neisseria meningitidis Z2491
guuucggagaaguuucug

SEQ ID NO: 1377200 - RNA, 13 nt, Neisseria meningitidis Z2491
guuucggguuuca

SEQ ID NO: 1377201 - RNA, 21 nt, Neisseria meningitidis Z2491
guuuccaaagugauuuccgcu

SEQ ID NO: 1377202 - RNA, 16 nt, Neisseria meningitidis Z2491
guuucaggaauuugcg

SEQ ID NO: 1377203 - RNA, 11 nt, Neisseria meningitidis Z2491
guuucagauug

SEQ ID NO: 1377204 - RNA, 16 nt, Neisseria meningitidis Z2491
guuucagacggcauuu

SEQ ID NO: 1377205 - RNA, 20 nt, Neisseria meningitidis Z2491
guuucagacggcauuugacu

SEQ ID NO: 1377206 - RNA, 12 nt, Neisseria meningitidis Z2491
uauuuucccuca

SEQ ID NO: 1377207 - RNA, 16 nt, Neisseria meningitidis Z2491
uauuuuccauaaaaua

SEQ ID NO: 1377208 - RNA, 18 nt, Neisseria meningitidis Z2491
uauuuucacaaaaacaga

SEQ ID NO: 1377209 - RNA, 12 nt, Neisseria meningitidis Z2491
uauuuucaaaau

SEQ ID NO: 1377210 - RNA, 14 nt, Neisseria meningitidis Z2491
uauuuugaaaaugg

SEQ ID NO: 1377211 - RNA, 21 nt, Neisseria meningitidis Z2491
uauuuugacuuuggaacaaaa

SEQ ID NO: 1377212 - RNA, 22 nt, Neisseria meningitidis Z2491
uauuuugcaagaauggcaaaau

SEQ ID NO: 1377213 - RNA, 18 nt, Neisseria meningitidis Z2491
uauuuuucugaaaaauuu

SEQ ID NO: 1377214 - RNA, 17 nt, Neisseria meningitidis Z2491
uauuuuugugaaaauaa

SEQ ID NO: 1377215 - RNA, 14 nt, Neisseria meningitidis Z2491
uauuuuuuaaccaa

SEQ ID NO: 1377216 - RNA, 18 nt, Neisseria meningitidis Z2491
ucaaaaacacaaaacuga

SEQ ID NO: 1377217 - RNA, 19 nt, Neisseria meningitidis Z2491
ucaaaaacacaaaacugaa

SEQ ID NO: 1377218 - RNA, 10 nt, Neisseria meningitidis Z2491
ucaaaaacag

SEQ ID NO: 1377219 - RNA, 15 nt, Neisseria meningitidis Z2491
ucaaaaacagaaaac

SEQ ID NO: 1377220 - RNA, 18 nt, Neisseria meningitidis Z2491
ucaaaaacagaaaaccaa

SEQ ID NO: 1377221 - RNA, 15 nt, Neisseria meningitidis Z2491
ucaaaaacagaaaau

SEQ ID NO: 1377222 - RNA, 19 nt, Neisseria meningitidis Z2491
ucaaaaaccugcuuguuuu

SEQ ID NO: 1377223 - RNA, 13 nt, Neisseria meningitidis Z2491
ucaaaaaaaaacc

SEQ ID NO: 1377224 - RNA, 23 nt, Neisseria meningitidis Z2491
ucaaaagccgugugaaaauuuaa

SEQ ID NO: 1377225 - RNA, 20 nt, Neisseria meningitidis Z2491
ucaaaacaucgacacccgcc

SEQ ID NO: 1377226 - RNA, 13 nt, Neisseria meningitidis Z2491
ucaaaaucagaaa

SEQ ID NO: 1377227 - RNA, 18 nt, Neisseria meningitidis Z2491
ucaaaaucaucccaaaca

SEQ ID NO: 1377228 - RNA, 15 nt, Neisseria meningitidis Z2491
ucaaaaugacacaaa

SEQ ID NO: 1377229 - RNA, 13 nt, Neisseria meningitidis Z2491
ucaaaaugcaaaa

SEQ ID NO: 1377230 - RNA, 15 nt, Neisseria meningitidis Z2491
ucaaaaugcaaaacu

SEQ ID NO: 1377231 - RNA, 15 nt, Neisseria meningitidis Z2491
ucaaaauguucaaua

SEQ ID NO: 1377232 - RNA, 17 nt, Neisseria meningitidis Z2491
ucaaaaucagaaaccua

SEQ ID NO: 1377233 - RNA, 12 nt, Neisseria meningitidis Z2491
ucaaacaacauc

SEQ ID NO: 1377234 - RNA, 16 nt, Neisseria meningitidis Z2491
ucaaacaagaaaugau

SEQ ID NO: 1377235 - RNA, 22 nt, Neisseria meningitidis Z2491
ucaaacaagaaaugauacgcga

SEQ ID NO: 1377236 - RNA, 18 nt, Neisseria meningitidis Z2491
ucaaacauuacugaaaug

SEQ ID NO: 1377237 - RNA, 18 nt, Neisseria meningitidis Z2491
ucaaacucacccugcaag

SEQ ID NO: 1377238 - RNA, 22 nt, Neisseria meningitidis Z2491
ucaaacucacccugcaaggcgg

SEQ ID NO: 1377239 - RNA, 23 nt, Neisseria meningitidis Z2491
ucaaauaaauucugaaacuuuaa

SEQ ID NO: 1377240 - RNA, 21 nt, Neisseria meningitidis Z2491
ucaaagauuaucugaaaguuu

SEQ ID NO: 1377241 - RNA, 18 nt, Neisseria meningitidis Z2491
ucaaagagaacaauucuc

SEQ ID NO: 1377242 - RNA, 19 nt, Neisseria meningitidis Z2491
ucaaagagaacaauucucu

SEQ ID NO: 1377243 - RNA, 19 nt, Neisseria meningitidis Z2491
ucaaagagaacgauucucu

SEQ ID NO: 1377244 - RNA, 13 nt, Neisseria meningitidis Z2491
ucaacaaaaugcc

SEQ ID NO: 1377245 - RNA, 14 nt, Neisseria meningitidis Z2491
ucaacaaaaugccg

SEQ ID NO: 1377246 - RNA, 16 nt, Neisseria meningitidis Z2491
ucaaauucugaugaaa

SEQ ID NO: 1377247 - RNA, 16 nt, Neisseria meningitidis Z2491
ucaaauucuuuuugca

SEQ ID NO: 1377248 - RNA, 20 nt, Neisseria meningitidis Z2491
ucaaaucguuuugcgccaaa

SEQ ID NO: 1377249 - RNA, 21 nt, Neisseria meningitidis Z2491
ucaaauaggcauugguaaaca

SEQ ID NO: 1377250 - RNA, 13 nt, Neisseria meningitidis Z2491
ucaaccaaaaaau

SEQ ID NO: 1377251 - RNA, 16 nt, Neisseria meningitidis Z2491
ucaaccgaaaaggaaa

SEQ ID NO: 1377252 - RNA, 18 nt, Neisseria meningitidis Z2491
ucaacacaccauccucau

SEQ ID NO: 1377253 - RNA, 11 nt, Neisseria meningitidis Z2491
ucaacacaaaa

SEQ ID NO: 1377254 - RNA, 15 nt, Neisseria meningitidis Z2491
ucaacacccugauuc

SEQ ID NO: 1377255 - RNA, 19 nt, Neisseria meningitidis Z2491
ucaacagauugucaaaaua

SEQ ID NO: 1377256 - RNA, 19 nt, Neisseria meningitidis Z2491
ucaacagguucaaacacau

SEQ ID NO: 1377257 - RNA, 19 nt, Neisseria meningitidis Z2491
ucaacugauuguuuuucag

SEQ ID NO: 1377258 - RNA, 20 nt, Neisseria meningitidis Z2491
ucaacguuucuauuuucccu

SEQ ID NO: 1377259 - RNA, 15 nt, Neisseria meningitidis Z2491
ucaacgcaagcggcg

SEQ ID NO: 1377260 - RNA, 22 nt, Neisseria meningitidis Z2491
ucaacgacuuccagcaccaguu

SEQ ID NO: 1377261 - RNA, 18 nt, Neisseria meningitidis Z2491
ucaaccggucaguuguuu

SEQ ID NO: 1377262 - RNA, 13 nt, Neisseria meningitidis Z2491
ucaaccuguuuuu

SEQ ID NO: 1377263 - RNA, 14 nt, Neisseria meningitidis Z2491
ucaagcaaaucuaa

SEQ ID NO: 1377264 - RNA, 17 nt, Neisseria meningitidis Z2491
ucaagcaaaaaaugccg

SEQ ID NO: 1377265 - RNA, 18 nt, Neisseria meningitidis Z2491
uauugccuuuauugugcu

SEQ ID NO: 1377266 - RNA, 17 nt, Neisseria meningitidis Z2491
uauugcacuaaaacuaa

SEQ ID NO: 1377267 - RNA, 15 nt, Neisseria meningitidis Z2491
uauuuaaauaaaauu

SEQ ID NO: 1377268 - RNA, 17 nt, Neisseria meningitidis Z2491
uauuuaaauaaagauag

SEQ ID NO: 1377269 - RNA, 16 nt, Neisseria meningitidis Z2491
uauuuagaauaaauuu

SEQ ID NO: 1377270 - RNA, 19 nt, Neisseria meningitidis Z2491
uauuuacguuuauuuacga

SEQ ID NO: 1377271 - RNA, 16 nt, Neisseria meningitidis Z2491
uauuuaccagaaaaaa

SEQ ID NO: 1377272 - RNA, 20 nt, Neisseria meningitidis Z2491
uauuugcgccgcccgaaaau

SEQ ID NO: 1377273 - RNA, 14 nt, Neisseria meningitidis Z2491
uauuuuagaaugaa

SEQ ID NO: 1377274 - RNA, 14 nt, Neisseria meningitidis Z2491
uauuuguacugucu

SEQ ID NO: 1377275 - RNA, 11 nt, Neisseria meningitidis Z2491
uauuuccugca

SEQ ID NO: 1377276 - RNA, 24 nt, Neisseria meningitidis Z2491
uauuucuagggaaaugcccgacuu

SEQ ID NO: 1377277 - RNA, 16 nt, Neisseria meningitidis Z2491
uauuucccgccauccc

SEQ ID NO: 1377278 - RNA, 13 nt, Neisseria meningitidis Z2491
uauuuauuuugaa

SEQ ID NO: 1377279 - RNA, 15 nt, Neisseria meningitidis Z2491
uauuuauuuugaaaa

SEQ ID NO: 1377280 - RNA, 22 nt, Neisseria meningitidis Z2491
uauucggaggcgcauugugggc

SEQ ID NO: 1377281 - RNA, 22 nt, Neisseria meningitidis Z2491
uauucugccgugggugcuuugg

SEQ ID NO: 1377282 - RNA, 18 nt, Neisseria meningitidis Z2491
uauucugauuuaaaacca

SEQ ID NO: 1377283 - RNA, 14 nt, Neisseria meningitidis Z2491
uauucugcaaaaau

SEQ ID NO: 1377284 - RNA, 12 nt, Neisseria meningitidis Z2491
uauucaagcaaa

SEQ ID NO: 1377285 - RNA, 12 nt, Neisseria meningitidis Z2491
uauuauuuucca

SEQ ID NO: 1377286 - RNA, 21 nt, Neisseria meningitidis Z2491
uauucaaagauuaucugaaag

SEQ ID NO: 1377287 - RNA, 15 nt, Neisseria meningitidis Z2491
uauucaauugacaaa

SEQ ID NO: 1377288 - RNA, 14 nt, Neisseria meningitidis Z2491
uauucaauuuaaac

SEQ ID NO: 1377289 - RNA, 16 nt, Neisseria meningitidis Z2491
uauucgaccagcuccc

SEQ ID NO: 1377290 - RNA, 22 nt, Neisseria meningitidis Z2491
uauucgaccagcucccaauccc

SEQ ID NO: 1377291 - RNA, 20 nt, Neisseria meningitidis Z2491
uauucgacgcgcuugauguc

SEQ ID NO: 1377292 - RNA, 22 nt, Neisseria meningitidis Z2491
uauucccguccggcaaacauca

SEQ ID NO: 1377293 - RNA, 20 nt, Neisseria meningitidis Z2491
uauuccccucggggucuuug

SEQ ID NO: 1377294 - RNA, 18 nt, Neisseria meningitidis Z2491
uauuaaugauuaucauaa

SEQ ID NO: 1377295 - RNA, 19 nt, Neisseria meningitidis Z2491
uauuaaugauuaucauaaa

SEQ ID NO: 1377296 - RNA, 21 nt, Neisseria meningitidis Z2491
uauuacgaacaaugcaaaaac

SEQ ID NO: 1377297 - RNA, 23 nt, Neisseria meningitidis Z2491
uauuacgaacaaugcaaaaacau

SEQ ID NO: 1377298 - RNA, 20 nt, Neisseria meningitidis Z2491
uauuacgaacaggacaaaaa

SEQ ID NO: 1377299 - RNA, 21 nt, Neisseria meningitidis Z2491
uauuacgaacaggacaaaaau

SEQ ID NO: 1377300 - RNA, 20 nt, Neisseria meningitidis Z2491
uauuaauuucggaaaugcgu

SEQ ID NO: 1377301 - RNA, 22 nt, Neisseria meningitidis Z2491
uauuaccgguauuuuuuucuua

SEQ ID NO: 1377302 - RNA, 13 nt, Neisseria meningitidis Z2491
uauuaaucagcgc

SEQ ID NO: 1377303 - RNA, 19 nt, Neisseria meningitidis Z2491
uauuaagugaguaaaaaca

SEQ ID NO: 1377304 - RNA, 22 nt, Neisseria meningitidis Z2491
uauuaagugaguaaaaacaauu

SEQ ID NO: 1377305 - RNA, 15 nt, Neisseria meningitidis Z2491
uauuaagaaaaacag

SEQ ID NO: 1377306 - RNA, 14 nt, Neisseria meningitidis Z2491
uauuagaaaugacu

SEQ ID NO: 1377307 - RNA, 16 nt, Neisseria meningitidis Z2491
uauuagaaaugacuga

SEQ ID NO: 1377308 - RNA, 21 nt, Neisseria meningitidis Z2491
uauuagaaccgaacacagaca

SEQ ID NO: 1377309 - RNA, 15 nt, Neisseria meningitidis Z2491
uauuauguauauaau

SEQ ID NO: 1377310 - RNA, 22 nt, Neisseria meningitidis Z2491
ucacaaugaggucgaacugccu

SEQ ID NO: 1377311 - RNA, 19 nt, Neisseria meningitidis Z2491
ucacacggccggcgcagcu

SEQ ID NO: 1377312 - RNA, 23 nt, Neisseria meningitidis Z2491
ucaccaaaccgucguuuuuuucc

SEQ ID NO: 1377313 - RNA, 13 nt, Neisseria meningitidis Z2491
ucacauagauggg

SEQ ID NO: 1377314 - RNA, 21 nt, Neisseria meningitidis Z2491
ucacaucguuggauuugucuu

SEQ ID NO: 1377315 - RNA, 16 nt, Neisseria meningitidis Z2491
ucaccaucacgcugcc

SEQ ID NO: 1377316 - RNA, 16 nt, Neisseria meningitidis Z2491
ucaccaucgagcugcc

SEQ ID NO: 1377317 - RNA, 19 nt, Neisseria meningitidis Z2491
ucaccgcgccgucaaucag

SEQ ID NO: 1377318 - RNA, 17 nt, Neisseria meningitidis Z2491
ucacccugcaaggcggc

SEQ ID NO: 1377319 - RNA, 16 nt, Neisseria meningitidis Z2491
ucaaugcuaaggcaau

SEQ ID NO: 1377320 - RNA, 12 nt, Neisseria meningitidis Z2491
ucaaucagcccc

SEQ ID NO: 1377321 - RNA, 16 nt, Neisseria meningitidis Z2491
ucaaucagccccgcca

SEQ ID NO: 1377322 - RNA, 14 nt, Neisseria meningitidis Z2491
ucaaucucauuuuc

SEQ ID NO: 1377323 - RNA, 13 nt, Neisseria meningitidis Z2491
ucaaucuuauuuu

SEQ ID NO: 1377324 - RNA, 14 nt, Neisseria meningitidis Z2491
ucaaucuuauuuuc

SEQ ID NO: 1377325 - RNA, 16 nt, Neisseria meningitidis Z2491
ucaauuaaaaacaaaa

SEQ ID NO: 1377326 - RNA, 23 nt, Neisseria meningitidis Z2491
ucaauuaaaaacaaaauaguaca

SEQ ID NO: 1377327 - RNA, 21 nt, Neisseria meningitidis Z2491
ucacaaaaacagaaaaccaaa

SEQ ID NO: 1377328 - RNA, 20 nt, Neisseria meningitidis Z2491
ucacaaaaacagaaauucaa

SEQ ID NO: 1377329 - RNA, 13 nt, Neisseria meningitidis Z2491
ucaauuucaacug

SEQ ID NO: 1377330 - RNA, 19 nt, Neisseria meningitidis Z2491
ucaauauuaggaagguuuu

SEQ ID NO: 1377331 - RNA, 16 nt, Neisseria meningitidis Z2491
ucaaucaaugugccuc

SEQ ID NO: 1377332 - RNA, 23 nt, Neisseria meningitidis Z2491
ucaaucacccgguccaacuucaa

SEQ ID NO: 1377333 - RNA, 20 nt, Neisseria meningitidis Z2491
ucaagcgaugccgcaccuaa

SEQ ID NO: 1377334 - RNA, 18 nt, Neisseria meningitidis Z2491
ucaagccuucccguucca

SEQ ID NO: 1377335 - RNA, 21 nt, Neisseria meningitidis Z2491
ucaagccuucccguuccacaa

SEQ ID NO: 1377336 - RNA, 22 nt, Neisseria meningitidis Z2491
ucaaguuccagacggcauuuuu

SEQ ID NO: 1377337 - RNA, 21 nt, Neisseria meningitidis Z2491
ucaaguccaaacaaaaaugcc

SEQ ID NO: 1377338 - RNA, 18 nt, Neisseria meningitidis Z2491
ucacuuggugcuucagca

SEQ ID NO: 1377339 - RNA, 21 nt, Neisseria meningitidis Z2491
ucacuuggugcuucagcaccu

SEQ ID NO: 1377340 - RNA, 18 nt, Neisseria meningitidis Z2491
ucacuuggaauaugaaua

SEQ ID NO: 1377341 - RNA, 21 nt, Neisseria meningitidis Z2491
ucacuuugcucagcccgaaau

SEQ ID NO: 1377342 - RNA, 12 nt, Neisseria meningitidis Z2491
ucacuauuaaaa

SEQ ID NO: 1377343 - RNA, 16 nt, Neisseria meningitidis Z2491
ucacuauuaaaaugcg

SEQ ID NO: 1377344 - RNA, 18 nt, Neisseria meningitidis Z2491
ucacguucugaaaaauau

SEQ ID NO: 1377345 - RNA, 19 nt, Neisseria meningitidis Z2491
ucacgcccaaaucuugcaa

SEQ ID NO: 1377346 - RNA, 22 nt, Neisseria meningitidis Z2491
ucacggcuuugucgguaaaaau

SEQ ID NO: 1377347 - RNA, 23 nt, Neisseria meningitidis Z2491
ucacggagaaggcaauaauaaac

SEQ ID NO: 1377348 - RNA, 20 nt, Neisseria meningitidis Z2491
ucagacgguauucuuucgcu

SEQ ID NO: 1377349 - RNA, 20 nt, Neisseria meningitidis Z2491
ucagacggcauauuuuuugg

SEQ ID NO: 1377350 - RNA, 18 nt, Neisseria meningitidis Z2491
ucagacggcaucaaaaug

SEQ ID NO: 1377351 - RNA, 16 nt, Neisseria meningitidis Z2491
ucagacggcaucagua

SEQ ID NO: 1377352 - RNA, 16 nt, Neisseria meningitidis Z2491
ucagacggcauuugac

SEQ ID NO: 1377353 - RNA, 24 nt, Neisseria meningitidis Z2491
ucagacggcauuuuccuugcaacc

SEQ ID NO: 1377354 - RNA, 15 nt, Neisseria meningitidis Z2491
ucagacggcauuuug

SEQ ID NO: 1377355 - RNA, 17 nt, Neisseria meningitidis Z2491
ucagacggcauuuugau

SEQ ID NO: 1377356 - RNA, 22 nt, Neisseria meningitidis Z2491
ucagacggcauuuugcugccgg

SEQ ID NO: 1377357 - RNA, 21 nt, Neisseria meningitidis Z2491
ucagacggcauuuuguuucgg

SEQ ID NO: 1377358 - RNA, 19 nt, Neisseria meningitidis Z2491
ucagacggcauuuuguuuu

SEQ ID NO: 1377359 - RNA, 14 nt, Neisseria meningitidis Z2491
ucagaauugauucu

SEQ ID NO: 1377360 - RNA, 17 nt, Neisseria meningitidis Z2491
ucagaccccuuucggca

SEQ ID NO: 1377361 - RNA, 17 nt, Neisseria meningitidis Z2491
ucagacauuaaaaaaua

SEQ ID NO: 1377362 - RNA, 20 nt, Neisseria meningitidis Z2491
ucagacagcccucuugccuu

SEQ ID NO: 1377363 - RNA, 13 nt, Neisseria meningitidis Z2491
ucagaaaccuaaa

SEQ ID NO: 1377364 - RNA, 17 nt, Neisseria meningitidis Z2491
ucagaaaccuaaaaucc

SEQ ID NO: 1377365 - RNA, 12 nt, Neisseria meningitidis Z2491
ucagaaaaguuu

SEQ ID NO: 1377366 - RNA, 21 nt, Neisseria meningitidis Z2491
ucagaaaugacggaaacucaa

SEQ ID NO: 1377367 - RNA, 22 nt, Neisseria meningitidis Z2491
ucagaaaugacugaaauucaaa

SEQ ID NO: 1377368 - RNA, 20 nt, Neisseria meningitidis Z2491
ucagauguuucggcgcaucc

SEQ ID NO: 1377369 - RNA, 16 nt, Neisseria meningitidis Z2491
ucagauugauaaaagc

SEQ ID NO: 1377370 - RNA, 16 nt, Neisseria meningitidis Z2491
ucagccaucuacaaaa

SEQ ID NO: 1377371 - RNA, 21 nt, Neisseria meningitidis Z2491
ucagccaucuacaaaauaauc

SEQ ID NO: 1377372 - RNA, 16 nt, Neisseria meningitidis Z2491
ucagcccgaaauaggc

SEQ ID NO: 1377373 - RNA, 14 nt, Neisseria meningitidis Z2491
ucagcaauaaaaua

SEQ ID NO: 1377374 - RNA, 15 nt, Neisseria meningitidis Z2491
ucagcaccuuagaga

SEQ ID NO: 1377375 - RNA, 22 nt, Neisseria meningitidis Z2491
ucagcaggggauugccgccccu

SEQ ID NO: 1377376 - RNA, 16 nt, Neisseria meningitidis Z2491
ucagcaguauagugaa

SEQ ID NO: 1377377 - RNA, 17 nt, Neisseria meningitidis Z2491
uagauucccguuuucac

SEQ ID NO: 1377378 - RNA, 19 nt, Neisseria meningitidis Z2491
uagauggggaggcgcggcc

SEQ ID NO: 1377379 - RNA, 15 nt, Neisseria meningitidis Z2491
uagaugcuccaaucu

SEQ ID NO: 1377380 - RNA, 21 nt, Neisseria meningitidis Z2491
uagaaaaccgaaacagaaacc

SEQ ID NO: 1377381 - RNA, 16 nt, Neisseria meningitidis Z2491
uagaaaaucaaaaaaa

SEQ ID NO: 1377382 - RNA, 20 nt, Neisseria meningitidis Z2491
uagaaaaucaaaaaaaaacc

SEQ ID NO: 1377383 - RNA, 15 nt, Neisseria meningitidis Z2491
uagcauuuaauucac

SEQ ID NO: 1377384 - RNA, 20 nt, Neisseria meningitidis Z2491
uagcagcccaguugguuuga

SEQ ID NO: 1377385 - RNA, 22 nt, Neisseria meningitidis Z2491
uagcaacugaaccgucauuccc

SEQ ID NO: 1377386 - RNA, 17 nt, Neisseria meningitidis Z2491
uagcaaaauaaaaugcc

SEQ ID NO: 1377387 - RNA, 18 nt, Neisseria meningitidis Z2491
uagauuuuuuuauuuaaa

SEQ ID NO: 1377388 - RNA, 23 nt, Neisseria meningitidis Z2491
uaggcggcggccugguugauguc

SEQ ID NO: 1377389 - RNA, 16 nt, Neisseria meningitidis Z2491
uaggcgggacggccgc

SEQ ID NO: 1377390 - RNA, 23 nt, Neisseria meningitidis Z2491
uaggcacgaaucuuauccacaga

SEQ ID NO: 1377391 - RNA, 19 nt, Neisseria meningitidis Z2491
uagcguccgaaaugguuua

SEQ ID NO: 1377392 - RNA, 11 nt, Neisseria meningitidis Z2491
uagguuuuguu

SEQ ID NO: 1377393 - RNA, 18 nt, Neisseria meningitidis Z2491
uagguuucugauuuuggu

SEQ ID NO: 1377394 - RNA, 14 nt, Neisseria meningitidis Z2491
uagguuugcaggaa

SEQ ID NO: 1377395 - RNA, 14 nt, Neisseria meningitidis Z2491
uaggcuuuuuccaa

SEQ ID NO: 1377396 - RNA, 23 nt, Neisseria meningitidis Z2491
uagugauuaacaaaaaucaggac

SEQ ID NO: 1377397 - RNA, 15 nt, Neisseria meningitidis Z2491
uagucaggcugccuu

SEQ ID NO: 1377398 - RNA, 16 nt, Neisseria meningitidis Z2491
uaguacugcaaggcga

SEQ ID NO: 1377399 - RNA, 23 nt, Neisseria meningitidis Z2491
uaguacggcaaggcaaggcaaca

SEQ ID NO: 1377400 - RNA, 19 nt, Neisseria meningitidis Z2491
uaguacggcaaggcgaggc

SEQ ID NO: 1377401 - RNA, 19 nt, Neisseria meningitidis Z2491
uaguugauuaaaacaaaaa

SEQ ID NO: 1377402 - RNA, 19 nt, Neisseria meningitidis Z2491
uaguugccgucaaagaaca

SEQ ID NO: 1377403 - RNA, 23 nt, Neisseria meningitidis Z2491
uauaaaaggucuuuucuaaaaua

SEQ ID NO: 1377404 - RNA, 17 nt, Neisseria meningitidis Z2491
uauaaagauacaagaac

SEQ ID NO: 1377405 - RNA, 15 nt, Neisseria meningitidis Z2491
uauaacgacuguaaa

SEQ ID NO: 1377406 - RNA, 18 nt, Neisseria meningitidis Z2491
uaucggcuucgcgggcug

SEQ ID NO: 1377407 - RNA, 18 nt, Neisseria meningitidis Z2491
uaucgguauagugaacua

SEQ ID NO: 1377408 - RNA, 13 nt, Neisseria meningitidis Z2491
uaucgcuguaaua

SEQ ID NO: 1377409 - RNA, 22 nt, Neisseria meningitidis Z2491
uaucggcauauguuucaacaca

SEQ ID NO: 1377410 - RNA, 16 nt, Neisseria meningitidis Z2491
uauccggcuuuccaug

SEQ ID NO: 1377411 - RNA, 16 nt, Neisseria meningitidis Z2491
uauccuaguuauccag

SEQ ID NO: 1377412 - RNA, 17 nt, Neisseria meningitidis Z2491
uauccauagauaaauuu

SEQ ID NO: 1377413 - RNA, 16 nt, Neisseria meningitidis Z2491
uaucccaacaagcuca

SEQ ID NO: 1377414 - RNA, 19 nt, Neisseria meningitidis Z2491
uaucagaugccgucugaaa

SEQ ID NO: 1377415 - RNA, 14 nt, Neisseria meningitidis Z2491
uaucagaaaugacu

SEQ ID NO: 1377416 - RNA, 21 nt, Neisseria meningitidis Z2491
uaucauucuguucuaaaagca

SEQ ID NO: 1377417 - RNA, 15 nt, Neisseria meningitidis Z2491
uaucauugcuuacaa

SEQ ID NO: 1377418 - RNA, 19 nt, Neisseria meningitidis Z2491
uauccaaacgcauaaccgu

SEQ ID NO: 1377419 - RNA, 17 nt, Neisseria meningitidis Z2491
uauccaccaacugguca

SEQ ID NO: 1377420 - RNA, 18 nt, Neisseria meningitidis Z2491
uauaguggauuaaauuua

SEQ ID NO: 1377421 - RNA, 22 nt, Neisseria meningitidis Z2491
uauaguggauuaaauuuaaacc

SEQ ID NO: 1377422 - RNA, 19 nt, Neisseria meningitidis Z2491
uauaguggauuaacaaaaa

SEQ ID NO: 1377423 - RNA, 17 nt, Neisseria meningitidis Z2491
uauagugaauuaaauuu

SEQ ID NO: 1377424 - RNA, 19 nt, Neisseria meningitidis Z2491
uauauuuuuucuaaauguu

SEQ ID NO: 1377425 - RNA, 19 nt, Neisseria meningitidis Z2491
uauauuuguccaugauuuu

SEQ ID NO: 1377426 - RNA, 23 nt, Neisseria meningitidis Z2491
uaugccgccugccuguuuuucuu

SEQ ID NO: 1377427 - RNA, 14 nt, Neisseria meningitidis Z2491
uaugccuuuuucaa

SEQ ID NO: 1377428 - RNA, 13 nt, Neisseria meningitidis Z2491
uaugcgccugcau

SEQ ID NO: 1377429 - RNA, 21 nt, Neisseria meningitidis Z2491
uaugcggcuugggcgacggcg

SEQ ID NO: 1377430 - RNA, 20 nt, Neisseria meningitidis Z2491
uaugcguucaaaugccgucu

SEQ ID NO: 1377431 - RNA, 22 nt, Neisseria meningitidis Z2491
uauggaucagacauuaaaaaau

SEQ ID NO: 1377432 - RNA, 21 nt, Neisseria meningitidis Z2491
uaugcucaaucucauuuucaa

SEQ ID NO: 1377433 - RNA, 11 nt, Neisseria meningitidis Z2491
uaugcuucaag

SEQ ID NO: 1377434 - RNA, 18 nt, Neisseria meningitidis Z2491
uauguauaguaauaaauu

SEQ ID NO: 1377435 - RNA, 19 nt, Neisseria meningitidis Z2491
uauguauaguaauaaauua

SEQ ID NO: 1377436 - RNA, 19 nt, Neisseria meningitidis Z2491
uauguauaaugcccauucc

SEQ ID NO: 1377437 - RNA, 21 nt, Neisseria meningitidis Z2491
uauuaaaaaccggauuuauuu

SEQ ID NO: 1377438 - RNA, 14 nt, Neisseria meningitidis Z2491
uaugucguaaagcg

SEQ ID NO: 1377439 - RNA, 13 nt, Neisseria meningitidis Z2491
uauguucaggguu

SEQ ID NO: 1377440 - RNA, 13 nt, Neisseria meningitidis Z2491
uaugaaaccauua

SEQ ID NO: 1377441 - RNA, 21 nt, Neisseria meningitidis Z2491
uaugaaaccauuacaaaugcu

SEQ ID NO: 1377442 - RNA, 19 nt, Neisseria meningitidis Z2491
uaucuuucagcaauaaaau

SEQ ID NO: 1377443 - RNA, 21 nt, Neisseria meningitidis Z2491
uaucuuucagcaauaaaauaa

SEQ ID NO: 1377444 - RNA, 20 nt, Neisseria meningitidis Z2491
uaucuucguccgugccgaaa

SEQ ID NO: 1377445 - RNA, 22 nt, Neisseria meningitidis Z2491
uaucuucguccgugccgaaaua

SEQ ID NO: 1377446 - RNA, 23 nt, Neisseria meningitidis Z2491
uaucugccccguuuuacccucuc

SEQ ID NO: 1377447 - RNA, 12 nt, Neisseria meningitidis Z2491
uacugguuuuug

SEQ ID NO: 1377448 - RNA, 22 nt, Neisseria meningitidis Z2491
uacuguuguucuaaggucuaga

SEQ ID NO: 1377449 - RNA, 18 nt, Neisseria meningitidis Z2491
uacugucugcggcucgcc

SEQ ID NO: 1377450 - RNA, 21 nt, Neisseria meningitidis Z2491
uacugucuuauuaaauauuaa

SEQ ID NO: 1377451 - RNA, 21 nt, Neisseria meningitidis Z2491
uacuggcaaauugaaaugccg

SEQ ID NO: 1377452 - RNA, 16 nt, Neisseria meningitidis Z2491
uacuucauuuuuucaa

SEQ ID NO: 1377453 - RNA, 14 nt, Neisseria meningitidis Z2491
uacuuauaucguca

SEQ ID NO: 1377454 - RNA, 13 nt, Neisseria meningitidis Z2491
uacuuggcaaaau

SEQ ID NO: 1377455 - RNA, 15 nt, Neisseria meningitidis Z2491
uacugccugccgcac

SEQ ID NO: 1377456 - RNA, 22 nt, Neisseria meningitidis Z2491
uacugccgcaaacggcaggcaa

SEQ ID NO: 1377457 - RNA, 22 nt, Neisseria meningitidis Z2491
uacucugcggacuuaagaaaca

SEQ ID NO: 1377458 - RNA, 19 nt, Neisseria meningitidis Z2491
uacuccgcauuguuggaaa

SEQ ID NO: 1377459 - RNA, 17 nt, Neisseria meningitidis Z2491
uacuauuuguacugucu

SEQ ID NO: 1377460 - RNA, 23 nt, Neisseria meningitidis Z2491
uacuaaaacacagccaaaauauu

SEQ ID NO: 1377461 - RNA, 16 nt, Neisseria meningitidis Z2491
uacccaaugacugccc

SEQ ID NO: 1377462 - RNA, 14 nt, Neisseria meningitidis Z2491
uacccaaggcagua

SEQ ID NO: 1377463 - RNA, 19 nt, Neisseria meningitidis Z2491
uacccucuuggauaaacau

SEQ ID NO: 1377464 - RNA, 17 nt, Neisseria meningitidis Z2491
uaccgcaaccugaaagg

SEQ ID NO: 1377465 - RNA, 18 nt, Neisseria meningitidis Z2491
uaccgccccuaaaaugcc

SEQ ID NO: 1377466 - RNA, 18 nt, Neisseria meningitidis Z2491
uaccgguauuuuuuucuu

SEQ ID NO: 1377467 - RNA, 19 nt, Neisseria meningitidis Z2491
uaccggucagaaucgccuc

SEQ ID NO: 1377468 - RNA, 13 nt, Neisseria meningitidis Z2491
uaccgggcaggcu

SEQ ID NO: 1377469 - RNA, 14 nt, Neisseria meningitidis Z2491
uacauagcaggcau

SEQ ID NO: 1377470 - RNA, 13 nt, Neisseria meningitidis Z2491
uacauaaggaaca

SEQ ID NO: 1377471 - RNA, 12 nt, Neisseria meningitidis Z2491
uacccaaaugca

SEQ ID NO: 1377472 - RNA, 19 nt, Neisseria meningitidis Z2491
uacccaaaugcagaauaag

SEQ ID NO: 1377473 - RNA, 11 nt, Neisseria meningitidis Z2491
uacccaaauac

SEQ ID NO: 1377474 - RNA, 19 nt, Neisseria meningitidis Z2491
uacgaaacggguucuguau

SEQ ID NO: 1377475 - RNA, 21 nt, Neisseria meningitidis Z2491
uacgaacaggacaaaaauccu

SEQ ID NO: 1377476 - RNA, 17 nt, Neisseria meningitidis Z2491
uacgaacaaugcaaaaa

SEQ ID NO: 1377477 - RNA, 21 nt, Neisseria meningitidis Z2491
uacgaacaaugcaaaaacauc

SEQ ID NO: 1377478 - RNA, 18 nt, Neisseria meningitidis Z2491
uaccgucaaauucuuuuu

SEQ ID NO: 1377479 - RNA, 22 nt, Neisseria meningitidis Z2491
uacggaugucgaguucuuuuaa

SEQ ID NO: 1377480 - RNA, 21 nt, Neisseria meningitidis Z2491
uacgcggcugaaaaaaugccg

SEQ ID NO: 1377481 - RNA, 17 nt, Neisseria meningitidis Z2491
uacggaaccaauucacu

SEQ ID NO: 1377482 - RNA, 17 nt, Neisseria meningitidis Z2491
uacggaaucgauucacu

SEQ ID NO: 1377483 - RNA, 16 nt, Neisseria meningitidis Z2491
uacgcaauggcaaaac

SEQ ID NO: 1377484 - RNA, 12 nt, Neisseria meningitidis Z2491
uacgcagcaguu

SEQ ID NO: 1377485 - RNA, 13 nt, Neisseria meningitidis Z2491
uacaguuuaaucc

SEQ ID NO: 1377486 - RNA, 19 nt, Neisseria meningitidis Z2491
uacagcguugccucgccuu

SEQ ID NO: 1377487 - RNA, 23 nt, Neisseria meningitidis Z2491
uacacuguaaucucaaaucccgu

SEQ ID NO: 1377488 - RNA, 14 nt, Neisseria meningitidis Z2491
uacacagccaaaaa

SEQ ID NO: 1377489 - RNA, 19 nt, Neisseria meningitidis Z2491
uacacagccaaaaaaaagc

SEQ ID NO: 1377490 - RNA, 22 nt, Neisseria meningitidis Z2491
uacacagccaaaaaaaagccgu

SEQ ID NO: 1377491 - RNA, 19 nt, Neisseria meningitidis Z2491
uacaagaaccgaaaaucuu

SEQ ID NO: 1377492 - RNA, 15 nt, Neisseria meningitidis Z2491
uacaagaacuuuauc

SEQ ID NO: 1377493 - RNA, 20 nt, Neisseria meningitidis Z2491
uaauuuuuaaaauuuuuaua

SEQ ID NO: 1377494 - RNA, 18 nt, Neisseria meningitidis Z2491
uacaaaauaaucuuccuu

SEQ ID NO: 1377495 - RNA, 15 nt, Neisseria meningitidis Z2491
uacaaacaggcuuca

SEQ ID NO: 1377496 - RNA, 21 nt, Neisseria meningitidis Z2491
uacaaacaucugauuuuucuu

SEQ ID NO: 1377497 - RNA, 12 nt, Neisseria meningitidis Z2491
uacaaaaugccg

SEQ ID NO: 1377498 - RNA, 13 nt, Neisseria meningitidis Z2491
uaauucggcuaga

SEQ ID NO: 1377499 - RNA, 15 nt, Neisseria meningitidis Z2491
uaauucuacccaaau

SEQ ID NO: 1377500 - RNA, 18 nt, Neisseria meningitidis Z2491
uaauucuacccaaauccc

SEQ ID NO: 1377501 - RNA, 22 nt, Neisseria meningitidis Z2491
uaauucuccaaguuccaauaca

SEQ ID NO: 1377502 - RNA, 21 nt, Neisseria meningitidis Z2491
uaauuugccguaucacaacac

SEQ ID NO: 1377503 - RNA, 13 nt, Neisseria meningitidis Z2491
uaauuucggaaau

SEQ ID NO: 1377504 - RNA, 17 nt, Neisseria meningitidis Z2491
uaauuuauccgaaauaa

SEQ ID NO: 1377505 - RNA, 10 nt, Neisseria meningitidis Z2491
uaauuucaau

SEQ ID NO: 1377506 - RNA, 20 nt, Neisseria meningitidis Z2491
uaaugcgguguaucuuuuug

SEQ ID NO: 1377507 - RNA, 13 nt, Neisseria meningitidis Z2491
uaauuaaaauacg

SEQ ID NO: 1377508 - RNA, 17 nt, Neisseria meningitidis Z2491
uaauccgaguggcuucc

SEQ ID NO: 1377509 - RNA, 15 nt, Neisseria meningitidis Z2491
uaauccggagcagaa

SEQ ID NO: 1377510 - RNA, 16 nt, Neisseria meningitidis Z2491
uaaucauguuauuauu

SEQ ID NO: 1377511 - RNA, 19 nt, Neisseria meningitidis Z2491
uaaucauguuauuauuuuc

SEQ ID NO: 1377512 - RNA, 23 nt, Neisseria meningitidis Z2491
uaaucauguuauuauuuuccaua

SEQ ID NO: 1377513 - RNA, 13 nt, Neisseria meningitidis Z2491
uaaucauguugcc

SEQ ID NO: 1377514 - RNA, 17 nt, Neisseria meningitidis Z2491
uaauccgcuauaacagc

SEQ ID NO: 1377515 - RNA, 20 nt, Neisseria meningitidis Z2491
uaauccgcuauaacagcaac

SEQ ID NO: 1377516 - RNA, 21 nt, Neisseria meningitidis Z2491
uaauccgcuauauauucugau

SEQ ID NO: 1377517 - RNA, 15 nt, Neisseria meningitidis Z2491
uaaucacuauaccaa

SEQ ID NO: 1377518 - RNA, 21 nt, Neisseria meningitidis Z2491
uaaucaucguauuuuuaucuu

SEQ ID NO: 1377519 - RNA, 13 nt, Neisseria meningitidis Z2491
uaauaugaaacca

SEQ ID NO: 1377520 - RNA, 16 nt, Neisseria meningitidis Z2491
uaauauucaaagguua

SEQ ID NO: 1377521 - RNA, 11 nt, Neisseria meningitidis Z2491
uaacguauucg

SEQ ID NO: 1377522 - RNA, 15 nt, Neisseria meningitidis Z2491
uaauauacuuggcaa

SEQ ID NO: 1377523 - RNA, 20 nt, Neisseria meningitidis Z2491
ggcaucgaugaugugaaaca

SEQ ID NO: 1377524 - RNA, 19 nt, Neisseria meningitidis Z2491
ggcaucggaaacagccagg

SEQ ID NO: 1377525 - RNA, 20 nt, Neisseria meningitidis Z2491
ggcaucggaaacagccaggc

SEQ ID NO: 1377526 - RNA, 19 nt, Neisseria meningitidis Z2491
ggcauggccgaccauuucu

SEQ ID NO: 1377527 - RNA, 20 nt, Neisseria meningitidis Z2491
ggcagucccguuugaaaaca

SEQ ID NO: 1377528 - RNA, 22 nt, Neisseria meningitidis Z2491
ggcauauugacggacggcggca

SEQ ID NO: 1377529 - RNA, 21 nt, Neisseria meningitidis Z2491
ggcagcguggagggacagcgu

SEQ ID NO: 1377530 - RNA, 14 nt, Neisseria meningitidis Z2491
ggcagcugaagccc

SEQ ID NO: 1377531 - RNA, 16 nt, Neisseria meningitidis Z2491
ggcagccaccucgccg

SEQ ID NO: 1377532 - RNA, 15 nt, Neisseria meningitidis Z2491
ggcagcacugaucag

SEQ ID NO: 1377533 - RNA, 18 nt, Neisseria meningitidis Z2491
ggcagcaacgacagcagc

SEQ ID NO: 1377534 - RNA, 16 nt, Neisseria meningitidis Z2491
ggcaccaauucuucaa

SEQ ID NO: 1377535 - RNA, 14 nt, Neisseria meningitidis Z2491
ggcaaacuauaucu

SEQ ID NO: 1377536 - RNA, 14 nt, Neisseria meningitidis Z2491
ggcauuaaaauuug

SEQ ID NO: 1377537 - RNA, 20 nt, Neisseria meningitidis Z2491
ggccacgccgacugccgccg

SEQ ID NO: 1377538 - RNA, 14 nt, Neisseria meningitidis Z2491
ggcaaaauccgcaa

SEQ ID NO: 1377539 - RNA, 15 nt, Neisseria meningitidis Z2491
ggauucgggcgugcg

SEQ ID NO: 1377540 - RNA, 14 nt, Neisseria meningitidis Z2491
ggauucccgccugc

SEQ ID NO: 1377541 - RNA, 14 nt, Neisseria meningitidis Z2491
ggauggggugcggc

SEQ ID NO: 1377542 - RNA, 19 nt, Neisseria meningitidis Z2491
ggauguccgcgcccacgcc

SEQ ID NO: 1377543 - RNA, 20 nt, Neisseria meningitidis Z2491
ggaugccugcucaaauaggc

SEQ ID NO: 1377544 - RNA, 12 nt, Neisseria meningitidis Z2491
ggauacaaaucc

SEQ ID NO: 1377545 - RNA, 18 nt, Neisseria meningitidis Z2491
ggauaauucauacaaauu

SEQ ID NO: 1377546 - RNA, 20 nt, Neisseria meningitidis Z2491
ggauaauucauacaaauuca

SEQ ID NO: 1377547 - RNA, 20 nt, Neisseria meningitidis Z2491
ggaucagacauuaaaaaaua

SEQ ID NO: 1377548 - RNA, 12 nt, Neisseria meningitidis Z2491
ggauaaacauua

SEQ ID NO: 1377549 - RNA, 15 nt, Neisseria meningitidis Z2491
ggauaaacauuaucu

SEQ ID NO: 1377550 - RNA, 20 nt, Neisseria meningitidis Z2491
ggagggauauucccccgcgc

SEQ ID NO: 1377551 - RNA, 20 nt, Neisseria meningitidis Z2491
ggagcaggcacaaggcggcg

SEQ ID NO: 1377552 - RNA, 20 nt, Neisseria meningitidis Z2491
ggacgcgugcaaucagugcg

SEQ ID NO: 1377553 - RNA, 17 nt, Neisseria meningitidis Z2491
ggacggcggauuucagu

SEQ ID NO: 1377554 - RNA, 17 nt, Neisseria meningitidis Z2491
ggaauuuugcaaagguc

SEQ ID NO: 1377555 - RNA, 12 nt, Neisseria meningitidis Z2491
ggaauuuauccg

SEQ ID NO: 1377556 - RNA, 14 nt, Neisseria meningitidis Z2491
ggaaggcggcggca

SEQ ID NO: 1377557 - RNA, 17 nt, Neisseria meningitidis Z2491
ggaaggcggggcgguca

SEQ ID NO: 1377558 - RNA, 23 nt, Neisseria meningitidis Z2491
ggaauccagacauucaaugcuaa

SEQ ID NO: 1377559 - RNA, 23 nt, Neisseria meningitidis Z2491
ggaauccagaccuuugggcggcg

SEQ ID NO: 1377560 - RNA, 19 nt, Neisseria meningitidis Z2491
ggaauccaguccguucagu

SEQ ID NO: 1377561 - RNA, 23 nt, Neisseria meningitidis Z2491
ggaagccgcgccgauguccugac

SEQ ID NO: 1377562 - RNA, 16 nt, Neisseria meningitidis Z2491
ggaaaugccgucugaa

SEQ ID NO: 1377563 - RNA, 13 nt, Neisseria meningitidis Z2491
ggaaaugacugaa

SEQ ID NO: 1377564 - RNA, 16 nt, Neisseria meningitidis Z2491
ggaaaugacugaaacu

SEQ ID NO: 1377565 - RNA, 21 nt, Neisseria meningitidis Z2491
ggaaauugccuucaucagcau

SEQ ID NO: 1377566 - RNA, 22 nt, Neisseria meningitidis Z2491
ggaaauugccuucaucagcauu

SEQ ID NO: 1377567 - RNA, 17 nt, Neisseria meningitidis Z2491
ggaacaaagaaagcaga

SEQ ID NO: 1377568 - RNA, 16 nt, Neisseria meningitidis Z2491
ggaaaucguaccaacc

SEQ ID NO: 1377569 - RNA, 18 nt, Neisseria meningitidis Z2491
ggaaaguggaacagaaag

SEQ ID NO: 1377570 - RNA, 16 nt, Neisseria meningitidis Z2491
ggaacagaaagcaaaa

SEQ ID NO: 1377571 - RNA, 18 nt, Neisseria meningitidis Z2491
ggaacacaaaaaacuucc

SEQ ID NO: 1377572 - RNA, 20 nt, Neisseria meningitidis Z2491
ggaacagcaucaaaccauau

SEQ ID NO: 1377573 - RNA, 15 nt, Neisseria meningitidis Z2491
ggaaaggcaaaugcc

SEQ ID NO: 1377574 - RNA, 17 nt, Neisseria meningitidis Z2491
ggaaagagcgucauauu

SEQ ID NO: 1377575 - RNA, 14 nt, Neisseria meningitidis Z2491
ggaaacucaaaaaa

SEQ ID NO: 1377576 - RNA, 19 nt, Neisseria meningitidis Z2491
ggaaacucaaaaaaccgga

SEQ ID NO: 1377577 - RNA, 23 nt, Neisseria meningitidis Z2491
ggaaaccaaaaaacaacaggaau

SEQ ID NO: 1377578 - RNA, 16 nt, Neisseria meningitidis Z2491
ggaaacgccuucaguu

SEQ ID NO: 1377579 - RNA, 21 nt, Neisseria meningitidis Z2491
gcuuuuuucagauuauuuauu

SEQ ID NO: 1377580 - RNA, 13 nt, Neisseria meningitidis Z2491
gcuuuuuucuguu

SEQ ID NO: 1377581 - RNA, 12 nt, Neisseria meningitidis Z2491
ggaaaaaaccga

SEQ ID NO: 1377582 - RNA, 12 nt, Neisseria meningitidis Z2491
ggaaaaacagca

SEQ ID NO: 1377583 - RNA, 15 nt, Neisseria meningitidis Z2491
ggaaaaaccggccgg

SEQ ID NO: 1377584 - RNA, 17 nt, Neisseria meningitidis Z2491
gcuuucgcugccgccgc

SEQ ID NO: 1377585 - RNA, 11 nt, Neisseria meningitidis Z2491
gcuuucagacg

SEQ ID NO: 1377586 - RNA, 13 nt, Neisseria meningitidis Z2491
gcuuucaccgaca

SEQ ID NO: 1377587 - RNA, 14 nt, Neisseria meningitidis Z2491
gcuuuauaguggau

SEQ ID NO: 1377588 - RNA, 19 nt, Neisseria meningitidis Z2491
gcuuuggcagcccauucug

SEQ ID NO: 1377589 - RNA, 20 nt, Neisseria meningitidis Z2491
gcuuugcgcgccuuuuuguu

SEQ ID NO: 1377590 - RNA, 16 nt, Neisseria meningitidis Z2491
gcuuuucauuucuaga

SEQ ID NO: 1377591 - RNA, 13 nt, Neisseria meningitidis Z2491
gcuuuugcagaau

SEQ ID NO: 1377592 - RNA, 19 nt, Neisseria meningitidis Z2491
gcuuuuucuuuuaaccaua

SEQ ID NO: 1377593 - RNA, 23 nt, Neisseria meningitidis Z2491
gcuuuuuaaacaacaaauuuuug

SEQ ID NO: 1377594 - RNA, 14 nt, Neisseria meningitidis Z2491
gcuuuaauucucca

SEQ ID NO: 1377595 - RNA, 19 nt, Neisseria meningitidis Z2491
gcuugugaaugcggcggca

SEQ ID NO: 1377596 - RNA, 17 nt, Neisseria meningitidis Z2491
gcuugccgccgccaugu

SEQ ID NO: 1377597 - RNA, 21 nt, Neisseria meningitidis Z2491
gcuugcccacgcacccaaacg

SEQ ID NO: 1377598 - RNA, 19 nt, Neisseria meningitidis Z2491
gcuugagcgacagcggccg

SEQ ID NO: 1377599 - RNA, 14 nt, Neisseria meningitidis Z2491
gcuuccucgugcca

SEQ ID NO: 1377600 - RNA, 22 nt, Neisseria meningitidis Z2491
gcuucgacguuuuuacgcguga

SEQ ID NO: 1377601 - RNA, 13 nt, Neisseria meningitidis Z2491
gcuucggauaaau

SEQ ID NO: 1377602 - RNA, 18 nt, Neisseria meningitidis Z2491
gcuucgguuguauuuuua

SEQ ID NO: 1377603 - RNA, 20 nt, Neisseria meningitidis Z2491
gcuucuuccagcaauuucug

SEQ ID NO: 1377604 - RNA, 19 nt, Neisseria meningitidis Z2491
gcuucuuccucgacagaca

SEQ ID NO: 1377605 - RNA, 13 nt, Neisseria meningitidis Z2491
gcuucuuccagca

SEQ ID NO: 1377606 - RNA, 18 nt, Neisseria meningitidis Z2491
gcuucuuugacggcgggc

SEQ ID NO: 1377607 - RNA, 20 nt, Neisseria meningitidis Z2491
gcuucuuugacggcgggcag

SEQ ID NO: 1377608 - RNA, 17 nt, Neisseria meningitidis Z2491
gcuucuuucgccgccug

SEQ ID NO: 1377609 - RNA, 19 nt, Neisseria meningitidis Z2491
gcuuauuuguucaaauauc

SEQ ID NO: 1377610 - RNA, 20 nt, Neisseria meningitidis Z2491
gcuucaaccacgcuucugau

SEQ ID NO: 1377611 - RNA, 20 nt, Neisseria meningitidis Z2491
gcuucacaacuuccgcccgg

SEQ ID NO: 1377612 - RNA, 20 nt, Neisseria meningitidis Z2491
gcuucacacguucgcaggcu

SEQ ID NO: 1377613 - RNA, 21 nt, Neisseria meningitidis Z2491
gcuucauaccccacugccagc

SEQ ID NO: 1377614 - RNA, 21 nt, Neisseria meningitidis Z2491
gcuuccagaccagccgccucc

SEQ ID NO: 1377615 - RNA, 15 nt, Neisseria meningitidis Z2491
gcuuccaaaaccacu

SEQ ID NO: 1377616 - RNA, 21 nt, Neisseria meningitidis Z2491
gcuucaucucgccaaucucac

SEQ ID NO: 1377617 - RNA, 12 nt, Neisseria meningitidis Z2491
gcuucaucuuua

SEQ ID NO: 1377618 - RNA, 15 nt, Neisseria meningitidis Z2491
gcuucaucuuuacuu

SEQ ID NO: 1377619 - RNA, 19 nt, Neisseria meningitidis Z2491
gcuucaucuuuacuuguuu

SEQ ID NO: 1377620 - RNA, 22 nt, Neisseria meningitidis Z2491
gcuuagaccuaacguggguuug

SEQ ID NO: 1377621 - RNA, 21 nt, Neisseria meningitidis Z2491
gcuuaucuaaaggaaugguug

SEQ ID NO: 1377622 - RNA, 19 nt, Neisseria meningitidis Z2491
gcuuaccgaccaacugcuc

SEQ ID NO: 1377623 - RNA, 19 nt, Neisseria meningitidis Z2491
gcuuacccgcuuuuuucag

SEQ ID NO: 1377624 - RNA, 16 nt, Neisseria meningitidis Z2491
gcuuaaaccuuaucca

SEQ ID NO: 1377625 - RNA, 22 nt, Neisseria meningitidis Z2491
gcuuaaaccuuauccauaucca

SEQ ID NO: 1377626 - RNA, 14 nt, Neisseria meningitidis Z2491
gcuuaaaaaacaac

SEQ ID NO: 1377627 - RNA, 22 nt, Neisseria meningitidis Z2491
gcuuaaaaaacaacugauucaa

SEQ ID NO: 1377628 - RNA, 17 nt, Neisseria meningitidis Z2491
gcuuaaacagcacugcc

SEQ ID NO: 1377629 - RNA, 16 nt, Neisseria meningitidis Z2491
gcuggcuguauggugc

SEQ ID NO: 1377630 - RNA, 20 nt, Neisseria meningitidis Z2491
gcugucgucauuuccaauuu

SEQ ID NO: 1377631 - RNA, 23 nt, Neisseria meningitidis Z2491
gcuguggaacgcgucaaccuuaa

SEQ ID NO: 1377632 - RNA, 17 nt, Neisseria meningitidis Z2491
gcuguguuuaucuuuuc

SEQ ID NO: 1377633 - RNA, 15 nt, Neisseria meningitidis Z2491
gcuguucgcggcgug

SEQ ID NO: 1377634 - RNA, 16 nt, Neisseria meningitidis Z2491
gcuguuugcgcuguug

SEQ ID NO: 1377635 - RNA, 12 nt, Neisseria meningitidis Z2491
gcuguuucuuca

SEQ ID NO: 1377636 - RNA, 14 nt, Neisseria meningitidis Z2491
gcuguacgcugaug

SEQ ID NO: 1377637 - RNA, 14 nt, Neisseria meningitidis Z2491
gcuguacagguuug

SEQ ID NO: 1377638 - RNA, 22 nt, Neisseria meningitidis Z2491
gcuguauuuuucgaggcgcagg

SEQ ID NO: 1377639 - RNA, 19 nt, Neisseria meningitidis Z2491
gcugcgguacaaggaugau

SEQ ID NO: 1377640 - RNA, 21 nt, Neisseria meningitidis Z2491
gcugcugaccgccggaaagcu

SEQ ID NO: 1377641 - RNA, 15 nt, Neisseria meningitidis Z2491
gcugcgggccaucac

SEQ ID NO: 1377642 - RNA, 15 nt, Neisseria meningitidis Z2491
gcuggaagcauugac

SEQ ID NO: 1377643 - RNA, 21 nt, Neisseria meningitidis Z2491
gcuggaagcauugaccacuuc

SEQ ID NO: 1377644 - RNA, 17 nt, Neisseria meningitidis Z2491
gcugcuguauuuuucca

SEQ ID NO: 1377645 - RNA, 23 nt, Neisseria meningitidis Z2491
gcugcuguauuuuucgaggcgca

SEQ ID NO: 1377646 - RNA, 15 nt, Neisseria meningitidis Z2491
gcugcaguugggcga

SEQ ID NO: 1377647 - RNA, 22 nt, Neisseria meningitidis Z2491
gcugcaaaaauuuauuuagaaa

SEQ ID NO: 1377648 - RNA, 22 nt, Neisseria meningitidis Z2491
gcugccgucgauuuugcagcug

SEQ ID NO: 1377649 - RNA, 23 nt, Neisseria meningitidis Z2491
gcugccgucgauuuugcagcuga

SEQ ID NO: 1377650 - RNA, 21 nt, Neisseria meningitidis Z2491
gcgcaggcgggaaucuagguc

SEQ ID NO: 1377651 - RNA, 16 nt, Neisseria meningitidis Z2491
gcgcaggcgggaaucu

SEQ ID NO: 1377652 - RNA, 21 nt, Neisseria meningitidis Z2491
gcgcaggcgggaaucuagaac

SEQ ID NO: 1377653 - RNA, 23 nt, Neisseria meningitidis Z2491
gcgcaggcgggaaucuagacauu

SEQ ID NO: 1377654 - RNA, 22 nt, Neisseria meningitidis Z2491
gcgcaggcgggaaucuagaccu

SEQ ID NO: 1377655 - RNA, 22 nt, Neisseria meningitidis Z2491
gcgcaccugacgcuccagcucc

SEQ ID NO: 1377656 - RNA, 22 nt, Neisseria meningitidis Z2491
gcgcaccuccauaauccaagau

SEQ ID NO: 1377657 - RNA, 22 nt, Neisseria meningitidis Z2491
gcgcaccagcaaaucguaaacg

SEQ ID NO: 1377658 - RNA, 17 nt, Neisseria meningitidis Z2491
gcgccaaggcuuucaga

SEQ ID NO: 1377659 - RNA, 19 nt, Neisseria meningitidis Z2491
gcgcauggcuucuuugcug

SEQ ID NO: 1377660 - RNA, 22 nt, Neisseria meningitidis Z2491
gcgcaucgccauauucgcacgc

SEQ ID NO: 1377661 - RNA, 13 nt, Neisseria meningitidis Z2491
gcgagaacagaaa

SEQ ID NO: 1377662 - RNA, 19 nt, Neisseria meningitidis Z2491
gcgagaacagaaaaccaaa

SEQ ID NO: 1377663 - RNA, 12 nt, Neisseria meningitidis Z2491
gcgagccaacgc

SEQ ID NO: 1377664 - RNA, 19 nt, Neisseria meningitidis Z2491
gcgagccaauagccgccgg

SEQ ID NO: 1377665 - RNA, 20 nt, Neisseria meningitidis Z2491
gcgacagcuugggcggacug

SEQ ID NO: 1377666 - RNA, 22 nt, Neisseria meningitidis Z2491
gcgacagcuugggcggacugcu

SEQ ID NO: 1377667 - RNA, 18 nt, Neisseria meningitidis Z2491
gcgaaucugcugcaaacc

SEQ ID NO: 1377668 - RNA, 23 nt, Neisseria meningitidis Z2491
gccguuucagacggcaucuuuuu

SEQ ID NO: 1377669 - RNA, 20 nt, Neisseria meningitidis Z2491
gcgaaagcgggaaucuagaa

SEQ ID NO: 1377670 - RNA, 23 nt, Neisseria meningitidis Z2491
gcgaaacagacauugcuaaaaca

SEQ ID NO: 1377671 - RNA, 12 nt, Neisseria meningitidis Z2491
gcggagaacaag

SEQ ID NO: 1377672 - RNA, 12 nt, Neisseria meningitidis Z2491
gcggagaggcuu

SEQ ID NO: 1377673 - RNA, 20 nt, Neisseria meningitidis Z2491
gcggacuggauucccgccug

SEQ ID NO: 1377674 - RNA, 19 nt, Neisseria meningitidis Z2491
gcggaauacggcaacauca

SEQ ID NO: 1377675 - RNA, 14 nt, Neisseria meningitidis Z2491
gcggaugaauuuaa

SEQ ID NO: 1377676 - RNA, 17 nt, Neisseria meningitidis Z2491
gcggauggaggacaaag

SEQ ID NO: 1377677 - RNA, 14 nt, Neisseria meningitidis Z2491
gcggcaauauucaa

SEQ ID NO: 1377678 - RNA, 15 nt, Neisseria meningitidis Z2491
gcggcaauauucaaa

SEQ ID NO: 1377679 - RNA, 18 nt, Neisseria meningitidis Z2491
gcggcaauauucaaagau

SEQ ID NO: 1377680 - RNA, 19 nt, Neisseria meningitidis Z2491
gcggcaaauuccgucagca

SEQ ID NO: 1377681 - RNA, 20 nt, Neisseria meningitidis Z2491
gcggcaaauuccgucagcac

SEQ ID NO: 1377682 - RNA, 18 nt, Neisseria meningitidis Z2491
gcggauugcccgaugccg

SEQ ID NO: 1377683 - RNA, 21 nt, Neisseria meningitidis Z2491
gcggauuugaaguuucuccac

SEQ ID NO: 1377684 - RNA, 22 nt, Neisseria meningitidis Z2491
gcggaaguacucauuuuucguc

SEQ ID NO: 1377685 - RNA, 19 nt, Neisseria meningitidis Z2491
gcggaaaucguaggucuuc

SEQ ID NO: 1377686 - RNA, 21 nt, Neisseria meningitidis Z2491
gcgcguaucggcggcaagcug

SEQ ID NO: 1377687 - RNA, 17 nt, Neisseria meningitidis Z2491
gcgcgguuggcggcggc

SEQ ID NO: 1377688 - RNA, 19 nt, Neisseria meningitidis Z2491
gcgcgguuggcggcggcga

SEQ ID NO: 1377689 - RNA, 17 nt, Neisseria meningitidis Z2491
gcgcgggaauagcucag

SEQ ID NO: 1377690 - RNA, 21 nt, Neisseria meningitidis Z2491
gcgcccacgcccucggcggcg

SEQ ID NO: 1377691 - RNA, 17 nt, Neisseria meningitidis Z2491
gcgcccagagggaaagu

SEQ ID NO: 1377692 - RNA, 15 nt, Neisseria meningitidis Z2491
gcgccgcuguauuug

SEQ ID NO: 1377693 - RNA, 18 nt, Neisseria meningitidis Z2491
gcgggaaucuaggucugu

SEQ ID NO: 1377694 - RNA, 17 nt, Neisseria meningitidis Z2491
gcgggaauccaaacuug

SEQ ID NO: 1377695 - RNA, 13 nt, Neisseria meningitidis Z2491
gcgggaauccagg

SEQ ID NO: 1377696 - RNA, 21 nt, Neisseria meningitidis Z2491
gcgggaaucuaaaaauccaac

SEQ ID NO: 1377697 - RNA, 19 nt, Neisseria meningitidis Z2491
gcgggaaucuagaaacuca

SEQ ID NO: 1377698 - RNA, 20 nt, Neisseria meningitidis Z2491
gcgggaaucuagaaacucaa

SEQ ID NO: 1377699 - RNA, 21 nt, Neisseria meningitidis Z2491
gcgggaaucuagaacguggaa

SEQ ID NO: 1377700 - RNA, 16 nt, Neisseria meningitidis Z2491
gcgggcgggguugcug

SEQ ID NO: 1377701 - RNA, 19 nt, Neisseria meningitidis Z2491
gcgguaggauguggguuug

SEQ ID NO: 1377702 - RNA, 17 nt, Neisseria meningitidis Z2491
gcggucguguucuucau

SEQ ID NO: 1377703 - RNA, 19 nt, Neisseria meningitidis Z2491
gcggucgauguggcugaug

SEQ ID NO: 1377704 - RNA, 19 nt, Neisseria meningitidis Z2491
gcgguacggcaacuuuuuu

SEQ ID NO: 1377705 - RNA, 15 nt, Neisseria meningitidis Z2491
gcgguaacgcgacgg

SEQ ID NO: 1377706 - RNA, 20 nt, Neisseria meningitidis Z2491
gcggguuuugccgaaauccu

SEQ ID NO: 1377707 - RNA, 19 nt, Neisseria meningitidis Z2491
gcggguuuggaaugcgcga

SEQ ID NO: 1377708 - RNA, 22 nt, Neisseria meningitidis Z2491
gcggguuuggaaugcgcgacgg

SEQ ID NO: 1377709 - RNA, 13 nt, Neisseria meningitidis Z2491
gcggcucgcccac

SEQ ID NO: 1377710 - RNA, 15 nt, Neisseria meningitidis Z2491
gcggcucgccgccuu

SEQ ID NO: 1377711 - RNA, 13 nt, Neisseria meningitidis Z2491
gcggcugcgggcg

SEQ ID NO: 1377712 - RNA, 20 nt, Neisseria meningitidis Z2491
gcggcuacuccugcugcggc

SEQ ID NO: 1377713 - RNA, 18 nt, Neisseria meningitidis Z2491
gcggcugguuuccgggcg

SEQ ID NO: 1377714 - RNA, 23 nt, Neisseria meningitidis Z2491
gcggcuaaggcgcaaaccuuaaa

SEQ ID NO: 1377715 - RNA, 15 nt, Neisseria meningitidis Z2491
gcggcgguaucaggc

SEQ ID NO: 1377716 - RNA, 13 nt, Neisseria meningitidis Z2491
gcguaggcggcgg

SEQ ID NO: 1377717 - RNA, 14 nt, Neisseria meningitidis Z2491
gcguaggcggcggc

SEQ ID NO: 1377718 - RNA, 18 nt, Neisseria meningitidis Z2491
gcguaggucagcccggcg

SEQ ID NO: 1377719 - RNA, 22 nt, Neisseria meningitidis Z2491
gcguccgcgauaaggcgcgucc

SEQ ID NO: 1377720 - RNA, 20 nt, Neisseria meningitidis Z2491
gcgucauucccgcaaaagcg

SEQ ID NO: 1377721 - RNA, 21 nt, Neisseria meningitidis Z2491
gcguccaacacgcagccgagc

SEQ ID NO: 1377722 - RNA, 19 nt, Neisseria meningitidis Z2491
gcguuccaaauauuuccug

SEQ ID NO: 1377723 - RNA, 24 nt, Neisseria meningitidis Z2491
gcguucaccaucuacauaaacagg

SEQ ID NO: 1377724 - RNA, 16 nt, Neisseria meningitidis Z2491
gcguuguccaaacccg

SEQ ID NO: 1377725 - RNA, 20 nt, Neisseria meningitidis Z2491
gcguuguccaaacccgcccg

SEQ ID NO: 1377726 - RNA, 15 nt, Neisseria meningitidis Z2491
gcguguuuguguucg

SEQ ID NO: 1377727 - RNA, 18 nt, Neisseria meningitidis Z2491
gcgugcggacguucaaac

SEQ ID NO: 1377728 - RNA, 23 nt, Neisseria meningitidis Z2491
gcgucggagaaaaacaaguuuuc

SEQ ID NO: 1377729 - RNA, 14 nt, Neisseria meningitidis Z2491
gcugaaaaaaugcc

SEQ ID NO: 1377730 - RNA, 22 nt, Neisseria meningitidis Z2491
gcucugccgucauucccgcgca

SEQ ID NO: 1377731 - RNA, 16 nt, Neisseria meningitidis Z2491
gcucugauagccgccc

SEQ ID NO: 1377732 - RNA, 13 nt, Neisseria meningitidis Z2491
gcucucaaaauau

SEQ ID NO: 1377733 - RNA, 16 nt, Neisseria meningitidis Z2491
gcugaaauagaaaaua

SEQ ID NO: 1377734 - RNA, 14 nt, Neisseria meningitidis Z2491
gcugaaauugaaag

SEQ ID NO: 1377735 - RNA, 23 nt, Neisseria meningitidis Z2491
gcugaaauugaaaguuacagaaa

SEQ ID NO: 1377736 - RNA, 16 nt, Neisseria meningitidis Z2491
gcugaagcuuuagaga

SEQ ID NO: 1377737 - RNA, 15 nt, Neisseria meningitidis Z2491
gcugaauuugaaacg

SEQ ID NO: 1377738 - RNA, 20 nt, Neisseria meningitidis Z2491
gcugaagcccacccuaccau

SEQ ID NO: 1377739 - RNA, 14 nt, Neisseria meningitidis Z2491
gcugacguaaaaaa

SEQ ID NO: 1377740 - RNA, 23 nt, Neisseria meningitidis Z2491
gcugaugaugauggcggcaacau

SEQ ID NO: 1377741 - RNA, 15 nt, Neisseria meningitidis Z2491
gcugacuaaccgaaa

SEQ ID NO: 1377742 - RNA, 16 nt, Neisseria meningitidis Z2491
gcuccggccaaaaaaa

SEQ ID NO: 1377743 - RNA, 22 nt, Neisseria meningitidis Z2491
gcuccgccgucauucccgcgca

SEQ ID NO: 1377744 - RNA, 13 nt, Neisseria meningitidis Z2491
gcuauuuagaaua

SEQ ID NO: 1377745 - RNA, 16 nt, Neisseria meningitidis Z2491
gcuauccgcacagaaa

SEQ ID NO: 1377746 - RNA, 17 nt, Neisseria meningitidis Z2491
gcuauccgcacagaaac

SEQ ID NO: 1377747 - RNA, 22 nt, Neisseria meningitidis Z2491
gcccaaccgugcggcacgccgc

SEQ ID NO: 1377748 - RNA, 14 nt, Neisseria meningitidis Z2491
gcccaaaagcagcc

SEQ ID NO: 1377749 - RNA, 16 nt, Neisseria meningitidis Z2491
gccauuuccaaaccca

SEQ ID NO: 1377750 - RNA, 23 nt, Neisseria meningitidis Z2491
gcccaagccgacuuuuuccagca

SEQ ID NO: 1377751 - RNA, 15 nt, Neisseria meningitidis Z2491
gcccaauaccguccc

SEQ ID NO: 1377752 - RNA, 22 nt, Neisseria meningitidis Z2491
gcccaauaccguccccgaaacc

SEQ ID NO: 1377753 - RNA, 17 nt, Neisseria meningitidis Z2491
gccaucaggaaugcaaa

SEQ ID NO: 1377754 - RNA, 20 nt, Neisseria meningitidis Z2491
gccaucaggacucgaacacc

SEQ ID NO: 1377755 - RNA, 20 nt, Neisseria meningitidis Z2491
gccauucccucaaaaacaga

SEQ ID NO: 1377756 - RNA, 21 nt, Neisseria meningitidis Z2491
gccauucccucaaaaacagaa

SEQ ID NO: 1377757 - RNA, 22 nt, Neisseria meningitidis Z2491
gccauucccucaaaaacagaaa

SEQ ID NO: 1377758 - RNA, 17 nt, Neisseria meningitidis Z2491
gccaugucggguucgga

SEQ ID NO: 1377759 - RNA, 14 nt, Neisseria meningitidis Z2491
gccagccugcccau

SEQ ID NO: 1377760 - RNA, 14 nt, Neisseria meningitidis Z2491
gccagccuuucaac

SEQ ID NO: 1377761 - RNA, 16 nt, Neisseria meningitidis Z2491
gccaggcguauauggc

SEQ ID NO: 1377762 - RNA, 19 nt, Neisseria meningitidis Z2491
gccagccaccacguccacc

SEQ ID NO: 1377763 - RNA, 13 nt, Neisseria meningitidis Z2491
gccagcacaaaca

SEQ ID NO: 1377764 - RNA, 18 nt, Neisseria meningitidis Z2491
gccagcacaaacagcaug

SEQ ID NO: 1377765 - RNA, 18 nt, Neisseria meningitidis Z2491
gccacuuuccgucauucc

SEQ ID NO: 1377766 - RNA, 16 nt, Neisseria meningitidis Z2491
gccaaugccgucugaa

SEQ ID NO: 1377767 - RNA, 19 nt, Neisseria meningitidis Z2491
gccaaucucuuaaccaugc

SEQ ID NO: 1377768 - RNA, 14 nt, Neisseria meningitidis Z2491
gccaauuccuucau

SEQ ID NO: 1377769 - RNA, 15 nt, Neisseria meningitidis Z2491
gccaauucaaaaacc

SEQ ID NO: 1377770 - RNA, 20 nt, Neisseria meningitidis Z2491
gccaauuuguauucaagcaa

SEQ ID NO: 1377771 - RNA, 21 nt, Neisseria meningitidis Z2491
gccaauagaauuuauacccuc

SEQ ID NO: 1377772 - RNA, 15 nt, Neisseria meningitidis Z2491
gccaauagccgccgg

SEQ ID NO: 1377773 - RNA, 14 nt, Neisseria meningitidis Z2491
gccaaggcggcggg

SEQ ID NO: 1377774 - RNA, 15 nt, Neisseria meningitidis Z2491
gccaaggcuuucaga

SEQ ID NO: 1377775 - RNA, 16 nt, Neisseria meningitidis Z2491
gccaaggcuuucagau

SEQ ID NO: 1377776 - RNA, 21 nt, Neisseria meningitidis Z2491
gccacaauauaaucaaacuca

SEQ ID NO: 1377777 - RNA, 19 nt, Neisseria meningitidis Z2491
gcauuuucguccuugcugu

SEQ ID NO: 1377778 - RNA, 18 nt, Neisseria meningitidis Z2491
gcauuucggcaguuuuca

SEQ ID NO: 1377779 - RNA, 22 nt, Neisseria meningitidis Z2491
gcauuuccuuuaaacucuuaaa

SEQ ID NO: 1377780 - RNA, 22 nt, Neisseria meningitidis Z2491
gcauuuccggcaucgcaacucc

SEQ ID NO: 1377781 - RNA, 15 nt, Neisseria meningitidis Z2491
gcauuucuaauuuuu

SEQ ID NO: 1377782 - RNA, 11 nt, Neisseria meningitidis Z2491
gccaaaaacag

SEQ ID NO: 1377783 - RNA, 14 nt, Neisseria meningitidis Z2491
gcauuuuugacggu

SEQ ID NO: 1377784 - RNA, 16 nt, Neisseria meningitidis Z2491
gcauuuuuaucuuuuu

SEQ ID NO: 1377785 - RNA, 17 nt, Neisseria meningitidis Z2491
gcauuuucuauuuuaca

SEQ ID NO: 1377786 - RNA, 11 nt, Neisseria meningitidis Z2491
gccaaacccuc

SEQ ID NO: 1377787 - RNA, 23 nt, Neisseria meningitidis Z2491
gccaaagcguaaagccgcgucca

SEQ ID NO: 1377788 - RNA, 15 nt, Neisseria meningitidis Z2491
gccaaagugccaaau

SEQ ID NO: 1377789 - RNA, 19 nt, Neisseria meningitidis Z2491
gccaacaucagcauaggga

SEQ ID NO: 1377790 - RNA, 22 nt, Neisseria meningitidis Z2491
gccaacccuugugcuucuucga

SEQ ID NO: 1377791 - RNA, 16 nt, Neisseria meningitidis Z2491
gcauugguaaacauac

SEQ ID NO: 1377792 - RNA, 18 nt, Neisseria meningitidis Z2491
gcauugaaauucuagauu

SEQ ID NO: 1377793 - RNA, 20 nt, Neisseria meningitidis Z2491
gcauucagacggcauccgcu

SEQ ID NO: 1377794 - RNA, 15 nt, Neisseria meningitidis Z2491
gcauuauuuuucauu

SEQ ID NO: 1377795 - RNA, 22 nt, Neisseria meningitidis Z2491
gcauucaaacggcggcgggcag

SEQ ID NO: 1377796 - RNA, 16 nt, Neisseria meningitidis Z2491
gcauuaaaauuuggcu

SEQ ID NO: 1377797 - RNA, 18 nt, Neisseria meningitidis Z2491
gcaucguuacaaauuuaa

SEQ ID NO: 1377798 - RNA, 16 nt, Neisseria meningitidis Z2491
gcaucguauuggggca

SEQ ID NO: 1377799 - RNA, 14 nt, Neisseria meningitidis Z2491
gcaucguaaggcug

SEQ ID NO: 1377800 - RNA, 16 nt, Neisseria meningitidis Z2491
gcaucgcagauucggg

SEQ ID NO: 1377801 - RNA, 13 nt, Neisseria meningitidis Z2491
gcaucgccgccgu

SEQ ID NO: 1377802 - RNA, 16 nt, Neisseria meningitidis Z2491
gcaucguaaaaaugcc

SEQ ID NO: 1377803 - RNA, 21 nt, Neisseria meningitidis Z2491
gccgucauucccgcaaaagcg

SEQ ID NO: 1377804 - RNA, 18 nt, Neisseria meningitidis Z2491
gccgucauucccgcgcag

SEQ ID NO: 1377805 - RNA, 22 nt, Neisseria meningitidis Z2491
gccgucauucccgcgcaggcgg

SEQ ID NO: 1377806 - RNA, 23 nt, Neisseria meningitidis Z2491
gccgucauugagcagcacaucgu

SEQ ID NO: 1377807 - RNA, 20 nt, Neisseria meningitidis Z2491
gccguauuuuuuaaccaacu

SEQ ID NO: 1377808 - RNA, 18 nt, Neisseria meningitidis Z2491
gccguacugguuuuuguu

SEQ ID NO: 1377809 - RNA, 13 nt, Neisseria meningitidis Z2491
gccguaaccgcac

SEQ ID NO: 1377810 - RNA, 15 nt, Neisseria meningitidis Z2491
gccgguugcggugcu

SEQ ID NO: 1377811 - RNA, 21 nt, Neisseria meningitidis Z2491
gccguccgaaagguuuucgga

SEQ ID NO: 1377812 - RNA, 15 nt, Neisseria meningitidis Z2491
gccguccgaaccgca

SEQ ID NO: 1377813 - RNA, 15 nt, Neisseria meningitidis Z2491
gccgucugaaagggc

SEQ ID NO: 1377814 - RNA, 13 nt, Neisseria meningitidis Z2491
gccgucugaaauc

SEQ ID NO: 1377815 - RNA, 15 nt, Neisseria meningitidis Z2491
gccgucugaaauguu

SEQ ID NO: 1377816 - RNA, 23 nt, Neisseria meningitidis Z2491
gccgucugaaauguucagacggc

SEQ ID NO: 1377817 - RNA, 13 nt, Neisseria meningitidis Z2491
gccgucugaaauu

SEQ ID NO: 1377818 - RNA, 23 nt, Neisseria meningitidis Z2491
gccgucugaacccguuuucaggu

SEQ ID NO: 1377819 - RNA, 12 nt, Neisseria meningitidis Z2491
gccgucugaagc

SEQ ID NO: 1377820 - RNA, 14 nt, Neisseria meningitidis Z2491
gccgucugaagccc

SEQ ID NO: 1377821 - RNA, 16 nt, Neisseria meningitidis Z2491
gccgucugaagcccug

SEQ ID NO: 1377822 - RNA, 20 nt, Neisseria meningitidis Z2491
gccgucugaagcgagcagcu

SEQ ID NO: 1377823 - RNA, 21 nt, Neisseria meningitidis Z2491
gccgucugaaggcuucagacg

SEQ ID NO: 1377824 - RNA, 23 nt, Neisseria meningitidis Z2491
gccgucugaaucgcgugcugcau

SEQ ID NO: 1377825 - RNA, 21 nt, Neisseria meningitidis Z2491
gccgggaaggcggggcgguca

SEQ ID NO: 1377826 - RNA, 16 nt, Neisseria meningitidis Z2491
gccggucguguggaaa

SEQ ID NO: 1377827 - RNA, 21 nt, Neisseria meningitidis Z2491
gccgccggaagauuccggcgg

SEQ ID NO: 1377828 - RNA, 22 nt, Neisseria meningitidis Z2491
gccgcaaugccgucugaaggcu

SEQ ID NO: 1377829 - RNA, 14 nt, Neisseria meningitidis Z2491
gccgcaaucgccgg

SEQ ID NO: 1377830 - RNA, 14 nt, Neisseria meningitidis Z2491
gccgcaauuucaaa

SEQ ID NO: 1377831 - RNA, 13 nt, Neisseria meningitidis Z2491
gccgcgccgccgg

SEQ ID NO: 1377832 - RNA, 14 nt, Neisseria meningitidis Z2491
gccgccuuuuucca

SEQ ID NO: 1377833 - RNA, 23 nt, Neisseria meningitidis Z2491
gccgccuuuuuccacgccgggca

SEQ ID NO: 1377834 - RNA, 17 nt, Neisseria meningitidis Z2491
gccgacugccgccgcgc

SEQ ID NO: 1377835 - RNA, 15 nt, Neisseria meningitidis Z2491
gccgacgaccaaugc

SEQ ID NO: 1377836 - RNA, 17 nt, Neisseria meningitidis Z2491
gccgacuuuuuccagca

SEQ ID NO: 1377837 - RNA, 14 nt, Neisseria meningitidis Z2491
gccgcaaacggcag

SEQ ID NO: 1377838 - RNA, 14 nt, Neisseria meningitidis Z2491
gccgcaaccucaaa

SEQ ID NO: 1377839 - RNA, 23 nt, Neisseria meningitidis Z2491
gccgauucggcguugcccggaaa

SEQ ID NO: 1377840 - RNA, 15 nt, Neisseria meningitidis Z2491
gccgaaauagucuga

SEQ ID NO: 1377841 - RNA, 13 nt, Neisseria meningitidis Z2491
gccgaaauccuga

SEQ ID NO: 1377842 - RNA, 18 nt, Neisseria meningitidis Z2491
gccgaaaggggucugacg

SEQ ID NO: 1377843 - RNA, 15 nt, Neisseria meningitidis Z2491
gccgaaaccaaaagc

SEQ ID NO: 1377844 - RNA, 19 nt, Neisseria meningitidis Z2491
gcccuuuuguaaaggaagu

SEQ ID NO: 1377845 - RNA, 13 nt, Neisseria meningitidis Z2491
gcccuuucagacg

SEQ ID NO: 1377846 - RNA, 21 nt, Neisseria meningitidis Z2491
gcccuuucagacggcauuuua

SEQ ID NO: 1377847 - RNA, 13 nt, Neisseria meningitidis Z2491
gccgacagcagcu

SEQ ID NO: 1377848 - RNA, 19 nt, Neisseria meningitidis Z2491
gcccuauguguugcccuga

SEQ ID NO: 1377849 - RNA, 22 nt, Neisseria meningitidis Z2491
gcccgguuggaaggcggcggca

SEQ ID NO: 1377850 - RNA, 17 nt, Neisseria meningitidis Z2491
gcccgaaauaggcugcc

SEQ ID NO: 1377851 - RNA, 17 nt, Neisseria meningitidis Z2491
gcccgaauaaaaaauau

SEQ ID NO: 1377852 - RNA, 20 nt, Neisseria meningitidis Z2491
gcccgaauaaaaaauaugga

SEQ ID NO: 1377853 - RNA, 14 nt, Neisseria meningitidis Z2491
gccccuaaaaugcc

SEQ ID NO: 1377854 - RNA, 23 nt, Neisseria meningitidis Z2491
gccccuaaaaugcccauccgccu

SEQ ID NO: 1377855 - RNA, 10 nt, Neisseria meningitidis Z2491
gcccgccagu

SEQ ID NO: 1377856 - RNA, 18 nt, Neisseria meningitidis Z2491
gcccgcaaucugaaauuu

SEQ ID NO: 1377857 - RNA, 13 nt, Neisseria meningitidis Z2491
gcacuagccaaaa

SEQ ID NO: 1377858 - RNA, 17 nt, Neisseria meningitidis Z2491
gcacuagccaaaaaaac

SEQ ID NO: 1377859 - RNA, 21 nt, Neisseria meningitidis Z2491
gcacuagccaaaaaaaccgaa

SEQ ID NO: 1377860 - RNA, 18 nt, Neisseria meningitidis Z2491
gcacuacuucauuuuuuc

SEQ ID NO: 1377861 - RNA, 20 nt, Neisseria meningitidis Z2491
gcacuacuucauuuuuucaa

SEQ ID NO: 1377862 - RNA, 23 nt, Neisseria meningitidis Z2491
gcacggcguucaacauccgcaga

SEQ ID NO: 1377863 - RNA, 18 nt, Neisseria meningitidis Z2491
gcacgguguacauugugg

SEQ ID NO: 1377864 - RNA, 24 nt, Neisseria meningitidis Z2491
gcacgguaaaccgccagccugccg

SEQ ID NO: 1377865 - RNA, 14 nt, Neisseria meningitidis Z2491
gcaccuccauaauc

SEQ ID NO: 1377866 - RNA, 21 nt, Neisseria meningitidis Z2491
gcaccuuagacaaucguucuc

SEQ ID NO: 1377867 - RNA, 19 nt, Neisseria meningitidis Z2491
gcaccuuagagaaucguuc

SEQ ID NO: 1377868 - RNA, 14 nt, Neisseria meningitidis Z2491
gcacgauacacaaa

SEQ ID NO: 1377869 - RNA, 12 nt, Neisseria meningitidis Z2491
gcacgccgacuu

SEQ ID NO: 1377870 - RNA, 16 nt, Neisseria meningitidis Z2491
gcaaucugaaauuuug

SEQ ID NO: 1377871 - RNA, 18 nt, Neisseria meningitidis Z2491
gcaaucugaaauuuugcc

SEQ ID NO: 1377872 - RNA, 23 nt, Neisseria meningitidis Z2491
gcaauauucaaagauuaucugaa

SEQ ID NO: 1377873 - RNA, 19 nt, Neisseria meningitidis Z2491
gcaauauacugauuuauau

SEQ ID NO: 1377874 - RNA, 17 nt, Neisseria meningitidis Z2491
gcaaguguccggcagcc

SEQ ID NO: 1377875 - RNA, 16 nt, Neisseria meningitidis Z2491
gcaaguuccaagaugg

SEQ ID NO: 1377876 - RNA, 20 nt, Neisseria meningitidis Z2491
gcaauagaagaagcguuuug

SEQ ID NO: 1377877 - RNA, 20 nt, Neisseria meningitidis Z2491
gcaauagaagccaaaauauc

SEQ ID NO: 1377878 - RNA, 16 nt, Neisseria meningitidis Z2491
gcaaauuccagcaaug

SEQ ID NO: 1377879 - RNA, 22 nt, Neisseria meningitidis Z2491
gcaaauugaaaugccgucugaa

SEQ ID NO: 1377880 - RNA, 20 nt, Neisseria meningitidis Z2491
gcaagcagcaggcguucgga

SEQ ID NO: 1377881 - RNA, 19 nt, Neisseria meningitidis Z2491
gcaagcaauaccgcaaccu

SEQ ID NO: 1377882 - RNA, 20 nt, Neisseria meningitidis Z2491
gcaagcaguugaaaucaaca

SEQ ID NO: 1377883 - RNA, 16 nt, Neisseria meningitidis Z2491
gcaagcagggcuuuug

SEQ ID NO: 1377884 - RNA, 23 nt, Neisseria meningitidis Z2491
gcaagccuuucaacaaucugcau

SEQ ID NO: 1377885 - RNA, 14 nt, Neisseria meningitidis Z2491
gcaagccaagauau

SEQ ID NO: 1377886 - RNA, 13 nt, Neisseria meningitidis Z2491
gcacauuuuuuuc

SEQ ID NO: 1377887 - RNA, 17 nt, Neisseria meningitidis Z2491
gcacauuuuuuucauac

SEQ ID NO: 1377888 - RNA, 13 nt, Neisseria meningitidis Z2491
gcacacgggacgg

SEQ ID NO: 1377889 - RNA, 20 nt, Neisseria meningitidis Z2491
gcacagaaaccugcaccacg

SEQ ID NO: 1377890 - RNA, 14 nt, Neisseria meningitidis Z2491
gcacaguucuguca

SEQ ID NO: 1377891 - RNA, 23 nt, Neisseria meningitidis Z2491
gcaauuuaucggaaaugacugaa

SEQ ID NO: 1377892 - RNA, 23 nt, Neisseria meningitidis Z2491
gcaauuuaucgggaaugacugaa

SEQ ID NO: 1377893 - RNA, 15 nt, Neisseria meningitidis Z2491
gcacaaggcggcggc

SEQ ID NO: 1377894 - RNA, 22 nt, Neisseria meningitidis Z2491
gcaauuccugcacguugccuug

SEQ ID NO: 1377895 - RNA, 21 nt, Neisseria meningitidis Z2491
gcaauuauaagguaaguuuuu

SEQ ID NO: 1377896 - RNA, 16 nt, Neisseria meningitidis Z2491
gcauccgagccgccgu

SEQ ID NO: 1377897 - RNA, 18 nt, Neisseria meningitidis Z2491
gcauccgcuuaaaaaaca

SEQ ID NO: 1377898 - RNA, 16 nt, Neisseria meningitidis Z2491
gcauccgggccgccuu

SEQ ID NO: 1377899 - RNA, 15 nt, Neisseria meningitidis Z2491
gcauccgggcugcuu

SEQ ID NO: 1377900 - RNA, 22 nt, Neisseria meningitidis Z2491
gcaucaaaaacaaaaaaccgcu

SEQ ID NO: 1377901 - RNA, 15 nt, Neisseria meningitidis Z2491
gcauauguuucaaca

SEQ ID NO: 1377902 - RNA, 16 nt, Neisseria meningitidis Z2491
gcauauguuucaacac

SEQ ID NO: 1377903 - RNA, 18 nt, Neisseria meningitidis Z2491
gcauauguuuuuuccugu

SEQ ID NO: 1377904 - RNA, 22 nt, Neisseria meningitidis Z2491
gcauaucgucgggcugccaagc

SEQ ID NO: 1377905 - RNA, 15 nt, Neisseria meningitidis Z2491
gcaucacauaaugcc

SEQ ID NO: 1377906 - RNA, 18 nt, Neisseria meningitidis Z2491
gcaucaaaccauauggaa

SEQ ID NO: 1377907 - RNA, 18 nt, Neisseria meningitidis Z2491
gcaggcuuuugaggcugc

SEQ ID NO: 1377908 - RNA, 20 nt, Neisseria meningitidis Z2491
gcaggcuuuugaggcugccg

SEQ ID NO: 1377909 - RNA, 22 nt, Neisseria meningitidis Z2491
gcaguauccggcaagaauuuuu

SEQ ID NO: 1377910 - RNA, 19 nt, Neisseria meningitidis Z2491
gcagguuuuuuugauucaa

SEQ ID NO: 1377911 - RNA, 22 nt, Neisseria meningitidis Z2491
gcaguccuuaucugauaucgga

SEQ ID NO: 1377912 - RNA, 21 nt, Neisseria meningitidis Z2491
gcauaguuuccggcaagcagg

SEQ ID NO: 1377913 - RNA, 22 nt, Neisseria meningitidis Z2491
gcauaguuuccggcaagcaggg

SEQ ID NO: 1377914 - RNA, 19 nt, Neisseria meningitidis Z2491
gcauacgguuuuccgccug

SEQ ID NO: 1377915 - RNA, 19 nt, Neisseria meningitidis Z2491
gcagcuuugaguucgucaa

SEQ ID NO: 1377916 - RNA, 19 nt, Neisseria meningitidis Z2491
gcagcuuugcguuucuaga

SEQ ID NO: 1377917 - RNA, 22 nt, Neisseria meningitidis Z2491
gcaggcaaacgcgauuuucgac

SEQ ID NO: 1377918 - RNA, 20 nt, Neisseria meningitidis Z2491
gcaggcacaaggcggcggca

SEQ ID NO: 1377919 - RNA, 20 nt, Neisseria meningitidis Z2491
gcaggcgaccgccgccgcaa

SEQ ID NO: 1377920 - RNA, 17 nt, Neisseria meningitidis Z2491
gcaggcuacggcuugcu

SEQ ID NO: 1377921 - RNA, 17 nt, Neisseria meningitidis Z2491
gcaggcgggaauccagg

SEQ ID NO: 1377922 - RNA, 14 nt, Neisseria meningitidis Z2491
gcaggcgggaaucu

SEQ ID NO: 1377923 - RNA, 16 nt, Neisseria meningitidis Z2491
gcaggcgggaaucuag

SEQ ID NO: 1377924 - RNA, 19 nt, Neisseria meningitidis Z2491
gcaggcgggaaucuagaaa

SEQ ID NO: 1377925 - RNA, 18 nt, Neisseria meningitidis Z2491
gcaggcgggaaucuagac

SEQ ID NO: 1377926 - RNA, 20 nt, Neisseria meningitidis Z2491
gcagcggaaaugguccgaac

SEQ ID NO: 1377927 - RNA, 22 nt, Neisseria meningitidis Z2491
gcagcgcguuuucauccaccag

SEQ ID NO: 1377928 - RNA, 17 nt, Neisseria meningitidis Z2491
gcagcacaucgucugca

SEQ ID NO: 1377929 - RNA, 17 nt, Neisseria meningitidis Z2491
gcagcagcccuccccag

SEQ ID NO: 1377930 - RNA, 23 nt, Neisseria meningitidis Z2491
gcagcccgaacacgaccaacgcc

SEQ ID NO: 1377931 - RNA, 14 nt, Neisseria meningitidis Z2491
gcaaaucaggcagg

SEQ ID NO: 1377932 - RNA, 20 nt, Neisseria meningitidis Z2491
gcaaauaauugaaaucaaca

SEQ ID NO: 1377933 - RNA, 16 nt, Neisseria meningitidis Z2491
gcaaaugccuuaucca

SEQ ID NO: 1377934 - RNA, 20 nt, Neisseria meningitidis Z2491
gcaaaugccgucugaaaggc

SEQ ID NO: 1377935 - RNA, 15 nt, Neisseria meningitidis Z2491
gcaaagcggcaauca

SEQ ID NO: 1377936 - RNA, 14 nt, Neisseria meningitidis Z2491
gcaaaggucucaga

SEQ ID NO: 1377937 - RNA, 18 nt, Neisseria meningitidis Z2491
gcaaagucauauuaauua

SEQ ID NO: 1377938 - RNA, 14 nt, Neisseria meningitidis Z2491
gcaaacggcaggca

SEQ ID NO: 1377939 - RNA, 15 nt, Neisseria meningitidis Z2491
gcaaacggcaggcaa

SEQ ID NO: 1377940 - RNA, 21 nt, Neisseria meningitidis Z2491
gcaaacuccuuggaaugguug

SEQ ID NO: 1377941 - RNA, 16 nt, Neisseria meningitidis Z2491
gcaaaagcgggaaucu

SEQ ID NO: 1377942 - RNA, 11 nt, Neisseria meningitidis Z2491
gcaaaauaugg

SEQ ID NO: 1377943 - RNA, 15 nt, Neisseria meningitidis Z2491
gcaaaauagaaaacc

SEQ ID NO: 1377944 - RNA, 14 nt, Neisseria meningitidis Z2491
gcaaaaucagcaca

SEQ ID NO: 1377945 - RNA, 16 nt, Neisseria meningitidis Z2491
gcaaaaucagcacaaa

SEQ ID NO: 1377946 - RNA, 19 nt, Neisseria meningitidis Z2491
gcaaaaucagcacaaaugc

SEQ ID NO: 1377947 - RNA, 13 nt, Neisseria meningitidis Z2491
gcaaaauuuaucc

SEQ ID NO: 1377948 - RNA, 14 nt, Neisseria meningitidis Z2491
gcaaaauuuauccg

SEQ ID NO: 1377949 - RNA, 14 nt, Neisseria meningitidis Z2491
gcaaaauuucagau

SEQ ID NO: 1377950 - RNA, 19 nt, Neisseria meningitidis Z2491
gcaaaaucuggauuacuga

SEQ ID NO: 1377951 - RNA, 21 nt, Neisseria meningitidis Z2491
gauuuuuccuacuuuuugcuc

SEQ ID NO: 1377952 - RNA, 19 nt, Neisseria meningitidis Z2491
gauuuugguuuauuuuugg

SEQ ID NO: 1377953 - RNA, 15 nt, Neisseria meningitidis Z2491
gauuuugguuuucug

SEQ ID NO: 1377954 - RNA, 15 nt, Neisseria meningitidis Z2491
gauuuucaaaucuuc

SEQ ID NO: 1377955 - RNA, 16 nt, Neisseria meningitidis Z2491
gcaaaaacaaaaaaaa

SEQ ID NO: 1377956 - RNA, 22 nt, Neisseria meningitidis Z2491
gcaaaaacaaaaaaaaucaaaa

SEQ ID NO: 1377957 - RNA, 13 nt, Neisseria meningitidis Z2491
gcaaaaacaucag

SEQ ID NO: 1377958 - RNA, 15 nt, Neisseria meningitidis Z2491
gauuuuucugaauug

SEQ ID NO: 1377959 - RNA, 17 nt, Neisseria meningitidis Z2491
gcaaaaaguccuucacg

SEQ ID NO: 1377960 - RNA, 20 nt, Neisseria meningitidis Z2491
gcaaaagccagcggauuguu

SEQ ID NO: 1377961 - RNA, 13 nt, Neisseria meningitidis Z2491
gauuuauucuguu

SEQ ID NO: 1377962 - RNA, 18 nt, Neisseria meningitidis Z2491
gauuuaaauuuaauccac

SEQ ID NO: 1377963 - RNA, 19 nt, Neisseria meningitidis Z2491
gauugcgacauuuaucagg

SEQ ID NO: 1377964 - RNA, 21 nt, Neisseria meningitidis Z2491
gauucucuaaggugcugaagc

SEQ ID NO: 1377965 - RNA, 20 nt, Neisseria meningitidis Z2491
gauucucccaaaggcaauaa

SEQ ID NO: 1377966 - RNA, 17 nt, Neisseria meningitidis Z2491
gauugaccgaaaaauaa

SEQ ID NO: 1377967 - RNA, 16 nt, Neisseria meningitidis Z2491
gauucuggauucccac

SEQ ID NO: 1377968 - RNA, 17 nt, Neisseria meningitidis Z2491
gauuaauaaaaaucagg

SEQ ID NO: 1377969 - RNA, 20 nt, Neisseria meningitidis Z2491
gauuaagguuaauuaaaaua

SEQ ID NO: 1377970 - RNA, 20 nt, Neisseria meningitidis Z2491
gauuaacggcggaaccugcu

SEQ ID NO: 1377971 - RNA, 21 nt, Neisseria meningitidis Z2491
gauuaacguauucaagcagca

SEQ ID NO: 1377972 - RNA, 18 nt, Neisseria meningitidis Z2491
gauuaucgggaaaaauag

SEQ ID NO: 1377973 - RNA, 20 nt, Neisseria meningitidis Z2491
gauuaucgggaaaaauagaa

SEQ ID NO: 1377974 - RNA, 23 nt, Neisseria meningitidis Z2491
gauuacuuauuuaucaaaacagu

SEQ ID NO: 1377975 - RNA, 17 nt, Neisseria meningitidis Z2491
gauguccugaccgcgcu

SEQ ID NO: 1377976 - RNA, 12 nt, Neisseria meningitidis Z2491
gauuaacaaaaa

SEQ ID NO: 1377977 - RNA, 17 nt, Neisseria meningitidis Z2491
gauuaacaaaaaccagu

SEQ ID NO: 1377978 - RNA, 15 nt, Neisseria meningitidis Z2491
gauuaacaaaaauca

SEQ ID NO: 1377979 - RNA, 17 nt, Neisseria meningitidis Z2491
gauuaacaaaaaucagg

SEQ ID NO: 1377980 - RNA, 14 nt, Neisseria meningitidis Z2491
gauuaaauuuaaau

SEQ ID NO: 1377981 - RNA, 15 nt, Neisseria meningitidis Z2491
gaugguuuugccgcu

SEQ ID NO: 1377982 - RNA, 19 nt, Neisseria meningitidis Z2491
gaugguuuugccgcugcug

SEQ ID NO: 1377983 - RNA, 22 nt, Neisseria meningitidis Z2491
gauggcgcgcuguuucuucaaa

SEQ ID NO: 1377984 - RNA, 18 nt, Neisseria meningitidis Z2491
gaugcgggaacuugauuc

SEQ ID NO: 1377985 - RNA, 15 nt, Neisseria meningitidis Z2491
gaugcauaucuucag

SEQ ID NO: 1377986 - RNA, 15 nt, Neisseria meningitidis Z2491
gaugaucaguaaaaa

SEQ ID NO: 1377987 - RNA, 20 nt, Neisseria meningitidis Z2491
gaugaauccgucggcaaggu

SEQ ID NO: 1377988 - RNA, 14 nt, Neisseria meningitidis Z2491
gauaucgccucaua

SEQ ID NO: 1377989 - RNA, 15 nt, Neisseria meningitidis Z2491
gauauccgacugugc

SEQ ID NO: 1377990 - RNA, 17 nt, Neisseria meningitidis Z2491
gauauccgacugugccg

SEQ ID NO: 1377991 - RNA, 21 nt, Neisseria meningitidis Z2491
gaucaacguuucuauuuuccc

SEQ ID NO: 1377992 - RNA, 13 nt, Neisseria meningitidis Z2491
gauacacaaaaaa

SEQ ID NO: 1377993 - RNA, 21 nt, Neisseria meningitidis Z2491
gauacacaaaaaagccagcag

SEQ ID NO: 1377994 - RNA, 16 nt, Neisseria meningitidis Z2491
gauacacacaccggca

SEQ ID NO: 1377995 - RNA, 18 nt, Neisseria meningitidis Z2491
gauacgcgacaauaaaga

SEQ ID NO: 1377996 - RNA, 12 nt, Neisseria meningitidis Z2491
gauaauuuuuug

SEQ ID NO: 1377997 - RNA, 13 nt, Neisseria meningitidis Z2491
gauaaucuuuucg

SEQ ID NO: 1377998 - RNA, 13 nt, Neisseria meningitidis Z2491
gaguucgggcggg

SEQ ID NO: 1377999 - RNA, 14 nt, Neisseria meningitidis Z2491
gauaaaaaauaugg

SEQ ID NO: 1378000 - RNA, 19 nt, Neisseria meningitidis Z2491
gaauuucuguuuuugugag

SEQ ID NO: 1378001 - RNA, 14 nt, Neisseria meningitidis Z2491
gaguccaagacagg

SEQ ID NO: 1378002 - RNA, 15 nt, Neisseria meningitidis Z2491
gaguccaagacaggc

SEQ ID NO: 1378003 - RNA, 15 nt, Neisseria meningitidis Z2491
cuuuucccugacaaa

SEQ ID NO: 1378004 - RNA, 15 nt, Neisseria meningitidis Z2491
cuuuuauuuucaaac

SEQ ID NO: 1378005 - RNA, 21 nt, Neisseria meningitidis Z2491
cuuuucacuucgauuucuuug

SEQ ID NO: 1378006 - RNA, 12 nt, Neisseria meningitidis Z2491
cuuuucauauca

SEQ ID NO: 1378007 - RNA, 19 nt, Neisseria meningitidis Z2491
cuuugaaacgguuguucaa

SEQ ID NO: 1378008 - RNA, 15 nt, Neisseria meningitidis Z2491
cuuuguugcuguaug

SEQ ID NO: 1378009 - RNA, 20 nt, Neisseria meningitidis Z2491
cuuuugaguuucggucauuu

SEQ ID NO: 1378010 - RNA, 15 nt, Neisseria meningitidis Z2491
cuuuugaggcugccg

SEQ ID NO: 1378011 - RNA, 14 nt, Neisseria meningitidis Z2491
cuuuucgucgaauc

SEQ ID NO: 1378012 - RNA, 13 nt, Neisseria meningitidis Z2491
cuuuucugauuuu

SEQ ID NO: 1378013 - RNA, 10 nt, Neisseria meningitidis Z2491
cuuuuuccug

SEQ ID NO: 1378014 - RNA, 12 nt, Neisseria meningitidis Z2491
cuuuuuccagca

SEQ ID NO: 1378015 - RNA, 19 nt, Neisseria meningitidis Z2491
cuuuuugcaggaucuuauc

SEQ ID NO: 1378016 - RNA, 16 nt, Neisseria meningitidis Z2491
cuuuuuaaacaacaaa

SEQ ID NO: 1378017 - RNA, 12 nt, Neisseria meningitidis Z2491
gaaacaacaaaa

SEQ ID NO: 1378018 - RNA, 21 nt, Neisseria meningitidis Z2491
gaaacaacaaaaccuauccgc

SEQ ID NO: 1378019 - RNA, 18 nt, Neisseria meningitidis Z2491
gaaaauuucuugauuuuu

SEQ ID NO: 1378020 - RNA, 19 nt, Neisseria meningitidis Z2491
gaaacaaagcuuuaaacua

SEQ ID NO: 1378021 - RNA, 16 nt, Neisseria meningitidis Z2491
gaaaauccgccaaccu

SEQ ID NO: 1378022 - RNA, 16 nt, Neisseria meningitidis Z2491
gaaaaucaggggauua

SEQ ID NO: 1378023 - RNA, 19 nt, Neisseria meningitidis Z2491
gaaaaucaaaaaaaaaccu

SEQ ID NO: 1378024 - RNA, 19 nt, Neisseria meningitidis Z2491
gaaaagugcgguaaauuuu

SEQ ID NO: 1378025 - RNA, 21 nt, Neisseria meningitidis Z2491
gaaaaguacaaaaugccgucu

SEQ ID NO: 1378026 - RNA, 23 nt, Neisseria meningitidis Z2491
cuuuuugcgccagcggcaccaau

SEQ ID NO: 1378027 - RNA, 13 nt, Neisseria meningitidis Z2491
cuuuuugcucaau

SEQ ID NO: 1378028 - RNA, 19 nt, Neisseria meningitidis Z2491
cuuuuugcucaauauuagg

SEQ ID NO: 1378029 - RNA, 18 nt, Neisseria meningitidis Z2491
cuuuuuggcgcauuuuuu

SEQ ID NO: 1378030 - RNA, 17 nt, Neisseria meningitidis Z2491
cuuuuuuauaccgggga

SEQ ID NO: 1378031 - RNA, 14 nt, Neisseria meningitidis Z2491
gaaaaaacagaaac

SEQ ID NO: 1378032 - RNA, 17 nt, Neisseria meningitidis Z2491
cuuuuuucuguuuggcu

SEQ ID NO: 1378033 - RNA, 10 nt, Neisseria meningitidis Z2491
gaaaaaauaa

SEQ ID NO: 1378034 - RNA, 11 nt, Neisseria meningitidis Z2491
gaaaaauaaug

SEQ ID NO: 1378035 - RNA, 21 nt, Neisseria meningitidis Z2491
gaaaaaucuguggauaaacau

SEQ ID NO: 1378036 - RNA, 21 nt, Neisseria meningitidis Z2491
gaaaaaaugccgucugaaacg

SEQ ID NO: 1378037 - RNA, 17 nt, Neisseria meningitidis Z2491
gaaaaccgaaacagaaa

SEQ ID NO: 1378038 - RNA, 18 nt, Neisseria meningitidis Z2491
gaaaaccgaaacagaaac

SEQ ID NO: 1378039 - RNA, 22 nt, Neisseria meningitidis Z2491
gaaaaccgaugcgggaacuuga

SEQ ID NO: 1378040 - RNA, 21 nt, Neisseria meningitidis Z2491
gaaaaccaccgccaucaggaa

SEQ ID NO: 1378041 - RNA, 16 nt, Neisseria meningitidis Z2491
gaaaaccaaaaucaga

SEQ ID NO: 1378042 - RNA, 23 nt, Neisseria meningitidis Z2491
gaaaaccaaaaucagaaaccuaa

SEQ ID NO: 1378043 - RNA, 16 nt, Neisseria meningitidis Z2491
gaaaaccuugccgccc

SEQ ID NO: 1378044 - RNA, 15 nt, Neisseria meningitidis Z2491
gaaaaccuuucagac

SEQ ID NO: 1378045 - RNA, 17 nt, Neisseria meningitidis Z2491
gaaaacgccgucugaaa

SEQ ID NO: 1378046 - RNA, 20 nt, Neisseria meningitidis Z2491
gaaaaauuuucagacgaccu

SEQ ID NO: 1378047 - RNA, 18 nt, Neisseria meningitidis Z2491
gaaaacagcgaguuuuuc

SEQ ID NO: 1378048 - RNA, 12 nt, Neisseria meningitidis Z2491
gaaaacagaaac

SEQ ID NO: 1378049 - RNA, 15 nt, Neisseria meningitidis Z2491
gaaaacagaaaccua

SEQ ID NO: 1378050 - RNA, 23 nt, Neisseria meningitidis Z2491
gaaaacagaaagccaaaaacaga

SEQ ID NO: 1378051 - RNA, 22 nt, Neisseria meningitidis Z2491
gaaacaucauuggcaacuauua

SEQ ID NO: 1378052 - RNA, 14 nt, Neisseria meningitidis Z2491
gaaaccaaaagcca

SEQ ID NO: 1378053 - RNA, 19 nt, Neisseria meningitidis Z2491
gaaaccaaaagccaaaaaa

SEQ ID NO: 1378054 - RNA, 15 nt, Neisseria meningitidis Z2491
gaaacccaaacacag

SEQ ID NO: 1378055 - RNA, 22 nt, Neisseria meningitidis Z2491
gaaaccuguaccguuucagacg

SEQ ID NO: 1378056 - RNA, 16 nt, Neisseria meningitidis Z2491
gaaaccugaaaacaga

SEQ ID NO: 1378057 - RNA, 16 nt, Neisseria meningitidis Z2491
gaaaccugaaauaugg

SEQ ID NO: 1378058 - RNA, 18 nt, Neisseria meningitidis Z2491
gaaacccgauguuuucaa

SEQ ID NO: 1378059 - RNA, 11 nt, Neisseria meningitidis Z2491
gaaagagaaaa

SEQ ID NO: 1378060 - RNA, 17 nt, Neisseria meningitidis Z2491
gaaacugguaucugcau

SEQ ID NO: 1378061 - RNA, 21 nt, Neisseria meningitidis Z2491
gaaacuuaucgggaaaaacgg

SEQ ID NO: 1378062 - RNA, 16 nt, Neisseria meningitidis Z2491
gaaacucaaagcugca

SEQ ID NO: 1378063 - RNA, 19 nt, Neisseria meningitidis Z2491
gaaacucaacgaaccugga

SEQ ID NO: 1378064 - RNA, 18 nt, Neisseria meningitidis Z2491
gaaacucaacgcacugga

SEQ ID NO: 1378065 - RNA, 22 nt, Neisseria meningitidis Z2491
gaaacucaaaaaaacuagauuc

SEQ ID NO: 1378066 - RNA, 16 nt, Neisseria meningitidis Z2491
gaaacucaaaaaaccg

SEQ ID NO: 1378067 - RNA, 17 nt, Neisseria meningitidis Z2491
gaaacucaaaaaaccgg

SEQ ID NO: 1378068 - RNA, 18 nt, Neisseria meningitidis Z2491
gaaacucaaaaagcugga

SEQ ID NO: 1378069 - RNA, 22 nt, Neisseria meningitidis Z2491
gaaacguguaccgucaaauucu

SEQ ID NO: 1378070 - RNA, 15 nt, Neisseria meningitidis Z2491
gaaacggacaaaccg

SEQ ID NO: 1378071 - RNA, 13 nt, Neisseria meningitidis Z2491
gaaagcagcagcc

SEQ ID NO: 1378072 - RNA, 18 nt, Neisseria meningitidis Z2491
gaaagguugcgggaaucc

SEQ ID NO: 1378073 - RNA, 18 nt, Neisseria meningitidis Z2491
gaaagguugugggaaucc

SEQ ID NO: 1378074 - RNA, 21 nt, Neisseria meningitidis Z2491
gaaagguugugggaauccaga

SEQ ID NO: 1378075 - RNA, 20 nt, Neisseria meningitidis Z2491
gaaaguaugugcgccgaggu

SEQ ID NO: 1378076 - RNA, 14 nt, Neisseria meningitidis Z2491
gaaagcuuccaacu

SEQ ID NO: 1378077 - RNA, 15 nt, Neisseria meningitidis Z2491
gaaauaacucaucau

SEQ ID NO: 1378078 - RNA, 18 nt, Neisseria meningitidis Z2491
gaaauaagcgguuuuccc

SEQ ID NO: 1378079 - RNA, 17 nt, Neisseria meningitidis Z2491
gaaauaaggauauagag

SEQ ID NO: 1378080 - RNA, 17 nt, Neisseria meningitidis Z2491
gaaaguuugaaguucua

SEQ ID NO: 1378081 - RNA, 17 nt, Neisseria meningitidis Z2491
gaaaguuggaauccagu

SEQ ID NO: 1378082 - RNA, 15 nt, Neisseria meningitidis Z2491
gaaaguggaacagaa

SEQ ID NO: 1378083 - RNA, 16 nt, Neisseria meningitidis Z2491
gaaaguggaacagaaa

SEQ ID NO: 1378084 - RNA, 20 nt, Neisseria meningitidis Z2491
gaaauacuuaacaaugcccg

SEQ ID NO: 1378085 - RNA, 17 nt, Neisseria meningitidis Z2491
gaaauacgauaaaguug

SEQ ID NO: 1378086 - RNA, 14 nt, Neisseria meningitidis Z2491
gaacaggcggcggc

SEQ ID NO: 1378087 - RNA, 22 nt, Neisseria meningitidis Z2491
gaacaggcuucagacggcauuu

SEQ ID NO: 1378088 - RNA, 20 nt, Neisseria meningitidis Z2491
gaacauaaaugccgucugaa

SEQ ID NO: 1378089 - RNA, 15 nt, Neisseria meningitidis Z2491
gaacaaugcaaaaac

SEQ ID NO: 1378090 - RNA, 17 nt, Neisseria meningitidis Z2491
gaacaaugcaaaaacau

SEQ ID NO: 1378091 - RNA, 23 nt, Neisseria meningitidis Z2491
gaacaauucucuaaggugcugaa

SEQ ID NO: 1378092 - RNA, 18 nt, Neisseria meningitidis Z2491
gaacacagacauagacug

SEQ ID NO: 1378093 - RNA, 22 nt, Neisseria meningitidis Z2491
gaacagccugucccccaccgcc

SEQ ID NO: 1378094 - RNA, 14 nt, Neisseria meningitidis Z2491
gaacacgaccacuu

SEQ ID NO: 1378095 - RNA, 17 nt, Neisseria meningitidis Z2491
gaacacggguucagacg

SEQ ID NO: 1378096 - RNA, 14 nt, Neisseria meningitidis Z2491
gaacaaagaaagca

SEQ ID NO: 1378097 - RNA, 19 nt, Neisseria meningitidis Z2491
gaaauugccuucaucagca

SEQ ID NO: 1378098 - RNA, 20 nt, Neisseria meningitidis Z2491
gaaauugccuucaucagcau

SEQ ID NO: 1378099 - RNA, 17 nt, Neisseria meningitidis Z2491
gaaauucgucauucccg

SEQ ID NO: 1378100 - RNA, 19 nt, Neisseria meningitidis Z2491
gaaauuccgauaaggcaag

SEQ ID NO: 1378101 - RNA, 16 nt, Neisseria meningitidis Z2491
gaaaugaucaggcgga

SEQ ID NO: 1378102 - RNA, 22 nt, Neisseria meningitidis Z2491
gaaaugaucaggcggauuucuc

SEQ ID NO: 1378103 - RNA, 21 nt, Neisseria meningitidis Z2491
gaaaugaaaaacgacgagaau

SEQ ID NO: 1378104 - RNA, 19 nt, Neisseria meningitidis Z2491
gaaaugacggaaacucaaa

SEQ ID NO: 1378105 - RNA, 22 nt, Neisseria meningitidis Z2491
gaaaugacggaaacucaaaaaa

SEQ ID NO: 1378106 - RNA, 13 nt, Neisseria meningitidis Z2491
gaaaugacugaaa

SEQ ID NO: 1378107 - RNA, 18 nt, Neisseria meningitidis Z2491
gaaaugccgucugaagcc

SEQ ID NO: 1378108 - RNA, 19 nt, Neisseria meningitidis Z2491
gaaaugccgucugaagccu

SEQ ID NO: 1378109 - RNA, 18 nt, Neisseria meningitidis Z2491
gaaaugguuuaagagcuc

SEQ ID NO: 1378110 - RNA, 21 nt, Neisseria meningitidis Z2491
gaaaugucgcccgacaaccgc

SEQ ID NO: 1378111 - RNA, 21 nt, Neisseria meningitidis Z2491
gaaaucaauccuuccugauga

SEQ ID NO: 1378112 - RNA, 22 nt, Neisseria meningitidis Z2491
gaaaucaauccuuccugaugaa

SEQ ID NO: 1378113 - RNA, 16 nt, Neisseria meningitidis Z2491
gaaaucccaaacccuc

SEQ ID NO: 1378114 - RNA, 15 nt, Neisseria meningitidis Z2491
gaaaucauccacagc

SEQ ID NO: 1378115 - RNA, 18 nt, Neisseria meningitidis Z2491
gaaauccuauuuucagau

SEQ ID NO: 1378116 - RNA, 22 nt, Neisseria meningitidis Z2491
gaagaaagcggaauacggcaac

SEQ ID NO: 1378117 - RNA, 17 nt, Neisseria meningitidis Z2491
gaagaaauagccgccgc

SEQ ID NO: 1378118 - RNA, 19 nt, Neisseria meningitidis Z2491
gaagaacgccaaacccaac

SEQ ID NO: 1378119 - RNA, 17 nt, Neisseria meningitidis Z2491
gaagacgauuugguugu

SEQ ID NO: 1378120 - RNA, 17 nt, Neisseria meningitidis Z2491
gaagaagugggucagcc

SEQ ID NO: 1378121 - RNA, 20 nt, Neisseria meningitidis Z2491
gaagaagugcguacgcaggc

SEQ ID NO: 1378122 - RNA, 19 nt, Neisseria meningitidis Z2491
gaagagcugcgggaaugac

SEQ ID NO: 1378123 - RNA, 16 nt, Neisseria meningitidis Z2491
gaagcaccaagugaau

SEQ ID NO: 1378124 - RNA, 20 nt, Neisseria meningitidis Z2491
gaagcccacccuaccauugu

SEQ ID NO: 1378125 - RNA, 13 nt, Neisseria meningitidis Z2491
gaagccuucagac

SEQ ID NO: 1378126 - RNA, 14 nt, Neisseria meningitidis Z2491
gaagcgaaaagugg

SEQ ID NO: 1378127 - RNA, 23 nt, Neisseria meningitidis Z2491
gaagcggaaaucguaccaaccgu

SEQ ID NO: 1378128 - RNA, 14 nt, Neisseria meningitidis Z2491
gaagcuauccgcac

SEQ ID NO: 1378129 - RNA, 12 nt, Neisseria meningitidis Z2491
gaagcggcggca

SEQ ID NO: 1378130 - RNA, 12 nt, Neisseria meningitidis Z2491
gaacuucagacg

SEQ ID NO: 1378131 - RNA, 22 nt, Neisseria meningitidis Z2491
gaacguggaaucuaaagaaacc

SEQ ID NO: 1378132 - RNA, 18 nt, Neisseria meningitidis Z2491
gaacguaaaaucugaaga

SEQ ID NO: 1378133 - RNA, 14 nt, Neisseria meningitidis Z2491
gaacggagccagcc

SEQ ID NO: 1378134 - RNA, 14 nt, Neisseria meningitidis Z2491
gaacgcuucagacg

SEQ ID NO: 1378135 - RNA, 20 nt, Neisseria meningitidis Z2491
gaacggcacaaacgccagca

SEQ ID NO: 1378136 - RNA, 19 nt, Neisseria meningitidis Z2491
gaaccucuaaacuuucaga

SEQ ID NO: 1378137 - RNA, 18 nt, Neisseria meningitidis Z2491
gaaccucaaacuuucaga

SEQ ID NO: 1378138 - RNA, 15 nt, Neisseria meningitidis Z2491
gaaccguuuuccgcc

SEQ ID NO: 1378139 - RNA, 23 nt, Neisseria meningitidis Z2491
gaacgauuuuuuuucuaaccagc

SEQ ID NO: 1378140 - RNA, 21 nt, Neisseria meningitidis Z2491
gaacgauucucuaaggugcug

SEQ ID NO: 1378141 - RNA, 19 nt, Neisseria meningitidis Z2491
gaacgauuugaaccauuuc

SEQ ID NO: 1378142 - RNA, 12 nt, Neisseria meningitidis Z2491
gaacccaaaccg

SEQ ID NO: 1378143 - RNA, 13 nt, Neisseria meningitidis Z2491
gaaccauuuccac

SEQ ID NO: 1378144 - RNA, 14 nt, Neisseria meningitidis Z2491
gaaccggauucccg

SEQ ID NO: 1378145 - RNA, 14 nt, Neisseria meningitidis Z2491
gaaccgcaaaugcu

SEQ ID NO: 1378146 - RNA, 20 nt, Neisseria meningitidis Z2491
gaauugcgccgacagcagcu

SEQ ID NO: 1378147 - RNA, 19 nt, Neisseria meningitidis Z2491
gaauuuaucggaaaugacc

SEQ ID NO: 1378148 - RNA, 16 nt, Neisseria meningitidis Z2491
gaaugccgaggguuug

SEQ ID NO: 1378149 - RNA, 18 nt, Neisseria meningitidis Z2491
gaaugccgucugaagccg

SEQ ID NO: 1378150 - RNA, 21 nt, Neisseria meningitidis Z2491
gaaugccuuucucuguuuuuc

SEQ ID NO: 1378151 - RNA, 23 nt, Neisseria meningitidis Z2491
gaauggccgauuuuggguuucug

SEQ ID NO: 1378152 - RNA, 17 nt, Neisseria meningitidis Z2491
gaaugucuagauucccg

SEQ ID NO: 1378153 - RNA, 15 nt, Neisseria meningitidis Z2491
gaauuaaaugcuaaa

SEQ ID NO: 1378154 - RNA, 16 nt, Neisseria meningitidis Z2491
gaaugacggggguuug

SEQ ID NO: 1378155 - RNA, 14 nt, Neisseria meningitidis Z2491
gaaugacguggugu

SEQ ID NO: 1378156 - RNA, 19 nt, Neisseria meningitidis Z2491
gaaugacgugguguagguu

SEQ ID NO: 1378157 - RNA, 15 nt, Neisseria meningitidis Z2491
gaaugacgaaagguu

SEQ ID NO: 1378158 - RNA, 17 nt, Neisseria meningitidis Z2491
gaaugacgaaguuucag

SEQ ID NO: 1378159 - RNA, 21 nt, Neisseria meningitidis Z2491
gaaugacgagauuuuagguua

SEQ ID NO: 1378160 - RNA, 21 nt, Neisseria meningitidis Z2491
gaaugacuguccgagacagaa

SEQ ID NO: 1378161 - RNA, 14 nt, Neisseria meningitidis Z2491
gaaugacugaaacu

SEQ ID NO: 1378162 - RNA, 17 nt, Neisseria meningitidis Z2491
gaaugacugaaacucaa

SEQ ID NO: 1378163 - RNA, 18 nt, Neisseria meningitidis Z2491
gaaugauucauaaaauau

SEQ ID NO: 1378164 - RNA, 16 nt, Neisseria meningitidis Z2491
gaaucuuauccacaga

SEQ ID NO: 1378165 - RNA, 20 nt, Neisseria meningitidis Z2491
gaaugaauagucaggcugcc

SEQ ID NO: 1378166 - RNA, 19 nt, Neisseria meningitidis Z2491
gaaugacaggauguagguu

SEQ ID NO: 1378167 - RNA, 20 nt, Neisseria meningitidis Z2491
gaaucugcugcaaaccgucu

SEQ ID NO: 1378168 - RNA, 15 nt, Neisseria meningitidis Z2491
gaaucuggaaaccaa

SEQ ID NO: 1378169 - RNA, 19 nt, Neisseria meningitidis Z2491
gaaucuggaaaccaaaaaa

SEQ ID NO: 1378170 - RNA, 18 nt, Neisseria meningitidis Z2491
gaaucucguuauuuccac

SEQ ID NO: 1378171 - RNA, 14 nt, Neisseria meningitidis Z2491
gaaucucuaaagcu

SEQ ID NO: 1378172 - RNA, 16 nt, Neisseria meningitidis Z2491
gaaucuagaaacucaa

SEQ ID NO: 1378173 - RNA, 15 nt, Neisseria meningitidis Z2491
gaaucuagaaaugaa

SEQ ID NO: 1378174 - RNA, 15 nt, Neisseria meningitidis Z2491
gaaucguucucuuug

SEQ ID NO: 1378175 - RNA, 23 nt, Neisseria meningitidis Z2491
gaaucuagacauucaaugcuaag

SEQ ID NO: 1378176 - RNA, 20 nt, Neisseria meningitidis Z2491
gaaucuagugcguugaguuu

SEQ ID NO: 1378177 - RNA, 17 nt, Neisseria meningitidis Z2491
gaaucggguuucagacg

SEQ ID NO: 1378178 - RNA, 19 nt, Neisseria meningitidis Z2491
gaaucagguugaaaaugcc

SEQ ID NO: 1378179 - RNA, 14 nt, Neisseria meningitidis Z2491
gaaucaaauauuaa

SEQ ID NO: 1378180 - RNA, 12 nt, Neisseria meningitidis Z2491
gaaucacaauau

SEQ ID NO: 1378181 - RNA, 20 nt, Neisseria meningitidis Z2491
gaaucacaauauagccgccc

SEQ ID NO: 1378182 - RNA, 14 nt, Neisseria meningitidis Z2491
gaauccagugcguu

SEQ ID NO: 1378183 - RNA, 23 nt, Neisseria meningitidis Z2491
gaauccagugcguugaguuucag

SEQ ID NO: 1378184 - RNA, 18 nt, Neisseria meningitidis Z2491
gaauccaucaauuuccac

SEQ ID NO: 1378185 - RNA, 23 nt, Neisseria meningitidis Z2491
gaauccagaacguaaaaucugaa

SEQ ID NO: 1378186 - RNA, 16 nt, Neisseria meningitidis Z2491
gaauccagacauucaa

SEQ ID NO: 1378187 - RNA, 14 nt, Neisseria meningitidis Z2491
gaauaaaaaauaug

SEQ ID NO: 1378188 - RNA, 15 nt, Neisseria meningitidis Z2491
gaauaaaaaauaugg

SEQ ID NO: 1378189 - RNA, 15 nt, Neisseria meningitidis Z2491
gaauaaacuucuaac

SEQ ID NO: 1378190 - RNA, 20 nt, Neisseria meningitidis Z2491
gaagugcguacgcaggcugg

SEQ ID NO: 1378191 - RNA, 14 nt, Neisseria meningitidis Z2491
gaagugggucagcc

SEQ ID NO: 1378192 - RNA, 22 nt, Neisseria meningitidis Z2491
gaagucgugaauuaaaugcuaa

SEQ ID NO: 1378193 - RNA, 23 nt, Neisseria meningitidis Z2491
gaagguuuuaggcaauugaaaaa

SEQ ID NO: 1378194 - RNA, 23 nt, Neisseria meningitidis Z2491
gaagguuuuaggcaauugaaaau

SEQ ID NO: 1378195 - RNA, 17 nt, Neisseria meningitidis Z2491
gaaggggcugauguauu

SEQ ID NO: 1378196 - RNA, 15 nt, Neisseria meningitidis Z2491
gaaggggcggaaugc

SEQ ID NO: 1378197 - RNA, 23 nt, Neisseria meningitidis Z2491
gaauacugccuguaaaaccaagu

SEQ ID NO: 1378198 - RNA, 19 nt, Neisseria meningitidis Z2491
gaauacaaacaucugauuu

SEQ ID NO: 1378199 - RNA, 19 nt, Neisseria meningitidis Z2491
gaauaaucuuauaaagaca

SEQ ID NO: 1378200 - RNA, 18 nt, Neisseria meningitidis Z2491
gaauauuuccucacugcc

SEQ ID NO: 1378201 - RNA, 13 nt, Neisseria meningitidis Z2491
gaauacuucuucu

SEQ ID NO: 1378202 - RNA, 16 nt, Neisseria meningitidis Z2491
gaauacuucuucugua

SEQ ID NO: 1378203 - RNA, 16 nt, Neisseria meningitidis Z2491
gaauagucaggcugcc

SEQ ID NO: 1378204 - RNA, 15 nt, Neisseria meningitidis Z2491
gaauaggacaaaugc

SEQ ID NO: 1378205 - RNA, 11 nt, Neisseria meningitidis Z2491
gaauagcucag

SEQ ID NO: 1378206 - RNA, 22 nt, Neisseria meningitidis Z2491
cuuaucggcaaaaaaaucgcug

SEQ ID NO: 1378207 - RNA, 13 nt, Neisseria meningitidis Z2491
cuuauccauccca

SEQ ID NO: 1378208 - RNA, 13 nt, Neisseria meningitidis Z2491
cuuaaaauuucau

SEQ ID NO: 1378209 - RNA, 20 nt, Neisseria meningitidis Z2491
cuuacggauggcauagccgc

SEQ ID NO: 1378210 - RNA, 20 nt, Neisseria meningitidis Z2491
cuuacaauccgcuuuuuaaa

SEQ ID NO: 1378211 - RNA, 22 nt, Neisseria meningitidis Z2491
cuuacaauccgcuuuuuaaaca

SEQ ID NO: 1378212 - RNA, 16 nt, Neisseria meningitidis Z2491
cuguuuccaagccgca

SEQ ID NO: 1378213 - RNA, 24 nt, Neisseria meningitidis Z2491
cuguuuccaagccgcauugucccu

SEQ ID NO: 1378214 - RNA, 21 nt, Neisseria meningitidis Z2491
cuguuucagacggcauuuuug

SEQ ID NO: 1378215 - RNA, 22 nt, Neisseria meningitidis Z2491
cuguuucagacggcauuuuugu

SEQ ID NO: 1378216 - RNA, 21 nt, Neisseria meningitidis Z2491
cuguuuucgcgggaauccggu

SEQ ID NO: 1378217 - RNA, 14 nt, Neisseria meningitidis Z2491
cuguuuucuguuug

SEQ ID NO: 1378218 - RNA, 20 nt, Neisseria meningitidis Z2491
cuguuugcgauaggauuugc

SEQ ID NO: 1378219 - RNA, 15 nt, Neisseria meningitidis Z2491
cuguuuggcuuuuuu

SEQ ID NO: 1378220 - RNA, 18 nt, Neisseria meningitidis Z2491
cuguuuggcuuuuuucug

SEQ ID NO: 1378221 - RNA, 13 nt, Neisseria meningitidis Z2491
cuuaaacagcacu

SEQ ID NO: 1378222 - RNA, 12 nt, Neisseria meningitidis Z2491
cuuaaaauuccg

SEQ ID NO: 1378223 - RNA, 23 nt, Neisseria meningitidis Z2491
cuuaaaaaacaaacaggcagccu

SEQ ID NO: 1378224 - RNA, 13 nt, Neisseria meningitidis Z2491
cuuaaaaaacaac

SEQ ID NO: 1378225 - RNA, 12 nt, Neisseria meningitidis Z2491
cuguuuuuuccg

SEQ ID NO: 1378226 - RNA, 21 nt, Neisseria meningitidis Z2491
cuguucggucauagccagaga

SEQ ID NO: 1378227 - RNA, 23 nt, Neisseria meningitidis Z2491
cuguugaaaaugccgucugaaac

SEQ ID NO: 1378228 - RNA, 17 nt, Neisseria meningitidis Z2491
cugucugcggcucgccg

SEQ ID NO: 1378229 - RNA, 11 nt, Neisseria meningitidis Z2491
cuguuggaaaa

SEQ ID NO: 1378230 - RNA, 15 nt, Neisseria meningitidis Z2491
cuguuggaaaaacug

SEQ ID NO: 1378231 - RNA, 16 nt, Neisseria meningitidis Z2491
cuguugcacaaacaga

SEQ ID NO: 1378232 - RNA, 19 nt, Neisseria meningitidis Z2491
cuguuggccgcuuucaaca

SEQ ID NO: 1378233 - RNA, 17 nt, Neisseria meningitidis Z2491
cuucagcaccuuagaga

SEQ ID NO: 1378234 - RNA, 17 nt, Neisseria meningitidis Z2491
cuuaucuaaaggaaugg

SEQ ID NO: 1378235 - RNA, 14 nt, Neisseria meningitidis Z2491
cuuauguuuaauca

SEQ ID NO: 1378236 - RNA, 22 nt, Neisseria meningitidis Z2491
cuucaguuccaucgcgucuuca

SEQ ID NO: 1378237 - RNA, 14 nt, Neisseria meningitidis Z2491
cuucagcucucccu

SEQ ID NO: 1378238 - RNA, 19 nt, Neisseria meningitidis Z2491
cuucagcucucccucuuua

SEQ ID NO: 1378239 - RNA, 21 nt, Neisseria meningitidis Z2491
cuucagcucucccucuuuaaa

SEQ ID NO: 1378240 - RNA, 14 nt, Neisseria meningitidis Z2491
cuucgcgccgcccg

SEQ ID NO: 1378241 - RNA, 22 nt, Neisseria meningitidis Z2491
cuucgauguguucgcauuuugc

SEQ ID NO: 1378242 - RNA, 17 nt, Neisseria meningitidis Z2491
cuuccauuugagccgca

SEQ ID NO: 1378243 - RNA, 14 nt, Neisseria meningitidis Z2491
cuuccgcaggcucc

SEQ ID NO: 1378244 - RNA, 17 nt, Neisseria meningitidis Z2491
cuuccgcauaauaaaaa

SEQ ID NO: 1378245 - RNA, 15 nt, Neisseria meningitidis Z2491
cuuccgaggcggcuu

SEQ ID NO: 1378246 - RNA, 16 nt, Neisseria meningitidis Z2491
cuuccgaggcggcuuu

SEQ ID NO: 1378247 - RNA, 15 nt, Neisseria meningitidis Z2491
cuuccgcuucuucca

SEQ ID NO: 1378248 - RNA, 15 nt, Neisseria meningitidis Z2491
cuucauuccgcgcag

SEQ ID NO: 1378249 - RNA, 23 nt, Neisseria meningitidis Z2491
cuuuccaugcuuaaacagcacug

SEQ ID NO: 1378250 - RNA, 22 nt, Neisseria meningitidis Z2491
cuuuccguucggaacacaaaaa

SEQ ID NO: 1378251 - RNA, 21 nt, Neisseria meningitidis Z2491
cuuucccguuucagacggcau

SEQ ID NO: 1378252 - RNA, 13 nt, Neisseria meningitidis Z2491
cuuucccucccga

SEQ ID NO: 1378253 - RNA, 20 nt, Neisseria meningitidis Z2491
cuuucggauaaucuuugaau

SEQ ID NO: 1378254 - RNA, 14 nt, Neisseria meningitidis Z2491
cuuucacaaaggag

SEQ ID NO: 1378255 - RNA, 19 nt, Neisseria meningitidis Z2491
cuuguguugguuuugaggc

SEQ ID NO: 1378256 - RNA, 16 nt, Neisseria meningitidis Z2491
cuuguggguauuuacc

SEQ ID NO: 1378257 - RNA, 11 nt, Neisseria meningitidis Z2491
cuuguccugau

SEQ ID NO: 1378258 - RNA, 14 nt, Neisseria meningitidis Z2491
cuuguccugauuua

SEQ ID NO: 1378259 - RNA, 21 nt, Neisseria meningitidis Z2491
cuuguccugauuuaaauuuaa

SEQ ID NO: 1378260 - RNA, 14 nt, Neisseria meningitidis Z2491
cuuguccugauuuu

SEQ ID NO: 1378261 - RNA, 16 nt, Neisseria meningitidis Z2491
cuugugccagcucuug

SEQ ID NO: 1378262 - RNA, 12 nt, Neisseria meningitidis Z2491
cuuuaaauuuaa

SEQ ID NO: 1378263 - RNA, 16 nt, Neisseria meningitidis Z2491
cuugcagcuuugcguu

SEQ ID NO: 1378264 - RNA, 16 nt, Neisseria meningitidis Z2491
cuugcagguggaauuc

SEQ ID NO: 1378265 - RNA, 21 nt, Neisseria meningitidis Z2491
cuugaaauacgguacuggugg

SEQ ID NO: 1378266 - RNA, 17 nt, Neisseria meningitidis Z2491
cuugaguuucuguauuu

SEQ ID NO: 1378267 - RNA, 13 nt, Neisseria meningitidis Z2491
cuucuucuaaaaa

SEQ ID NO: 1378268 - RNA, 19 nt, Neisseria meningitidis Z2491
cuucuucgacguugccuuc

SEQ ID NO: 1378269 - RNA, 21 nt, Neisseria meningitidis Z2491
cuucuucgacguugccuucuu

SEQ ID NO: 1378270 - RNA, 13 nt, Neisseria meningitidis Z2491
cuucuuacccaau

SEQ ID NO: 1378271 - RNA, 22 nt, Neisseria meningitidis Z2491
cuucuguaacuuccacaccguu

SEQ ID NO: 1378272 - RNA, 17 nt, Neisseria meningitidis Z2491
cugcuuuaauucuccaa

SEQ ID NO: 1378273 - RNA, 18 nt, Neisseria meningitidis Z2491
cugcuugaccaaagcauu

SEQ ID NO: 1378274 - RNA, 21 nt, Neisseria meningitidis Z2491
cuguauuuuucgaggcgcagg

SEQ ID NO: 1378275 - RNA, 15 nt, Neisseria meningitidis Z2491
cuguaaacagauaaa

SEQ ID NO: 1378276 - RNA, 19 nt, Neisseria meningitidis Z2491
cuguaaacagauaaaacca

SEQ ID NO: 1378277 - RNA, 18 nt, Neisseria meningitidis Z2491
cugguuuuuguuaauccg

SEQ ID NO: 1378278 - RNA, 22 nt, Neisseria meningitidis Z2491
cuguaccgcaucuucaaaggaa

SEQ ID NO: 1378279 - RNA, 14 nt, Neisseria meningitidis Z2491
cuguacgcugaugu

SEQ ID NO: 1378280 - RNA, 17 nt, Neisseria meningitidis Z2491
cuguaccguuucagacg

SEQ ID NO: 1378281 - RNA, 15 nt, Neisseria meningitidis Z2491
cugggugguggcaag

SEQ ID NO: 1378282 - RNA, 23 nt, Neisseria meningitidis Z2491
cuggcgguaaagugcggugaaau

SEQ ID NO: 1378283 - RNA, 18 nt, Neisseria meningitidis Z2491
cugguaucuuuaaacagc

SEQ ID NO: 1378284 - RNA, 13 nt, Neisseria meningitidis Z2491
cugcggaaacaga

SEQ ID NO: 1378285 - RNA, 17 nt, Neisseria meningitidis Z2491
cugcggcuuugccgccu

SEQ ID NO: 1378286 - RNA, 18 nt, Neisseria meningitidis Z2491
cugcggcuucguugccuu

SEQ ID NO: 1378287 - RNA, 16 nt, Neisseria meningitidis Z2491
cugcggacuuaagaaa

SEQ ID NO: 1378288 - RNA, 13 nt, Neisseria meningitidis Z2491
cugcgcccaaagc

SEQ ID NO: 1378289 - RNA, 17 nt, Neisseria meningitidis Z2491
cugccucuuuucagaca

SEQ ID NO: 1378290 - RNA, 18 nt, Neisseria meningitidis Z2491
cugccugauacagccacg

SEQ ID NO: 1378291 - RNA, 21 nt, Neisseria meningitidis Z2491
cugccugauacagccacgcca

SEQ ID NO: 1378292 - RNA, 18 nt, Neisseria meningitidis Z2491
cugccugcaacgcuugug

SEQ ID NO: 1378293 - RNA, 15 nt, Neisseria meningitidis Z2491
cugccuguuuuucuu

SEQ ID NO: 1378294 - RNA, 22 nt, Neisseria meningitidis Z2491
cugccugcgcgagaauaaugaa

SEQ ID NO: 1378295 - RNA, 20 nt, Neisseria meningitidis Z2491
cugcgcgggaaugacggcaa

SEQ ID NO: 1378296 - RNA, 19 nt, Neisseria meningitidis Z2491
cugcgcgggaaugacggcg

SEQ ID NO: 1378297 - RNA, 16 nt, Neisseria meningitidis Z2491
cugccacgaugggcau

SEQ ID NO: 1378298 - RNA, 23 nt, Neisseria meningitidis Z2491
cugccgucauucccgcaaaagcg

SEQ ID NO: 1378299 - RNA, 17 nt, Neisseria meningitidis Z2491
cugccgugggugcuuug

SEQ ID NO: 1378300 - RNA, 22 nt, Neisseria meningitidis Z2491
cugccgugggugcuuuggcuuc

SEQ ID NO: 1378301 - RNA, 14 nt, Neisseria meningitidis Z2491
cugccgugaugccc

SEQ ID NO: 1378302 - RNA, 18 nt, Neisseria meningitidis Z2491
cugccgugaugccccaau

SEQ ID NO: 1378303 - RNA, 11 nt, Neisseria meningitidis Z2491
cugccggcaaa

SEQ ID NO: 1378304 - RNA, 20 nt, Neisseria meningitidis Z2491
cugcccguauuugagugcgg

SEQ ID NO: 1378305 - RNA, 21 nt, Neisseria meningitidis Z2491
cugcccguauuugagugcggc

SEQ ID NO: 1378306 - RNA, 13 nt, Neisseria meningitidis Z2491
cugccgaccgcgc

SEQ ID NO: 1378307 - RNA, 21 nt, Neisseria meningitidis Z2491
cugccgaggcgcgugaauuug

SEQ ID NO: 1378308 - RNA, 14 nt, Neisseria meningitidis Z2491
cugauuuauuuccu

SEQ ID NO: 1378309 - RNA, 13 nt, Neisseria meningitidis Z2491
cugcaaaauuuau

SEQ ID NO: 1378310 - RNA, 14 nt, Neisseria meningitidis Z2491
cugcaaaauuuauc

SEQ ID NO: 1378311 - RNA, 16 nt, Neisseria meningitidis Z2491
cugcaagaauuuauca

SEQ ID NO: 1378312 - RNA, 17 nt, Neisseria meningitidis Z2491
cugcaaggcgaggcaac

SEQ ID NO: 1378313 - RNA, 17 nt, Neisseria meningitidis Z2491
cugcaggcguaugccuu

SEQ ID NO: 1378314 - RNA, 14 nt, Neisseria meningitidis Z2491
cugcaguugggcga

SEQ ID NO: 1378315 - RNA, 18 nt, Neisseria meningitidis Z2491
cugcaguugggcgauggc

SEQ ID NO: 1378316 - RNA, 20 nt, Neisseria meningitidis Z2491
cugcaguaacuucaaacccc

SEQ ID NO: 1378317 - RNA, 21 nt, Neisseria meningitidis Z2491
cugcaggugcagcggaaaugg

SEQ ID NO: 1378318 - RNA, 19 nt, Neisseria meningitidis Z2491
cucuauuuaaaaauuccug

SEQ ID NO: 1378319 - RNA, 22 nt, Neisseria meningitidis Z2491
cugauaucggaggaguuugaug

SEQ ID NO: 1378320 - RNA, 20 nt, Neisseria meningitidis Z2491
cugauaguugccgucaaaga

SEQ ID NO: 1378321 - RNA, 22 nt, Neisseria meningitidis Z2491
cugauaaaugccgcaaucucaa

SEQ ID NO: 1378322 - RNA, 13 nt, Neisseria meningitidis Z2491
cuauaacagcaac

SEQ ID NO: 1378323 - RNA, 10 nt, Neisseria meningitidis Z2491
cuauaaaauu

SEQ ID NO: 1378324 - RNA, 22 nt, Neisseria meningitidis Z2491
cuauaaaauuggaaaugacgac

SEQ ID NO: 1378325 - RNA, 17 nt, Neisseria meningitidis Z2491
cuauacuguaaucaggg

SEQ ID NO: 1378326 - RNA, 20 nt, Neisseria meningitidis Z2491
cuauaaugauugacuauuuu

SEQ ID NO: 1378327 - RNA, 23 nt, Neisseria meningitidis Z2491
cuauaugaguguaucggugucaa

SEQ ID NO: 1378328 - RNA, 18 nt, Neisseria meningitidis Z2491
cuauauauaguugauuaa

SEQ ID NO: 1378329 - RNA, 13 nt, Neisseria meningitidis Z2491
cuagccaaaaaaa

SEQ ID NO: 1378330 - RNA, 12 nt, Neisseria meningitidis Z2491
cuagaaauuuaa

SEQ ID NO: 1378331 - RNA, 15 nt, Neisseria meningitidis Z2491
cuagaaacucaaagc

SEQ ID NO: 1378332 - RNA, 17 nt, Neisseria meningitidis Z2491
cuagaaacgcaaagcug

SEQ ID NO: 1378333 - RNA, 21 nt, Neisseria meningitidis Z2491
cuacgcggcugaaaaaaugcc

SEQ ID NO: 1378334 - RNA, 14 nt, Neisseria meningitidis Z2491
cuacgcgggaauga

SEQ ID NO: 1378335 - RNA, 18 nt, Neisseria meningitidis Z2491
cuacggcucguuuaauua

SEQ ID NO: 1378336 - RNA, 17 nt, Neisseria meningitidis Z2491
cucagccaccagcggua

SEQ ID NO: 1378337 - RNA, 22 nt, Neisseria meningitidis Z2491
cucaaacagcaggucgacggca

SEQ ID NO: 1378338 - RNA, 17 nt, Neisseria meningitidis Z2491
cucaaaaaaugccgucu

SEQ ID NO: 1378339 - RNA, 12 nt, Neisseria meningitidis Z2491
cucaaagcugca

SEQ ID NO: 1378340 - RNA, 12 nt, Neisseria meningitidis Z2491
cuauuuuuuaau

SEQ ID NO: 1378341 - RNA, 20 nt, Neisseria meningitidis Z2491
cuauuuguucgauauuuuug

SEQ ID NO: 1378342 - RNA, 21 nt, Neisseria meningitidis Z2491
cuauuuguucgauauuuuuga

SEQ ID NO: 1378343 - RNA, 13 nt, Neisseria meningitidis Z2491
cuauuuuacagcg

SEQ ID NO: 1378344 - RNA, 22 nt, Neisseria meningitidis Z2491
cuauuacgaacaggacaaaaau

SEQ ID NO: 1378345 - RNA, 17 nt, Neisseria meningitidis Z2491
cucaaccuguuuuucaa

SEQ ID NO: 1378346 - RNA, 14 nt, Neisseria meningitidis Z2491
cucaaauaaaaugc

SEQ ID NO: 1378347 - RNA, 12 nt, Neisseria meningitidis Z2491
cucaaucccguu

SEQ ID NO: 1378348 - RNA, 18 nt, Neisseria meningitidis Z2491
cucaaucccguugccaaa

SEQ ID NO: 1378349 - RNA, 15 nt, Neisseria meningitidis Z2491
cucaaucucauuuuc

SEQ ID NO: 1378350 - RNA, 17 nt, Neisseria meningitidis Z2491
cucgcggcucgcccacg

SEQ ID NO: 1378351 - RNA, 17 nt, Neisseria meningitidis Z2491
cucgcguauccagccgc

SEQ ID NO: 1378352 - RNA, 17 nt, Neisseria meningitidis Z2491
cucgauuugaaaucuga

SEQ ID NO: 1378353 - RNA, 16 nt, Neisseria meningitidis Z2491
cuccugauaaaugccg

SEQ ID NO: 1378354 - RNA, 22 nt, Neisseria meningitidis Z2491
cuccugaucuaaaaauucuaac

SEQ ID NO: 1378355 - RNA, 22 nt, Neisseria meningitidis Z2491
cucguacacguccauacccaau

SEQ ID NO: 1378356 - RNA, 14 nt, Neisseria meningitidis Z2491
cucuaaagcuucag

SEQ ID NO: 1378357 - RNA, 18 nt, Neisseria meningitidis Z2491
cucggcguuuuucagacg

SEQ ID NO: 1378358 - RNA, 15 nt, Neisseria meningitidis Z2491
cucggaaaugacuga

SEQ ID NO: 1378359 - RNA, 14 nt, Neisseria meningitidis Z2491
cucggauuaauccg

SEQ ID NO: 1378360 - RNA, 23 nt, Neisseria meningitidis Z2491
cucccgacagccgaaacccaaac

SEQ ID NO: 1378361 - RNA, 16 nt, Neisseria meningitidis Z2491
cucccgauaaaugccg

SEQ ID NO: 1378362 - RNA, 20 nt, Neisseria meningitidis Z2491
cuccgcaaacaaaaugccgu

SEQ ID NO: 1378363 - RNA, 16 nt, Neisseria meningitidis Z2491
cuccgcaaacaccagc

SEQ ID NO: 1378364 - RNA, 20 nt, Neisseria meningitidis Z2491
cucccaaucccgauaauaau

SEQ ID NO: 1378365 - RNA, 13 nt, Neisseria meningitidis Z2491
cuccugacggcaa

SEQ ID NO: 1378366 - RNA, 16 nt, Neisseria meningitidis Z2491
cuccagcaccacaccu

SEQ ID NO: 1378367 - RNA, 23 nt, Neisseria meningitidis Z2491
cuccacggacacccgauaaucag

SEQ ID NO: 1378368 - RNA, 16 nt, Neisseria meningitidis Z2491
cuccacgggucuccga

SEQ ID NO: 1378369 - RNA, 20 nt, Neisseria meningitidis Z2491
cuccacggugugcaggcugc

SEQ ID NO: 1378370 - RNA, 14 nt, Neisseria meningitidis Z2491
cuccaucaggccgc

SEQ ID NO: 1378371 - RNA, 15 nt, Neisseria meningitidis Z2491
cgugggaaugacgga

SEQ ID NO: 1378372 - RNA, 16 nt, Neisseria meningitidis Z2491
cgugcggacguucaaa

SEQ ID NO: 1378373 - RNA, 23 nt, Neisseria meningitidis Z2491
cguguuccgcaucgucgggaaaa

SEQ ID NO: 1378374 - RNA, 22 nt, Neisseria meningitidis Z2491
cguuaacagacuauuuuugcaa

SEQ ID NO: 1378375 - RNA, 23 nt, Neisseria meningitidis Z2491
cguguccugaccuuugcagaaag

SEQ ID NO: 1378376 - RNA, 20 nt, Neisseria meningitidis Z2491
cgugugaaaauuuaaaaggu

SEQ ID NO: 1378377 - RNA, 23 nt, Neisseria meningitidis Z2491
cguucagacggcauuguuuaucu

SEQ ID NO: 1378378 - RNA, 12 nt, Neisseria meningitidis Z2491
cguucagauucc

SEQ ID NO: 1378379 - RNA, 23 nt, Neisseria meningitidis Z2491
cguucaauugcuuauuuguucaa

SEQ ID NO: 1378380 - RNA, 19 nt, Neisseria meningitidis Z2491
cguucaacauccgcagacg

SEQ ID NO: 1378381 - RNA, 14 nt, Neisseria meningitidis Z2491
cguucaaaucacgc

SEQ ID NO: 1378382 - RNA, 16 nt, Neisseria meningitidis Z2491
cguucaaaucacgccc

SEQ ID NO: 1378383 - RNA, 13 nt, Neisseria meningitidis Z2491
cguucaaaugccg

SEQ ID NO: 1378384 - RNA, 14 nt, Neisseria meningitidis Z2491
cguuggcucgccuu

SEQ ID NO: 1378385 - RNA, 22 nt, Neisseria meningitidis Z2491
cguuuccaaagugauuuccgcu

SEQ ID NO: 1378386 - RNA, 17 nt, Neisseria meningitidis Z2491
cguucggcaaaauccgc

SEQ ID NO: 1378387 - RNA, 15 nt, Neisseria meningitidis Z2491
cguucggaacacaaa

SEQ ID NO: 1378388 - RNA, 16 nt, Neisseria meningitidis Z2491
cguucuggauucccac

SEQ ID NO: 1378389 - RNA, 12 nt, Neisseria meningitidis Z2491
cguucuucuucg

SEQ ID NO: 1378390 - RNA, 13 nt, Neisseria meningitidis Z2491
cguugaaauccug

SEQ ID NO: 1378391 - RNA, 13 nt, Neisseria meningitidis Z2491
cguuuguucaacu

SEQ ID NO: 1378392 - RNA, 21 nt, Neisseria meningitidis Z2491
cguuuuuguuuuauauucuga

SEQ ID NO: 1378393 - RNA, 22 nt, Neisseria meningitidis Z2491
cguuuuuguuuuauauucugau

SEQ ID NO: 1378394 - RNA, 16 nt, Neisseria meningitidis Z2491
cguuuuuuuccugcca

SEQ ID NO: 1378395 - RNA, 15 nt, Neisseria meningitidis Z2491
cuaaaacuuaaaauu

SEQ ID NO: 1378396 - RNA, 16 nt, Neisseria meningitidis Z2491
cuaaaacuuaaaauuc

SEQ ID NO: 1378397 - RNA, 17 nt, Neisseria meningitidis Z2491
cuaaaacuuaaaauucc

SEQ ID NO: 1378398 - RNA, 18 nt, Neisseria meningitidis Z2491
cuaaaacuuaaaauuuca

SEQ ID NO: 1378399 - RNA, 23 nt, Neisseria meningitidis Z2491
cuaaacuuucagauaaucuuuga

SEQ ID NO: 1378400 - RNA, 16 nt, Neisseria meningitidis Z2491
cuaaauugcauuuuua

SEQ ID NO: 1378401 - RNA, 17 nt, Neisseria meningitidis Z2491
cuaaauugcauuuuuaa

SEQ ID NO: 1378402 - RNA, 20 nt, Neisseria meningitidis Z2491
cuaagcgucccgacgcuugu

SEQ ID NO: 1378403 - RNA, 16 nt, Neisseria meningitidis Z2491
cuaaccgaaaaaauaa

SEQ ID NO: 1378404 - RNA, 15 nt, Neisseria meningitidis Z2491
cuaaccgaaaauaau

SEQ ID NO: 1378405 - RNA, 16 nt, Neisseria meningitidis Z2491
cuaaccgaaaauaauu

SEQ ID NO: 1378406 - RNA, 21 nt, Neisseria meningitidis Z2491
cuaaccgaaaauaauugccuu

SEQ ID NO: 1378407 - RNA, 20 nt, Neisseria meningitidis Z2491
cgucugaaacccggaaaaaa

SEQ ID NO: 1378408 - RNA, 14 nt, Neisseria meningitidis Z2491
cgucugaaaccugu

SEQ ID NO: 1378409 - RNA, 17 nt, Neisseria meningitidis Z2491
cgucugaaaccuguuuc

SEQ ID NO: 1378410 - RNA, 17 nt, Neisseria meningitidis Z2491
cgucugaaacggcggca

SEQ ID NO: 1378411 - RNA, 19 nt, Neisseria meningitidis Z2491
cgucugaaacguuucagac

SEQ ID NO: 1378412 - RNA, 16 nt, Neisseria meningitidis Z2491
cgucugaaaggcuuca

SEQ ID NO: 1378413 - RNA, 19 nt, Neisseria meningitidis Z2491
cgucugaaauccuauuuuc

SEQ ID NO: 1378414 - RNA, 17 nt, Neisseria meningitidis Z2491
cgucugaaauguucaga

SEQ ID NO: 1378415 - RNA, 14 nt, Neisseria meningitidis Z2491
cgucugaacacggg

SEQ ID NO: 1378416 - RNA, 19 nt, Neisseria meningitidis Z2491
cgucugaacucaggcuuca

SEQ ID NO: 1378417 - RNA, 20 nt, Neisseria meningitidis Z2491
cgucugaaaagauauuguuc

SEQ ID NO: 1378418 - RNA, 14 nt, Neisseria meningitidis Z2491
cgucugaaaagucu

SEQ ID NO: 1378419 - RNA, 21 nt, Neisseria meningitidis Z2491
cgucugaaaagucuuucagac

SEQ ID NO: 1378420 - RNA, 22 nt, Neisseria meningitidis Z2491
cgucugaaacaaaauguucaga

SEQ ID NO: 1378421 - RNA, 14 nt, Neisseria meningitidis Z2491
cgucugcggcggga

SEQ ID NO: 1378422 - RNA, 19 nt, Neisseria meningitidis Z2491
cgucuucaaaaucauccca

SEQ ID NO: 1378423 - RNA, 12 nt, Neisseria meningitidis Z2491
cgucuauuuucg

SEQ ID NO: 1378424 - RNA, 13 nt, Neisseria meningitidis Z2491
cgugaauuaaaug

SEQ ID NO: 1378425 - RNA, 13 nt, Neisseria meningitidis Z2491
cgugcaauacacu

SEQ ID NO: 1378426 - RNA, 22 nt, Neisseria meningitidis Z2491
cgugcaaaaauucgucggucag

SEQ ID NO: 1378427 - RNA, 13 nt, Neisseria meningitidis Z2491
cgugcaucaucac

SEQ ID NO: 1378428 - RNA, 15 nt, Neisseria meningitidis Z2491
cgugcauucagcagg

SEQ ID NO: 1378429 - RNA, 13 nt, Neisseria meningitidis Z2491
cgugccggcggcg

SEQ ID NO: 1378430 - RNA, 21 nt, Neisseria meningitidis Z2491
cgucgaccugcuguuugagcc

SEQ ID NO: 1378431 - RNA, 16 nt, Neisseria meningitidis Z2491
cgucgccuuguccuga

SEQ ID NO: 1378432 - RNA, 14 nt, Neisseria meningitidis Z2491
cgucggcaagguuu

SEQ ID NO: 1378433 - RNA, 23 nt, Neisseria meningitidis Z2491
cguccgacaauuucuccgccagc

SEQ ID NO: 1378434 - RNA, 17 nt, Neisseria meningitidis Z2491
cguacuccuguuuuuaa

SEQ ID NO: 1378435 - RNA, 23 nt, Neisseria meningitidis Z2491
cguacugguuuaaauuuaaucca

SEQ ID NO: 1378436 - RNA, 19 nt, Neisseria meningitidis Z2491
cguccacuuucgccauaau

SEQ ID NO: 1378437 - RNA, 14 nt, Neisseria meningitidis Z2491
cgcgggaaugacga

SEQ ID NO: 1378438 - RNA, 19 nt, Neisseria meningitidis Z2491
cgcgcugcgccuaugcaau

SEQ ID NO: 1378439 - RNA, 22 nt, Neisseria meningitidis Z2491
cgcgcuugggcggcaggcuugc

SEQ ID NO: 1378440 - RNA, 23 nt, Neisseria meningitidis Z2491
cgcggacacgguucugcaccgcu

SEQ ID NO: 1378441 - RNA, 12 nt, Neisseria meningitidis Z2491
cgcgcucugcca

SEQ ID NO: 1378442 - RNA, 15 nt, Neisseria meningitidis Z2491
cgcgcgggaauagcu

SEQ ID NO: 1378443 - RNA, 18 nt, Neisseria meningitidis Z2491
cgcgcgccaaggcuuuca

SEQ ID NO: 1378444 - RNA, 18 nt, Neisseria meningitidis Z2491
cgccagcaacauuuccug

SEQ ID NO: 1378445 - RNA, 18 nt, Neisseria meningitidis Z2491
cgccagcaaucagggccu

SEQ ID NO: 1378446 - RNA, 13 nt, Neisseria meningitidis Z2491
cgcugcauuuguu

SEQ ID NO: 1378447 - RNA, 16 nt, Neisseria meningitidis Z2491
cgcuauaauuuauuga

SEQ ID NO: 1378448 - RNA, 19 nt, Neisseria meningitidis Z2491
cgcgggcugcgucgcgggc

SEQ ID NO: 1378449 - RNA, 14 nt, Neisseria meningitidis Z2491
cgcguagccggcca

SEQ ID NO: 1378450 - RNA, 17 nt, Neisseria meningitidis Z2491
cgcguagccggccaaca

SEQ ID NO: 1378451 - RNA, 19 nt, Neisseria meningitidis Z2491
cgcgucuuccgucugcggc

SEQ ID NO: 1378452 - RNA, 14 nt, Neisseria meningitidis Z2491
cgcgucaaacagac

SEQ ID NO: 1378453 - RNA, 20 nt, Neisseria meningitidis Z2491
cggcauuuuuacaaggcagc

SEQ ID NO: 1378454 - RNA, 21 nt, Neisseria meningitidis Z2491
cggcauuuuugaggauuauuc

SEQ ID NO: 1378455 - RNA, 14 nt, Neisseria meningitidis Z2491
cggcauuuccuuua

SEQ ID NO: 1378456 - RNA, 20 nt, Neisseria meningitidis Z2491
cggcauuuguccauucggcu

SEQ ID NO: 1378457 - RNA, 13 nt, Neisseria meningitidis Z2491
cggcauuuuccuu

SEQ ID NO: 1378458 - RNA, 14 nt, Neisseria meningitidis Z2491
cggcauuuuccuug

SEQ ID NO: 1378459 - RNA, 22 nt, Neisseria meningitidis Z2491
cggcauuuugcugccggcagga

SEQ ID NO: 1378460 - RNA, 16 nt, Neisseria meningitidis Z2491
cggcauuaaaauuugg

SEQ ID NO: 1378461 - RNA, 13 nt, Neisseria meningitidis Z2491
cggauaggcaaaa

SEQ ID NO: 1378462 - RNA, 22 nt, Neisseria meningitidis Z2491
cggauacggugucuucaauucc

SEQ ID NO: 1378463 - RNA, 23 nt, Neisseria meningitidis Z2491
cggcaaccgggguucgaaucccc

SEQ ID NO: 1378464 - RNA, 18 nt, Neisseria meningitidis Z2491
cggcaaccgguccuucca

SEQ ID NO: 1378465 - RNA, 14 nt, Neisseria meningitidis Z2491
cggcaauccggucu

SEQ ID NO: 1378466 - RNA, 19 nt, Neisseria meningitidis Z2491
cggcaaugaggcaauagaa

SEQ ID NO: 1378467 - RNA, 21 nt, Neisseria meningitidis Z2491
cggcaauaauggcaaccaaaa

SEQ ID NO: 1378468 - RNA, 21 nt, Neisseria meningitidis Z2491
cggcaagguugcgucugccuu

SEQ ID NO: 1378469 - RNA, 20 nt, Neisseria meningitidis Z2491
cggcaaggcgaggcaacgac

SEQ ID NO: 1378470 - RNA, 18 nt, Neisseria meningitidis Z2491
cggcaagaucggaaauga

SEQ ID NO: 1378471 - RNA, 22 nt, Neisseria meningitidis Z2491
cggcacggcguuccaaauauuu

SEQ ID NO: 1378472 - RNA, 16 nt, Neisseria meningitidis Z2491
cggcacgcgguuuugc

SEQ ID NO: 1378473 - RNA, 13 nt, Neisseria meningitidis Z2491
cggcacaggcuca

SEQ ID NO: 1378474 - RNA, 16 nt, Neisseria meningitidis Z2491
cggcaauuuccgccgg

SEQ ID NO: 1378475 - RNA, 22 nt, Neisseria meningitidis Z2491
cggcacaaccgcccuauauuug

SEQ ID NO: 1378476 - RNA, 19 nt, Neisseria meningitidis Z2491
cggcagauacaacaaacag

SEQ ID NO: 1378477 - RNA, 20 nt, Neisseria meningitidis Z2491
cgcuucggucggauguuugu

SEQ ID NO: 1378478 - RNA, 19 nt, Neisseria meningitidis Z2491
cgcuucggaaggcgcguca

SEQ ID NO: 1378479 - RNA, 18 nt, Neisseria meningitidis Z2491
cgcuucagacggcauuuu

SEQ ID NO: 1378480 - RNA, 21 nt, Neisseria meningitidis Z2491
cgcuucagacggcauuuuuuc

SEQ ID NO: 1378481 - RNA, 16 nt, Neisseria meningitidis Z2491
cgcugccgccgcccgg

SEQ ID NO: 1378482 - RNA, 12 nt, Neisseria meningitidis Z2491
cgcugccgucga

SEQ ID NO: 1378483 - RNA, 13 nt, Neisseria meningitidis Z2491
cgcuucaaggcgg

SEQ ID NO: 1378484 - RNA, 17 nt, Neisseria meningitidis Z2491
cgcuuucgcauccccga

SEQ ID NO: 1378485 - RNA, 16 nt, Neisseria meningitidis Z2491
cgcuuucgcgggaaug

SEQ ID NO: 1378486 - RNA, 14 nt, Neisseria meningitidis Z2491
cgcuuucggggaag

SEQ ID NO: 1378487 - RNA, 14 nt, Neisseria meningitidis Z2491
cggaacacaaaaaa

SEQ ID NO: 1378488 - RNA, 21 nt, Neisseria meningitidis Z2491
cggaagaggcgguguuuuuua

SEQ ID NO: 1378489 - RNA, 15 nt, Neisseria meningitidis Z2491
cggaaucgauucacu

SEQ ID NO: 1378490 - RNA, 15 nt, Neisseria meningitidis Z2491
cggaauacggcaaca

SEQ ID NO: 1378491 - RNA, 14 nt, Neisseria meningitidis Z2491
cggaaggguuuugu

SEQ ID NO: 1378492 - RNA, 20 nt, Neisseria meningitidis Z2491
cggacggauguucaaacacg

SEQ ID NO: 1378493 - RNA, 14 nt, Neisseria meningitidis Z2491
cggacaccgcaauc

SEQ ID NO: 1378494 - RNA, 22 nt, Neisseria meningitidis Z2491
cggacgcaucgaguguggggua

SEQ ID NO: 1378495 - RNA, 14 nt, Neisseria meningitidis Z2491
cggacggcauuuug

SEQ ID NO: 1378496 - RNA, 19 nt, Neisseria meningitidis Z2491
cguaccaaccguccacaca

SEQ ID NO: 1378497 - RNA, 22 nt, Neisseria meningitidis Z2491
cguaccaaccguccacacauca

SEQ ID NO: 1378498 - RNA, 13 nt, Neisseria meningitidis Z2491
cguaccaaaaccg

SEQ ID NO: 1378499 - RNA, 15 nt, Neisseria meningitidis Z2491
cguacuauuuacacu

SEQ ID NO: 1378500 - RNA, 14 nt, Neisseria meningitidis Z2491
cguaccgcgcgcca

SEQ ID NO: 1378501 - RNA, 18 nt, Neisseria meningitidis Z2491
cguacgcaggcuggggau

SEQ ID NO: 1378502 - RNA, 13 nt, Neisseria meningitidis Z2491
cguacaaaugccg

SEQ ID NO: 1378503 - RNA, 19 nt, Neisseria meningitidis Z2491
cguaauuccggcagccugc

SEQ ID NO: 1378504 - RNA, 17 nt, Neisseria meningitidis Z2491
cgguugaucauuucagg

SEQ ID NO: 1378505 - RNA, 16 nt, Neisseria meningitidis Z2491
cgguuuuuguucaucc

SEQ ID NO: 1378506 - RNA, 12 nt, Neisseria meningitidis Z2491
cgguugaaacuc

SEQ ID NO: 1378507 - RNA, 16 nt, Neisseria meningitidis Z2491
cguaacaaugcggaaa

SEQ ID NO: 1378508 - RNA, 19 nt, Neisseria meningitidis Z2491
cguaaauuguccauuuuuc

SEQ ID NO: 1378509 - RNA, 15 nt, Neisseria meningitidis Z2491
cgguguaucuuuuug

SEQ ID NO: 1378510 - RNA, 15 nt, Neisseria meningitidis Z2491
cggucuguccgaccu

SEQ ID NO: 1378511 - RNA, 20 nt, Neisseria meningitidis Z2491
cggggauuuggcugaccagu

SEQ ID NO: 1378512 - RNA, 14 nt, Neisseria meningitidis Z2491
cggggaacugccau

SEQ ID NO: 1378513 - RNA, 21 nt, Neisseria meningitidis Z2491
cgggcauuguuaaguauuucu

SEQ ID NO: 1378514 - RNA, 23 nt, Neisseria meningitidis Z2491
cgggguuuaucagaaaugacuga

SEQ ID NO: 1378515 - RNA, 17 nt, Neisseria meningitidis Z2491
cgggguugcgcggcagg

SEQ ID NO: 1378516 - RNA, 16 nt, Neisseria meningitidis Z2491
cgggguucgaaucccc

SEQ ID NO: 1378517 - RNA, 18 nt, Neisseria meningitidis Z2491
cgggugauggagcugugu

SEQ ID NO: 1378518 - RNA, 16 nt, Neisseria meningitidis Z2491
cgguaauuuccgacca

SEQ ID NO: 1378519 - RNA, 16 nt, Neisseria meningitidis Z2491
cgguagggcaguucca

SEQ ID NO: 1378520 - RNA, 20 nt, Neisseria meningitidis Z2491
cggucaaaaucggcauucuc

SEQ ID NO: 1378521 - RNA, 17 nt, Neisseria meningitidis Z2491
cgguauuuuuuucuuaa

SEQ ID NO: 1378522 - RNA, 20 nt, Neisseria meningitidis Z2491
cgguaaccacgacgcagacc

SEQ ID NO: 1378523 - RNA, 12 nt, Neisseria meningitidis Z2491
cgguaaauuccu

SEQ ID NO: 1378524 - RNA, 16 nt, Neisseria meningitidis Z2491
cgguaaauuccuaaaa

SEQ ID NO: 1378525 - RNA, 18 nt, Neisseria meningitidis Z2491
cggguuuucgauuuccga

SEQ ID NO: 1378526 - RNA, 16 nt, Neisseria meningitidis Z2491
cggguucguaaaaggc

SEQ ID NO: 1378527 - RNA, 20 nt, Neisseria meningitidis Z2491
cgggaccgacgggcaggccc

SEQ ID NO: 1378528 - RNA, 19 nt, Neisseria meningitidis Z2491
cgggacuuugcggcugugc

SEQ ID NO: 1378529 - RNA, 20 nt, Neisseria meningitidis Z2491
cgggacuuugcggcugugca

SEQ ID NO: 1378530 - RNA, 16 nt, Neisseria meningitidis Z2491
cggcuugccgccgcca

SEQ ID NO: 1378531 - RNA, 21 nt, Neisseria meningitidis Z2491
cggcggcaaucguuucugucg

SEQ ID NO: 1378532 - RNA, 18 nt, Neisseria meningitidis Z2491
cggcggcaaauuccguca

SEQ ID NO: 1378533 - RNA, 23 nt, Neisseria meningitidis Z2491
cggcggcaacagaaauaaaagca

SEQ ID NO: 1378534 - RNA, 23 nt, Neisseria meningitidis Z2491
cggcgggggggauuucuguuuuu

SEQ ID NO: 1378535 - RNA, 18 nt, Neisseria meningitidis Z2491
cggcggcagcguggaggg

SEQ ID NO: 1378536 - RNA, 21 nt, Neisseria meningitidis Z2491
cggcugaaaaaaugccgucug

SEQ ID NO: 1378537 - RNA, 16 nt, Neisseria meningitidis Z2491
cggcugaccgcgccgu

SEQ ID NO: 1378538 - RNA, 16 nt, Neisseria meningitidis Z2491
cggcgagcaggggaau

SEQ ID NO: 1378539 - RNA, 13 nt, Neisseria meningitidis Z2491
cggcgagccgcag

SEQ ID NO: 1378540 - RNA, 12 nt, Neisseria meningitidis Z2491
cggcgcgggcgu

SEQ ID NO: 1378541 - RNA, 18 nt, Neisseria meningitidis Z2491
cggcgcaguuaccgccca

SEQ ID NO: 1378542 - RNA, 12 nt, Neisseria meningitidis Z2491
cccugccgcuuc

SEQ ID NO: 1378543 - RNA, 14 nt, Neisseria meningitidis Z2491
cccugauaaaaaau

SEQ ID NO: 1378544 - RNA, 12 nt, Neisseria meningitidis Z2491
cccugaaaggga

SEQ ID NO: 1378545 - RNA, 21 nt, Neisseria meningitidis Z2491
cccucuucgaugacugccuua

SEQ ID NO: 1378546 - RNA, 19 nt, Neisseria meningitidis Z2491
ccgaaaauaauugccuuuu

SEQ ID NO: 1378547 - RNA, 15 nt, Neisseria meningitidis Z2491
ccgaaaacaaagggu

SEQ ID NO: 1378548 - RNA, 23 nt, Neisseria meningitidis Z2491
ccgaaaacaaaggguuugccgcg

SEQ ID NO: 1378549 - RNA, 12 nt, Neisseria meningitidis Z2491
ccgaaacaacaa

SEQ ID NO: 1378550 - RNA, 17 nt, Neisseria meningitidis Z2491
ccgaaacaacaaaaccu

SEQ ID NO: 1378551 - RNA, 12 nt, Neisseria meningitidis Z2491
ccgaaacagaaa

SEQ ID NO: 1378552 - RNA, 13 nt, Neisseria meningitidis Z2491
ccgaaacagaaac

SEQ ID NO: 1378553 - RNA, 16 nt, Neisseria meningitidis Z2491
ccgaaacauuccgcca

SEQ ID NO: 1378554 - RNA, 14 nt, Neisseria meningitidis Z2491
ccgaaaccaaaagc

SEQ ID NO: 1378555 - RNA, 20 nt, Neisseria meningitidis Z2491
ccgaaaccaaaagccaaaaa

SEQ ID NO: 1378556 - RNA, 19 nt, Neisseria meningitidis Z2491
ccgaaaaucuugccauucu

SEQ ID NO: 1378557 - RNA, 13 nt, Neisseria meningitidis Z2491
ccgaauaaccgcu

SEQ ID NO: 1378558 - RNA, 20 nt, Neisseria meningitidis Z2491
ccgaauauuuccucacugcc

SEQ ID NO: 1378559 - RNA, 19 nt, Neisseria meningitidis Z2491
cccuguuucgggcaaaagc

SEQ ID NO: 1378560 - RNA, 15 nt, Neisseria meningitidis Z2491
cccuuaauccucucc

SEQ ID NO: 1378561 - RNA, 14 nt, Neisseria meningitidis Z2491
cccuguaaacagau

SEQ ID NO: 1378562 - RNA, 21 nt, Neisseria meningitidis Z2491
ccgauucacuuggugcuucag

SEQ ID NO: 1378563 - RNA, 23 nt, Neisseria meningitidis Z2491
ccgauuaacguauucaagcagca

SEQ ID NO: 1378564 - RNA, 22 nt, Neisseria meningitidis Z2491
ccgcaaccugaaaggcacaacg

SEQ ID NO: 1378565 - RNA, 14 nt, Neisseria meningitidis Z2491
ccgcaaacggcagc

SEQ ID NO: 1378566 - RNA, 16 nt, Neisseria meningitidis Z2491
ccgcaaacggcagcag

SEQ ID NO: 1378567 - RNA, 16 nt, Neisseria meningitidis Z2491
ccgcaaaaacaaaaaa

SEQ ID NO: 1378568 - RNA, 11 nt, Neisseria meningitidis Z2491
ccgcaaaagcg

SEQ ID NO: 1378569 - RNA, 16 nt, Neisseria meningitidis Z2491
ccgcaaaagcgggagu

SEQ ID NO: 1378570 - RNA, 21 nt, Neisseria meningitidis Z2491
ccgcacggucaacgccgugcg

SEQ ID NO: 1378571 - RNA, 15 nt, Neisseria meningitidis Z2491
ccgcacccccgacca

SEQ ID NO: 1378572 - RNA, 13 nt, Neisseria meningitidis Z2491
ccgcagccgccau

SEQ ID NO: 1378573 - RNA, 20 nt, Neisseria meningitidis Z2491
ccgacuucuuuuaagaacgu

SEQ ID NO: 1378574 - RNA, 15 nt, Neisseria meningitidis Z2491
ccgagaaaacagaaa

SEQ ID NO: 1378575 - RNA, 18 nt, Neisseria meningitidis Z2491
ccgagauuacagaaaccu

SEQ ID NO: 1378576 - RNA, 21 nt, Neisseria meningitidis Z2491
ccgauaaauuccugccgcucu

SEQ ID NO: 1378577 - RNA, 18 nt, Neisseria meningitidis Z2491
ccgaggcgcgugaauuug

SEQ ID NO: 1378578 - RNA, 20 nt, Neisseria meningitidis Z2491
ccggagagcucggucagaua

SEQ ID NO: 1378579 - RNA, 13 nt, Neisseria meningitidis Z2491
ccggaaagcuggu

SEQ ID NO: 1378580 - RNA, 21 nt, Neisseria meningitidis Z2491
ccggcaauauugcuccugacg

SEQ ID NO: 1378581 - RNA, 13 nt, Neisseria meningitidis Z2491
ccggcaagccuuu

SEQ ID NO: 1378582 - RNA, 14 nt, Neisseria meningitidis Z2491
ccggccaacaucag

SEQ ID NO: 1378583 - RNA, 15 nt, Neisseria meningitidis Z2491
ccggcaugauuuucu

SEQ ID NO: 1378584 - RNA, 15 nt, Neisseria meningitidis Z2491
ccgcguucuuggcuu

SEQ ID NO: 1378585 - RNA, 22 nt, Neisseria meningitidis Z2491
ccgcugccgaaaccaaaagcca

SEQ ID NO: 1378586 - RNA, 17 nt, Neisseria meningitidis Z2491
ccgccguaaccagcccc

SEQ ID NO: 1378587 - RNA, 23 nt, Neisseria meningitidis Z2491
ccgccguaaccgcacccccgacc

SEQ ID NO: 1378588 - RNA, 16 nt, Neisseria meningitidis Z2491
ccgccuaucacuucca

SEQ ID NO: 1378589 - RNA, 22 nt, Neisseria meningitidis Z2491
ccgccuaucacuuccagcgcac

SEQ ID NO: 1378590 - RNA, 21 nt, Neisseria meningitidis Z2491
ccgccugaacauuucagacgg

SEQ ID NO: 1378591 - RNA, 23 nt, Neisseria meningitidis Z2491
ccgccugaacauuucagacggca

SEQ ID NO: 1378592 - RNA, 20 nt, Neisseria meningitidis Z2491
ccgccuccgaagccucgccc

SEQ ID NO: 1378593 - RNA, 16 nt, Neisseria meningitidis Z2491
ccgcgcacgccaucgg

SEQ ID NO: 1378594 - RNA, 14 nt, Neisseria meningitidis Z2491
ccgcccgggccggc

SEQ ID NO: 1378595 - RNA, 18 nt, Neisseria meningitidis Z2491
ccgccgacaucccccagc

SEQ ID NO: 1378596 - RNA, 20 nt, Neisseria meningitidis Z2491
ccgccgacaucgaaaugccg

SEQ ID NO: 1378597 - RNA, 13 nt, Neisseria meningitidis Z2491
ccgccgcgcccca

SEQ ID NO: 1378598 - RNA, 14 nt, Neisseria meningitidis Z2491
ccgccgcgcccgca

SEQ ID NO: 1378599 - RNA, 19 nt, Neisseria meningitidis Z2491
ccgccgccaugucgcgggc

SEQ ID NO: 1378600 - RNA, 19 nt, Neisseria meningitidis Z2491
ccgccggaagcgcaccgcc

SEQ ID NO: 1378601 - RNA, 21 nt, Neisseria meningitidis Z2491
ccgccggaagcgcaccgccgc

SEQ ID NO: 1378602 - RNA, 16 nt, Neisseria meningitidis Z2491
ccuguccaaagccucg

SEQ ID NO: 1378603 - RNA, 19 nt, Neisseria meningitidis Z2491
ccugaauaaaacgcgugca

SEQ ID NO: 1378604 - RNA, 16 nt, Neisseria meningitidis Z2491
ccugcccugccaaaac

SEQ ID NO: 1378605 - RNA, 18 nt, Neisseria meningitidis Z2491
ccugcccgacagccgcaa

SEQ ID NO: 1378606 - RNA, 23 nt, Neisseria meningitidis Z2491
ccugcagauugaggaucuugaug

SEQ ID NO: 1378607 - RNA, 16 nt, Neisseria meningitidis Z2491
ccugcgcgagaauaau

SEQ ID NO: 1378608 - RNA, 20 nt, Neisseria meningitidis Z2491
ccugcgcgggaaugacaaaa

SEQ ID NO: 1378609 - RNA, 19 nt, Neisseria meningitidis Z2491
ccugcgcgggaaugacgau

SEQ ID NO: 1378610 - RNA, 20 nt, Neisseria meningitidis Z2491
ccugccugccauuccccuau

SEQ ID NO: 1378611 - RNA, 17 nt, Neisseria meningitidis Z2491
ccugccuucauucuuga

SEQ ID NO: 1378612 - RNA, 19 nt, Neisseria meningitidis Z2491
ccugaacggcacaaacgcc

SEQ ID NO: 1378613 - RNA, 22 nt, Neisseria meningitidis Z2491
ccugaaacggacaaaccgccau

SEQ ID NO: 1378614 - RNA, 15 nt, Neisseria meningitidis Z2491
ccugaaaacagaaac

SEQ ID NO: 1378615 - RNA, 14 nt, Neisseria meningitidis Z2491
ccucuuuaaauuua

SEQ ID NO: 1378616 - RNA, 14 nt, Neisseria meningitidis Z2491
ccucuuucaucaua

SEQ ID NO: 1378617 - RNA, 24 nt, Neisseria meningitidis Z2491
ccucuuucaucauaugcaucagca

SEQ ID NO: 1378618 - RNA, 20 nt, Neisseria meningitidis Z2491
ccucgugccagcgcaccguu

SEQ ID NO: 1378619 - RNA, 17 nt, Neisseria meningitidis Z2491
ccucgcggcucgcccac

SEQ ID NO: 1378620 - RNA, 19 nt, Neisseria meningitidis Z2491
ccuacgcgggaaugacgag

SEQ ID NO: 1378621 - RNA, 18 nt, Neisseria meningitidis Z2491
ccuacgccaaccucagcc

SEQ ID NO: 1378622 - RNA, 22 nt, Neisseria meningitidis Z2491
ccuccaccauuucuuuggccaa

SEQ ID NO: 1378623 - RNA, 22 nt, Neisseria meningitidis Z2491
ccucauugccgcccguuuaaac

SEQ ID NO: 1378624 - RNA, 20 nt, Neisseria meningitidis Z2491
ccucccaauguuucaacgcc

SEQ ID NO: 1378625 - RNA, 11 nt, Neisseria meningitidis Z2491
ccguucaauuu

SEQ ID NO: 1378626 - RNA, 19 nt, Neisseria meningitidis Z2491
ccguucaaaguauguacca

SEQ ID NO: 1378627 - RNA, 16 nt, Neisseria meningitidis Z2491
ccguguguauagugga

SEQ ID NO: 1378628 - RNA, 17 nt, Neisseria meningitidis Z2491
ccguuauucugccgugg

SEQ ID NO: 1378629 - RNA, 22 nt, Neisseria meningitidis Z2491
ccguuauuuucacaaaaacaga

SEQ ID NO: 1378630 - RNA, 18 nt, Neisseria meningitidis Z2491
ccgugcggcacgccgccg

SEQ ID NO: 1378631 - RNA, 15 nt, Neisseria meningitidis Z2491
ccgucuugggaaaug

SEQ ID NO: 1378632 - RNA, 22 nt, Neisseria meningitidis Z2491
ccgucuugggaaaugccgucug

SEQ ID NO: 1378633 - RNA, 14 nt, Neisseria meningitidis Z2491
ccgugcgccguccg

SEQ ID NO: 1378634 - RNA, 15 nt, Neisseria meningitidis Z2491
ccuaaccgaaaaaau

SEQ ID NO: 1378635 - RNA, 13 nt, Neisseria meningitidis Z2491
ccguugcgugucu

SEQ ID NO: 1378636 - RNA, 13 nt, Neisseria meningitidis Z2491
ccguuuucaagcc

SEQ ID NO: 1378637 - RNA, 22 nt, Neisseria meningitidis Z2491
ccgguuuguauuugaugcguuu

SEQ ID NO: 1378638 - RNA, 19 nt, Neisseria meningitidis Z2491
ccgucgguuuucaacaccc

SEQ ID NO: 1378639 - RNA, 18 nt, Neisseria meningitidis Z2491
ccgucuaaacgguauuca

SEQ ID NO: 1378640 - RNA, 15 nt, Neisseria meningitidis Z2491
ccgucugaaaagaua

SEQ ID NO: 1378641 - RNA, 15 nt, Neisseria meningitidis Z2491
ccgucugaaaccucg

SEQ ID NO: 1378642 - RNA, 19 nt, Neisseria meningitidis Z2491
ccgucugaaaccugcaacg

SEQ ID NO: 1378643 - RNA, 18 nt, Neisseria meningitidis Z2491
ccgucugaaacgggaauc

SEQ ID NO: 1378644 - RNA, 16 nt, Neisseria meningitidis Z2491
ccgucugaaagggcuu

SEQ ID NO: 1378645 - RNA, 12 nt, Neisseria meningitidis Z2491
ccgucugaaauc

SEQ ID NO: 1378646 - RNA, 23 nt, Neisseria meningitidis Z2491
ccgucugaaauguucagacggca

SEQ ID NO: 1378647 - RNA, 22 nt, Neisseria meningitidis Z2491
ccgucugaacccgauuggauuc

SEQ ID NO: 1378648 - RNA, 17 nt, Neisseria meningitidis Z2491
ccgucugaacccgccug

SEQ ID NO: 1378649 - RNA, 21 nt, Neisseria meningitidis Z2491
ccgucugaagauauuggaaca

SEQ ID NO: 1378650 - RNA, 19 nt, Neisseria meningitidis Z2491
ccgucugaagcccugccug

SEQ ID NO: 1378651 - RNA, 14 nt, Neisseria meningitidis Z2491
ccgucugaagccug

SEQ ID NO: 1378652 - RNA, 15 nt, Neisseria meningitidis Z2491
ccgucugaagccugu

SEQ ID NO: 1378653 - RNA, 19 nt, Neisseria meningitidis Z2491
ccgucugaaggcuucagac

SEQ ID NO: 1378654 - RNA, 19 nt, Neisseria meningitidis Z2491
ccgucugaaguuucugccc

SEQ ID NO: 1378655 - RNA, 23 nt, Neisseria meningitidis Z2491
ccgucggcacgaaccgcauugcc

SEQ ID NO: 1378656 - RNA, 19 nt, Neisseria meningitidis Z2491
ccgucggcagugauuuccc

SEQ ID NO: 1378657 - RNA, 21 nt, Neisseria meningitidis Z2491
ccgucaggcacgaagcccuca

SEQ ID NO: 1378658 - RNA, 19 nt, Neisseria meningitidis Z2491
ccggucagaaucgccuccg

SEQ ID NO: 1378659 - RNA, 16 nt, Neisseria meningitidis Z2491
ccgguccguucaguuu

SEQ ID NO: 1378660 - RNA, 14 nt, Neisseria meningitidis Z2491
ccgguaaauaccca

SEQ ID NO: 1378661 - RNA, 12 nt, Neisseria meningitidis Z2491
ccggcuuuccau

SEQ ID NO: 1378662 - RNA, 15 nt, Neisseria meningitidis Z2491
ccggcuuuccaugcu

SEQ ID NO: 1378663 - RNA, 17 nt, Neisseria meningitidis Z2491
ccgggcugcuuuuuagg

SEQ ID NO: 1378664 - RNA, 18 nt, Neisseria meningitidis Z2491
ccggcugaacauuccguu

SEQ ID NO: 1378665 - RNA, 19 nt, Neisseria meningitidis Z2491
ccggcuguguuuaucuuuu

SEQ ID NO: 1378666 - RNA, 23 nt, Neisseria meningitidis Z2491
ccggcuccgguucguuuugcaac

SEQ ID NO: 1378667 - RNA, 19 nt, Neisseria meningitidis Z2491
cgaggaugucggacauuuu

SEQ ID NO: 1378668 - RNA, 14 nt, Neisseria meningitidis Z2491
cgaggcaacgccgu

SEQ ID NO: 1378669 - RNA, 15 nt, Neisseria meningitidis Z2491
cgaggcgcaggguca

SEQ ID NO: 1378670 - RNA, 19 nt, Neisseria meningitidis Z2491
cgaggaacaaaaugccgcc

SEQ ID NO: 1378671 - RNA, 22 nt, Neisseria meningitidis Z2491
cgagccgcagacgguacaaaua

SEQ ID NO: 1378672 - RNA, 15 nt, Neisseria meningitidis Z2491
cgauaaggcaagcgu

SEQ ID NO: 1378673 - RNA, 14 nt, Neisseria meningitidis Z2491
cgaguuuuugguag

SEQ ID NO: 1378674 - RNA, 18 nt, Neisseria meningitidis Z2491
cgauaaugcgguguaucu

SEQ ID NO: 1378675 - RNA, 17 nt, Neisseria meningitidis Z2491
cgaguucuuuuaaagga

SEQ ID NO: 1378676 - RNA, 22 nt, Neisseria meningitidis Z2491
cgauauuacgaacaaugcaaaa

SEQ ID NO: 1378677 - RNA, 14 nt, Neisseria meningitidis Z2491
cgauagauuccugu

SEQ ID NO: 1378678 - RNA, 20 nt, Neisseria meningitidis Z2491
cgauaccaagucgucuaaga

SEQ ID NO: 1378679 - RNA, 21 nt, Neisseria meningitidis Z2491
cgaguggcuuccuuuuuaaag

SEQ ID NO: 1378680 - RNA, 20 nt, Neisseria meningitidis Z2491
cgagguuacaguuuaauccc

SEQ ID NO: 1378681 - RNA, 13 nt, Neisseria meningitidis Z2491
cgaggucgccggc

SEQ ID NO: 1378682 - RNA, 21 nt, Neisseria meningitidis Z2491
cgacucaaaaucaucuucaug

SEQ ID NO: 1378683 - RNA, 21 nt, Neisseria meningitidis Z2491
cgacuucugacagcauuucca

SEQ ID NO: 1378684 - RNA, 15 nt, Neisseria meningitidis Z2491
cgacuuuuuccagca

SEQ ID NO: 1378685 - RNA, 17 nt, Neisseria meningitidis Z2491
cgacuggcacugggaug

SEQ ID NO: 1378686 - RNA, 17 nt, Neisseria meningitidis Z2491
cgacgcggcugcugccu

SEQ ID NO: 1378687 - RNA, 20 nt, Neisseria meningitidis Z2491
cgacgguucgauaucgccuc

SEQ ID NO: 1378688 - RNA, 17 nt, Neisseria meningitidis Z2491
cgacgguggugcguuug

SEQ ID NO: 1378689 - RNA, 18 nt, Neisseria meningitidis Z2491
cgagaauuuaucagaaau

SEQ ID NO: 1378690 - RNA, 15 nt, Neisseria meningitidis Z2491
cgagaugacggcugc

SEQ ID NO: 1378691 - RNA, 20 nt, Neisseria meningitidis Z2491
cgagauuuuagauggcggga

SEQ ID NO: 1378692 - RNA, 19 nt, Neisseria meningitidis Z2491
cgagauaaguguuggacaa

SEQ ID NO: 1378693 - RNA, 15 nt, Neisseria meningitidis Z2491
cgagccaauagccgc

SEQ ID NO: 1378694 - RNA, 15 nt, Neisseria meningitidis Z2491
cgagcagguugcggu

SEQ ID NO: 1378695 - RNA, 21 nt, Neisseria meningitidis Z2491
cgagcaggugcuggguggugg

SEQ ID NO: 1378696 - RNA, 16 nt, Neisseria meningitidis Z2491
cgagccaugcgugccc

SEQ ID NO: 1378697 - RNA, 23 nt, Neisseria meningitidis Z2491
cgagcaauauuggcacgggcgca

SEQ ID NO: 1378698 - RNA, 21 nt, Neisseria meningitidis Z2491
cgcaucggcggcguauuugcu

SEQ ID NO: 1378699 - RNA, 21 nt, Neisseria meningitidis Z2491
cgcagcaaaauauggcugacu

SEQ ID NO: 1378700 - RNA, 13 nt, Neisseria meningitidis Z2491
cgcauuguuggaa

SEQ ID NO: 1378701 - RNA, 12 nt, Neisseria meningitidis Z2491
cgcauugucccu

SEQ ID NO: 1378702 - RNA, 20 nt, Neisseria meningitidis Z2491
cgcauucuuucaagaacagu

SEQ ID NO: 1378703 - RNA, 22 nt, Neisseria meningitidis Z2491
cgcauugccgcaaucgccgguc

SEQ ID NO: 1378704 - RNA, 14 nt, Neisseria meningitidis Z2491
cgcauuaaaauucu

SEQ ID NO: 1378705 - RNA, 12 nt, Neisseria meningitidis Z2491
cgcauucagacg

SEQ ID NO: 1378706 - RNA, 19 nt, Neisseria meningitidis Z2491
cgccaaacccaaccaagaa

SEQ ID NO: 1378707 - RNA, 17 nt, Neisseria meningitidis Z2491
cgccaaggcuuucagau

SEQ ID NO: 1378708 - RNA, 16 nt, Neisseria meningitidis Z2491
cgccacgccauuuguu

SEQ ID NO: 1378709 - RNA, 14 nt, Neisseria meningitidis Z2491
cgccacggcauaac

SEQ ID NO: 1378710 - RNA, 12 nt, Neisseria meningitidis Z2491
cgccacuuuccg

SEQ ID NO: 1378711 - RNA, 21 nt, Neisseria meningitidis Z2491
cgccagacaggcuuuuuucug

SEQ ID NO: 1378712 - RNA, 15 nt, Neisseria meningitidis Z2491
cgcaaggacgggcag

SEQ ID NO: 1378713 - RNA, 13 nt, Neisseria meningitidis Z2491
cgcaaccuugcca

SEQ ID NO: 1378714 - RNA, 14 nt, Neisseria meningitidis Z2491
cgcaaccuugccaa

SEQ ID NO: 1378715 - RNA, 18 nt, Neisseria meningitidis Z2491
cgcaaaaacgcagccagc

SEQ ID NO: 1378716 - RNA, 16 nt, Neisseria meningitidis Z2491
cgcacauuuuuuucau

SEQ ID NO: 1378717 - RNA, 13 nt, Neisseria meningitidis Z2491
cgcaauuccugca

SEQ ID NO: 1378718 - RNA, 17 nt, Neisseria meningitidis Z2491
cgcaaucuucaaacgau

SEQ ID NO: 1378719 - RNA, 18 nt, Neisseria meningitidis Z2491
cgcaaugcgccuucuuca

SEQ ID NO: 1378720 - RNA, 21 nt, Neisseria meningitidis Z2491
cgcagaccguccacaagccgc

SEQ ID NO: 1378721 - RNA, 14 nt, Neisseria meningitidis Z2491
cgcagacaguacaa

SEQ ID NO: 1378722 - RNA, 14 nt, Neisseria meningitidis Z2491
cgcacgcaugaagc

SEQ ID NO: 1378723 - RNA, 18 nt, Neisseria meningitidis Z2491
cgauuuuuuuucuaacca

SEQ ID NO: 1378724 - RNA, 18 nt, Neisseria meningitidis Z2491
cgauuucgcguaccaaaa

SEQ ID NO: 1378725 - RNA, 14 nt, Neisseria meningitidis Z2491
cgauuucgagauac

SEQ ID NO: 1378726 - RNA, 12 nt, Neisseria meningitidis Z2491
cgauuugaacca

SEQ ID NO: 1378727 - RNA, 18 nt, Neisseria meningitidis Z2491
cgauuugaaccauuucca

SEQ ID NO: 1378728 - RNA, 22 nt, Neisseria meningitidis Z2491
cgauugagggcacagucggcau

SEQ ID NO: 1378729 - RNA, 19 nt, Neisseria meningitidis Z2491
cgauuccguacuauuugag

SEQ ID NO: 1378730 - RNA, 12 nt, Neisseria meningitidis Z2491
cgauauuuuuga

SEQ ID NO: 1378731 - RNA, 16 nt, Neisseria meningitidis Z2491
cgaugccgucauuccc

SEQ ID NO: 1378732 - RNA, 22 nt, Neisseria meningitidis Z2491
cgaugccgucauucccgcgcag

SEQ ID NO: 1378733 - RNA, 12 nt, Neisseria meningitidis Z2491
cgauguccugac

SEQ ID NO: 1378734 - RNA, 21 nt, Neisseria meningitidis Z2491
cgaugggcuucaucaguuucc

SEQ ID NO: 1378735 - RNA, 23 nt, Neisseria meningitidis Z2491
cgaugucguugucaaccaaaaaa

SEQ ID NO: 1378736 - RNA, 14 nt, Neisseria meningitidis Z2491
cgauggaaccguuu

SEQ ID NO: 1378737 - RNA, 17 nt, Neisseria meningitidis Z2491
cgauggaccucaggccg

SEQ ID NO: 1378738 - RNA, 19 nt, Neisseria meningitidis Z2491
cgaaaugccgucugaaacc

SEQ ID NO: 1378739 - RNA, 22 nt, Neisseria meningitidis Z2491
cgaaauuuuagauugcaggcau

SEQ ID NO: 1378740 - RNA, 22 nt, Neisseria meningitidis Z2491
cgaaauuuuagguuucugauuu

SEQ ID NO: 1378741 - RNA, 17 nt, Neisseria meningitidis Z2491
cgaacaaugcaaaaaca

SEQ ID NO: 1378742 - RNA, 19 nt, Neisseria meningitidis Z2491
cgaacaaugcaaaaacauc

SEQ ID NO: 1378743 - RNA, 14 nt, Neisseria meningitidis Z2491
cgaacaccagugcg

SEQ ID NO: 1378744 - RNA, 12 nt, Neisseria meningitidis Z2491
cgaaagcgggaa

SEQ ID NO: 1378745 - RNA, 15 nt, Neisseria meningitidis Z2491
cgaaagcgggaaucc

SEQ ID NO: 1378746 - RNA, 16 nt, Neisseria meningitidis Z2491
cgaaagcgggaaucua

SEQ ID NO: 1378747 - RNA, 16 nt, Neisseria meningitidis Z2491
cgaaagcgggaaugcc

SEQ ID NO: 1378748 - RNA, 15 nt, Neisseria meningitidis Z2491
cgaaagugggaaucc

SEQ ID NO: 1378749 - RNA, 16 nt, Neisseria meningitidis Z2491
cgaaagugggaaucca

SEQ ID NO: 1378750 - RNA, 16 nt, Neisseria meningitidis Z2491
cgaaagugggaaucua

SEQ ID NO: 1378751 - RNA, 17 nt, Neisseria meningitidis Z2491
cgaaagguugcgggaau

SEQ ID NO: 1378752 - RNA, 19 nt, Neisseria meningitidis Z2491
cgaaagguugcgggaaucc

SEQ ID NO: 1378753 - RNA, 19 nt, Neisseria meningitidis Z2491
cgaaagguugugggaaucc

SEQ ID NO: 1378754 - RNA, 18 nt, Neisseria meningitidis Z2491
cgaaacggcaaaacaggu

SEQ ID NO: 1378755 - RNA, 15 nt, Neisseria meningitidis Z2491
cgaacccguuuggca

SEQ ID NO: 1378756 - RNA, 19 nt, Neisseria meningitidis Z2491
cgaacccguuuggcaaggu

SEQ ID NO: 1378757 - RNA, 21 nt, Neisseria meningitidis Z2491
cgaaccaaauaaacaaggucu

SEQ ID NO: 1378758 - RNA, 17 nt, Neisseria meningitidis Z2491
cgaacaucaucuaaaug

SEQ ID NO: 1378759 - RNA, 19 nt, Neisseria meningitidis Z2491
cgaacaucaucuaaauguu

SEQ ID NO: 1378760 - RNA, 16 nt, Neisseria meningitidis Z2491
cgaacaggacaaaaau

SEQ ID NO: 1378761 - RNA, 12 nt, Neisseria meningitidis Z2491
cgaaaaaauaau

SEQ ID NO: 1378762 - RNA, 12 nt, Neisseria meningitidis Z2491
cgaaaaccugug

SEQ ID NO: 1378763 - RNA, 16 nt, Neisseria meningitidis Z2491
cgaaaaguugcaagaa

SEQ ID NO: 1378764 - RNA, 15 nt, Neisseria meningitidis Z2491
cgaaaccaaaagcca

SEQ ID NO: 1378765 - RNA, 16 nt, Neisseria meningitidis Z2491
cgaaaccaaaagccaa

SEQ ID NO: 1378766 - RNA, 18 nt, Neisseria meningitidis Z2491
cgaaacacucggccucca

SEQ ID NO: 1378767 - RNA, 20 nt, Neisseria meningitidis Z2491
ccuuuugauuaacaggcaac

SEQ ID NO: 1378768 - RNA, 20 nt, Neisseria meningitidis Z2491
ccuuuuuacccgauaaguuu

SEQ ID NO: 1378769 - RNA, 12 nt, Neisseria meningitidis Z2491
ccuuuuuaaagg

SEQ ID NO: 1378770 - RNA, 12 nt, Neisseria meningitidis Z2491
ccuuuucuuccu

SEQ ID NO: 1378771 - RNA, 22 nt, Neisseria meningitidis Z2491
ccuuuuuuuucuauugccuuua

SEQ ID NO: 1378772 - RNA, 13 nt, Neisseria meningitidis Z2491
ccuuuuuguuuuc

SEQ ID NO: 1378773 - RNA, 21 nt, Neisseria meningitidis Z2491
ccuuuuaccuugaggucuuug

SEQ ID NO: 1378774 - RNA, 16 nt, Neisseria meningitidis Z2491
ccuuugccaccaauac

SEQ ID NO: 1378775 - RNA, 14 nt, Neisseria meningitidis Z2491
ccuuugauuucggc

SEQ ID NO: 1378776 - RNA, 14 nt, Neisseria meningitidis Z2491
ccuuugcaaaaccg

SEQ ID NO: 1378777 - RNA, 16 nt, Neisseria meningitidis Z2491
ccuuugcaauaacaua

SEQ ID NO: 1378778 - RNA, 21 nt, Neisseria meningitidis Z2491
ccuuugacuuucguaccuugu

SEQ ID NO: 1378779 - RNA, 16 nt, Neisseria meningitidis Z2491
ccuuuccucuuucauc

SEQ ID NO: 1378780 - RNA, 21 nt, Neisseria meningitidis Z2491
ccuuucagacggcauuguuuc

SEQ ID NO: 1378781 - RNA, 21 nt, Neisseria meningitidis Z2491
ccuuucagacggcauuuuaug

SEQ ID NO: 1378782 - RNA, 22 nt, Neisseria meningitidis Z2491
ccuuucagacggcauuuuaugu

SEQ ID NO: 1378783 - RNA, 22 nt, Neisseria meningitidis Z2491
ccuuucagacggcauuuuuaua

SEQ ID NO: 1378784 - RNA, 17 nt, Neisseria meningitidis Z2491
ccuuucaaucaaugugc

SEQ ID NO: 1378785 - RNA, 16 nt, Neisseria meningitidis Z2491
ccuuucaacacgcccu

SEQ ID NO: 1378786 - RNA, 20 nt, Neisseria meningitidis Z2491
ccuugccaagguugaggucg

SEQ ID NO: 1378787 - RNA, 15 nt, Neisseria meningitidis Z2491
ccuugugcuucuucg

SEQ ID NO: 1378788 - RNA, 22 nt, Neisseria meningitidis Z2491
ccuuuacucauucaauccucaa

SEQ ID NO: 1378789 - RNA, 13 nt, Neisseria meningitidis Z2491
ccuuguaaaaaug

SEQ ID NO: 1378790 - RNA, 19 nt, Neisseria meningitidis Z2491
ccuucgcgggaaugacgaa

SEQ ID NO: 1378791 - RNA, 22 nt, Neisseria meningitidis Z2491
ccuucgggcagcggcaauauuc

SEQ ID NO: 1378792 - RNA, 19 nt, Neisseria meningitidis Z2491
ccuguguuuggguuucggc

SEQ ID NO: 1378793 - RNA, 17 nt, Neisseria meningitidis Z2491
ccuuccaucacguuuuc

SEQ ID NO: 1378794 - RNA, 22 nt, Neisseria meningitidis Z2491
ccuuccaucacguuuuccaagg

SEQ ID NO: 1378795 - RNA, 20 nt, Neisseria meningitidis Z2491
ccuuccgcuucuuccagcaa

SEQ ID NO: 1378796 - RNA, 12 nt, Neisseria meningitidis Z2491
ccuucguagucg

SEQ ID NO: 1378797 - RNA, 15 nt, Neisseria meningitidis Z2491
cgaagccgcagacag

SEQ ID NO: 1378798 - RNA, 13 nt, Neisseria meningitidis Z2491
cgaagcgacaaca

SEQ ID NO: 1378799 - RNA, 12 nt, Neisseria meningitidis Z2491
cgaagcugcaga

SEQ ID NO: 1378800 - RNA, 15 nt, Neisseria meningitidis Z2491
cgaagcugcagacag

SEQ ID NO: 1378801 - RNA, 19 nt, Neisseria meningitidis Z2491
cgaacgggcggauaaugaa

SEQ ID NO: 1378802 - RNA, 16 nt, Neisseria meningitidis Z2491
cgaagaugggaauccg

SEQ ID NO: 1378803 - RNA, 15 nt, Neisseria meningitidis Z2491
cgacaaccgcccagc

SEQ ID NO: 1378804 - RNA, 20 nt, Neisseria meningitidis Z2491
cgacaaccguauccgccagu

SEQ ID NO: 1378805 - RNA, 23 nt, Neisseria meningitidis Z2491
cgacaacacgucggcagucugua

SEQ ID NO: 1378806 - RNA, 14 nt, Neisseria meningitidis Z2491
cgacacccgccccg

SEQ ID NO: 1378807 - RNA, 12 nt, Neisseria meningitidis Z2491
cgacagcagcag

SEQ ID NO: 1378808 - RNA, 16 nt, Neisseria meningitidis Z2491
cgaaucuuauccacag

SEQ ID NO: 1378809 - RNA, 19 nt, Neisseria meningitidis Z2491
cgaauugcgccgacagcag

SEQ ID NO: 1378810 - RNA, 19 nt, Neisseria meningitidis Z2491
cgacagccggguaaaauca

SEQ ID NO: 1378811 - RNA, 12 nt, Neisseria meningitidis Z2491
cgacagccgcaa

SEQ ID NO: 1378812 - RNA, 16 nt, Neisseria meningitidis Z2491
cgacagccgcaaagac

SEQ ID NO: 1378813 - RNA, 19 nt, Neisseria meningitidis Z2491
cgacaucccccagccgaaa

SEQ ID NO: 1378814 - RNA, 22 nt, Neisseria meningitidis Z2491
cgaccaucguccaaccuucccg

SEQ ID NO: 1378815 - RNA, 21 nt, Neisseria meningitidis Z2491
cgaccagugcgccggcauaac

SEQ ID NO: 1378816 - RNA, 12 nt, Neisseria meningitidis Z2491
cgaccagcuccc

SEQ ID NO: 1378817 - RNA, 14 nt, Neisseria meningitidis Z2491
cgacgagaauuuau

SEQ ID NO: 1378818 - RNA, 17 nt, Neisseria meningitidis Z2491
cgacgaagccgcagaca

SEQ ID NO: 1378819 - RNA, 18 nt, Neisseria meningitidis Z2491
cgacgaagccgcagacag

SEQ ID NO: 1378820 - RNA, 24 nt, Neisseria meningitidis Z2491
cgacgcccccgcaggcagcagauc

SEQ ID NO: 1378821 - RNA, 16 nt, Neisseria meningitidis Z2491
cgaccgccgccgccuu

SEQ ID NO: 1378822 - RNA, 16 nt, Neisseria meningitidis Z2491
cccacuuucgugggaa

SEQ ID NO: 1378823 - RNA, 17 nt, Neisseria meningitidis Z2491
cccacugccagccgccg

SEQ ID NO: 1378824 - RNA, 16 nt, Neisseria meningitidis Z2491
cccacuuccgugggaa

SEQ ID NO: 1378825 - RNA, 23 nt, Neisseria meningitidis Z2491
cccacugagaccuuugcaauaac

SEQ ID NO: 1378826 - RNA, 14 nt, Neisseria meningitidis Z2491
cccacgcacccaaa

SEQ ID NO: 1378827 - RNA, 13 nt, Neisseria meningitidis Z2491
cccacgaaagugg

SEQ ID NO: 1378828 - RNA, 21 nt, Neisseria meningitidis Z2491
cccacgaaagugggaauccag

SEQ ID NO: 1378829 - RNA, 21 nt, Neisseria meningitidis Z2491
cccacgaaaguuggaauccag

SEQ ID NO: 1378830 - RNA, 16 nt, Neisseria meningitidis Z2491
cccacgaacccacauc

SEQ ID NO: 1378831 - RNA, 22 nt, Neisseria meningitidis Z2491
cccaagcggucuucuuuggcuu

SEQ ID NO: 1378832 - RNA, 17 nt, Neisseria meningitidis Z2491
cccaauccugcacgcgc

SEQ ID NO: 1378833 - RNA, 20 nt, Neisseria meningitidis Z2491
cccaauauuaagaaaaacag

SEQ ID NO: 1378834 - RNA, 16 nt, Neisseria meningitidis Z2491
cccaccauuguuuccg

SEQ ID NO: 1378835 - RNA, 13 nt, Neisseria meningitidis Z2491
cccaauuccugcg

SEQ ID NO: 1378836 - RNA, 22 nt, Neisseria meningitidis Z2491
ccauuacugcugcggcucugaa

SEQ ID NO: 1378837 - RNA, 14 nt, Neisseria meningitidis Z2491
ccauucuugcaaaa

SEQ ID NO: 1378838 - RNA, 22 nt, Neisseria meningitidis Z2491
ccauuggacagcggcaauauuc

SEQ ID NO: 1378839 - RNA, 14 nt, Neisseria meningitidis Z2491
ccaugcuauucaaa

SEQ ID NO: 1378840 - RNA, 13 nt, Neisseria meningitidis Z2491
ccauggaaaccaa

SEQ ID NO: 1378841 - RNA, 19 nt, Neisseria meningitidis Z2491
ccauggaaaccaagggcag

SEQ ID NO: 1378842 - RNA, 15 nt, Neisseria meningitidis Z2491
cccauaugccgucug

SEQ ID NO: 1378843 - RNA, 23 nt, Neisseria meningitidis Z2491
cccauaguuuguaaaaucucuug

SEQ ID NO: 1378844 - RNA, 16 nt, Neisseria meningitidis Z2491
cccagugcgaugacga

SEQ ID NO: 1378845 - RNA, 17 nt, Neisseria meningitidis Z2491
cccauccgcccaagucg

SEQ ID NO: 1378846 - RNA, 16 nt, Neisseria meningitidis Z2491
ccccaguucuucgaug

SEQ ID NO: 1378847 - RNA, 12 nt, Neisseria meningitidis Z2491
cccauugccgcg

SEQ ID NO: 1378848 - RNA, 20 nt, Neisseria meningitidis Z2491
cccauugccacgccgaaccc

SEQ ID NO: 1378849 - RNA, 16 nt, Neisseria meningitidis Z2491
ccccgucauucccgcc

SEQ ID NO: 1378850 - RNA, 17 nt, Neisseria meningitidis Z2491
ccccuaaaggcuucaga

SEQ ID NO: 1378851 - RNA, 14 nt, Neisseria meningitidis Z2491
ccccuaaaaugccc

SEQ ID NO: 1378852 - RNA, 20 nt, Neisseria meningitidis Z2491
cccccuuaauccuccacgga

SEQ ID NO: 1378853 - RNA, 11 nt, Neisseria meningitidis Z2491
ccaugauuuuu

SEQ ID NO: 1378854 - RNA, 21 nt, Neisseria meningitidis Z2491
ccaucuacauaaacaggcgcg

SEQ ID NO: 1378855 - RNA, 23 nt, Neisseria meningitidis Z2491
ccauccauacggaaaccugcauc

SEQ ID NO: 1378856 - RNA, 13 nt, Neisseria meningitidis Z2491
ccauagaaaggga

SEQ ID NO: 1378857 - RNA, 18 nt, Neisseria meningitidis Z2491
ccauagauaaauuucaga

SEQ ID NO: 1378858 - RNA, 13 nt, Neisseria meningitidis Z2491
ccaucaacaaaau

SEQ ID NO: 1378859 - RNA, 22 nt, Neisseria meningitidis Z2491
ccaguuccuccacuaaaaaauc

SEQ ID NO: 1378860 - RNA, 17 nt, Neisseria meningitidis Z2491
ccauaaucaaaaccagc

SEQ ID NO: 1378861 - RNA, 19 nt, Neisseria meningitidis Z2491
ccauaauccaagauuucau

SEQ ID NO: 1378862 - RNA, 14 nt, Neisseria meningitidis Z2491
ccagcuuccgcagg

SEQ ID NO: 1378863 - RNA, 12 nt, Neisseria meningitidis Z2491
ccagcccgccgc

SEQ ID NO: 1378864 - RNA, 17 nt, Neisseria meningitidis Z2491
ccagcccgccgcgcccg

SEQ ID NO: 1378865 - RNA, 17 nt, Neisseria meningitidis Z2491
ccagcuccggccaaaaa

SEQ ID NO: 1378866 - RNA, 19 nt, Neisseria meningitidis Z2491
ccaguaacgccaccaaggc

SEQ ID NO: 1378867 - RNA, 19 nt, Neisseria meningitidis Z2491
ccagaacguaaaaucugaa

SEQ ID NO: 1378868 - RNA, 19 nt, Neisseria meningitidis Z2491
ccacuuuuugcgccagcgg

SEQ ID NO: 1378869 - RNA, 14 nt, Neisseria meningitidis Z2491
ccacguucuagauu

SEQ ID NO: 1378870 - RNA, 17 nt, Neisseria meningitidis Z2491
ccagacggcauuuuuca

SEQ ID NO: 1378871 - RNA, 23 nt, Neisseria meningitidis Z2491
ccagaggcggaaucgaaccgccg

SEQ ID NO: 1378872 - RNA, 12 nt, Neisseria meningitidis Z2491
ccagagggaaag

SEQ ID NO: 1378873 - RNA, 19 nt, Neisseria meningitidis Z2491
ccagacaggcuuuuuucug

SEQ ID NO: 1378874 - RNA, 20 nt, Neisseria meningitidis Z2491
ccagcaacauuuccugcauc

SEQ ID NO: 1378875 - RNA, 20 nt, Neisseria meningitidis Z2491
ccagcaaucagggccuugac

SEQ ID NO: 1378876 - RNA, 14 nt, Neisseria meningitidis Z2491
ccagcacaaacagc

SEQ ID NO: 1378877 - RNA, 15 nt, Neisseria meningitidis Z2491
ccagcacaaacagca

SEQ ID NO: 1378878 - RNA, 16 nt, Neisseria meningitidis Z2491
ccagcaaugccgucug

SEQ ID NO: 1378879 - RNA, 17 nt, Neisseria meningitidis Z2491
ccagcaaugcgucuucc

SEQ ID NO: 1378880 - RNA, 17 nt, Neisseria meningitidis Z2491
ccagcagcccuugcccc

SEQ ID NO: 1378881 - RNA, 13 nt, Neisseria meningitidis Z2491
ccacauaauucaa

SEQ ID NO: 1378882 - RNA, 14 nt, Neisseria meningitidis Z2491
ccacaguuuuucca

SEQ ID NO: 1378883 - RNA, 17 nt, Neisseria meningitidis Z2491
ccacaguuuuuccaguu

SEQ ID NO: 1378884 - RNA, 22 nt, Neisseria meningitidis Z2491
ccacauugucggauuuguccaa

SEQ ID NO: 1378885 - RNA, 14 nt, Neisseria meningitidis Z2491
ccaccauuguuucc

SEQ ID NO: 1378886 - RNA, 19 nt, Neisseria meningitidis Z2491
ccaccauuguuuccgcuuc

SEQ ID NO: 1378887 - RNA, 21 nt, Neisseria meningitidis Z2491
ccaauuaaaccccguucccug

SEQ ID NO: 1378888 - RNA, 23 nt, Neisseria meningitidis Z2491
ccaaugcuugggcacguuugagu

SEQ ID NO: 1378889 - RNA, 20 nt, Neisseria meningitidis Z2491
ccaaugccgucugaaaaccu

SEQ ID NO: 1378890 - RNA, 14 nt, Neisseria meningitidis Z2491
ccacaaauccgccu

SEQ ID NO: 1378891 - RNA, 21 nt, Neisseria meningitidis Z2491
ccacaagucuucggcaagaug

SEQ ID NO: 1378892 - RNA, 15 nt, Neisseria meningitidis Z2491
ccacaauauaaucaa

SEQ ID NO: 1378893 - RNA, 13 nt, Neisseria meningitidis Z2491
ccacaaaaaacag

SEQ ID NO: 1378894 - RNA, 14 nt, Neisseria meningitidis Z2491
ccacaaaaaacaga

SEQ ID NO: 1378895 - RNA, 14 nt, Neisseria meningitidis Z2491
ccacaaaaaacagc

SEQ ID NO: 1378896 - RNA, 22 nt, Neisseria meningitidis Z2491
ccacacacaagccguacauaag

SEQ ID NO: 1378897 - RNA, 15 nt, Neisseria meningitidis Z2491
ccaauacaacaaaau

SEQ ID NO: 1378898 - RNA, 16 nt, Neisseria meningitidis Z2491
ccaagccgacuuuuuc

SEQ ID NO: 1378899 - RNA, 15 nt, Neisseria meningitidis Z2491
ccaagauuucaucau

SEQ ID NO: 1378900 - RNA, 16 nt, Neisseria meningitidis Z2491
ccaagaagcggcggca

SEQ ID NO: 1378901 - RNA, 15 nt, Neisseria meningitidis Z2491
ccaagguugaggucg

SEQ ID NO: 1378902 - RNA, 12 nt, Neisseria meningitidis Z2491
ccaaggcagcaa

SEQ ID NO: 1378903 - RNA, 23 nt, Neisseria meningitidis Z2491
ccaacacggcaaaaauuuauccg

SEQ ID NO: 1378904 - RNA, 15 nt, Neisseria meningitidis Z2491
ccaacccuccgccgc

SEQ ID NO: 1378905 - RNA, 23 nt, Neisseria meningitidis Z2491
ccaacucggggucaagcgcggaa

SEQ ID NO: 1378906 - RNA, 14 nt, Neisseria meningitidis Z2491
ccaacgcuguacug

SEQ ID NO: 1378907 - RNA, 14 nt, Neisseria meningitidis Z2491
ccaacgccguacug

SEQ ID NO: 1378908 - RNA, 21 nt, Neisseria meningitidis Z2491
ccaacgcgaaggcgaccgccu

SEQ ID NO: 1378909 - RNA, 21 nt, Neisseria meningitidis Z2491
ccaaaccgaugggcuucauca

SEQ ID NO: 1378910 - RNA, 19 nt, Neisseria meningitidis Z2491
ccaaacagcgcggcggcgu

SEQ ID NO: 1378911 - RNA, 19 nt, Neisseria meningitidis Z2491
ccaaacaucgcucaaauuc

SEQ ID NO: 1378912 - RNA, 17 nt, Neisseria meningitidis Z2491
cauuucuagauucccac

SEQ ID NO: 1378913 - RNA, 18 nt, Neisseria meningitidis Z2491
cauuucuagauucccacu

SEQ ID NO: 1378914 - RNA, 20 nt, Neisseria meningitidis Z2491
cauuucuagauucccacuuu

SEQ ID NO: 1378915 - RNA, 14 nt, Neisseria meningitidis Z2491
cauuucugauaaau

SEQ ID NO: 1378916 - RNA, 16 nt, Neisseria meningitidis Z2491
ccaaaaacagaaaccu

SEQ ID NO: 1378917 - RNA, 17 nt, Neisseria meningitidis Z2491
ccaaaaaaucugauaag

SEQ ID NO: 1378918 - RNA, 14 nt, Neisseria meningitidis Z2491
ccaaaaaauuuuca

SEQ ID NO: 1378919 - RNA, 17 nt, Neisseria meningitidis Z2491
cauuucuggauucccac

SEQ ID NO: 1378920 - RNA, 18 nt, Neisseria meningitidis Z2491
cauuucuggauucccacu

SEQ ID NO: 1378921 - RNA, 18 nt, Neisseria meningitidis Z2491
ccaaaacucaaucaaauc

SEQ ID NO: 1378922 - RNA, 14 nt, Neisseria meningitidis Z2491
ccaaagcauuuuuc

SEQ ID NO: 1378923 - RNA, 21 nt, Neisseria meningitidis Z2491
ccaaaggcagugccgccaaag

SEQ ID NO: 1378924 - RNA, 11 nt, Neisseria meningitidis Z2491
ccaaacggcuc

SEQ ID NO: 1378925 - RNA, 13 nt, Neisseria meningitidis Z2491
ccaaacguuuuuc

SEQ ID NO: 1378926 - RNA, 20 nt, Neisseria meningitidis Z2491
ccaaacguuuuuccaaaccu

SEQ ID NO: 1378927 - RNA, 23 nt, Neisseria meningitidis Z2491
ccaaagagaaagaacccaaaccg

SEQ ID NO: 1378928 - RNA, 19 nt, Neisseria meningitidis Z2491
ccaaaggucuggauuccca

SEQ ID NO: 1378929 - RNA, 15 nt, Neisseria meningitidis Z2491
ccaaagugccaaaug

SEQ ID NO: 1378930 - RNA, 13 nt, Neisseria meningitidis Z2491
ccaaauaaacaag

SEQ ID NO: 1378931 - RNA, 20 nt, Neisseria meningitidis Z2491
ccaaaucgcccguuaccagc

SEQ ID NO: 1378932 - RNA, 12 nt, Neisseria meningitidis Z2491
ccaaauauaaaa

SEQ ID NO: 1378933 - RNA, 14 nt, Neisseria meningitidis Z2491
ccaaauagaaaaua

SEQ ID NO: 1378934 - RNA, 14 nt, Neisseria meningitidis Z2491
cagguuguuggaaa

SEQ ID NO: 1378935 - RNA, 15 nt, Neisseria meningitidis Z2491
cagguuguuggaaaa

SEQ ID NO: 1378936 - RNA, 14 nt, Neisseria meningitidis Z2491
caguaacgccacca

SEQ ID NO: 1378937 - RNA, 19 nt, Neisseria meningitidis Z2491
cagguuaucacuuggaaua

SEQ ID NO: 1378938 - RNA, 23 nt, Neisseria meningitidis Z2491
cagguucguuuaguuucggucau

SEQ ID NO: 1378939 - RNA, 17 nt, Neisseria meningitidis Z2491
caguacggcguugccuc

SEQ ID NO: 1378940 - RNA, 14 nt, Neisseria meningitidis Z2491
caguacaaauagca

SEQ ID NO: 1378941 - RNA, 15 nt, Neisseria meningitidis Z2491
caguacaaauaguac

SEQ ID NO: 1378942 - RNA, 13 nt, Neisseria meningitidis Z2491
cagucauuuuuga

SEQ ID NO: 1378943 - RNA, 17 nt, Neisseria meningitidis Z2491
caguuucggucauuucc

SEQ ID NO: 1378944 - RNA, 18 nt, Neisseria meningitidis Z2491
caguuuccacuaaaugcu

SEQ ID NO: 1378945 - RNA, 13 nt, Neisseria meningitidis Z2491
caguuugaugccg

SEQ ID NO: 1378946 - RNA, 16 nt, Neisseria meningitidis Z2491
caguuuguucaggaag

SEQ ID NO: 1378947 - RNA, 14 nt, Neisseria meningitidis Z2491
caguucguucugca

SEQ ID NO: 1378948 - RNA, 18 nt, Neisseria meningitidis Z2491
cauaaugcccaaaccgcc

SEQ ID NO: 1378949 - RNA, 17 nt, Neisseria meningitidis Z2491
cauaaucaauuaaaaac

SEQ ID NO: 1378950 - RNA, 16 nt, Neisseria meningitidis Z2491
cauaaguguauucgga

SEQ ID NO: 1378951 - RNA, 13 nt, Neisseria meningitidis Z2491
cauaauaaaaaua

SEQ ID NO: 1378952 - RNA, 16 nt, Neisseria meningitidis Z2491
cauaauaaaaauaacg

SEQ ID NO: 1378953 - RNA, 15 nt, Neisseria meningitidis Z2491
caguccuacccaaaa

SEQ ID NO: 1378954 - RNA, 16 nt, Neisseria meningitidis Z2491
caguccuacccaaaag

SEQ ID NO: 1378955 - RNA, 17 nt, Neisseria meningitidis Z2491
cagugauggcuucuaaa

SEQ ID NO: 1378956 - RNA, 22 nt, Neisseria meningitidis Z2491
cagugauuucccgucccagcca

SEQ ID NO: 1378957 - RNA, 19 nt, Neisseria meningitidis Z2491
cagugccgccaaagugcca

SEQ ID NO: 1378958 - RNA, 15 nt, Neisseria meningitidis Z2491
cagugcggacaccgc

SEQ ID NO: 1378959 - RNA, 21 nt, Neisseria meningitidis Z2491
cagugccgcaccaccagccac

SEQ ID NO: 1378960 - RNA, 14 nt, Neisseria meningitidis Z2491
caguuccaaagccu

SEQ ID NO: 1378961 - RNA, 22 nt, Neisseria meningitidis Z2491
caguuccaucgcgucuucaaaa

SEQ ID NO: 1378962 - RNA, 20 nt, Neisseria meningitidis Z2491
caggcugccgcacaagcccu

SEQ ID NO: 1378963 - RNA, 14 nt, Neisseria meningitidis Z2491
caggcuuuuuucug

SEQ ID NO: 1378964 - RNA, 23 nt, Neisseria meningitidis Z2491
caggcuuuuuucuguuuggcuuu

SEQ ID NO: 1378965 - RNA, 16 nt, Neisseria meningitidis Z2491
caggcuuuuuugacga

SEQ ID NO: 1378966 - RNA, 17 nt, Neisseria meningitidis Z2491
caggcuuuuuugacgaa

SEQ ID NO: 1378967 - RNA, 16 nt, Neisseria meningitidis Z2491
caggaaauuuccaaau

SEQ ID NO: 1378968 - RNA, 20 nt, Neisseria meningitidis Z2491
caggcaaaaaaaauaaccgc

SEQ ID NO: 1378969 - RNA, 15 nt, Neisseria meningitidis Z2491
caggcccaaaacaaa

SEQ ID NO: 1378970 - RNA, 22 nt, Neisseria meningitidis Z2491
caggcccaaaacaaauacccaa

SEQ ID NO: 1378971 - RNA, 13 nt, Neisseria meningitidis Z2491
caggccaaacccc

SEQ ID NO: 1378972 - RNA, 17 nt, Neisseria meningitidis Z2491
cagcuugggcggacugc

SEQ ID NO: 1378973 - RNA, 15 nt, Neisseria meningitidis Z2491
cagcuucgucgccuu

SEQ ID NO: 1378974 - RNA, 14 nt, Neisseria meningitidis Z2491
cagcucucccucuu

SEQ ID NO: 1378975 - RNA, 14 nt, Neisseria meningitidis Z2491
cagcugaaaacagc

SEQ ID NO: 1378976 - RNA, 19 nt, Neisseria meningitidis Z2491
cagcugaaaacagcugaaa

SEQ ID NO: 1378977 - RNA, 16 nt, Neisseria meningitidis Z2491
cagcguuggcucgccu

SEQ ID NO: 1378978 - RNA, 17 nt, Neisseria meningitidis Z2491
cagcguuggcucgccuu

SEQ ID NO: 1378979 - RNA, 18 nt, Neisseria meningitidis Z2491
cagcguuacuuugcguuc

SEQ ID NO: 1378980 - RNA, 21 nt, Neisseria meningitidis Z2491
cagcgugaugauguccgacug

SEQ ID NO: 1378981 - RNA, 15 nt, Neisseria meningitidis Z2491
cauggcguucaacac

SEQ ID NO: 1378982 - RNA, 21 nt, Neisseria meningitidis Z2491
caugucgccgguacacagggu

SEQ ID NO: 1378983 - RNA, 22 nt, Neisseria meningitidis Z2491
caugucggguucggauauuucc

SEQ ID NO: 1378984 - RNA, 21 nt, Neisseria meningitidis Z2491
caugcccaaaagcagcccgaa

SEQ ID NO: 1378985 - RNA, 20 nt, Neisseria meningitidis Z2491
caugccauggauuauauuug

SEQ ID NO: 1378986 - RNA, 19 nt, Neisseria meningitidis Z2491
caucucuucuauaaagccu

SEQ ID NO: 1378987 - RNA, 19 nt, Neisseria meningitidis Z2491
caucucuaagauuuacagc

SEQ ID NO: 1378988 - RNA, 18 nt, Neisseria meningitidis Z2491
cauuuccgauaaauucuu

SEQ ID NO: 1378989 - RNA, 13 nt, Neisseria meningitidis Z2491
cauuuccaauuuu

SEQ ID NO: 1378990 - RNA, 18 nt, Neisseria meningitidis Z2491
cauuuccgauaaauuccu

SEQ ID NO: 1378991 - RNA, 14 nt, Neisseria meningitidis Z2491
cauuucaggacgga

SEQ ID NO: 1378992 - RNA, 18 nt, Neisseria meningitidis Z2491
cauuguccgagcaggacg

SEQ ID NO: 1378993 - RNA, 12 nt, Neisseria meningitidis Z2491
cauugccaccgc

SEQ ID NO: 1378994 - RNA, 21 nt, Neisseria meningitidis Z2491
cauucggcuuaaaccuuaucc

SEQ ID NO: 1378995 - RNA, 20 nt, Neisseria meningitidis Z2491
cauucggggcagauguauug

SEQ ID NO: 1378996 - RNA, 14 nt, Neisseria meningitidis Z2491
cauucuugauggcg

SEQ ID NO: 1378997 - RNA, 15 nt, Neisseria meningitidis Z2491
cauucuugcaaaaua

SEQ ID NO: 1378998 - RNA, 16 nt, Neisseria meningitidis Z2491
cauucuugcaaaauag

SEQ ID NO: 1378999 - RNA, 23 nt, Neisseria meningitidis Z2491
cauuauuugggauauuuucuucc

SEQ ID NO: 1379000 - RNA, 18 nt, Neisseria meningitidis Z2491
cauuauuuucacaaaaac

SEQ ID NO: 1379001 - RNA, 12 nt, Neisseria meningitidis Z2491
cauucaaugcua

SEQ ID NO: 1379002 - RNA, 18 nt, Neisseria meningitidis Z2491
cauucaaugcuaaggcaa

SEQ ID NO: 1379003 - RNA, 21 nt, Neisseria meningitidis Z2491
cauuccuacaaggacaaaaaa

SEQ ID NO: 1379004 - RNA, 15 nt, Neisseria meningitidis Z2491
cauuccuacgaaccu

SEQ ID NO: 1379005 - RNA, 15 nt, Neisseria meningitidis Z2491
cauuccuguaaaaac

SEQ ID NO: 1379006 - RNA, 14 nt, Neisseria meningitidis Z2491
cauucccgcgcagg

SEQ ID NO: 1379007 - RNA, 13 nt, Neisseria meningitidis Z2491
cauuccgcgcagg

SEQ ID NO: 1379008 - RNA, 16 nt, Neisseria meningitidis Z2491
cauuccgucauuccca

SEQ ID NO: 1379009 - RNA, 23 nt, Neisseria meningitidis Z2491
cauuccguuaucccauaaaaacg

SEQ ID NO: 1379010 - RNA, 21 nt, Neisseria meningitidis Z2491
cauucccucaaaaacagaaaa

SEQ ID NO: 1379011 - RNA, 14 nt, Neisseria meningitidis Z2491
cauucccucucccg

SEQ ID NO: 1379012 - RNA, 15 nt, Neisseria meningitidis Z2491
cauucccgauaaauu

SEQ ID NO: 1379013 - RNA, 16 nt, Neisseria meningitidis Z2491
cauucccgcaaaaaca

SEQ ID NO: 1379014 - RNA, 17 nt, Neisseria meningitidis Z2491
cauucccgcaaaaacaa

SEQ ID NO: 1379015 - RNA, 20 nt, Neisseria meningitidis Z2491
cauucccgcaaaaacaaaaa

SEQ ID NO: 1379016 - RNA, 14 nt, Neisseria meningitidis Z2491
cauucccgcaaaag

SEQ ID NO: 1379017 - RNA, 21 nt, Neisseria meningitidis Z2491
cauucccacgaaagugggaau

SEQ ID NO: 1379018 - RNA, 20 nt, Neisseria meningitidis Z2491
cauagccuucacgcacagcg

SEQ ID NO: 1379019 - RNA, 16 nt, Neisseria meningitidis Z2491
cauacacagccaaaaa

SEQ ID NO: 1379020 - RNA, 22 nt, Neisseria meningitidis Z2491
cauagacuguaccaaauuauug

SEQ ID NO: 1379021 - RNA, 23 nt, Neisseria meningitidis Z2491
cauagacuguaccaaauuauugc

SEQ ID NO: 1379022 - RNA, 13 nt, Neisseria meningitidis Z2491
cauagguuacuaa

SEQ ID NO: 1379023 - RNA, 16 nt, Neisseria meningitidis Z2491
cauauagacauuuuuu

SEQ ID NO: 1379024 - RNA, 21 nt, Neisseria meningitidis Z2491
cauaguuuccggcaagcaggg

SEQ ID NO: 1379025 - RNA, 23 nt, Neisseria meningitidis Z2491
cauauugcccaacagcagcauaa

SEQ ID NO: 1379026 - RNA, 16 nt, Neisseria meningitidis Z2491
cauaucgagguuguuc

SEQ ID NO: 1379027 - RNA, 17 nt, Neisseria meningitidis Z2491
cauaucgagguuguuca

SEQ ID NO: 1379028 - RNA, 14 nt, Neisseria meningitidis Z2491
cauauuugaaccug

SEQ ID NO: 1379029 - RNA, 16 nt, Neisseria meningitidis Z2491
cauauuugaaccugac

SEQ ID NO: 1379030 - RNA, 18 nt, Neisseria meningitidis Z2491
caucacguuuuccaaggc

SEQ ID NO: 1379031 - RNA, 19 nt, Neisseria meningitidis Z2491
caucaauuuccacaauuca

SEQ ID NO: 1379032 - RNA, 17 nt, Neisseria meningitidis Z2491
caucacuccgucuuuca

SEQ ID NO: 1379033 - RNA, 14 nt, Neisseria meningitidis Z2491
caucagcaccacug

SEQ ID NO: 1379034 - RNA, 15 nt, Neisseria meningitidis Z2491
caucagauugauaaa

SEQ ID NO: 1379035 - RNA, 21 nt, Neisseria meningitidis Z2491
caucuacaaaauaaucuuccu

SEQ ID NO: 1379036 - RNA, 15 nt, Neisseria meningitidis Z2491
caucguuuuuuuagg

SEQ ID NO: 1379037 - RNA, 23 nt, Neisseria meningitidis Z2491
caucguuuuauuacgcaauggca

SEQ ID NO: 1379038 - RNA, 12 nt, Neisseria meningitidis Z2491
caucgucuagag

SEQ ID NO: 1379039 - RNA, 23 nt, Neisseria meningitidis Z2491
caucguccuccaccgucauuccc

SEQ ID NO: 1379040 - RNA, 17 nt, Neisseria meningitidis Z2491
caucguccaaccuuccc

SEQ ID NO: 1379041 - RNA, 15 nt, Neisseria meningitidis Z2491
caucguaugaaacaa

SEQ ID NO: 1379042 - RNA, 17 nt, Neisseria meningitidis Z2491
caucgguuucuucuucg

SEQ ID NO: 1379043 - RNA, 14 nt, Neisseria meningitidis Z2491
cauccugcuuuaau

SEQ ID NO: 1379044 - RNA, 21 nt, Neisseria meningitidis Z2491
caucgcaacuccaaagagaaa

SEQ ID NO: 1379045 - RNA, 11 nt, Neisseria meningitidis Z2491
caucgccgccg

SEQ ID NO: 1379046 - RNA, 23 nt, Neisseria meningitidis Z2491
caucggcaaucagucaugaccga

SEQ ID NO: 1379047 - RNA, 14 nt, Neisseria meningitidis Z2491
caucgcuuucaggu

SEQ ID NO: 1379048 - RNA, 20 nt, Neisseria meningitidis Z2491
caucgcuuucagguggcuuu

SEQ ID NO: 1379049 - RNA, 21 nt, Neisseria meningitidis Z2491
caucggacaagggaaauccgc

SEQ ID NO: 1379050 - RNA, 15 nt, Neisseria meningitidis Z2491
caucccccaaccaau

SEQ ID NO: 1379051 - RNA, 17 nt, Neisseria meningitidis Z2491
cauccgaauaugccaga

SEQ ID NO: 1379052 - RNA, 23 nt, Neisseria meningitidis Z2491
cauccgaccgccccgucauuccc

SEQ ID NO: 1379053 - RNA, 19 nt, Neisseria meningitidis Z2491
cauccgcaacgcgcaaacc

SEQ ID NO: 1379054 - RNA, 18 nt, Neisseria meningitidis Z2491
caucagcuucauacccca

SEQ ID NO: 1379055 - RNA, 15 nt, Neisseria meningitidis Z2491
cauccaguucuucua

SEQ ID NO: 1379056 - RNA, 20 nt, Neisseria meningitidis Z2491
cauccauaaucaaaaccagc

SEQ ID NO: 1379057 - RNA, 15 nt, Neisseria meningitidis Z2491
auuuuuauugcuuca

SEQ ID NO: 1379058 - RNA, 22 nt, Neisseria meningitidis Z2491
auuuuuauagugauuaacaaaa

SEQ ID NO: 1379059 - RNA, 23 nt, Neisseria meningitidis Z2491
auuuuuauaguggauuaacaaaa

SEQ ID NO: 1379060 - RNA, 23 nt, Neisseria meningitidis Z2491
auuuuuaugccacuuggucagaa

SEQ ID NO: 1379061 - RNA, 19 nt, Neisseria meningitidis Z2491
auuuuucaccgugauuuua

SEQ ID NO: 1379062 - RNA, 22 nt, Neisseria meningitidis Z2491
caaaauacauccuaaaaauuua

SEQ ID NO: 1379063 - RNA, 13 nt, Neisseria meningitidis Z2491
caaaauagaaaac

SEQ ID NO: 1379064 - RNA, 18 nt, Neisseria meningitidis Z2491
caaaauagaaaaccgaaa

SEQ ID NO: 1379065 - RNA, 16 nt, Neisseria meningitidis Z2491
caaaaucaguauagug

SEQ ID NO: 1379066 - RNA, 17 nt, Neisseria meningitidis Z2491
caaaaucagcacaaaug

SEQ ID NO: 1379067 - RNA, 21 nt, Neisseria meningitidis Z2491
caaaaucagaaaccuaaaauc

SEQ ID NO: 1379068 - RNA, 15 nt, Neisseria meningitidis Z2491
caaacaaaaaugccg

SEQ ID NO: 1379069 - RNA, 21 nt, Neisseria meningitidis Z2491
caaaauuuauccgaaacaaca

SEQ ID NO: 1379070 - RNA, 23 nt, Neisseria meningitidis Z2491
caaaaucggccauucccucaaaa

SEQ ID NO: 1379071 - RNA, 20 nt, Neisseria meningitidis Z2491
caaaaucuggauuacugaua

SEQ ID NO: 1379072 - RNA, 14 nt, Neisseria meningitidis Z2491
caaaaugccgucug

SEQ ID NO: 1379073 - RNA, 16 nt, Neisseria meningitidis Z2491
caaaaugccgucugaa

SEQ ID NO: 1379074 - RNA, 17 nt, Neisseria meningitidis Z2491
caaaaugccgucugaaa

SEQ ID NO: 1379075 - RNA, 17 nt, Neisseria meningitidis Z2491
caaaaugccgucugaac

SEQ ID NO: 1379076 - RNA, 23 nt, Neisseria meningitidis Z2491
caaaaugccgucugaagcgagca

SEQ ID NO: 1379077 - RNA, 22 nt, Neisseria meningitidis Z2491
caaaaugccgccugaacauuuc

SEQ ID NO: 1379078 - RNA, 16 nt, Neisseria meningitidis Z2491
caaacuccuuggaaug

SEQ ID NO: 1379079 - RNA, 17 nt, Neisseria meningitidis Z2491
caaacggcaggcaaaaa

SEQ ID NO: 1379080 - RNA, 14 nt, Neisseria meningitidis Z2491
caaacgggacugcc

SEQ ID NO: 1379081 - RNA, 17 nt, Neisseria meningitidis Z2491
caaacgguacaggaaag

SEQ ID NO: 1379082 - RNA, 18 nt, Neisseria meningitidis Z2491
caaacuaacuuauacaca

SEQ ID NO: 1379083 - RNA, 20 nt, Neisseria meningitidis Z2491
caaacuaacuuauacacacg

SEQ ID NO: 1379084 - RNA, 22 nt, Neisseria meningitidis Z2491
caaacuacccgguuuugcgccu

SEQ ID NO: 1379085 - RNA, 18 nt, Neisseria meningitidis Z2491
caaacuauaucuauacua

SEQ ID NO: 1379086 - RNA, 22 nt, Neisseria meningitidis Z2491
caaacuauaucuauacuaaaac

SEQ ID NO: 1379087 - RNA, 20 nt, Neisseria meningitidis Z2491
caaaccgggcauucgggguu

SEQ ID NO: 1379088 - RNA, 15 nt, Neisseria meningitidis Z2491
caaaccgucauuccc

SEQ ID NO: 1379089 - RNA, 22 nt, Neisseria meningitidis Z2491
caaaccgucgccgaacgccauc

SEQ ID NO: 1379090 - RNA, 14 nt, Neisseria meningitidis Z2491
caaaccgucugcca

SEQ ID NO: 1379091 - RNA, 20 nt, Neisseria meningitidis Z2491
caaacaggcuucagacggca

SEQ ID NO: 1379092 - RNA, 14 nt, Neisseria meningitidis Z2491
caaacaggcagccu

SEQ ID NO: 1379093 - RNA, 20 nt, Neisseria meningitidis Z2491
caaacaggcagccuaaaaca

SEQ ID NO: 1379094 - RNA, 22 nt, Neisseria meningitidis Z2491
caaacaggcagccuaaaacauc

SEQ ID NO: 1379095 - RNA, 20 nt, Neisseria meningitidis Z2491
caaacaucacggucuuuuug

SEQ ID NO: 1379096 - RNA, 18 nt, Neisseria meningitidis Z2491
caaaccccuucaaaccaa

SEQ ID NO: 1379097 - RNA, 22 nt, Neisseria meningitidis Z2491
caaaccccauucggagcaagac

SEQ ID NO: 1379098 - RNA, 19 nt, Neisseria meningitidis Z2491
caaacaucugauuuuucuu

SEQ ID NO: 1379099 - RNA, 18 nt, Neisseria meningitidis Z2491
caaacaugggcuaaaaau

SEQ ID NO: 1379100 - RNA, 16 nt, Neisseria meningitidis Z2491
caaacaucgcucaaau

SEQ ID NO: 1379101 - RNA, 23 nt, Neisseria meningitidis Z2491
caaaggggacagacggccaaaca

SEQ ID NO: 1379102 - RNA, 14 nt, Neisseria meningitidis Z2491
caaauaaagucuga

SEQ ID NO: 1379103 - RNA, 15 nt, Neisseria meningitidis Z2491
caaauaaauucugaa

SEQ ID NO: 1379104 - RNA, 18 nt, Neisseria meningitidis Z2491
caaaggcagugccgccaa

SEQ ID NO: 1379105 - RNA, 22 nt, Neisseria meningitidis Z2491
caaauauccggcaagccuuuca

SEQ ID NO: 1379106 - RNA, 17 nt, Neisseria meningitidis Z2491
caaauccccccuuaauc

SEQ ID NO: 1379107 - RNA, 14 nt, Neisseria meningitidis Z2491
caaagcggcuggga

SEQ ID NO: 1379108 - RNA, 21 nt, Neisseria meningitidis Z2491
caaagcgguuucuugugucau

SEQ ID NO: 1379109 - RNA, 15 nt, Neisseria meningitidis Z2491
caaagauuaucugaa

SEQ ID NO: 1379110 - RNA, 16 nt, Neisseria meningitidis Z2491
caaagauuaucugaaa

SEQ ID NO: 1379111 - RNA, 13 nt, Neisseria meningitidis Z2491
caaacuuccaaau

SEQ ID NO: 1379112 - RNA, 15 nt, Neisseria meningitidis Z2491
caaacuuccaaauca

SEQ ID NO: 1379113 - RNA, 15 nt, Neisseria meningitidis Z2491
caaagacauccccca

SEQ ID NO: 1379114 - RNA, 21 nt, Neisseria meningitidis Z2491
caaaucuuuggcaaccgucag

SEQ ID NO: 1379115 - RNA, 15 nt, Neisseria meningitidis Z2491
caaauuccuaaaacu

SEQ ID NO: 1379116 - RNA, 16 nt, Neisseria meningitidis Z2491
caaauuccagcaaugc

SEQ ID NO: 1379117 - RNA, 23 nt, Neisseria meningitidis Z2491
caaauuccaacucgacauuuucc

SEQ ID NO: 1379118 - RNA, 17 nt, Neisseria meningitidis Z2491
caaauuuuugauuucua

SEQ ID NO: 1379119 - RNA, 16 nt, Neisseria meningitidis Z2491
caacaaauuuuugauu

SEQ ID NO: 1379120 - RNA, 20 nt, Neisseria meningitidis Z2491
caacaccugcagauugagga

SEQ ID NO: 1379121 - RNA, 20 nt, Neisseria meningitidis Z2491
caacagauugucaaaauaca

SEQ ID NO: 1379122 - RNA, 15 nt, Neisseria meningitidis Z2491
caacagguucaaaca

SEQ ID NO: 1379123 - RNA, 17 nt, Neisseria meningitidis Z2491
caacagguucaaacaca

SEQ ID NO: 1379124 - RNA, 17 nt, Neisseria meningitidis Z2491
caaggcaacgaagccgu

SEQ ID NO: 1379125 - RNA, 14 nt, Neisseria meningitidis Z2491
caaggcaaggcaac

SEQ ID NO: 1379126 - RNA, 13 nt, Neisseria meningitidis Z2491
caagcgcauggac

SEQ ID NO: 1379127 - RNA, 19 nt, Neisseria meningitidis Z2491
caagccuguuuuccugccc

SEQ ID NO: 1379128 - RNA, 24 nt, Neisseria meningitidis Z2491
caagauuucaucauccugcuuuaa

SEQ ID NO: 1379129 - RNA, 15 nt, Neisseria meningitidis Z2491
caagugaaucgguuu

SEQ ID NO: 1379130 - RNA, 17 nt, Neisseria meningitidis Z2491
caaguguccggcagccu

SEQ ID NO: 1379131 - RNA, 15 nt, Neisseria meningitidis Z2491
caagguugucugaaa

SEQ ID NO: 1379132 - RNA, 22 nt, Neisseria meningitidis Z2491
caagggaaauccgccguaucca

SEQ ID NO: 1379133 - RNA, 23 nt, Neisseria meningitidis Z2491
caaucacgucaggcacgcgcugc

SEQ ID NO: 1379134 - RNA, 14 nt, Neisseria meningitidis Z2491
caaucaagaagaaa

SEQ ID NO: 1379135 - RNA, 15 nt, Neisseria meningitidis Z2491
caauauuaagaaaaa

SEQ ID NO: 1379136 - RNA, 20 nt, Neisseria meningitidis Z2491
caauauggugcugauaacau

SEQ ID NO: 1379137 - RNA, 20 nt, Neisseria meningitidis Z2491
caauaccuugagccaagcaa

SEQ ID NO: 1379138 - RNA, 14 nt, Neisseria meningitidis Z2491
caauauaucgaaca

SEQ ID NO: 1379139 - RNA, 18 nt, Neisseria meningitidis Z2491
caauaauggcaaccaaaa

SEQ ID NO: 1379140 - RNA, 12 nt, Neisseria meningitidis Z2491
caagaagcggcg

SEQ ID NO: 1379141 - RNA, 15 nt, Neisseria meningitidis Z2491
caagaagcggcggca

SEQ ID NO: 1379142 - RNA, 17 nt, Neisseria meningitidis Z2491
caagaacuuuaucccca

SEQ ID NO: 1379143 - RNA, 19 nt, Neisseria meningitidis Z2491
caagaacuuuauccccagc

SEQ ID NO: 1379144 - RNA, 21 nt, Neisseria meningitidis Z2491
caagaacuuuauccccagcga

SEQ ID NO: 1379145 - RNA, 24 nt, Neisseria meningitidis Z2491
caagaagaaagcggaauacggcaa

SEQ ID NO: 1379146 - RNA, 14 nt, Neisseria meningitidis Z2491
caacucuacggguu

SEQ ID NO: 1379147 - RNA, 20 nt, Neisseria meningitidis Z2491
caacucuccgucauucccac

SEQ ID NO: 1379148 - RNA, 22 nt, Neisseria meningitidis Z2491
caacuugguggucggcauucaa

SEQ ID NO: 1379149 - RNA, 17 nt, Neisseria meningitidis Z2491
caacuuugcguuucuag

SEQ ID NO: 1379150 - RNA, 16 nt, Neisseria meningitidis Z2491
caagaccaaacagaac

SEQ ID NO: 1379151 - RNA, 18 nt, Neisseria meningitidis Z2491
caagauaugcguagcaau

SEQ ID NO: 1379152 - RNA, 14 nt, Neisseria meningitidis Z2491
caacgcaagcggcg

SEQ ID NO: 1379153 - RNA, 17 nt, Neisseria meningitidis Z2491
caacgcacuggauuccc

SEQ ID NO: 1379154 - RNA, 21 nt, Neisseria meningitidis Z2491
caaccugcugcccaugaagag

SEQ ID NO: 1379155 - RNA, 14 nt, Neisseria meningitidis Z2491
caaccuuaacaauc

SEQ ID NO: 1379156 - RNA, 19 nt, Neisseria meningitidis Z2491
caacaucagcucgggcuga

SEQ ID NO: 1379157 - RNA, 14 nt, Neisseria meningitidis Z2491
caacgcgcaaaccc

SEQ ID NO: 1379158 - RNA, 18 nt, Neisseria meningitidis Z2491
caacgccggggcaaacau

SEQ ID NO: 1379159 - RNA, 20 nt, Neisseria meningitidis Z2491
caacgccgugcgguuuuuuu

SEQ ID NO: 1379160 - RNA, 20 nt, Neisseria meningitidis Z2491
caacgggaggaccucaaacg

SEQ ID NO: 1379161 - RNA, 22 nt, Neisseria meningitidis Z2491
caacgggaggaccucaaacgaa

SEQ ID NO: 1379162 - RNA, 20 nt, Neisseria meningitidis Z2491
auuuucaaaaugcaaaacuu

SEQ ID NO: 1379163 - RNA, 16 nt, Neisseria meningitidis Z2491
auuuucaaacauuacu

SEQ ID NO: 1379164 - RNA, 14 nt, Neisseria meningitidis Z2491
auuuuauaugggau

SEQ ID NO: 1379165 - RNA, 18 nt, Neisseria meningitidis Z2491
auuuuacagcggauuaaa

SEQ ID NO: 1379166 - RNA, 15 nt, Neisseria meningitidis Z2491
auuuuagguuuuugu

SEQ ID NO: 1379167 - RNA, 21 nt, Neisseria meningitidis Z2491
auuuuggagcaguaaaauuua

SEQ ID NO: 1379168 - RNA, 16 nt, Neisseria meningitidis Z2491
auuuugguagcugccg

SEQ ID NO: 1379169 - RNA, 18 nt, Neisseria meningitidis Z2491
auuuugguuuauuuuugg

SEQ ID NO: 1379170 - RNA, 17 nt, Neisseria meningitidis Z2491
auuuucuauuugauuuu

SEQ ID NO: 1379171 - RNA, 18 nt, Neisseria meningitidis Z2491
auuuucuugaguuucugu

SEQ ID NO: 1379172 - RNA, 20 nt, Neisseria meningitidis Z2491
auuuugcggcuugccgccgc

SEQ ID NO: 1379173 - RNA, 22 nt, Neisseria meningitidis Z2491
auuuugcagcccugauaaaaaa

SEQ ID NO: 1379174 - RNA, 14 nt, Neisseria meningitidis Z2491
auuucuaauuuuua

SEQ ID NO: 1379175 - RNA, 17 nt, Neisseria meningitidis Z2491
auuucuaauuuuuauag

SEQ ID NO: 1379176 - RNA, 19 nt, Neisseria meningitidis Z2491
auuucuagauucccacuuu

SEQ ID NO: 1379177 - RNA, 19 nt, Neisseria meningitidis Z2491
auuucuggauucccacuuu

SEQ ID NO: 1379178 - RNA, 14 nt, Neisseria meningitidis Z2491
auuucuguuuuucc

SEQ ID NO: 1379179 - RNA, 15 nt, Neisseria meningitidis Z2491
auuucuguuuuuccg

SEQ ID NO: 1379180 - RNA, 13 nt, Neisseria meningitidis Z2491
auuuggaauuuau

SEQ ID NO: 1379181 - RNA, 19 nt, Neisseria meningitidis Z2491
auuugaauccgcguguugu

SEQ ID NO: 1379182 - RNA, 16 nt, Neisseria meningitidis Z2491
auuugagcaaaugccg

SEQ ID NO: 1379183 - RNA, 17 nt, Neisseria meningitidis Z2491
auuguuuucucacgcag

SEQ ID NO: 1379184 - RNA, 21 nt, Neisseria meningitidis Z2491
auuuaaaaauuccuguuuuua

SEQ ID NO: 1379185 - RNA, 16 nt, Neisseria meningitidis Z2491
auuuaaaccaguacag

SEQ ID NO: 1379186 - RNA, 15 nt, Neisseria meningitidis Z2491
auuuacgauaugcaa

SEQ ID NO: 1379187 - RNA, 13 nt, Neisseria meningitidis Z2491
auuuacggugcag

SEQ ID NO: 1379188 - RNA, 17 nt, Neisseria meningitidis Z2491
auuuauauuguuauuuu

SEQ ID NO: 1379189 - RNA, 17 nt, Neisseria meningitidis Z2491
auuuagaaaaaauauac

SEQ ID NO: 1379190 - RNA, 20 nt, Neisseria meningitidis Z2491
auuuccucuuucaacggcac

SEQ ID NO: 1379191 - RNA, 17 nt, Neisseria meningitidis Z2491
auuuccgauaaauuccu

SEQ ID NO: 1379192 - RNA, 16 nt, Neisseria meningitidis Z2491
auuuccgacuggaugg

SEQ ID NO: 1379193 - RNA, 23 nt, Neisseria meningitidis Z2491
auuuccacaucguucaaaccguc

SEQ ID NO: 1379194 - RNA, 16 nt, Neisseria meningitidis Z2491
auuuccaaauauaaaa

SEQ ID NO: 1379195 - RNA, 23 nt, Neisseria meningitidis Z2491
auuuccaaauauaaaaaaugccg

SEQ ID NO: 1379196 - RNA, 13 nt, Neisseria meningitidis Z2491
auuucauuuuuca

SEQ ID NO: 1379197 - RNA, 17 nt, Neisseria meningitidis Z2491
auuucauuuuucauauc

SEQ ID NO: 1379198 - RNA, 21 nt, Neisseria meningitidis Z2491
auucccacggaagugggaauc

SEQ ID NO: 1379199 - RNA, 20 nt, Neisseria meningitidis Z2491
auucccacuuucgugggaau

SEQ ID NO: 1379200 - RNA, 17 nt, Neisseria meningitidis Z2491
auucccacuuuuguggg

SEQ ID NO: 1379201 - RNA, 18 nt, Neisseria meningitidis Z2491
auucccacgaaaguggga

SEQ ID NO: 1379202 - RNA, 20 nt, Neisseria meningitidis Z2491
auucccacgaaagugggaau

SEQ ID NO: 1379203 - RNA, 21 nt, Neisseria meningitidis Z2491
auucccacgaaagugggaauc

SEQ ID NO: 1379204 - RNA, 17 nt, Neisseria meningitidis Z2491
auucccgagaaaacaga

SEQ ID NO: 1379205 - RNA, 23 nt, Neisseria meningitidis Z2491
auuccccucggggucuuuggcaa

SEQ ID NO: 1379206 - RNA, 18 nt, Neisseria meningitidis Z2491
auucccgccaucuaaaau

SEQ ID NO: 1379207 - RNA, 19 nt, Neisseria meningitidis Z2491
auucccgcgaaaaauagaa

SEQ ID NO: 1379208 - RNA, 23 nt, Neisseria meningitidis Z2491
auucccgcgaaagcggaaaucca

SEQ ID NO: 1379209 - RNA, 12 nt, Neisseria meningitidis Z2491
auucccgccugc

SEQ ID NO: 1379210 - RNA, 18 nt, Neisseria meningitidis Z2491
auucccgcgagaacagaa

SEQ ID NO: 1379211 - RNA, 20 nt, Neisseria meningitidis Z2491
auucccgcgagaacagaaaa

SEQ ID NO: 1379212 - RNA, 23 nt, Neisseria meningitidis Z2491
auucccgcgcaggcagaaaucca

SEQ ID NO: 1379213 - RNA, 14 nt, Neisseria meningitidis Z2491
auucccuucccucc

SEQ ID NO: 1379214 - RNA, 20 nt, Neisseria meningitidis Z2491
auucccugucuuucaauaua

SEQ ID NO: 1379215 - RNA, 21 nt, Neisseria meningitidis Z2491
auucccugucuuucaauauac

SEQ ID NO: 1379216 - RNA, 14 nt, Neisseria meningitidis Z2491
auucccucucccgu

SEQ ID NO: 1379217 - RNA, 15 nt, Neisseria meningitidis Z2491
auucccucaaaaaca

SEQ ID NO: 1379218 - RNA, 18 nt, Neisseria meningitidis Z2491
auucccucaaaaacagaa

SEQ ID NO: 1379219 - RNA, 19 nt, Neisseria meningitidis Z2491
auucccucaaaaacagaaa

SEQ ID NO: 1379220 - RNA, 23 nt, Neisseria meningitidis Z2491
auucccguccggcaaacaucacg

SEQ ID NO: 1379221 - RNA, 15 nt, Neisseria meningitidis Z2491
auucccgugaaaacg

SEQ ID NO: 1379222 - RNA, 16 nt, Neisseria meningitidis Z2491
auucccgugguuuuuc

SEQ ID NO: 1379223 - RNA, 14 nt, Neisseria meningitidis Z2491
auucccguuucaga

SEQ ID NO: 1379224 - RNA, 19 nt, Neisseria meningitidis Z2491
auuccguuaucccauaaaa

SEQ ID NO: 1379225 - RNA, 17 nt, Neisseria meningitidis Z2491
auuccgccgauguaaac

SEQ ID NO: 1379226 - RNA, 12 nt, Neisseria meningitidis Z2491
auucgagcgcgg

SEQ ID NO: 1379227 - RNA, 19 nt, Neisseria meningitidis Z2491
auucgacgcgcuugauguc

SEQ ID NO: 1379228 - RNA, 13 nt, Neisseria meningitidis Z2491
auuccuucauggc

SEQ ID NO: 1379229 - RNA, 23 nt, Neisseria meningitidis Z2491
auuccuguugcuuuucauuucua

SEQ ID NO: 1379230 - RNA, 16 nt, Neisseria meningitidis Z2491
auuccuguuguuuuuu

SEQ ID NO: 1379231 - RNA, 20 nt, Neisseria meningitidis Z2491
auuccuguaaaaacaaaaaa

SEQ ID NO: 1379232 - RNA, 17 nt, Neisseria meningitidis Z2491
auuccugcgcgaacagc

SEQ ID NO: 1379233 - RNA, 18 nt, Neisseria meningitidis Z2491
auucauaaaauauuugca

SEQ ID NO: 1379234 - RNA, 23 nt, Neisseria meningitidis Z2491
auucauacacagccaaaaaaaag

SEQ ID NO: 1379235 - RNA, 21 nt, Neisseria meningitidis Z2491
auucauacugugggaaacuuu

SEQ ID NO: 1379236 - RNA, 17 nt, Neisseria meningitidis Z2491
auuccaucaacaaaaug

SEQ ID NO: 1379237 - RNA, 20 nt, Neisseria meningitidis Z2491
auuccaucaacaaaaugccg

SEQ ID NO: 1379238 - RNA, 19 nt, Neisseria meningitidis Z2491
auugaaugucuagauuccc

SEQ ID NO: 1379239 - RNA, 16 nt, Neisseria meningitidis Z2491
auugcgggaauagcuc

SEQ ID NO: 1379240 - RNA, 13 nt, Neisseria meningitidis Z2491
auucgucauuccc

SEQ ID NO: 1379241 - RNA, 15 nt, Neisseria meningitidis Z2491
auucuacccaaaucc

SEQ ID NO: 1379242 - RNA, 21 nt, Neisseria meningitidis Z2491
auucuagauucccgccugcgc

SEQ ID NO: 1379243 - RNA, 17 nt, Neisseria meningitidis Z2491
auucucaugaucuucuu

SEQ ID NO: 1379244 - RNA, 17 nt, Neisseria meningitidis Z2491
auucuucuuuccaucca

SEQ ID NO: 1379245 - RNA, 20 nt, Neisseria meningitidis Z2491
auucuucuuuccauccauca

SEQ ID NO: 1379246 - RNA, 13 nt, Neisseria meningitidis Z2491
auucugcaaaaau

SEQ ID NO: 1379247 - RNA, 12 nt, Neisseria meningitidis Z2491
auucugauuuau

SEQ ID NO: 1379248 - RNA, 12 nt, Neisseria meningitidis Z2491
auugaaauucca

SEQ ID NO: 1379249 - RNA, 19 nt, Neisseria meningitidis Z2491
auugaaauuccagauuccc

SEQ ID NO: 1379250 - RNA, 22 nt, Neisseria meningitidis Z2491
auucuuugaaaacagguuuaag

SEQ ID NO: 1379251 - RNA, 20 nt, Neisseria meningitidis Z2491
auucuuucgcuugugaaaau

SEQ ID NO: 1379252 - RNA, 17 nt, Neisseria meningitidis Z2491
auucuugucaaaccaac

SEQ ID NO: 1379253 - RNA, 20 nt, Neisseria meningitidis Z2491
auucuugauggcgaaagcaa

SEQ ID NO: 1379254 - RNA, 15 nt, Neisseria meningitidis Z2491
auucuugcaaaauag

SEQ ID NO: 1379255 - RNA, 14 nt, Neisseria meningitidis Z2491
auucuugcaacuuu

SEQ ID NO: 1379256 - RNA, 17 nt, Neisseria meningitidis Z2491
cacuauaauccaccaua

SEQ ID NO: 1379257 - RNA, 20 nt, Neisseria meningitidis Z2491
cacuauaauccaccauauuu

SEQ ID NO: 1379258 - RNA, 22 nt, Neisseria meningitidis Z2491
cacuauaguuuuuuugaauuuc

SEQ ID NO: 1379259 - RNA, 22 nt, Neisseria meningitidis Z2491
cacuaucauauagauuuuuaug

SEQ ID NO: 1379260 - RNA, 20 nt, Neisseria meningitidis Z2491
cacuauaucgucauucccgc

SEQ ID NO: 1379261 - RNA, 20 nt, Neisseria meningitidis Z2491
cacgucguaggcuuuuucca

SEQ ID NO: 1379262 - RNA, 22 nt, Neisseria meningitidis Z2491
cacgucguaggcuuuuuccaau

SEQ ID NO: 1379263 - RNA, 17 nt, Neisseria meningitidis Z2491
cacguucgcaggcuucg

SEQ ID NO: 1379264 - RNA, 23 nt, Neisseria meningitidis Z2491
cacgucauuccuacgaaccuaca

SEQ ID NO: 1379265 - RNA, 17 nt, Neisseria meningitidis Z2491
cacgguucugcaccgcu

SEQ ID NO: 1379266 - RNA, 20 nt, Neisseria meningitidis Z2491
cacgguggcaucgucagacc

SEQ ID NO: 1379267 - RNA, 16 nt, Neisseria meningitidis Z2491
cacggcuuucgcgccg

SEQ ID NO: 1379268 - RNA, 19 nt, Neisseria meningitidis Z2491
cacggcuuucgcgccgcgc

SEQ ID NO: 1379269 - RNA, 22 nt, Neisseria meningitidis Z2491
cacgauauuacgaacaaugcaa

SEQ ID NO: 1379270 - RNA, 21 nt, Neisseria meningitidis Z2491
cacgauacacaaaaaagccag

SEQ ID NO: 1379271 - RNA, 15 nt, Neisseria meningitidis Z2491
cacgcaugaagccgu

SEQ ID NO: 1379272 - RNA, 15 nt, Neisseria meningitidis Z2491
cacgcauuccgacag

SEQ ID NO: 1379273 - RNA, 20 nt, Neisseria meningitidis Z2491
cacgccgccugcaaaggcaa

SEQ ID NO: 1379274 - RNA, 22 nt, Neisseria meningitidis Z2491
cacgccgaacccgacuucugac

SEQ ID NO: 1379275 - RNA, 16 nt, Neisseria meningitidis Z2491
cacgcgcaccugacgc

SEQ ID NO: 1379276 - RNA, 14 nt, Neisseria meningitidis Z2491
cacgcgcuucaaau

SEQ ID NO: 1379277 - RNA, 21 nt, Neisseria meningitidis Z2491
cacgcgcccaucgucuagagg

SEQ ID NO: 1379278 - RNA, 12 nt, Neisseria meningitidis Z2491
cacggcaaaaau

SEQ ID NO: 1379279 - RNA, 14 nt, Neisseria meningitidis Z2491
cacggcgcaggcaa

SEQ ID NO: 1379280 - RNA, 23 nt, Neisseria meningitidis Z2491
cacccgccccgccgaucugcccg

SEQ ID NO: 1379281 - RNA, 22 nt, Neisseria meningitidis Z2491
cacccuaccauuguuucugaag

SEQ ID NO: 1379282 - RNA, 19 nt, Neisseria meningitidis Z2491
cacccugcaaggcggcggc

SEQ ID NO: 1379283 - RNA, 14 nt, Neisseria meningitidis Z2491
cacccuuaagauuu

SEQ ID NO: 1379284 - RNA, 22 nt, Neisseria meningitidis Z2491
caccgauggauuuuuuuguugc

SEQ ID NO: 1379285 - RNA, 18 nt, Neisseria meningitidis Z2491
caccgaucaggcuuucac

SEQ ID NO: 1379286 - RNA, 15 nt, Neisseria meningitidis Z2491
caccgacggaauaug

SEQ ID NO: 1379287 - RNA, 22 nt, Neisseria meningitidis Z2491
caccgcuuuguccaaaucggca

SEQ ID NO: 1379288 - RNA, 20 nt, Neisseria meningitidis Z2491
caccgccgcuccgcaaacaa

SEQ ID NO: 1379289 - RNA, 13 nt, Neisseria meningitidis Z2491
caccgcgcauuug

SEQ ID NO: 1379290 - RNA, 13 nt, Neisseria meningitidis Z2491
caccuuagagaau

SEQ ID NO: 1379291 - RNA, 21 nt, Neisseria meningitidis Z2491
caccuuagagaaucguucucu

SEQ ID NO: 1379292 - RNA, 15 nt, Neisseria meningitidis Z2491
cacgaaucuuaucca

SEQ ID NO: 1379293 - RNA, 18 nt, Neisseria meningitidis Z2491
cacgaaucuuauccacag

SEQ ID NO: 1379294 - RNA, 12 nt, Neisseria meningitidis Z2491
cacgaagcccuc

SEQ ID NO: 1379295 - RNA, 22 nt, Neisseria meningitidis Z2491
cacgaagcccucagcuaugccu

SEQ ID NO: 1379296 - RNA, 18 nt, Neisseria meningitidis Z2491
caccuuugggcucaauga

SEQ ID NO: 1379297 - RNA, 24 nt, Neisseria meningitidis Z2491
cacgacgcagaccguccacaagcc

SEQ ID NO: 1379298 - RNA, 21 nt, Neisseria meningitidis Z2491
caccugcagauugaggaucuu

SEQ ID NO: 1379299 - RNA, 16 nt, Neisseria meningitidis Z2491
caccugcauaaucagu

SEQ ID NO: 1379300 - RNA, 13 nt, Neisseria meningitidis Z2491
caccguucagccc

SEQ ID NO: 1379301 - RNA, 15 nt, Neisseria meningitidis Z2491
caccguuauggaaau

SEQ ID NO: 1379302 - RNA, 21 nt, Neisseria meningitidis Z2491
caccguacugguuuaaauuua

SEQ ID NO: 1379303 - RNA, 19 nt, Neisseria meningitidis Z2491
caccgggcuucaucugccg

SEQ ID NO: 1379304 - RNA, 15 nt, Neisseria meningitidis Z2491
caccagcccgccgcg

SEQ ID NO: 1379305 - RNA, 17 nt, Neisseria meningitidis Z2491
caccagcccgccgcgcc

SEQ ID NO: 1379306 - RNA, 18 nt, Neisseria meningitidis Z2491
caccauccucaucaacgc

SEQ ID NO: 1379307 - RNA, 16 nt, Neisseria meningitidis Z2491
caccaauucuucaaau

SEQ ID NO: 1379308 - RNA, 19 nt, Neisseria meningitidis Z2491
caccacgucauucccacga

SEQ ID NO: 1379309 - RNA, 21 nt, Neisseria meningitidis Z2491
cacauuuucuauuugauuuuc

SEQ ID NO: 1379310 - RNA, 14 nt, Neisseria meningitidis Z2491
cacauuuguuccaa

SEQ ID NO: 1379311 - RNA, 20 nt, Neisseria meningitidis Z2491
cacauccuccaucacaacuu

SEQ ID NO: 1379312 - RNA, 17 nt, Neisseria meningitidis Z2491
cacaucguucaaaccgu

SEQ ID NO: 1379313 - RNA, 14 nt, Neisseria meningitidis Z2491
cacaucgucugcaa

SEQ ID NO: 1379314 - RNA, 23 nt, Neisseria meningitidis Z2491
cacaucgucugcaagcagcaggc

SEQ ID NO: 1379315 - RNA, 17 nt, Neisseria meningitidis Z2491
cacagauaccgucugaa

SEQ ID NO: 1379316 - RNA, 16 nt, Neisseria meningitidis Z2491
cacagccaaaaaaaag

SEQ ID NO: 1379317 - RNA, 22 nt, Neisseria meningitidis Z2491
cacagccaaaauauucaauuga

SEQ ID NO: 1379318 - RNA, 14 nt, Neisseria meningitidis Z2491
cacauaauucaaau

SEQ ID NO: 1379319 - RNA, 17 nt, Neisseria meningitidis Z2491
cacaggggagggaguca

SEQ ID NO: 1379320 - RNA, 16 nt, Neisseria meningitidis Z2491
cacaagguuauuuucu

SEQ ID NO: 1379321 - RNA, 17 nt, Neisseria meningitidis Z2491
cacacacaagccguaca

SEQ ID NO: 1379322 - RNA, 18 nt, Neisseria meningitidis Z2491
cacacaccggcaaacacc

SEQ ID NO: 1379323 - RNA, 21 nt, Neisseria meningitidis Z2491
cacaauucccaccguuuccca

SEQ ID NO: 1379324 - RNA, 16 nt, Neisseria meningitidis Z2491
cacacgaacugccucc

SEQ ID NO: 1379325 - RNA, 17 nt, Neisseria meningitidis Z2491
cacacguuuugcaggua

SEQ ID NO: 1379326 - RNA, 23 nt, Neisseria meningitidis Z2491
cacacgguuuucacaucuuuaga

SEQ ID NO: 1379327 - RNA, 21 nt, Neisseria meningitidis Z2491
cacacucuucgucauucccgu

SEQ ID NO: 1379328 - RNA, 14 nt, Neisseria meningitidis Z2491
cacaacacgcaaaa

SEQ ID NO: 1379329 - RNA, 20 nt, Neisseria meningitidis Z2491
cacaaacgccagcacaaaca

SEQ ID NO: 1379330 - RNA, 17 nt, Neisseria meningitidis Z2491
cacaaaagauacacaca

SEQ ID NO: 1379331 - RNA, 20 nt, Neisseria meningitidis Z2491
cacaaagccuucuucuaaaa

SEQ ID NO: 1379332 - RNA, 10 nt, Neisseria meningitidis Z2491
cacaaaggag

SEQ ID NO: 1379333 - RNA, 17 nt, Neisseria meningitidis Z2491
cacaaaugccaaaggca

SEQ ID NO: 1379334 - RNA, 13 nt, Neisseria meningitidis Z2491
caauuuuuuaaau

SEQ ID NO: 1379335 - RNA, 16 nt, Neisseria meningitidis Z2491
cacaaaaaacuucccg

SEQ ID NO: 1379336 - RNA, 19 nt, Neisseria meningitidis Z2491
cacaaaaaacuucccgucc

SEQ ID NO: 1379337 - RNA, 15 nt, Neisseria meningitidis Z2491
cacaaaaacagaaaa

SEQ ID NO: 1379338 - RNA, 21 nt, Neisseria meningitidis Z2491
caauuuaucggaaaugacuga

SEQ ID NO: 1379339 - RNA, 23 nt, Neisseria meningitidis Z2491
caauuucaaaucccgucauuccc

SEQ ID NO: 1379340 - RNA, 15 nt, Neisseria meningitidis Z2491
caaucaggaaaacag

SEQ ID NO: 1379341 - RNA, 20 nt, Neisseria meningitidis Z2491
caaucagaauacugccugua

SEQ ID NO: 1379342 - RNA, 15 nt, Neisseria meningitidis Z2491
caauucacuuggugc

SEQ ID NO: 1379343 - RNA, 12 nt, Neisseria meningitidis Z2491
caauucaaaauu

SEQ ID NO: 1379344 - RNA, 18 nt, Neisseria meningitidis Z2491
caauugaaaaauuuuugg

SEQ ID NO: 1379345 - RNA, 17 nt, Neisseria meningitidis Z2491
caauugaaaauuuuuug

SEQ ID NO: 1379346 - RNA, 16 nt, Neisseria meningitidis Z2491
auccuguuauuuucac

SEQ ID NO: 1379347 - RNA, 18 nt, Neisseria meningitidis Z2491
auccuucccgcaaaaacg

SEQ ID NO: 1379348 - RNA, 15 nt, Neisseria meningitidis Z2491
aucgaaccaaauaaa

SEQ ID NO: 1379349 - RNA, 16 nt, Neisseria meningitidis Z2491
aucgaaccaaauaaac

SEQ ID NO: 1379350 - RNA, 20 nt, Neisseria meningitidis Z2491
aucgacgacgauuaauaccg

SEQ ID NO: 1379351 - RNA, 16 nt, Neisseria meningitidis Z2491
aucgaccgcuuccucg

SEQ ID NO: 1379352 - RNA, 18 nt, Neisseria meningitidis Z2491
aucgacacccgccccgcc

SEQ ID NO: 1379353 - RNA, 22 nt, Neisseria meningitidis Z2491
aucgacugcaguaacuucaaac

SEQ ID NO: 1379354 - RNA, 20 nt, Neisseria meningitidis Z2491
aucgccgacgaccaaugccu

SEQ ID NO: 1379355 - RNA, 22 nt, Neisseria meningitidis Z2491
aucggcaagguugcgucugccu

SEQ ID NO: 1379356 - RNA, 20 nt, Neisseria meningitidis Z2491
aucggcaaucacgucaggca

SEQ ID NO: 1379357 - RNA, 16 nt, Neisseria meningitidis Z2491
aucggcaaugcgcccg

SEQ ID NO: 1379358 - RNA, 19 nt, Neisseria meningitidis Z2491
aucggacggauguucaaac

SEQ ID NO: 1379359 - RNA, 14 nt, Neisseria meningitidis Z2491
aucggaaaaacagc

SEQ ID NO: 1379360 - RNA, 21 nt, Neisseria meningitidis Z2491
aucgcuggcgauaugcuucaa

SEQ ID NO: 1379361 - RNA, 15 nt, Neisseria meningitidis Z2491
aucgucugcaagcag

SEQ ID NO: 1379362 - RNA, 21 nt, Neisseria meningitidis Z2491
aucguuuacgauuacuuauuu

SEQ ID NO: 1379363 - RNA, 18 nt, Neisseria meningitidis Z2491
aucuaaaaauucuaacuc

SEQ ID NO: 1379364 - RNA, 13 nt, Neisseria meningitidis Z2491
aucguuuuuuccc

SEQ ID NO: 1379365 - RNA, 21 nt, Neisseria meningitidis Z2491
aucguaaaaaugccgucugaa

SEQ ID NO: 1379366 - RNA, 19 nt, Neisseria meningitidis Z2491
aucguauuggggcaaagcg

SEQ ID NO: 1379367 - RNA, 15 nt, Neisseria meningitidis Z2491
auccugcuuuaauuc

SEQ ID NO: 1379368 - RNA, 21 nt, Neisseria meningitidis Z2491
auccugcacgcgcuucaaauc

SEQ ID NO: 1379369 - RNA, 13 nt, Neisseria meningitidis Z2491
auccugccuucau

SEQ ID NO: 1379370 - RNA, 13 nt, Neisseria meningitidis Z2491
auccuccaccauu

SEQ ID NO: 1379371 - RNA, 14 nt, Neisseria meningitidis Z2491
auccuccaucacaa

SEQ ID NO: 1379372 - RNA, 15 nt, Neisseria meningitidis Z2491
auccucccacucuuu

SEQ ID NO: 1379373 - RNA, 20 nt, Neisseria meningitidis Z2491
auccucccacucuuucaaca

SEQ ID NO: 1379374 - RNA, 22 nt, Neisseria meningitidis Z2491
auccucccacucuuucaacagc

SEQ ID NO: 1379375 - RNA, 14 nt, Neisseria meningitidis Z2491
auccgggauuuuaa

SEQ ID NO: 1379376 - RNA, 14 nt, Neisseria meningitidis Z2491
auccggucuuggca

SEQ ID NO: 1379377 - RNA, 22 nt, Neisseria meningitidis Z2491
auccgguuggucggcuucuuuu

SEQ ID NO: 1379378 - RNA, 21 nt, Neisseria meningitidis Z2491
auccguuugguuuuauagugg

SEQ ID NO: 1379379 - RNA, 22 nt, Neisseria meningitidis Z2491
auccguuugguuuuauagugga

SEQ ID NO: 1379380 - RNA, 16 nt, Neisseria meningitidis Z2491
auccuaguuauccagg

SEQ ID NO: 1379381 - RNA, 15 nt, Neisseria meningitidis Z2491
auccgaaacaacaaa

SEQ ID NO: 1379382 - RNA, 17 nt, Neisseria meningitidis Z2491
auccgcaaacggcagca

SEQ ID NO: 1379383 - RNA, 17 nt, Neisseria meningitidis Z2491
auccgcacagaaaccug

SEQ ID NO: 1379384 - RNA, 21 nt, Neisseria meningitidis Z2491
auccgccaaaaacggcacggc

SEQ ID NO: 1379385 - RNA, 14 nt, Neisseria meningitidis Z2491
auccgccaaccugc

SEQ ID NO: 1379386 - RNA, 23 nt, Neisseria meningitidis Z2491
auccgccaaccugcugcccauga

SEQ ID NO: 1379387 - RNA, 23 nt, Neisseria meningitidis Z2491
auccgccggcaauauugcuccug

SEQ ID NO: 1379388 - RNA, 20 nt, Neisseria meningitidis Z2491
auccgcguguuguuuuaaag

SEQ ID NO: 1379389 - RNA, 18 nt, Neisseria meningitidis Z2491
auccggcaagaauuuuua

SEQ ID NO: 1379390 - RNA, 19 nt, Neisseria meningitidis Z2491
aucccgucauucccgcgaa

SEQ ID NO: 1379391 - RNA, 19 nt, Neisseria meningitidis Z2491
aucccgucauucccgcgca

SEQ ID NO: 1379392 - RNA, 23 nt, Neisseria meningitidis Z2491
auccaguuucuugaguuucaguc

SEQ ID NO: 1379393 - RNA, 14 nt, Neisseria meningitidis Z2491
aucccaauauuaag

SEQ ID NO: 1379394 - RNA, 19 nt, Neisseria meningitidis Z2491
aucccaaacaucgcucaaa

SEQ ID NO: 1379395 - RNA, 19 nt, Neisseria meningitidis Z2491
aucccauauuccacaguga

SEQ ID NO: 1379396 - RNA, 17 nt, Neisseria meningitidis Z2491
auccaucccauauucca

SEQ ID NO: 1379397 - RNA, 15 nt, Neisseria meningitidis Z2491
auccaucaguuucca

SEQ ID NO: 1379398 - RNA, 20 nt, Neisseria meningitidis Z2491
auccaucaguuuccacuaaa

SEQ ID NO: 1379399 - RNA, 21 nt, Neisseria meningitidis Z2491
auccauagauaaauuucagau

SEQ ID NO: 1379400 - RNA, 22 nt, Neisseria meningitidis Z2491
auccauaccaaacagcgcggcg

SEQ ID NO: 1379401 - RNA, 15 nt, Neisseria meningitidis Z2491
auccagacauucaau

SEQ ID NO: 1379402 - RNA, 13 nt, Neisseria meningitidis Z2491
auccagaaagugg

SEQ ID NO: 1379403 - RNA, 16 nt, Neisseria meningitidis Z2491
auccagaaaaucggac

SEQ ID NO: 1379404 - RNA, 15 nt, Neisseria meningitidis Z2491
auccacuauaaaaac

SEQ ID NO: 1379405 - RNA, 16 nt, Neisseria meningitidis Z2491
auccacuauaaaaggu

SEQ ID NO: 1379406 - RNA, 19 nt, Neisseria meningitidis Z2491
auccacuauaacagcaacc

SEQ ID NO: 1379407 - RNA, 14 nt, Neisseria meningitidis Z2491
auccacuauaauga

SEQ ID NO: 1379408 - RNA, 13 nt, Neisseria meningitidis Z2491
auccacuauauga

SEQ ID NO: 1379409 - RNA, 18 nt, Neisseria meningitidis Z2491
auccacuauaugagugua

SEQ ID NO: 1379410 - RNA, 15 nt, Neisseria meningitidis Z2491
auccacuauauuuuc

SEQ ID NO: 1379411 - RNA, 12 nt, Neisseria meningitidis Z2491
auccaaggcauc

SEQ ID NO: 1379412 - RNA, 22 nt, Neisseria meningitidis Z2491
auccaaggcaucauggcacgca

SEQ ID NO: 1379413 - RNA, 20 nt, Neisseria meningitidis Z2491
auccacagagauuguuuccc

SEQ ID NO: 1379414 - RNA, 21 nt, Neisseria meningitidis Z2491
auccacagccgcaaaagccag

SEQ ID NO: 1379415 - RNA, 16 nt, Neisseria meningitidis Z2491
auccacaguuuuucca

SEQ ID NO: 1379416 - RNA, 20 nt, Neisseria meningitidis Z2491
aucauugcgggaauagcuca

SEQ ID NO: 1379417 - RNA, 23 nt, Neisseria meningitidis Z2491
aucauugcauggacauucucuug

SEQ ID NO: 1379418 - RNA, 12 nt, Neisseria meningitidis Z2491
aucauuucagga

SEQ ID NO: 1379419 - RNA, 13 nt, Neisseria meningitidis Z2491
auccaaaaauacg

SEQ ID NO: 1379420 - RNA, 14 nt, Neisseria meningitidis Z2491
auccaaaaauacgc

SEQ ID NO: 1379421 - RNA, 23 nt, Neisseria meningitidis Z2491
aucauggcgcguuggcguuggcc

SEQ ID NO: 1379422 - RNA, 14 nt, Neisseria meningitidis Z2491
aucaugcggaagaa

SEQ ID NO: 1379423 - RNA, 20 nt, Neisseria meningitidis Z2491
aucaucggaaacagcauccu

SEQ ID NO: 1379424 - RNA, 21 nt, Neisseria meningitidis Z2491
aucaucggaaacagcauccuu

SEQ ID NO: 1379425 - RNA, 14 nt, Neisseria meningitidis Z2491
aucaguuuccaguu

SEQ ID NO: 1379426 - RNA, 17 nt, Neisseria meningitidis Z2491
aucauauagauuuuuau

SEQ ID NO: 1379427 - RNA, 14 nt, Neisseria meningitidis Z2491
aucauagaaaucag

SEQ ID NO: 1379428 - RNA, 18 nt, Neisseria meningitidis Z2491
aucagggcugcaaaauuu

SEQ ID NO: 1379429 - RNA, 13 nt, Neisseria meningitidis Z2491
aucagggccuuga

SEQ ID NO: 1379430 - RNA, 14 nt, Neisseria meningitidis Z2491
aucagguuaucacu

SEQ ID NO: 1379431 - RNA, 15 nt, Neisseria meningitidis Z2491
aucagguugaaaaug

SEQ ID NO: 1379432 - RNA, 20 nt, Neisseria meningitidis Z2491
aucaggcguaauguugugca

SEQ ID NO: 1379433 - RNA, 18 nt, Neisseria meningitidis Z2491
aucaggcaucacauaaug

SEQ ID NO: 1379434 - RNA, 20 nt, Neisseria meningitidis Z2491
aucaggcguuuccaaaguga

SEQ ID NO: 1379435 - RNA, 12 nt, Neisseria meningitidis Z2491
aucaggacucga

SEQ ID NO: 1379436 - RNA, 13 nt, Neisseria meningitidis Z2491
aucaggaaaacag

SEQ ID NO: 1379437 - RNA, 14 nt, Neisseria meningitidis Z2491
aucaggacaaggcg

SEQ ID NO: 1379438 - RNA, 17 nt, Neisseria meningitidis Z2491
aucaggacaaggcggcg

SEQ ID NO: 1379439 - RNA, 17 nt, Neisseria meningitidis Z2491
aucaggaacaucagcac

SEQ ID NO: 1379440 - RNA, 17 nt, Neisseria meningitidis Z2491
augcggccgcgcccgca

SEQ ID NO: 1379441 - RNA, 13 nt, Neisseria meningitidis Z2491
augcaugauuauc

SEQ ID NO: 1379442 - RNA, 17 nt, Neisseria meningitidis Z2491
augcggucgugcagccu

SEQ ID NO: 1379443 - RNA, 18 nt, Neisseria meningitidis Z2491
augcgggaacuugauuca

SEQ ID NO: 1379444 - RNA, 22 nt, Neisseria meningitidis Z2491
augcggcgggcuuggaaaucuu

SEQ ID NO: 1379445 - RNA, 14 nt, Neisseria meningitidis Z2491
augcgucaaauuuc

SEQ ID NO: 1379446 - RNA, 22 nt, Neisseria meningitidis Z2491
augcguuuucggguucccauac

SEQ ID NO: 1379447 - RNA, 17 nt, Neisseria meningitidis Z2491
augcucaaucucauuuu

SEQ ID NO: 1379448 - RNA, 19 nt, Neisseria meningitidis Z2491
augcucaaucucauuuuca

SEQ ID NO: 1379449 - RNA, 18 nt, Neisseria meningitidis Z2491
augcucaaucuuauuuuc

SEQ ID NO: 1379450 - RNA, 16 nt, Neisseria meningitidis Z2491
augcuauucaaauuua

SEQ ID NO: 1379451 - RNA, 14 nt, Neisseria meningitidis Z2491
augcuaaggcaauu

SEQ ID NO: 1379452 - RNA, 21 nt, Neisseria meningitidis Z2491
augcuaaggcaauuucucgga

SEQ ID NO: 1379453 - RNA, 20 nt, Neisseria meningitidis Z2491
augcuucggucagguucaaa

SEQ ID NO: 1379454 - RNA, 13 nt, Neisseria meningitidis Z2491
augcugcggaugu

SEQ ID NO: 1379455 - RNA, 16 nt, Neisseria meningitidis Z2491
augcugcggauguuug

SEQ ID NO: 1379456 - RNA, 16 nt, Neisseria meningitidis Z2491
auggaaccguuuuccg

SEQ ID NO: 1379457 - RNA, 21 nt, Neisseria meningitidis Z2491
auggaucagacauuaaaaaau

SEQ ID NO: 1379458 - RNA, 22 nt, Neisseria meningitidis Z2491
auggaucagacauuaaaaaaua

SEQ ID NO: 1379459 - RNA, 20 nt, Neisseria meningitidis Z2491
auggacgacgcggcugcugc

SEQ ID NO: 1379460 - RNA, 16 nt, Neisseria meningitidis Z2491
auguuauuauuuucca

SEQ ID NO: 1379461 - RNA, 18 nt, Neisseria meningitidis Z2491
auguguugcccugauucg

SEQ ID NO: 1379462 - RNA, 18 nt, Neisseria meningitidis Z2491
augucguugucaaccaaa

SEQ ID NO: 1379463 - RNA, 21 nt, Neisseria meningitidis Z2491
augucguugucaaccaaaaaa

SEQ ID NO: 1379464 - RNA, 17 nt, Neisseria meningitidis Z2491
augucgugcagauggcu

SEQ ID NO: 1379465 - RNA, 15 nt, Neisseria meningitidis Z2491
augugcucggguugu

SEQ ID NO: 1379466 - RNA, 22 nt, Neisseria meningitidis Z2491
augucggguucggauauuuccg

SEQ ID NO: 1379467 - RNA, 12 nt, Neisseria meningitidis Z2491
auguaaauuuuu

SEQ ID NO: 1379468 - RNA, 16 nt, Neisseria meningitidis Z2491
auguaaauuuuuaaau

SEQ ID NO: 1379469 - RNA, 21 nt, Neisseria meningitidis Z2491
auguagauuuuuuuauuuaaa

SEQ ID NO: 1379470 - RNA, 22 nt, Neisseria meningitidis Z2491
auguagauuuuuuuauuuaaac

SEQ ID NO: 1379471 - RNA, 18 nt, Neisseria meningitidis Z2491
auggucaauacacaaggu

SEQ ID NO: 1379472 - RNA, 19 nt, Neisseria meningitidis Z2491
auggcuucuaaaaauucuu

SEQ ID NO: 1379473 - RNA, 14 nt, Neisseria meningitidis Z2491
auggcaaccaaaac

SEQ ID NO: 1379474 - RNA, 18 nt, Neisseria meningitidis Z2491
auggcaaaacggccgcaa

SEQ ID NO: 1379475 - RNA, 16 nt, Neisseria meningitidis Z2491
auggccgaccauuucu

SEQ ID NO: 1379476 - RNA, 15 nt, Neisseria meningitidis Z2491
auggccuuuucccuu

SEQ ID NO: 1379477 - RNA, 21 nt, Neisseria meningitidis Z2491
auggcggugcgguagccgccu

SEQ ID NO: 1379478 - RNA, 16 nt, Neisseria meningitidis Z2491
auggcguugacaaaca

SEQ ID NO: 1379479 - RNA, 19 nt, Neisseria meningitidis Z2491
augcaccugcauaaucagu

SEQ ID NO: 1379480 - RNA, 21 nt, Neisseria meningitidis Z2491
augcacuacuucauuuuuuca

SEQ ID NO: 1379481 - RNA, 20 nt, Neisseria meningitidis Z2491
augcacugcgcgaugcauau

SEQ ID NO: 1379482 - RNA, 21 nt, Neisseria meningitidis Z2491
augcacugcgcgaugcauauc

SEQ ID NO: 1379483 - RNA, 16 nt, Neisseria meningitidis Z2491
augauucauaaaauau

SEQ ID NO: 1379484 - RNA, 20 nt, Neisseria meningitidis Z2491
augauucauaaaauauuugc

SEQ ID NO: 1379485 - RNA, 15 nt, Neisseria meningitidis Z2491
augauugacuauuuu

SEQ ID NO: 1379486 - RNA, 23 nt, Neisseria meningitidis Z2491
augauuuuguucugguugcguuu

SEQ ID NO: 1379487 - RNA, 13 nt, Neisseria meningitidis Z2491
augcaaaaacauc

SEQ ID NO: 1379488 - RNA, 15 nt, Neisseria meningitidis Z2491
augauuuuuucaaca

SEQ ID NO: 1379489 - RNA, 16 nt, Neisseria meningitidis Z2491
augcaaaacuuuucug

SEQ ID NO: 1379490 - RNA, 15 nt, Neisseria meningitidis Z2491
augaucaguaaaaaa

SEQ ID NO: 1379491 - RNA, 15 nt, Neisseria meningitidis Z2491
augaugcguucaaau

SEQ ID NO: 1379492 - RNA, 18 nt, Neisseria meningitidis Z2491
augauuaucauaaaaucu

SEQ ID NO: 1379493 - RNA, 18 nt, Neisseria meningitidis Z2491
augaugccgaacaggcgu

SEQ ID NO: 1379494 - RNA, 21 nt, Neisseria meningitidis Z2491
augacguggugcagguuucug

SEQ ID NO: 1379495 - RNA, 18 nt, Neisseria meningitidis Z2491
augacaagacgacaggcg

SEQ ID NO: 1379496 - RNA, 20 nt, Neisseria meningitidis Z2491
augacccacgccaaaccgau

SEQ ID NO: 1379497 - RNA, 15 nt, Neisseria meningitidis Z2491
augacgguaaagauu

SEQ ID NO: 1379498 - RNA, 21 nt, Neisseria meningitidis Z2491
aucuuugaauauugccgccgc

SEQ ID NO: 1379499 - RNA, 14 nt, Neisseria meningitidis Z2491
aucuuuagacugcu

SEQ ID NO: 1379500 - RNA, 14 nt, Neisseria meningitidis Z2491
aucuuucaaacauc

SEQ ID NO: 1379501 - RNA, 16 nt, Neisseria meningitidis Z2491
aucuuucaaacaucug

SEQ ID NO: 1379502 - RNA, 18 nt, Neisseria meningitidis Z2491
aucuuuauuuaaauaaaa

SEQ ID NO: 1379503 - RNA, 17 nt, Neisseria meningitidis Z2491
augaaaugccgucugaa

SEQ ID NO: 1379504 - RNA, 18 nt, Neisseria meningitidis Z2491
augaaaagaccgucauuc

SEQ ID NO: 1379505 - RNA, 13 nt, Neisseria meningitidis Z2491
aucuuuuuugaau

SEQ ID NO: 1379506 - RNA, 19 nt, Neisseria meningitidis Z2491
aucuugugccagcucuuga

SEQ ID NO: 1379507 - RNA, 21 nt, Neisseria meningitidis Z2491
aucuggaaaccaaaaaacaac

SEQ ID NO: 1379508 - RNA, 13 nt, Neisseria meningitidis Z2491
aucugugaaaauc

SEQ ID NO: 1379509 - RNA, 14 nt, Neisseria meningitidis Z2491
aucuuauccacaga

SEQ ID NO: 1379510 - RNA, 13 nt, Neisseria meningitidis Z2491
aucuuauccaucc

SEQ ID NO: 1379511 - RNA, 19 nt, Neisseria meningitidis Z2491
aucuuauccaucccauauu

SEQ ID NO: 1379512 - RNA, 12 nt, Neisseria meningitidis Z2491
aucuuauuuuca

SEQ ID NO: 1379513 - RNA, 19 nt, Neisseria meningitidis Z2491
aucuuauuuauuuuuucuc

SEQ ID NO: 1379514 - RNA, 18 nt, Neisseria meningitidis Z2491
auaugccgucugaaaaca

SEQ ID NO: 1379515 - RNA, 20 nt, Neisseria meningitidis Z2491
auaugccgucugaagccuuc

SEQ ID NO: 1379516 - RNA, 19 nt, Neisseria meningitidis Z2491
auaugcagagaccuuugca

SEQ ID NO: 1379517 - RNA, 14 nt, Neisseria meningitidis Z2491
auauggaaaaaucu

SEQ ID NO: 1379518 - RNA, 15 nt, Neisseria meningitidis Z2491
auauggaaaaaucug

SEQ ID NO: 1379519 - RNA, 22 nt, Neisseria meningitidis Z2491
auaugcuaucuuuauuuaaaua

SEQ ID NO: 1379520 - RNA, 23 nt, Neisseria meningitidis Z2491
auaucgucauucccgcaaaaaca

SEQ ID NO: 1379521 - RNA, 15 nt, Neisseria meningitidis Z2491
auauagauuuuuaug

SEQ ID NO: 1379522 - RNA, 21 nt, Neisseria meningitidis Z2491
auauaguggauuaaauuuaaa

SEQ ID NO: 1379523 - RNA, 17 nt, Neisseria meningitidis Z2491
auauaguggauuaacaa

SEQ ID NO: 1379524 - RNA, 21 nt, Neisseria meningitidis Z2491
auauaguggauuaacaaaaau

SEQ ID NO: 1379525 - RNA, 23 nt, Neisseria meningitidis Z2491
auauaguggauuaacaaaaauca

SEQ ID NO: 1379526 - RNA, 23 nt, Neisseria meningitidis Z2491
auauaguugauuaaaacaaaaau

SEQ ID NO: 1379527 - RNA, 15 nt, Neisseria meningitidis Z2491
auauaguuacacaca

SEQ ID NO: 1379528 - RNA, 16 nt, Neisseria meningitidis Z2491
auauaguuacacacac

SEQ ID NO: 1379529 - RNA, 22 nt, Neisseria meningitidis Z2491
auauaaucaaacucacccugca

SEQ ID NO: 1379530 - RNA, 17 nt, Neisseria meningitidis Z2491
auauacugauuuauauu

SEQ ID NO: 1379531 - RNA, 18 nt, Neisseria meningitidis Z2491
auagugaauuaacaaaaa

SEQ ID NO: 1379532 - RNA, 20 nt, Neisseria meningitidis Z2491
auauaaacucucuauaaaau

SEQ ID NO: 1379533 - RNA, 20 nt, Neisseria meningitidis Z2491
aucaaagucaucaccgcagc

SEQ ID NO: 1379534 - RNA, 12 nt, Neisseria meningitidis Z2491
auauuuccugca

SEQ ID NO: 1379535 - RNA, 12 nt, Neisseria meningitidis Z2491
aucaacagcaga

SEQ ID NO: 1379536 - RNA, 17 nt, Neisseria meningitidis Z2491
aucaacagauuacuaaa

SEQ ID NO: 1379537 - RNA, 13 nt, Neisseria meningitidis Z2491
aucaacguuucua

SEQ ID NO: 1379538 - RNA, 13 nt, Neisseria meningitidis Z2491
aucaagaagaaag

SEQ ID NO: 1379539 - RNA, 21 nt, Neisseria meningitidis Z2491
aucaaucacccgguccaacuu

SEQ ID NO: 1379540 - RNA, 16 nt, Neisseria meningitidis Z2491
auauuuagcauuuaau

SEQ ID NO: 1379541 - RNA, 14 nt, Neisseria meningitidis Z2491
auauugagaccuuu

SEQ ID NO: 1379542 - RNA, 20 nt, Neisseria meningitidis Z2491
auauugagaccuuugcaaua

SEQ ID NO: 1379543 - RNA, 19 nt, Neisseria meningitidis Z2491
auauggcguugacaaacau

SEQ ID NO: 1379544 - RNA, 21 nt, Neisseria meningitidis Z2491
auauggugcugauaacauacu

SEQ ID NO: 1379545 - RNA, 23 nt, Neisseria meningitidis Z2491
auauguugcccgucaacacaaaa

SEQ ID NO: 1379546 - RNA, 16 nt, Neisseria meningitidis Z2491
auauguugggaaguua

SEQ ID NO: 1379547 - RNA, 11 nt, Neisseria meningitidis Z2491
auauguuuuac

SEQ ID NO: 1379548 - RNA, 14 nt, Neisseria meningitidis Z2491
auauuaaucagcgc

SEQ ID NO: 1379549 - RNA, 19 nt, Neisseria meningitidis Z2491
auauguuuucugguuuuua

SEQ ID NO: 1379550 - RNA, 23 nt, Neisseria meningitidis Z2491
auacauaaccuuguuccuccaaa

SEQ ID NO: 1379551 - RNA, 22 nt, Neisseria meningitidis Z2491
auacauccuaaaaauuuaauaa

SEQ ID NO: 1379552 - RNA, 17 nt, Neisseria meningitidis Z2491
auacaucccgucauucc

SEQ ID NO: 1379553 - RNA, 16 nt, Neisseria meningitidis Z2491
auacauccgaauaugc

SEQ ID NO: 1379554 - RNA, 19 nt, Neisseria meningitidis Z2491
auacauaggguuaauauca

SEQ ID NO: 1379555 - RNA, 15 nt, Neisseria meningitidis Z2491
auacauagcaggcau

SEQ ID NO: 1379556 - RNA, 17 nt, Neisseria meningitidis Z2491
auacauuucggcaaggu

SEQ ID NO: 1379557 - RNA, 22 nt, Neisseria meningitidis Z2491
auacaagaacuuuauccccagc

SEQ ID NO: 1379558 - RNA, 19 nt, Neisseria meningitidis Z2491
auacaaacaggcuucagac

SEQ ID NO: 1379559 - RNA, 17 nt, Neisseria meningitidis Z2491
auacaaacaucugauuu

SEQ ID NO: 1379560 - RNA, 22 nt, Neisseria meningitidis Z2491
auacaaacaucugauuuuucuu

SEQ ID NO: 1379561 - RNA, 23 nt, Neisseria meningitidis Z2491
auacacuguaaucucaaaucccg

SEQ ID NO: 1379562 - RNA, 20 nt, Neisseria meningitidis Z2491
auacacaagguuauuuucuu

SEQ ID NO: 1379563 - RNA, 17 nt, Neisseria meningitidis Z2491
auacacacgguuuucac

SEQ ID NO: 1379564 - RNA, 18 nt, Neisseria meningitidis Z2491
auacacaaaaaagccagc

SEQ ID NO: 1379565 - RNA, 23 nt, Neisseria meningitidis Z2491
auaaucugcggcaguuuuucuuu

SEQ ID NO: 1379566 - RNA, 19 nt, Neisseria meningitidis Z2491
auaauccaagauuucauca

SEQ ID NO: 1379567 - RNA, 23 nt, Neisseria meningitidis Z2491
auaacgguugcacgguuuuccuc

SEQ ID NO: 1379568 - RNA, 21 nt, Neisseria meningitidis Z2491
auaauuugucggcuuuugaca

SEQ ID NO: 1379569 - RNA, 15 nt, Neisseria meningitidis Z2491
auacccucucaaacg

SEQ ID NO: 1379570 - RNA, 17 nt, Neisseria meningitidis Z2491
auacccccuuaauccuc

SEQ ID NO: 1379571 - RNA, 21 nt, Neisseria meningitidis Z2491
auaccgucugaaaccugcaac

SEQ ID NO: 1379572 - RNA, 22 nt, Neisseria meningitidis Z2491
auaccgucugaaaggcuuucag

SEQ ID NO: 1379573 - RNA, 16 nt, Neisseria meningitidis Z2491
auaccgucugaacacg

SEQ ID NO: 1379574 - RNA, 17 nt, Neisseria meningitidis Z2491
auaccgccuucaucaaa

SEQ ID NO: 1379575 - RNA, 21 nt, Neisseria meningitidis Z2491
auacguuuuucucgugcauau

SEQ ID NO: 1379576 - RNA, 11 nt, Neisseria meningitidis Z2491
auagccgccgc

SEQ ID NO: 1379577 - RNA, 23 nt, Neisseria meningitidis Z2491
auagccgccgguggcgguuugac

SEQ ID NO: 1379578 - RNA, 19 nt, Neisseria meningitidis Z2491
auagccgaccgccauaccg

SEQ ID NO: 1379579 - RNA, 17 nt, Neisseria meningitidis Z2491
auagcaugguuaagaga

SEQ ID NO: 1379580 - RNA, 20 nt, Neisseria meningitidis Z2491
auagacaucucgaauuuuuu

SEQ ID NO: 1379581 - RNA, 14 nt, Neisseria meningitidis Z2491
auagauaaauuuca

SEQ ID NO: 1379582 - RNA, 21 nt, Neisseria meningitidis Z2491
auagaauuuauacccucucaa

SEQ ID NO: 1379583 - RNA, 20 nt, Neisseria meningitidis Z2491
auagaaaaccgaaacagaaa

SEQ ID NO: 1379584 - RNA, 21 nt, Neisseria meningitidis Z2491
auacuacgcggcugaaaaaau

SEQ ID NO: 1379585 - RNA, 20 nt, Neisseria meningitidis Z2491
auaaauuccuguugcuuuuc

SEQ ID NO: 1379586 - RNA, 21 nt, Neisseria meningitidis Z2491
auaaauuccuguuguuuuuug

SEQ ID NO: 1379587 - RNA, 17 nt, Neisseria meningitidis Z2491
auaaauucguuaaugcu

SEQ ID NO: 1379588 - RNA, 13 nt, Neisseria meningitidis Z2491
auaaauucuugca

SEQ ID NO: 1379589 - RNA, 22 nt, Neisseria meningitidis Z2491
auaaauucuugccgcauuaaaa

SEQ ID NO: 1379590 - RNA, 14 nt, Neisseria meningitidis Z2491
auaaauucugaaac

SEQ ID NO: 1379591 - RNA, 23 nt, Neisseria meningitidis Z2491
auaaauuucagauagcugaacug

SEQ ID NO: 1379592 - RNA, 21 nt, Neisseria meningitidis Z2491
auaacauacuuuguuucaaaa

SEQ ID NO: 1379593 - RNA, 19 nt, Neisseria meningitidis Z2491
auaacgacuguaaagauaa

SEQ ID NO: 1379594 - RNA, 22 nt, Neisseria meningitidis Z2491
auaaacauuaucugacaggaaa

SEQ ID NO: 1379595 - RNA, 21 nt, Neisseria meningitidis Z2491
auaaacauuuuugcguauucg

SEQ ID NO: 1379596 - RNA, 12 nt, Neisseria meningitidis Z2491
auaaaccaaaau

SEQ ID NO: 1379597 - RNA, 21 nt, Neisseria meningitidis Z2491
auaaacgccauaaucacaccg

SEQ ID NO: 1379598 - RNA, 21 nt, Neisseria meningitidis Z2491
auaaacgccgcagcaaaauau

SEQ ID NO: 1379599 - RNA, 23 nt, Neisseria meningitidis Z2491
auaaacgccgcagcaaaauaugg

SEQ ID NO: 1379600 - RNA, 23 nt, Neisseria meningitidis Z2491
auaaaaugccgucugaaagggcu

SEQ ID NO: 1379601 - RNA, 23 nt, Neisseria meningitidis Z2491
auaaaaugccgucugaacucagg

SEQ ID NO: 1379602 - RNA, 14 nt, Neisseria meningitidis Z2491
auaaaaucccccgc

SEQ ID NO: 1379603 - RNA, 23 nt, Neisseria meningitidis Z2491
auaaaauccgguucauuucaggc

SEQ ID NO: 1379604 - RNA, 15 nt, Neisseria meningitidis Z2491
auaaaaggucuuuuc

SEQ ID NO: 1379605 - RNA, 16 nt, Neisseria meningitidis Z2491
auaaaaggucuuuucu

SEQ ID NO: 1379606 - RNA, 21 nt, Neisseria meningitidis Z2491
auaaaaggucuuuucuaaaau

SEQ ID NO: 1379607 - RNA, 22 nt, Neisseria meningitidis Z2491
auaaaagacauugccaaauaga

SEQ ID NO: 1379608 - RNA, 22 nt, Neisseria meningitidis Z2491
aguuuuucgguuuugaugguuu

SEQ ID NO: 1379609 - RNA, 15 nt, Neisseria meningitidis Z2491
aguuuuugucuuggu

SEQ ID NO: 1379610 - RNA, 13 nt, Neisseria meningitidis Z2491
aguuuuccuuugg

SEQ ID NO: 1379611 - RNA, 21 nt, Neisseria meningitidis Z2491
aguuugccgacccgaaucaca

SEQ ID NO: 1379612 - RNA, 14 nt, Neisseria meningitidis Z2491
aguuucagucauuc

SEQ ID NO: 1379613 - RNA, 17 nt, Neisseria meningitidis Z2491
aguuuccaauacaacaa

SEQ ID NO: 1379614 - RNA, 19 nt, Neisseria meningitidis Z2491
aguuuccaauacaacaaaa

SEQ ID NO: 1379615 - RNA, 18 nt, Neisseria meningitidis Z2491
aguugauaauaugaaacc

SEQ ID NO: 1379616 - RNA, 19 nt, Neisseria meningitidis Z2491
aguucauucgacagcagcc

SEQ ID NO: 1379617 - RNA, 16 nt, Neisseria meningitidis Z2491
agucggugcuuuggca

SEQ ID NO: 1379618 - RNA, 18 nt, Neisseria meningitidis Z2491
agugcaacacuaguguau

SEQ ID NO: 1379619 - RNA, 13 nt, Neisseria meningitidis Z2491
aguggaacagaaa

SEQ ID NO: 1379620 - RNA, 16 nt, Neisseria meningitidis Z2491
agugccgccaaagugc

SEQ ID NO: 1379621 - RNA, 17 nt, Neisseria meningitidis Z2491
agugcgcguuaaagguc

SEQ ID NO: 1379622 - RNA, 18 nt, Neisseria meningitidis Z2491
agucccaucccgcgaacc

SEQ ID NO: 1379623 - RNA, 15 nt, Neisseria meningitidis Z2491
aguccaaacaaaaau

SEQ ID NO: 1379624 - RNA, 15 nt, Neisseria meningitidis Z2491
aguccaagacaggcg

SEQ ID NO: 1379625 - RNA, 16 nt, Neisseria meningitidis Z2491
agucgaucaguuugca

SEQ ID NO: 1379626 - RNA, 19 nt, Neisseria meningitidis Z2491
agucggcuuggcgggaagc

SEQ ID NO: 1379627 - RNA, 13 nt, Neisseria meningitidis Z2491
aguccuacccaaa

SEQ ID NO: 1379628 - RNA, 18 nt, Neisseria meningitidis Z2491
agucccguuugaaaacaa

SEQ ID NO: 1379629 - RNA, 22 nt, Neisseria meningitidis Z2491
aguauaguggauuaacaaaaau

SEQ ID NO: 1379630 - RNA, 15 nt, Neisseria meningitidis Z2491
aguacucauuuuucg

SEQ ID NO: 1379631 - RNA, 20 nt, Neisseria meningitidis Z2491
aguagaaauggacgacgcgg

SEQ ID NO: 1379632 - RNA, 15 nt, Neisseria meningitidis Z2491
aguacgcgcugugca

SEQ ID NO: 1379633 - RNA, 21 nt, Neisseria meningitidis Z2491
aguacgcgcugugcaaagaaa

SEQ ID NO: 1379634 - RNA, 19 nt, Neisseria meningitidis Z2491
aguacggcaaggcgaggca

SEQ ID NO: 1379635 - RNA, 20 nt, Neisseria meningitidis Z2491
aguacggcaaggcgaggcaa

SEQ ID NO: 1379636 - RNA, 17 nt, Neisseria meningitidis Z2491
agccguccguaagccuu

SEQ ID NO: 1379637 - RNA, 17 nt, Neisseria meningitidis Z2491
agccgucgccccaaaaa

SEQ ID NO: 1379638 - RNA, 23 nt, Neisseria meningitidis Z2491
agccguauuugucuuccgccaaa

SEQ ID NO: 1379639 - RNA, 21 nt, Neisseria meningitidis Z2491
agccguauuuuuuaaccaacu

SEQ ID NO: 1379640 - RNA, 17 nt, Neisseria meningitidis Z2491
agccguccgaacccaaa

SEQ ID NO: 1379641 - RNA, 15 nt, Neisseria meningitidis Z2491
agccgucauucccgc

SEQ ID NO: 1379642 - RNA, 20 nt, Neisseria meningitidis Z2491
agccucgucauuuccacaaa

SEQ ID NO: 1379643 - RNA, 13 nt, Neisseria meningitidis Z2491
agccugcccaucg

SEQ ID NO: 1379644 - RNA, 13 nt, Neisseria meningitidis Z2491
agccuaaaacauc

SEQ ID NO: 1379645 - RNA, 19 nt, Neisseria meningitidis Z2491
agccuaaaacgccuuugag

SEQ ID NO: 1379646 - RNA, 21 nt, Neisseria meningitidis Z2491
agccuacuugcccgccuucag

SEQ ID NO: 1379647 - RNA, 12 nt, Neisseria meningitidis Z2491
agccuuucagac

SEQ ID NO: 1379648 - RNA, 20 nt, Neisseria meningitidis Z2491
agccuuucagacggcauuuu

SEQ ID NO: 1379649 - RNA, 22 nt, Neisseria meningitidis Z2491
agccuucuucuaaaaauacaua

SEQ ID NO: 1379650 - RNA, 20 nt, Neisseria meningitidis Z2491
agccuguccaaagccucgcg

SEQ ID NO: 1379651 - RNA, 23 nt, Neisseria meningitidis Z2491
agccuucacgccgccgcgcccca

SEQ ID NO: 1379652 - RNA, 12 nt, Neisseria meningitidis Z2491
agccgcaaagac

SEQ ID NO: 1379653 - RNA, 18 nt, Neisseria meningitidis Z2491
agccgaacaccagugcga

SEQ ID NO: 1379654 - RNA, 14 nt, Neisseria meningitidis Z2491
agccgaaaaccugu

SEQ ID NO: 1379655 - RNA, 15 nt, Neisseria meningitidis Z2491
agccgaaaaccugug

SEQ ID NO: 1379656 - RNA, 18 nt, Neisseria meningitidis Z2491
agccgaaacccaaacaca

SEQ ID NO: 1379657 - RNA, 19 nt, Neisseria meningitidis Z2491
agccgaaacccaaacacag

SEQ ID NO: 1379658 - RNA, 21 nt, Neisseria meningitidis Z2491
agccgcucgcguauccagccg

SEQ ID NO: 1379659 - RNA, 18 nt, Neisseria meningitidis Z2491
agccgccuccaucagcac

SEQ ID NO: 1379660 - RNA, 15 nt, Neisseria meningitidis Z2491
agcccaaucccgcaa

SEQ ID NO: 1379661 - RNA, 14 nt, Neisseria meningitidis Z2491
agcccgugccgccg

SEQ ID NO: 1379662 - RNA, 17 nt, Neisseria meningitidis Z2491
agcccgucuaugccgag

SEQ ID NO: 1379663 - RNA, 15 nt, Neisseria meningitidis Z2491
agcccuaucacgcuc

SEQ ID NO: 1379664 - RNA, 20 nt, Neisseria meningitidis Z2491
agcccgcugccgaaaccaaa

SEQ ID NO: 1379665 - RNA, 17 nt, Neisseria meningitidis Z2491
agcgcaaccuugccaag

SEQ ID NO: 1379666 - RNA, 18 nt, Neisseria meningitidis Z2491
agcgcaaccuugccaagg

SEQ ID NO: 1379667 - RNA, 14 nt, Neisseria meningitidis Z2491
agcgcgucaaacag

SEQ ID NO: 1379668 - RNA, 20 nt, Neisseria meningitidis Z2491
agcuaaaaucccguuauuuu

SEQ ID NO: 1379669 - RNA, 14 nt, Neisseria meningitidis Z2491
agcguuggcucgcc

SEQ ID NO: 1379670 - RNA, 23 nt, Neisseria meningitidis Z2491
agcguauuucuagggaaaugccc

SEQ ID NO: 1379671 - RNA, 14 nt, Neisseria meningitidis Z2491
agcuccgaaccgaa

SEQ ID NO: 1379672 - RNA, 15 nt, Neisseria meningitidis Z2491
agcuccggccaaaaa

SEQ ID NO: 1379673 - RNA, 16 nt, Neisseria meningitidis Z2491
agcugcaacugaaacc

SEQ ID NO: 1379674 - RNA, 14 nt, Neisseria meningitidis Z2491
agcuggauuuucgc

SEQ ID NO: 1379675 - RNA, 15 nt, Neisseria meningitidis Z2491
agcaaucaucucuuc

SEQ ID NO: 1379676 - RNA, 14 nt, Neisseria meningitidis Z2491
agcaauccauuccc

SEQ ID NO: 1379677 - RNA, 15 nt, Neisseria meningitidis Z2491
agcaacgacagcagc

SEQ ID NO: 1379678 - RNA, 16 nt, Neisseria meningitidis Z2491
agcaacgacagcagca

SEQ ID NO: 1379679 - RNA, 19 nt, Neisseria meningitidis Z2491
agcaacgacagcagcagcc

SEQ ID NO: 1379680 - RNA, 16 nt, Neisseria meningitidis Z2491
agcaagaccaaacaga

SEQ ID NO: 1379681 - RNA, 22 nt, Neisseria meningitidis Z2491
agcaaccugaaauucgucauuc

SEQ ID NO: 1379682 - RNA, 22 nt, Neisseria meningitidis Z2491
agcaacccugucgccgucauuc

SEQ ID NO: 1379683 - RNA, 15 nt, Neisseria meningitidis Z2491
agcaacauuuccugc

SEQ ID NO: 1379684 - RNA, 23 nt, Neisseria meningitidis Z2491
agcaaaugccuuauccagaaaau

SEQ ID NO: 1379685 - RNA, 18 nt, Neisseria meningitidis Z2491
agcaaaaccgccgauggc

SEQ ID NO: 1379686 - RNA, 16 nt, Neisseria meningitidis Z2491
agcaaaaucagcacaa

SEQ ID NO: 1379687 - RNA, 13 nt, Neisseria meningitidis Z2491
agcaaaauauggc

SEQ ID NO: 1379688 - RNA, 15 nt, Neisseria meningitidis Z2491
agauuuuggagcagu

SEQ ID NO: 1379689 - RNA, 19 nt, Neisseria meningitidis Z2491
agauuuuggagcaguaaaa

SEQ ID NO: 1379690 - RNA, 23 nt, Neisseria meningitidis Z2491
agauuuuggagcaguaaaauuua

SEQ ID NO: 1379691 - RNA, 19 nt, Neisseria meningitidis Z2491
agauuuuuuuauuuaaaca

SEQ ID NO: 1379692 - RNA, 22 nt, Neisseria meningitidis Z2491
agauuuggcaguggcaauuuuu

SEQ ID NO: 1379693 - RNA, 15 nt, Neisseria meningitidis Z2491
agauuugcaaucgau

SEQ ID NO: 1379694 - RNA, 15 nt, Neisseria meningitidis Z2491
agauaaguguuggac

SEQ ID NO: 1379695 - RNA, 23 nt, Neisseria meningitidis Z2491
agauuguuucccaguuccuccac

SEQ ID NO: 1379696 - RNA, 15 nt, Neisseria meningitidis Z2491
agauugucaaaauac

SEQ ID NO: 1379697 - RNA, 11 nt, Neisseria meningitidis Z2491
agcagcagccc

SEQ ID NO: 1379698 - RNA, 17 nt, Neisseria meningitidis Z2491
agcaccuuagagaaucg

SEQ ID NO: 1379699 - RNA, 18 nt, Neisseria meningitidis Z2491
agcaccuuagagaaucgu

SEQ ID NO: 1379700 - RNA, 18 nt, Neisseria meningitidis Z2491
agcacaucgucugcaagc

SEQ ID NO: 1379701 - RNA, 20 nt, Neisseria meningitidis Z2491
agcacagccuauuuuucuga

SEQ ID NO: 1379702 - RNA, 23 nt, Neisseria meningitidis Z2491
agcaccaagugaaucgguuccgu

SEQ ID NO: 1379703 - RNA, 16 nt, Neisseria meningitidis Z2491
agcacaaaugccaaag

SEQ ID NO: 1379704 - RNA, 16 nt, Neisseria meningitidis Z2491
agcacaaauuaaaaua

SEQ ID NO: 1379705 - RNA, 15 nt, Neisseria meningitidis Z2491
agcacaaacagcaug

SEQ ID NO: 1379706 - RNA, 22 nt, Neisseria meningitidis Z2491
agcaggggaauuaacuuuccuu

SEQ ID NO: 1379707 - RNA, 14 nt, Neisseria meningitidis Z2491
agcaggcacaaggc

SEQ ID NO: 1379708 - RNA, 17 nt, Neisseria meningitidis Z2491
agcaggacggcuuugaa

SEQ ID NO: 1379709 - RNA, 20 nt, Neisseria meningitidis Z2491
agcagcccgucuaugccgag

SEQ ID NO: 1379710 - RNA, 22 nt, Neisseria meningitidis Z2491
agcaguauagugaauuaaauuu

SEQ ID NO: 1379711 - RNA, 20 nt, Neisseria meningitidis Z2491
agcagugcgcguuaaagguc

SEQ ID NO: 1379712 - RNA, 22 nt, Neisseria meningitidis Z2491
agcauaccguucaaacugcccg

SEQ ID NO: 1379713 - RNA, 16 nt, Neisseria meningitidis Z2491
agcauccuuuccucuu

SEQ ID NO: 1379714 - RNA, 15 nt, Neisseria meningitidis Z2491
agcaucgcagauucg

SEQ ID NO: 1379715 - RNA, 20 nt, Neisseria meningitidis Z2491
agcaucuuguuuuucaauca

SEQ ID NO: 1379716 - RNA, 17 nt, Neisseria meningitidis Z2491
agcaucguuacaaauuu

SEQ ID NO: 1379717 - RNA, 15 nt, Neisseria meningitidis Z2491
agcaucaaaccauau

SEQ ID NO: 1379718 - RNA, 18 nt, Neisseria meningitidis Z2491
agccaugcggcaaaaagc

SEQ ID NO: 1379719 - RNA, 17 nt, Neisseria meningitidis Z2491
agccacgccaaaaaugc

SEQ ID NO: 1379720 - RNA, 21 nt, Neisseria meningitidis Z2491
agccacgccaaaaaugcggcc

SEQ ID NO: 1379721 - RNA, 16 nt, Neisseria meningitidis Z2491
agccaagcaagcaacg

SEQ ID NO: 1379722 - RNA, 16 nt, Neisseria meningitidis Z2491
agccaaaauauucaau

SEQ ID NO: 1379723 - RNA, 21 nt, Neisseria meningitidis Z2491
agccaaaaacagaaaccuaaa

SEQ ID NO: 1379724 - RNA, 14 nt, Neisseria meningitidis Z2491
acuuggugcuucag

SEQ ID NO: 1379725 - RNA, 18 nt, Neisseria meningitidis Z2491
acuugccgcauaaaucaa

SEQ ID NO: 1379726 - RNA, 19 nt, Neisseria meningitidis Z2491
acuucugacagcauuucca

SEQ ID NO: 1379727 - RNA, 22 nt, Neisseria meningitidis Z2491
acuucuucacgaguccaagaca

SEQ ID NO: 1379728 - RNA, 16 nt, Neisseria meningitidis Z2491
acuucguauuccgaca

SEQ ID NO: 1379729 - RNA, 18 nt, Neisseria meningitidis Z2491
acuuccagcgcaccucca

SEQ ID NO: 1379730 - RNA, 15 nt, Neisseria meningitidis Z2491
acuuacgcaacccua

SEQ ID NO: 1379731 - RNA, 22 nt, Neisseria meningitidis Z2491
acuuauuuaucaaaacagucca

SEQ ID NO: 1379732 - RNA, 14 nt, Neisseria meningitidis Z2491
acuucauuuuuuca

SEQ ID NO: 1379733 - RNA, 21 nt, Neisseria meningitidis Z2491
acuguauugggaugauuuugu

SEQ ID NO: 1379734 - RNA, 17 nt, Neisseria meningitidis Z2491
acuguaccaaauuauug

SEQ ID NO: 1379735 - RNA, 21 nt, Neisseria meningitidis Z2491
acugugccuguuuaaauucau

SEQ ID NO: 1379736 - RNA, 15 nt, Neisseria meningitidis Z2491
acuguccggcaugau

SEQ ID NO: 1379737 - RNA, 19 nt, Neisseria meningitidis Z2491
acuguccggcaugauuuuc

SEQ ID NO: 1379738 - RNA, 16 nt, Neisseria meningitidis Z2491
acuuuccgucauuccc

SEQ ID NO: 1379739 - RNA, 21 nt, Neisseria meningitidis Z2491
acuuugcacuugcugaacaaa

SEQ ID NO: 1379740 - RNA, 17 nt, Neisseria meningitidis Z2491
acuuuggaacaaaaaau

SEQ ID NO: 1379741 - RNA, 17 nt, Neisseria meningitidis Z2491
acuugucaagaaacacg

SEQ ID NO: 1379742 - RNA, 16 nt, Neisseria meningitidis Z2491
acuugucgcagcugcu

SEQ ID NO: 1379743 - RNA, 17 nt, Neisseria meningitidis Z2491
acuugucgcagcugcuc

SEQ ID NO: 1379744 - RNA, 19 nt, Neisseria meningitidis Z2491
acuuuaaucccgucauucc

SEQ ID NO: 1379745 - RNA, 20 nt, Neisseria meningitidis Z2491
acuuuaaucccgucauuccc

SEQ ID NO: 1379746 - RNA, 13 nt, Neisseria meningitidis Z2491
acuuuauccacca

SEQ ID NO: 1379747 - RNA, 12 nt, Neisseria meningitidis Z2491
acuuuaucccca

SEQ ID NO: 1379748 - RNA, 15 nt, Neisseria meningitidis Z2491
agaaauaaggauaua

SEQ ID NO: 1379749 - RNA, 18 nt, Neisseria meningitidis Z2491
agaaagaacccaaaccgu

SEQ ID NO: 1379750 - RNA, 18 nt, Neisseria meningitidis Z2491
agaaaacgccgucugaaa

SEQ ID NO: 1379751 - RNA, 19 nt, Neisseria meningitidis Z2491
agaaaacgccgucugaaau

SEQ ID NO: 1379752 - RNA, 13 nt, Neisseria meningitidis Z2491
agaaaaccaaaaa

SEQ ID NO: 1379753 - RNA, 17 nt, Neisseria meningitidis Z2491
agaaaaccaaaaucaga

SEQ ID NO: 1379754 - RNA, 18 nt, Neisseria meningitidis Z2491
agaaaaccaaaaucagaa

SEQ ID NO: 1379755 - RNA, 20 nt, Neisseria meningitidis Z2491
agaaaaccaaaaucagaaac

SEQ ID NO: 1379756 - RNA, 18 nt, Neisseria meningitidis Z2491
agaaaaccgaaacagaaa

SEQ ID NO: 1379757 - RNA, 10 nt, Neisseria meningitidis Z2491
agaaaacaga

SEQ ID NO: 1379758 - RNA, 11 nt, Neisseria meningitidis Z2491
agaaaacagaa

SEQ ID NO: 1379759 - RNA, 12 nt, Neisseria meningitidis Z2491
agaaaacagaaa

SEQ ID NO: 1379760 - RNA, 15 nt, Neisseria meningitidis Z2491
agaaaaacaaguuuu

SEQ ID NO: 1379761 - RNA, 19 nt, Neisseria meningitidis Z2491
acuuuuccgcgucauuccc

SEQ ID NO: 1379762 - RNA, 19 nt, Neisseria meningitidis Z2491
agaggcugucuuuggauuu

SEQ ID NO: 1379763 - RNA, 16 nt, Neisseria meningitidis Z2491
agagggaaucuagaaa

SEQ ID NO: 1379764 - RNA, 14 nt, Neisseria meningitidis Z2491
agaggcuuucagac

SEQ ID NO: 1379765 - RNA, 13 nt, Neisseria meningitidis Z2491
agauaaauaccca

SEQ ID NO: 1379766 - RNA, 12 nt, Neisseria meningitidis Z2491
agauaaaaccaa

SEQ ID NO: 1379767 - RNA, 14 nt, Neisseria meningitidis Z2491
agauaaauuucaga

SEQ ID NO: 1379768 - RNA, 20 nt, Neisseria meningitidis Z2491
agacuuggugcgcuauucca

SEQ ID NO: 1379769 - RNA, 18 nt, Neisseria meningitidis Z2491
agagaaauggcaguauca

SEQ ID NO: 1379770 - RNA, 15 nt, Neisseria meningitidis Z2491
agagaacgauucucu

SEQ ID NO: 1379771 - RNA, 13 nt, Neisseria meningitidis Z2491
agagaaugaagga

SEQ ID NO: 1379772 - RNA, 18 nt, Neisseria meningitidis Z2491
agagaaucguucucuuug

SEQ ID NO: 1379773 - RNA, 15 nt, Neisseria meningitidis Z2491
agacugcuuccgugu

SEQ ID NO: 1379774 - RNA, 13 nt, Neisseria meningitidis Z2491
agacuccggauuc

SEQ ID NO: 1379775 - RNA, 17 nt, Neisseria meningitidis Z2491
agacggcaucaaaaacu

SEQ ID NO: 1379776 - RNA, 18 nt, Neisseria meningitidis Z2491
agacggcauccgcuuaaa

SEQ ID NO: 1379777 - RNA, 23 nt, Neisseria meningitidis Z2491
agacggcauugcggcuccgguuu

SEQ ID NO: 1379778 - RNA, 14 nt, Neisseria meningitidis Z2491
agacggcauuuccc

SEQ ID NO: 1379779 - RNA, 16 nt, Neisseria meningitidis Z2491
agacauuaaaaaauac

SEQ ID NO: 1379780 - RNA, 17 nt, Neisseria meningitidis Z2491
agaccaaacagaacgca

SEQ ID NO: 1379781 - RNA, 14 nt, Neisseria meningitidis Z2491
agacauucaaugcu

SEQ ID NO: 1379782 - RNA, 22 nt, Neisseria meningitidis Z2491
agaccgauaacggcggcaauaa

SEQ ID NO: 1379783 - RNA, 18 nt, Neisseria meningitidis Z2491
agacagcccucuugccuu

SEQ ID NO: 1379784 - RNA, 12 nt, Neisseria meningitidis Z2491
agacaguacaaa

SEQ ID NO: 1379785 - RNA, 13 nt, Neisseria meningitidis Z2491
agacaguacaaau

SEQ ID NO: 1379786 - RNA, 16 nt, Neisseria meningitidis Z2491
agaauaaugaaaaugu

SEQ ID NO: 1379787 - RNA, 20 nt, Neisseria meningitidis Z2491
agaaugccgucugaaauguu

SEQ ID NO: 1379788 - RNA, 13 nt, Neisseria meningitidis Z2491
agaagacgugcaa

SEQ ID NO: 1379789 - RNA, 13 nt, Neisseria meningitidis Z2491
agaaauucaaaaa

SEQ ID NO: 1379790 - RNA, 21 nt, Neisseria meningitidis Z2491
agaaaugacggaaacucaaaa

SEQ ID NO: 1379791 - RNA, 16 nt, Neisseria meningitidis Z2491
agaaaugccgucugaa

SEQ ID NO: 1379792 - RNA, 15 nt, Neisseria meningitidis Z2491
acggcaucaaaauga

SEQ ID NO: 1379793 - RNA, 22 nt, Neisseria meningitidis Z2491
acggcauccgcuuaaaaaacaa

SEQ ID NO: 1379794 - RNA, 20 nt, Neisseria meningitidis Z2491
acggcaucgguuucuucuuc

SEQ ID NO: 1379795 - RNA, 16 nt, Neisseria meningitidis Z2491
acggcaucuuuuuuug

SEQ ID NO: 1379796 - RNA, 16 nt, Neisseria meningitidis Z2491
acggcaggcaaaaaaa

SEQ ID NO: 1379797 - RNA, 14 nt, Neisseria meningitidis Z2491
acggcaggcaaaaa

SEQ ID NO: 1379798 - RNA, 19 nt, Neisseria meningitidis Z2491
acggcaguuuccaauacaa

SEQ ID NO: 1379799 - RNA, 17 nt, Neisseria meningitidis Z2491
acggcgcaggcaaacgc

SEQ ID NO: 1379800 - RNA, 21 nt, Neisseria meningitidis Z2491
acggcguaauccgccugcgcc

SEQ ID NO: 1379801 - RNA, 17 nt, Neisseria meningitidis Z2491
acggcguugccucgccu

SEQ ID NO: 1379802 - RNA, 18 nt, Neisseria meningitidis Z2491
acggcguucaacauccgc

SEQ ID NO: 1379803 - RNA, 14 nt, Neisseria meningitidis Z2491
acggcguuuucaac

SEQ ID NO: 1379804 - RNA, 23 nt, Neisseria meningitidis Z2491
acggcucaucaugcggaagaagu

SEQ ID NO: 1379805 - RNA, 16 nt, Neisseria meningitidis Z2491
acggcacuuucauuca

SEQ ID NO: 1379806 - RNA, 22 nt, Neisseria meningitidis Z2491
acgcuucagacggcauuuugau

SEQ ID NO: 1379807 - RNA, 15 nt, Neisseria meningitidis Z2491
acgcuugaaucuuca

SEQ ID NO: 1379808 - RNA, 17 nt, Neisseria meningitidis Z2491
acgcugcaaaaauuuau

SEQ ID NO: 1379809 - RNA, 12 nt, Neisseria meningitidis Z2491
acgcgccuucau

SEQ ID NO: 1379810 - RNA, 16 nt, Neisseria meningitidis Z2491
acgcgggaaugacgag

SEQ ID NO: 1379811 - RNA, 16 nt, Neisseria meningitidis Z2491
acgcuccccauauaga

SEQ ID NO: 1379812 - RNA, 18 nt, Neisseria meningitidis Z2491
acgcucaaacacccccga

SEQ ID NO: 1379813 - RNA, 21 nt, Neisseria meningitidis Z2491
acgccagcacaaacagcaugg

SEQ ID NO: 1379814 - RNA, 14 nt, Neisseria meningitidis Z2491
acgccaauuuguau

SEQ ID NO: 1379815 - RNA, 13 nt, Neisseria meningitidis Z2491
acgcauaaaaaug

SEQ ID NO: 1379816 - RNA, 17 nt, Neisseria meningitidis Z2491
acgcaggcuuuugaggc

SEQ ID NO: 1379817 - RNA, 19 nt, Neisseria meningitidis Z2491
acgcaggguuaagaaaacc

SEQ ID NO: 1379818 - RNA, 17 nt, Neisseria meningitidis Z2491
acgcagccagcaucgca

SEQ ID NO: 1379819 - RNA, 21 nt, Neisseria meningitidis Z2491
accggauacggugucuucaau

SEQ ID NO: 1379820 - RNA, 14 nt, Neisseria meningitidis Z2491
acgcgaaaaugccg

SEQ ID NO: 1379821 - RNA, 18 nt, Neisseria meningitidis Z2491
acgccugguacgcuucgc

SEQ ID NO: 1379822 - RNA, 19 nt, Neisseria meningitidis Z2491
acgccguacugguuuaaau

SEQ ID NO: 1379823 - RNA, 18 nt, Neisseria meningitidis Z2491
acgcccuuuuguaaagga

SEQ ID NO: 1379824 - RNA, 12 nt, Neisseria meningitidis Z2491
acucuuucgggc

SEQ ID NO: 1379825 - RNA, 19 nt, Neisseria meningitidis Z2491
acucuaaaccgucauuccu

SEQ ID NO: 1379826 - RNA, 15 nt, Neisseria meningitidis Z2491
acucacuuuaaucaa

SEQ ID NO: 1379827 - RNA, 17 nt, Neisseria meningitidis Z2491
acucacuuugcucagcc

SEQ ID NO: 1379828 - RNA, 22 nt, Neisseria meningitidis Z2491
acuaucuguacugucugcggcu

SEQ ID NO: 1379829 - RNA, 13 nt, Neisseria meningitidis Z2491
acuccaaagagaa

SEQ ID NO: 1379830 - RNA, 17 nt, Neisseria meningitidis Z2491
acuauaucgucauuccc

SEQ ID NO: 1379831 - RNA, 20 nt, Neisseria meningitidis Z2491
acuauaauuuuuaaaauuuu

SEQ ID NO: 1379832 - RNA, 16 nt, Neisseria meningitidis Z2491
acuaaaugccaaucuc

SEQ ID NO: 1379833 - RNA, 12 nt, Neisseria meningitidis Z2491
acguucuagauu

SEQ ID NO: 1379834 - RNA, 20 nt, Neisseria meningitidis Z2491
acgucaagcaaaaaaugccg

SEQ ID NO: 1379835 - RNA, 14 nt, Neisseria meningitidis Z2491
acgucauucccacg

SEQ ID NO: 1379836 - RNA, 19 nt, Neisseria meningitidis Z2491
acguacugguuuuuguuaa

SEQ ID NO: 1379837 - RNA, 19 nt, Neisseria meningitidis Z2491
acgggauuugagauugcgg

SEQ ID NO: 1379838 - RNA, 15 nt, Neisseria meningitidis Z2491
acgggaggaccucaa

SEQ ID NO: 1379839 - RNA, 18 nt, Neisseria meningitidis Z2491
acgggacgggcagacagu

SEQ ID NO: 1379840 - RNA, 16 nt, Neisseria meningitidis Z2491
acgggaaugacgaaga

SEQ ID NO: 1379841 - RNA, 17 nt, Neisseria meningitidis Z2491
acccugccgucauuccc

SEQ ID NO: 1379842 - RNA, 14 nt, Neisseria meningitidis Z2491
acccucucaaacgu

SEQ ID NO: 1379843 - RNA, 18 nt, Neisseria meningitidis Z2491
acccuugugcuucuucga

SEQ ID NO: 1379844 - RNA, 20 nt, Neisseria meningitidis Z2491
acccugucgccgucauuccc

SEQ ID NO: 1379845 - RNA, 22 nt, Neisseria meningitidis Z2491
acccugucgccgucauucccgc

SEQ ID NO: 1379846 - RNA, 20 nt, Neisseria meningitidis Z2491
acccuaccauuguuucugaa

SEQ ID NO: 1379847 - RNA, 12 nt, Neisseria meningitidis Z2491
accgaaacagaa

SEQ ID NO: 1379848 - RNA, 19 nt, Neisseria meningitidis Z2491
accgaaugccacacgcagg

SEQ ID NO: 1379849 - RNA, 14 nt, Neisseria meningitidis Z2491
accgacgaaggcaa

SEQ ID NO: 1379850 - RNA, 18 nt, Neisseria meningitidis Z2491
accgccccuaaaaugccc

SEQ ID NO: 1379851 - RNA, 19 nt, Neisseria meningitidis Z2491
accgcuuucgcauccccga

SEQ ID NO: 1379852 - RNA, 17 nt, Neisseria meningitidis Z2491
accgccgcuccgcaaac

SEQ ID NO: 1379853 - RNA, 22 nt, Neisseria meningitidis Z2491
accgccgcuccgcaaacaaaau

SEQ ID NO: 1379854 - RNA, 16 nt, Neisseria meningitidis Z2491
accgccgccguaaccg

SEQ ID NO: 1379855 - RNA, 14 nt, Neisseria meningitidis Z2491
accgccgccgccuu

SEQ ID NO: 1379856 - RNA, 21 nt, Neisseria meningitidis Z2491
acccgguccaacuucaauagu

SEQ ID NO: 1379857 - RNA, 19 nt, Neisseria meningitidis Z2491
acccgucauucccacgcag

SEQ ID NO: 1379858 - RNA, 16 nt, Neisseria meningitidis Z2491
acccaugccauacugc

SEQ ID NO: 1379859 - RNA, 16 nt, Neisseria meningitidis Z2491
acccgaaucacaaaca

SEQ ID NO: 1379860 - RNA, 17 nt, Neisseria meningitidis Z2491
acccgaaucacaaacau

SEQ ID NO: 1379861 - RNA, 13 nt, Neisseria meningitidis Z2491
acccaaaaggaag

SEQ ID NO: 1379862 - RNA, 20 nt, Neisseria meningitidis Z2491
acccaaaccgucauucccgc

SEQ ID NO: 1379863 - RNA, 17 nt, Neisseria meningitidis Z2491
accauggucgcugacac

SEQ ID NO: 1379864 - RNA, 18 nt, Neisseria meningitidis Z2491
accaucuacauaaacagg

SEQ ID NO: 1379865 - RNA, 14 nt, Neisseria meningitidis Z2491
accaucucuaagau

SEQ ID NO: 1379866 - RNA, 16 nt, Neisseria meningitidis Z2491
accaucucuaagauuu

SEQ ID NO: 1379867 - RNA, 14 nt, Neisseria meningitidis Z2491
accacuguugccac

SEQ ID NO: 1379868 - RNA, 17 nt, Neisseria meningitidis Z2491
accacgucauucccacg

SEQ ID NO: 1379869 - RNA, 12 nt, Neisseria meningitidis Z2491
accacguccacc

SEQ ID NO: 1379870 - RNA, 16 nt, Neisseria meningitidis Z2491
accagcccgccgcgcc

SEQ ID NO: 1379871 - RNA, 14 nt, Neisseria meningitidis Z2491
acauuucggcaagg

SEQ ID NO: 1379872 - RNA, 18 nt, Neisseria meningitidis Z2491
acauuuguuccaauuccu

SEQ ID NO: 1379873 - RNA, 19 nt, Neisseria meningitidis Z2491
accaaaucggcuuucagac

SEQ ID NO: 1379874 - RNA, 16 nt, Neisseria meningitidis Z2491
acauuuugcucauuca

SEQ ID NO: 1379875 - RNA, 21 nt, Neisseria meningitidis Z2491
acauuuucuugcuguuggaaa

SEQ ID NO: 1379876 - RNA, 13 nt, Neisseria meningitidis Z2491
accaaaagccaaa

SEQ ID NO: 1379877 - RNA, 21 nt, Neisseria meningitidis Z2491
accaaaagccaaaaaacacaa

SEQ ID NO: 1379878 - RNA, 12 nt, Neisseria meningitidis Z2491
accaaaaugccc

SEQ ID NO: 1379879 - RNA, 20 nt, Neisseria meningitidis Z2491
accaaaaugcccgccagucc

SEQ ID NO: 1379880 - RNA, 22 nt, Neisseria meningitidis Z2491
accaaaaugcccgccaguccua

SEQ ID NO: 1379881 - RNA, 15 nt, Neisseria meningitidis Z2491
acauuccgccauucc

SEQ ID NO: 1379882 - RNA, 18 nt, Neisseria meningitidis Z2491
acauuccaucaacaaaau

SEQ ID NO: 1379883 - RNA, 22 nt, Neisseria meningitidis Z2491
acauuccaucaacaaaaugccg

SEQ ID NO: 1379884 - RNA, 14 nt, Neisseria meningitidis Z2491
acauucaaugcuaa

SEQ ID NO: 1379885 - RNA, 15 nt, Neisseria meningitidis Z2491
acauucuccguuuca

SEQ ID NO: 1379886 - RNA, 16 nt, Neisseria meningitidis Z2491
acauucuccguuucag

SEQ ID NO: 1379887 - RNA, 19 nt, Neisseria meningitidis Z2491
acauuaagauguuuuucca

SEQ ID NO: 1379888 - RNA, 18 nt, Neisseria meningitidis Z2491
acaucguacugguuuaaa

SEQ ID NO: 1379889 - RNA, 13 nt, Neisseria meningitidis Z2491
acaucgucugcaa

SEQ ID NO: 1379890 - RNA, 13 nt, Neisseria meningitidis Z2491
acaucguucaaac

SEQ ID NO: 1379891 - RNA, 22 nt, Neisseria meningitidis Z2491
acaucaggcggcguucuucuuc

SEQ ID NO: 1379892 - RNA, 18 nt, Neisseria meningitidis Z2491
acauauacaucgcgccca

SEQ ID NO: 1379893 - RNA, 13 nt, Neisseria meningitidis Z2491
acaguuuuuccag

SEQ ID NO: 1379894 - RNA, 15 nt, Neisseria meningitidis Z2491
acauaaaaauagcuu

SEQ ID NO: 1379895 - RNA, 12 nt, Neisseria meningitidis Z2491
acaguuuggaga

SEQ ID NO: 1379896 - RNA, 13 nt, Neisseria meningitidis Z2491
acauaccgccccu

SEQ ID NO: 1379897 - RNA, 21 nt, Neisseria meningitidis Z2491
acauacuuuguuucaaaaugu

SEQ ID NO: 1379898 - RNA, 14 nt, Neisseria meningitidis Z2491
acauagauggggau

SEQ ID NO: 1379899 - RNA, 20 nt, Neisseria meningitidis Z2491
acauagguuacuaaaauuuu

SEQ ID NO: 1379900 - RNA, 13 nt, Neisseria meningitidis Z2491
acagauaaaacca

SEQ ID NO: 1379901 - RNA, 15 nt, Neisseria meningitidis Z2491
acagcauggcgacaa

SEQ ID NO: 1379902 - RNA, 19 nt, Neisseria meningitidis Z2491
acagcauggcgacaaucuc

SEQ ID NO: 1379903 - RNA, 21 nt, Neisseria meningitidis Z2491
acagcauccuuuccucuuuca

SEQ ID NO: 1379904 - RNA, 16 nt, Neisseria meningitidis Z2491
acagcaaccugaaauu

SEQ ID NO: 1379905 - RNA, 19 nt, Neisseria meningitidis Z2491
acagcaacuuaaaaccucg

SEQ ID NO: 1379906 - RNA, 23 nt, Neisseria meningitidis Z2491
acagcaacuuuuccgcgucauuc

SEQ ID NO: 1379907 - RNA, 18 nt, Neisseria meningitidis Z2491
acacgcugccgcccaagc

SEQ ID NO: 1379908 - RNA, 14 nt, Neisseria meningitidis Z2491
acacgcaaaacaca

SEQ ID NO: 1379909 - RNA, 18 nt, Neisseria meningitidis Z2491
acacgguucugcaccgcu

SEQ ID NO: 1379910 - RNA, 17 nt, Neisseria meningitidis Z2491
acacguuuugcagguag

SEQ ID NO: 1379911 - RNA, 11 nt, Neisseria meningitidis Z2491
acagaaaacca

SEQ ID NO: 1379912 - RNA, 15 nt, Neisseria meningitidis Z2491
acagaaaaccaaaaa

SEQ ID NO: 1379913 - RNA, 16 nt, Neisseria meningitidis Z2491
acagaaaaccaaaaac

SEQ ID NO: 1379914 - RNA, 19 nt, Neisseria meningitidis Z2491
acagaaaaccaaaaacaga

SEQ ID NO: 1379915 - RNA, 16 nt, Neisseria meningitidis Z2491
acagaaaaccaaaauc

SEQ ID NO: 1379916 - RNA, 20 nt, Neisseria meningitidis Z2491
acagaaaaccaaaaucagaa

SEQ ID NO: 1379917 - RNA, 23 nt, Neisseria meningitidis Z2491
acagaaaaccaaaaucagaaacc

SEQ ID NO: 1379918 - RNA, 22 nt, Neisseria meningitidis Z2491
acagaaauaaaagcaucuuguu

SEQ ID NO: 1379919 - RNA, 13 nt, Neisseria meningitidis Z2491
acagaaaccuaaa

SEQ ID NO: 1379920 - RNA, 19 nt, Neisseria meningitidis Z2491
acagaaaccuaaaaucucg

SEQ ID NO: 1379921 - RNA, 19 nt, Neisseria meningitidis Z2491
acagaaaccuaaaauucgu

SEQ ID NO: 1379922 - RNA, 14 nt, Neisseria meningitidis Z2491
acagaaaccucaaa

SEQ ID NO: 1379923 - RNA, 21 nt, Neisseria meningitidis Z2491
acagaaaccugaaaacagaaa

SEQ ID NO: 1379924 - RNA, 18 nt, Neisseria meningitidis Z2491
acagaaccgauucacuug

SEQ ID NO: 1379925 - RNA, 19 nt, Neisseria meningitidis Z2491
acagaaauucaaaaacaga

SEQ ID NO: 1379926 - RNA, 21 nt, Neisseria meningitidis Z2491
acagaaauuuauaaacaaaaa

SEQ ID NO: 1379927 - RNA, 17 nt, Neisseria meningitidis Z2491
acacccaugccauacug

SEQ ID NO: 1379928 - RNA, 17 nt, Neisseria meningitidis Z2491
acacccccgucauuccc

SEQ ID NO: 1379929 - RNA, 22 nt, Neisseria meningitidis Z2491
acacccauuuggagucgccuuc

SEQ ID NO: 1379930 - RNA, 19 nt, Neisseria meningitidis Z2491
acacccccgaaugacaacc

SEQ ID NO: 1379931 - RNA, 20 nt, Neisseria meningitidis Z2491
acacccguuaaggcagagau

SEQ ID NO: 1379932 - RNA, 22 nt, Neisseria meningitidis Z2491
acaccgccgccaacaccgcgcc

SEQ ID NO: 1379933 - RNA, 22 nt, Neisseria meningitidis Z2491
acaccgccgcuccgcaaacaaa

SEQ ID NO: 1379934 - RNA, 20 nt, Neisseria meningitidis Z2491
acaccggauacggugucuuc

SEQ ID NO: 1379935 - RNA, 15 nt, Neisseria meningitidis Z2491
acacgaacugccucc

SEQ ID NO: 1379936 - RNA, 23 nt, Neisseria meningitidis Z2491
acaccuuucaaucaaugugccuc

SEQ ID NO: 1379937 - RNA, 14 nt, Neisseria meningitidis Z2491
acaaucaucaucac

SEQ ID NO: 1379938 - RNA, 18 nt, Neisseria meningitidis Z2491
acaaucaucaucacaaug

SEQ ID NO: 1379939 - RNA, 22 nt, Neisseria meningitidis Z2491
acaaucaggccggcggagaaca

SEQ ID NO: 1379940 - RNA, 21 nt, Neisseria meningitidis Z2491
acaauccgcccgaauaaaaaa

SEQ ID NO: 1379941 - RNA, 17 nt, Neisseria meningitidis Z2491
acaauccgcuuuuuaaa

SEQ ID NO: 1379942 - RNA, 21 nt, Neisseria meningitidis Z2491
acaauccgcuuuuuaaacaac

SEQ ID NO: 1379943 - RNA, 15 nt, Neisseria meningitidis Z2491
acaaucaggaaaaca

SEQ ID NO: 1379944 - RNA, 22 nt, Neisseria meningitidis Z2491
acaaucagaucggcaaacccuu

SEQ ID NO: 1379945 - RNA, 23 nt, Neisseria meningitidis Z2491
acaaucuuuucaucgucauuccc

SEQ ID NO: 1379946 - RNA, 11 nt, Neisseria meningitidis Z2491
acaaucuucca

SEQ ID NO: 1379947 - RNA, 18 nt, Neisseria meningitidis Z2491
acaaggacaaaaaaccaa

SEQ ID NO: 1379948 - RNA, 16 nt, Neisseria meningitidis Z2491
acaagguuauuuucuu

SEQ ID NO: 1379949 - RNA, 15 nt, Neisseria meningitidis Z2491
acacagccaaaaaaa

SEQ ID NO: 1379950 - RNA, 14 nt, Neisseria meningitidis Z2491
acacagccaaaaua

SEQ ID NO: 1379951 - RNA, 15 nt, Neisseria meningitidis Z2491
acacagccaaaauau

SEQ ID NO: 1379952 - RNA, 13 nt, Neisseria meningitidis Z2491
acacaaauauauu

SEQ ID NO: 1379953 - RNA, 15 nt, Neisseria meningitidis Z2491
acacaauucccaccg

SEQ ID NO: 1379954 - RNA, 23 nt, Neisseria meningitidis Z2491
acacagauaccgucugaacacga

SEQ ID NO: 1379955 - RNA, 14 nt, Neisseria meningitidis Z2491
acacaccauccuca

SEQ ID NO: 1379956 - RNA, 20 nt, Neisseria meningitidis Z2491
acacacaggacgacacauaa

SEQ ID NO: 1379957 - RNA, 21 nt, Neisseria meningitidis Z2491
acacacaggacgacacauaaa

SEQ ID NO: 1379958 - RNA, 17 nt, Neisseria meningitidis Z2491
acacaaaaaagccagca

SEQ ID NO: 1379959 - RNA, 19 nt, Neisseria meningitidis Z2491
acacaaaaaagccagcagc

SEQ ID NO: 1379960 - RNA, 12 nt, Neisseria meningitidis Z2491
acaauuucuccg

SEQ ID NO: 1379961 - RNA, 21 nt, Neisseria meningitidis Z2491
aauuuuuuggcgcauuuuuau

SEQ ID NO: 1379962 - RNA, 20 nt, Neisseria meningitidis Z2491
aauuuuuggcgcauuuuuau

SEQ ID NO: 1379963 - RNA, 17 nt, Neisseria meningitidis Z2491
acaaaauaaaaaacaaa

SEQ ID NO: 1379964 - RNA, 17 nt, Neisseria meningitidis Z2491
acaaaagauacacacac

SEQ ID NO: 1379965 - RNA, 21 nt, Neisseria meningitidis Z2491
acaaaauuaaaguuucagaau

SEQ ID NO: 1379966 - RNA, 18 nt, Neisseria meningitidis Z2491
acaaaaaaccgcuucgga

SEQ ID NO: 1379967 - RNA, 12 nt, Neisseria meningitidis Z2491
acaaaaacagaa

SEQ ID NO: 1379968 - RNA, 15 nt, Neisseria meningitidis Z2491
acaaaacgcccuuuu

SEQ ID NO: 1379969 - RNA, 21 nt, Neisseria meningitidis Z2491
acaaaaauccugcuuauugca

SEQ ID NO: 1379970 - RNA, 18 nt, Neisseria meningitidis Z2491
aauuugacgcauaaaaau

SEQ ID NO: 1379971 - RNA, 23 nt, Neisseria meningitidis Z2491
aauuuggcuguguuucaauaugg

SEQ ID NO: 1379972 - RNA, 20 nt, Neisseria meningitidis Z2491
aauuugucggcuuuugacag

SEQ ID NO: 1379973 - RNA, 19 nt, Neisseria meningitidis Z2491
aauuugucgggaaaacagc

SEQ ID NO: 1379974 - RNA, 22 nt, Neisseria meningitidis Z2491
aauuuuagguuucugauuuuga

SEQ ID NO: 1379975 - RNA, 22 nt, Neisseria meningitidis Z2491
aauuuuauggcagguuuuuaua

SEQ ID NO: 1379976 - RNA, 14 nt, Neisseria meningitidis Z2491
aauuucuugauuuu

SEQ ID NO: 1379977 - RNA, 20 nt, Neisseria meningitidis Z2491
acaacccugaugaugaagua

SEQ ID NO: 1379978 - RNA, 16 nt, Neisseria meningitidis Z2491
acaacggcguuuucaa

SEQ ID NO: 1379979 - RNA, 12 nt, Neisseria meningitidis Z2491
acaacucuuucg

SEQ ID NO: 1379980 - RNA, 21 nt, Neisseria meningitidis Z2491
acaagccguacauaaggaaca

SEQ ID NO: 1379981 - RNA, 22 nt, Neisseria meningitidis Z2491
acaagccuguuuuccugcccaa

SEQ ID NO: 1379982 - RNA, 21 nt, Neisseria meningitidis Z2491
acaaacaggcagccuaaaaca

SEQ ID NO: 1379983 - RNA, 15 nt, Neisseria meningitidis Z2491
acaaacaggcuucag

SEQ ID NO: 1379984 - RNA, 12 nt, Neisseria meningitidis Z2491
acaaacagcaug

SEQ ID NO: 1379985 - RNA, 19 nt, Neisseria meningitidis Z2491
acaaacaucugauuuuucu

SEQ ID NO: 1379986 - RNA, 14 nt, Neisseria meningitidis Z2491
acaaacgccagcac

SEQ ID NO: 1379987 - RNA, 19 nt, Neisseria meningitidis Z2491
acaaacgccagcacaaaca

SEQ ID NO: 1379988 - RNA, 23 nt, Neisseria meningitidis Z2491
acaaacgccagcacaaacagcau

SEQ ID NO: 1379989 - RNA, 21 nt, Neisseria meningitidis Z2491
acaaagccggcggcaacaaug

SEQ ID NO: 1379990 - RNA, 13 nt, Neisseria meningitidis Z2491
acaaauauauucg

SEQ ID NO: 1379991 - RNA, 20 nt, Neisseria meningitidis Z2491
acaaaucgguacgcagcagu

SEQ ID NO: 1379992 - RNA, 17 nt, Neisseria meningitidis Z2491
acaaaugccgccagcca

SEQ ID NO: 1379993 - RNA, 14 nt, Neisseria meningitidis Z2491
acaaaugccaaagg

SEQ ID NO: 1379994 - RNA, 14 nt, Neisseria meningitidis Z2491
acaacaaauuuuug

SEQ ID NO: 1379995 - RNA, 14 nt, Neisseria meningitidis Z2491
acaacaaaaugccg

SEQ ID NO: 1379996 - RNA, 10 nt, Neisseria meningitidis Z2491
acaaauuccu

SEQ ID NO: 1379997 - RNA, 12 nt, Neisseria meningitidis Z2491
acaaauuccuaa

SEQ ID NO: 1379998 - RNA, 17 nt, Neisseria meningitidis Z2491
acaaauuccuaaaacuu

SEQ ID NO: 1379999 - RNA, 20 nt, Neisseria meningitidis Z2491
acaaauuaaaauaaaaccga

SEQ ID NO: 1380000 - RNA, 18 nt, Neisseria meningitidis Z2491
aaggcgaggcaacgccgu

SEQ ID NO: 1380001 - RNA, 18 nt, Neisseria meningitidis Z2491
aaggcgaggcaacgcugu

SEQ ID NO: 1380002 - RNA, 18 nt, Neisseria meningitidis Z2491
aaggcgagccaacgcugu

SEQ ID NO: 1380003 - RNA, 19 nt, Neisseria meningitidis Z2491
aaggcgacaaagccgcaga

SEQ ID NO: 1380004 - RNA, 12 nt, Neisseria meningitidis Z2491
aaggcgccggcg

SEQ ID NO: 1380005 - RNA, 23 nt, Neisseria meningitidis Z2491
aaggcagcaccguuuaaaacagc

SEQ ID NO: 1380006 - RNA, 21 nt, Neisseria meningitidis Z2491
aaggcauacggggaggaaagu

SEQ ID NO: 1380007 - RNA, 18 nt, Neisseria meningitidis Z2491
aagguuaauuaaaauacg

SEQ ID NO: 1380008 - RNA, 14 nt, Neisseria meningitidis Z2491
aaggugggaaucug

SEQ ID NO: 1380009 - RNA, 20 nt, Neisseria meningitidis Z2491
aaggucuuuucuaaaauaug

SEQ ID NO: 1380010 - RNA, 17 nt, Neisseria meningitidis Z2491
aaggugcugaagcacca

SEQ ID NO: 1380011 - RNA, 15 nt, Neisseria meningitidis Z2491
aagguuuuaggcaau

SEQ ID NO: 1380012 - RNA, 14 nt, Neisseria meningitidis Z2491
aagguucaaacaca

SEQ ID NO: 1380013 - RNA, 16 nt, Neisseria meningitidis Z2491
aaggucucauccuguu

SEQ ID NO: 1380014 - RNA, 14 nt, Neisseria meningitidis Z2491
aaggucgucugaaa

SEQ ID NO: 1380015 - RNA, 11 nt, Neisseria meningitidis Z2491
aaggcuuucag

SEQ ID NO: 1380016 - RNA, 13 nt, Neisseria meningitidis Z2491
aaggcuuucagau

SEQ ID NO: 1380017 - RNA, 17 nt, Neisseria meningitidis Z2491
aaggcuggauucccgcc

SEQ ID NO: 1380018 - RNA, 20 nt, Neisseria meningitidis Z2491
aagcugcaacugaaaccaca

SEQ ID NO: 1380019 - RNA, 14 nt, Neisseria meningitidis Z2491
aaggaauuugagau

SEQ ID NO: 1380020 - RNA, 19 nt, Neisseria meningitidis Z2491
aagcggcaaucaaauccug

SEQ ID NO: 1380021 - RNA, 19 nt, Neisseria meningitidis Z2491
aagcggacgauuucccugu

SEQ ID NO: 1380022 - RNA, 21 nt, Neisseria meningitidis Z2491
aagcggaauacggcaacauca

SEQ ID NO: 1380023 - RNA, 13 nt, Neisseria meningitidis Z2491
aagccaagauaug

SEQ ID NO: 1380024 - RNA, 18 nt, Neisseria meningitidis Z2491
aagcuauccgcacagaaa

SEQ ID NO: 1380025 - RNA, 19 nt, Neisseria meningitidis Z2491
aaguccgaacauacggcgu

SEQ ID NO: 1380026 - RNA, 18 nt, Neisseria meningitidis Z2491
aaguccggcauaaauccu

SEQ ID NO: 1380027 - RNA, 14 nt, Neisseria meningitidis Z2491
aagucgggcaaagc

SEQ ID NO: 1380028 - RNA, 20 nt, Neisseria meningitidis Z2491
aagguuuuugccaagugcaa

SEQ ID NO: 1380029 - RNA, 20 nt, Neisseria meningitidis Z2491
aagugauucaauaggauagg

SEQ ID NO: 1380030 - RNA, 17 nt, Neisseria meningitidis Z2491
aagugccauuuaaaauc

SEQ ID NO: 1380031 - RNA, 13 nt, Neisseria meningitidis Z2491
aagugggaaucca

SEQ ID NO: 1380032 - RNA, 17 nt, Neisseria meningitidis Z2491
aaguuucccgaaauucc

SEQ ID NO: 1380033 - RNA, 18 nt, Neisseria meningitidis Z2491
aaguuucccgaaauucca

SEQ ID NO: 1380034 - RNA, 14 nt, Neisseria meningitidis Z2491
aauaaaaaauaugg

SEQ ID NO: 1380035 - RNA, 16 nt, Neisseria meningitidis Z2491
aauaaaaaacaaaguu

SEQ ID NO: 1380036 - RNA, 14 nt, Neisseria meningitidis Z2491
aauaaaaaaugccg

SEQ ID NO: 1380037 - RNA, 14 nt, Neisseria meningitidis Z2491
aagauggcugaaau

SEQ ID NO: 1380038 - RNA, 23 nt, Neisseria meningitidis Z2491
aagauuccggcggcuuuuucgca

SEQ ID NO: 1380039 - RNA, 20 nt, Neisseria meningitidis Z2491
aagauuucaucauccugcuu

SEQ ID NO: 1380040 - RNA, 12 nt, Neisseria meningitidis Z2491
aagaucauaccu

SEQ ID NO: 1380041 - RNA, 13 nt, Neisseria meningitidis Z2491
aagcagaaauaag

SEQ ID NO: 1380042 - RNA, 11 nt, Neisseria meningitidis Z2491
aagcagcagcc

SEQ ID NO: 1380043 - RNA, 15 nt, Neisseria meningitidis Z2491
aagcaguugaaauca

SEQ ID NO: 1380044 - RNA, 17 nt, Neisseria meningitidis Z2491
aagcaguugaaaucaac

SEQ ID NO: 1380045 - RNA, 21 nt, Neisseria meningitidis Z2491
aagcauugaccacuucagggc

SEQ ID NO: 1380046 - RNA, 21 nt, Neisseria meningitidis Z2491
aagcacagccuauuuuucuga

SEQ ID NO: 1380047 - RNA, 18 nt, Neisseria meningitidis Z2491
aagcaccaaguaaaucgg

SEQ ID NO: 1380048 - RNA, 19 nt, Neisseria meningitidis Z2491
aagcaaucaucucuucuau

SEQ ID NO: 1380049 - RNA, 18 nt, Neisseria meningitidis Z2491
aagcaauccugccgaggc

SEQ ID NO: 1380050 - RNA, 16 nt, Neisseria meningitidis Z2491
aagagcaggacaaagu

SEQ ID NO: 1380051 - RNA, 23 nt, Neisseria meningitidis Z2491
aagacuuuuucgcgcaccagcaa

SEQ ID NO: 1380052 - RNA, 16 nt, Neisseria meningitidis Z2491
aagaauuuaucaaaaa

SEQ ID NO: 1380053 - RNA, 15 nt, Neisseria meningitidis Z2491
aagaccaaacagaac

SEQ ID NO: 1380054 - RNA, 19 nt, Neisseria meningitidis Z2491
aagaccaaacagaacgcaa

SEQ ID NO: 1380055 - RNA, 21 nt, Neisseria meningitidis Z2491
aagacaucccccaaccaauau

SEQ ID NO: 1380056 - RNA, 19 nt, Neisseria meningitidis Z2491
aagaaugacggaguuucag

SEQ ID NO: 1380057 - RNA, 15 nt, Neisseria meningitidis Z2491
aaauugaaaguuaca

SEQ ID NO: 1380058 - RNA, 14 nt, Neisseria meningitidis Z2491
aaauugaaaugccg

SEQ ID NO: 1380059 - RNA, 21 nt, Neisseria meningitidis Z2491
aaauucuugccgcauuaaaau

SEQ ID NO: 1380060 - RNA, 22 nt, Neisseria meningitidis Z2491
aaauucuugccgcauuaaaauu

SEQ ID NO: 1380061 - RNA, 16 nt, Neisseria meningitidis Z2491
aaugucggcauuuucg

SEQ ID NO: 1380062 - RNA, 17 nt, Neisseria meningitidis Z2491
aauguccguuuucuucu

SEQ ID NO: 1380063 - RNA, 22 nt, Neisseria meningitidis Z2491
aauguccguuuucuucugaaua

SEQ ID NO: 1380064 - RNA, 20 nt, Neisseria meningitidis Z2491
aauguauuagaaaugacuga

SEQ ID NO: 1380065 - RNA, 18 nt, Neisseria meningitidis Z2491
aaugcacuacuucauuuu

SEQ ID NO: 1380066 - RNA, 20 nt, Neisseria meningitidis Z2491
aaugcacuacuucauuuuuu

SEQ ID NO: 1380067 - RNA, 23 nt, Neisseria meningitidis Z2491
aaugcccauccgccuuccgcaua

SEQ ID NO: 1380068 - RNA, 21 nt, Neisseria meningitidis Z2491
aaugcccgaaccgucauuccc

SEQ ID NO: 1380069 - RNA, 13 nt, Neisseria meningitidis Z2491
aauuaaaaacaaa

SEQ ID NO: 1380070 - RNA, 22 nt, Neisseria meningitidis Z2491
aauguugcggcacuagccaaaa

SEQ ID NO: 1380071 - RNA, 13 nt, Neisseria meningitidis Z2491
aauguuucaacgc

SEQ ID NO: 1380072 - RNA, 23 nt, Neisseria meningitidis Z2491
aauguucguacggguuaaucaaa

SEQ ID NO: 1380073 - RNA, 16 nt, Neisseria meningitidis Z2491
aauguguuuugaaggu

SEQ ID NO: 1380074 - RNA, 17 nt, Neisseria meningitidis Z2491
aauguguugauuaaaua

SEQ ID NO: 1380075 - RNA, 15 nt, Neisseria meningitidis Z2491
aaugugguuucagac

SEQ ID NO: 1380076 - RNA, 17 nt, Neisseria meningitidis Z2491
aaugaaggaauuugaga

SEQ ID NO: 1380077 - RNA, 14 nt, Neisseria meningitidis Z2491
aaucuuugaauauu

SEQ ID NO: 1380078 - RNA, 17 nt, Neisseria meningitidis Z2491
aaucuuugaauauugcu

SEQ ID NO: 1380079 - RNA, 22 nt, Neisseria meningitidis Z2491
aaucuugaaacccgucauuccc

SEQ ID NO: 1380080 - RNA, 22 nt, Neisseria meningitidis Z2491
aaucuucgcaguuggaacagcu

SEQ ID NO: 1380081 - RNA, 16 nt, Neisseria meningitidis Z2491
aaucuggaaaccaaaa

SEQ ID NO: 1380082 - RNA, 22 nt, Neisseria meningitidis Z2491
aaucuggaaaccaaaaaacaac

SEQ ID NO: 1380083 - RNA, 20 nt, Neisseria meningitidis Z2491
aaugauucauaaaauauuug

SEQ ID NO: 1380084 - RNA, 21 nt, Neisseria meningitidis Z2491
aaugacuguccgagacagaac

SEQ ID NO: 1380085 - RNA, 13 nt, Neisseria meningitidis Z2491
aaugacugaaacu

SEQ ID NO: 1380086 - RNA, 16 nt, Neisseria meningitidis Z2491
aaugacugaaacucaa

SEQ ID NO: 1380087 - RNA, 21 nt, Neisseria meningitidis Z2491
aaugacugaaacucaaaaaaa

SEQ ID NO: 1380088 - RNA, 21 nt, Neisseria meningitidis Z2491
aaugacugaaauucaaaaaac

SEQ ID NO: 1380089 - RNA, 18 nt, Neisseria meningitidis Z2491
aaucuaaauagcguuuua

SEQ ID NO: 1380090 - RNA, 22 nt, Neisseria meningitidis Z2491
aaucuaaauagcguuuuaauuc

SEQ ID NO: 1380091 - RNA, 22 nt, Neisseria meningitidis Z2491
aaucucauuuucaaaaugcaaa

SEQ ID NO: 1380092 - RNA, 17 nt, Neisseria meningitidis Z2491
aaucucggacuuucaga

SEQ ID NO: 1380093 - RNA, 22 nt, Neisseria meningitidis Z2491
aaucucguuauccauacaagaa

SEQ ID NO: 1380094 - RNA, 16 nt, Neisseria meningitidis Z2491
aaucucgucccaaaca

SEQ ID NO: 1380095 - RNA, 18 nt, Neisseria meningitidis Z2491
aaucucgucccaaacaau

SEQ ID NO: 1380096 - RNA, 13 nt, Neisseria meningitidis Z2491
aaucugaaauuuu

SEQ ID NO: 1380097 - RNA, 20 nt, Neisseria meningitidis Z2491
aaucugaaaccccauccuuc

SEQ ID NO: 1380098 - RNA, 22 nt, Neisseria meningitidis Z2491
aaucugagaccuuugcaaaaau

SEQ ID NO: 1380099 - RNA, 21 nt, Neisseria meningitidis Z2491
aaucgacggagcugcuggaaa

SEQ ID NO: 1380100 - RNA, 17 nt, Neisseria meningitidis Z2491
aaucaucccaaacaucg

SEQ ID NO: 1380101 - RNA, 23 nt, Neisseria meningitidis Z2491
aaucauccacagccgcaaaagcc

SEQ ID NO: 1380102 - RNA, 17 nt, Neisseria meningitidis Z2491
aauacaacaaaaugccg

SEQ ID NO: 1380103 - RNA, 18 nt, Neisseria meningitidis Z2491
aauacaaacaucugauuu

SEQ ID NO: 1380104 - RNA, 15 nt, Neisseria meningitidis Z2491
aauaaaggcugaauu

SEQ ID NO: 1380105 - RNA, 14 nt, Neisseria meningitidis Z2491
aauacauugauuuu

SEQ ID NO: 1380106 - RNA, 13 nt, Neisseria meningitidis Z2491
aauacccauaccg

SEQ ID NO: 1380107 - RNA, 16 nt, Neisseria meningitidis Z2491
aauaggacaaaugccg

SEQ ID NO: 1380108 - RNA, 23 nt, Neisseria meningitidis Z2491
aauaguacggaaccgauucacuu

SEQ ID NO: 1380109 - RNA, 17 nt, Neisseria meningitidis Z2491
aauagaagccaaaauau

SEQ ID NO: 1380110 - RNA, 18 nt, Neisseria meningitidis Z2491
aauagcguuuuaauucgg

SEQ ID NO: 1380111 - RNA, 14 nt, Neisseria meningitidis Z2491
aauagcugaaacuc

SEQ ID NO: 1380112 - RNA, 15 nt, Neisseria meningitidis Z2491
aauagcugaaacuca

SEQ ID NO: 1380113 - RNA, 16 nt, Neisseria meningitidis Z2491
aauaucgggacgcugc

SEQ ID NO: 1380114 - RNA, 16 nt, Neisseria meningitidis Z2491
aaucaaguuuauccua

SEQ ID NO: 1380115 - RNA, 21 nt, Neisseria meningitidis Z2491
aaucaauccuuccugaugaaa

SEQ ID NO: 1380116 - RNA, 15 nt, Neisseria meningitidis Z2491
aaucaauuaaaaaca

SEQ ID NO: 1380117 - RNA, 16 nt, Neisseria meningitidis Z2491
aaucaauuaaaaacaa

SEQ ID NO: 1380118 - RNA, 17 nt, Neisseria meningitidis Z2491
aaucagcguacccacgc

SEQ ID NO: 1380119 - RNA, 16 nt, Neisseria meningitidis Z2491
aaucaguuuuugucuu

SEQ ID NO: 1380120 - RNA, 14 nt, Neisseria meningitidis Z2491
aaucaaauauuaaa

SEQ ID NO: 1380121 - RNA, 14 nt, Neisseria meningitidis Z2491
aaucaaaaccagcc

SEQ ID NO: 1380122 - RNA, 15 nt, Neisseria meningitidis Z2491
aaucaaaaccagccc

SEQ ID NO: 1380123 - RNA, 12 nt, Neisseria meningitidis Z2491
aaucaaaauaaa

SEQ ID NO: 1380124 - RNA, 16 nt, Neisseria meningitidis Z2491
aauauucaacuuugaa

SEQ ID NO: 1380125 - RNA, 18 nt, Neisseria meningitidis Z2491
aauauuacuguuguucua

SEQ ID NO: 1380126 - RNA, 17 nt, Neisseria meningitidis Z2491
aauauuaagaaaaacag

SEQ ID NO: 1380127 - RNA, 17 nt, Neisseria meningitidis Z2491
aauauugagcaaaaagu

SEQ ID NO: 1380128 - RNA, 18 nt, Neisseria meningitidis Z2491
aauauugagcaaaaagua

SEQ ID NO: 1380129 - RNA, 13 nt, Neisseria meningitidis Z2491
aauauucaaagau

SEQ ID NO: 1380130 - RNA, 22 nt, Neisseria meningitidis Z2491
uuuuugaguuuccgucauuucu

SEQ ID NO: 1380131 - RNA, 13 nt, Neisseria meningitidis Z2491
uuuuugccuguuc

SEQ ID NO: 1380132 - RNA, 22 nt, Neisseria meningitidis Z2491
uuuuugggaaguaaccccuucc

SEQ ID NO: 1380133 - RNA, 17 nt, Neisseria meningitidis Z2491
uuuuuggcgcauuuuuu

SEQ ID NO: 1380134 - RNA, 13 nt, Neisseria meningitidis Z2491
uuuuugaaugccu

SEQ ID NO: 1380135 - RNA, 22 nt, Neisseria meningitidis Z2491
uuuuuuagggaaacguuuguuu

SEQ ID NO: 1380136 - RNA, 23 nt, Neisseria meningitidis Z2491
aaaugugcauuucuaauuuuuau

SEQ ID NO: 1380137 - RNA, 17 nt, Neisseria meningitidis Z2491
aaauuaagcgugacgaa

SEQ ID NO: 1380138 - RNA, 16 nt, Neisseria meningitidis Z2491
aaauuaaauuuuauuu

SEQ ID NO: 1380139 - RNA, 17 nt, Neisseria meningitidis Z2491
aaauuaaauuuuauuua

SEQ ID NO: 1380140 - RNA, 19 nt, Neisseria meningitidis Z2491
aaauuaaauuuuauuuaaa

SEQ ID NO: 1380141 - RNA, 13 nt, Neisseria meningitidis Z2491
aaauuaaaauaaa

SEQ ID NO: 1380142 - RNA, 14 nt, Neisseria meningitidis Z2491
aaauuaaaauaaaa

SEQ ID NO: 1380143 - RNA, 15 nt, Neisseria meningitidis Z2491
aaauuaaaauaaaac

SEQ ID NO: 1380144 - RNA, 18 nt, Neisseria meningitidis Z2491
aaauuaaaauaaaaccga

SEQ ID NO: 1380145 - RNA, 17 nt, Neisseria meningitidis Z2491
aaauuaaaguuucagaa

SEQ ID NO: 1380146 - RNA, 23 nt, Neisseria meningitidis Z2491
aaauuccuguugcuuuucauuuc

SEQ ID NO: 1380147 - RNA, 23 nt, Neisseria meningitidis Z2491
aaauuccgucagcacguguucca

SEQ ID NO: 1380148 - RNA, 13 nt, Neisseria meningitidis Z2491
aaauuccuaaaac

SEQ ID NO: 1380149 - RNA, 14 nt, Neisseria meningitidis Z2491
aaauuccuaaaacu

SEQ ID NO: 1380150 - RNA, 15 nt, Neisseria meningitidis Z2491
aaauuccuaaaacuu

SEQ ID NO: 1380151 - RNA, 21 nt, Neisseria meningitidis Z2491
aaauuccuaaaacuuaaaauu

SEQ ID NO: 1380152 - RNA, 17 nt, Neisseria meningitidis Z2491
aaauucccuucccuccc

SEQ ID NO: 1380153 - RNA, 17 nt, Neisseria meningitidis Z2491
aaauuccuuucccuccc

SEQ ID NO: 1380154 - RNA, 19 nt, Neisseria meningitidis Z2491
aaauucuagauucccgccu

SEQ ID NO: 1380155 - RNA, 14 nt, Neisseria meningitidis Z2491
aaauucaaauuaag

SEQ ID NO: 1380156 - RNA, 22 nt, Neisseria meningitidis Z2491
aaauucaaaaacagaaauccca

SEQ ID NO: 1380157 - RNA, 19 nt, Neisseria meningitidis Z2491
aaauuaucgaugugcucgg

SEQ ID NO: 1380158 - RNA, 22 nt, Neisseria meningitidis Z2491
aaauuaucggucagcucuuuga

SEQ ID NO: 1380159 - RNA, 11 nt, Neisseria meningitidis Z2491
uuuuuuggcaa

SEQ ID NO: 1380160 - RNA, 14 nt, Neisseria meningitidis Z2491
uuuuuucauaccca

SEQ ID NO: 1380161 - RNA, 18 nt, Neisseria meningitidis Z2491
uuuuuuccgguaaauucc

SEQ ID NO: 1380162 - RNA, 16 nt, Neisseria meningitidis Z2491
uuuuguuaauccacua

SEQ ID NO: 1380163 - RNA, 17 nt, Neisseria meningitidis Z2491
uuuuguuaauccacuau

SEQ ID NO: 1380164 - RNA, 23 nt, Neisseria meningitidis Z2491
uuuuguuaauccacuauacugua

SEQ ID NO: 1380165 - RNA, 23 nt, Neisseria meningitidis Z2491
uuuuguuaaucacuauaccaaac

SEQ ID NO: 1380166 - RNA, 21 nt, Neisseria meningitidis Z2491
uuuugguauauuuuuucuaaa

SEQ ID NO: 1380167 - RNA, 13 nt, Neisseria meningitidis Z2491
uuuugguuuucua

SEQ ID NO: 1380168 - RNA, 16 nt, Neisseria meningitidis Z2491
uuuuguuuuuccaaac

SEQ ID NO: 1380169 - RNA, 22 nt, Neisseria meningitidis Z2491
uuuuuaauccacaguuuuucca

SEQ ID NO: 1380170 - RNA, 16 nt, Neisseria meningitidis Z2491
uuuuuauucaauguca

SEQ ID NO: 1380171 - RNA, 23 nt, Neisseria meningitidis Z2491
uuuuuacgcgugauuugccgcca

SEQ ID NO: 1380172 - RNA, 16 nt, Neisseria meningitidis Z2491
uuuuuauaccggggaa

SEQ ID NO: 1380173 - RNA, 17 nt, Neisseria meningitidis Z2491
uuuuuagggaaacguuu

SEQ ID NO: 1380174 - RNA, 19 nt, Neisseria meningitidis Z2491
uuuuucacggggaaaauac

SEQ ID NO: 1380175 - RNA, 18 nt, Neisseria meningitidis Z2491
uuuuuccacaaaagauac

SEQ ID NO: 1380176 - RNA, 12 nt, Neisseria meningitidis Z2491
uuuuuccaaacc

SEQ ID NO: 1380177 - RNA, 11 nt, Neisseria meningitidis Z2491
uuuuuccagca

SEQ ID NO: 1380178 - RNA, 17 nt, Neisseria meningitidis Z2491
uuuuuccgacaaauucc

SEQ ID NO: 1380179 - RNA, 18 nt, Neisseria meningitidis Z2491
uuuuuccgacaaauuccu

SEQ ID NO: 1380180 - RNA, 19 nt, Neisseria meningitidis Z2491
uuuuuccgauaaauuccua

SEQ ID NO: 1380181 - RNA, 18 nt, Neisseria meningitidis Z2491
uuuuuccgauaaauucuu

SEQ ID NO: 1380182 - RNA, 12 nt, Neisseria meningitidis Z2491
uuuuuccuguuc

SEQ ID NO: 1380183 - RNA, 19 nt, Neisseria meningitidis Z2491
uuuugcauuuugaaaauga

SEQ ID NO: 1380184 - RNA, 22 nt, Neisseria meningitidis Z2491
uuuugccguauccauaccaaac

SEQ ID NO: 1380185 - RNA, 24 nt, Neisseria meningitidis Z2491
uuuugccguccaucggcgcgccgc

SEQ ID NO: 1380186 - RNA, 14 nt, Neisseria meningitidis Z2491
uuuugcucauucac

SEQ ID NO: 1380187 - RNA, 11 nt, Neisseria meningitidis Z2491
uuuugcugccg

SEQ ID NO: 1380188 - RNA, 15 nt, Neisseria meningitidis Z2491
uuuuggcgcauuuuu

SEQ ID NO: 1380189 - RNA, 20 nt, Neisseria meningitidis Z2491
uuuuggagcaguaaaauuua

SEQ ID NO: 1380190 - RNA, 14 nt, Neisseria meningitidis Z2491
uuuugaugacaggg

SEQ ID NO: 1380191 - RNA, 22 nt, Neisseria meningitidis Z2491
uuuugcaagaauggcaaaauuu

SEQ ID NO: 1380192 - RNA, 23 nt, Neisseria meningitidis Z2491
uuuugcaagaauggcaaaauuuc

SEQ ID NO: 1380193 - RNA, 22 nt, Neisseria meningitidis Z2491
uuuugacuuuggaacaaaaaau

SEQ ID NO: 1380194 - RNA, 13 nt, Neisseria meningitidis Z2491
uuuucuucugaau

SEQ ID NO: 1380195 - RNA, 23 nt, Neisseria meningitidis Z2491
uuuucuuaugccuauuuuuuaau

SEQ ID NO: 1380196 - RNA, 14 nt, Neisseria meningitidis Z2491
uuugguauauuuuu

SEQ ID NO: 1380197 - RNA, 16 nt, Neisseria meningitidis Z2491
uuugguauauuuuuuc

SEQ ID NO: 1380198 - RNA, 20 nt, Neisseria meningitidis Z2491
uuugguaaaacgccaauuug

SEQ ID NO: 1380199 - RNA, 22 nt, Neisseria meningitidis Z2491
uuugguaaaacgccaauuugua

SEQ ID NO: 1380200 - RNA, 23 nt, Neisseria meningitidis Z2491
uuugguaaaacgccaauuuguau

SEQ ID NO: 1380201 - RNA, 18 nt, Neisseria meningitidis Z2491
uuugggugguuuucugaa

SEQ ID NO: 1380202 - RNA, 16 nt, Neisseria meningitidis Z2491
uuuggcgcauuuuuuc

SEQ ID NO: 1380203 - RNA, 21 nt, Neisseria meningitidis Z2491
uuuggcuuacccgcuuuuuuc

SEQ ID NO: 1380204 - RNA, 17 nt, Neisseria meningitidis Z2491
uuugggauauuuucuuc

SEQ ID NO: 1380205 - RNA, 17 nt, Neisseria meningitidis Z2491
uuugcuggaagcauuga

SEQ ID NO: 1380206 - RNA, 12 nt, Neisseria meningitidis Z2491
uuuggaacaaaa

SEQ ID NO: 1380207 - RNA, 14 nt, Neisseria meningitidis Z2491
uuuggaacaaaaaa

SEQ ID NO: 1380208 - RNA, 15 nt, Neisseria meningitidis Z2491
uuuggagcaguaaaa

SEQ ID NO: 1380209 - RNA, 20 nt, Neisseria meningitidis Z2491
uuuggagcaguaaaauuuau

SEQ ID NO: 1380210 - RNA, 16 nt, Neisseria meningitidis Z2491
uuuggcaaaauccggu

SEQ ID NO: 1380211 - RNA, 19 nt, Neisseria meningitidis Z2491
uuuguccgacacaaugaaa

SEQ ID NO: 1380212 - RNA, 19 nt, Neisseria meningitidis Z2491
uuugugcacucacuuugcu

SEQ ID NO: 1380213 - RNA, 23 nt, Neisseria meningitidis Z2491
uuugugaucgcgcugaaugucga

SEQ ID NO: 1380214 - RNA, 17 nt, Neisseria meningitidis Z2491
uuuguacugucugcagc

SEQ ID NO: 1380215 - RNA, 19 nt, Neisseria meningitidis Z2491
uuuguaagaguucguccca

SEQ ID NO: 1380216 - RNA, 17 nt, Neisseria meningitidis Z2491
uuugguuuccagauucc

SEQ ID NO: 1380217 - RNA, 14 nt, Neisseria meningitidis Z2491
uuugguuuauuuuu

SEQ ID NO: 1380218 - RNA, 14 nt, Neisseria meningitidis Z2491
uuugguuuucuauu

SEQ ID NO: 1380219 - RNA, 17 nt, Neisseria meningitidis Z2491
uuuguauuugaucaccg

SEQ ID NO: 1380220 - RNA, 19 nt, Neisseria meningitidis Z2491
uuuguuugccaucaggacu

SEQ ID NO: 1380221 - RNA, 14 nt, Neisseria meningitidis Z2491
uuuguuuacaugga

SEQ ID NO: 1380222 - RNA, 15 nt, Neisseria meningitidis Z2491
uuuguuuuauuuccc

SEQ ID NO: 1380223 - RNA, 15 nt, Neisseria meningitidis Z2491
uuuguugaauuuuau

SEQ ID NO: 1380224 - RNA, 22 nt, Neisseria meningitidis Z2491
uuuguuaauccacuauaaaaaa

SEQ ID NO: 1380225 - RNA, 15 nt, Neisseria meningitidis Z2491
uuuuaauuucuucua

SEQ ID NO: 1380226 - RNA, 20 nt, Neisseria meningitidis Z2491
uuuuaauuucuucuaucauu

SEQ ID NO: 1380227 - RNA, 22 nt, Neisseria meningitidis Z2491
uuuuacaaucagaauacugccu

SEQ ID NO: 1380228 - RNA, 19 nt, Neisseria meningitidis Z2491
uuuuacccucuccccgacc

SEQ ID NO: 1380229 - RNA, 20 nt, Neisseria meningitidis Z2491
uuuuaccguucaauuucaac

SEQ ID NO: 1380230 - RNA, 14 nt, Neisseria meningitidis Z2491
uuuuaccgagccua

SEQ ID NO: 1380231 - RNA, 16 nt, Neisseria meningitidis Z2491
uuuuacacaauuccca

SEQ ID NO: 1380232 - RNA, 18 nt, Neisseria meningitidis Z2491
uuuuaaccauacuucauu

SEQ ID NO: 1380233 - RNA, 13 nt, Neisseria meningitidis Z2491
uuuuagaacagaa

SEQ ID NO: 1380234 - RNA, 16 nt, Neisseria meningitidis Z2491
uuuuacguucuagauu

SEQ ID NO: 1380235 - RNA, 11 nt, Neisseria meningitidis Z2491
uuuuagguuuc

SEQ ID NO: 1380236 - RNA, 21 nt, Neisseria meningitidis Z2491
uuuuaggcaauugaaaaauuu

SEQ ID NO: 1380237 - RNA, 17 nt, Neisseria meningitidis Z2491
uuuuaucuuuuuugaau

SEQ ID NO: 1380238 - RNA, 13 nt, Neisseria meningitidis Z2491
uuuuaugccuguu

SEQ ID NO: 1380239 - RNA, 22 nt, Neisseria meningitidis Z2491
uuuuauaguggauuaaauuuaa

SEQ ID NO: 1380240 - RNA, 20 nt, Neisseria meningitidis Z2491
uuuuauccucggcagacaaa

SEQ ID NO: 1380241 - RNA, 19 nt, Neisseria meningitidis Z2491
uuuuauccgcacacgaacu

SEQ ID NO: 1380242 - RNA, 13 nt, Neisseria meningitidis Z2491
uuuuauuuacguu

SEQ ID NO: 1380243 - RNA, 23 nt, Neisseria meningitidis Z2491
uuuucgcaagacgcguuuugccu

SEQ ID NO: 1380244 - RNA, 13 nt, Neisseria meningitidis Z2491
uuuucgccuauca

SEQ ID NO: 1380245 - RNA, 18 nt, Neisseria meningitidis Z2491
uuuucgcgcaccagcaaa

SEQ ID NO: 1380246 - RNA, 19 nt, Neisseria meningitidis Z2491
uuuucggcggcguguuuga

SEQ ID NO: 1380247 - RNA, 15 nt, Neisseria meningitidis Z2491
uuuuccuacuuuuug

SEQ ID NO: 1380248 - RNA, 17 nt, Neisseria meningitidis Z2491
uuuuccugacaaauucc

SEQ ID NO: 1380249 - RNA, 18 nt, Neisseria meningitidis Z2491
uuuuccugacaaauuccc

SEQ ID NO: 1380250 - RNA, 20 nt, Neisseria meningitidis Z2491
uuuuccgauaaauuccuaaa

SEQ ID NO: 1380251 - RNA, 23 nt, Neisseria meningitidis Z2491
uuuuccgcccgaacggaaauaag

SEQ ID NO: 1380252 - RNA, 13 nt, Neisseria meningitidis Z2491
uuuucauuucuag

SEQ ID NO: 1380253 - RNA, 15 nt, Neisseria meningitidis Z2491
uuuucauuuuuggcu

SEQ ID NO: 1380254 - RNA, 16 nt, Neisseria meningitidis Z2491
uuuuccauaaaauaca

SEQ ID NO: 1380255 - RNA, 12 nt, Neisseria meningitidis Z2491
uuuuauuuuuug

SEQ ID NO: 1380256 - RNA, 15 nt, Neisseria meningitidis Z2491
uuuucaaaaugcaaa

SEQ ID NO: 1380257 - RNA, 16 nt, Neisseria meningitidis Z2491
uuuucaaaaugcaaaa

SEQ ID NO: 1380258 - RNA, 12 nt, Neisseria meningitidis Z2491
uuuucacaaaaa

SEQ ID NO: 1380259 - RNA, 13 nt, Neisseria meningitidis Z2491
uuuucauccacca

SEQ ID NO: 1380260 - RNA, 15 nt, Neisseria meningitidis Z2491
uuuucacaaaaacag

SEQ ID NO: 1380261 - RNA, 22 nt, Neisseria meningitidis Z2491
uuuucacaaaaacagaaaacca

SEQ ID NO: 1380262 - RNA, 12 nt, Neisseria meningitidis Z2491
uuuucacgggga

SEQ ID NO: 1380263 - RNA, 11 nt, Neisseria meningitidis Z2491
uuucugauuuu

SEQ ID NO: 1380264 - RNA, 13 nt, Neisseria meningitidis Z2491
uuucugauuuuga

SEQ ID NO: 1380265 - RNA, 14 nt, Neisseria meningitidis Z2491
uuucugauuuugag

SEQ ID NO: 1380266 - RNA, 14 nt, Neisseria meningitidis Z2491
uuucugauuuuucc

SEQ ID NO: 1380267 - RNA, 13 nt, Neisseria meningitidis Z2491
uuucuauugccuu

SEQ ID NO: 1380268 - RNA, 17 nt, Neisseria meningitidis Z2491
uuucuauuuuugugaaa

SEQ ID NO: 1380269 - RNA, 13 nt, Neisseria meningitidis Z2491
uuucuauuuugca

SEQ ID NO: 1380270 - RNA, 13 nt, Neisseria meningitidis Z2491
uuucggauaaauu

SEQ ID NO: 1380271 - RNA, 18 nt, Neisseria meningitidis Z2491
uuucgcuugugaaaauau

SEQ ID NO: 1380272 - RNA, 15 nt, Neisseria meningitidis Z2491
uuucggguucccaua

SEQ ID NO: 1380273 - RNA, 14 nt, Neisseria meningitidis Z2491
uuucgggcaaaagc

SEQ ID NO: 1380274 - RNA, 17 nt, Neisseria meningitidis Z2491
uuucguauauucugcaa

SEQ ID NO: 1380275 - RNA, 21 nt, Neisseria meningitidis Z2491
uuucguuaacagacuauuuuu

SEQ ID NO: 1380276 - RNA, 15 nt, Neisseria meningitidis Z2491
uuucuagauucccac

SEQ ID NO: 1380277 - RNA, 16 nt, Neisseria meningitidis Z2491
uuucuagauucccacu

SEQ ID NO: 1380278 - RNA, 15 nt, Neisseria meningitidis Z2491
uuuccuugcaacccc

SEQ ID NO: 1380279 - RNA, 20 nt, Neisseria meningitidis Z2491
uuuccuacuuuuugcucaau

SEQ ID NO: 1380280 - RNA, 22 nt, Neisseria meningitidis Z2491
uuuccgucauuucugauaaauu

SEQ ID NO: 1380281 - RNA, 22 nt, Neisseria meningitidis Z2491
uuuccuccucgccgucuuucag

SEQ ID NO: 1380282 - RNA, 15 nt, Neisseria meningitidis Z2491
uuuccucacugccgc

SEQ ID NO: 1380283 - RNA, 16 nt, Neisseria meningitidis Z2491
uuuccucuuucaucau

SEQ ID NO: 1380284 - RNA, 23 nt, Neisseria meningitidis Z2491
uuuccgcuugaaacaucugccgu

SEQ ID NO: 1380285 - RNA, 16 nt, Neisseria meningitidis Z2491
uuucccucagccaucu

SEQ ID NO: 1380286 - RNA, 20 nt, Neisseria meningitidis Z2491
uuuccgcaccgacagaccua

SEQ ID NO: 1380287 - RNA, 23 nt, Neisseria meningitidis Z2491
uuuccgcaccgacagaccuagau

SEQ ID NO: 1380288 - RNA, 22 nt, Neisseria meningitidis Z2491
uuuccgauaaauucuugcaacu

SEQ ID NO: 1380289 - RNA, 15 nt, Neisseria meningitidis Z2491
uuuccgauagauucc

SEQ ID NO: 1380290 - RNA, 18 nt, Neisseria meningitidis Z2491
uuucccgaaauuccaaca

SEQ ID NO: 1380291 - RNA, 15 nt, Neisseria meningitidis Z2491
uuuccauaaaauaca

SEQ ID NO: 1380292 - RNA, 16 nt, Neisseria meningitidis Z2491
uuuccauaaaauacau

SEQ ID NO: 1380293 - RNA, 16 nt, Neisseria meningitidis Z2491
uuugccgccacaaguc

SEQ ID NO: 1380294 - RNA, 22 nt, Neisseria meningitidis Z2491
uuugccgccugaugauuuuuuc

SEQ ID NO: 1380295 - RNA, 24 nt, Neisseria meningitidis Z2491
uuugcgccgcccgaaaaugucggu

SEQ ID NO: 1380296 - RNA, 18 nt, Neisseria meningitidis Z2491
uuugcgccucgccuuuca

SEQ ID NO: 1380297 - RNA, 19 nt, Neisseria meningitidis Z2491
uuugcgcgccuuuuuguuu

SEQ ID NO: 1380298 - RNA, 18 nt, Neisseria meningitidis Z2491
uuugauucaauauaaaca

SEQ ID NO: 1380299 - RNA, 13 nt, Neisseria meningitidis Z2491
uuugcagauaaau

SEQ ID NO: 1380300 - RNA, 18 nt, Neisseria meningitidis Z2491
uuugcagcccugauaaaa

SEQ ID NO: 1380301 - RNA, 14 nt, Neisseria meningitidis Z2491
uuugcaauaacaua

SEQ ID NO: 1380302 - RNA, 15 nt, Neisseria meningitidis Z2491
uuugcaagaauggca

SEQ ID NO: 1380303 - RNA, 18 nt, Neisseria meningitidis Z2491
uuugaguuucuagauucc

SEQ ID NO: 1380304 - RNA, 20 nt, Neisseria meningitidis Z2491
uuugaugaaacucaauauaa

SEQ ID NO: 1380305 - RNA, 18 nt, Neisseria meningitidis Z2491
uuugaugguuuugccgcu

SEQ ID NO: 1380306 - RNA, 15 nt, Neisseria meningitidis Z2491
uuugacgcauaaaaa

SEQ ID NO: 1380307 - RNA, 22 nt, Neisseria meningitidis Z2491
uuugacuuuuuuaccuugcugg

SEQ ID NO: 1380308 - RNA, 16 nt, Neisseria meningitidis Z2491
uuugagcaguuuuuug

SEQ ID NO: 1380309 - RNA, 17 nt, Neisseria meningitidis Z2491
uuugaauggaaaugccg

SEQ ID NO: 1380310 - RNA, 17 nt, Neisseria meningitidis Z2491
uuugaaagagaaaaggu

SEQ ID NO: 1380311 - RNA, 16 nt, Neisseria meningitidis Z2491
uuugaaucugacuugc

SEQ ID NO: 1380312 - RNA, 19 nt, Neisseria meningitidis Z2491
uuugaaucugacuugccau

SEQ ID NO: 1380313 - RNA, 23 nt, Neisseria meningitidis Z2491
uuugaaccagggauuuuucaaau

SEQ ID NO: 1380314 - RNA, 22 nt, Neisseria meningitidis Z2491
uuucuuugacaaaauccaguuc

SEQ ID NO: 1380315 - RNA, 15 nt, Neisseria meningitidis Z2491
uuucuugugucauuu

SEQ ID NO: 1380316 - RNA, 20 nt, Neisseria meningitidis Z2491
uuucuuaugccuauuuuuua

SEQ ID NO: 1380317 - RNA, 17 nt, Neisseria meningitidis Z2491
uuucuguuuggcuguuu

SEQ ID NO: 1380318 - RNA, 16 nt, Neisseria meningitidis Z2491
uuucuguuuggcuuuu

SEQ ID NO: 1380319 - RNA, 12 nt, Neisseria meningitidis Z2491
uuucuguuuuuu

SEQ ID NO: 1380320 - RNA, 13 nt, Neisseria meningitidis Z2491
uuucuguuuuuuc

SEQ ID NO: 1380321 - RNA, 16 nt, Neisseria meningitidis Z2491
uuucugucgccagcau

SEQ ID NO: 1380322 - RNA, 20 nt, Neisseria meningitidis Z2491
uuuauaguggauuaacaaaa

SEQ ID NO: 1380323 - RNA, 22 nt, Neisseria meningitidis Z2491
uuuauaguggauuaacaaaaac

SEQ ID NO: 1380324 - RNA, 16 nt, Neisseria meningitidis Z2491
uuuauuccgaaauauc

SEQ ID NO: 1380325 - RNA, 14 nt, Neisseria meningitidis Z2491
uuucaacaaucugc

SEQ ID NO: 1380326 - RNA, 13 nt, Neisseria meningitidis Z2491
uuuauuugagcaa

SEQ ID NO: 1380327 - RNA, 19 nt, Neisseria meningitidis Z2491
uuucaaaauuuauucuaaa

SEQ ID NO: 1380328 - RNA, 20 nt, Neisseria meningitidis Z2491
uuucaaaauuuauucuaaau

SEQ ID NO: 1380329 - RNA, 13 nt, Neisseria meningitidis Z2491
uuucacaucuuua

SEQ ID NO: 1380330 - RNA, 16 nt, Neisseria meningitidis Z2491
uuucacgggaaugacg

SEQ ID NO: 1380331 - RNA, 21 nt, Neisseria meningitidis Z2491
uuucaagaacaggcggcggca

SEQ ID NO: 1380332 - RNA, 17 nt, Neisseria meningitidis Z2491
uuucagacggcauuuuu

SEQ ID NO: 1380333 - RNA, 19 nt, Neisseria meningitidis Z2491
uuucagacggcauuuuuau

SEQ ID NO: 1380334 - RNA, 19 nt, Neisseria meningitidis Z2491
uuucagacggcauuuuuuc

SEQ ID NO: 1380335 - RNA, 19 nt, Neisseria meningitidis Z2491
uuucagacggcauuuuuuu

SEQ ID NO: 1380336 - RNA, 16 nt, Neisseria meningitidis Z2491
uuucagacggcacuuu

SEQ ID NO: 1380337 - RNA, 22 nt, Neisseria meningitidis Z2491
uuucagacggcacuuucauuca

SEQ ID NO: 1380338 - RNA, 18 nt, Neisseria meningitidis Z2491
uuucagacggcauaaaug

SEQ ID NO: 1380339 - RNA, 23 nt, Neisseria meningitidis Z2491
uuucagacggcaucaaaaugaca

SEQ ID NO: 1380340 - RNA, 18 nt, Neisseria meningitidis Z2491
uuucagacggcaucuuuu

SEQ ID NO: 1380341 - RNA, 16 nt, Neisseria meningitidis Z2491
uuucagacggcauuga

SEQ ID NO: 1380342 - RNA, 19 nt, Neisseria meningitidis Z2491
uuucagacggcauuucccg

SEQ ID NO: 1380343 - RNA, 21 nt, Neisseria meningitidis Z2491
uuucagacggcauuucuuaug

SEQ ID NO: 1380344 - RNA, 20 nt, Neisseria meningitidis Z2491
uuucagacggcauuuuccuu

SEQ ID NO: 1380345 - RNA, 17 nt, Neisseria meningitidis Z2491
uuucacuucgauuucuu

SEQ ID NO: 1380346 - RNA, 14 nt, Neisseria meningitidis Z2491
uuucacuuccaacu

SEQ ID NO: 1380347 - RNA, 12 nt, Neisseria meningitidis Z2491
uuucagauuauu

SEQ ID NO: 1380348 - RNA, 12 nt, Neisseria meningitidis Z2491
uuucauuucuag

SEQ ID NO: 1380349 - RNA, 15 nt, Neisseria meningitidis Z2491
uuucauuucuagauu

SEQ ID NO: 1380350 - RNA, 17 nt, Neisseria meningitidis Z2491
uuucauuucuagauucc

SEQ ID NO: 1380351 - RNA, 22 nt, Neisseria meningitidis Z2491
uuucauuucuagauucccacuu

SEQ ID NO: 1380352 - RNA, 12 nt, Neisseria meningitidis Z2491
uuuccaaaguga

SEQ ID NO: 1380353 - RNA, 22 nt, Neisseria meningitidis Z2491
uuuccaaauauaaaaaaugccg

SEQ ID NO: 1380354 - RNA, 19 nt, Neisseria meningitidis Z2491
uuuccaaacguuuuuccaa

SEQ ID NO: 1380355 - RNA, 22 nt, Neisseria meningitidis Z2491
uuuccaaacguuuuuccaaacc

SEQ ID NO: 1380356 - RNA, 13 nt, Neisseria meningitidis Z2491
uuuccacaaaaaa

SEQ ID NO: 1380357 - RNA, 15 nt, Neisseria meningitidis Z2491
uuuccacaaaaaaca

SEQ ID NO: 1380358 - RNA, 16 nt, Neisseria meningitidis Z2491
uuuccacaaaaaacag

SEQ ID NO: 1380359 - RNA, 23 nt, Neisseria meningitidis Z2491
uuuccaauacggcgaccagcguu

SEQ ID NO: 1380360 - RNA, 11 nt, Neisseria meningitidis Z2491
uuuccaauaca

SEQ ID NO: 1380361 - RNA, 21 nt, Neisseria meningitidis Z2491
uuuccaauacaacaaaaugcc

SEQ ID NO: 1380362 - RNA, 22 nt, Neisseria meningitidis Z2491
uuuccaauacaacaaaaugccg

SEQ ID NO: 1380363 - RNA, 15 nt, Neisseria meningitidis Z2491
uuucauccaccagcc

SEQ ID NO: 1380364 - RNA, 18 nt, Neisseria meningitidis Z2491
uuguuaugaugcguucaa

SEQ ID NO: 1380365 - RNA, 11 nt, Neisseria meningitidis Z2491
uuguuguauuc

SEQ ID NO: 1380366 - RNA, 14 nt, Neisseria meningitidis Z2491
uugcugccgugaug

SEQ ID NO: 1380367 - RNA, 18 nt, Neisseria meningitidis Z2491
uuguuaaguauuucuauu

SEQ ID NO: 1380368 - RNA, 13 nt, Neisseria meningitidis Z2491
uuguuaauccacu

SEQ ID NO: 1380369 - RNA, 15 nt, Neisseria meningitidis Z2491
uuguuaauucacuau

SEQ ID NO: 1380370 - RNA, 19 nt, Neisseria meningitidis Z2491
uuuaaaaggggcuguacua

SEQ ID NO: 1380371 - RNA, 23 nt, Neisseria meningitidis Z2491
uuguuucggagguuaacgcguua

SEQ ID NO: 1380372 - RNA, 13 nt, Neisseria meningitidis Z2491
uuuaaacaacaaa

SEQ ID NO: 1380373 - RNA, 17 nt, Neisseria meningitidis Z2491
uuuaguuucggucauuu

SEQ ID NO: 1380374 - RNA, 18 nt, Neisseria meningitidis Z2491
uuuacgauuacuuauuua

SEQ ID NO: 1380375 - RNA, 19 nt, Neisseria meningitidis Z2491
uuuaauuaagauccuccca

SEQ ID NO: 1380376 - RNA, 15 nt, Neisseria meningitidis Z2491
uuuacccgauaaguu

SEQ ID NO: 1380377 - RNA, 16 nt, Neisseria meningitidis Z2491
uuuacccgauaaguuu

SEQ ID NO: 1380378 - RNA, 13 nt, Neisseria meningitidis Z2491
uuuaauuuuguca

SEQ ID NO: 1380379 - RNA, 21 nt, Neisseria meningitidis Z2491
uugacaggucggacauuugac

SEQ ID NO: 1380380 - RNA, 17 nt, Neisseria meningitidis Z2491
uugaccaaagcauuuuu

SEQ ID NO: 1380381 - RNA, 12 nt, Neisseria meningitidis Z2491
uugacauauccg

SEQ ID NO: 1380382 - RNA, 19 nt, Neisseria meningitidis Z2491
uugacaaacauccauaucu

SEQ ID NO: 1380383 - RNA, 16 nt, Neisseria meningitidis Z2491
uugaauuucauuuuuc

SEQ ID NO: 1380384 - RNA, 18 nt, Neisseria meningitidis Z2491
uugaauuucauuuuucau

SEQ ID NO: 1380385 - RNA, 13 nt, Neisseria meningitidis Z2491
uugaauuuaauuu

SEQ ID NO: 1380386 - RNA, 13 nt, Neisseria meningitidis Z2491
uugacccauuacu

SEQ ID NO: 1380387 - RNA, 18 nt, Neisseria meningitidis Z2491
uugacgcauaaaaaugcg

SEQ ID NO: 1380388 - RNA, 16 nt, Neisseria meningitidis Z2491
uugaauggaaaugccg

SEQ ID NO: 1380389 - RNA, 22 nt, Neisseria meningitidis Z2491
uugaaugccuuucucuguuuuu

SEQ ID NO: 1380390 - RNA, 17 nt, Neisseria meningitidis Z2491
uugaauagcaugguuaa

SEQ ID NO: 1380391 - RNA, 14 nt, Neisseria meningitidis Z2491
uugaaauucuagau

SEQ ID NO: 1380392 - RNA, 13 nt, Neisseria meningitidis Z2491
uugaaagagaaaa

SEQ ID NO: 1380393 - RNA, 16 nt, Neisseria meningitidis Z2491
uugaaagagaaaaggu

SEQ ID NO: 1380394 - RNA, 24 nt, Neisseria meningitidis Z2491
uugaaaucaacagauugucaaaau

SEQ ID NO: 1380395 - RNA, 17 nt, Neisseria meningitidis Z2491
uugaaacgcgccuucau

SEQ ID NO: 1380396 - RNA, 21 nt, Neisseria meningitidis Z2491
uugaaacgguuguucaaaucg

SEQ ID NO: 1380397 - RNA, 18 nt, Neisseria meningitidis Z2491
uugaaaaauaauccuuau

SEQ ID NO: 1380398 - RNA, 23 nt, Neisseria meningitidis Z2491
uucugcgcaggcgggaauacaaa

SEQ ID NO: 1380399 - RNA, 20 nt, Neisseria meningitidis Z2491
uucuugauggcgaaagcaau

SEQ ID NO: 1380400 - RNA, 14 nt, Neisseria meningitidis Z2491
uucuugauuuuucu

SEQ ID NO: 1380401 - RNA, 13 nt, Neisseria meningitidis Z2491
uucuugaggcauu

SEQ ID NO: 1380402 - RNA, 23 nt, Neisseria meningitidis Z2491
uucuugaggcauugaaauuccag

SEQ ID NO: 1380403 - RNA, 18 nt, Neisseria meningitidis Z2491
uucuuugacggcgggcag

SEQ ID NO: 1380404 - RNA, 13 nt, Neisseria meningitidis Z2491
uucuuuccaucca

SEQ ID NO: 1380405 - RNA, 19 nt, Neisseria meningitidis Z2491
uucuuucacauccuccauc

SEQ ID NO: 1380406 - RNA, 15 nt, Neisseria meningitidis Z2491
uugagaccuuugcaa

SEQ ID NO: 1380407 - RNA, 20 nt, Neisseria meningitidis Z2491
uugacuuuggaacaaaaaau

SEQ ID NO: 1380408 - RNA, 22 nt, Neisseria meningitidis Z2491
uugaguuucagcuauuuagaau

SEQ ID NO: 1380409 - RNA, 21 nt, Neisseria meningitidis Z2491
uugagauuuuacguucuagau

SEQ ID NO: 1380410 - RNA, 14 nt, Neisseria meningitidis Z2491
uugagcaaaaagua

SEQ ID NO: 1380411 - RNA, 15 nt, Neisseria meningitidis Z2491
uugagcaaaaaguag

SEQ ID NO: 1380412 - RNA, 23 nt, Neisseria meningitidis Z2491
uugaucaccaucgagcugccuuu

SEQ ID NO: 1380413 - RNA, 18 nt, Neisseria meningitidis Z2491
uugauauggcguugacaa

SEQ ID NO: 1380414 - RNA, 21 nt, Neisseria meningitidis Z2491
uugauauggcguugacaaaca

SEQ ID NO: 1380415 - RNA, 22 nt, Neisseria meningitidis Z2491
uugauauggcguugacaaacau

SEQ ID NO: 1380416 - RNA, 19 nt, Neisseria meningitidis Z2491
uugaugaugucgaaggcgc

SEQ ID NO: 1380417 - RNA, 13 nt, Neisseria meningitidis Z2491
uugcaaaauagaa

SEQ ID NO: 1380418 - RNA, 15 nt, Neisseria meningitidis Z2491
uugcaaaauagaaaa

SEQ ID NO: 1380419 - RNA, 19 nt, Neisseria meningitidis Z2491
uugcaagcaguugaaauca

SEQ ID NO: 1380420 - RNA, 15 nt, Neisseria meningitidis Z2491
uugcaaggcaggcag

SEQ ID NO: 1380421 - RNA, 21 nt, Neisseria meningitidis Z2491
uugcaauauacugauuuauau

SEQ ID NO: 1380422 - RNA, 17 nt, Neisseria meningitidis Z2491
uugcaauauucgugaaa

SEQ ID NO: 1380423 - RNA, 14 nt, Neisseria meningitidis Z2491
uugcaagaaugacg

SEQ ID NO: 1380424 - RNA, 18 nt, Neisseria meningitidis Z2491
uugcaagaauggcaaaau

SEQ ID NO: 1380425 - RNA, 19 nt, Neisseria meningitidis Z2491
uugcaagaauggcaaaauu

SEQ ID NO: 1380426 - RNA, 14 nt, Neisseria meningitidis Z2491
uugcaaagaaaugu

SEQ ID NO: 1380427 - RNA, 19 nt, Neisseria meningitidis Z2491
uugcaaauaauugaaauca

SEQ ID NO: 1380428 - RNA, 20 nt, Neisseria meningitidis Z2491
uugcaaauaauugaaaucaa

SEQ ID NO: 1380429 - RNA, 22 nt, Neisseria meningitidis Z2491
uugcaaauaauugaaaucaaca

SEQ ID NO: 1380430 - RNA, 13 nt, Neisseria meningitidis Z2491
uugcccauagaaa

SEQ ID NO: 1380431 - RNA, 20 nt, Neisseria meningitidis Z2491
uugccaccaauaccgccuug

SEQ ID NO: 1380432 - RNA, 12 nt, Neisseria meningitidis Z2491
uugccaaggcgg

SEQ ID NO: 1380433 - RNA, 17 nt, Neisseria meningitidis Z2491
uugccucuauuuaaaaa

SEQ ID NO: 1380434 - RNA, 13 nt, Neisseria meningitidis Z2491
uugccucgccuug

SEQ ID NO: 1380435 - RNA, 24 nt, Neisseria meningitidis Z2491
uugccgcccgucccgaugccgcaa

SEQ ID NO: 1380436 - RNA, 15 nt, Neisseria meningitidis Z2491
uugcccgauuuaaag

SEQ ID NO: 1380437 - RNA, 17 nt, Neisseria meningitidis Z2491
uugcccgcgaaauaaag

SEQ ID NO: 1380438 - RNA, 19 nt, Neisseria meningitidis Z2491
uugcuccugauaaaugccg

SEQ ID NO: 1380439 - RNA, 19 nt, Neisseria meningitidis Z2491
uugcucccgauaaaugccg

SEQ ID NO: 1380440 - RNA, 23 nt, Neisseria meningitidis Z2491
uugcucaauauuaggaagguuuu

SEQ ID NO: 1380441 - RNA, 18 nt, Neisseria meningitidis Z2491
uugcgucugccuucuucu

SEQ ID NO: 1380442 - RNA, 13 nt, Neisseria meningitidis Z2491
uugcguucagacg

SEQ ID NO: 1380443 - RNA, 15 nt, Neisseria meningitidis Z2491
uugcgccgacagcag

SEQ ID NO: 1380444 - RNA, 16 nt, Neisseria meningitidis Z2491
uugcgccgguacccaa

SEQ ID NO: 1380445 - RNA, 16 nt, Neisseria meningitidis Z2491
uugccugauccaaacc

SEQ ID NO: 1380446 - RNA, 14 nt, Neisseria meningitidis Z2491
uugccugcaaugca

SEQ ID NO: 1380447 - RNA, 14 nt, Neisseria meningitidis Z2491
uucccgcgcaggcg

SEQ ID NO: 1380448 - RNA, 13 nt, Neisseria meningitidis Z2491
uuccgaagcgguu

SEQ ID NO: 1380449 - RNA, 19 nt, Neisseria meningitidis Z2491
uuccgaaaucauccacagc

SEQ ID NO: 1380450 - RNA, 13 nt, Neisseria meningitidis Z2491
uuccgaaaccaag

SEQ ID NO: 1380451 - RNA, 19 nt, Neisseria meningitidis Z2491
uuccgauaaauucuugcaa

SEQ ID NO: 1380452 - RNA, 19 nt, Neisseria meningitidis Z2491
uuccgauaaauucuugccg

SEQ ID NO: 1380453 - RNA, 13 nt, Neisseria meningitidis Z2491
uuccgcgcaggcg

SEQ ID NO: 1380454 - RNA, 19 nt, Neisseria meningitidis Z2491
uucccgcaaaaacaaaaaa

SEQ ID NO: 1380455 - RNA, 20 nt, Neisseria meningitidis Z2491
uucccacggaagugggaauc

SEQ ID NO: 1380456 - RNA, 18 nt, Neisseria meningitidis Z2491
uucccaauucuccccuac

SEQ ID NO: 1380457 - RNA, 22 nt, Neisseria meningitidis Z2491
uuccuguaaaaacaaaaaauca

SEQ ID NO: 1380458 - RNA, 14 nt, Neisseria meningitidis Z2491
uuccugccagacuu

SEQ ID NO: 1380459 - RNA, 21 nt, Neisseria meningitidis Z2491
uuccugauugaccgaaaaaua

SEQ ID NO: 1380460 - RNA, 23 nt, Neisseria meningitidis Z2491
uuccugauugaccgaaaaauaau

SEQ ID NO: 1380461 - RNA, 14 nt, Neisseria meningitidis Z2491
uuccucgauuugaa

SEQ ID NO: 1380462 - RNA, 21 nt, Neisseria meningitidis Z2491
uuccucacugccgccaauccu

SEQ ID NO: 1380463 - RNA, 17 nt, Neisseria meningitidis Z2491
uuccuccgcaaacacca

SEQ ID NO: 1380464 - RNA, 16 nt, Neisseria meningitidis Z2491
uuccuccacuaaaaaa

SEQ ID NO: 1380465 - RNA, 14 nt, Neisseria meningitidis Z2491
uuccgcuucuucca

SEQ ID NO: 1380466 - RNA, 17 nt, Neisseria meningitidis Z2491
uuccgcuucuuccagca

SEQ ID NO: 1380467 - RNA, 21 nt, Neisseria meningitidis Z2491
uuccagcgcaccuccauaauc

SEQ ID NO: 1380468 - RNA, 22 nt, Neisseria meningitidis Z2491
uuccagaccagccgccuccauc

SEQ ID NO: 1380469 - RNA, 19 nt, Neisseria meningitidis Z2491
uuccagacggcauuuuuca

SEQ ID NO: 1380470 - RNA, 15 nt, Neisseria meningitidis Z2491
uuccaccgcagcuuu

SEQ ID NO: 1380471 - RNA, 20 nt, Neisseria meningitidis Z2491
uuccaaugacugcgggcuuu

SEQ ID NO: 1380472 - RNA, 14 nt, Neisseria meningitidis Z2491
uuccacaaaagaua

SEQ ID NO: 1380473 - RNA, 20 nt, Neisseria meningitidis Z2491
uuccacaaaagauacacaca

SEQ ID NO: 1380474 - RNA, 16 nt, Neisseria meningitidis Z2491
uuccacaaauccgccu

SEQ ID NO: 1380475 - RNA, 18 nt, Neisseria meningitidis Z2491
uuccaucgcgucuucaaa

SEQ ID NO: 1380476 - RNA, 13 nt, Neisseria meningitidis Z2491
uuccaguuugaaa

SEQ ID NO: 1380477 - RNA, 12 nt, Neisseria meningitidis Z2491
uuccauaaaaua

SEQ ID NO: 1380478 - RNA, 14 nt, Neisseria meningitidis Z2491
uuccauaaaauaca

SEQ ID NO: 1380479 - RNA, 21 nt, Neisseria meningitidis Z2491
uucgcacgcaugaagccgucu

SEQ ID NO: 1380480 - RNA, 15 nt, Neisseria meningitidis Z2491
uuccuuucugacaaa

SEQ ID NO: 1380481 - RNA, 16 nt, Neisseria meningitidis Z2491
uucgcugccgccgccc

SEQ ID NO: 1380482 - RNA, 17 nt, Neisseria meningitidis Z2491
uucgccuuaaaaaacaa

SEQ ID NO: 1380483 - RNA, 14 nt, Neisseria meningitidis Z2491
uucgugcaucauca

SEQ ID NO: 1380484 - RNA, 12 nt, Neisseria meningitidis Z2491
uucgugggaaug

SEQ ID NO: 1380485 - RNA, 15 nt, Neisseria meningitidis Z2491
uucguguucgucuuu

SEQ ID NO: 1380486 - RNA, 17 nt, Neisseria meningitidis Z2491
uucuaacucuauuuccc

SEQ ID NO: 1380487 - RNA, 12 nt, Neisseria meningitidis Z2491
uucgguuuucua

SEQ ID NO: 1380488 - RNA, 21 nt, Neisseria meningitidis Z2491
uucgguuucaacgacuuccag

SEQ ID NO: 1380489 - RNA, 23 nt, Neisseria meningitidis Z2491
uucggagcaagaccaaacagaac

SEQ ID NO: 1380490 - RNA, 17 nt, Neisseria meningitidis Z2491
uucggacggcauuuuug

SEQ ID NO: 1380491 - RNA, 13 nt, Neisseria meningitidis Z2491
uucugcaaaaauc

SEQ ID NO: 1380492 - RNA, 14 nt, Neisseria meningitidis Z2491
uucucuuggucaaa

SEQ ID NO: 1380493 - RNA, 19 nt, Neisseria meningitidis Z2491
uucucuuggucaaaauguc

SEQ ID NO: 1380494 - RNA, 12 nt, Neisseria meningitidis Z2491
uucucuguuuuu

SEQ ID NO: 1380495 - RNA, 23 nt, Neisseria meningitidis Z2491
uucucuaaggugcugaagcacca

SEQ ID NO: 1380496 - RNA, 22 nt, Neisseria meningitidis Z2491
uucucauccaauucgauggaua

SEQ ID NO: 1380497 - RNA, 17 nt, Neisseria meningitidis Z2491
uucuauaaagccuaaau

SEQ ID NO: 1380498 - RNA, 22 nt, Neisseria meningitidis Z2491
uucucacaaaaacagaaauuca

SEQ ID NO: 1380499 - RNA, 18 nt, Neisseria meningitidis Z2491
uuauccgcacacgaacug

SEQ ID NO: 1380500 - RNA, 14 nt, Neisseria meningitidis Z2491
uuauccgaaaucac

SEQ ID NO: 1380501 - RNA, 15 nt, Neisseria meningitidis Z2491
uuaucagaaaugacg

SEQ ID NO: 1380502 - RNA, 21 nt, Neisseria meningitidis Z2491
uuaucagaugccgucugaaac

SEQ ID NO: 1380503 - RNA, 20 nt, Neisseria meningitidis Z2491
uuaucauaaaaucuauuauu

SEQ ID NO: 1380504 - RNA, 17 nt, Neisseria meningitidis Z2491
uuaucaucgauguuuuu

SEQ ID NO: 1380505 - RNA, 17 nt, Neisseria meningitidis Z2491
uuaucaggagcaacaga

SEQ ID NO: 1380506 - RNA, 20 nt, Neisseria meningitidis Z2491
uuauauuguuauuuuuauuu

SEQ ID NO: 1380507 - RNA, 12 nt, Neisseria meningitidis Z2491
uuauauucugau

SEQ ID NO: 1380508 - RNA, 11 nt, Neisseria meningitidis Z2491
uuauaguggau

SEQ ID NO: 1380509 - RNA, 14 nt, Neisseria meningitidis Z2491
uuauaguggauuaa

SEQ ID NO: 1380510 - RNA, 18 nt, Neisseria meningitidis Z2491
uuauaguggauuaacaaa

SEQ ID NO: 1380511 - RNA, 20 nt, Neisseria meningitidis Z2491
uuauaguggauuaacaaaaa

SEQ ID NO: 1380512 - RNA, 21 nt, Neisseria meningitidis Z2491
uuauaguggauuaacaaaaau

SEQ ID NO: 1380513 - RNA, 22 nt, Neisseria meningitidis Z2491
uuauaguggauuaacaaaaauc

SEQ ID NO: 1380514 - RNA, 23 nt, Neisseria meningitidis Z2491
uuaugcagauggcguuaccaaua

SEQ ID NO: 1380515 - RNA, 19 nt, Neisseria meningitidis Z2491
uuauguagauuuuuuuauu

SEQ ID NO: 1380516 - RNA, 23 nt, Neisseria meningitidis Z2491
uuauguuucaaaccucauucaaa

SEQ ID NO: 1380517 - RNA, 14 nt, Neisseria meningitidis Z2491
uuaucggguaaaac

SEQ ID NO: 1380518 - RNA, 15 nt, Neisseria meningitidis Z2491
uuaucggaaaaacag

SEQ ID NO: 1380519 - RNA, 15 nt, Neisseria meningitidis Z2491
uuaucggaaaugacc

SEQ ID NO: 1380520 - RNA, 14 nt, Neisseria meningitidis Z2491
uuaucggcaaaaaa

SEQ ID NO: 1380521 - RNA, 15 nt, Neisseria meningitidis Z2491
uuaucugacaggaaa

SEQ ID NO: 1380522 - RNA, 19 nt, Neisseria meningitidis Z2491
uuaucugacgcguuuuacc

SEQ ID NO: 1380523 - RNA, 11 nt, Neisseria meningitidis Z2491
uuaucuuuucu

SEQ ID NO: 1380524 - RNA, 18 nt, Neisseria meningitidis Z2491
uucagcaguauagugaau

SEQ ID NO: 1380525 - RNA, 18 nt, Neisseria meningitidis Z2491
uucagcaccuuagagaau

SEQ ID NO: 1380526 - RNA, 13 nt, Neisseria meningitidis Z2491
uucagagaaaugg

SEQ ID NO: 1380527 - RNA, 20 nt, Neisseria meningitidis Z2491
uucagagaaauggcaguauc

SEQ ID NO: 1380528 - RNA, 21 nt, Neisseria meningitidis Z2491
uucagagaaauggcaguauca

SEQ ID NO: 1380529 - RNA, 20 nt, Neisseria meningitidis Z2491
uucagacggcauauguuuuu

SEQ ID NO: 1380530 - RNA, 16 nt, Neisseria meningitidis Z2491
uucagacggcaucaaa

SEQ ID NO: 1380531 - RNA, 21 nt, Neisseria meningitidis Z2491
uucagacggcauuucgaggau

SEQ ID NO: 1380532 - RNA, 16 nt, Neisseria meningitidis Z2491
uucagacggcauuuuc

SEQ ID NO: 1380533 - RNA, 20 nt, Neisseria meningitidis Z2491
uucagacggcauuuucaaca

SEQ ID NO: 1380534 - RNA, 16 nt, Neisseria meningitidis Z2491
uucagacggcauuuuu

SEQ ID NO: 1380535 - RNA, 21 nt, Neisseria meningitidis Z2491
uucagacggccuuuggaaugg

SEQ ID NO: 1380536 - RNA, 16 nt, Neisseria meningitidis Z2491
uucagacggucugcca

SEQ ID NO: 1380537 - RNA, 21 nt, Neisseria meningitidis Z2491
uucagacagcccucuugccuu

SEQ ID NO: 1380538 - RNA, 15 nt, Neisseria meningitidis Z2491
uucaauccucaacuu

SEQ ID NO: 1380539 - RNA, 23 nt, Neisseria meningitidis Z2491
uucaaucaaugugccucuuccca

SEQ ID NO: 1380540 - RNA, 14 nt, Neisseria meningitidis Z2491
uucaauauacucaa

SEQ ID NO: 1380541 - RNA, 21 nt, Neisseria meningitidis Z2491
uucaauauacugcucgccaca

SEQ ID NO: 1380542 - RNA, 18 nt, Neisseria meningitidis Z2491
uucacaucuuuagacugc

SEQ ID NO: 1380543 - RNA, 22 nt, Neisseria meningitidis Z2491
uucaacgccgauuaauccgcuu

SEQ ID NO: 1380544 - RNA, 13 nt, Neisseria meningitidis Z2491
uucaagcaaaucu

SEQ ID NO: 1380545 - RNA, 17 nt, Neisseria meningitidis Z2491
uucaaacacaucgccuu

SEQ ID NO: 1380546 - RNA, 16 nt, Neisseria meningitidis Z2491
uucaaaccccuucaaa

SEQ ID NO: 1380547 - RNA, 21 nt, Neisseria meningitidis Z2491
uucaaacgggacugccuacac

SEQ ID NO: 1380548 - RNA, 20 nt, Neisseria meningitidis Z2491
uucaaaagccgugugaaaau

SEQ ID NO: 1380549 - RNA, 15 nt, Neisseria meningitidis Z2491
uucaaaaugcaaaac

SEQ ID NO: 1380550 - RNA, 18 nt, Neisseria meningitidis Z2491
uucaaaaugcaaaacuuu

SEQ ID NO: 1380551 - RNA, 17 nt, Neisseria meningitidis Z2491
uucaaaagguucaaaca

SEQ ID NO: 1380552 - RNA, 19 nt, Neisseria meningitidis Z2491
uuauuugagcaaaugccgu

SEQ ID NO: 1380553 - RNA, 16 nt, Neisseria meningitidis Z2491
uuauuuaaauaaaauu

SEQ ID NO: 1380554 - RNA, 20 nt, Neisseria meningitidis Z2491
uuaggguucugauuuuguuu

SEQ ID NO: 1380555 - RNA, 15 nt, Neisseria meningitidis Z2491
uuagguugcggucau

SEQ ID NO: 1380556 - RNA, 13 nt, Neisseria meningitidis Z2491
uuauacuggcaaa

SEQ ID NO: 1380557 - RNA, 19 nt, Neisseria meningitidis Z2491
uuauagaauuauccacaga

SEQ ID NO: 1380558 - RNA, 20 nt, Neisseria meningitidis Z2491
uuauaccauaaauuuuaaau

SEQ ID NO: 1380559 - RNA, 22 nt, Neisseria meningitidis Z2491
uuauacacacgguuuucacauc

SEQ ID NO: 1380560 - RNA, 22 nt, Neisseria meningitidis Z2491
uuauaaaagacauugccaaaua

SEQ ID NO: 1380561 - RNA, 15 nt, Neisseria meningitidis Z2491
uuauaaacaaaaaac

SEQ ID NO: 1380562 - RNA, 20 nt, Neisseria meningitidis Z2491
uuauaaacaaaaaacagcaa

SEQ ID NO: 1380563 - RNA, 21 nt, Neisseria meningitidis Z2491
uuacguucuggauucccacuu

SEQ ID NO: 1380564 - RNA, 17 nt, Neisseria meningitidis Z2491
uuacguuuauuuacgau

SEQ ID NO: 1380565 - RNA, 22 nt, Neisseria meningitidis Z2491
uuacuaaaacacagccaaaaua

SEQ ID NO: 1380566 - RNA, 14 nt, Neisseria meningitidis Z2491
uuacuaaaauuuua

SEQ ID NO: 1380567 - RNA, 21 nt, Neisseria meningitidis Z2491
uuacuaaaauuuuaugcucaa

SEQ ID NO: 1380568 - RNA, 22 nt, Neisseria meningitidis Z2491
uuacucauucaauccucaacuu

SEQ ID NO: 1380569 - RNA, 23 nt, Neisseria meningitidis Z2491
uuacugccgcaaacggcaggcaa

SEQ ID NO: 1380570 - RNA, 17 nt, Neisseria meningitidis Z2491
uuagcugaagcuuuaga

SEQ ID NO: 1380571 - RNA, 20 nt, Neisseria meningitidis Z2491
uuagaguuucaaaauuuauu

SEQ ID NO: 1380572 - RNA, 22 nt, Neisseria meningitidis Z2491
uuacauggauuacugucuuauu

SEQ ID NO: 1380573 - RNA, 17 nt, Neisseria meningitidis Z2491
uuaaugauuaucauaaa

SEQ ID NO: 1380574 - RNA, 15 nt, Neisseria meningitidis Z2491
uuaauuaagauccuc

SEQ ID NO: 1380575 - RNA, 21 nt, Neisseria meningitidis Z2491
uuaagacguggugcuaaaaca

SEQ ID NO: 1380576 - RNA, 18 nt, Neisseria meningitidis Z2491
uuaagcgugacgaaaauu

SEQ ID NO: 1380577 - RNA, 16 nt, Neisseria meningitidis Z2491
uguggaaaaaguccag

SEQ ID NO: 1380578 - RNA, 20 nt, Neisseria meningitidis Z2491
uguggaucauaauagaguga

SEQ ID NO: 1380579 - RNA, 14 nt, Neisseria meningitidis Z2491
uuaaccguaucaaa

SEQ ID NO: 1380580 - RNA, 15 nt, Neisseria meningitidis Z2491
uuaaccguaucaaac

SEQ ID NO: 1380581 - RNA, 13 nt, Neisseria meningitidis Z2491
uuaaccugcaaaa

SEQ ID NO: 1380582 - RNA, 20 nt, Neisseria meningitidis Z2491
uuaaccugcaaaacaucguu

SEQ ID NO: 1380583 - RNA, 17 nt, Neisseria meningitidis Z2491
uuaauccgcuauaauuu

SEQ ID NO: 1380584 - RNA, 23 nt, Neisseria meningitidis Z2491
uuaauccgcuauaauuuauugaa

SEQ ID NO: 1380585 - RNA, 15 nt, Neisseria meningitidis Z2491
uggauuaacaaaaau

SEQ ID NO: 1380586 - RNA, 21 nt, Neisseria meningitidis Z2491
uggauuaacaaaaaucaggac

SEQ ID NO: 1380587 - RNA, 22 nt, Neisseria meningitidis Z2491
uggauuaacaaaaaucaggaca

SEQ ID NO: 1380588 - RNA, 14 nt, Neisseria meningitidis Z2491
uggauuaaauuuaa

SEQ ID NO: 1380589 - RNA, 14 nt, Neisseria meningitidis Z2491
uggauuaaauuuau

SEQ ID NO: 1380590 - RNA, 15 nt, Neisseria meningitidis Z2491
uggauuaacaaaaac

SEQ ID NO: 1380591 - RNA, 22 nt, Neisseria meningitidis Z2491
uggauuauaguggauuaaauuu

SEQ ID NO: 1380592 - RNA, 15 nt, Neisseria meningitidis Z2491
uggauuugucuucaa

SEQ ID NO: 1380593 - RNA, 14 nt, Neisseria meningitidis Z2491
uggauuuuuuuaua

SEQ ID NO: 1380594 - RNA, 17 nt, Neisseria meningitidis Z2491
uggcaguaauccaaggc

SEQ ID NO: 1380595 - RNA, 17 nt, Neisseria meningitidis Z2491
uggauaaaaccgcucac

SEQ ID NO: 1380596 - RNA, 17 nt, Neisseria meningitidis Z2491
uggagucgccuucgcaa

SEQ ID NO: 1380597 - RNA, 21 nt, Neisseria meningitidis Z2491
uggauaccgucugaacaucgu

SEQ ID NO: 1380598 - RNA, 18 nt, Neisseria meningitidis Z2491
uggauauugccguuuucc

SEQ ID NO: 1380599 - RNA, 20 nt, Neisseria meningitidis Z2491
uggauauugccguuuuccuu

SEQ ID NO: 1380600 - RNA, 22 nt, Neisseria meningitidis Z2491
uggaugaacaauccauacaucu

SEQ ID NO: 1380601 - RNA, 21 nt, Neisseria meningitidis Z2491
uggaugaucggagugauuauc

SEQ ID NO: 1380602 - RNA, 12 nt, Neisseria meningitidis Z2491
uggaugaauucg

SEQ ID NO: 1380603 - RNA, 18 nt, Neisseria meningitidis Z2491
uggagcaguaaaauuuau

SEQ ID NO: 1380604 - RNA, 12 nt, Neisseria meningitidis Z2491
uggagaaaauau

SEQ ID NO: 1380605 - RNA, 12 nt, Neisseria meningitidis Z2491
uggcgcauuuuu

SEQ ID NO: 1380606 - RNA, 16 nt, Neisseria meningitidis Z2491
uggcgcauuuuuaugc

SEQ ID NO: 1380607 - RNA, 17 nt, Neisseria meningitidis Z2491
uggcuaacguacaaaug

SEQ ID NO: 1380608 - RNA, 20 nt, Neisseria meningitidis Z2491
uggcgcgcgaggcgugccuu

SEQ ID NO: 1380609 - RNA, 15 nt, Neisseria meningitidis Z2491
ugggacgguucggac

SEQ ID NO: 1380610 - RNA, 18 nt, Neisseria meningitidis Z2491
ugggaaugacaggaugua

SEQ ID NO: 1380611 - RNA, 12 nt, Neisseria meningitidis Z2491
ugggaauccaga

SEQ ID NO: 1380612 - RNA, 20 nt, Neisseria meningitidis Z2491
uggcuguguuucaauauggu

SEQ ID NO: 1380613 - RNA, 16 nt, Neisseria meningitidis Z2491
uggcuguauuuuaaua

SEQ ID NO: 1380614 - RNA, 12 nt, Neisseria meningitidis Z2491
ugggaaaugccg

SEQ ID NO: 1380615 - RNA, 15 nt, Neisseria meningitidis Z2491
uggcugaugacggca

SEQ ID NO: 1380616 - RNA, 13 nt, Neisseria meningitidis Z2491
ugggcuucaucag

SEQ ID NO: 1380617 - RNA, 19 nt, Neisseria meningitidis Z2491
ugggcugaaauagaaaaua

SEQ ID NO: 1380618 - RNA, 19 nt, Neisseria meningitidis Z2491
ugugaucgcgcugaauguc

SEQ ID NO: 1380619 - RNA, 20 nt, Neisseria meningitidis Z2491
ugucuucauacgacucaaaa

SEQ ID NO: 1380620 - RNA, 13 nt, Neisseria meningitidis Z2491
ugucuuuucccuu

SEQ ID NO: 1380621 - RNA, 18 nt, Neisseria meningitidis Z2491
ugugaaauaaaaaaugcc

SEQ ID NO: 1380622 - RNA, 19 nt, Neisseria meningitidis Z2491
ugugaaauaaaaaaugccg

SEQ ID NO: 1380623 - RNA, 23 nt, Neisseria meningitidis Z2491
ugugaaaauaacgggauuucagc

SEQ ID NO: 1380624 - RNA, 12 nt, Neisseria meningitidis Z2491
ugucugaaaccu

SEQ ID NO: 1380625 - RNA, 15 nt, Neisseria meningitidis Z2491
ugucggcuuuugaca

SEQ ID NO: 1380626 - RNA, 16 nt, Neisseria meningitidis Z2491
ugucgcagcugcucag

SEQ ID NO: 1380627 - RNA, 18 nt, Neisseria meningitidis Z2491
ugucggaauaagguuuga

SEQ ID NO: 1380628 - RNA, 22 nt, Neisseria meningitidis Z2491
ugucggaauaagguuugagcag

SEQ ID NO: 1380629 - RNA, 18 nt, Neisseria meningitidis Z2491
ugucgaguucuuuuaaag

SEQ ID NO: 1380630 - RNA, 20 nt, Neisseria meningitidis Z2491
uguccggcaugauuuucuuu

SEQ ID NO: 1380631 - RNA, 22 nt, Neisseria meningitidis Z2491
uguccguuugcggguuuauucc

SEQ ID NO: 1380632 - RNA, 15 nt, Neisseria meningitidis Z2491
uguccguuuucuucu

SEQ ID NO: 1380633 - RNA, 22 nt, Neisseria meningitidis Z2491
uguccgaaugccgcaaaugccg

SEQ ID NO: 1380634 - RNA, 21 nt, Neisseria meningitidis Z2491
uguccugauuuuuguuaaucc

SEQ ID NO: 1380635 - RNA, 22 nt, Neisseria meningitidis Z2491
uguccugcuggcagucuaucag

SEQ ID NO: 1380636 - RNA, 22 nt, Neisseria meningitidis Z2491
ugucccacagagcgaacaaguu

SEQ ID NO: 1380637 - RNA, 17 nt, Neisseria meningitidis Z2491
uguacugguuuaaauuu

SEQ ID NO: 1380638 - RNA, 19 nt, Neisseria meningitidis Z2491
uguaucggugucaaaacaa

SEQ ID NO: 1380639 - RNA, 14 nt, Neisseria meningitidis Z2491
uguauuuuaauaau

SEQ ID NO: 1380640 - RNA, 16 nt, Neisseria meningitidis Z2491
uguauuugcgccgccc

SEQ ID NO: 1380641 - RNA, 18 nt, Neisseria meningitidis Z2491
uguauucggaggcgcauu

SEQ ID NO: 1380642 - RNA, 13 nt, Neisseria meningitidis Z2491
uggugcuaaaaca

SEQ ID NO: 1380643 - RNA, 19 nt, Neisseria meningitidis Z2491
uggugcugauaacauacuu

SEQ ID NO: 1380644 - RNA, 13 nt, Neisseria meningitidis Z2491
ugguguuugcaga

SEQ ID NO: 1380645 - RNA, 21 nt, Neisseria meningitidis Z2491
uguaauuaggcuccuuaugca

SEQ ID NO: 1380646 - RNA, 15 nt, Neisseria meningitidis Z2491
ugguuggaacagauu

SEQ ID NO: 1380647 - RNA, 20 nt, Neisseria meningitidis Z2491
ugguuguucagaaaauccgc

SEQ ID NO: 1380648 - RNA, 20 nt, Neisseria meningitidis Z2491
ugguuugaaccagggauuuu

SEQ ID NO: 1380649 - RNA, 12 nt, Neisseria meningitidis Z2491
ugguugaaaacg

SEQ ID NO: 1380650 - RNA, 14 nt, Neisseria meningitidis Z2491
ugguuuucaaaaca

SEQ ID NO: 1380651 - RNA, 15 nt, Neisseria meningitidis Z2491
uguaaagauaaaucu

SEQ ID NO: 1380652 - RNA, 17 nt, Neisseria meningitidis Z2491
uguaaagauaaaucuau

SEQ ID NO: 1380653 - RNA, 18 nt, Neisseria meningitidis Z2491
uguaaacgaauugaauca

SEQ ID NO: 1380654 - RNA, 13 nt, Neisseria meningitidis Z2491
ugccgucugaaag

SEQ ID NO: 1380655 - RNA, 17 nt, Neisseria meningitidis Z2491
ugccgucugaaauguuc

SEQ ID NO: 1380656 - RNA, 22 nt, Neisseria meningitidis Z2491
ugccgucugaacaucuuucaga

SEQ ID NO: 1380657 - RNA, 22 nt, Neisseria meningitidis Z2491
ugccgucugaagcccugccugc

SEQ ID NO: 1380658 - RNA, 15 nt, Neisseria meningitidis Z2491
ugccgucugaagccu

SEQ ID NO: 1380659 - RNA, 20 nt, Neisseria meningitidis Z2491
ugccgucugaagccuucaga

SEQ ID NO: 1380660 - RNA, 18 nt, Neisseria meningitidis Z2491
ugccgucugaaggcuuca

SEQ ID NO: 1380661 - RNA, 13 nt, Neisseria meningitidis Z2491
ugccgucugagaa

SEQ ID NO: 1380662 - RNA, 20 nt, Neisseria meningitidis Z2491
ugccgucugagaacuucaga

SEQ ID NO: 1380663 - RNA, 15 nt, Neisseria meningitidis Z2491
ugccucgccuuagcu

SEQ ID NO: 1380664 - RNA, 16 nt, Neisseria meningitidis Z2491
ugccuguaaaaccaag

SEQ ID NO: 1380665 - RNA, 16 nt, Neisseria meningitidis Z2491
ugccugauccaaaccg

SEQ ID NO: 1380666 - RNA, 14 nt, Neisseria meningitidis Z2491
ugccucuuuucaga

SEQ ID NO: 1380667 - RNA, 14 nt, Neisseria meningitidis Z2491
ugccuguuuuucuu

SEQ ID NO: 1380668 - RNA, 15 nt, Neisseria meningitidis Z2491
ugccuucuucuuugc

SEQ ID NO: 1380669 - RNA, 13 nt, Neisseria meningitidis Z2491
ugccuuauguaua

SEQ ID NO: 1380670 - RNA, 21 nt, Neisseria meningitidis Z2491
ugccuuauguauaguaauaaa

SEQ ID NO: 1380671 - RNA, 14 nt, Neisseria meningitidis Z2491
ugccuucauucuug

SEQ ID NO: 1380672 - RNA, 19 nt, Neisseria meningitidis Z2491
ugccaccgcgcgccaaggc

SEQ ID NO: 1380673 - RNA, 21 nt, Neisseria meningitidis Z2491
ugccaccgcgcgccaaggcuu

SEQ ID NO: 1380674 - RNA, 16 nt, Neisseria meningitidis Z2491
ugccguacuauuugua

SEQ ID NO: 1380675 - RNA, 13 nt, Neisseria meningitidis Z2491
ugccgucugaaaa

SEQ ID NO: 1380676 - RNA, 14 nt, Neisseria meningitidis Z2491
ugccgucugaaaaa

SEQ ID NO: 1380677 - RNA, 17 nt, Neisseria meningitidis Z2491
ugccgucugaaaacagg

SEQ ID NO: 1380678 - RNA, 17 nt, Neisseria meningitidis Z2491
ugccgucugaaaagucu

SEQ ID NO: 1380679 - RNA, 18 nt, Neisseria meningitidis Z2491
ugccgucugaaacagguu

SEQ ID NO: 1380680 - RNA, 17 nt, Neisseria meningitidis Z2491
ugccgucugaaacccga

SEQ ID NO: 1380681 - RNA, 23 nt, Neisseria meningitidis Z2491
ugccgucugaaacccggaaaaaa

SEQ ID NO: 1380682 - RNA, 15 nt, Neisseria meningitidis Z2491
ugccgucugaaaccu

SEQ ID NO: 1380683 - RNA, 20 nt, Neisseria meningitidis Z2491
ugccgucugaaacguugugc

SEQ ID NO: 1380684 - RNA, 16 nt, Neisseria meningitidis Z2491
ugccgggguaauccaa

SEQ ID NO: 1380685 - RNA, 19 nt, Neisseria meningitidis Z2491
ugcgaaagggcaguuggga

SEQ ID NO: 1380686 - RNA, 22 nt, Neisseria meningitidis Z2491
ugcgaaaugccgucugaagccu

SEQ ID NO: 1380687 - RNA, 23 nt, Neisseria meningitidis Z2491
ugccuuguaaaaaugccgucuga

SEQ ID NO: 1380688 - RNA, 22 nt, Neisseria meningitidis Z2491
ugccuuguccugauuuaaauuu

SEQ ID NO: 1380689 - RNA, 18 nt, Neisseria meningitidis Z2491
ugccuuuucccugacaaa

SEQ ID NO: 1380690 - RNA, 12 nt, Neisseria meningitidis Z2491
ugccuuucucug

SEQ ID NO: 1380691 - RNA, 20 nt, Neisseria meningitidis Z2491
ugcgccauuauacuggcaaa

SEQ ID NO: 1380692 - RNA, 16 nt, Neisseria meningitidis Z2491
ugcgccgacagcagcu

SEQ ID NO: 1380693 - RNA, 19 nt, Neisseria meningitidis Z2491
ugcgcccgauguagucguu

SEQ ID NO: 1380694 - RNA, 17 nt, Neisseria meningitidis Z2491
ugcgaugacgaagccga

SEQ ID NO: 1380695 - RNA, 15 nt, Neisseria meningitidis Z2491
ugcgccacggcauaa

SEQ ID NO: 1380696 - RNA, 18 nt, Neisseria meningitidis Z2491
ugcucaauauuaggaagg

SEQ ID NO: 1380697 - RNA, 14 nt, Neisseria meningitidis Z2491
ugcucagcccgaaa

SEQ ID NO: 1380698 - RNA, 18 nt, Neisseria meningitidis Z2491
ugcguuuugacaaaauca

SEQ ID NO: 1380699 - RNA, 12 nt, Neisseria meningitidis Z2491
ugcuaaggcaau

SEQ ID NO: 1380700 - RNA, 21 nt, Neisseria meningitidis Z2491
ugcuauuuuuuguugcauaau

SEQ ID NO: 1380701 - RNA, 14 nt, Neisseria meningitidis Z2491
ugcggcaucaggaa

SEQ ID NO: 1380702 - RNA, 15 nt, Neisseria meningitidis Z2491
ugcggcacgccgccg

SEQ ID NO: 1380703 - RNA, 22 nt, Neisseria meningitidis Z2491
ugcggcacuagccaaaaaaacc

SEQ ID NO: 1380704 - RNA, 14 nt, Neisseria meningitidis Z2491
ugcggcgggcuugg

SEQ ID NO: 1380705 - RNA, 14 nt, Neisseria meningitidis Z2491
ugcggcuguggaac

SEQ ID NO: 1380706 - RNA, 20 nt, Neisseria meningitidis Z2491
ugcggcucgccgccuugucc

SEQ ID NO: 1380707 - RNA, 17 nt, Neisseria meningitidis Z2491
ugcggaaacguaucgga

SEQ ID NO: 1380708 - RNA, 23 nt, Neisseria meningitidis Z2491
ugcggaaacuuaucggguaaaac

SEQ ID NO: 1380709 - RNA, 13 nt, Neisseria meningitidis Z2491
ugcgccggcauaa

SEQ ID NO: 1380710 - RNA, 15 nt, Neisseria meningitidis Z2491
ugcgccggcauaacc

SEQ ID NO: 1380711 - RNA, 19 nt, Neisseria meningitidis Z2491
ugcgccgguacccaaacuu

SEQ ID NO: 1380712 - RNA, 16 nt, Neisseria meningitidis Z2491
ugcgguucggacggca

SEQ ID NO: 1380713 - RNA, 15 nt, Neisseria meningitidis Z2491
ugcgucaaaccagcu

SEQ ID NO: 1380714 - RNA, 18 nt, Neisseria meningitidis Z2491
ugcgggaauagcucaguu

SEQ ID NO: 1380715 - RNA, 19 nt, Neisseria meningitidis Z2491
ugcguuucagagcauugcg

SEQ ID NO: 1380716 - RNA, 18 nt, Neisseria meningitidis Z2491
ugcgucugccuucuucuu

SEQ ID NO: 1380717 - RNA, 14 nt, Neisseria meningitidis Z2491
uggaaucuaagaaa

SEQ ID NO: 1380718 - RNA, 23 nt, Neisseria meningitidis Z2491
uggacaacagcggguaggcggga

SEQ ID NO: 1380719 - RNA, 20 nt, Neisseria meningitidis Z2491
uggacagaaacgaaaaugcc

SEQ ID NO: 1380720 - RNA, 14 nt, Neisseria meningitidis Z2491
uggaccucaggccg

SEQ ID NO: 1380721 - RNA, 20 nt, Neisseria meningitidis Z2491
uggacgacgcggcugcugcc

SEQ ID NO: 1380722 - RNA, 21 nt, Neisseria meningitidis Z2491
uggacgacgcggcugcugccu

SEQ ID NO: 1380723 - RNA, 11 nt, Neisseria meningitidis Z2491
uggaacagaaa

SEQ ID NO: 1380724 - RNA, 22 nt, Neisseria meningitidis Z2491
uggaacaaagaaagcagaaaua

SEQ ID NO: 1380725 - RNA, 22 nt, Neisseria meningitidis Z2491
uggaaaguggguguagcguggg

SEQ ID NO: 1380726 - RNA, 19 nt, Neisseria meningitidis Z2491
uggaaagcguguuccgcau

SEQ ID NO: 1380727 - RNA, 20 nt, Neisseria meningitidis Z2491
uggaaaugccgucugaagcc

SEQ ID NO: 1380728 - RNA, 22 nt, Neisseria meningitidis Z2491
uggaaauuaucggucagcucuu

SEQ ID NO: 1380729 - RNA, 16 nt, Neisseria meningitidis Z2491
ugcuuucuccgggccc

SEQ ID NO: 1380730 - RNA, 15 nt, Neisseria meningitidis Z2491
ugcuuucgcugccgc

SEQ ID NO: 1380731 - RNA, 20 nt, Neisseria meningitidis Z2491
ugcuuucgcugccgccgccc

SEQ ID NO: 1380732 - RNA, 12 nt, Neisseria meningitidis Z2491
ugcuuucgcuuu

SEQ ID NO: 1380733 - RNA, 13 nt, Neisseria meningitidis Z2491
ugcuuugcgcgcc

SEQ ID NO: 1380734 - RNA, 20 nt, Neisseria meningitidis Z2491
ugcuuuggcagcacaggcaa

SEQ ID NO: 1380735 - RNA, 21 nt, Neisseria meningitidis Z2491
ugcuuuggcagcacaggcaag

SEQ ID NO: 1380736 - RNA, 20 nt, Neisseria meningitidis Z2491
ugcuuuggcagcccauucug

SEQ ID NO: 1380737 - RNA, 17 nt, Neisseria meningitidis Z2491
ugcuuauugcacuaaaa

SEQ ID NO: 1380738 - RNA, 15 nt, Neisseria meningitidis Z2491
ugcugucugaaaccu

SEQ ID NO: 1380739 - RNA, 17 nt, Neisseria meningitidis Z2491
ugcugucugaaaccuga

SEQ ID NO: 1380740 - RNA, 13 nt, Neisseria meningitidis Z2491
ugcuguuggaaaa

SEQ ID NO: 1380741 - RNA, 22 nt, Neisseria meningitidis Z2491
ugcuguuguucuaaggucuaga

SEQ ID NO: 1380742 - RNA, 20 nt, Neisseria meningitidis Z2491
ugcuuaaacagcacugccuc

SEQ ID NO: 1380743 - RNA, 21 nt, Neisseria meningitidis Z2491
ugcuuaaacagcacugccucu

SEQ ID NO: 1380744 - RNA, 14 nt, Neisseria meningitidis Z2491
ugcuguauuuuucc

SEQ ID NO: 1380745 - RNA, 21 nt, Neisseria meningitidis Z2491
ugcugcguuuggagaaaauau

SEQ ID NO: 1380746 - RNA, 14 nt, Neisseria meningitidis Z2491
ugcugcuuuucauu

SEQ ID NO: 1380747 - RNA, 18 nt, Neisseria meningitidis Z2491
ugcugcuguauuuuucca

SEQ ID NO: 1380748 - RNA, 12 nt, Neisseria meningitidis Z2491
ugcuggcugccg

SEQ ID NO: 1380749 - RNA, 13 nt, Neisseria meningitidis Z2491
ugcugaagcacca

SEQ ID NO: 1380750 - RNA, 18 nt, Neisseria meningitidis Z2491
ugcugaagucgugaauua

SEQ ID NO: 1380751 - RNA, 19 nt, Neisseria meningitidis Z2491
ugcucuaccaacugagcua

SEQ ID NO: 1380752 - RNA, 17 nt, Neisseria meningitidis Z2491
ugcucgaucggcugcca

SEQ ID NO: 1380753 - RNA, 20 nt, Neisseria meningitidis Z2491
ugcucgagcggcaggucuuc

SEQ ID NO: 1380754 - RNA, 22 nt, Neisseria meningitidis Z2491
ugaaauacauaggguuaauauc

SEQ ID NO: 1380755 - RNA, 16 nt, Neisseria meningitidis Z2491
ugaaauaaaaaaugcc

SEQ ID NO: 1380756 - RNA, 17 nt, Neisseria meningitidis Z2491
ugaaacaucauuggcaa

SEQ ID NO: 1380757 - RNA, 17 nt, Neisseria meningitidis Z2491
ugaaacggcggcagggu

SEQ ID NO: 1380758 - RNA, 13 nt, Neisseria meningitidis Z2491
ugaaacucaaaaa

SEQ ID NO: 1380759 - RNA, 20 nt, Neisseria meningitidis Z2491
ugaaacucaaaaaaacuaga

SEQ ID NO: 1380760 - RNA, 16 nt, Neisseria meningitidis Z2491
ugaaacucaaaaaacc

SEQ ID NO: 1380761 - RNA, 17 nt, Neisseria meningitidis Z2491
ugaaacucaaaaaaccg

SEQ ID NO: 1380762 - RNA, 14 nt, Neisseria meningitidis Z2491
ugaaacucaauaua

SEQ ID NO: 1380763 - RNA, 18 nt, Neisseria meningitidis Z2491
ugaaacucaauauaacga

SEQ ID NO: 1380764 - RNA, 14 nt, Neisseria meningitidis Z2491
ugaaaaugccgucu

SEQ ID NO: 1380765 - RNA, 21 nt, Neisseria meningitidis Z2491
ugaaaaugccgucugaaaccu

SEQ ID NO: 1380766 - RNA, 15 nt, Neisseria meningitidis Z2491
ugaaaauauagugga

SEQ ID NO: 1380767 - RNA, 16 nt, Neisseria meningitidis Z2491
ugaaaacagaaaccua

SEQ ID NO: 1380768 - RNA, 20 nt, Neisseria meningitidis Z2491
ugaaaacagaaaccuaaaau

SEQ ID NO: 1380769 - RNA, 21 nt, Neisseria meningitidis Z2491
ugaaaacagaaaccuaaaauu

SEQ ID NO: 1380770 - RNA, 11 nt, Neisseria meningitidis Z2491
ugaaaacggga

SEQ ID NO: 1380771 - RNA, 16 nt, Neisseria meningitidis Z2491
ugaaaacgggaaucua

SEQ ID NO: 1380772 - RNA, 20 nt, Neisseria meningitidis Z2491
ugaaaacgggaaucuagagc

SEQ ID NO: 1380773 - RNA, 13 nt, Neisseria meningitidis Z2491
ugaaaaccuuuca

SEQ ID NO: 1380774 - RNA, 15 nt, Neisseria meningitidis Z2491
ugaaaagucuuucag

SEQ ID NO: 1380775 - RNA, 21 nt, Neisseria meningitidis Z2491
ugaaaaacgacgagaauuuau

SEQ ID NO: 1380776 - RNA, 16 nt, Neisseria meningitidis Z2491
ugaaaaaaugccgucu

SEQ ID NO: 1380777 - RNA, 20 nt, Neisseria meningitidis Z2491
ugaaaaaaugccgucugaaa

SEQ ID NO: 1380778 - RNA, 16 nt, Neisseria meningitidis Z2491
ugaagcaccaagugaa

SEQ ID NO: 1380779 - RNA, 18 nt, Neisseria meningitidis Z2491
ugaagucguuggcagcaa

SEQ ID NO: 1380780 - RNA, 20 nt, Neisseria meningitidis Z2491
ugaacgcgcgggaauagcuc

SEQ ID NO: 1380781 - RNA, 22 nt, Neisseria meningitidis Z2491
ugaaaucgccaaacauuuugau

SEQ ID NO: 1380782 - RNA, 17 nt, Neisseria meningitidis Z2491
ugaaccgucauucccac

SEQ ID NO: 1380783 - RNA, 18 nt, Neisseria meningitidis Z2491
ugaaccgucauucccacg

SEQ ID NO: 1380784 - RNA, 16 nt, Neisseria meningitidis Z2491
ugaaccggcacaggcu

SEQ ID NO: 1380785 - RNA, 22 nt, Neisseria meningitidis Z2491
ugaacccuuugggcguucagac

SEQ ID NO: 1380786 - RNA, 13 nt, Neisseria meningitidis Z2491
ucuuuucuaaaau

SEQ ID NO: 1380787 - RNA, 14 nt, Neisseria meningitidis Z2491
ucuuuuauuuucaa

SEQ ID NO: 1380788 - RNA, 19 nt, Neisseria meningitidis Z2491
ucuuucaucauaugcauca

SEQ ID NO: 1380789 - RNA, 19 nt, Neisseria meningitidis Z2491
ucuuucgccgccuguuccc

SEQ ID NO: 1380790 - RNA, 14 nt, Neisseria meningitidis Z2491
ucuuuggcgugcau

SEQ ID NO: 1380791 - RNA, 16 nt, Neisseria meningitidis Z2491
ucuuugacaaaaucca

SEQ ID NO: 1380792 - RNA, 16 nt, Neisseria meningitidis Z2491
ucuugcuguuggaaaa

SEQ ID NO: 1380793 - RNA, 19 nt, Neisseria meningitidis Z2491
ucuuguacguggccuuuuc

SEQ ID NO: 1380794 - RNA, 13 nt, Neisseria meningitidis Z2491
ucuuguuuuucaa

SEQ ID NO: 1380795 - RNA, 14 nt, Neisseria meningitidis Z2491
ucuuguuuuucaau

SEQ ID NO: 1380796 - RNA, 23 nt, Neisseria meningitidis Z2491
ucuuuaaacuucgguuuuuuccg

SEQ ID NO: 1380797 - RNA, 13 nt, Neisseria meningitidis Z2491
ucuuuaaauucaa

SEQ ID NO: 1380798 - RNA, 18 nt, Neisseria meningitidis Z2491
ucuuucaacggcacggcg

SEQ ID NO: 1380799 - RNA, 15 nt, Neisseria meningitidis Z2491
ucuugaguuucaguc

SEQ ID NO: 1380800 - RNA, 18 nt, Neisseria meningitidis Z2491
ucuugauuuuucugaauu

SEQ ID NO: 1380801 - RNA, 16 nt, Neisseria meningitidis Z2491
ucuugcaaaauagaaa

SEQ ID NO: 1380802 - RNA, 21 nt, Neisseria meningitidis Z2491
ucuugaggcauugaaauucca

SEQ ID NO: 1380803 - RNA, 22 nt, Neisseria meningitidis Z2491
ucuucgagggcauacaaaucau

SEQ ID NO: 1380804 - RNA, 13 nt, Neisseria meningitidis Z2491
ucuucuucgucuu

SEQ ID NO: 1380805 - RNA, 19 nt, Neisseria meningitidis Z2491
ucuucuuacccaaugacug

SEQ ID NO: 1380806 - RNA, 17 nt, Neisseria meningitidis Z2491
ucuucauguucgugcau

SEQ ID NO: 1380807 - RNA, 15 nt, Neisseria meningitidis Z2491
ucuuaugccuauuuu

SEQ ID NO: 1380808 - RNA, 16 nt, Neisseria meningitidis Z2491
ucuucaaaggaaacau

SEQ ID NO: 1380809 - RNA, 20 nt, Neisseria meningitidis Z2491
ucuucaaauuccaacucgac

SEQ ID NO: 1380810 - RNA, 18 nt, Neisseria meningitidis Z2491
ucuuauuuauuuuuucuc

SEQ ID NO: 1380811 - RNA, 14 nt, Neisseria meningitidis Z2491
ucuuauuuucaaaa

SEQ ID NO: 1380812 - RNA, 17 nt, Neisseria meningitidis Z2491
ucuucaaaaucauccca

SEQ ID NO: 1380813 - RNA, 22 nt, Neisseria meningitidis Z2491
ucuucaaaaucaucccaaacau

SEQ ID NO: 1380814 - RNA, 21 nt, Neisseria meningitidis Z2491
ucuucauacgacucaaaauca

SEQ ID NO: 1380815 - RNA, 22 nt, Neisseria meningitidis Z2491
ucuuauuaaauauuaaugauua

SEQ ID NO: 1380816 - RNA, 16 nt, Neisseria meningitidis Z2491
ucuguuucuuuuugcu

SEQ ID NO: 1380817 - RNA, 12 nt, Neisseria meningitidis Z2491
ucuguuuuuccg

SEQ ID NO: 1380818 - RNA, 22 nt, Neisseria meningitidis Z2491
ucuguuuuuccgacaaauuccu

SEQ ID NO: 1380819 - RNA, 18 nt, Neisseria meningitidis Z2491
ucuguuuuugugggaaug

SEQ ID NO: 1380820 - RNA, 23 nt, Neisseria meningitidis Z2491
ucuguuuuuuccgguaaauuccu

SEQ ID NO: 1380821 - RNA, 14 nt, Neisseria meningitidis Z2491
ucuuaagaugaagu

SEQ ID NO: 1380822 - RNA, 23 nt, Neisseria meningitidis Z2491
ucugcccguauuugagugcggca

SEQ ID NO: 1380823 - RNA, 20 nt, Neisseria meningitidis Z2491
ucugccccguuuuacccucu

SEQ ID NO: 1380824 - RNA, 22 nt, Neisseria meningitidis Z2491
ucugccccguuuuacccucucc

SEQ ID NO: 1380825 - RNA, 15 nt, Neisseria meningitidis Z2491
ucugccgacugccaa

SEQ ID NO: 1380826 - RNA, 12 nt, Neisseria meningitidis Z2491
ucugauuuugau

SEQ ID NO: 1380827 - RNA, 14 nt, Neisseria meningitidis Z2491
ucugauuuugauuu

SEQ ID NO: 1380828 - RNA, 17 nt, Neisseria meningitidis Z2491
ucugauuuugguuuucu

SEQ ID NO: 1380829 - RNA, 20 nt, Neisseria meningitidis Z2491
ucugauuuuguuuuugagag

SEQ ID NO: 1380830 - RNA, 14 nt, Neisseria meningitidis Z2491
ucugauuuuuccua

SEQ ID NO: 1380831 - RNA, 21 nt, Neisseria meningitidis Z2491
ucugccgccgccuugugccug

SEQ ID NO: 1380832 - RNA, 22 nt, Neisseria meningitidis Z2491
ucugccuucgggauaaucuuuu

SEQ ID NO: 1380833 - RNA, 14 nt, Neisseria meningitidis Z2491
ucugccuucuucuu

SEQ ID NO: 1380834 - RNA, 23 nt, Neisseria meningitidis Z2491
ucugcggacuuaagaaacaaagc

SEQ ID NO: 1380835 - RNA, 16 nt, Neisseria meningitidis Z2491
ucugauagccgcccaa

SEQ ID NO: 1380836 - RNA, 20 nt, Neisseria meningitidis Z2491
ucugagaccuuugcaaaaau

SEQ ID NO: 1380837 - RNA, 22 nt, Neisseria meningitidis Z2491
ucugagaccuuugcaaaaauaa

SEQ ID NO: 1380838 - RNA, 21 nt, Neisseria meningitidis Z2491
ucugacaaggccgacaggcgu

SEQ ID NO: 1380839 - RNA, 19 nt, Neisseria meningitidis Z2491
ucugaauaaacuucuaaca

SEQ ID NO: 1380840 - RNA, 17 nt, Neisseria meningitidis Z2491
ucugaagcccugccugc

SEQ ID NO: 1380841 - RNA, 20 nt, Neisseria meningitidis Z2491
ucugaaauccuauuuucaga

SEQ ID NO: 1380842 - RNA, 15 nt, Neisseria meningitidis Z2491
ucugaaauguucaga

SEQ ID NO: 1380843 - RNA, 14 nt, Neisseria meningitidis Z2491
ucugaaauuucaga

SEQ ID NO: 1380844 - RNA, 20 nt, Neisseria meningitidis Z2491
ucugaaaaauuuaugaaaua

SEQ ID NO: 1380845 - RNA, 17 nt, Neisseria meningitidis Z2491
ucugaaaaauuuucaga

SEQ ID NO: 1380846 - RNA, 14 nt, Neisseria meningitidis Z2491
ucugaaaacagcaa

SEQ ID NO: 1380847 - RNA, 18 nt, Neisseria meningitidis Z2491
ucugaaaacaguuuuuua

SEQ ID NO: 1380848 - RNA, 17 nt, Neisseria meningitidis Z2491
ucugaaaaccuuucaga

SEQ ID NO: 1380849 - RNA, 16 nt, Neisseria meningitidis Z2491
aaaugcugucugaaac

SEQ ID NO: 1380850 - RNA, 22 nt, Neisseria meningitidis Z2491
aaaugcguuuugacaaaaucag

SEQ ID NO: 1380851 - RNA, 19 nt, Neisseria meningitidis Z2491
ucucuaaggugcugaagca

SEQ ID NO: 1380852 - RNA, 19 nt, Neisseria meningitidis Z2491
ugaccguguuuccaaggca

SEQ ID NO: 1380853 - RNA, 23 nt, Neisseria meningitidis Z2491
ugaccgaagcauaagccgccauc

SEQ ID NO: 1380854 - RNA, 20 nt, Neisseria meningitidis Z2491
ugacgcuccagcuccggcca

SEQ ID NO: 1380855 - RNA, 18 nt, Neisseria meningitidis Z2491
ugagaccuuugcaaaaau

SEQ ID NO: 1380856 - RNA, 15 nt, Neisseria meningitidis Z2491
ugagaccuuugcaau

SEQ ID NO: 1380857 - RNA, 22 nt, Neisseria meningitidis Z2491
ugacuugaaggcguguuugccg

SEQ ID NO: 1380858 - RNA, 14 nt, Neisseria meningitidis Z2491
ugacugaaacucaa

SEQ ID NO: 1380859 - RNA, 20 nt, Neisseria meningitidis Z2491
ugacugaaacucaaaaaacc

SEQ ID NO: 1380860 - RNA, 14 nt, Neisseria meningitidis Z2491
ugacggucaggaag

SEQ ID NO: 1380861 - RNA, 18 nt, Neisseria meningitidis Z2491
ugacgggauauagguuuc

SEQ ID NO: 1380862 - RNA, 20 nt, Neisseria meningitidis Z2491
ugacggaaacucaaaaaacc

SEQ ID NO: 1380863 - RNA, 21 nt, Neisseria meningitidis Z2491
ugacuaaccgaaaauaauugc

SEQ ID NO: 1380864 - RNA, 19 nt, Neisseria meningitidis Z2491
ugaucggagugauuaucac

SEQ ID NO: 1380865 - RNA, 23 nt, Neisseria meningitidis Z2491
ugauacgggcggcucucaaaaua

SEQ ID NO: 1380866 - RNA, 15 nt, Neisseria meningitidis Z2491
ugaggucuuugauga

SEQ ID NO: 1380867 - RNA, 15 nt, Neisseria meningitidis Z2491
ugaggucgucugaaa

SEQ ID NO: 1380868 - RNA, 22 nt, Neisseria meningitidis Z2491
ugaggucgaacugccugccuuc

SEQ ID NO: 1380869 - RNA, 20 nt, Neisseria meningitidis Z2491
ugaggucgcgaguucgagac

SEQ ID NO: 1380870 - RNA, 23 nt, Neisseria meningitidis Z2491
ugauaaaagcacaaauuaaaaua

SEQ ID NO: 1380871 - RNA, 11 nt, Neisseria meningitidis Z2491
ugagcuaaggc

SEQ ID NO: 1380872 - RNA, 19 nt, Neisseria meningitidis Z2491
ugagcuaaggcgagccaac

SEQ ID NO: 1380873 - RNA, 11 nt, Neisseria meningitidis Z2491
ugagcggacgu

SEQ ID NO: 1380874 - RNA, 20 nt, Neisseria meningitidis Z2491
ugagcaaaugccuuauccag

SEQ ID NO: 1380875 - RNA, 15 nt, Neisseria meningitidis Z2491
ugcaucaucacgcug

SEQ ID NO: 1380876 - RNA, 11 nt, Neisseria meningitidis Z2491
ugcauuuguuc

SEQ ID NO: 1380877 - RNA, 15 nt, Neisseria meningitidis Z2491
ugcauuuguucggua

SEQ ID NO: 1380878 - RNA, 17 nt, Neisseria meningitidis Z2491
ugcauuucuaauuuuua

SEQ ID NO: 1380879 - RNA, 21 nt, Neisseria meningitidis Z2491
ugcaguauccggcaagaauuu

SEQ ID NO: 1380880 - RNA, 17 nt, Neisseria meningitidis Z2491
ugcaucacguucugaaa

SEQ ID NO: 1380881 - RNA, 22 nt, Neisseria meningitidis Z2491
ugcaguugaguuugaugaaacu

SEQ ID NO: 1380882 - RNA, 18 nt, Neisseria meningitidis Z2491
ugcaccacgucauuccca

SEQ ID NO: 1380883 - RNA, 19 nt, Neisseria meningitidis Z2491
ugcaccacgucauucccac

SEQ ID NO: 1380884 - RNA, 20 nt, Neisseria meningitidis Z2491
ugcaccacgucauucccacg

SEQ ID NO: 1380885 - RNA, 14 nt, Neisseria meningitidis Z2491
ugcacucacuuugc

SEQ ID NO: 1380886 - RNA, 17 nt, Neisseria meningitidis Z2491
ugcacucacuuugcuca

SEQ ID NO: 1380887 - RNA, 19 nt, Neisseria meningitidis Z2491
ugcacugcgcgaugcauau

SEQ ID NO: 1380888 - RNA, 17 nt, Neisseria meningitidis Z2491
ugcagcagagcugugca

SEQ ID NO: 1380889 - RNA, 19 nt, Neisseria meningitidis Z2491
ugcaagaaugacggaguuu

SEQ ID NO: 1380890 - RNA, 19 nt, Neisseria meningitidis Z2491
ugcaagaauggcaaaauuu

SEQ ID NO: 1380891 - RNA, 19 nt, Neisseria meningitidis Z2491
ugcaagaauuuaucggaaa

SEQ ID NO: 1380892 - RNA, 14 nt, Neisseria meningitidis Z2491
ugcaagcagcaggc

SEQ ID NO: 1380893 - RNA, 23 nt, Neisseria meningitidis Z2491
ugcaaucagugcggcaucguauu

SEQ ID NO: 1380894 - RNA, 23 nt, Neisseria meningitidis Z2491
ugcaauauucgugaaacgucggu

SEQ ID NO: 1380895 - RNA, 17 nt, Neisseria meningitidis Z2491
ugcaauauacugauuua

SEQ ID NO: 1380896 - RNA, 22 nt, Neisseria meningitidis Z2491
ugcaauacacuguuuccaagcc

SEQ ID NO: 1380897 - RNA, 23 nt, Neisseria meningitidis Z2491
ugcaauaacauagguuacuaaaa

SEQ ID NO: 1380898 - RNA, 21 nt, Neisseria meningitidis Z2491
ugauuuuucgggaugaacgau

SEQ ID NO: 1380899 - RNA, 23 nt, Neisseria meningitidis Z2491
ugauuuugagaaaucugugaaaa

SEQ ID NO: 1380900 - RNA, 18 nt, Neisseria meningitidis Z2491
ugcaaaaaguccuucacg

SEQ ID NO: 1380901 - RNA, 21 nt, Neisseria meningitidis Z2491
ugcaaaaaguccuucacgcca

SEQ ID NO: 1380902 - RNA, 15 nt, Neisseria meningitidis Z2491
ugauuuuuucaacac

SEQ ID NO: 1380903 - RNA, 19 nt, Neisseria meningitidis Z2491
ugauuuuuucaacaccaaa

SEQ ID NO: 1380904 - RNA, 12 nt, Neisseria meningitidis Z2491
ugauuuuucuuu

SEQ ID NO: 1380905 - RNA, 14 nt, Neisseria meningitidis Z2491
ugauuuuucuuuua

SEQ ID NO: 1380906 - RNA, 17 nt, Neisseria meningitidis Z2491
ugauuuuuguuaaucac

SEQ ID NO: 1380907 - RNA, 21 nt, Neisseria meningitidis Z2491
ugauuuuuguuaauucacuau

SEQ ID NO: 1380908 - RNA, 22 nt, Neisseria meningitidis Z2491
ugcaaaauuuauccgaaacaac

SEQ ID NO: 1380909 - RNA, 12 nt, Neisseria meningitidis Z2491
ugcaaaauagaa

SEQ ID NO: 1380910 - RNA, 15 nt, Neisseria meningitidis Z2491
ugcaaaauagaaaac

SEQ ID NO: 1380911 - RNA, 19 nt, Neisseria meningitidis Z2491
ugcaaaauagaaaaccgaa

SEQ ID NO: 1380912 - RNA, 13 nt, Neisseria meningitidis Z2491
ugcaaaaauuuau

SEQ ID NO: 1380913 - RNA, 19 nt, Neisseria meningitidis Z2491
ugaugauguccgacugggc

SEQ ID NO: 1380914 - RNA, 21 nt, Neisseria meningitidis Z2491
ugauugacuauuuuuuaauca

SEQ ID NO: 1380915 - RNA, 16 nt, Neisseria meningitidis Z2491
ugauugaccgaaaaau

SEQ ID NO: 1380916 - RNA, 14 nt, Neisseria meningitidis Z2491
ugauuuaaauuuaa

SEQ ID NO: 1380917 - RNA, 18 nt, Neisseria meningitidis Z2491
ugauuuaaauuuaaucca

SEQ ID NO: 1380918 - RNA, 21 nt, Neisseria meningitidis Z2491
ugauuuaaauuuaauccacua

SEQ ID NO: 1380919 - RNA, 14 nt, Neisseria meningitidis Z2491
ugauuuaaggaaug

SEQ ID NO: 1380920 - RNA, 19 nt, Neisseria meningitidis Z2491
ucaguuucggucauuuccg

SEQ ID NO: 1380921 - RNA, 23 nt, Neisseria meningitidis Z2491
ucaguugguagagcgcaaccuug

SEQ ID NO: 1380922 - RNA, 20 nt, Neisseria meningitidis Z2491
ucauuccuacgaaccuacau

SEQ ID NO: 1380923 - RNA, 11 nt, Neisseria meningitidis Z2491
ucauucccacg

SEQ ID NO: 1380924 - RNA, 23 nt, Neisseria meningitidis Z2491
ucauucccacgaacccacauccc

SEQ ID NO: 1380925 - RNA, 15 nt, Neisseria meningitidis Z2491
ucauucccacggaag

SEQ ID NO: 1380926 - RNA, 18 nt, Neisseria meningitidis Z2491
ucauucccgcaaaaacaa

SEQ ID NO: 1380927 - RNA, 16 nt, Neisseria meningitidis Z2491
ucauucccgcaaaagc

SEQ ID NO: 1380928 - RNA, 22 nt, Neisseria meningitidis Z2491
ucauucccgcaacucuccguca

SEQ ID NO: 1380929 - RNA, 20 nt, Neisseria meningitidis Z2491
ucauuucuggauucccacuu

SEQ ID NO: 1380930 - RNA, 16 nt, Neisseria meningitidis Z2491
ucauuucugauaaacc

SEQ ID NO: 1380931 - RNA, 16 nt, Neisseria meningitidis Z2491
ucauuucugauaaauu

SEQ ID NO: 1380932 - RNA, 20 nt, Neisseria meningitidis Z2491
ucauuucuagauucccacuu

SEQ ID NO: 1380933 - RNA, 21 nt, Neisseria meningitidis Z2491
uccaaacccaaugcuucaacc

SEQ ID NO: 1380934 - RNA, 21 nt, Neisseria meningitidis Z2491
uccaaaccuuugagcuggauu

SEQ ID NO: 1380935 - RNA, 12 nt, Neisseria meningitidis Z2491
uccaaagagaaa

SEQ ID NO: 1380936 - RNA, 21 nt, Neisseria meningitidis Z2491
uccaaagagaaagaacccaaa

SEQ ID NO: 1380937 - RNA, 18 nt, Neisseria meningitidis Z2491
uccaaacguuuuuccaaa

SEQ ID NO: 1380938 - RNA, 17 nt, Neisseria meningitidis Z2491
uccaaacuuccgaugug

SEQ ID NO: 1380939 - RNA, 18 nt, Neisseria meningitidis Z2491
uccacgcaaucaagaaga

SEQ ID NO: 1380940 - RNA, 11 nt, Neisseria meningitidis Z2491
uccacggccac

SEQ ID NO: 1380941 - RNA, 15 nt, Neisseria meningitidis Z2491
uccacggacacccga

SEQ ID NO: 1380942 - RNA, 17 nt, Neisseria meningitidis Z2491
uccacggacacccgaua

SEQ ID NO: 1380943 - RNA, 21 nt, Neisseria meningitidis Z2491
uccacuaaaaaauccaaaaau

SEQ ID NO: 1380944 - RNA, 19 nt, Neisseria meningitidis Z2491
uccacaauucaauuaaaua

SEQ ID NO: 1380945 - RNA, 16 nt, Neisseria meningitidis Z2491
uccaauucgauggaua

SEQ ID NO: 1380946 - RNA, 17 nt, Neisseria meningitidis Z2491
uccaauuaaaccccguu

SEQ ID NO: 1380947 - RNA, 16 nt, Neisseria meningitidis Z2491
uccacagagauuguuu

SEQ ID NO: 1380948 - RNA, 16 nt, Neisseria meningitidis Z2491
uccaauacaacaaaau

SEQ ID NO: 1380949 - RNA, 16 nt, Neisseria meningitidis Z2491
uccaacgcugcaaaaa

SEQ ID NO: 1380950 - RNA, 18 nt, Neisseria meningitidis Z2491
uccaaccuucccgcgcca

SEQ ID NO: 1380951 - RNA, 21 nt, Neisseria meningitidis Z2491
uccaguugcgggccuuuggcg

SEQ ID NO: 1380952 - RNA, 20 nt, Neisseria meningitidis Z2491
uccaguuucuugaguuucag

SEQ ID NO: 1380953 - RNA, 18 nt, Neisseria meningitidis Z2491
uccaucaacaaaaugccg

SEQ ID NO: 1380954 - RNA, 14 nt, Neisseria meningitidis Z2491
uccauauccaaacg

SEQ ID NO: 1380955 - RNA, 20 nt, Neisseria meningitidis Z2491
uccagugcguugaguuucag

SEQ ID NO: 1380956 - RNA, 19 nt, Neisseria meningitidis Z2491
uccagaacguaaaaucuga

SEQ ID NO: 1380957 - RNA, 14 nt, Neisseria meningitidis Z2491
uccauucccucucc

SEQ ID NO: 1380958 - RNA, 15 nt, Neisseria meningitidis Z2491
uccauucccucuccc

SEQ ID NO: 1380959 - RNA, 15 nt, Neisseria meningitidis Z2491
ucccaaaggcaauaa

SEQ ID NO: 1380960 - RNA, 18 nt, Neisseria meningitidis Z2491
ucccaaaggcaauaacua

SEQ ID NO: 1380961 - RNA, 20 nt, Neisseria meningitidis Z2491
uccaucgcgucuucaaaauc

SEQ ID NO: 1380962 - RNA, 18 nt, Neisseria meningitidis Z2491
uccaucacgacaacgguc

SEQ ID NO: 1380963 - RNA, 13 nt, Neisseria meningitidis Z2491
uccgauagauucc

SEQ ID NO: 1380964 - RNA, 20 nt, Neisseria meningitidis Z2491
uccgauaaauuccuguugcu

SEQ ID NO: 1380965 - RNA, 21 nt, Neisseria meningitidis Z2491
uccgcaaaaugccgucugaaa

SEQ ID NO: 1380966 - RNA, 18 nt, Neisseria meningitidis Z2491
uccgcaaacaaaaugccg

SEQ ID NO: 1380967 - RNA, 17 nt, Neisseria meningitidis Z2491
uccgcaccgacagaccu

SEQ ID NO: 1380968 - RNA, 17 nt, Neisseria meningitidis Z2491
uccgcacagaaaccugc

SEQ ID NO: 1380969 - RNA, 14 nt, Neisseria meningitidis Z2491
uccgccauuuccaa

SEQ ID NO: 1380970 - RNA, 19 nt, Neisseria meningitidis Z2491
uccgcuauauauucugauu

SEQ ID NO: 1380971 - RNA, 19 nt, Neisseria meningitidis Z2491
uccgcuauauuccaccauc

SEQ ID NO: 1380972 - RNA, 20 nt, Neisseria meningitidis Z2491
uccgcgccgauguuuuccug

SEQ ID NO: 1380973 - RNA, 12 nt, Neisseria meningitidis Z2491
uccgcgcccacg

SEQ ID NO: 1380974 - RNA, 21 nt, Neisseria meningitidis Z2491
uccgcccgaauaaaaaauaug

SEQ ID NO: 1380975 - RNA, 18 nt, Neisseria meningitidis Z2491
uccgccucugccagcucc

SEQ ID NO: 1380976 - RNA, 21 nt, Neisseria meningitidis Z2491
uccgacugugccgcguguccg

SEQ ID NO: 1380977 - RNA, 15 nt, Neisseria meningitidis Z2491
aaaucugauaagcaa

SEQ ID NO: 1380978 - RNA, 16 nt, Neisseria meningitidis Z2491
aaaucugauaagcaag

SEQ ID NO: 1380979 - RNA, 16 nt, Neisseria meningitidis Z2491
aaaucugugaaaauca

SEQ ID NO: 1380980 - RNA, 17 nt, Neisseria meningitidis Z2491
aaaucugugaaaaucag

SEQ ID NO: 1380981 - RNA, 20 nt, Neisseria meningitidis Z2491
uccgaaacaacaaaaccuau

SEQ ID NO: 1380982 - RNA, 17 nt, Neisseria meningitidis Z2491
uccgaaauauuacccaa

SEQ ID NO: 1380983 - RNA, 14 nt, Neisseria meningitidis Z2491
uccgaaaucaucca

SEQ ID NO: 1380984 - RNA, 17 nt, Neisseria meningitidis Z2491
uccgaaccgcaaaugcu

SEQ ID NO: 1380985 - RNA, 19 nt, Neisseria meningitidis Z2491
uccgaagcgacaacaaucu

SEQ ID NO: 1380986 - RNA, 13 nt, Neisseria meningitidis Z2491
uccgacaggcaaa

SEQ ID NO: 1380987 - RNA, 23 nt, Neisseria meningitidis Z2491
uccgacaaauuccuaaaacuuaa

SEQ ID NO: 1380988 - RNA, 19 nt, Neisseria meningitidis Z2491
uccgacaauuucuccgcca

SEQ ID NO: 1380989 - RNA, 23 nt, Neisseria meningitidis Z2491
uccgacaauuucuccgccagccu

SEQ ID NO: 1380990 - RNA, 23 nt, Neisseria meningitidis Z2491
ucccucaaaaacagaaaaccaaa

SEQ ID NO: 1380991 - RNA, 22 nt, Neisseria meningitidis Z2491
ucccucccgacagccgaaaccc

SEQ ID NO: 1380992 - RNA, 13 nt, Neisseria meningitidis Z2491
ucccguuucagac

SEQ ID NO: 1380993 - RNA, 15 nt, Neisseria meningitidis Z2491
ucccguuugaaaaca

SEQ ID NO: 1380994 - RNA, 21 nt, Neisseria meningitidis Z2491
ucccucaaauaaaaugccguc

SEQ ID NO: 1380995 - RNA, 15 nt, Neisseria meningitidis Z2491
ucccgcccgcaggua

SEQ ID NO: 1380996 - RNA, 17 nt, Neisseria meningitidis Z2491
ucccgcgagaacagaaa

SEQ ID NO: 1380997 - RNA, 16 nt, Neisseria meningitidis Z2491
ucccgcaaaaacgcag

SEQ ID NO: 1380998 - RNA, 15 nt, Neisseria meningitidis Z2491
ucccgccaaacccuc

SEQ ID NO: 1380999 - RNA, 21 nt, Neisseria meningitidis Z2491
ucccgcuuucgcgggaaugac

SEQ ID NO: 1381000 - RNA, 15 nt, Neisseria meningitidis Z2491
ucccguuauuuucac

SEQ ID NO: 1381001 - RNA, 16 nt, Neisseria meningitidis Z2491
ucccgugguuuuucgg

SEQ ID NO: 1381002 - RNA, 22 nt, Neisseria meningitidis Z2491
ucccgugguuuuucgguuacug

SEQ ID NO: 1381003 - RNA, 21 nt, Neisseria meningitidis Z2491
ucccgacagccgaaacccaaa

SEQ ID NO: 1381004 - RNA, 23 nt, Neisseria meningitidis Z2491
ucccgacagccgaaacccaaaca

SEQ ID NO: 1381005 - RNA, 17 nt, Neisseria meningitidis Z2491
ucccgagaaaacagaaa

SEQ ID NO: 1381006 - RNA, 22 nt, Neisseria meningitidis Z2491
uccccgaauccacgcucaaaca

SEQ ID NO: 1381007 - RNA, 19 nt, Neisseria meningitidis Z2491
uccccgaaaccgaaugcca

SEQ ID NO: 1381008 - RNA, 14 nt, Neisseria meningitidis Z2491
uccccgacccuccc

SEQ ID NO: 1381009 - RNA, 19 nt, Neisseria meningitidis Z2491
uccccgguauaaaaaagau

SEQ ID NO: 1381010 - RNA, 15 nt, Neisseria meningitidis Z2491
ucccauuauuuucac

SEQ ID NO: 1381011 - RNA, 22 nt, Neisseria meningitidis Z2491
uccccauaugccgucugaagau

SEQ ID NO: 1381012 - RNA, 19 nt, Neisseria meningitidis Z2491
ucccccgaagaugggaauc

SEQ ID NO: 1381013 - RNA, 13 nt, Neisseria meningitidis Z2491
ucccccacagggg

SEQ ID NO: 1381014 - RNA, 18 nt, Neisseria meningitidis Z2491
ucccccacaggggaggga

SEQ ID NO: 1381015 - RNA, 21 nt, Neisseria meningitidis Z2491
ucccacuuccgugggaaugac

SEQ ID NO: 1381016 - RNA, 17 nt, Neisseria meningitidis Z2491
ucccacgcgcccaucgu

SEQ ID NO: 1381017 - RNA, 21 nt, Neisseria meningitidis Z2491
ucccacuuucgugggaaugac

SEQ ID NO: 1381018 - RNA, 15 nt, Neisseria meningitidis Z2491
uccuguuauuuucac

SEQ ID NO: 1381019 - RNA, 13 nt, Neisseria meningitidis Z2491
uccuucagcucuc

SEQ ID NO: 1381020 - RNA, 23 nt, Neisseria meningitidis Z2491
uccugcuuauugcacuaaaacua

SEQ ID NO: 1381021 - RNA, 21 nt, Neisseria meningitidis Z2491
uccugccgccggaagcgcacc

SEQ ID NO: 1381022 - RNA, 17 nt, Neisseria meningitidis Z2491
uccugcacgcgcuucaa

SEQ ID NO: 1381023 - RNA, 20 nt, Neisseria meningitidis Z2491
uccucaucguucaacagcag

SEQ ID NO: 1381024 - RNA, 17 nt, Neisseria meningitidis Z2491
uccuccaccauuucuuu

SEQ ID NO: 1381025 - RNA, 16 nt, Neisseria meningitidis Z2491
uccuccacuaaaaaau

SEQ ID NO: 1381026 - RNA, 16 nt, Neisseria meningitidis Z2491
uccuccgucaaaacau

SEQ ID NO: 1381027 - RNA, 18 nt, Neisseria meningitidis Z2491
uccucgauuugaaaucug

SEQ ID NO: 1381028 - RNA, 14 nt, Neisseria meningitidis Z2491
uccucuuucaucau

SEQ ID NO: 1381029 - RNA, 15 nt, Neisseria meningitidis Z2491
uccugacaaauuccc

SEQ ID NO: 1381030 - RNA, 18 nt, Neisseria meningitidis Z2491
uccugacaaauucccgcc

SEQ ID NO: 1381031 - RNA, 23 nt, Neisseria meningitidis Z2491
uccugacggacacgcccucaaac

SEQ ID NO: 1381032 - RNA, 21 nt, Neisseria meningitidis Z2491
uccugauuuuuguuaaucacu

SEQ ID NO: 1381033 - RNA, 22 nt, Neisseria meningitidis Z2491
uccugauuuuuguuaauccacu

SEQ ID NO: 1381034 - RNA, 11 nt, Neisseria meningitidis Z2491
uccugauuuaa

SEQ ID NO: 1381035 - RNA, 13 nt, Neisseria meningitidis Z2491
uccugauuuaaau

SEQ ID NO: 1381036 - RNA, 17 nt, Neisseria meningitidis Z2491
uccugauuuaaauuuaa

SEQ ID NO: 1381037 - RNA, 14 nt, Neisseria meningitidis Z2491
uccuacuuuuugcu

SEQ ID NO: 1381038 - RNA, 21 nt, Neisseria meningitidis Z2491
uccuacuuuuugcucaauauu

SEQ ID NO: 1381039 - RNA, 16 nt, Neisseria meningitidis Z2491
uccuacaaggacaaaa

SEQ ID NO: 1381040 - RNA, 17 nt, Neisseria meningitidis Z2491
uccuaauucuacccaaa

SEQ ID NO: 1381041 - RNA, 20 nt, Neisseria meningitidis Z2491
uccuaauauugagcaaaaag

SEQ ID NO: 1381042 - RNA, 15 nt, Neisseria meningitidis Z2491
uccguauggauggau

SEQ ID NO: 1381043 - RNA, 19 nt, Neisseria meningitidis Z2491
uccguaucggcauauguuu

SEQ ID NO: 1381044 - RNA, 14 nt, Neisseria meningitidis Z2491
uccgucauucccac

SEQ ID NO: 1381045 - RNA, 15 nt, Neisseria meningitidis Z2491
uccgucauucccacg

SEQ ID NO: 1381046 - RNA, 17 nt, Neisseria meningitidis Z2491
uccgucauucccgcgaa

SEQ ID NO: 1381047 - RNA, 18 nt, Neisseria meningitidis Z2491
uccgucaggcacgaagcc

SEQ ID NO: 1381048 - RNA, 17 nt, Neisseria meningitidis Z2491
uccgguucauuucaggc

SEQ ID NO: 1381049 - RNA, 14 nt, Neisseria meningitidis Z2491
uccgguucccugcc

SEQ ID NO: 1381050 - RNA, 20 nt, Neisseria meningitidis Z2491
uccgguuuuuugaguuucag

SEQ ID NO: 1381051 - RNA, 17 nt, Neisseria meningitidis Z2491
uccguaaauuguccauu

SEQ ID NO: 1381052 - RNA, 15 nt, Neisseria meningitidis Z2491
uccguaagccuucau

SEQ ID NO: 1381053 - RNA, 22 nt, Neisseria meningitidis Z2491
uccgucggggucuucgacgaag

SEQ ID NO: 1381054 - RNA, 18 nt, Neisseria meningitidis Z2491
uccguuaucccauaaaaa

SEQ ID NO: 1381055 - RNA, 21 nt, Neisseria meningitidis Z2491
uccguucgggaauauucugau

SEQ ID NO: 1381056 - RNA, 11 nt, Neisseria meningitidis Z2491
uccggcagccu

SEQ ID NO: 1381057 - RNA, 18 nt, Neisseria meningitidis Z2491
uccggcaagccuuucaac

SEQ ID NO: 1381058 - RNA, 21 nt, Neisseria meningitidis Z2491
uccggcagggcagguuuuggu

SEQ ID NO: 1381059 - RNA, 15 nt, Neisseria meningitidis Z2491
uccggcaugauuuuc

SEQ ID NO: 1381060 - RNA, 15 nt, Neisseria meningitidis Z2491
uccggaaucagaccg

SEQ ID NO: 1381061 - RNA, 13 nt, Neisseria meningitidis Z2491
uccgcuugaaaca

SEQ ID NO: 1381062 - RNA, 16 nt, Neisseria meningitidis Z2491
uccgggauuuuaaagu

SEQ ID NO: 1381063 - RNA, 15 nt, Neisseria meningitidis Z2491
uccgguaaauuccua

SEQ ID NO: 1381064 - RNA, 23 nt, Neisseria meningitidis Z2491
uccggcuccgguucguuuugcaa

SEQ ID NO: 1381065 - RNA, 18 nt, Neisseria meningitidis Z2491
uccggcuccuaucccuua

SEQ ID NO: 1381066 - RNA, 20 nt, Neisseria meningitidis Z2491
ucgcaggcuucguaggcauc

SEQ ID NO: 1381067 - RNA, 16 nt, Neisseria meningitidis Z2491
ucgcacucugaaagcc

SEQ ID NO: 1381068 - RNA, 15 nt, Neisseria meningitidis Z2491
ucgcagcaguauuag

SEQ ID NO: 1381069 - RNA, 11 nt, Neisseria meningitidis Z2491
ucgcagauucg

SEQ ID NO: 1381070 - RNA, 15 nt, Neisseria meningitidis Z2491
ucgcaagccaagaua

SEQ ID NO: 1381071 - RNA, 17 nt, Neisseria meningitidis Z2491
ucgcaacuccaaagaga

SEQ ID NO: 1381072 - RNA, 18 nt, Neisseria meningitidis Z2491
ucgcaaugcugcggaugu

SEQ ID NO: 1381073 - RNA, 15 nt, Neisseria meningitidis Z2491
ucgauguggcugaug

SEQ ID NO: 1381074 - RNA, 18 nt, Neisseria meningitidis Z2491
ucgaugugguagagaaaa

SEQ ID NO: 1381075 - RNA, 17 nt, Neisseria meningitidis Z2491
ucgaugccguucaauuc

SEQ ID NO: 1381076 - RNA, 16 nt, Neisseria meningitidis Z2491
ucgaugcguuccugcc

SEQ ID NO: 1381077 - RNA, 23 nt, Neisseria meningitidis Z2491
ucgaugcgguugaucauuucagg

SEQ ID NO: 1381078 - RNA, 18 nt, Neisseria meningitidis Z2491
ucgaggguuucuguuuuu

SEQ ID NO: 1381079 - RNA, 17 nt, Neisseria meningitidis Z2491
ucgagauaaguguugga

SEQ ID NO: 1381080 - RNA, 22 nt, Neisseria meningitidis Z2491
ucgagauaaguguuggacaaau

SEQ ID NO: 1381081 - RNA, 15 nt, Neisseria meningitidis Z2491
ucgaagaaguggguc

SEQ ID NO: 1381082 - RNA, 21 nt, Neisseria meningitidis Z2491
ucgaagaagugggucagcccc

SEQ ID NO: 1381083 - RNA, 17 nt, Neisseria meningitidis Z2491
ucgaaggcgcggcugcc

SEQ ID NO: 1381084 - RNA, 23 nt, Neisseria meningitidis Z2491
ucgaacaacucuuucgggcugcc

SEQ ID NO: 1381085 - RNA, 20 nt, Neisseria meningitidis Z2491
ucgaacaccaauuccgguuc

SEQ ID NO: 1381086 - RNA, 12 nt, Neisseria meningitidis Z2491
uccuuucccucc

SEQ ID NO: 1381087 - RNA, 17 nt, Neisseria meningitidis Z2491
uccuuucccucccgaca

SEQ ID NO: 1381088 - RNA, 13 nt, Neisseria meningitidis Z2491
uccuuuccucuuu

SEQ ID NO: 1381089 - RNA, 14 nt, Neisseria meningitidis Z2491
uccuuuaauuaaga

SEQ ID NO: 1381090 - RNA, 21 nt, Neisseria meningitidis Z2491
uccuuguguugguuuugaggc

SEQ ID NO: 1381091 - RNA, 15 nt, Neisseria meningitidis Z2491
uccuuccugaugaaa

SEQ ID NO: 1381092 - RNA, 19 nt, Neisseria meningitidis Z2491
uauaauacaaaaaugccgu

SEQ ID NO: 1381093 - RNA, 18 nt, Neisseria meningitidis Z2491
uauaauccggagcagaau

SEQ ID NO: 1381094 - RNA, 20 nt, Neisseria meningitidis Z2491
uaguggauuaacaaaaauca

SEQ ID NO: 1381095 - RNA, 18 nt, Neisseria meningitidis Z2491
uagugguuuuccggcgug

SEQ ID NO: 1381096 - RNA, 17 nt, Neisseria meningitidis Z2491
uaguggauuaaauuuaa

SEQ ID NO: 1381097 - RNA, 19 nt, Neisseria meningitidis Z2491
uaguggauuaaauuuaaac

SEQ ID NO: 1381098 - RNA, 19 nt, Neisseria meningitidis Z2491
uaguggauuaaauuuaaau

SEQ ID NO: 1381099 - RNA, 23 nt, Neisseria meningitidis Z2491
uaguggauuaaauuuaaaucagg

SEQ ID NO: 1381100 - RNA, 18 nt, Neisseria meningitidis Z2491
uaguggauuaaauuuaua

SEQ ID NO: 1381101 - RNA, 17 nt, Neisseria meningitidis Z2491
uaguggauuaacaaaaa

SEQ ID NO: 1381102 - RNA, 20 nt, Neisseria meningitidis Z2491
uaguggauuaacaaaaacca

SEQ ID NO: 1381103 - RNA, 20 nt, Neisseria meningitidis Z2491
uagucugagaccuuugcaaa

SEQ ID NO: 1381104 - RNA, 17 nt, Neisseria meningitidis Z2491
uagugaauuaaauuuaa

SEQ ID NO: 1381105 - RNA, 19 nt, Neisseria meningitidis Z2491
uagugaauuaaauuuaaac

SEQ ID NO: 1381106 - RNA, 15 nt, Neisseria meningitidis Z2491
uagugaacuaaauuu

SEQ ID NO: 1381107 - RNA, 14 nt, Neisseria meningitidis Z2491
uagguuacuaaaau

SEQ ID NO: 1381108 - RNA, 15 nt, Neisseria meningitidis Z2491
uagguuacuaaaauu

SEQ ID NO: 1381109 - RNA, 16 nt, Neisseria meningitidis Z2491
uaguacggcaaggcga

SEQ ID NO: 1381110 - RNA, 20 nt, Neisseria meningitidis Z2491
uaguacagccccuuaaaguu

SEQ ID NO: 1381111 - RNA, 15 nt, Neisseria meningitidis Z2491
uaguaauaaauuaau

SEQ ID NO: 1381112 - RNA, 19 nt, Neisseria meningitidis Z2491
uagucaggcugccuuaugu

SEQ ID NO: 1381113 - RNA, 17 nt, Neisseria meningitidis Z2491
uauaguaauaaauuaau

SEQ ID NO: 1381114 - RNA, 14 nt, Neisseria meningitidis Z2491
uauacaaaaugccg

SEQ ID NO: 1381115 - RNA, 14 nt, Neisseria meningitidis Z2491
uauaucgaacagcc

SEQ ID NO: 1381116 - RNA, 21 nt, Neisseria meningitidis Z2491
uauaucgaacagccuguccaa

SEQ ID NO: 1381117 - RNA, 22 nt, Neisseria meningitidis Z2491
uaucaagcccugaaagggauaa

SEQ ID NO: 1381118 - RNA, 14 nt, Neisseria meningitidis Z2491
uaucagauuuugga

SEQ ID NO: 1381119 - RNA, 18 nt, Neisseria meningitidis Z2491
uauauuaaggcugcggca

SEQ ID NO: 1381120 - RNA, 14 nt, Neisseria meningitidis Z2491
uaucgggaaaaacg

SEQ ID NO: 1381121 - RNA, 13 nt, Neisseria meningitidis Z2491
uaucgggaaaaau

SEQ ID NO: 1381122 - RNA, 16 nt, Neisseria meningitidis Z2491
uaucgggaaaaauaga

SEQ ID NO: 1381123 - RNA, 16 nt, Neisseria meningitidis Z2491
uaucggaaaugacuga

SEQ ID NO: 1381124 - RNA, 18 nt, Neisseria meningitidis Z2491
uaucggaggaguuugaug

SEQ ID NO: 1381125 - RNA, 22 nt, Neisseria meningitidis Z2491
uaucgucauucccgcaaaaaca

SEQ ID NO: 1381126 - RNA, 16 nt, Neisseria meningitidis Z2491
uaucgggaaugacuga

SEQ ID NO: 1381127 - RNA, 21 nt, Neisseria meningitidis Z2491
uaucgggcagugccguuuugu

SEQ ID NO: 1381128 - RNA, 15 nt, Neisseria meningitidis Z2491
uaucgccucauacag

SEQ ID NO: 1381129 - RNA, 13 nt, Neisseria meningitidis Z2491
uauccggcuccua

SEQ ID NO: 1381130 - RNA, 13 nt, Neisseria meningitidis Z2491
uauccccagugcg

SEQ ID NO: 1381131 - RNA, 15 nt, Neisseria meningitidis Z2491
uaucccaauauuaag

SEQ ID NO: 1381132 - RNA, 14 nt, Neisseria meningitidis Z2491
uaucccauaaaaac

SEQ ID NO: 1381133 - RNA, 21 nt, Neisseria meningitidis Z2491
uaucccauaaaaacgggaauc

SEQ ID NO: 1381134 - RNA, 18 nt, Neisseria meningitidis Z2491
uaucauacauagcaggca

SEQ ID NO: 1381135 - RNA, 14 nt, Neisseria meningitidis Z2491
uauccagaaaaucg

SEQ ID NO: 1381136 - RNA, 15 nt, Neisseria meningitidis Z2491
uaugccgucugaaac

SEQ ID NO: 1381137 - RNA, 20 nt, Neisseria meningitidis Z2491
uaugccgucugaagccuuca

SEQ ID NO: 1381138 - RNA, 15 nt, Neisseria meningitidis Z2491
uaugccugccgaccc

SEQ ID NO: 1381139 - RNA, 15 nt, Neisseria meningitidis Z2491
uaugccuuuuucaaa

SEQ ID NO: 1381140 - RNA, 14 nt, Neisseria meningitidis Z2491
uaugccgccugccu

SEQ ID NO: 1381141 - RNA, 12 nt, Neisseria meningitidis Z2491
uaugccaugucg

SEQ ID NO: 1381142 - RNA, 21 nt, Neisseria meningitidis Z2491
uaugcucaaucuuauuuucaa

SEQ ID NO: 1381143 - RNA, 17 nt, Neisseria meningitidis Z2491
uaugcguucaaaugccg

SEQ ID NO: 1381144 - RNA, 14 nt, Neisseria meningitidis Z2491
uauggcugucuuug

SEQ ID NO: 1381145 - RNA, 21 nt, Neisseria meningitidis Z2491
uaugcuucggucagguucaaa

SEQ ID NO: 1381146 - RNA, 13 nt, Neisseria meningitidis Z2491
uaugauuuuucgg

SEQ ID NO: 1381147 - RNA, 22 nt, Neisseria meningitidis Z2491
uaugcaaaugcacgguuacaca

SEQ ID NO: 1381148 - RNA, 18 nt, Neisseria meningitidis Z2491
uaugacaagacgacaggc

SEQ ID NO: 1381149 - RNA, 12 nt, Neisseria meningitidis Z2491
uaucuuuaagug

SEQ ID NO: 1381150 - RNA, 18 nt, Neisseria meningitidis Z2491
uaucuuuaagugauucaa

SEQ ID NO: 1381151 - RNA, 17 nt, Neisseria meningitidis Z2491
uaucuuuaaacagcaua

SEQ ID NO: 1381152 - RNA, 11 nt, Neisseria meningitidis Z2491
uaugaaacaau

SEQ ID NO: 1381153 - RNA, 12 nt, Neisseria meningitidis Z2491
uaugaaacaauc

SEQ ID NO: 1381154 - RNA, 14 nt, Neisseria meningitidis Z2491
uaucuauacuaaaa

SEQ ID NO: 1381155 - RNA, 15 nt, Neisseria meningitidis Z2491
uaucguuuuccaaau

SEQ ID NO: 1381156 - RNA, 21 nt, Neisseria meningitidis Z2491
uaucucaaccuguuuuucaaa

SEQ ID NO: 1381157 - RNA, 18 nt, Neisseria meningitidis Z2491
uaucugcugccaucucaa

SEQ ID NO: 1381158 - RNA, 22 nt, Neisseria meningitidis Z2491
uaucugcauuauuugggauauu

SEQ ID NO: 1381159 - RNA, 19 nt, Neisseria meningitidis Z2491
uauugcuguuguucuaagg

SEQ ID NO: 1381160 - RNA, 11 nt, Neisseria meningitidis Z2491
aaauccuauuu

SEQ ID NO: 1381161 - RNA, 17 nt, Neisseria meningitidis Z2491
aaauccuauuuucagau

SEQ ID NO: 1381162 - RNA, 21 nt, Neisseria meningitidis Z2491
uauugaagauggcugaaauug

SEQ ID NO: 1381163 - RNA, 18 nt, Neisseria meningitidis Z2491
uauuggucaacucuucca

SEQ ID NO: 1381164 - RNA, 13 nt, Neisseria meningitidis Z2491
uauuauuuuccau

SEQ ID NO: 1381165 - RNA, 20 nt, Neisseria meningitidis Z2491
uauuccggugcgaccguaug

SEQ ID NO: 1381166 - RNA, 14 nt, Neisseria meningitidis Z2491
uauuaagugaguaa

SEQ ID NO: 1381167 - RNA, 14 nt, Neisseria meningitidis Z2491
uauuaagaaaaaca

SEQ ID NO: 1381168 - RNA, 17 nt, Neisseria meningitidis Z2491
uaugugcugucagaauu

SEQ ID NO: 1381169 - RNA, 15 nt, Neisseria meningitidis Z2491
uauguuuaaucagcu

SEQ ID NO: 1381170 - RNA, 15 nt, Neisseria meningitidis Z2491
uauguuuagcggagc

SEQ ID NO: 1381171 - RNA, 22 nt, Neisseria meningitidis Z2491
uauguagauuuuuuuauuuaaa

SEQ ID NO: 1381172 - RNA, 21 nt, Neisseria meningitidis Z2491
ucaauugcuuauuuguucaaa

SEQ ID NO: 1381173 - RNA, 16 nt, Neisseria meningitidis Z2491
ucaauuuaaacacuuc

SEQ ID NO: 1381174 - RNA, 15 nt, Neisseria meningitidis Z2491
ucaaugucaaaauau

SEQ ID NO: 1381175 - RNA, 14 nt, Neisseria meningitidis Z2491
aaaucggccauucc

SEQ ID NO: 1381176 - RNA, 23 nt, Neisseria meningitidis Z2491
aaaucgacgacgauuaauaccgc

SEQ ID NO: 1381177 - RNA, 19 nt, Neisseria meningitidis Z2491
ucacaaaaacagaaaacca

SEQ ID NO: 1381178 - RNA, 22 nt, Neisseria meningitidis Z2491
ucacaaaaacagaaaaccaaaa

SEQ ID NO: 1381179 - RNA, 22 nt, Neisseria meningitidis Z2491
ucacaaaaacagaaauucaaaa

SEQ ID NO: 1381180 - RNA, 18 nt, Neisseria meningitidis Z2491
ucaacagguucaaacaca

SEQ ID NO: 1381181 - RNA, 17 nt, Neisseria meningitidis Z2491
ucaaccacgcuucugau

SEQ ID NO: 1381182 - RNA, 19 nt, Neisseria meningitidis Z2491
ucaacagcagcgaaggcgc

SEQ ID NO: 1381183 - RNA, 14 nt, Neisseria meningitidis Z2491
ucaacaccugcaga

SEQ ID NO: 1381184 - RNA, 12 nt, Neisseria meningitidis Z2491
ucaacacgcccu

SEQ ID NO: 1381185 - RNA, 16 nt, Neisseria meningitidis Z2491
ucaacacgcccuucca

SEQ ID NO: 1381186 - RNA, 21 nt, Neisseria meningitidis Z2491
ucaacgcacuggauucccgcc

SEQ ID NO: 1381187 - RNA, 20 nt, Neisseria meningitidis Z2491
ucaacgccggggcaaacaua

SEQ ID NO: 1381188 - RNA, 11 nt, Neisseria meningitidis Z2491
ucaaccuguuu

SEQ ID NO: 1381189 - RNA, 16 nt, Neisseria meningitidis Z2491
ucaaccuguuuuucaa

SEQ ID NO: 1381190 - RNA, 14 nt, Neisseria meningitidis Z2491
ucaaccccaggaua

SEQ ID NO: 1381191 - RNA, 23 nt, Neisseria meningitidis Z2491
ucaacccguaugccgccugccug

SEQ ID NO: 1381192 - RNA, 20 nt, Neisseria meningitidis Z2491
ucaaagauuaucugaaaguu

SEQ ID NO: 1381193 - RNA, 17 nt, Neisseria meningitidis Z2491
ucaaaucauauuccagc

SEQ ID NO: 1381194 - RNA, 14 nt, Neisseria meningitidis Z2491
ucaaauaggcauug

SEQ ID NO: 1381195 - RNA, 16 nt, Neisseria meningitidis Z2491
ucaaauucggaagaca

SEQ ID NO: 1381196 - RNA, 15 nt, Neisseria meningitidis Z2491
ucaaauuuauuugaa

SEQ ID NO: 1381197 - RNA, 19 nt, Neisseria meningitidis Z2491
ucaaaccauauggaaaaau

SEQ ID NO: 1381198 - RNA, 19 nt, Neisseria meningitidis Z2491
ucaaaccccuucaaaccaa

SEQ ID NO: 1381199 - RNA, 13 nt, Neisseria meningitidis Z2491
ucaaacaucugcc

SEQ ID NO: 1381200 - RNA, 11 nt, Neisseria meningitidis Z2491
ucaaaauuuac

SEQ ID NO: 1381201 - RNA, 15 nt, Neisseria meningitidis Z2491
ucaaaaucaucccaa

SEQ ID NO: 1381202 - RNA, 15 nt, Neisseria meningitidis Z2491
ucaaaaucggcauuc

SEQ ID NO: 1381203 - RNA, 23 nt, Neisseria meningitidis Z2491
ucacggcuuugucgguaaaaaug

SEQ ID NO: 1381204 - RNA, 19 nt, Neisseria meningitidis Z2491
ucacguccgccauuuccaa

SEQ ID NO: 1381205 - RNA, 16 nt, Neisseria meningitidis Z2491
ucacguucugaaaaau

SEQ ID NO: 1381206 - RNA, 20 nt, Neisseria meningitidis Z2491
ucacguucugaaaaauauug

SEQ ID NO: 1381207 - RNA, 23 nt, Neisseria meningitidis Z2491
ucacuauauuuucccgacaggcg

SEQ ID NO: 1381208 - RNA, 15 nt, Neisseria meningitidis Z2491
ucacuauaccaaacg

SEQ ID NO: 1381209 - RNA, 18 nt, Neisseria meningitidis Z2491
ucacuauaccaaacggca

SEQ ID NO: 1381210 - RNA, 23 nt, Neisseria meningitidis Z2491
ucacuauaccaaacggcauaucc

SEQ ID NO: 1381211 - RNA, 16 nt, Neisseria meningitidis Z2491
ucacccugcaaggcgg

SEQ ID NO: 1381212 - RNA, 19 nt, Neisseria meningitidis Z2491
ucacgccauuggaagaaga

SEQ ID NO: 1381213 - RNA, 22 nt, Neisseria meningitidis Z2491
ucacgccgccgcgccccaagcc

SEQ ID NO: 1381214 - RNA, 21 nt, Neisseria meningitidis Z2491
ucacgccguguuucaaggcgg

SEQ ID NO: 1381215 - RNA, 22 nt, Neisseria meningitidis Z2491
ucacgccguguuucaaggcggc

SEQ ID NO: 1381216 - RNA, 20 nt, Neisseria meningitidis Z2491
ucacuuuaaucaauccgaaa

SEQ ID NO: 1381217 - RNA, 15 nt, Neisseria meningitidis Z2491
ucacuuggugcuuca

SEQ ID NO: 1381218 - RNA, 19 nt, Neisseria meningitidis Z2491
ucagaaaugacugaaauuc

SEQ ID NO: 1381219 - RNA, 11 nt, Neisseria meningitidis Z2491
ucagaaaccua

SEQ ID NO: 1381220 - RNA, 12 nt, Neisseria meningitidis Z2491
ucagaaaccuaa

SEQ ID NO: 1381221 - RNA, 16 nt, Neisseria meningitidis Z2491
ucagaaaccuaaaauc

SEQ ID NO: 1381222 - RNA, 21 nt, Neisseria meningitidis Z2491
ucagaaaauuucuugauuuuu

SEQ ID NO: 1381223 - RNA, 22 nt, Neisseria meningitidis Z2491
ucacuuugcucagcccgaaaua

SEQ ID NO: 1381224 - RNA, 22 nt, Neisseria meningitidis Z2491
ucagauuuuggagcaguaaaau

SEQ ID NO: 1381225 - RNA, 23 nt, Neisseria meningitidis Z2491
aaaucgguuccguacuaucugua

SEQ ID NO: 1381226 - RNA, 20 nt, Neisseria meningitidis Z2491
ucagauggccuuuacucauu

SEQ ID NO: 1381227 - RNA, 19 nt, Neisseria meningitidis Z2491
ucagauuauuuauuaauuu

SEQ ID NO: 1381228 - RNA, 15 nt, Neisseria meningitidis Z2491
ucagaauacugccug

SEQ ID NO: 1381229 - RNA, 23 nt, Neisseria meningitidis Z2491
ucagaaguuacucgaaacuuaaa

SEQ ID NO: 1381230 - RNA, 18 nt, Neisseria meningitidis Z2491
ucagaauugauucuccca

SEQ ID NO: 1381231 - RNA, 20 nt, Neisseria meningitidis Z2491
ucagaauuuauuugaacaac

SEQ ID NO: 1381232 - RNA, 16 nt, Neisseria meningitidis Z2491
ucagaccgaauuuaau

SEQ ID NO: 1381233 - RNA, 15 nt, Neisseria meningitidis Z2491
ucagacauuaaaaaa

SEQ ID NO: 1381234 - RNA, 16 nt, Neisseria meningitidis Z2491
ucagacauuaaaaaau

SEQ ID NO: 1381235 - RNA, 22 nt, Neisseria meningitidis Z2491
ucagacggcauccgcuuaaaaa

SEQ ID NO: 1381236 - RNA, 17 nt, Neisseria meningitidis Z2491
ucagacggcauuucccg

SEQ ID NO: 1381237 - RNA, 17 nt, Neisseria meningitidis Z2491
ucagacggcauuuucaa

SEQ ID NO: 1381238 - RNA, 16 nt, Neisseria meningitidis Z2491
ucagacggcauuuugu

SEQ ID NO: 1381239 - RNA, 15 nt, Neisseria meningitidis Z2491
ucagacggcauuuuu

SEQ ID NO: 1381240 - RNA, 18 nt, Neisseria meningitidis Z2491
ucagacggcauuuuucca

SEQ ID NO: 1381241 - RNA, 20 nt, Neisseria meningitidis Z2491
ucagacggcauuuuuuacgg

SEQ ID NO: 1381242 - RNA, 19 nt, Neisseria meningitidis Z2491
ucagacggcauuuuuucac

SEQ ID NO: 1381243 - RNA, 14 nt, Neisseria meningitidis Z2491
ucagagaaauggca

SEQ ID NO: 1381244 - RNA, 17 nt, Neisseria meningitidis Z2491
ucagagaaauggcagua

SEQ ID NO: 1381245 - RNA, 15 nt, Neisseria meningitidis Z2491
ucaggcguuuccaaa

SEQ ID NO: 1381246 - RNA, 18 nt, Neisseria meningitidis Z2491
ucaggcugccuuauguau

SEQ ID NO: 1381247 - RNA, 18 nt, Neisseria meningitidis Z2491
ucaggcuggaaaacagcu

SEQ ID NO: 1381248 - RNA, 19 nt, Neisseria meningitidis Z2491
ucaggcacaaacaaggcga

SEQ ID NO: 1381249 - RNA, 14 nt, Neisseria meningitidis Z2491
ucaggacaaggcga

SEQ ID NO: 1381250 - RNA, 15 nt, Neisseria meningitidis Z2491
ucaggacaaggcgac

SEQ ID NO: 1381251 - RNA, 23 nt, Neisseria meningitidis Z2491
ucaggacaaggcgacgaagccgc

SEQ ID NO: 1381252 - RNA, 21 nt, Neisseria meningitidis Z2491
aaaucuauaguggauuaacaa

SEQ ID NO: 1381253 - RNA, 23 nt, Neisseria meningitidis Z2491
aaaucuauaguggauuaacaaaa

SEQ ID NO: 1381254 - RNA, 14 nt, Neisseria meningitidis Z2491
aaaucuauguuaug

SEQ ID NO: 1381255 - RNA, 17 nt, Neisseria meningitidis Z2491
ucagcacggggauuuuc

SEQ ID NO: 1381256 - RNA, 18 nt, Neisseria meningitidis Z2491
ucagcaccuuagagaauc

SEQ ID NO: 1381257 - RNA, 14 nt, Neisseria meningitidis Z2491
ucagcacaaaugcc

SEQ ID NO: 1381258 - RNA, 15 nt, Neisseria meningitidis Z2491
ucagcacaaaugcca

SEQ ID NO: 1381259 - RNA, 16 nt, Neisseria meningitidis Z2491
ucagcccgaaauaacu

SEQ ID NO: 1381260 - RNA, 23 nt, Neisseria meningitidis Z2491
ucagccaccagcgguacauccaa

SEQ ID NO: 1381261 - RNA, 22 nt, Neisseria meningitidis Z2491
gugggaaugacgggauuugaga

SEQ ID NO: 1381262 - RNA, 13 nt, Neisseria meningitidis Z2491
gugggaauccaga

SEQ ID NO: 1381263 - RNA, 17 nt, Neisseria meningitidis Z2491
gugggaauccagaaucu

SEQ ID NO: 1381264 - RNA, 18 nt, Neisseria meningitidis Z2491
gugggaaucuagaauccc

SEQ ID NO: 1381265 - RNA, 17 nt, Neisseria meningitidis Z2491
gugggaaucuagaaucu

SEQ ID NO: 1381266 - RNA, 15 nt, Neisseria meningitidis Z2491
gugggaaucuggaaa

SEQ ID NO: 1381267 - RNA, 15 nt, Neisseria meningitidis Z2491
guggcgaagccggcg

SEQ ID NO: 1381268 - RNA, 19 nt, Neisseria meningitidis Z2491
guggcgaagccggcggcga

SEQ ID NO: 1381269 - RNA, 15 nt, Neisseria meningitidis Z2491
guggcaguacauuuu

SEQ ID NO: 1381270 - RNA, 21 nt, Neisseria meningitidis Z2491
guggccacgccgacugccgcc

SEQ ID NO: 1381271 - RNA, 20 nt, Neisseria meningitidis Z2491
guggauuauaguggauuaaa

SEQ ID NO: 1381272 - RNA, 16 nt, Neisseria meningitidis Z2491
guggcaacuuccagcg

SEQ ID NO: 1381273 - RNA, 12 nt, Neisseria meningitidis Z2491
guggaaggcaac

SEQ ID NO: 1381274 - RNA, 16 nt, Neisseria meningitidis Z2491
guggaagauucggcug

SEQ ID NO: 1381275 - RNA, 15 nt, Neisseria meningitidis Z2491
guggagauuuggaga

SEQ ID NO: 1381276 - RNA, 23 nt, Neisseria meningitidis Z2491
gugcuguuucagacggcauuuuu

SEQ ID NO: 1381277 - RNA, 18 nt, Neisseria meningitidis Z2491
gugcugggugguggcaag

SEQ ID NO: 1381278 - RNA, 16 nt, Neisseria meningitidis Z2491
gugugguugaagucca

SEQ ID NO: 1381279 - RNA, 20 nt, Neisseria meningitidis Z2491
guguggcgguuauugugcuu

SEQ ID NO: 1381280 - RNA, 15 nt, Neisseria meningitidis Z2491
gugugccggaugcgg

SEQ ID NO: 1381281 - RNA, 13 nt, Neisseria meningitidis Z2491
gugugcgguucgg

SEQ ID NO: 1381282 - RNA, 14 nt, Neisseria meningitidis Z2491
gugguugaagucca

SEQ ID NO: 1381283 - RNA, 19 nt, Neisseria meningitidis Z2491
guggguaacgacgaccauc

SEQ ID NO: 1381284 - RNA, 13 nt, Neisseria meningitidis Z2491
gugugaaaauuua

SEQ ID NO: 1381285 - RNA, 12 nt, Neisseria meningitidis Z2491
guguaggcaguu

SEQ ID NO: 1381286 - RNA, 16 nt, Neisseria meningitidis Z2491
guucaggaaggacugg

SEQ ID NO: 1381287 - RNA, 14 nt, Neisseria meningitidis Z2491
guuccaauuccugu

SEQ ID NO: 1381288 - RNA, 19 nt, Neisseria meningitidis Z2491
guuccaaauauuuccugca

SEQ ID NO: 1381289 - RNA, 13 nt, Neisseria meningitidis Z2491
guuauuuucuuga

SEQ ID NO: 1381290 - RNA, 13 nt, Neisseria meningitidis Z2491
guuauuuucacaa

SEQ ID NO: 1381291 - RNA, 19 nt, Neisseria meningitidis Z2491
guucgggcagucuuccaac

SEQ ID NO: 1381292 - RNA, 18 nt, Neisseria meningitidis Z2491
guuccgcgccgcaaaccg

SEQ ID NO: 1381293 - RNA, 21 nt, Neisseria meningitidis Z2491
guuccgcaccuuuguguccga

SEQ ID NO: 1381294 - RNA, 16 nt, Neisseria meningitidis Z2491
guuauggggauuuauu

SEQ ID NO: 1381295 - RNA, 17 nt, Neisseria meningitidis Z2491
guuaggguaauuuaucc

SEQ ID NO: 1381296 - RNA, 22 nt, Neisseria meningitidis Z2491
guuaacgcguuaccgguuugua

SEQ ID NO: 1381297 - RNA, 19 nt, Neisseria meningitidis Z2491
guuaaggcagagauaaaag

SEQ ID NO: 1381298 - RNA, 20 nt, Neisseria meningitidis Z2491
guuaaguauuucuauuuuuu

SEQ ID NO: 1381299 - RNA, 17 nt, Neisseria meningitidis Z2491
guucuaaggucuagauu

SEQ ID NO: 1381300 - RNA, 20 nt, Neisseria meningitidis Z2491
guucuaaggucuagauuccc

SEQ ID NO: 1381301 - RNA, 19 nt, Neisseria meningitidis Z2491
guugagcuaaggcgagaca

SEQ ID NO: 1381302 - RNA, 12 nt, Neisseria meningitidis Z2491
guugaguuucag

SEQ ID NO: 1381303 - RNA, 14 nt, Neisseria meningitidis Z2491
guugccgucaaaac

SEQ ID NO: 1381304 - RNA, 20 nt, Neisseria meningitidis Z2491
guugccuuuaugagaaaaag

SEQ ID NO: 1381305 - RNA, 21 nt, Neisseria meningitidis Z2491
guugccucgccuuagcucaaa

SEQ ID NO: 1381306 - RNA, 15 nt, Neisseria meningitidis Z2491
guuggccgcuuucaa

SEQ ID NO: 1381307 - RNA, 20 nt, Neisseria meningitidis Z2491
guugguagagcgcaaccuug

SEQ ID NO: 1381308 - RNA, 22 nt, Neisseria meningitidis Z2491
guuggcguuuggcgcgggugau

SEQ ID NO: 1381309 - RNA, 19 nt, Neisseria meningitidis Z2491
guugcgucugccuucuucu

SEQ ID NO: 1381310 - RNA, 17 nt, Neisseria meningitidis Z2491
guuucaacgacuuccag

SEQ ID NO: 1381311 - RNA, 20 nt, Neisseria meningitidis Z2491
guuucaacgacuuccagcac

SEQ ID NO: 1381312 - RNA, 17 nt, Neisseria meningitidis Z2491
guuucaaggcggcggcg

SEQ ID NO: 1381313 - RNA, 15 nt, Neisseria meningitidis Z2491
guugucgagccuucc

SEQ ID NO: 1381314 - RNA, 13 nt, Neisseria meningitidis Z2491
guuuaaauucauc

SEQ ID NO: 1381315 - RNA, 20 nt, Neisseria meningitidis Z2491
guuuaacuugucaagaaaca

SEQ ID NO: 1381316 - RNA, 20 nt, Neisseria meningitidis Z2491
guuuacggucagaaaauuuc

SEQ ID NO: 1381317 - RNA, 22 nt, Neisseria meningitidis Z2491
guuuacggucagaaaauuucuu

SEQ ID NO: 1381318 - RNA, 19 nt, Neisseria meningitidis Z2491
guuuaaucccuuugagcuu

SEQ ID NO: 1381319 - RNA, 21 nt, Neisseria meningitidis Z2491
guuuaauuaaaacucuccuga

SEQ ID NO: 1381320 - RNA, 21 nt, Neisseria meningitidis Z2491
guuucagacggcauuugacuu

SEQ ID NO: 1381321 - RNA, 18 nt, Neisseria meningitidis Z2491
guuucagacggcauuuug

SEQ ID NO: 1381322 - RNA, 21 nt, Neisseria meningitidis Z2491
guuucagacggcauuuuguug

SEQ ID NO: 1381323 - RNA, 18 nt, Neisseria meningitidis Z2491
guuucagacggcauuuuu

SEQ ID NO: 1381324 - RNA, 19 nt, Neisseria meningitidis Z2491
guuucagacggcauuuuug

SEQ ID NO: 1381325 - RNA, 20 nt, Neisseria meningitidis Z2491
guuucagacggcaucuuuuu

SEQ ID NO: 1381326 - RNA, 21 nt, Neisseria meningitidis Z2491
guuucacuuguuuucggguaa

SEQ ID NO: 1381327 - RNA, 18 nt, Neisseria meningitidis Z2491
aaauaugccgucauuccc

SEQ ID NO: 1381328 - RNA, 15 nt, Neisseria meningitidis Z2491
aaauaucuagcaaaa

SEQ ID NO: 1381329 - RNA, 14 nt, Neisseria meningitidis Z2491
aaauaucugacaaa

SEQ ID NO: 1381330 - RNA, 13 nt, Neisseria meningitidis Z2491
aaauauuaaucag

SEQ ID NO: 1381331 - RNA, 12 nt, Neisseria meningitidis Z2491
aaauauuaaaaa

SEQ ID NO: 1381332 - RNA, 21 nt, Neisseria meningitidis Z2491
guuuccaauacaacaaaaugc

SEQ ID NO: 1381333 - RNA, 22 nt, Neisseria meningitidis Z2491
guuuugcgcuccauugccugac

SEQ ID NO: 1381334 - RNA, 19 nt, Neisseria meningitidis Z2491
guuuugcagauucaacgca

SEQ ID NO: 1381335 - RNA, 13 nt, Neisseria meningitidis Z2491
guuuugaugguuu

SEQ ID NO: 1381336 - RNA, 21 nt, Neisseria meningitidis Z2491
guuuuauuuuuuggcuuugaa

SEQ ID NO: 1381337 - RNA, 22 nt, Neisseria meningitidis Z2491
guuuuauuuuuuggcuuugaag

SEQ ID NO: 1381338 - RNA, 15 nt, Neisseria meningitidis Z2491
guuuucaagccuucc

SEQ ID NO: 1381339 - RNA, 18 nt, Neisseria meningitidis Z2491
guuuuaggcaauugaaaa

SEQ ID NO: 1381340 - RNA, 23 nt, Neisseria meningitidis Z2491
guuuuaggcaauugaaaaauuuu

SEQ ID NO: 1381341 - RNA, 13 nt, Neisseria meningitidis Z2491
guuucugauuuug

SEQ ID NO: 1381342 - RNA, 13 nt, Neisseria meningitidis Z2491
guuucugaagcca

SEQ ID NO: 1381343 - RNA, 17 nt, Neisseria meningitidis Z2491
guuucuucaguuguuuu

SEQ ID NO: 1381344 - RNA, 20 nt, Neisseria meningitidis Z2491
guuucuucaguuguuuuacu

SEQ ID NO: 1381345 - RNA, 14 nt, Neisseria meningitidis Z2491
guuucuguuuuuuc

SEQ ID NO: 1381346 - RNA, 20 nt, Neisseria meningitidis Z2491
guuucuguuucgguuuucua

SEQ ID NO: 1381347 - RNA, 20 nt, Neisseria meningitidis Z2491
guuugagcaguuuuuugacu

SEQ ID NO: 1381348 - RNA, 22 nt, Neisseria meningitidis Z2491
guuugccgcugacgaaaccaga

SEQ ID NO: 1381349 - RNA, 20 nt, Neisseria meningitidis Z2491
aaaucaaguuuauccuaguu

SEQ ID NO: 1381350 - RNA, 16 nt, Neisseria meningitidis Z2491
aaaucaacggauugac

SEQ ID NO: 1381351 - RNA, 23 nt, Neisseria meningitidis Z2491
guuucggucauuuccgauaaauu

SEQ ID NO: 1381352 - RNA, 16 nt, Neisseria meningitidis Z2491
guuucguaaauccauu

SEQ ID NO: 1381353 - RNA, 14 nt, Neisseria meningitidis Z2491
guuucguaugauuu

SEQ ID NO: 1381354 - RNA, 14 nt, Neisseria meningitidis Z2491
guuucgugccuucu

SEQ ID NO: 1381355 - RNA, 13 nt, Neisseria meningitidis Z2491
guuucggauaaau

SEQ ID NO: 1381356 - RNA, 17 nt, Neisseria meningitidis Z2491
guuucggauaaauuuug

SEQ ID NO: 1381357 - RNA, 16 nt, Neisseria meningitidis Z2491
guuucuagauucccac

SEQ ID NO: 1381358 - RNA, 19 nt, Neisseria meningitidis Z2491
guuucuagauucccacuuc

SEQ ID NO: 1381359 - RNA, 19 nt, Neisseria meningitidis Z2491
guuucuagauucccacuuu

SEQ ID NO: 1381360 - RNA, 20 nt, Neisseria meningitidis Z2491
aaaucaccaucacgcugccg

SEQ ID NO: 1381361 - RNA, 22 nt, Neisseria meningitidis Z2491
aaaucacggugaaaaaugaaaa

SEQ ID NO: 1381362 - RNA, 14 nt, Neisseria meningitidis Z2491
guuuccuccucgcc

SEQ ID NO: 1381363 - RNA, 17 nt, Neisseria meningitidis Z2491
guuuccgggcggugcgu

SEQ ID NO: 1381364 - RNA, 15 nt, Neisseria meningitidis Z2491
guuuccgcaccgaca

SEQ ID NO: 1381365 - RNA, 20 nt, Neisseria meningitidis Z2491
guuuccugcagguagcggcu

SEQ ID NO: 1381366 - RNA, 12 nt, Neisseria meningitidis Z2491
aaaucaaaaaaa

SEQ ID NO: 1381367 - RNA, 12 nt, Neisseria meningitidis Z2491
aaaucaaaaaca

SEQ ID NO: 1381368 - RNA, 14 nt, Neisseria meningitidis Z2491
aaaucaaaaacaca

SEQ ID NO: 1381369 - RNA, 20 nt, Neisseria meningitidis Z2491
aaaucaaaaacagaaaccuc

SEQ ID NO: 1381370 - RNA, 23 nt, Neisseria meningitidis Z2491
aaaucaacagauuacuaaaacac

SEQ ID NO: 1381371 - RNA, 20 nt, Neisseria meningitidis Z2491
aaaucaacagauugucaaaa

SEQ ID NO: 1381372 - RNA, 16 nt, Neisseria meningitidis Z2491
guuuccacuaaaugcu

SEQ ID NO: 1381373 - RNA, 16 nt, Neisseria meningitidis Z2491
guuucccgaaauucca

SEQ ID NO: 1381374 - RNA, 22 nt, Neisseria meningitidis Z2491
aaauaguacggaaccaauucac

SEQ ID NO: 1381375 - RNA, 23 nt, Neisseria meningitidis Z2491
gugauucaauaggauaggcugcu

SEQ ID NO: 1381376 - RNA, 22 nt, Neisseria meningitidis Z2491
gugcaggcugccgcacaagccc

SEQ ID NO: 1381377 - RNA, 18 nt, Neisseria meningitidis Z2491
gucuuuuccuuccaaaag

SEQ ID NO: 1381378 - RNA, 21 nt, Neisseria meningitidis Z2491
gucuuuucccuugcaaauaau

SEQ ID NO: 1381379 - RNA, 18 nt, Neisseria meningitidis Z2491
gucuuuuuuauucaaugu

SEQ ID NO: 1381380 - RNA, 23 nt, Neisseria meningitidis Z2491
gucuuucaauauacugcucgcca

SEQ ID NO: 1381381 - RNA, 12 nt, Neisseria meningitidis Z2491
gucuucagcuug

SEQ ID NO: 1381382 - RNA, 16 nt, Neisseria meningitidis Z2491
gucuucaauuccugcg

SEQ ID NO: 1381383 - RNA, 17 nt, Neisseria meningitidis Z2491
gucuucaauuccugcgc

SEQ ID NO: 1381384 - RNA, 14 nt, Neisseria meningitidis Z2491
gucuuggucaacca

SEQ ID NO: 1381385 - RNA, 16 nt, Neisseria meningitidis Z2491
gucgugcgccguaucg

SEQ ID NO: 1381386 - RNA, 14 nt, Neisseria meningitidis Z2491
gucucauauucacu

SEQ ID NO: 1381387 - RNA, 21 nt, Neisseria meningitidis Z2491
gucucauccuguuauuuucac

SEQ ID NO: 1381388 - RNA, 17 nt, Neisseria meningitidis Z2491
gucuccauuucugcgca

SEQ ID NO: 1381389 - RNA, 13 nt, Neisseria meningitidis Z2491
gucugaaaaaccu

SEQ ID NO: 1381390 - RNA, 15 nt, Neisseria meningitidis Z2491
gucugaaaacagcaa

SEQ ID NO: 1381391 - RNA, 18 nt, Neisseria meningitidis Z2491
gucugaaaaccuuucaga

SEQ ID NO: 1381392 - RNA, 22 nt, Neisseria meningitidis Z2491
gucugaaaagaugccugcuucg

SEQ ID NO: 1381393 - RNA, 14 nt, Neisseria meningitidis Z2491
gucugcgaaacaga

SEQ ID NO: 1381394 - RNA, 20 nt, Neisseria meningitidis Z2491
gucugccaacccuugugcuu

SEQ ID NO: 1381395 - RNA, 18 nt, Neisseria meningitidis Z2491
gucugccaaggauagaga

SEQ ID NO: 1381396 - RNA, 23 nt, Neisseria meningitidis Z2491
gucugaaaccccuaaaggcuuca

SEQ ID NO: 1381397 - RNA, 22 nt, Neisseria meningitidis Z2491
gucugaaacccgauguuuucaa

SEQ ID NO: 1381398 - RNA, 13 nt, Neisseria meningitidis Z2491
gucugaaaccuga

SEQ ID NO: 1381399 - RNA, 13 nt, Neisseria meningitidis Z2491
gucugaaaccugc

SEQ ID NO: 1381400 - RNA, 19 nt, Neisseria meningitidis Z2491
gucugaaacgaacaaaccc

SEQ ID NO: 1381401 - RNA, 20 nt, Neisseria meningitidis Z2491
gucugaaacguugugcuguu

SEQ ID NO: 1381402 - RNA, 13 nt, Neisseria meningitidis Z2491
gucugaaacguuu

SEQ ID NO: 1381403 - RNA, 14 nt, Neisseria meningitidis Z2491
gucugaaacguuuc

SEQ ID NO: 1381404 - RNA, 18 nt, Neisseria meningitidis Z2491
gucugaaagucuuucaga

SEQ ID NO: 1381405 - RNA, 18 nt, Neisseria meningitidis Z2491
gucugaagauauuggaac

SEQ ID NO: 1381406 - RNA, 18 nt, Neisseria meningitidis Z2491
gucugaagcccugccugc

SEQ ID NO: 1381407 - RNA, 20 nt, Neisseria meningitidis Z2491
gucugaaggcuugagcguuc

SEQ ID NO: 1381408 - RNA, 21 nt, Neisseria meningitidis Z2491
gucugaaucgcgugcugcauc

SEQ ID NO: 1381409 - RNA, 17 nt, Neisseria meningitidis Z2491
gucuggaacuugaaaac

SEQ ID NO: 1381410 - RNA, 16 nt, Neisseria meningitidis Z2491
gucgggcugccaagcg

SEQ ID NO: 1381411 - RNA, 12 nt, Neisseria meningitidis Z2491
gucguacagaua

SEQ ID NO: 1381412 - RNA, 20 nt, Neisseria meningitidis Z2491
gucgcaaaucggcuucagac

SEQ ID NO: 1381413 - RNA, 16 nt, Neisseria meningitidis Z2491
gucgagcaggaugcug

SEQ ID NO: 1381414 - RNA, 17 nt, Neisseria meningitidis Z2491
gucgagcaggaugcugc

SEQ ID NO: 1381415 - RNA, 13 nt, Neisseria meningitidis Z2491
guccugauuuaaa

SEQ ID NO: 1381416 - RNA, 16 nt, Neisseria meningitidis Z2491
guccugauuuaaauuu

SEQ ID NO: 1381417 - RNA, 16 nt, Neisseria meningitidis Z2491
guccugauuuuuguua

SEQ ID NO: 1381418 - RNA, 17 nt, Neisseria meningitidis Z2491
gucccgacgcuuguccc

SEQ ID NO: 1381419 - RNA, 14 nt, Neisseria meningitidis Z2491
gucaacucuuccau

SEQ ID NO: 1381420 - RNA, 17 nt, Neisseria meningitidis Z2491
gucagcccgcugcgggc

SEQ ID NO: 1381421 - RNA, 17 nt, Neisseria meningitidis Z2491
gucagcccggcgguguc

SEQ ID NO: 1381422 - RNA, 16 nt, Neisseria meningitidis Z2491
gucaucuuucaaacau

SEQ ID NO: 1381423 - RNA, 19 nt, Neisseria meningitidis Z2491
guccacacaucaggggcgg

SEQ ID NO: 1381424 - RNA, 13 nt, Neisseria meningitidis Z2491
guccaugauuuuu

SEQ ID NO: 1381425 - RNA, 22 nt, Neisseria meningitidis Z2491
uacgcccacaaauccugcugcu

SEQ ID NO: 1381426 - RNA, 23 nt, Neisseria meningitidis Z2491
uacgcccgcagccggggcaggcg

SEQ ID NO: 1381427 - RNA, 16 nt, Neisseria meningitidis Z2491
uacgacucaaaaucau

SEQ ID NO: 1381428 - RNA, 19 nt, Neisseria meningitidis Z2491
uacgacucgcuugcuggua

SEQ ID NO: 1381429 - RNA, 22 nt, Neisseria meningitidis Z2491
uaccgguuuaaauuuaauucac

SEQ ID NO: 1381430 - RNA, 17 nt, Neisseria meningitidis Z2491
uaccgucugaaaccugc

SEQ ID NO: 1381431 - RNA, 14 nt, Neisseria meningitidis Z2491
uaccgucugaaagg

SEQ ID NO: 1381432 - RNA, 19 nt, Neisseria meningitidis Z2491
uacuaaaauuuuaugcuca

SEQ ID NO: 1381433 - RNA, 23 nt, Neisseria meningitidis Z2491
uacuacgcggcugaaaaaaugcc

SEQ ID NO: 1381434 - RNA, 17 nt, Neisseria meningitidis Z2491
uacggcggcggcaggca

SEQ ID NO: 1381435 - RNA, 17 nt, Neisseria meningitidis Z2491
uacggcguuggcucgcc

SEQ ID NO: 1381436 - RNA, 16 nt, Neisseria meningitidis Z2491
uacgcggcugaaaaaa

SEQ ID NO: 1381437 - RNA, 23 nt, Neisseria meningitidis Z2491
uacuggaugucgguaaucgccuu

SEQ ID NO: 1381438 - RNA, 23 nt, Neisseria meningitidis Z2491
uacugccgcaaacggcaggcaaa

SEQ ID NO: 1381439 - RNA, 20 nt, Neisseria meningitidis Z2491
uacugcugcggcucugaaac

SEQ ID NO: 1381440 - RNA, 20 nt, Neisseria meningitidis Z2491
uacuuuauccaccaacuggu

SEQ ID NO: 1381441 - RNA, 15 nt, Neisseria meningitidis Z2491
uaccgaccaccacuu

SEQ ID NO: 1381442 - RNA, 17 nt, Neisseria meningitidis Z2491
uaccgauacauccgaau

SEQ ID NO: 1381443 - RNA, 23 nt, Neisseria meningitidis Z2491
uacccggcugucgucauuuccaa

SEQ ID NO: 1381444 - RNA, 17 nt, Neisseria meningitidis Z2491
uaccaugcgaagacuuu

SEQ ID NO: 1381445 - RNA, 22 nt, Neisseria meningitidis Z2491
uaccauuguuucugaagccagc

SEQ ID NO: 1381446 - RNA, 20 nt, Neisseria meningitidis Z2491
uacccaaaaggaagucaugc

SEQ ID NO: 1381447 - RNA, 15 nt, Neisseria meningitidis Z2491
uacccaaacuuccaa

SEQ ID NO: 1381448 - RNA, 16 nt, Neisseria meningitidis Z2491
uacccaaacuuccaaa

SEQ ID NO: 1381449 - RNA, 13 nt, Neisseria meningitidis Z2491
uacccaaauaccc

SEQ ID NO: 1381450 - RNA, 14 nt, Neisseria meningitidis Z2491
uaccagaaaaaaca

SEQ ID NO: 1381451 - RNA, 17 nt, Neisseria meningitidis Z2491
uacauuccgucauuccc

SEQ ID NO: 1381452 - RNA, 18 nt, Neisseria meningitidis Z2491
uacauuccgucauuccca

SEQ ID NO: 1381453 - RNA, 15 nt, Neisseria meningitidis Z2491
uacacaaaaaagcca

SEQ ID NO: 1381454 - RNA, 17 nt, Neisseria meningitidis Z2491
uacacaaaaaagccagc

SEQ ID NO: 1381455 - RNA, 15 nt, Neisseria meningitidis Z2491
uacaaggcagcaccg

SEQ ID NO: 1381456 - RNA, 17 nt, Neisseria meningitidis Z2491
uacauccgaauaugcca

SEQ ID NO: 1381457 - RNA, 15 nt, Neisseria meningitidis Z2491
uacauccaauaaucc

SEQ ID NO: 1381458 - RNA, 18 nt, Neisseria meningitidis Z2491
uacaucaucuuauuuauu

SEQ ID NO: 1381459 - RNA, 15 nt, Neisseria meningitidis Z2491
uacaacaaaaugccg

SEQ ID NO: 1381460 - RNA, 19 nt, Neisseria meningitidis Z2491
uacaaaaugccgucugaaa

SEQ ID NO: 1381461 - RNA, 19 nt, Neisseria meningitidis Z2491
uacaaacaucugauuuuuc

SEQ ID NO: 1381462 - RNA, 22 nt, Neisseria meningitidis Z2491
uacaaacaggcuucagacggca

SEQ ID NO: 1381463 - RNA, 19 nt, Neisseria meningitidis Z2491
uacaaaaggccgucugaaa

SEQ ID NO: 1381464 - RNA, 18 nt, Neisseria meningitidis Z2491
uaaugcgguguaucuuuu

SEQ ID NO: 1381465 - RNA, 17 nt, Neisseria meningitidis Z2491
uaauuaccgaaacauuc

SEQ ID NO: 1381466 - RNA, 22 nt, Neisseria meningitidis Z2491
uaauagugccgucaaauuacuu

SEQ ID NO: 1381467 - RNA, 16 nt, Neisseria meningitidis Z2491
uaauacguuuuucucg

SEQ ID NO: 1381468 - RNA, 21 nt, Neisseria meningitidis Z2491
uaauaauguguugauuaaaua

SEQ ID NO: 1381469 - RNA, 22 nt, Neisseria meningitidis Z2491
uaauaauguguugauuaaauau

SEQ ID NO: 1381470 - RNA, 21 nt, Neisseria meningitidis Z2491
uaauauaucgauugcgcuuca

SEQ ID NO: 1381471 - RNA, 12 nt, Neisseria meningitidis Z2491
uaaucaaaucuu

SEQ ID NO: 1381472 - RNA, 14 nt, Neisseria meningitidis Z2491
uaaucaaaaccagc

SEQ ID NO: 1381473 - RNA, 19 nt, Neisseria meningitidis Z2491
uaaucccgucauucccacg

SEQ ID NO: 1381474 - RNA, 18 nt, Neisseria meningitidis Z2491
uaauccacuauaaugauu

SEQ ID NO: 1381475 - RNA, 15 nt, Neisseria meningitidis Z2491
uaaucaucguauuuu

SEQ ID NO: 1381476 - RNA, 18 nt, Neisseria meningitidis Z2491
uaauccacaguuuuucca

SEQ ID NO: 1381477 - RNA, 14 nt, Neisseria meningitidis Z2491
uaauccacuauaaa

SEQ ID NO: 1381478 - RNA, 15 nt, Neisseria meningitidis Z2491
uaauccacuauaaaa

SEQ ID NO: 1381479 - RNA, 18 nt, Neisseria meningitidis Z2491
uaaucaauuaaaaacaaa

SEQ ID NO: 1381480 - RNA, 18 nt, Neisseria meningitidis Z2491
uaaucagcuauauauagu

SEQ ID NO: 1381481 - RNA, 23 nt, Neisseria meningitidis Z2491
uaaucaucacuccgucuuucauu

SEQ ID NO: 1381482 - RNA, 16 nt, Neisseria meningitidis Z2491
aaaucccgucauuccc

SEQ ID NO: 1381483 - RNA, 16 nt, Neisseria meningitidis Z2491
uaacugcaagaacagc

SEQ ID NO: 1381484 - RNA, 18 nt, Neisseria meningitidis Z2491
aaauccccccuuaauccu

SEQ ID NO: 1381485 - RNA, 21 nt, Neisseria meningitidis Z2491
aaaucccauuauuuucacaaa

SEQ ID NO: 1381486 - RNA, 15 nt, Neisseria meningitidis Z2491
aaaucccaaacccuc

SEQ ID NO: 1381487 - RNA, 15 nt, Neisseria meningitidis Z2491
uaacuuauacacacg

SEQ ID NO: 1381488 - RNA, 19 nt, Neisseria meningitidis Z2491
uaacgguuuggcauuuuua

SEQ ID NO: 1381489 - RNA, 15 nt, Neisseria meningitidis Z2491
uaacucuaaaccguc

SEQ ID NO: 1381490 - RNA, 21 nt, Neisseria meningitidis Z2491
uaagacguggugcuaaaacag

SEQ ID NO: 1381491 - RNA, 13 nt, Neisseria meningitidis Z2491
uaagaaaaccugc

SEQ ID NO: 1381492 - RNA, 22 nt, Neisseria meningitidis Z2491
uaagaaacaaagcuuuaaacua

SEQ ID NO: 1381493 - RNA, 19 nt, Neisseria meningitidis Z2491
uaaggucuagauucccgcu

SEQ ID NO: 1381494 - RNA, 16 nt, Neisseria meningitidis Z2491
uaaguauuucuauuuu

SEQ ID NO: 1381495 - RNA, 15 nt, Neisseria meningitidis Z2491
uaauaaauuaaucuc

SEQ ID NO: 1381496 - RNA, 23 nt, Neisseria meningitidis Z2491
uaagugaguaaaaacaauuuuau

SEQ ID NO: 1381497 - RNA, 13 nt, Neisseria meningitidis Z2491
uaaguguuuucaa

SEQ ID NO: 1381498 - RNA, 18 nt, Neisseria meningitidis Z2491
uaaguuucccgaaauucc

SEQ ID NO: 1381499 - RNA, 13 nt, Neisseria meningitidis Z2491
uaaggcaauuuau

SEQ ID NO: 1381500 - RNA, 13 nt, Neisseria meningitidis Z2491
uaaggcaauuucu

SEQ ID NO: 1381501 - RNA, 14 nt, Neisseria meningitidis Z2491
uaaggcgagccaac

SEQ ID NO: 1381502 - RNA, 15 nt, Neisseria meningitidis Z2491
uaaggcgaggcaacg

SEQ ID NO: 1381503 - RNA, 21 nt, Neisseria meningitidis Z2491
uaagccgguauaaacaaaaua

SEQ ID NO: 1381504 - RNA, 19 nt, Neisseria meningitidis Z2491
uaagcaaucaucucuucua

SEQ ID NO: 1381505 - RNA, 21 nt, Neisseria meningitidis Z2491
uaaaucgguuccguacuaucu

SEQ ID NO: 1381506 - RNA, 15 nt, Neisseria meningitidis Z2491
uaaauuaaucuccuu

SEQ ID NO: 1381507 - RNA, 23 nt, Neisseria meningitidis Z2491
uaaauucucgucguuuuucauuu

SEQ ID NO: 1381508 - RNA, 19 nt, Neisseria meningitidis Z2491
uaaauucugaaacuuuaau

SEQ ID NO: 1381509 - RNA, 22 nt, Neisseria meningitidis Z2491
uaaauucuugccgcauuaaaau

SEQ ID NO: 1381510 - RNA, 23 nt, Neisseria meningitidis Z2491
uaaauuccuaaaacuuaaaauuu

SEQ ID NO: 1381511 - RNA, 17 nt, Neisseria meningitidis Z2491
uaaauuuuuaaaaccgu

SEQ ID NO: 1381512 - RNA, 18 nt, Neisseria meningitidis Z2491
uaaauuuugaaacucuaa

SEQ ID NO: 1381513 - RNA, 12 nt, Neisseria meningitidis Z2491
uaacaaaaacca

SEQ ID NO: 1381514 - RNA, 15 nt, Neisseria meningitidis Z2491
uaacaaaaaccagua

SEQ ID NO: 1381515 - RNA, 14 nt, Neisseria meningitidis Z2491
uaaccgaaaauaau

SEQ ID NO: 1381516 - RNA, 14 nt, Neisseria meningitidis Z2491
uaaccgaaaccuga

SEQ ID NO: 1381517 - RNA, 15 nt, Neisseria meningitidis Z2491
uaacgggauuucagc

SEQ ID NO: 1381518 - RNA, 22 nt, Neisseria meningitidis Z2491
uaaccagccccaagccuaucca

SEQ ID NO: 1381519 - RNA, 20 nt, Neisseria meningitidis Z2491
uaaccauacuucauuaaagu

SEQ ID NO: 1381520 - RNA, 15 nt, Neisseria meningitidis Z2491
uaaacucuuaaaaca

SEQ ID NO: 1381521 - RNA, 15 nt, Neisseria meningitidis Z2491
uaaacauuaucugac

SEQ ID NO: 1381522 - RNA, 23 nt, Neisseria meningitidis Z2491
uaaacauuaucugacaggaaauu

SEQ ID NO: 1381523 - RNA, 18 nt, Neisseria meningitidis Z2491
guuuuggcugaaaauaau

SEQ ID NO: 1381524 - RNA, 22 nt, Neisseria meningitidis Z2491
guuuuuaucuguucguuuuugg

SEQ ID NO: 1381525 - RNA, 14 nt, Neisseria meningitidis Z2491
guuuuucagagaaa

SEQ ID NO: 1381526 - RNA, 13 nt, Neisseria meningitidis Z2491
guuuuucaaagcc

SEQ ID NO: 1381527 - RNA, 13 nt, Neisseria meningitidis Z2491
guuuuuccacaaa

SEQ ID NO: 1381528 - RNA, 18 nt, Neisseria meningitidis Z2491
uaaagugcggugaaaucu

SEQ ID NO: 1381529 - RNA, 15 nt, Neisseria meningitidis Z2491
uaaaguuaauccacu

SEQ ID NO: 1381530 - RNA, 22 nt, Neisseria meningitidis Z2491
uaaaguccggcauaaauccuuc

SEQ ID NO: 1381531 - RNA, 17 nt, Neisseria meningitidis Z2491
gcugauguauucuucca

SEQ ID NO: 1381532 - RNA, 12 nt, Neisseria meningitidis Z2491
gcugauguugug

SEQ ID NO: 1381533 - RNA, 17 nt, Neisseria meningitidis Z2491
gcugcaaagcggcuggg

SEQ ID NO: 1381534 - RNA, 17 nt, Neisseria meningitidis Z2491
gcugacaaucggcucgc

SEQ ID NO: 1381535 - RNA, 10 nt, Neisseria meningitidis Z2491
gcugaaacuc

SEQ ID NO: 1381536 - RNA, 11 nt, Neisseria meningitidis Z2491
gcugaaacuca

SEQ ID NO: 1381537 - RNA, 13 nt, Neisseria meningitidis Z2491
gcugaaauagaaa

SEQ ID NO: 1381538 - RNA, 15 nt, Neisseria meningitidis Z2491
gcugcgcccaaagcg

SEQ ID NO: 1381539 - RNA, 15 nt, Neisseria meningitidis Z2491
gcugcgccuaugcaa

SEQ ID NO: 1381540 - RNA, 17 nt, Neisseria meningitidis Z2491
gcugccgcacaagcccu

SEQ ID NO: 1381541 - RNA, 14 nt, Neisseria meningitidis Z2491
gcugccgccccauu

SEQ ID NO: 1381542 - RNA, 13 nt, Neisseria meningitidis Z2491
gcugccggcagga

SEQ ID NO: 1381543 - RNA, 20 nt, Neisseria meningitidis Z2491
gcugccgucauugagcagca

SEQ ID NO: 1381544 - RNA, 16 nt, Neisseria meningitidis Z2491
gcucgccgccuugucc

SEQ ID NO: 1381545 - RNA, 15 nt, Neisseria meningitidis Z2491
gcucgcguauccagc

SEQ ID NO: 1381546 - RNA, 12 nt, Neisseria meningitidis Z2491
gcucgccacaua

SEQ ID NO: 1381547 - RNA, 19 nt, Neisseria meningitidis Z2491
gcucgagcggcaggucuuc

SEQ ID NO: 1381548 - RNA, 12 nt, Neisseria meningitidis Z2491
gcuccugacggc

SEQ ID NO: 1381549 - RNA, 16 nt, Neisseria meningitidis Z2491
gcuccauugucugaua

SEQ ID NO: 1381550 - RNA, 17 nt, Neisseria meningitidis Z2491
gcuuuaagcaaucaucu

SEQ ID NO: 1381551 - RNA, 20 nt, Neisseria meningitidis Z2491
gcuuuaccguuucagugcca

SEQ ID NO: 1381552 - RNA, 22 nt, Neisseria meningitidis Z2491
gcuuuccaguugggcuuugagu

SEQ ID NO: 1381553 - RNA, 14 nt, Neisseria meningitidis Z2491
aaaggccgucugaa

SEQ ID NO: 1381554 - RNA, 15 nt, Neisseria meningitidis Z2491
aaaggccgucugaaa

SEQ ID NO: 1381555 - RNA, 14 nt, Neisseria meningitidis Z2491
gcuugguuuugcuu

SEQ ID NO: 1381556 - RNA, 17 nt, Neisseria meningitidis Z2491
gcuugguuuugcuucca

SEQ ID NO: 1381557 - RNA, 18 nt, Neisseria meningitidis Z2491
aaaggcagugccgccaaa

SEQ ID NO: 1381558 - RNA, 22 nt, Neisseria meningitidis Z2491
aaaggcaaaugccgucugaaaa

SEQ ID NO: 1381559 - RNA, 12 nt, Neisseria meningitidis Z2491
aaaggcaauaac

SEQ ID NO: 1381560 - RNA, 19 nt, Neisseria meningitidis Z2491
gcuugaucugcaccccaaa

SEQ ID NO: 1381561 - RNA, 14 nt, Neisseria meningitidis Z2491
gcuugccgccgcca

SEQ ID NO: 1381562 - RNA, 18 nt, Neisseria meningitidis Z2491
gcuucgcacucugaaagc

SEQ ID NO: 1381563 - RNA, 13 nt, Neisseria meningitidis Z2491
gcuucgcgggcug

SEQ ID NO: 1381564 - RNA, 17 nt, Neisseria meningitidis Z2491
gcuucggauaaauuuuu

SEQ ID NO: 1381565 - RNA, 18 nt, Neisseria meningitidis Z2491
gcuucggauaaauuuuug

SEQ ID NO: 1381566 - RNA, 17 nt, Neisseria meningitidis Z2491
gcuucgucgccuugucc

SEQ ID NO: 1381567 - RNA, 16 nt, Neisseria meningitidis Z2491
gcuucgguuguauuuu

SEQ ID NO: 1381568 - RNA, 20 nt, Neisseria meningitidis Z2491
gcuucagcuaaccuuugaau

SEQ ID NO: 1381569 - RNA, 19 nt, Neisseria meningitidis Z2491
gcuucauaccccacugcca

SEQ ID NO: 1381570 - RNA, 14 nt, Neisseria meningitidis Z2491
gcuucaucuuuacu

SEQ ID NO: 1381571 - RNA, 19 nt, Neisseria meningitidis Z2491
gcuuccguguguauagugg

SEQ ID NO: 1381572 - RNA, 21 nt, Neisseria meningitidis Z2491
gcuuauggcgaacaaacaaca

SEQ ID NO: 1381573 - RNA, 21 nt, Neisseria meningitidis Z2491
gcuucaauaccuugagccaag

SEQ ID NO: 1381574 - RNA, 16 nt, Neisseria meningitidis Z2491
gcuucaaggcgguuuu

SEQ ID NO: 1381575 - RNA, 23 nt, Neisseria meningitidis Z2491
gcuucagcaccuuagagaaucgu

SEQ ID NO: 1381576 - RNA, 22 nt, Neisseria meningitidis Z2491
gcuuaucuaaaggaaugguuga

SEQ ID NO: 1381577 - RNA, 18 nt, Neisseria meningitidis Z2491
gcuuaccgaccaacugcu

SEQ ID NO: 1381578 - RNA, 21 nt, Neisseria meningitidis Z2491
gcuguuugcagggaccuuuaa

SEQ ID NO: 1381579 - RNA, 13 nt, Neisseria meningitidis Z2491
gcuguuugagccu

SEQ ID NO: 1381580 - RNA, 13 nt, Neisseria meningitidis Z2491
gcuguuuucuguu

SEQ ID NO: 1381581 - RNA, 17 nt, Neisseria meningitidis Z2491
gcuguuuuucaguuuaa

SEQ ID NO: 1381582 - RNA, 13 nt, Neisseria meningitidis Z2491
gcuguuuuuuguu

SEQ ID NO: 1381583 - RNA, 13 nt, Neisseria meningitidis Z2491
gcuuaaaaaacaa

SEQ ID NO: 1381584 - RNA, 17 nt, Neisseria meningitidis Z2491
gcuuaaaccuuauccau

SEQ ID NO: 1381585 - RNA, 17 nt, Neisseria meningitidis Z2491
gcuguaugccgucugaa

SEQ ID NO: 1381586 - RNA, 14 nt, Neisseria meningitidis Z2491
aaaggaaguuuugu

SEQ ID NO: 1381587 - RNA, 20 nt, Neisseria meningitidis Z2491
gcuggaugaucggagugauu

SEQ ID NO: 1381588 - RNA, 21 nt, Neisseria meningitidis Z2491
ggcauuggguuuucuguuccu

SEQ ID NO: 1381589 - RNA, 20 nt, Neisseria meningitidis Z2491
aaaguccggcauaaauccuu

SEQ ID NO: 1381590 - RNA, 17 nt, Neisseria meningitidis Z2491
aaagucauauuaauuau

SEQ ID NO: 1381591 - RNA, 22 nt, Neisseria meningitidis Z2491
aaagucauauuaauuauagugg

SEQ ID NO: 1381592 - RNA, 19 nt, Neisseria meningitidis Z2491
ggcagguaaaaaauagaaa

SEQ ID NO: 1381593 - RNA, 22 nt, Neisseria meningitidis Z2491
ggcaucgcgcacuugagccgca

SEQ ID NO: 1381594 - RNA, 17 nt, Neisseria meningitidis Z2491
ggcaguaaugccgccgc

SEQ ID NO: 1381595 - RNA, 20 nt, Neisseria meningitidis Z2491
ggcaggcagugcaugaauuu

SEQ ID NO: 1381596 - RNA, 13 nt, Neisseria meningitidis Z2491
aaaguaguuuccc

SEQ ID NO: 1381597 - RNA, 15 nt, Neisseria meningitidis Z2491
ggcaaggcgccggcg

SEQ ID NO: 1381598 - RNA, 23 nt, Neisseria meningitidis Z2491
ggcaagggugaaaaggugcggua

SEQ ID NO: 1381599 - RNA, 15 nt, Neisseria meningitidis Z2491
ggcaaguguccggca

SEQ ID NO: 1381600 - RNA, 17 nt, Neisseria meningitidis Z2491
ggcaaguguccggcagc

SEQ ID NO: 1381601 - RNA, 20 nt, Neisseria meningitidis Z2491
ggcagcaacgacagcagcag

SEQ ID NO: 1381602 - RNA, 21 nt, Neisseria meningitidis Z2491
ggcagcaacgacagcagcagc

SEQ ID NO: 1381603 - RNA, 17 nt, Neisseria meningitidis Z2491
ggcagagcgguuucugu

SEQ ID NO: 1381604 - RNA, 16 nt, Neisseria meningitidis Z2491
ggcagccugcucgagc

SEQ ID NO: 1381605 - RNA, 17 nt, Neisseria meningitidis Z2491
ggcagccugcucgagcg

SEQ ID NO: 1381606 - RNA, 15 nt, Neisseria meningitidis Z2491
ggccaguuuguucag

SEQ ID NO: 1381607 - RNA, 15 nt, Neisseria meningitidis Z2491
ggcaacacaaaugcc

SEQ ID NO: 1381608 - RNA, 20 nt, Neisseria meningitidis Z2491
ggauuuuugcccgauuuaaa

SEQ ID NO: 1381609 - RNA, 14 nt, Neisseria meningitidis Z2491
ggcaaaaaaaauaa

SEQ ID NO: 1381610 - RNA, 12 nt, Neisseria meningitidis Z2491
ggauuaacaaaa

SEQ ID NO: 1381611 - RNA, 23 nt, Neisseria meningitidis Z2491
ggauguuugccugauccaaaccg

SEQ ID NO: 1381612 - RNA, 20 nt, Neisseria meningitidis Z2491
ggauucccgcaaccuuucgu

SEQ ID NO: 1381613 - RNA, 17 nt, Neisseria meningitidis Z2491
ggauucccgccugcgcg

SEQ ID NO: 1381614 - RNA, 20 nt, Neisseria meningitidis Z2491
ggauucccacaaccuuucgu

SEQ ID NO: 1381615 - RNA, 19 nt, Neisseria meningitidis Z2491
ggauuccuacgaaaacagg

SEQ ID NO: 1381616 - RNA, 23 nt, Neisseria meningitidis Z2491
ggauuuguccaaauugacaggca

SEQ ID NO: 1381617 - RNA, 23 nt, Neisseria meningitidis Z2491
ggauggacagaaacgaaaaugcc

SEQ ID NO: 1381618 - RNA, 17 nt, Neisseria meningitidis Z2491
ggaugccgucugaaacg

SEQ ID NO: 1381619 - RNA, 21 nt, Neisseria meningitidis Z2491
ggaugccugcucaaauaggca

SEQ ID NO: 1381620 - RNA, 14 nt, Neisseria meningitidis Z2491
aaaguacaaaaugc

SEQ ID NO: 1381621 - RNA, 16 nt, Neisseria meningitidis Z2491
ggaucggagagacugu

SEQ ID NO: 1381622 - RNA, 12 nt, Neisseria meningitidis Z2491
ggauaaaacaga

SEQ ID NO: 1381623 - RNA, 22 nt, Neisseria meningitidis Z2491
ggauaaacauuaucugacagga

SEQ ID NO: 1381624 - RNA, 15 nt, Neisseria meningitidis Z2491
ggagcaugaguuccu

SEQ ID NO: 1381625 - RNA, 18 nt, Neisseria meningitidis Z2491
ggauauugccguuuuccu

SEQ ID NO: 1381626 - RNA, 23 nt, Neisseria meningitidis Z2491
ggagcaggcacaaggcggcggca

SEQ ID NO: 1381627 - RNA, 19 nt, Neisseria meningitidis Z2491
ggagcagaucgagggcgcg

SEQ ID NO: 1381628 - RNA, 21 nt, Neisseria meningitidis Z2491
ggagaaaauauagccgaccgc

SEQ ID NO: 1381629 - RNA, 21 nt, Neisseria meningitidis Z2491
ggagacauucgcguucggcuu

SEQ ID NO: 1381630 - RNA, 16 nt, Neisseria meningitidis Z2491
ggacgacaugcaagca

SEQ ID NO: 1381631 - RNA, 23 nt, Neisseria meningitidis Z2491
aaaggcuuacucguucggcagcc

SEQ ID NO: 1381632 - RNA, 18 nt, Neisseria meningitidis Z2491
aaaggcuuucagacggca

SEQ ID NO: 1381633 - RNA, 17 nt, Neisseria meningitidis Z2491
ggacagcgugaaaccuu

SEQ ID NO: 1381634 - RNA, 18 nt, Neisseria meningitidis Z2491
ggacagaaacgaaaaugc

SEQ ID NO: 1381635 - RNA, 17 nt, Neisseria meningitidis Z2491
ggacagcggcaauauuc

SEQ ID NO: 1381636 - RNA, 17 nt, Neisseria meningitidis Z2491
ggaaugaugggguuuuu

SEQ ID NO: 1381637 - RNA, 19 nt, Neisseria meningitidis Z2491
ggaaugcguuuucggguuc

SEQ ID NO: 1381638 - RNA, 16 nt, Neisseria meningitidis Z2491
ggaauaagucagcgug

SEQ ID NO: 1381639 - RNA, 21 nt, Neisseria meningitidis Z2491
ggaauuugcggcaaauuuaca

SEQ ID NO: 1381640 - RNA, 13 nt, Neisseria meningitidis Z2491
ggacaccagcgcg

SEQ ID NO: 1381641 - RNA, 14 nt, Neisseria meningitidis Z2491
ggaacaaaaaauau

SEQ ID NO: 1381642 - RNA, 17 nt, Neisseria meningitidis Z2491
ggaacacaaaaaacuuc

SEQ ID NO: 1381643 - RNA, 13 nt, Neisseria meningitidis Z2491
ggaacaaagaaag

SEQ ID NO: 1381644 - RNA, 13 nt, Neisseria meningitidis Z2491
ggucuucagcuug

SEQ ID NO: 1381645 - RNA, 14 nt, Neisseria meningitidis Z2491
ggucugucggugcg

SEQ ID NO: 1381646 - RNA, 16 nt, Neisseria meningitidis Z2491
ggucuucuuuggcuuu

SEQ ID NO: 1381647 - RNA, 19 nt, Neisseria meningitidis Z2491
ggucuuuucuaaaauaugc

SEQ ID NO: 1381648 - RNA, 19 nt, Neisseria meningitidis Z2491
ggugaaaaaugaaaaaugc

SEQ ID NO: 1381649 - RNA, 20 nt, Neisseria meningitidis Z2491
ggucucauugguaaacaguu

SEQ ID NO: 1381650 - RNA, 21 nt, Neisseria meningitidis Z2491
ggucgugcagccugcucggcc

SEQ ID NO: 1381651 - RNA, 13 nt, Neisseria meningitidis Z2491
ggucguggcaacu

SEQ ID NO: 1381652 - RNA, 15 nt, Neisseria meningitidis Z2491
ggucguguucuucau

SEQ ID NO: 1381653 - RNA, 15 nt, Neisseria meningitidis Z2491
ggucagcccggcggu

SEQ ID NO: 1381654 - RNA, 20 nt, Neisseria meningitidis Z2491
ggucaacucuuccauuugag

SEQ ID NO: 1381655 - RNA, 19 nt, Neisseria meningitidis Z2491
gguaugccaugucggguuc

SEQ ID NO: 1381656 - RNA, 19 nt, Neisseria meningitidis Z2491
gguaucugcauuauuuggg

SEQ ID NO: 1381657 - RNA, 18 nt, Neisseria meningitidis Z2491
gguaucgggcauaaaauu

SEQ ID NO: 1381658 - RNA, 20 nt, Neisseria meningitidis Z2491
gguaucgggcauaaaauuug

SEQ ID NO: 1381659 - RNA, 18 nt, Neisseria meningitidis Z2491
ggucaaaauauuaaucag

SEQ ID NO: 1381660 - RNA, 20 nt, Neisseria meningitidis Z2491
gguaucgccguuuugcagug

SEQ ID NO: 1381661 - RNA, 19 nt, Neisseria meningitidis Z2491
gguacccaaacuuccaaau

SEQ ID NO: 1381662 - RNA, 15 nt, Neisseria meningitidis Z2491
gguacgcccgcagcc

SEQ ID NO: 1381663 - RNA, 16 nt, Neisseria meningitidis Z2491
gguagagcgcaaccuu

SEQ ID NO: 1381664 - RNA, 18 nt, Neisseria meningitidis Z2491
gguagauggggaggcgcg

SEQ ID NO: 1381665 - RNA, 18 nt, Neisseria meningitidis Z2491
gguagccgccuuuauccc

SEQ ID NO: 1381666 - RNA, 18 nt, Neisseria meningitidis Z2491
ggguucagauguggugga

SEQ ID NO: 1381667 - RNA, 16 nt, Neisseria meningitidis Z2491
ggguuaagaaaaccug

SEQ ID NO: 1381668 - RNA, 18 nt, Neisseria meningitidis Z2491
gguaauccgaaucaacac

SEQ ID NO: 1381669 - RNA, 18 nt, Neisseria meningitidis Z2491
gguaacucuaaaccguca

SEQ ID NO: 1381670 - RNA, 13 nt, Neisseria meningitidis Z2491
gguaacaauaugc

SEQ ID NO: 1381671 - RNA, 18 nt, Neisseria meningitidis Z2491
ggguuuaucagaaaugac

SEQ ID NO: 1381672 - RNA, 14 nt, Neisseria meningitidis Z2491
gguaaaccgccagc

SEQ ID NO: 1381673 - RNA, 20 nt, Neisseria meningitidis Z2491
gggcguucagacggcauugu

SEQ ID NO: 1381674 - RNA, 19 nt, Neisseria meningitidis Z2491
gggcgcacuucaaguccga

SEQ ID NO: 1381675 - RNA, 17 nt, Neisseria meningitidis Z2491
gggcgacggcaauauuc

SEQ ID NO: 1381676 - RNA, 15 nt, Neisseria meningitidis Z2491
gggccuuuggcggcg

SEQ ID NO: 1381677 - RNA, 21 nt, Neisseria meningitidis Z2491
gggcauuaucaguauuuucua

SEQ ID NO: 1381678 - RNA, 20 nt, Neisseria meningitidis Z2491
gggguaauccaagccugcgg

SEQ ID NO: 1381679 - RNA, 14 nt, Neisseria meningitidis Z2491
ggggugcggguggc

SEQ ID NO: 1381680 - RNA, 11 nt, Neisseria meningitidis Z2491
ggguaaacagg

SEQ ID NO: 1381681 - RNA, 19 nt, Neisseria meningitidis Z2491
gggcugcggucgggcgcgu

SEQ ID NO: 1381682 - RNA, 21 nt, Neisseria meningitidis Z2491
gggcugcgucgcgggcggggu

SEQ ID NO: 1381683 - RNA, 10 nt, Neisseria meningitidis Z2491
gggcuuugag

SEQ ID NO: 1381684 - RNA, 21 nt, Neisseria meningitidis Z2491
ggggaguccuuauugggaaau

SEQ ID NO: 1381685 - RNA, 23 nt, Neisseria meningitidis Z2491
ggggcaaguguccggcagccugc

SEQ ID NO: 1381686 - RNA, 23 nt, Neisseria meningitidis Z2491
ggggcgggacaauacggggguga

SEQ ID NO: 1381687 - RNA, 18 nt, Neisseria meningitidis Z2491
ggggcgguuugcggcggc

SEQ ID NO: 1381688 - RNA, 16 nt, Neisseria meningitidis Z2491
gggacuuugcggcugu

SEQ ID NO: 1381689 - RNA, 13 nt, Neisseria meningitidis Z2491
gggacggccgcgg

SEQ ID NO: 1381690 - RNA, 15 nt, Neisseria meningitidis Z2491
gggaauagcucaguu

SEQ ID NO: 1381691 - RNA, 17 nt, Neisseria meningitidis Z2491
gggaauccgggauuuua

SEQ ID NO: 1381692 - RNA, 16 nt, Neisseria meningitidis Z2491
gggaaucuagaaacuc

SEQ ID NO: 1381693 - RNA, 21 nt, Neisseria meningitidis Z2491
gggaaucuagaaaugaaaaac

SEQ ID NO: 1381694 - RNA, 15 nt, Neisseria meningitidis Z2491
gggaaucuagaaucu

SEQ ID NO: 1381695 - RNA, 13 nt, Neisseria meningitidis Z2491
gggaaucuaggac

SEQ ID NO: 1381696 - RNA, 15 nt, Neisseria meningitidis Z2491
gggaaugacgaaucc

SEQ ID NO: 1381697 - RNA, 19 nt, Neisseria meningitidis Z2491
gggaaugacggaauguagg

SEQ ID NO: 1381698 - RNA, 13 nt, Neisseria meningitidis Z2491
gggaaugacggag

SEQ ID NO: 1381699 - RNA, 19 nt, Neisseria meningitidis Z2491
gggaaugacgggaugcagg

SEQ ID NO: 1381700 - RNA, 16 nt, Neisseria meningitidis Z2491
gggaaugacugaaacu

SEQ ID NO: 1381701 - RNA, 20 nt, Neisseria meningitidis Z2491
gggaaugacugaaacucaaa

SEQ ID NO: 1381702 - RNA, 20 nt, Neisseria meningitidis Z2491
gggaauguauuagaaaugac

SEQ ID NO: 1381703 - RNA, 18 nt, Neisseria meningitidis Z2491
gggaaaaauagaaucuuu

SEQ ID NO: 1381704 - RNA, 12 nt, Neisseria meningitidis Z2491
ggcuuuuuucug

SEQ ID NO: 1381705 - RNA, 20 nt, Neisseria meningitidis Z2491
ggcuuugcccgcgaaauaaa

SEQ ID NO: 1381706 - RNA, 19 nt, Neisseria meningitidis Z2491
ggcuuugugcacucacuuu

SEQ ID NO: 1381707 - RNA, 18 nt, Neisseria meningitidis Z2491
gggaagaugggcaaaucc

SEQ ID NO: 1381708 - RNA, 15 nt, Neisseria meningitidis Z2491
gggaaggcggggcgg

SEQ ID NO: 1381709 - RNA, 16 nt, Neisseria meningitidis Z2491
gggaaagcagacgacu

SEQ ID NO: 1381710 - RNA, 13 nt, Neisseria meningitidis Z2491
gggaaagcagcag

SEQ ID NO: 1381711 - RNA, 17 nt, Neisseria meningitidis Z2491
gggaaagcagcagcccu

SEQ ID NO: 1381712 - RNA, 20 nt, Neisseria meningitidis Z2491
gggauagaaugugggcgcgc

SEQ ID NO: 1381713 - RNA, 12 nt, Neisseria meningitidis Z2491
gggagggaaagg

SEQ ID NO: 1381714 - RNA, 15 nt, Neisseria meningitidis Z2491
gggcaaaagccagcg

SEQ ID NO: 1381715 - RNA, 17 nt, Neisseria meningitidis Z2491
gggauuuuucaaaugca

SEQ ID NO: 1381716 - RNA, 17 nt, Neisseria meningitidis Z2491
gggcaacggcaauauuc

SEQ ID NO: 1381717 - RNA, 17 nt, Neisseria meningitidis Z2491
gggcaacacgcccaagc

SEQ ID NO: 1381718 - RNA, 14 nt, Neisseria meningitidis Z2491
gggcaggcggcugc

SEQ ID NO: 1381719 - RNA, 11 nt, Neisseria meningitidis Z2491
gggcaggcuga

SEQ ID NO: 1381720 - RNA, 20 nt, Neisseria meningitidis Z2491
ggcugcgucgcgggcggggu

SEQ ID NO: 1381721 - RNA, 22 nt, Neisseria meningitidis Z2491
ggcugcuuuggcagcacaggca

SEQ ID NO: 1381722 - RNA, 18 nt, Neisseria meningitidis Z2491
ggcuguaugccgucugaa

SEQ ID NO: 1381723 - RNA, 21 nt, Neisseria meningitidis Z2491
ggcuguaugccgucugaaacc

SEQ ID NO: 1381724 - RNA, 18 nt, Neisseria meningitidis Z2491
ggcuucaauauacucaau

SEQ ID NO: 1381725 - RNA, 18 nt, Neisseria meningitidis Z2491
ggcuugguuuugcuucca

SEQ ID NO: 1381726 - RNA, 19 nt, Neisseria meningitidis Z2491
ggcucguuuaauuaaaacu

SEQ ID NO: 1381727 - RNA, 13 nt, Neisseria meningitidis Z2491
ggcucugauauuc

SEQ ID NO: 1381728 - RNA, 18 nt, Neisseria meningitidis Z2491
ggcuccuccgucaaaaca

SEQ ID NO: 1381729 - RNA, 14 nt, Neisseria meningitidis Z2491
ggcguauauggcug

SEQ ID NO: 1381730 - RNA, 16 nt, Neisseria meningitidis Z2491
ggcguaggcggcggcg

SEQ ID NO: 1381731 - RNA, 18 nt, Neisseria meningitidis Z2491
ggcugaaucgccaaugcu

SEQ ID NO: 1381732 - RNA, 12 nt, Neisseria meningitidis Z2491
ggcugaaauaga

SEQ ID NO: 1381733 - RNA, 13 nt, Neisseria meningitidis Z2491
ggcugaaaauaau

SEQ ID NO: 1381734 - RNA, 14 nt, Neisseria meningitidis Z2491
ggcugagggcuucu

SEQ ID NO: 1381735 - RNA, 16 nt, Neisseria meningitidis Z2491
ggcugccgaccgcgca

SEQ ID NO: 1381736 - RNA, 19 nt, Neisseria meningitidis Z2491
ggcgagccaauagccgccg

SEQ ID NO: 1381737 - RNA, 22 nt, Neisseria meningitidis Z2491
ggcgacgguggugcguuugugu

SEQ ID NO: 1381738 - RNA, 15 nt, Neisseria meningitidis Z2491
ggcgacguauuugcc

SEQ ID NO: 1381739 - RNA, 14 nt, Neisseria meningitidis Z2491
ggccuuuuugcuuu

SEQ ID NO: 1381740 - RNA, 18 nt, Neisseria meningitidis Z2491
ggcgacagccgcucgcgu

SEQ ID NO: 1381741 - RNA, 24 nt, Neisseria meningitidis Z2491
ggcgacagccgcucgcguauccag

SEQ ID NO: 1381742 - RNA, 19 nt, Neisseria meningitidis Z2491
aaauaauugccuuuucccu

SEQ ID NO: 1381743 - RNA, 19 nt, Neisseria meningitidis Z2491
aaauaauugucuuuucccu

SEQ ID NO: 1381744 - RNA, 15 nt, Neisseria meningitidis Z2491
aaauaauugaaauca

SEQ ID NO: 1381745 - RNA, 17 nt, Neisseria meningitidis Z2491
aaauaagcgguuuuccc

SEQ ID NO: 1381746 - RNA, 14 nt, Neisseria meningitidis Z2491
aaauacauccuaaa

SEQ ID NO: 1381747 - RNA, 22 nt, Neisseria meningitidis Z2491
aaauacccaaaugcagaauaag

SEQ ID NO: 1381748 - RNA, 16 nt, Neisseria meningitidis Z2491
ggcgggaauagcucag

SEQ ID NO: 1381749 - RNA, 18 nt, Neisseria meningitidis Z2491
ggcgggcaggcggcugcg

SEQ ID NO: 1381750 - RNA, 19 nt, Neisseria meningitidis Z2491
ggcgggaauuugucgggaa

SEQ ID NO: 1381751 - RNA, 19 nt, Neisseria meningitidis Z2491
ggcggauuucuccgucggg

SEQ ID NO: 1381752 - RNA, 20 nt, Neisseria meningitidis Z2491
ggcggcaaauuccgucagca

SEQ ID NO: 1381753 - RNA, 12 nt, Neisseria meningitidis Z2491
ggcggacgcauc

SEQ ID NO: 1381754 - RNA, 13 nt, Neisseria meningitidis Z2491
ggcggagcgguuu

SEQ ID NO: 1381755 - RNA, 13 nt, Neisseria meningitidis Z2491
ggcggcaucccac

SEQ ID NO: 1381756 - RNA, 17 nt, Neisseria meningitidis Z2491
ggcggccugguugaugu

SEQ ID NO: 1381757 - RNA, 14 nt, Neisseria meningitidis Z2491
ggcgcggcgcggcg

SEQ ID NO: 1381758 - RNA, 16 nt, Neisseria meningitidis Z2491
ggcgcgccgcuguauu

SEQ ID NO: 1381759 - RNA, 14 nt, Neisseria meningitidis Z2491
aaauagaaaaccga

SEQ ID NO: 1381760 - RNA, 23 nt, Neisseria meningitidis Z2491
aaauagaaaaccgaaacagaaac

SEQ ID NO: 1381761 - RNA, 19 nt, Neisseria meningitidis Z2491
aaauagaaaauacugauaa

SEQ ID NO: 1381762 - RNA, 20 nt, Neisseria meningitidis Z2491
aaauaccgccuaauucuacc

SEQ ID NO: 1381763 - RNA, 17 nt, Neisseria meningitidis Z2491
aaauaccuccuaauucu

SEQ ID NO: 1381764 - RNA, 15 nt, Neisseria meningitidis Z2491
aaauacgcguaagcg

SEQ ID NO: 1381765 - RNA, 19 nt, Neisseria meningitidis Z2491
ggcgcgaacggagccagcc

SEQ ID NO: 1381766 - RNA, 22 nt, Neisseria meningitidis Z2491
ggcgcgaacggagccagcccgc

SEQ ID NO: 1381767 - RNA, 17 nt, Neisseria meningitidis Z2491
gccuucuacuucgaugu

SEQ ID NO: 1381768 - RNA, 15 nt, Neisseria meningitidis Z2491
gccuuuggcggcggc

SEQ ID NO: 1381769 - RNA, 16 nt, Neisseria meningitidis Z2491
gccuuucaacaaucug

SEQ ID NO: 1381770 - RNA, 17 nt, Neisseria meningitidis Z2491
gcgaacagaaggggcgg

SEQ ID NO: 1381771 - RNA, 14 nt, Neisseria meningitidis Z2491
gccuuauguauagu

SEQ ID NO: 1381772 - RNA, 14 nt, Neisseria meningitidis Z2491
gccuuaaaaaacaa

SEQ ID NO: 1381773 - RNA, 15 nt, Neisseria meningitidis Z2491
gccuuaaaaaacaaa

SEQ ID NO: 1381774 - RNA, 19 nt, Neisseria meningitidis Z2491
gccuuaacagggaaagcag

SEQ ID NO: 1381775 - RNA, 22 nt, Neisseria meningitidis Z2491
gccuuaacagggaaagcagcag

SEQ ID NO: 1381776 - RNA, 15 nt, Neisseria meningitidis Z2491
gccugccgaccccga

SEQ ID NO: 1381777 - RNA, 15 nt, Neisseria meningitidis Z2491
gccugccgcugauga

SEQ ID NO: 1381778 - RNA, 16 nt, Neisseria meningitidis Z2491
gccucugccagcuccg

SEQ ID NO: 1381779 - RNA, 15 nt, Neisseria meningitidis Z2491
gccucuucgcgcgcu

SEQ ID NO: 1381780 - RNA, 23 nt, Neisseria meningitidis Z2491
gccucuauuuaaaaauuccuguu

SEQ ID NO: 1381781 - RNA, 23 nt, Neisseria meningitidis Z2491
gccuaggggcgguuugcggcggc

SEQ ID NO: 1381782 - RNA, 20 nt, Neisseria meningitidis Z2491
gccuccacggugugcaggcu

SEQ ID NO: 1381783 - RNA, 14 nt, Neisseria meningitidis Z2491
gccuccgacugcuc

SEQ ID NO: 1381784 - RNA, 23 nt, Neisseria meningitidis Z2491
gccgugaugccccaauaccaaca

SEQ ID NO: 1381785 - RNA, 20 nt, Neisseria meningitidis Z2491
gccguguuucaaggcggcgg

SEQ ID NO: 1381786 - RNA, 21 nt, Neisseria meningitidis Z2491
gccguguuucaaggcggcggc

SEQ ID NO: 1381787 - RNA, 22 nt, Neisseria meningitidis Z2491
gccguguuucaaggcggcggcg

SEQ ID NO: 1381788 - RNA, 20 nt, Neisseria meningitidis Z2491
gccguguuggguucuagauu

SEQ ID NO: 1381789 - RNA, 13 nt, Neisseria meningitidis Z2491
gccguuucagacg

SEQ ID NO: 1381790 - RNA, 15 nt, Neisseria meningitidis Z2491
gccgucugauauagu

SEQ ID NO: 1381791 - RNA, 23 nt, Neisseria meningitidis Z2491
gccgucugaaggcuucagacggc

SEQ ID NO: 1381792 - RNA, 16 nt, Neisseria meningitidis Z2491
gccgucugaaggcuug

SEQ ID NO: 1381793 - RNA, 14 nt, Neisseria meningitidis Z2491
gccgucaaucagcu

SEQ ID NO: 1381794 - RNA, 19 nt, Neisseria meningitidis Z2491
gccggaaauaccgacggcg

SEQ ID NO: 1381795 - RNA, 15 nt, Neisseria meningitidis Z2491
gcgccaaaaaauuuu

SEQ ID NO: 1381796 - RNA, 12 nt, Neisseria meningitidis Z2491
gcgccaauuccu

SEQ ID NO: 1381797 - RNA, 20 nt, Neisseria meningitidis Z2491
gcgccagcggcaccaauucu

SEQ ID NO: 1381798 - RNA, 18 nt, Neisseria meningitidis Z2491
gcgccaccgacauuucau

SEQ ID NO: 1381799 - RNA, 14 nt, Neisseria meningitidis Z2491
gcgcagccugcagc

SEQ ID NO: 1381800 - RNA, 14 nt, Neisseria meningitidis Z2491
gcgcaggcgguggc

SEQ ID NO: 1381801 - RNA, 17 nt, Neisseria meningitidis Z2491
gcgcaguuaccgcccau

SEQ ID NO: 1381802 - RNA, 14 nt, Neisseria meningitidis Z2491
gcgcaauuccugca

SEQ ID NO: 1381803 - RNA, 23 nt, Neisseria meningitidis Z2491
gcgcaaccuugccaagguugagg

SEQ ID NO: 1381804 - RNA, 22 nt, Neisseria meningitidis Z2491
gcgcaaucgaaaaagccgccgg

SEQ ID NO: 1381805 - RNA, 15 nt, Neisseria meningitidis Z2491
gcgaugcgccuugcc

SEQ ID NO: 1381806 - RNA, 16 nt, Neisseria meningitidis Z2491
gcgaguucgagacucg

SEQ ID NO: 1381807 - RNA, 17 nt, Neisseria meningitidis Z2491
gcgauaggauuugccau

SEQ ID NO: 1381808 - RNA, 20 nt, Neisseria meningitidis Z2491
gcgaaggcgaccgccugcgc

SEQ ID NO: 1381809 - RNA, 18 nt, Neisseria meningitidis Z2491
gcgagccaauagccgccg

SEQ ID NO: 1381810 - RNA, 14 nt, Neisseria meningitidis Z2491
gcgagaacagaaaa

SEQ ID NO: 1381811 - RNA, 16 nt, Neisseria meningitidis Z2491
gcgagaauaaugaaaa

SEQ ID NO: 1381812 - RNA, 20 nt, Neisseria meningitidis Z2491
gcgcccacgcccucggcggc

SEQ ID NO: 1381813 - RNA, 22 nt, Neisseria meningitidis Z2491
gcgccaucaacauuugcgcagc

SEQ ID NO: 1381814 - RNA, 18 nt, Neisseria meningitidis Z2491
gcgccgcacacgggacgg

SEQ ID NO: 1381815 - RNA, 11 nt, Neisseria meningitidis Z2491
gcgccgcccga

SEQ ID NO: 1381816 - RNA, 12 nt, Neisseria meningitidis Z2491
gcgccgcgcgcc

SEQ ID NO: 1381817 - RNA, 15 nt, Neisseria meningitidis Z2491
gcgccgccgguggcg

SEQ ID NO: 1381818 - RNA, 15 nt, Neisseria meningitidis Z2491
gcgccugcuuccgag

SEQ ID NO: 1381819 - RNA, 14 nt, Neisseria meningitidis Z2491
gcgcgacggcggca

SEQ ID NO: 1381820 - RNA, 18 nt, Neisseria meningitidis Z2491
gcgcgacggcggcagggu

SEQ ID NO: 1381821 - RNA, 14 nt, Neisseria meningitidis Z2491
gcggcgguuuccug

SEQ ID NO: 1381822 - RNA, 16 nt, Neisseria meningitidis Z2491
gcggcgguuuccugca

SEQ ID NO: 1381823 - RNA, 18 nt, Neisseria meningitidis Z2491
gcggcgggacgcgcgcca

SEQ ID NO: 1381824 - RNA, 14 nt, Neisseria meningitidis Z2491
gcggcgggcggcuc

SEQ ID NO: 1381825 - RNA, 15 nt, Neisseria meningitidis Z2491
gcggcgcggcgggcg

SEQ ID NO: 1381826 - RNA, 15 nt, Neisseria meningitidis Z2491
gcgggcguuccacaa

SEQ ID NO: 1381827 - RNA, 13 nt, Neisseria meningitidis Z2491
gcgggcuauaggg

SEQ ID NO: 1381828 - RNA, 20 nt, Neisseria meningitidis Z2491
gcgggcggugcgcggcagcu

SEQ ID NO: 1381829 - RNA, 15 nt, Neisseria meningitidis Z2491
gcggggauucugucc

SEQ ID NO: 1381830 - RNA, 17 nt, Neisseria meningitidis Z2491
gcgggcuuggaaaucuu

SEQ ID NO: 1381831 - RNA, 18 nt, Neisseria meningitidis Z2491
gcgggaacuugauucaag

SEQ ID NO: 1381832 - RNA, 16 nt, Neisseria meningitidis Z2491
gcgggaagccagggcg

SEQ ID NO: 1381833 - RNA, 16 nt, Neisseria meningitidis Z2491
gcggcuugggcgacgg

SEQ ID NO: 1381834 - RNA, 15 nt, Neisseria meningitidis Z2491
gcggcuugccgccgc

SEQ ID NO: 1381835 - RNA, 18 nt, Neisseria meningitidis Z2491
gcggcugccgaccgcgca

SEQ ID NO: 1381836 - RNA, 18 nt, Neisseria meningitidis Z2491
gcgggccuuuggcggcgg

SEQ ID NO: 1381837 - RNA, 19 nt, Neisseria meningitidis Z2491
gcgggccuuuggcggcggc

SEQ ID NO: 1381838 - RNA, 14 nt, Neisseria meningitidis Z2491
gcgggaauagcuca

SEQ ID NO: 1381839 - RNA, 13 nt, Neisseria meningitidis Z2491
gcgggaauccaga

SEQ ID NO: 1381840 - RNA, 21 nt, Neisseria meningitidis Z2491
gcgggaauccagacauucaau

SEQ ID NO: 1381841 - RNA, 13 nt, Neisseria meningitidis Z2491
gcgggaauccagu

SEQ ID NO: 1381842 - RNA, 20 nt, Neisseria meningitidis Z2491
gcgggaauccggaaacgaaa

SEQ ID NO: 1381843 - RNA, 19 nt, Neisseria meningitidis Z2491
gcgggaaucuagaaaugaa

SEQ ID NO: 1381844 - RNA, 21 nt, Neisseria meningitidis Z2491
gcgggaaucuagacauucaau

SEQ ID NO: 1381845 - RNA, 17 nt, Neisseria meningitidis Z2491
gcgggaaucuagaccuu

SEQ ID NO: 1381846 - RNA, 11 nt, Neisseria meningitidis Z2491
gcgggaaugac

SEQ ID NO: 1381847 - RNA, 20 nt, Neisseria meningitidis Z2491
gcgggaaugacgaauccauc

SEQ ID NO: 1381848 - RNA, 13 nt, Neisseria meningitidis Z2491
gcggacggcggca

SEQ ID NO: 1381849 - RNA, 21 nt, Neisseria meningitidis Z2491
gcggauuguucggaucggcag

SEQ ID NO: 1381850 - RNA, 22 nt, Neisseria meningitidis Z2491
gcggaaacuuaucggguaaaac

SEQ ID NO: 1381851 - RNA, 13 nt, Neisseria meningitidis Z2491
gcggaaaccugca

SEQ ID NO: 1381852 - RNA, 11 nt, Neisseria meningitidis Z2491
gcgcugcucgg

SEQ ID NO: 1381853 - RNA, 12 nt, Neisseria meningitidis Z2491
gcgcugcucggc

SEQ ID NO: 1381854 - RNA, 19 nt, Neisseria meningitidis Z2491
gcagguuuuguuuuuccaa

SEQ ID NO: 1381855 - RNA, 16 nt, Neisseria meningitidis Z2491
gcagguuguuggaaaa

SEQ ID NO: 1381856 - RNA, 15 nt, Neisseria meningitidis Z2491
gcaguaacuucaaac

SEQ ID NO: 1381857 - RNA, 18 nt, Neisseria meningitidis Z2491
gcaguaacuucaaacccc

SEQ ID NO: 1381858 - RNA, 14 nt, Neisseria meningitidis Z2491
gcagggucauggcu

SEQ ID NO: 1381859 - RNA, 15 nt, Neisseria meningitidis Z2491
gcaguugaaaucaac

SEQ ID NO: 1381860 - RNA, 16 nt, Neisseria meningitidis Z2491
gcauaaaucaacagca

SEQ ID NO: 1381861 - RNA, 17 nt, Neisseria meningitidis Z2491
gcauaaauccuucacca

SEQ ID NO: 1381862 - RNA, 13 nt, Neisseria meningitidis Z2491
gcauaaaauuuua

SEQ ID NO: 1381863 - RNA, 14 nt, Neisseria meningitidis Z2491
gcagugggauuuug

SEQ ID NO: 1381864 - RNA, 18 nt, Neisseria meningitidis Z2491
gcaggcguuuuucagacg

SEQ ID NO: 1381865 - RNA, 20 nt, Neisseria meningitidis Z2491
gcaggauaaguguuuucaag

SEQ ID NO: 1381866 - RNA, 16 nt, Neisseria meningitidis Z2491
gcagcuucgucgccuu

SEQ ID NO: 1381867 - RNA, 22 nt, Neisseria meningitidis Z2491
gcagcugcucagacuaucggua

SEQ ID NO: 1381868 - RNA, 16 nt, Neisseria meningitidis Z2491
gcagcuccgaaccgaa

SEQ ID NO: 1381869 - RNA, 16 nt, Neisseria meningitidis Z2491
gcaucgaccaguuuga

SEQ ID NO: 1381870 - RNA, 19 nt, Neisseria meningitidis Z2491
gcaucgucgggaaaaauau

SEQ ID NO: 1381871 - RNA, 16 nt, Neisseria meningitidis Z2491
gcaucgcaucggcaac

SEQ ID NO: 1381872 - RNA, 14 nt, Neisseria meningitidis Z2491
gcaucaguauuuua

SEQ ID NO: 1381873 - RNA, 15 nt, Neisseria meningitidis Z2491
gcaucauauugguuc

SEQ ID NO: 1381874 - RNA, 16 nt, Neisseria meningitidis Z2491
gcauauuccggugcga

SEQ ID NO: 1381875 - RNA, 22 nt, Neisseria meningitidis Z2491
gcaucaaaaugacacaaagccu

SEQ ID NO: 1381876 - RNA, 19 nt, Neisseria meningitidis Z2491
gcauaugccauuacauucu

SEQ ID NO: 1381877 - RNA, 14 nt, Neisseria meningitidis Z2491
gcauaauaaaaaua

SEQ ID NO: 1381878 - RNA, 17 nt, Neisseria meningitidis Z2491
gcauaaucaauuaaaaa

SEQ ID NO: 1381879 - RNA, 20 nt, Neisseria meningitidis Z2491
gcauaaucaauuaaaaacaa

SEQ ID NO: 1381880 - RNA, 21 nt, Neisseria meningitidis Z2491
gcauaaucaauuaaaaacaaa

SEQ ID NO: 1381881 - RNA, 12 nt, Neisseria meningitidis Z2491
gcaugauuaucg

SEQ ID NO: 1381882 - RNA, 12 nt, Neisseria meningitidis Z2491
gcauuucuuaug

SEQ ID NO: 1381883 - RNA, 21 nt, Neisseria meningitidis Z2491
gcauuuccacaucguucaaac

SEQ ID NO: 1381884 - RNA, 22 nt, Neisseria meningitidis Z2491
gcauuuaucggauaaaacagaa

SEQ ID NO: 1381885 - RNA, 22 nt, Neisseria meningitidis Z2491
gcauuuaucgggagcaacugaa

SEQ ID NO: 1381886 - RNA, 17 nt, Neisseria meningitidis Z2491
gccagccccaccauugu

SEQ ID NO: 1381887 - RNA, 13 nt, Neisseria meningitidis Z2491
gccagccugccca

SEQ ID NO: 1381888 - RNA, 21 nt, Neisseria meningitidis Z2491
gccacgccaaaaaugcggccg

SEQ ID NO: 1381889 - RNA, 21 nt, Neisseria meningitidis Z2491
gccaccagcgguacauccaau

SEQ ID NO: 1381890 - RNA, 17 nt, Neisseria meningitidis Z2491
gccagcaacauuuccug

SEQ ID NO: 1381891 - RNA, 19 nt, Neisseria meningitidis Z2491
gccagaggcggaaucgaac

SEQ ID NO: 1381892 - RNA, 18 nt, Neisseria meningitidis Z2491
gccagcaaucagggccuu

SEQ ID NO: 1381893 - RNA, 17 nt, Neisseria meningitidis Z2491
gccagcacaaacagcau

SEQ ID NO: 1381894 - RNA, 17 nt, Neisseria meningitidis Z2491
gccagagagccgcaggc

SEQ ID NO: 1381895 - RNA, 14 nt, Neisseria meningitidis Z2491
gccgccuuguccug

SEQ ID NO: 1381896 - RNA, 17 nt, Neisseria meningitidis Z2491
gccgcgccgauguccug

SEQ ID NO: 1381897 - RNA, 20 nt, Neisseria meningitidis Z2491
gccgcgauuccggcgcggcg

SEQ ID NO: 1381898 - RNA, 21 nt, Neisseria meningitidis Z2491
gccgcgauuccggcgcggcgc

SEQ ID NO: 1381899 - RNA, 12 nt, Neisseria meningitidis Z2491
gccgccgcccgg

SEQ ID NO: 1381900 - RNA, 14 nt, Neisseria meningitidis Z2491
gccgccgcccgggc

SEQ ID NO: 1381901 - RNA, 18 nt, Neisseria meningitidis Z2491
gccgcccgcccggcagga

SEQ ID NO: 1381902 - RNA, 24 nt, Neisseria meningitidis Z2491
aaagcugcaagaauuuaucaaaaa

SEQ ID NO: 1381903 - RNA, 23 nt, Neisseria meningitidis Z2491
gccgcucgcguauccagccgcca

SEQ ID NO: 1381904 - RNA, 17 nt, Neisseria meningitidis Z2491
gccgcuguauuugcgcc

SEQ ID NO: 1381905 - RNA, 14 nt, Neisseria meningitidis Z2491
gccgaauugcagcg

SEQ ID NO: 1381906 - RNA, 12 nt, Neisseria meningitidis Z2491
gccgacaaaacc

SEQ ID NO: 1381907 - RNA, 19 nt, Neisseria meningitidis Z2491
gccgacuuugccguauuuc

SEQ ID NO: 1381908 - RNA, 15 nt, Neisseria meningitidis Z2491
gccgacuuuuuccag

SEQ ID NO: 1381909 - RNA, 18 nt, Neisseria meningitidis Z2491
gccgacuucgauugccaa

SEQ ID NO: 1381910 - RNA, 13 nt, Neisseria meningitidis Z2491
gccgaccgccaua

SEQ ID NO: 1381911 - RNA, 17 nt, Neisseria meningitidis Z2491
gcccugccgcuucacac

SEQ ID NO: 1381912 - RNA, 14 nt, Neisseria meningitidis Z2491
gccgaaacccaaac

SEQ ID NO: 1381913 - RNA, 15 nt, Neisseria meningitidis Z2491
gccgcauugucccug

SEQ ID NO: 1381914 - RNA, 21 nt, Neisseria meningitidis Z2491
gccgcauuaaaauucuagauu

SEQ ID NO: 1381915 - RNA, 20 nt, Neisseria meningitidis Z2491
gccgauuuuggguuucuguu

SEQ ID NO: 1381916 - RNA, 14 nt, Neisseria meningitidis Z2491
gccgcaaaccgggc

SEQ ID NO: 1381917 - RNA, 21 nt, Neisseria meningitidis Z2491
gccgcagcaaaauauggcuga

SEQ ID NO: 1381918 - RNA, 17 nt, Neisseria meningitidis Z2491
gccgagcaggugcuggg

SEQ ID NO: 1381919 - RNA, 23 nt, Neisseria meningitidis Z2491
gccgagcagcagucccaucccgc

SEQ ID NO: 1381920 - RNA, 15 nt, Neisseria meningitidis Z2491
gccgauauagagucc

SEQ ID NO: 1381921 - RNA, 14 nt, Neisseria meningitidis Z2491
gccaggcguauaug

SEQ ID NO: 1381922 - RNA, 16 nt, Neisseria meningitidis Z2491
gcccacaaucugaaac

SEQ ID NO: 1381923 - RNA, 14 nt, Neisseria meningitidis Z2491
gccauuacauucuc

SEQ ID NO: 1381924 - RNA, 15 nt, Neisseria meningitidis Z2491
gcccacgcccucggc

SEQ ID NO: 1381925 - RNA, 19 nt, Neisseria meningitidis Z2491
gcccacgcccucggcggcg

SEQ ID NO: 1381926 - RNA, 15 nt, Neisseria meningitidis Z2491
gcccauucugccggu

SEQ ID NO: 1381927 - RNA, 12 nt, Neisseria meningitidis Z2491
gccccggcuggu

SEQ ID NO: 1381928 - RNA, 21 nt, Neisseria meningitidis Z2491
gccccguuuuacccucucccc

SEQ ID NO: 1381929 - RNA, 21 nt, Neisseria meningitidis Z2491
gcccgagauuacagaaaccua

SEQ ID NO: 1381930 - RNA, 20 nt, Neisseria meningitidis Z2491
gcccggaaaggcaaacccga

SEQ ID NO: 1381931 - RNA, 23 nt, Neisseria meningitidis Z2491
gcaacccugucgccgucauuccc

SEQ ID NO: 1381932 - RNA, 22 nt, Neisseria meningitidis Z2491
gcaacccuaaaaacuaaaugcc

SEQ ID NO: 1381933 - RNA, 14 nt, Neisseria meningitidis Z2491
gcaacaucauagaa

SEQ ID NO: 1381934 - RNA, 14 nt, Neisseria meningitidis Z2491
gcaaccaaaaccga

SEQ ID NO: 1381935 - RNA, 17 nt, Neisseria meningitidis Z2491
gcaaccaacgaaacacu

SEQ ID NO: 1381936 - RNA, 22 nt, Neisseria meningitidis Z2491
gcaaauacuucguauuccgaca

SEQ ID NO: 1381937 - RNA, 19 nt, Neisseria meningitidis Z2491
gcaaauaauugaaaucaac

SEQ ID NO: 1381938 - RNA, 10 nt, Neisseria meningitidis Z2491
gcaaauaauu

SEQ ID NO: 1381939 - RNA, 15 nt, Neisseria meningitidis Z2491
gcaaagucauauuaa

SEQ ID NO: 1381940 - RNA, 16 nt, Neisseria meningitidis Z2491
gcaaaugccgucugaa

SEQ ID NO: 1381941 - RNA, 23 nt, Neisseria meningitidis Z2491
gcaaaugaugggcugaaauagaa

SEQ ID NO: 1381942 - RNA, 21 nt, Neisseria meningitidis Z2491
gcaaaugcacgguuacacaaa

SEQ ID NO: 1381943 - RNA, 17 nt, Neisseria meningitidis Z2491
gcaaaucggcuucagac

SEQ ID NO: 1381944 - RNA, 18 nt, Neisseria meningitidis Z2491
gcaaaucggcuucagaca

SEQ ID NO: 1381945 - RNA, 23 nt, Neisseria meningitidis Z2491
gcaaaucgaugcguuccugccag

SEQ ID NO: 1381946 - RNA, 12 nt, Neisseria meningitidis Z2491
gcaaauuuacag

SEQ ID NO: 1381947 - RNA, 14 nt, Neisseria meningitidis Z2491
gcaaauuccagcaa

SEQ ID NO: 1381948 - RNA, 20 nt, Neisseria meningitidis Z2491
gcaaacuaacuuauacacac

SEQ ID NO: 1381949 - RNA, 19 nt, Neisseria meningitidis Z2491
gcaaacuauaucuauacua

SEQ ID NO: 1381950 - RNA, 21 nt, Neisseria meningitidis Z2491
gcaaagccuccgacugcucgg

SEQ ID NO: 1381951 - RNA, 22 nt, Neisseria meningitidis Z2491
gcaaagccuccgacugcucgga

SEQ ID NO: 1381952 - RNA, 14 nt, Neisseria meningitidis Z2491
gauuuuguuuuuga

SEQ ID NO: 1381953 - RNA, 10 nt, Neisseria meningitidis Z2491
gauuuugcag

SEQ ID NO: 1381954 - RNA, 16 nt, Neisseria meningitidis Z2491
gauuuuuccuacuuuu

SEQ ID NO: 1381955 - RNA, 23 nt, Neisseria meningitidis Z2491
gauuuuuccuacuuuuugcucaa

SEQ ID NO: 1381956 - RNA, 17 nt, Neisseria meningitidis Z2491
gauuuuuguuaauccac

SEQ ID NO: 1381957 - RNA, 22 nt, Neisseria meningitidis Z2491
gcaaaaaaugccgucugaaacc

SEQ ID NO: 1381958 - RNA, 22 nt, Neisseria meningitidis Z2491
gcaaaaaguaggagaaaucaga

SEQ ID NO: 1381959 - RNA, 22 nt, Neisseria meningitidis Z2491
gcaaaaaaagaugccgucugaa

SEQ ID NO: 1381960 - RNA, 20 nt, Neisseria meningitidis Z2491
gauuuuuuuauuuaaacagc

SEQ ID NO: 1381961 - RNA, 23 nt, Neisseria meningitidis Z2491
gcaaacaaaauaucguuuuccaa

SEQ ID NO: 1381962 - RNA, 14 nt, Neisseria meningitidis Z2491
gcaaaauagaaaac

SEQ ID NO: 1381963 - RNA, 20 nt, Neisseria meningitidis Z2491
gcaaaagcgggaaucuagaa

SEQ ID NO: 1381964 - RNA, 12 nt, Neisseria meningitidis Z2491
gcaaaaauuuau

SEQ ID NO: 1381965 - RNA, 15 nt, Neisseria meningitidis Z2491
gcaaaaauuuauccg

SEQ ID NO: 1381966 - RNA, 18 nt, Neisseria meningitidis Z2491
gcaaaaaugccgucugaa

SEQ ID NO: 1381967 - RNA, 12 nt, Neisseria meningitidis Z2491
gcaaaaauaauc

SEQ ID NO: 1381968 - RNA, 17 nt, Neisseria meningitidis Z2491
gcaaaaccggcuugaac

SEQ ID NO: 1381969 - RNA, 21 nt, Neisseria meningitidis Z2491
gcaaaagaccgucugaacagu

SEQ ID NO: 1381970 - RNA, 10 nt, Neisseria meningitidis Z2491
gauuucuguu

SEQ ID NO: 1381971 - RNA, 18 nt, Neisseria meningitidis Z2491
gauuugaaguuucuccac

SEQ ID NO: 1381972 - RNA, 20 nt, Neisseria meningitidis Z2491
gauuugaaucugacuugcca

SEQ ID NO: 1381973 - RNA, 17 nt, Neisseria meningitidis Z2491
gauuugaaccauuucca

SEQ ID NO: 1381974 - RNA, 22 nt, Neisseria meningitidis Z2491
gauuuuacguucuggauuccca

SEQ ID NO: 1381975 - RNA, 19 nt, Neisseria meningitidis Z2491
gauuuauugggaauaaugg

SEQ ID NO: 1381976 - RNA, 15 nt, Neisseria meningitidis Z2491
gauuuccuuaaaaaa

SEQ ID NO: 1381977 - RNA, 14 nt, Neisseria meningitidis Z2491
gauuuaaauuuaau

SEQ ID NO: 1381978 - RNA, 14 nt, Neisseria meningitidis Z2491
gauuguuuggaaau

SEQ ID NO: 1381979 - RNA, 16 nt, Neisseria meningitidis Z2491
gauucaggcuuuccgu

SEQ ID NO: 1381980 - RNA, 20 nt, Neisseria meningitidis Z2491
gauucauaaaauauuugcac

SEQ ID NO: 1381981 - RNA, 14 nt, Neisseria meningitidis Z2491
gauucgcuuuugug

SEQ ID NO: 1381982 - RNA, 20 nt, Neisseria meningitidis Z2491
gauucccgcguucgcgggaa

SEQ ID NO: 1381983 - RNA, 19 nt, Neisseria meningitidis Z2491
gauugcgacauuuaucggg

SEQ ID NO: 1381984 - RNA, 14 nt, Neisseria meningitidis Z2491
gauugauaaaagca

SEQ ID NO: 1381985 - RNA, 18 nt, Neisseria meningitidis Z2491
gauugaccgaaaaauaau

SEQ ID NO: 1381986 - RNA, 15 nt, Neisseria meningitidis Z2491
gauugacuauuuuuu

SEQ ID NO: 1381987 - RNA, 21 nt, Neisseria meningitidis Z2491
gauugacuauuuuuuaaucau

SEQ ID NO: 1381988 - RNA, 17 nt, Neisseria meningitidis Z2491
gauucuugucaaaccaa

SEQ ID NO: 1381989 - RNA, 20 nt, Neisseria meningitidis Z2491
gauucucuaaggugcugaag

SEQ ID NO: 1381990 - RNA, 23 nt, Neisseria meningitidis Z2491
gauucucaugaucuucuuaccca

SEQ ID NO: 1381991 - RNA, 14 nt, Neisseria meningitidis Z2491
gauuaacaaaaacc

SEQ ID NO: 1381992 - RNA, 15 nt, Neisseria meningitidis Z2491
gauuaacaaaaacca

SEQ ID NO: 1381993 - RNA, 12 nt, Neisseria meningitidis Z2491
gauuaaauuuaa

SEQ ID NO: 1381994 - RNA, 20 nt, Neisseria meningitidis Z2491
gauguuuuugcguucagacg

SEQ ID NO: 1381995 - RNA, 12 nt, Neisseria meningitidis Z2491
gauguuuugccu

SEQ ID NO: 1381996 - RNA, 17 nt, Neisseria meningitidis Z2491
gauuaaaacaaaaauga

SEQ ID NO: 1381997 - RNA, 22 nt, Neisseria meningitidis Z2491
gauguucggcaagaucggaaau

SEQ ID NO: 1381998 - RNA, 14 nt, Neisseria meningitidis Z2491
gaugucgugcaaua

SEQ ID NO: 1381999 - RNA, 15 nt, Neisseria meningitidis Z2491
gauguguuucaacac

SEQ ID NO: 1382000 - RNA, 16 nt, Neisseria meningitidis Z2491
gauguguuucaacacc

SEQ ID NO: 1382001 - RNA, 16 nt, Neisseria meningitidis Z2491
gaugugguagagaaaa

SEQ ID NO: 1382002 - RNA, 17 nt, Neisseria meningitidis Z2491
gaugugguagagaaaau

SEQ ID NO: 1382003 - RNA, 23 nt, Neisseria meningitidis Z2491
gauuaauccgcuuccaaaaccac

SEQ ID NO: 1382004 - RNA, 20 nt, Neisseria meningitidis Z2491
gauuaauuccggaaucagac

SEQ ID NO: 1382005 - RNA, 12 nt, Neisseria meningitidis Z2491
gauuacuuauuu

SEQ ID NO: 1382006 - RNA, 18 nt, Neisseria meningitidis Z2491
gauggggaggcgcggcca

SEQ ID NO: 1382007 - RNA, 17 nt, Neisseria meningitidis Z2491
gauggaugaacaaucca

SEQ ID NO: 1382008 - RNA, 20 nt, Neisseria meningitidis Z2491
gaugcugcggaugggggcgu

SEQ ID NO: 1382009 - RNA, 21 nt, Neisseria meningitidis Z2491
gauggcgggaaauaaaacaaa

SEQ ID NO: 1382010 - RNA, 17 nt, Neisseria meningitidis Z2491
gaugauuuuuucaacac

SEQ ID NO: 1382011 - RNA, 22 nt, Neisseria meningitidis Z2491
gaugcacugcgcgaugcauauc

SEQ ID NO: 1382012 - RNA, 19 nt, Neisseria meningitidis Z2491
gaugauguccgacugggca

SEQ ID NO: 1382013 - RNA, 20 nt, Neisseria meningitidis Z2491
gaugcaugagguuagcggau

SEQ ID NO: 1382014 - RNA, 14 nt, Neisseria meningitidis Z2491
gaugccgguaaaga

SEQ ID NO: 1382015 - RNA, 20 nt, Neisseria meningitidis Z2491
gaugccgucauucccgcgca

SEQ ID NO: 1382016 - RNA, 23 nt, Neisseria meningitidis Z2491
gaugaauuuaaacaggcacaguu

SEQ ID NO: 1382017 - RNA, 15 nt, Neisseria meningitidis Z2491
gaucuuauccauccc

SEQ ID NO: 1382018 - RNA, 16 nt, Neisseria meningitidis Z2491
gaucuugggcaaugcu

SEQ ID NO: 1382019 - RNA, 22 nt, Neisseria meningitidis Z2491
gaugacgguaucgccguuuugc

SEQ ID NO: 1382020 - RNA, 22 nt, Neisseria meningitidis Z2491
gaugaggcggaacgcgucuucc

SEQ ID NO: 1382021 - RNA, 14 nt, Neisseria meningitidis Z2491
gaugaggaugacgg

SEQ ID NO: 1382022 - RNA, 14 nt, Neisseria meningitidis Z2491
gaugacugccuuac

SEQ ID NO: 1382023 - RNA, 21 nt, Neisseria meningitidis Z2491
gaugaugacggucaggaagau

SEQ ID NO: 1382024 - RNA, 21 nt, Neisseria meningitidis Z2491
aaagccggcauuucugcgaaa

SEQ ID NO: 1382025 - RNA, 21 nt, Neisseria meningitidis Z2491
aaagccgugugaaaauuuaaa

SEQ ID NO: 1382026 - RNA, 22 nt, Neisseria meningitidis Z2491
aaagccgugugaaaauuuaaaa

SEQ ID NO: 1382027 - RNA, 13 nt, Neisseria meningitidis Z2491
aaagccugcugca

SEQ ID NO: 1382028 - RNA, 18 nt, Neisseria meningitidis Z2491
aaagccugaaucuuuuuu

SEQ ID NO: 1382029 - RNA, 20 nt, Neisseria meningitidis Z2491
gaugaguccgaggcugugga

SEQ ID NO: 1382030 - RNA, 15 nt, Neisseria meningitidis Z2491
gagccaagcaagcaa

SEQ ID NO: 1382031 - RNA, 12 nt, Neisseria meningitidis Z2491
aaagcacaaauu

SEQ ID NO: 1382032 - RNA, 13 nt, Neisseria meningitidis Z2491
aaagcacaaauua

SEQ ID NO: 1382033 - RNA, 14 nt, Neisseria meningitidis Z2491
aaagcacaaauuaa

SEQ ID NO: 1382034 - RNA, 20 nt, Neisseria meningitidis Z2491
gagcaggcacaaggcggcgg

SEQ ID NO: 1382035 - RNA, 23 nt, Neisseria meningitidis Z2491
gagcgggcgcacuucaaguccga

SEQ ID NO: 1382036 - RNA, 14 nt, Neisseria meningitidis Z2491
gagcgagcgggcgu

SEQ ID NO: 1382037 - RNA, 14 nt, Neisseria meningitidis Z2491
gagcgcaaccuugc

SEQ ID NO: 1382038 - RNA, 17 nt, Neisseria meningitidis Z2491
gagccgcaaggucggcg

SEQ ID NO: 1382039 - RNA, 21 nt, Neisseria meningitidis Z2491
gauaaaacgguuucuucagau

SEQ ID NO: 1382040 - RNA, 21 nt, Neisseria meningitidis Z2491
gaggaaaguccgggcuccgca

SEQ ID NO: 1382041 - RNA, 20 nt, Neisseria meningitidis Z2491
gaggaagaugucgggggcgg

SEQ ID NO: 1382042 - RNA, 17 nt, Neisseria meningitidis Z2491
gaggaguuugaugccgu

SEQ ID NO: 1382043 - RNA, 19 nt, Neisseria meningitidis Z2491
gaucauaccuaccgccuau

SEQ ID NO: 1382044 - RNA, 16 nt, Neisseria meningitidis Z2491
gaucaggcggauuucu

SEQ ID NO: 1382045 - RNA, 20 nt, Neisseria meningitidis Z2491
gaucagacauuaaaaaauac

SEQ ID NO: 1382046 - RNA, 19 nt, Neisseria meningitidis Z2491
gauauaguggauuaaauuu

SEQ ID NO: 1382047 - RNA, 18 nt, Neisseria meningitidis Z2491
gauaggcaaaaaccggcu

SEQ ID NO: 1382048 - RNA, 17 nt, Neisseria meningitidis Z2491
cuuucccguuucagacg

SEQ ID NO: 1382049 - RNA, 14 nt, Neisseria meningitidis Z2491
cuuuccauccauca

SEQ ID NO: 1382050 - RNA, 17 nt, Neisseria meningitidis Z2491
cuuugacaaaauccagu

SEQ ID NO: 1382051 - RNA, 16 nt, Neisseria meningitidis Z2491
cuuucucuguuuuucg

SEQ ID NO: 1382052 - RNA, 20 nt, Neisseria meningitidis Z2491
cuuugcguuucuagauuccc

SEQ ID NO: 1382053 - RNA, 22 nt, Neisseria meningitidis Z2491
cuuugcguuucuagauucccac

SEQ ID NO: 1382054 - RNA, 15 nt, Neisseria meningitidis Z2491
cuuugcaaaauuccc

SEQ ID NO: 1382055 - RNA, 22 nt, Neisseria meningitidis Z2491
cuuugacggcgggcaggcggcu

SEQ ID NO: 1382056 - RNA, 16 nt, Neisseria meningitidis Z2491
cuuugcuggaagcauu

SEQ ID NO: 1382057 - RNA, 21 nt, Neisseria meningitidis Z2491
cuuugcuggaagcauugacca

SEQ ID NO: 1382058 - RNA, 11 nt, Neisseria meningitidis Z2491
cuuuguuucaa

SEQ ID NO: 1382059 - RNA, 22 nt, Neisseria meningitidis Z2491
cuuuguuucaaaauguucaaua

SEQ ID NO: 1382060 - RNA, 22 nt, Neisseria meningitidis Z2491
cuuucaggaagucgggcaaagc

SEQ ID NO: 1382061 - RNA, 23 nt, Neisseria meningitidis Z2491
cuuucagcaauaaaauaaagucc

SEQ ID NO: 1382062 - RNA, 13 nt, Neisseria meningitidis Z2491
cuucggauaaauu

SEQ ID NO: 1382063 - RNA, 20 nt, Neisseria meningitidis Z2491
cuuuaaucccgucauuccca

SEQ ID NO: 1382064 - RNA, 15 nt, Neisseria meningitidis Z2491
cuuuaaauucaacuu

SEQ ID NO: 1382065 - RNA, 13 nt, Neisseria meningitidis Z2491
cuuuaaauuuaaa

SEQ ID NO: 1382066 - RNA, 19 nt, Neisseria meningitidis Z2491
gaaaagauauuguucagac

SEQ ID NO: 1382067 - RNA, 21 nt, Neisseria meningitidis Z2491
gaaaagcaagacguagcgugg

SEQ ID NO: 1382068 - RNA, 10 nt, Neisseria meningitidis Z2491
gaaaauaaua

SEQ ID NO: 1382069 - RNA, 16 nt, Neisseria meningitidis Z2491
gaaaacgccgucugaa

SEQ ID NO: 1382070 - RNA, 18 nt, Neisseria meningitidis Z2491
gaaaacgggaaucuagaa

SEQ ID NO: 1382071 - RNA, 18 nt, Neisseria meningitidis Z2491
gaaaacgucuuacucaau

SEQ ID NO: 1382072 - RNA, 14 nt, Neisseria meningitidis Z2491
gaaaaccuguguuu

SEQ ID NO: 1382073 - RNA, 15 nt, Neisseria meningitidis Z2491
gaaaaccaaaaacag

SEQ ID NO: 1382074 - RNA, 17 nt, Neisseria meningitidis Z2491
gaaaaccaaaaacagca

SEQ ID NO: 1382075 - RNA, 13 nt, Neisseria meningitidis Z2491
gaaaacagcugaa

SEQ ID NO: 1382076 - RNA, 20 nt, Neisseria meningitidis Z2491
gaaaacagaaaaucaaaaac

SEQ ID NO: 1382077 - RNA, 12 nt, Neisseria meningitidis Z2491
gaaaacagaaag

SEQ ID NO: 1382078 - RNA, 16 nt, Neisseria meningitidis Z2491
gaaaaaguccagcaua

SEQ ID NO: 1382079 - RNA, 16 nt, Neisseria meningitidis Z2491
gaaaaauuuucagacg

SEQ ID NO: 1382080 - RNA, 15 nt, Neisseria meningitidis Z2491
cuuuuccuuccaaaa

SEQ ID NO: 1382081 - RNA, 16 nt, Neisseria meningitidis Z2491
cuuuucauaucaugcc

SEQ ID NO: 1382082 - RNA, 18 nt, Neisseria meningitidis Z2491
cuuuuauuuucaaacauu

SEQ ID NO: 1382083 - RNA, 21 nt, Neisseria meningitidis Z2491
cuuuugugguuuuaaccugca

SEQ ID NO: 1382084 - RNA, 21 nt, Neisseria meningitidis Z2491
cuuuucuaaaauaugcagaga

SEQ ID NO: 1382085 - RNA, 22 nt, Neisseria meningitidis Z2491
cuuuucuuaugccuauuuuuua

SEQ ID NO: 1382086 - RNA, 16 nt, Neisseria meningitidis Z2491
cuuuucugauuuugag

SEQ ID NO: 1382087 - RNA, 20 nt, Neisseria meningitidis Z2491
gaacgacgguauaaaccaaa

SEQ ID NO: 1382088 - RNA, 15 nt, Neisseria meningitidis Z2491
gaaccuggauucccg

SEQ ID NO: 1382089 - RNA, 22 nt, Neisseria meningitidis Z2491
gaaccuggauucccgccugcgc

SEQ ID NO: 1382090 - RNA, 15 nt, Neisseria meningitidis Z2491
gaaccgucauucccg

SEQ ID NO: 1382091 - RNA, 16 nt, Neisseria meningitidis Z2491
gaaccugaccgaagca

SEQ ID NO: 1382092 - RNA, 21 nt, Neisseria meningitidis Z2491
gaacccgauuggauucagacg

SEQ ID NO: 1382093 - RNA, 14 nt, Neisseria meningitidis Z2491
gaacccgacuucug

SEQ ID NO: 1382094 - RNA, 16 nt, Neisseria meningitidis Z2491
gaacccgacuucugac

SEQ ID NO: 1382095 - RNA, 18 nt, Neisseria meningitidis Z2491
gaaccgauucacuuggug

SEQ ID NO: 1382096 - RNA, 18 nt, Neisseria meningitidis Z2491
gaaccagggauuuuucaa

SEQ ID NO: 1382097 - RNA, 13 nt, Neisseria meningitidis Z2491
gaacccaaaccgu

SEQ ID NO: 1382098 - RNA, 20 nt, Neisseria meningitidis Z2491
gaacccaaaggggacagacg

SEQ ID NO: 1382099 - RNA, 11 nt, Neisseria meningitidis Z2491
gaaccauuucc

SEQ ID NO: 1382100 - RNA, 17 nt, Neisseria meningitidis Z2491
gaaccaaauaaacaagg

SEQ ID NO: 1382101 - RNA, 14 nt, Neisseria meningitidis Z2491
gaacauuucagacg

SEQ ID NO: 1382102 - RNA, 15 nt, Neisseria meningitidis Z2491
gaacugccugcaacg

SEQ ID NO: 1382103 - RNA, 16 nt, Neisseria meningitidis Z2491
gaacugccugccuucc

SEQ ID NO: 1382104 - RNA, 21 nt, Neisseria meningitidis Z2491
gaacguggaaucuaagaaacc

SEQ ID NO: 1382105 - RNA, 15 nt, Neisseria meningitidis Z2491
gaacggguuuucggu

SEQ ID NO: 1382106 - RNA, 12 nt, Neisseria meningitidis Z2491
gaacaaugcaaa

SEQ ID NO: 1382107 - RNA, 13 nt, Neisseria meningitidis Z2491
gaacacggcggca

SEQ ID NO: 1382108 - RNA, 19 nt, Neisseria meningitidis Z2491
gaacacggcggcacuugcc

SEQ ID NO: 1382109 - RNA, 21 nt, Neisseria meningitidis Z2491
gaacacgaccaacgccgccga

SEQ ID NO: 1382110 - RNA, 18 nt, Neisseria meningitidis Z2491
gaacagcaucaaaccaua

SEQ ID NO: 1382111 - RNA, 13 nt, Neisseria meningitidis Z2491
gaacaggcggcgg

SEQ ID NO: 1382112 - RNA, 12 nt, Neisseria meningitidis Z2491
gaaaugacugaa

SEQ ID NO: 1382113 - RNA, 15 nt, Neisseria meningitidis Z2491
gaaaugacugaaacu

SEQ ID NO: 1382114 - RNA, 17 nt, Neisseria meningitidis Z2491
gaaaugacugaaacuca

SEQ ID NO: 1382115 - RNA, 19 nt, Neisseria meningitidis Z2491
gaaaugacugaaacucaaa

SEQ ID NO: 1382116 - RNA, 22 nt, Neisseria meningitidis Z2491
gaaaugacugaaacucaaaaaa

SEQ ID NO: 1382117 - RNA, 22 nt, Neisseria meningitidis Z2491
gaaaugacugaaauucaaaaaa

SEQ ID NO: 1382118 - RNA, 23 nt, Neisseria meningitidis Z2491
gaaaugaaaaacgacgagaauuu

SEQ ID NO: 1382119 - RNA, 19 nt, Neisseria meningitidis Z2491
aaagagaacaauucucuaa

SEQ ID NO: 1382120 - RNA, 15 nt, Neisseria meningitidis Z2491
gaaauuacccgaaac

SEQ ID NO: 1382121 - RNA, 19 nt, Neisseria meningitidis Z2491
aaagagaacgauucucuaa

SEQ ID NO: 1382122 - RNA, 22 nt, Neisseria meningitidis Z2491
gaaauugaagcgucccaaauau

SEQ ID NO: 1382123 - RNA, 14 nt, Neisseria meningitidis Z2491
gaaauucuagauuc

SEQ ID NO: 1382124 - RNA, 13 nt, Neisseria meningitidis Z2491
gaaauugccuuca

SEQ ID NO: 1382125 - RNA, 23 nt, Neisseria meningitidis Z2491
gaaauuuugccauucuugcaaaa

SEQ ID NO: 1382126 - RNA, 16 nt, Neisseria meningitidis Z2491
gaaauuccaacauaac

SEQ ID NO: 1382127 - RNA, 19 nt, Neisseria meningitidis Z2491
gaaauuccaacauaaccga

SEQ ID NO: 1382128 - RNA, 16 nt, Neisseria meningitidis Z2491
gaaauucaaaaaaccg

SEQ ID NO: 1382129 - RNA, 17 nt, Neisseria meningitidis Z2491
gaaauucaaaaaaccgu

SEQ ID NO: 1382130 - RNA, 22 nt, Neisseria meningitidis Z2491
aaagagcaggacaaaguuggca

SEQ ID NO: 1382131 - RNA, 16 nt, Neisseria meningitidis Z2491
gaaacucuaaucccgu

SEQ ID NO: 1382132 - RNA, 18 nt, Neisseria meningitidis Z2491
gaaagccaaaaacagaaa

SEQ ID NO: 1382133 - RNA, 15 nt, Neisseria meningitidis Z2491
gaaagcagaaauaag

SEQ ID NO: 1382134 - RNA, 17 nt, Neisseria meningitidis Z2491
gaaagcagaaauaagga

SEQ ID NO: 1382135 - RNA, 12 nt, Neisseria meningitidis Z2491
gaaagcaaagcc

SEQ ID NO: 1382136 - RNA, 22 nt, Neisseria meningitidis Z2491
gaaaaugccguccgaaagguuu

SEQ ID NO: 1382137 - RNA, 22 nt, Neisseria meningitidis Z2491
gaaaaugccgucugaaaccuuu

SEQ ID NO: 1382138 - RNA, 20 nt, Neisseria meningitidis Z2491
gaaaaugguaucgggcauaa

SEQ ID NO: 1382139 - RNA, 19 nt, Neisseria meningitidis Z2491
gaaacgugguucaacguuc

SEQ ID NO: 1382140 - RNA, 19 nt, Neisseria meningitidis Z2491
gaaaaucuugccauucuca

SEQ ID NO: 1382141 - RNA, 14 nt, Neisseria meningitidis Z2491
gaaagcgggaaucu

SEQ ID NO: 1382142 - RNA, 15 nt, Neisseria meningitidis Z2491
gaaagcgggaaugcc

SEQ ID NO: 1382143 - RNA, 21 nt, Neisseria meningitidis Z2491
gaaauaagcgguuuuccccug

SEQ ID NO: 1382144 - RNA, 14 nt, Neisseria meningitidis Z2491
gaaauaacucauca

SEQ ID NO: 1382145 - RNA, 19 nt, Neisseria meningitidis Z2491
gaaauaccgucugaaagcu

SEQ ID NO: 1382146 - RNA, 13 nt, Neisseria meningitidis Z2491
gacaguacaaaua

SEQ ID NO: 1382147 - RNA, 15 nt, Neisseria meningitidis Z2491
gacaguacaaauagu

SEQ ID NO: 1382148 - RNA, 20 nt, Neisseria meningitidis Z2491
gacaggucggacauuugacu

SEQ ID NO: 1382149 - RNA, 16 nt, Neisseria meningitidis Z2491
gacaggcuuuuuucug

SEQ ID NO: 1382150 - RNA, 19 nt, Neisseria meningitidis Z2491
gacaggcuccguaucggca

SEQ ID NO: 1382151 - RNA, 18 nt, Neisseria meningitidis Z2491
gacagccccuaaauuuaa

SEQ ID NO: 1382152 - RNA, 20 nt, Neisseria meningitidis Z2491
gacaggcauuugcacacguu

SEQ ID NO: 1382153 - RNA, 14 nt, Neisseria meningitidis Z2491
gacagcauuuccac

SEQ ID NO: 1382154 - RNA, 15 nt, Neisseria meningitidis Z2491
gacagacggccaaac

SEQ ID NO: 1382155 - RNA, 14 nt, Neisseria meningitidis Z2491
gacaugcaagcaua

SEQ ID NO: 1382156 - RNA, 18 nt, Neisseria meningitidis Z2491
gacagugcagcgacaaca

SEQ ID NO: 1382157 - RNA, 17 nt, Neisseria meningitidis Z2491
gaccccgauuuguccga

SEQ ID NO: 1382158 - RNA, 14 nt, Neisseria meningitidis Z2491
gacgcauaaaaaug

SEQ ID NO: 1382159 - RNA, 20 nt, Neisseria meningitidis Z2491
gacgcaggguuaagaaaacc

SEQ ID NO: 1382160 - RNA, 12 nt, Neisseria meningitidis Z2491
gacgaaaccaga

SEQ ID NO: 1382161 - RNA, 15 nt, Neisseria meningitidis Z2491
gaccuuugcaaaaau

SEQ ID NO: 1382162 - RNA, 13 nt, Neisseria meningitidis Z2491
gacgaaaaccugu

SEQ ID NO: 1382163 - RNA, 23 nt, Neisseria meningitidis Z2491
gacgaagcuauccgcacagaaac

SEQ ID NO: 1382164 - RNA, 16 nt, Neisseria meningitidis Z2491
gaccugauaaacgcuc

SEQ ID NO: 1382165 - RNA, 14 nt, Neisseria meningitidis Z2491
gacggcauuguuuc

SEQ ID NO: 1382166 - RNA, 15 nt, Neisseria meningitidis Z2491
gacggcauauguuuu

SEQ ID NO: 1382167 - RNA, 21 nt, Neisseria meningitidis Z2491
gacggcauuucguuuggggau

SEQ ID NO: 1382168 - RNA, 20 nt, Neisseria meningitidis Z2491
gacggcauuuucaacagcag

SEQ ID NO: 1382169 - RNA, 17 nt, Neisseria meningitidis Z2491
gacggcauuuucuauuu

SEQ ID NO: 1382170 - RNA, 15 nt, Neisseria meningitidis Z2491
gacggcauuuuucau

SEQ ID NO: 1382171 - RNA, 21 nt, Neisseria meningitidis Z2491
gacggcauuuuuguguggcgg

SEQ ID NO: 1382172 - RNA, 16 nt, Neisseria meningitidis Z2491
gacggcauuuuuuccg

SEQ ID NO: 1382173 - RNA, 16 nt, Neisseria meningitidis Z2491
gacggacacgcccuca

SEQ ID NO: 1382174 - RNA, 15 nt, Neisseria meningitidis Z2491
gacggcauuaaaauu

SEQ ID NO: 1382175 - RNA, 17 nt, Neisseria meningitidis Z2491
gacggcauuauagugaa

SEQ ID NO: 1382176 - RNA, 22 nt, Neisseria meningitidis Z2491
gacggagaguugcgggaaugac

SEQ ID NO: 1382177 - RNA, 18 nt, Neisseria meningitidis Z2491
gacggcggcagauaaaua

SEQ ID NO: 1382178 - RNA, 22 nt, Neisseria meningitidis Z2491
gacggcguuuuuguuuuauauu

SEQ ID NO: 1382179 - RNA, 20 nt, Neisseria meningitidis Z2491
gacggcguuuuuuauauggc

SEQ ID NO: 1382180 - RNA, 15 nt, Neisseria meningitidis Z2491
gacuauuuuugcaaa

SEQ ID NO: 1382181 - RNA, 16 nt, Neisseria meningitidis Z2491
gacuauuuuugcaaag

SEQ ID NO: 1382182 - RNA, 22 nt, Neisseria meningitidis Z2491
gacgugugaguagcggugugcg

SEQ ID NO: 1382183 - RNA, 14 nt, Neisseria meningitidis Z2491
gacguucaaacccu

SEQ ID NO: 1382184 - RNA, 17 nt, Neisseria meningitidis Z2491
gacuaaccgaaaauaau

SEQ ID NO: 1382185 - RNA, 17 nt, Neisseria meningitidis Z2491
gaauuaaaugcuaaaua

SEQ ID NO: 1382186 - RNA, 14 nt, Neisseria meningitidis Z2491
gaauuaacaaaaau

SEQ ID NO: 1382187 - RNA, 19 nt, Neisseria meningitidis Z2491
gacaaaaauaccgucugaa

SEQ ID NO: 1382188 - RNA, 22 nt, Neisseria meningitidis Z2491
gacaaaaauaccgucugaaacc

SEQ ID NO: 1382189 - RNA, 17 nt, Neisseria meningitidis Z2491
gaauuuauccgaaacaa

SEQ ID NO: 1382190 - RNA, 21 nt, Neisseria meningitidis Z2491
gaauuuauccgaaacaacaaa

SEQ ID NO: 1382191 - RNA, 15 nt, Neisseria meningitidis Z2491
gaauuuauacccucu

SEQ ID NO: 1382192 - RNA, 13 nt, Neisseria meningitidis Z2491
gaauuuaucagaa

SEQ ID NO: 1382193 - RNA, 22 nt, Neisseria meningitidis Z2491
gaauuuaaucaagucuuccggu

SEQ ID NO: 1382194 - RNA, 19 nt, Neisseria meningitidis Z2491
gacaaucucgucccaaaca

SEQ ID NO: 1382195 - RNA, 15 nt, Neisseria meningitidis Z2491
gacaauacggcggcg

SEQ ID NO: 1382196 - RNA, 16 nt, Neisseria meningitidis Z2491
gacaauacggcggcgg

SEQ ID NO: 1382197 - RNA, 22 nt, Neisseria meningitidis Z2491
gacaauacggcggcggcaggca

SEQ ID NO: 1382198 - RNA, 13 nt, Neisseria meningitidis Z2491
gacaaaauccagu

SEQ ID NO: 1382199 - RNA, 16 nt, Neisseria meningitidis Z2491
gacaaaauccaguucg

SEQ ID NO: 1382200 - RNA, 21 nt, Neisseria meningitidis Z2491
gacaaaauuaaaguuucagaa

SEQ ID NO: 1382201 - RNA, 17 nt, Neisseria meningitidis Z2491
gacaaggcgacaaagcc

SEQ ID NO: 1382202 - RNA, 14 nt, Neisseria meningitidis Z2491
gacaaggcuggauu

SEQ ID NO: 1382203 - RNA, 17 nt, Neisseria meningitidis Z2491
gaaugccuuucucuguu

SEQ ID NO: 1382204 - RNA, 18 nt, Neisseria meningitidis Z2491
gaauguagguucguggga

SEQ ID NO: 1382205 - RNA, 14 nt, Neisseria meningitidis Z2491
gaaugacgaaauuu

SEQ ID NO: 1382206 - RNA, 18 nt, Neisseria meningitidis Z2491
gaaugacgcgaacagaaa

SEQ ID NO: 1382207 - RNA, 18 nt, Neisseria meningitidis Z2491
gaaugacugaaacucaaa

SEQ ID NO: 1382208 - RNA, 22 nt, Neisseria meningitidis Z2491
gaaugacggcggaaggguuuug

SEQ ID NO: 1382209 - RNA, 21 nt, Neisseria meningitidis Z2491
gaaugacguggugcagguuuc

SEQ ID NO: 1382210 - RNA, 23 nt, Neisseria meningitidis Z2491
gaaucuucuuuugugguuuuaac

SEQ ID NO: 1382211 - RNA, 20 nt, Neisseria meningitidis Z2491
gaaugaaaaugccgucugaa

SEQ ID NO: 1382212 - RNA, 18 nt, Neisseria meningitidis Z2491
gaaucgaguacgcgggca

SEQ ID NO: 1382213 - RNA, 16 nt, Neisseria meningitidis Z2491
gaaucaggcaaauuuc

SEQ ID NO: 1382214 - RNA, 23 nt, Neisseria meningitidis Z2491
gaauccaguuucuugaguuucag

SEQ ID NO: 1382215 - RNA, 20 nt, Neisseria meningitidis Z2491
gaaucaaauauuaaaaaccg

SEQ ID NO: 1382216 - RNA, 23 nt, Neisseria meningitidis Z2491
gaauaaaaaauauggaucagaca

SEQ ID NO: 1382217 - RNA, 13 nt, Neisseria meningitidis Z2491
gaaguucuagauu

SEQ ID NO: 1382218 - RNA, 12 nt, Neisseria meningitidis Z2491
gaaggcggcggc

SEQ ID NO: 1382219 - RNA, 18 nt, Neisseria meningitidis Z2491
gaaggcgggcaggcagug

SEQ ID NO: 1382220 - RNA, 14 nt, Neisseria meningitidis Z2491
gaaggguuuuguuu

SEQ ID NO: 1382221 - RNA, 18 nt, Neisseria meningitidis Z2491
gaaggguuuuguuuuuuc

SEQ ID NO: 1382222 - RNA, 14 nt, Neisseria meningitidis Z2491
gaagcgcguuuugc

SEQ ID NO: 1382223 - RNA, 16 nt, Neisseria meningitidis Z2491
gaagcgcguuuugcgu

SEQ ID NO: 1382224 - RNA, 23 nt, Neisseria meningitidis Z2491
gaagcggaaagccgccgggguuu

SEQ ID NO: 1382225 - RNA, 22 nt, Neisseria meningitidis Z2491
gaagcggcggcaucugcugcgu

SEQ ID NO: 1382226 - RNA, 23 nt, Neisseria meningitidis Z2491
gaagcguauguggucaggcccug

SEQ ID NO: 1382227 - RNA, 20 nt, Neisseria meningitidis Z2491
gaagccagggcggauugcag

SEQ ID NO: 1382228 - RNA, 16 nt, Neisseria meningitidis Z2491
gaacuuuauccccagc

SEQ ID NO: 1382229 - RNA, 22 nt, Neisseria meningitidis Z2491
cuguacugguuuaaauuuaauu

SEQ ID NO: 1382230 - RNA, 17 nt, Neisseria meningitidis Z2491
aaacucuggucgaacca

SEQ ID NO: 1382231 - RNA, 15 nt, Neisseria meningitidis Z2491
cuguauuuguauagu

SEQ ID NO: 1382232 - RNA, 17 nt, Neisseria meningitidis Z2491
cuguauuuguauagugg

SEQ ID NO: 1382233 - RNA, 18 nt, Neisseria meningitidis Z2491
cugucaaacccuuuuucu

SEQ ID NO: 1382234 - RNA, 21 nt, Neisseria meningitidis Z2491
cuguauaguggauuaaauuua

SEQ ID NO: 1382235 - RNA, 16 nt, Neisseria meningitidis Z2491
cuguccggcaugauuu

SEQ ID NO: 1382236 - RNA, 11 nt, Neisseria meningitidis Z2491
cuguccaaagc

SEQ ID NO: 1382237 - RNA, 23 nt, Neisseria meningitidis Z2491
cuguccaaagccucgcggcucgc

SEQ ID NO: 1382238 - RNA, 13 nt, Neisseria meningitidis Z2491
cugucugcggcuu

SEQ ID NO: 1382239 - RNA, 15 nt, Neisseria meningitidis Z2491
cugucugaaaccuga

SEQ ID NO: 1382240 - RNA, 23 nt, Neisseria meningitidis Z2491
cugucuccgccuguaugcggcuu

SEQ ID NO: 1382241 - RNA, 16 nt, Neisseria meningitidis Z2491
cugucuuucaauauac

SEQ ID NO: 1382242 - RNA, 22 nt, Neisseria meningitidis Z2491
cugucgccagacaggcuuuuuu

SEQ ID NO: 1382243 - RNA, 22 nt, Neisseria meningitidis Z2491
cugucgccgucauucccgcaaa

SEQ ID NO: 1382244 - RNA, 15 nt, Neisseria meningitidis Z2491
cuguggauaaacauu

SEQ ID NO: 1382245 - RNA, 16 nt, Neisseria meningitidis Z2491
cugugccuguuuaaau

SEQ ID NO: 1382246 - RNA, 17 nt, Neisseria meningitidis Z2491
cugugccgguucaaacu

SEQ ID NO: 1382247 - RNA, 16 nt, Neisseria meningitidis Z2491
cuguaaaaacaaaaaa

SEQ ID NO: 1382248 - RNA, 12 nt, Neisseria meningitidis Z2491
cuguaaacagau

SEQ ID NO: 1382249 - RNA, 20 nt, Neisseria meningitidis Z2491
cuguaaacagauaaaaccaa

SEQ ID NO: 1382250 - RNA, 19 nt, Neisseria meningitidis Z2491
cuguaaagauaaaucuaug

SEQ ID NO: 1382251 - RNA, 18 nt, Neisseria meningitidis Z2491
cuguaccgcaucuucaaa

SEQ ID NO: 1382252 - RNA, 12 nt, Neisseria meningitidis Z2491
cuguaccagcaa

SEQ ID NO: 1382253 - RNA, 12 nt, Neisseria meningitidis Z2491
cugguugauguc

SEQ ID NO: 1382254 - RNA, 18 nt, Neisseria meningitidis Z2491
cugguuuuuguuaaucca

SEQ ID NO: 1382255 - RNA, 21 nt, Neisseria meningitidis Z2491
cuggugguacgcccgcagccg

SEQ ID NO: 1382256 - RNA, 13 nt, Neisseria meningitidis Z2491
cuuccuuuuuaaa

SEQ ID NO: 1382257 - RNA, 14 nt, Neisseria meningitidis Z2491
cuuccuuuuuaaag

SEQ ID NO: 1382258 - RNA, 23 nt, Neisseria meningitidis Z2491
cuuccuuuaauuaagauccuccc

SEQ ID NO: 1382259 - RNA, 20 nt, Neisseria meningitidis Z2491
cuuccgaaauauuacccaac

SEQ ID NO: 1382260 - RNA, 23 nt, Neisseria meningitidis Z2491
cuuccccauaugccgucugaaga

SEQ ID NO: 1382261 - RNA, 15 nt, Neisseria meningitidis Z2491
cuuccagcgcaccuc

SEQ ID NO: 1382262 - RNA, 20 nt, Neisseria meningitidis Z2491
cuuccaaggcacgguaaacc

SEQ ID NO: 1382263 - RNA, 21 nt, Neisseria meningitidis Z2491
cuuccaaggcacgguaaaccg

SEQ ID NO: 1382264 - RNA, 20 nt, Neisseria meningitidis Z2491
aaacuuaucggauaaaacgg

SEQ ID NO: 1382265 - RNA, 20 nt, Neisseria meningitidis Z2491
aaacuuaucggguaaaacgg

SEQ ID NO: 1382266 - RNA, 16 nt, Neisseria meningitidis Z2491
cuucacgaguccaaga

SEQ ID NO: 1382267 - RNA, 22 nt, Neisseria meningitidis Z2491
cuucacgccgccgcgccccaag

SEQ ID NO: 1382268 - RNA, 21 nt, Neisseria meningitidis Z2491
cuucacacguucgcaggcuuc

SEQ ID NO: 1382269 - RNA, 19 nt, Neisseria meningitidis Z2491
cuucaaccacgcuucugau

SEQ ID NO: 1382270 - RNA, 17 nt, Neisseria meningitidis Z2491
cuucaaaggaaacauag

SEQ ID NO: 1382271 - RNA, 23 nt, Neisseria meningitidis Z2491
cuucaaaggaaacauagccuuca

SEQ ID NO: 1382272 - RNA, 11 nt, Neisseria meningitidis Z2491
cuuccaaaccg

SEQ ID NO: 1382273 - RNA, 18 nt, Neisseria meningitidis Z2491
cuuccaaaagcgucauca

SEQ ID NO: 1382274 - RNA, 15 nt, Neisseria meningitidis Z2491
cuucaugcggcgggc

SEQ ID NO: 1382275 - RNA, 12 nt, Neisseria meningitidis Z2491
cuucaucugccg

SEQ ID NO: 1382276 - RNA, 20 nt, Neisseria meningitidis Z2491
cuucaucucgccaaucucac

SEQ ID NO: 1382277 - RNA, 16 nt, Neisseria meningitidis Z2491
cuucaucaaaauccgg

SEQ ID NO: 1382278 - RNA, 19 nt, Neisseria meningitidis Z2491
cuucauccguugcuucaau

SEQ ID NO: 1382279 - RNA, 18 nt, Neisseria meningitidis Z2491
cuucauaccccacugcca

SEQ ID NO: 1382280 - RNA, 20 nt, Neisseria meningitidis Z2491
cuucagacggcauuuuguuu

SEQ ID NO: 1382281 - RNA, 19 nt, Neisseria meningitidis Z2491
cuucagacggcauuuuuua

SEQ ID NO: 1382282 - RNA, 15 nt, Neisseria meningitidis Z2491
cuuacaauccgcuuu

SEQ ID NO: 1382283 - RNA, 16 nt, Neisseria meningitidis Z2491
cuuacaauccgcuuuu

SEQ ID NO: 1382284 - RNA, 19 nt, Neisseria meningitidis Z2491
cuuacaauccgcuuuuuaa

SEQ ID NO: 1382285 - RNA, 16 nt, Neisseria meningitidis Z2491
cuuagaacaacaguaa

SEQ ID NO: 1382286 - RNA, 22 nt, Neisseria meningitidis Z2491
cuuauacacacgguuuucacau

SEQ ID NO: 1382287 - RNA, 14 nt, Neisseria meningitidis Z2491
cuuauccauaucca

SEQ ID NO: 1382288 - RNA, 10 nt, Neisseria meningitidis Z2491
cuuauccaca

SEQ ID NO: 1382289 - RNA, 21 nt, Neisseria meningitidis Z2491
cuuaaaauuucaucauuccca

SEQ ID NO: 1382290 - RNA, 17 nt, Neisseria meningitidis Z2491
cuuaaaauugccaacac

SEQ ID NO: 1382291 - RNA, 12 nt, Neisseria meningitidis Z2491
cuguuuggcuuu

SEQ ID NO: 1382292 - RNA, 22 nt, Neisseria meningitidis Z2491
cuguuuggcuuuuuucuguuug

SEQ ID NO: 1382293 - RNA, 23 nt, Neisseria meningitidis Z2491
cuguugcacaaacagauuuuuug

SEQ ID NO: 1382294 - RNA, 17 nt, Neisseria meningitidis Z2491
cuguuaacgaaauuuga

SEQ ID NO: 1382295 - RNA, 13 nt, Neisseria meningitidis Z2491
cuguucguuuuug

SEQ ID NO: 1382296 - RNA, 16 nt, Neisseria meningitidis Z2491
cuguugaaaaugccgu

SEQ ID NO: 1382297 - RNA, 21 nt, Neisseria meningitidis Z2491
cuguucagacggucuuuugcu

SEQ ID NO: 1382298 - RNA, 17 nt, Neisseria meningitidis Z2491
cuggcgauaugcuucaa

SEQ ID NO: 1382299 - RNA, 15 nt, Neisseria meningitidis Z2491
cuggcgguaaagugc

SEQ ID NO: 1382300 - RNA, 14 nt, Neisseria meningitidis Z2491
cuggaacuugaaaa

SEQ ID NO: 1382301 - RNA, 16 nt, Neisseria meningitidis Z2491
cuggaacuugaaaaca

SEQ ID NO: 1382302 - RNA, 20 nt, Neisseria meningitidis Z2491
cugcuugaccaaagcauuuu

SEQ ID NO: 1382303 - RNA, 18 nt, Neisseria meningitidis Z2491
cugcuuccgaggcggcuu

SEQ ID NO: 1382304 - RNA, 19 nt, Neisseria meningitidis Z2491
cugcugguuuuucggcaca

SEQ ID NO: 1382305 - RNA, 18 nt, Neisseria meningitidis Z2491
cugcuguauuuuuccaac

SEQ ID NO: 1382306 - RNA, 22 nt, Neisseria meningitidis Z2491
cugcuguauuuuucgaggcgca

SEQ ID NO: 1382307 - RNA, 17 nt, Neisseria meningitidis Z2491
cugcucggaggcuuugu

SEQ ID NO: 1382308 - RNA, 20 nt, Neisseria meningitidis Z2491
cugcucggccugcccugcca

SEQ ID NO: 1382309 - RNA, 22 nt, Neisseria meningitidis Z2491
cugcucggccugcccugccaaa

SEQ ID NO: 1382310 - RNA, 22 nt, Neisseria meningitidis Z2491
aaacuauaguggauuaacaaaa

SEQ ID NO: 1382311 - RNA, 19 nt, Neisseria meningitidis Z2491
cugcucgccacauaauuca

SEQ ID NO: 1382312 - RNA, 18 nt, Neisseria meningitidis Z2491
cugcggacuuaagaaaca

SEQ ID NO: 1382313 - RNA, 16 nt, Neisseria meningitidis Z2491
cugcaucacguucuga

SEQ ID NO: 1382314 - RNA, 17 nt, Neisseria meningitidis Z2491
cugccacauuuguucca

SEQ ID NO: 1382315 - RNA, 18 nt, Neisseria meningitidis Z2491
cugccauuccccuaugcu

SEQ ID NO: 1382316 - RNA, 23 nt, Neisseria meningitidis Z2491
cugccccguuuuacccucucccc

SEQ ID NO: 1382317 - RNA, 15 nt, Neisseria meningitidis Z2491
cugcccgacagccgc

SEQ ID NO: 1382318 - RNA, 20 nt, Neisseria meningitidis Z2491
cugccgaaaccaaaagccaa

SEQ ID NO: 1382319 - RNA, 14 nt, Neisseria meningitidis Z2491
cugccgccgcgccu

SEQ ID NO: 1382320 - RNA, 14 nt, Neisseria meningitidis Z2491
cugccguauuuauu

SEQ ID NO: 1382321 - RNA, 17 nt, Neisseria meningitidis Z2491
cugccguauuuauuucc

SEQ ID NO: 1382322 - RNA, 20 nt, Neisseria meningitidis Z2491
cugccgucauucccgcgcag

SEQ ID NO: 1382323 - RNA, 12 nt, Neisseria meningitidis Z2491
cugccgcugaaa

SEQ ID NO: 1382324 - RNA, 22 nt, Neisseria meningitidis Z2491
cugauuuuguuuuugagagaau

SEQ ID NO: 1382325 - RNA, 15 nt, Neisseria meningitidis Z2491
cugauuuuuccuacu

SEQ ID NO: 1382326 - RNA, 18 nt, Neisseria meningitidis Z2491
cugcacgcgcuucaaauc

SEQ ID NO: 1382327 - RNA, 23 nt, Neisseria meningitidis Z2491
cugcacgaaaggaugguuuugcg

SEQ ID NO: 1382328 - RNA, 23 nt, Neisseria meningitidis Z2491
cugauucaacgccgauuaauccg

SEQ ID NO: 1382329 - RNA, 16 nt, Neisseria meningitidis Z2491
cugauguauucuucca

SEQ ID NO: 1382330 - RNA, 18 nt, Neisseria meningitidis Z2491
cugauaguugccgucaaa

SEQ ID NO: 1382331 - RNA, 16 nt, Neisseria meningitidis Z2491
cugaugacggcagcca

SEQ ID NO: 1382332 - RNA, 13 nt, Neisseria meningitidis Z2491
cugauaaaaaaua

SEQ ID NO: 1382333 - RNA, 14 nt, Neisseria meningitidis Z2491
cugauaaaaaauau

SEQ ID NO: 1382334 - RNA, 23 nt, Neisseria meningitidis Z2491
cugaaugcccauuuguuggaugu

SEQ ID NO: 1382335 - RNA, 17 nt, Neisseria meningitidis Z2491
cugaauugacaugguau

SEQ ID NO: 1382336 - RNA, 13 nt, Neisseria meningitidis Z2491
cugaauugcuuga

SEQ ID NO: 1382337 - RNA, 14 nt, Neisseria meningitidis Z2491
cugaaugucgagga

SEQ ID NO: 1382338 - RNA, 14 nt, Neisseria meningitidis Z2491
cugacguaaaaaac

SEQ ID NO: 1382339 - RNA, 11 nt, Neisseria meningitidis Z2491
cugacaaacag

SEQ ID NO: 1382340 - RNA, 17 nt, Neisseria meningitidis Z2491
cugacaggaaauuucca

SEQ ID NO: 1382341 - RNA, 18 nt, Neisseria meningitidis Z2491
cugacagcauuuccacau

SEQ ID NO: 1382342 - RNA, 14 nt, Neisseria meningitidis Z2491
cguucgugcagaua

SEQ ID NO: 1382343 - RNA, 18 nt, Neisseria meningitidis Z2491
cguuccgcgccgcaaacc

SEQ ID NO: 1382344 - RNA, 14 nt, Neisseria meningitidis Z2491
cguucggcgcggcu

SEQ ID NO: 1382345 - RNA, 21 nt, Neisseria meningitidis Z2491
cguucagcggacagugcagcg

SEQ ID NO: 1382346 - RNA, 22 nt, Neisseria meningitidis Z2491
cguucagauuccugccgccgga

SEQ ID NO: 1382347 - RNA, 14 nt, Neisseria meningitidis Z2491
cguucaacagcagc

SEQ ID NO: 1382348 - RNA, 16 nt, Neisseria meningitidis Z2491
cguucaaacugcccga

SEQ ID NO: 1382349 - RNA, 16 nt, Neisseria meningitidis Z2491
cguggcaacuuccagc

SEQ ID NO: 1382350 - RNA, 15 nt, Neisseria meningitidis Z2491
cguuacaaauuuaaa

SEQ ID NO: 1382351 - RNA, 20 nt, Neisseria meningitidis Z2491
cguuuucgucuuugaaacgc

SEQ ID NO: 1382352 - RNA, 22 nt, Neisseria meningitidis Z2491
cguuuuacccucuccccgaccc

SEQ ID NO: 1382353 - RNA, 21 nt, Neisseria meningitidis Z2491
cguuuuuacgggaaugacgaa

SEQ ID NO: 1382354 - RNA, 14 nt, Neisseria meningitidis Z2491
cguuuuuccaaacc

SEQ ID NO: 1382355 - RNA, 15 nt, Neisseria meningitidis Z2491
cguuuuuuuccugcc

SEQ ID NO: 1382356 - RNA, 13 nt, Neisseria meningitidis Z2491
cuaaaauuuuaug

SEQ ID NO: 1382357 - RNA, 15 nt, Neisseria meningitidis Z2491
cguuuggcaagguuc

SEQ ID NO: 1382358 - RNA, 20 nt, Neisseria meningitidis Z2491
cguuucuagauucccacuuu

SEQ ID NO: 1382359 - RNA, 12 nt, Neisseria meningitidis Z2491
cguuuuaauucg

SEQ ID NO: 1382360 - RNA, 18 nt, Neisseria meningitidis Z2491
cguuguauaguggauuaa

SEQ ID NO: 1382361 - RNA, 22 nt, Neisseria meningitidis Z2491
cuaacaaauaauguucaaugaa

SEQ ID NO: 1382362 - RNA, 15 nt, Neisseria meningitidis Z2491
cuaaaccgucauucc

SEQ ID NO: 1382363 - RNA, 17 nt, Neisseria meningitidis Z2491
cuaaccgaaaaaauaau

SEQ ID NO: 1382364 - RNA, 18 nt, Neisseria meningitidis Z2491
cuaaccgaaaaaauaauu

SEQ ID NO: 1382365 - RNA, 18 nt, Neisseria meningitidis Z2491
cuaaccgauggaugaaca

SEQ ID NO: 1382366 - RNA, 12 nt, Neisseria meningitidis Z2491
cuaaggcgagcc

SEQ ID NO: 1382367 - RNA, 13 nt, Neisseria meningitidis Z2491
cuaaggcgaggca

SEQ ID NO: 1382368 - RNA, 18 nt, Neisseria meningitidis Z2491
cuaaggcgaggcaacgac

SEQ ID NO: 1382369 - RNA, 20 nt, Neisseria meningitidis Z2491
cuaaggugcugaagcaccaa

SEQ ID NO: 1382370 - RNA, 18 nt, Neisseria meningitidis Z2491
cuaaggugaggcaacgcu

SEQ ID NO: 1382371 - RNA, 15 nt, Neisseria meningitidis Z2491
cuaagauauaacuuu

SEQ ID NO: 1382372 - RNA, 17 nt, Neisseria meningitidis Z2491
cuaaugcuuucgcuuuu

SEQ ID NO: 1382373 - RNA, 13 nt, Neisseria meningitidis Z2491
cuaauucuaccca

SEQ ID NO: 1382374 - RNA, 13 nt, Neisseria meningitidis Z2491
cuaauuuuuauag

SEQ ID NO: 1382375 - RNA, 17 nt, Neisseria meningitidis Z2491
cuaauuuuuauagugga

SEQ ID NO: 1382376 - RNA, 18 nt, Neisseria meningitidis Z2491
cgucgggauucagauguu

SEQ ID NO: 1382377 - RNA, 21 nt, Neisseria meningitidis Z2491
cgucgggcaacucgauuuccg

SEQ ID NO: 1382378 - RNA, 14 nt, Neisseria meningitidis Z2491
cgugaauuaaaugc

SEQ ID NO: 1382379 - RNA, 15 nt, Neisseria meningitidis Z2491
cgucuuuaaucaggc

SEQ ID NO: 1382380 - RNA, 13 nt, Neisseria meningitidis Z2491
cgugccuucuucg

SEQ ID NO: 1382381 - RNA, 22 nt, Neisseria meningitidis Z2491
cguauuugcuguuggggaagcg

SEQ ID NO: 1382382 - RNA, 15 nt, Neisseria meningitidis Z2491
cgucaaaaacgggcu

SEQ ID NO: 1382383 - RNA, 18 nt, Neisseria meningitidis Z2491
cgucaggcacgaagcccu

SEQ ID NO: 1382384 - RNA, 21 nt, Neisseria meningitidis Z2491
cgucaggcacgcgcugcggca

SEQ ID NO: 1382385 - RNA, 22 nt, Neisseria meningitidis Z2491
cgucauuccucaaaaacagaaa

SEQ ID NO: 1382386 - RNA, 19 nt, Neisseria meningitidis Z2491
cgucauucccgcaaaaaca

SEQ ID NO: 1382387 - RNA, 15 nt, Neisseria meningitidis Z2491
cguccgccauuucca

SEQ ID NO: 1382388 - RNA, 14 nt, Neisseria meningitidis Z2491
cguaggcggcggcc

SEQ ID NO: 1382389 - RNA, 12 nt, Neisseria meningitidis Z2491
cguauauuuccc

SEQ ID NO: 1382390 - RNA, 13 nt, Neisseria meningitidis Z2491
cguaauuuuucuc

SEQ ID NO: 1382391 - RNA, 15 nt, Neisseria meningitidis Z2491
cguaccguccaaacu

SEQ ID NO: 1382392 - RNA, 13 nt, Neisseria meningitidis Z2491
cguacccacgccc

SEQ ID NO: 1382393 - RNA, 16 nt, Neisseria meningitidis Z2491
cuacccaaaaggaagu

SEQ ID NO: 1382394 - RNA, 16 nt, Neisseria meningitidis Z2491
cuacccaaauaccccc

SEQ ID NO: 1382395 - RNA, 14 nt, Neisseria meningitidis Z2491
cuacccaaaucccc

SEQ ID NO: 1382396 - RNA, 14 nt, Neisseria meningitidis Z2491
cuaccguuuccucc

SEQ ID NO: 1382397 - RNA, 19 nt, Neisseria meningitidis Z2491
cuagacauucaaugcuaag

SEQ ID NO: 1382398 - RNA, 21 nt, Neisseria meningitidis Z2491
cuagacauucaaugcuaaggc

SEQ ID NO: 1382399 - RNA, 18 nt, Neisseria meningitidis Z2491
cuacgcgggaaugacgag

SEQ ID NO: 1382400 - RNA, 21 nt, Neisseria meningitidis Z2491
cuauaaaaggucuuuucuaaa

SEQ ID NO: 1382401 - RNA, 15 nt, Neisseria meningitidis Z2491
cuauaaaauuggaaa

SEQ ID NO: 1382402 - RNA, 16 nt, Neisseria meningitidis Z2491
cuaggacacugcccuu

SEQ ID NO: 1382403 - RNA, 15 nt, Neisseria meningitidis Z2491
cucagcuaugccugc

SEQ ID NO: 1382404 - RNA, 21 nt, Neisseria meningitidis Z2491
cucagcccgaaauaggcugcc

SEQ ID NO: 1382405 - RNA, 18 nt, Neisseria meningitidis Z2491
cucaaucuuauuuucaaa

SEQ ID NO: 1382406 - RNA, 18 nt, Neisseria meningitidis Z2491
cucaaaguuauuaaguga

SEQ ID NO: 1382407 - RNA, 18 nt, Neisseria meningitidis Z2491
cucaaucucauuuucaaa

SEQ ID NO: 1382408 - RNA, 23 nt, Neisseria meningitidis Z2491
cucaaucucauuuucaaaaugca

SEQ ID NO: 1382409 - RNA, 14 nt, Neisseria meningitidis Z2491
cucaaagagaacga

SEQ ID NO: 1382410 - RNA, 23 nt, Neisseria meningitidis Z2491
cucaaaaaaccggauucccgccu

SEQ ID NO: 1382411 - RNA, 22 nt, Neisseria meningitidis Z2491
cuauuuguacugucugcggcuc

SEQ ID NO: 1382412 - RNA, 14 nt, Neisseria meningitidis Z2491
cucaaaaaaacuag

SEQ ID NO: 1382413 - RNA, 19 nt, Neisseria meningitidis Z2491
cucaaaaacagaaaaccaa

SEQ ID NO: 1382414 - RNA, 17 nt, Neisseria meningitidis Z2491
cuauuuuugugaaaaua

SEQ ID NO: 1382415 - RNA, 10 nt, Neisseria meningitidis Z2491
cuauuuuugu

SEQ ID NO: 1382416 - RNA, 21 nt, Neisseria meningitidis Z2491
cuauuuuucugaaaaauuuau

SEQ ID NO: 1382417 - RNA, 13 nt, Neisseria meningitidis Z2491
cucguuauuucca

SEQ ID NO: 1382418 - RNA, 16 nt, Neisseria meningitidis Z2491
cucguuauuuccacaa

SEQ ID NO: 1382419 - RNA, 14 nt, Neisseria meningitidis Z2491
cucguucggcagcc

SEQ ID NO: 1382420 - RNA, 17 nt, Neisseria meningitidis Z2491
cucguuucccgcuccaa

SEQ ID NO: 1382421 - RNA, 17 nt, Neisseria meningitidis Z2491
cucguuuuccgcuccaa

SEQ ID NO: 1382422 - RNA, 20 nt, Neisseria meningitidis Z2491
cucuaaggugcugaagcacc

SEQ ID NO: 1382423 - RNA, 19 nt, Neisseria meningitidis Z2491
cucgggcugaaucgccaau

SEQ ID NO: 1382424 - RNA, 16 nt, Neisseria meningitidis Z2491
cucggggucaagcgcg

SEQ ID NO: 1382425 - RNA, 21 nt, Neisseria meningitidis Z2491
cucgccgaacgagccguaacc

SEQ ID NO: 1382426 - RNA, 23 nt, Neisseria meningitidis Z2491
cucgccuugccguacuaucugua

SEQ ID NO: 1382427 - RNA, 20 nt, Neisseria meningitidis Z2491
cuccguaucggcauauguuu

SEQ ID NO: 1382428 - RNA, 14 nt, Neisseria meningitidis Z2491
cuccguaaauuguc

SEQ ID NO: 1382429 - RNA, 21 nt, Neisseria meningitidis Z2491
cuccguaaauuguccauuuuu

SEQ ID NO: 1382430 - RNA, 23 nt, Neisseria meningitidis Z2491
cucccgugggagagggugaggga

SEQ ID NO: 1382431 - RNA, 13 nt, Neisseria meningitidis Z2491
cucccaaauaaag

SEQ ID NO: 1382432 - RNA, 18 nt, Neisseria meningitidis Z2491
cucauugagcuauuuguc

SEQ ID NO: 1382433 - RNA, 12 nt, Neisseria meningitidis Z2491
cucauucaaucc

SEQ ID NO: 1382434 - RNA, 15 nt, Neisseria meningitidis Z2491
cucauugguaaacag

SEQ ID NO: 1382435 - RNA, 20 nt, Neisseria meningitidis Z2491
cuccaaaggagcaauuaaau

SEQ ID NO: 1382436 - RNA, 16 nt, Neisseria meningitidis Z2491
cuccacuaaaaaaucc

SEQ ID NO: 1382437 - RNA, 19 nt, Neisseria meningitidis Z2491
cuccaaguuccaauacauu

SEQ ID NO: 1382438 - RNA, 13 nt, Neisseria meningitidis Z2491
aaaaaaaccgaaa

SEQ ID NO: 1382439 - RNA, 19 nt, Neisseria meningitidis Z2491
aaaaaaccgaaguuuaaag

SEQ ID NO: 1382440 - RNA, 16 nt, Neisseria meningitidis Z2491
aaaaaaccaaaacaga

SEQ ID NO: 1382441 - RNA, 11 nt, Neisseria meningitidis Z2491
aaaaacaaaaa

SEQ ID NO: 1382442 - RNA, 12 nt, Neisseria meningitidis Z2491
aaaaacaaaaaa

SEQ ID NO: 1382443 - RNA, 13 nt, Neisseria meningitidis Z2491
aaaaaauuuucaa

SEQ ID NO: 1382444 - RNA, 13 nt, Neisseria meningitidis Z2491
aaaaacaacugaa

SEQ ID NO: 1382445 - RNA, 14 nt, Neisseria meningitidis Z2491
aaaaagccagcagc

SEQ ID NO: 1382446 - RNA, 16 nt, Neisseria meningitidis Z2491
aaaaagccagcagcag

SEQ ID NO: 1382447 - RNA, 19 nt, Neisseria meningitidis Z2491
aaaaagccgccggaagauu

SEQ ID NO: 1382448 - RNA, 16 nt, Neisseria meningitidis Z2491
aaaaagcuggauuccc

SEQ ID NO: 1382449 - RNA, 20 nt, Neisseria meningitidis Z2491
aaaaaguaggagaaaucaga

SEQ ID NO: 1382450 - RNA, 21 nt, Neisseria meningitidis Z2491
aaaaaguaggagaaaucagaa

SEQ ID NO: 1382451 - RNA, 20 nt, Neisseria meningitidis Z2491
aaaaacgacgagaauuuauc

SEQ ID NO: 1382452 - RNA, 20 nt, Neisseria meningitidis Z2491
aaaaaccggcucaauauauu

SEQ ID NO: 1382453 - RNA, 22 nt, Neisseria meningitidis Z2491
aaaaaccggauuuauuuuagaa

SEQ ID NO: 1382454 - RNA, 15 nt, Neisseria meningitidis Z2491
aaaaacuggauuccc

SEQ ID NO: 1382455 - RNA, 14 nt, Neisseria meningitidis Z2491
aaaaaccuaaaauc

SEQ ID NO: 1382456 - RNA, 22 nt, Neisseria meningitidis Z2491
aaaaaccggccggaaaaccuug

SEQ ID NO: 1382457 - RNA, 13 nt, Neisseria meningitidis Z2491
aaaaaccggcuca

SEQ ID NO: 1382458 - RNA, 15 nt, Neisseria meningitidis Z2491
aaaaaccugcuuguu

SEQ ID NO: 1382459 - RNA, 13 nt, Neisseria meningitidis Z2491
aaaaaucaaaaac

SEQ ID NO: 1382460 - RNA, 23 nt, Neisseria meningitidis Z2491
aaaaaucuguggauaaacauuau

SEQ ID NO: 1382461 - RNA, 18 nt, Neisseria meningitidis Z2491
aaaaaugacugaagcuca

SEQ ID NO: 1382462 - RNA, 10 nt, Neisseria meningitidis Z2491
aaaaaugccu

SEQ ID NO: 1382463 - RNA, 19 nt, Neisseria meningitidis Z2491
aaaaaugcgccaaaaaauu

SEQ ID NO: 1382464 - RNA, 20 nt, Neisseria meningitidis Z2491
aaaaaugcgccaaaaaauuu

SEQ ID NO: 1382465 - RNA, 21 nt, Neisseria meningitidis Z2491
aaaaaugcuuaaucaaaucuu

SEQ ID NO: 1382466 - RNA, 13 nt, Neisseria meningitidis Z2491
aaaaauuuaugaa

SEQ ID NO: 1382467 - RNA, 17 nt, Neisseria meningitidis Z2491
aaaaauucuaacucuau

SEQ ID NO: 1382468 - RNA, 18 nt, Neisseria meningitidis Z2491
aaaaccugcaucccguca

SEQ ID NO: 1382469 - RNA, 20 nt, Neisseria meningitidis Z2491
aaaaccuuccuaauauugag

SEQ ID NO: 1382470 - RNA, 17 nt, Neisseria meningitidis Z2491
aaaaccgauaaacaaca

SEQ ID NO: 1382471 - RNA, 19 nt, Neisseria meningitidis Z2491
aaaaccggccggaaaaccu

SEQ ID NO: 1382472 - RNA, 13 nt, Neisseria meningitidis Z2491
aaaaccaguacag

SEQ ID NO: 1382473 - RNA, 18 nt, Neisseria meningitidis Z2491
aaaacagguuuaagucaa

SEQ ID NO: 1382474 - RNA, 13 nt, Neisseria meningitidis Z2491
aaaacagcugaaa

SEQ ID NO: 1382475 - RNA, 22 nt, Neisseria meningitidis Z2491
aaaacaggaaucggguuucaga

SEQ ID NO: 1382476 - RNA, 19 nt, Neisseria meningitidis Z2491
aaaacaacaaugcaaagaa

SEQ ID NO: 1382477 - RNA, 20 nt, Neisseria meningitidis Z2491
aaaacaaaaaaaaucaaaaa

SEQ ID NO: 1382478 - RNA, 15 nt, Neisseria meningitidis Z2491
aaaacaaaaaaucaa

SEQ ID NO: 1382479 - RNA, 18 nt, Neisseria meningitidis Z2491
aaaacaaaaaaucaaaaa

SEQ ID NO: 1382480 - RNA, 11 nt, Neisseria meningitidis Z2491
aaaacaaaaau

SEQ ID NO: 1382481 - RNA, 20 nt, Neisseria meningitidis Z2491
aaaacaaaguugcaauauac

SEQ ID NO: 1382482 - RNA, 9 nt, Neisseria meningitidis Z2491
aaaacaaau

SEQ ID NO: 1382483 - RNA, 14 nt, Neisseria meningitidis Z2491
aaacagcaauccau

SEQ ID NO: 1382484 - RNA, 12 nt, Neisseria meningitidis Z2491
aaacagcaaaaa

SEQ ID NO: 1382485 - RNA, 15 nt, Neisseria meningitidis Z2491
aaacagauaaaacca

SEQ ID NO: 1382486 - RNA, 18 nt, Neisseria meningitidis Z2491
aaacagaaaaccaaaaac

SEQ ID NO: 1382487 - RNA, 18 nt, Neisseria meningitidis Z2491
aaacagaaaaccaaaauc

SEQ ID NO: 1382488 - RNA, 16 nt, Neisseria meningitidis Z2491
aaacagaaacccaaaa

SEQ ID NO: 1382489 - RNA, 16 nt, Neisseria meningitidis Z2491
aaacagaaaccuaaaa

SEQ ID NO: 1382490 - RNA, 14 nt, Neisseria meningitidis Z2491
aaacagaaaaacaa

SEQ ID NO: 1382491 - RNA, 16 nt, Neisseria meningitidis Z2491
aaacagaaagccaaaa

SEQ ID NO: 1382492 - RNA, 16 nt, Neisseria meningitidis Z2491
aaacagcguuuucauu

SEQ ID NO: 1382493 - RNA, 16 nt, Neisseria meningitidis Z2491
aaacagcugaaaaccu

SEQ ID NO: 1382494 - RNA, 18 nt, Neisseria meningitidis Z2491
aaacagccgaaaacagcu

SEQ ID NO: 1382495 - RNA, 12 nt, Neisseria meningitidis Z2491
aaacagccaggc

SEQ ID NO: 1382496 - RNA, 19 nt, Neisseria meningitidis Z2491
aaacagcauauagccgagc

SEQ ID NO: 1382497 - RNA, 16 nt, Neisseria meningitidis Z2491
aaacagcacugccucu

SEQ ID NO: 1382498 - RNA, 22 nt, Neisseria meningitidis Z2491
aaacagguuuaagucaauguuu

SEQ ID NO: 1382499 - RNA, 17 nt, Neisseria meningitidis Z2491
aaacagguuucagacgg

SEQ ID NO: 1382500 - RNA, 20 nt, Neisseria meningitidis Z2491
aaacaggcagccuaaaacau

SEQ ID NO: 1382501 - RNA, 19 nt, Neisseria meningitidis Z2491
aaacauaugccgucugaaa

SEQ ID NO: 1382502 - RNA, 16 nt, Neisseria meningitidis Z2491
aaacaucacggucuuu

SEQ ID NO: 1382503 - RNA, 19 nt, Neisseria meningitidis Z2491
aaacaucacggucuuuuug

SEQ ID NO: 1382504 - RNA, 22 nt, Neisseria meningitidis Z2491
aaacaucacggucuuuuugcuu

SEQ ID NO: 1382505 - RNA, 14 nt, Neisseria meningitidis Z2491
aaacaguuucagca

SEQ ID NO: 1382506 - RNA, 14 nt, Neisseria meningitidis Z2491
aaaauucuucuuuc

SEQ ID NO: 1382507 - RNA, 13 nt, Neisseria meningitidis Z2491
aaacacgggguuu

SEQ ID NO: 1382508 - RNA, 16 nt, Neisseria meningitidis Z2491
aaacacgggguuuauc

SEQ ID NO: 1382509 - RNA, 14 nt, Neisseria meningitidis Z2491
aaacacuguucaga

SEQ ID NO: 1382510 - RNA, 13 nt, Neisseria meningitidis Z2491
aaacacaaaacug

SEQ ID NO: 1382511 - RNA, 15 nt, Neisseria meningitidis Z2491
aaacauuacugaaau

SEQ ID NO: 1382512 - RNA, 14 nt, Neisseria meningitidis Z2491
aaacaucugauuuu

SEQ ID NO: 1382513 - RNA, 15 nt, Neisseria meningitidis Z2491
aaacaucguuugcau

SEQ ID NO: 1382514 - RNA, 22 nt, Neisseria meningitidis Z2491
aaaccaaaagccaaaaaacaca

SEQ ID NO: 1382515 - RNA, 15 nt, Neisseria meningitidis Z2491
aaaccaaaaaacaac

SEQ ID NO: 1382516 - RNA, 12 nt, Neisseria meningitidis Z2491
aaacauuuuugc

SEQ ID NO: 1382517 - RNA, 22 nt, Neisseria meningitidis Z2491
aaaccagcccgauaagcuguuu

SEQ ID NO: 1382518 - RNA, 12 nt, Neisseria meningitidis Z2491
aaacccgaacca

SEQ ID NO: 1382519 - RNA, 22 nt, Neisseria meningitidis Z2491
aaacccgccugagcaaaugccu

SEQ ID NO: 1382520 - RNA, 23 nt, Neisseria meningitidis Z2491
aaacccgccugagcaaaugccuu

SEQ ID NO: 1382521 - RNA, 13 nt, Neisseria meningitidis Z2491
aaacccaaacaca

SEQ ID NO: 1382522 - RNA, 15 nt, Neisseria meningitidis Z2491
aaaccgaaacagaaa

SEQ ID NO: 1382523 - RNA, 14 nt, Neisseria meningitidis Z2491
aaaccgccauuccc

SEQ ID NO: 1382524 - RNA, 13 nt, Neisseria meningitidis Z2491
aaaccggcauucu

SEQ ID NO: 1382525 - RNA, 17 nt, Neisseria meningitidis Z2491
aaaccggauucccgccu

SEQ ID NO: 1382526 - RNA, 13 nt, Neisseria meningitidis Z2491
aaaccggcuugaa

SEQ ID NO: 1382527 - RNA, 19 nt, Neisseria meningitidis Z2491
aaaccggucggaagaucau

SEQ ID NO: 1382528 - RNA, 14 nt, Neisseria meningitidis Z2491
aaaaccuuucagac

SEQ ID NO: 1382529 - RNA, 23 nt, Neisseria meningitidis Z2491
aaaaccuuucccguuucagacgg

SEQ ID NO: 1382530 - RNA, 23 nt, Neisseria meningitidis Z2491
aaaacgacgagaauuuaucagaa

SEQ ID NO: 1382531 - RNA, 16 nt, Neisseria meningitidis Z2491
aaaacgccuucuucgc

SEQ ID NO: 1382532 - RNA, 13 nt, Neisseria meningitidis Z2491
aaaacgccgucug

SEQ ID NO: 1382533 - RNA, 16 nt, Neisseria meningitidis Z2491
aaaacgccgucugaaa

SEQ ID NO: 1382534 - RNA, 17 nt, Neisseria meningitidis Z2491
aaaacgccgucugaaau

SEQ ID NO: 1382535 - RNA, 16 nt, Neisseria meningitidis Z2491
aaaagcgggaauccaa

SEQ ID NO: 1382536 - RNA, 17 nt, Neisseria meningitidis Z2491
aaaaacuuuucugauuu

SEQ ID NO: 1382537 - RNA, 23 nt, Neisseria meningitidis Z2491
aaaaacuuuucugauuuugagaa

SEQ ID NO: 1382538 - RNA, 15 nt, Neisseria meningitidis Z2491
aaaaggucuuuucua

SEQ ID NO: 1382539 - RNA, 18 nt, Neisseria meningitidis Z2491
aaaaggaaauacgauaaa

SEQ ID NO: 1382540 - RNA, 21 nt, Neisseria meningitidis Z2491
aaaaggacguagucggugcuu

SEQ ID NO: 1382541 - RNA, 14 nt, Neisseria meningitidis Z2491
aaaauaaaguaauu

SEQ ID NO: 1382542 - RNA, 19 nt, Neisseria meningitidis Z2491
aaaaguuuugcauuuugaa

SEQ ID NO: 1382543 - RNA, 21 nt, Neisseria meningitidis Z2491
aaaaugguaucgggcauaaaa

SEQ ID NO: 1382544 - RNA, 14 nt, Neisseria meningitidis Z2491
aaaaugagauugag

SEQ ID NO: 1382545 - RNA, 15 nt, Neisseria meningitidis Z2491
aaaaugugcauuucu

SEQ ID NO: 1382546 - RNA, 20 nt, Neisseria meningitidis Z2491
aaaaugugcauuucuaauuu

SEQ ID NO: 1382547 - RNA, 13 nt, Neisseria meningitidis Z2491
aaaaucagcacaa

SEQ ID NO: 1382548 - RNA, 19 nt, Neisseria meningitidis Z2491
aaaaucagcacaaaugcca

SEQ ID NO: 1382549 - RNA, 20 nt, Neisseria meningitidis Z2491
aaaaucagcacaaaugccaa

SEQ ID NO: 1382550 - RNA, 13 nt, Neisseria meningitidis Z2491
aaaaucagaaacc

SEQ ID NO: 1382551 - RNA, 14 nt, Neisseria meningitidis Z2491
aaaaucagaaaccu

SEQ ID NO: 1382552 - RNA, 14 nt, Neisseria meningitidis Z2491
aaaaucaaaaacac

SEQ ID NO: 1382553 - RNA, 15 nt, Neisseria meningitidis Z2491
aaaaucaaaaaaaaa

SEQ ID NO: 1382554 - RNA, 19 nt, Neisseria meningitidis Z2491
aaaaucucgucauucucgc

SEQ ID NO: 1382555 - RNA, 21 nt, Neisseria meningitidis Z2491
aaaauauucaauugacaaaaa

SEQ ID NO: 1382556 - RNA, 17 nt, Neisseria meningitidis Z2491
aaaauaugccgucauuc

SEQ ID NO: 1382557 - RNA, 18 nt, Neisseria meningitidis Z2491
aaaauaugccgucauucc

SEQ ID NO: 1382558 - RNA, 13 nt, Neisseria meningitidis Z2491
aaaauauuaauca

SEQ ID NO: 1382559 - RNA, 14 nt, Neisseria meningitidis Z2491
aaaauaugcagaga

SEQ ID NO: 1382560 - RNA, 23 nt, Neisseria meningitidis Z2491
aaaauaucuucuccgaccuauag

SEQ ID NO: 1382561 - RNA, 16 nt, Neisseria meningitidis Z2491
aaaauacauugggcau

SEQ ID NO: 1382562 - RNA, 15 nt, Neisseria meningitidis Z2491
aaagcauacggcuga

SEQ ID NO: 1382563 - RNA, 22 nt, Neisseria meningitidis Z2491
aaagccuaaauacaaaaggccg

SEQ ID NO: 1382564 - RNA, 24 nt, Neisseria meningitidis Z2491
aaagcaucuuguuuuucaaucaaa

SEQ ID NO: 1382565 - RNA, 18 nt, Neisseria meningitidis Z2491
aaagcggcaaucaaaucc

SEQ ID NO: 1382566 - RNA, 17 nt, Neisseria meningitidis Z2491
aaagcgggaaucuagaa

SEQ ID NO: 1382567 - RNA, 19 nt, Neisseria meningitidis Z2491
aaagcgggaaucuagaaac

SEQ ID NO: 1382568 - RNA, 18 nt, Neisseria meningitidis Z2491
aaagcgggguuggggaaa

SEQ ID NO: 1382569 - RNA, 15 nt, Neisseria meningitidis Z2491
aaaggagcaauuaaa

SEQ ID NO: 1382570 - RNA, 16 nt, Neisseria meningitidis Z2491
aaaggauguuugaguc

SEQ ID NO: 1382571 - RNA, 23 nt, Neisseria meningitidis Z2491
aaagcugcccgagauuacagaaa

SEQ ID NO: 1382572 - RNA, 18 nt, Neisseria meningitidis Z2491
aaagcuuccaacucggca

SEQ ID NO: 1382573 - RNA, 14 nt, Neisseria meningitidis Z2491
aaaggucuuuucua

SEQ ID NO: 1382574 - RNA, 18 nt, Neisseria meningitidis Z2491
aaaggucucuauuuguuc

SEQ ID NO: 1382575 - RNA, 17 nt, Neisseria meningitidis Z2491
aaagaugccgucugaaa

SEQ ID NO: 1382576 - RNA, 16 nt, Neisseria meningitidis Z2491
aaagauuaucugaaag

SEQ ID NO: 1382577 - RNA, 20 nt, Neisseria meningitidis Z2491
aaagauugagaccuuugcaa

SEQ ID NO: 1382578 - RNA, 21 nt, Neisseria meningitidis Z2491
aaagcaauuuaucggaaaaaa

SEQ ID NO: 1382579 - RNA, 22 nt, Neisseria meningitidis Z2491
aaagaacccaaaccgucauucc

SEQ ID NO: 1382580 - RNA, 14 nt, Neisseria meningitidis Z2491
aaagaaauguaaau

SEQ ID NO: 1382581 - RNA, 15 nt, Neisseria meningitidis Z2491
aaaccucaaaucccg

SEQ ID NO: 1382582 - RNA, 21 nt, Neisseria meningitidis Z2491
aaaccgucugccaaggauaga

SEQ ID NO: 1382583 - RNA, 14 nt, Neisseria meningitidis Z2491
aaaccgucauuccc

SEQ ID NO: 1382584 - RNA, 16 nt, Neisseria meningitidis Z2491
aaaccgucaaacaaaa

SEQ ID NO: 1382585 - RNA, 21 nt, Neisseria meningitidis Z2491
aaaccguuucagacggcauuu

SEQ ID NO: 1382586 - RNA, 13 nt, Neisseria meningitidis Z2491
aaauagaaaauau

SEQ ID NO: 1382587 - RNA, 18 nt, Neisseria meningitidis Z2491
aaauacccacaagcuaaa

SEQ ID NO: 1382588 - RNA, 21 nt, Neisseria meningitidis Z2491
aaauacccaaaugcagaauaa

SEQ ID NO: 1382589 - RNA, 12 nt, Neisseria meningitidis Z2491
aaauaauugaaa

SEQ ID NO: 1382590 - RNA, 19 nt, Neisseria meningitidis Z2491
aaauaauggccuuuucccu

SEQ ID NO: 1382591 - RNA, 21 nt, Neisseria meningitidis Z2491
aaauaauggccuuuucccuug

SEQ ID NO: 1382592 - RNA, 21 nt, Neisseria meningitidis Z2491
aaauaauugucuuuucccuug

SEQ ID NO: 1382593 - RNA, 23 nt, Neisseria meningitidis Z2491
aaauacaaaaggccgucugaaau

SEQ ID NO: 1382594 - RNA, 13 nt, Neisseria meningitidis Z2491
aaauauaaaaaau

SEQ ID NO: 1382595 - RNA, 23 nt, Neisseria meningitidis Z2491
aaauauaguggauuaacaaaaau

SEQ ID NO: 1382596 - RNA, 22 nt, Neisseria meningitidis Z2491
aaauauccggcaagccuuucaa

SEQ ID NO: 1382597 - RNA, 22 nt, Neisseria meningitidis Z2491
aaauaucgggguucucauccaa

SEQ ID NO: 1382598 - RNA, 16 nt, Neisseria meningitidis Z2491
aaauaucgucauuccc

SEQ ID NO: 1382599 - RNA, 14 nt, Neisseria meningitidis Z2491
aaagugccaaaugu

SEQ ID NO: 1382600 - RNA, 16 nt, Neisseria meningitidis Z2491
aaagugcgguaaauuu

SEQ ID NO: 1382601 - RNA, 20 nt, Neisseria meningitidis Z2491
aaaguuauucaauuuaaaca

SEQ ID NO: 1382602 - RNA, 21 nt, Neisseria meningitidis Z2491
aaaguuauucaauuuaaacac

SEQ ID NO: 1382603 - RNA, 17 nt, Neisseria meningitidis Z2491
aaaguuuugcauuuuga

SEQ ID NO: 1382604 - RNA, 12 nt, Neisseria meningitidis Z2491
aaauaaaacaaa

SEQ ID NO: 1382605 - RNA, 15 nt, Neisseria meningitidis Z2491
aaaugguaucgggca

SEQ ID NO: 1382606 - RNA, 16 nt, Neisseria meningitidis Z2491
aaauggcaguaucaau

SEQ ID NO: 1382607 - RNA, 18 nt, Neisseria meningitidis Z2491
aaaugcagaauaaggcaa

SEQ ID NO: 1382608 - RNA, 20 nt, Neisseria meningitidis Z2491
aaaugcacgguuacacaaau

SEQ ID NO: 1382609 - RNA, 20 nt, Neisseria meningitidis Z2491
aaaugauacgcgacaauaaa

SEQ ID NO: 1382610 - RNA, 21 nt, Neisseria meningitidis Z2491
aaauuagacggcaucuuccuu

SEQ ID NO: 1382611 - RNA, 21 nt, Neisseria meningitidis Z2491
aaauuaaaauaaaaccgauaa

SEQ ID NO: 1382612 - RNA, 22 nt, Neisseria meningitidis Z2491
aaauuaagcgugacgaaaauuu

SEQ ID NO: 1382613 - RNA, 14 nt, Neisseria meningitidis Z2491
aaaugacugaaacu

SEQ ID NO: 1382614 - RNA, 16 nt, Neisseria meningitidis Z2491
aaaugacugaaacuca

SEQ ID NO: 1382615 - RNA, 18 nt, Neisseria meningitidis Z2491
aaaugacugaaacucaaa

SEQ ID NO: 1382616 - RNA, 22 nt, Neisseria meningitidis Z2491
aaaugacugaaacucaacgaac

SEQ ID NO: 1382617 - RNA, 20 nt, Neisseria meningitidis Z2491
aaaugacugaaauucaaaaa

SEQ ID NO: 1382618 - RNA, 21 nt, Neisseria meningitidis Z2491
aaaugacugaaauucaaaaaa

SEQ ID NO: 1382619 - RNA, 14 nt, Neisseria meningitidis Z2491
aaaucggcuuucag

SEQ ID NO: 1382620 - RNA, 16 nt, Neisseria meningitidis Z2491
aaaucggcuuucagac

SEQ ID NO: 1382621 - RNA, 17 nt, Neisseria meningitidis Z2491
aaaucugauaagcaagc

SEQ ID NO: 1382622 - RNA, 11 nt, Neisseria meningitidis Z2491
aaaucucuugc

SEQ ID NO: 1382623 - RNA, 23 nt, Neisseria meningitidis Z2491
aaaucucguuauccauacaagaa

SEQ ID NO: 1382624 - RNA, 14 nt, Neisseria meningitidis Z2491
aaaucgucauuccc

SEQ ID NO: 1382625 - RNA, 17 nt, Neisseria meningitidis Z2491
aaaucuggauuacugau

SEQ ID NO: 1382626 - RNA, 16 nt, Neisseria meningitidis Z2491
aaaucuugcaaacccc

SEQ ID NO: 1382627 - RNA, 16 nt, Neisseria meningitidis Z2491
aaauccccccuuaauc

SEQ ID NO: 1382628 - RNA, 12 nt, Neisseria meningitidis Z2491
aaauauggcuga

SEQ ID NO: 1382629 - RNA, 12 nt, Neisseria meningitidis Z2491
aaauccaaaaau

SEQ ID NO: 1382630 - RNA, 14 nt, Neisseria meningitidis Z2491
aaauccaaaaauac

SEQ ID NO: 1382631 - RNA, 23 nt, Neisseria meningitidis Z2491
aaauccgccaaaaacggcacggc

SEQ ID NO: 1382632 - RNA, 21 nt, Neisseria meningitidis Z2491
aaauccgccguauccauugcc

SEQ ID NO: 1382633 - RNA, 14 nt, Neisseria meningitidis Z2491
aaauccgccugucu

SEQ ID NO: 1382634 - RNA, 20 nt, Neisseria meningitidis Z2491
aaaucccuguguccuuauuu

SEQ ID NO: 1382635 - RNA, 15 nt, Neisseria meningitidis Z2491
aaauccgucauuccc

SEQ ID NO: 1382636 - RNA, 20 nt, Neisseria meningitidis Z2491
aaaucggauaggcaaaaacc

SEQ ID NO: 1382637 - RNA, 15 nt, Neisseria meningitidis Z2491
aaauccugcugcugg

SEQ ID NO: 1382638 - RNA, 17 nt, Neisseria meningitidis Z2491
aaauccugcuuauugca

SEQ ID NO: 1382639 - RNA, 14 nt, Neisseria meningitidis Z2491
aacaagaaaugaua

SEQ ID NO: 1382640 - RNA, 13 nt, Neisseria meningitidis Z2491
aacaacaaauuuu

SEQ ID NO: 1382641 - RNA, 20 nt, Neisseria meningitidis Z2491
aacaacaucagcucgggcug

SEQ ID NO: 1382642 - RNA, 13 nt, Neisseria meningitidis Z2491
aacaacaguaaua

SEQ ID NO: 1382643 - RNA, 17 nt, Neisseria meningitidis Z2491
aacaacaggaauuuauc

SEQ ID NO: 1382644 - RNA, 20 nt, Neisseria meningitidis Z2491
aacaacaggaauuuauccga

SEQ ID NO: 1382645 - RNA, 16 nt, Neisseria meningitidis Z2491
aacaaauuuuugauuu

SEQ ID NO: 1382646 - RNA, 14 nt, Neisseria meningitidis Z2491
aacaacagaaacca

SEQ ID NO: 1382647 - RNA, 11 nt, Neisseria meningitidis Z2491
aacaaauaccc

SEQ ID NO: 1382648 - RNA, 16 nt, Neisseria meningitidis Z2491
aaauuuuuaaaaccgu

SEQ ID NO: 1382649 - RNA, 13 nt, Neisseria meningitidis Z2491
aaauuuuuaaauu

SEQ ID NO: 1382650 - RNA, 13 nt, Neisseria meningitidis Z2491
aaauuuugccauu

SEQ ID NO: 1382651 - RNA, 15 nt, Neisseria meningitidis Z2491
aaauuuuugccgugu

SEQ ID NO: 1382652 - RNA, 20 nt, Neisseria meningitidis Z2491
aaauuuuuggcgcauuuuua

SEQ ID NO: 1382653 - RNA, 23 nt, Neisseria meningitidis Z2491
aaauuuuuggcgcauuuuuaugc

SEQ ID NO: 1382654 - RNA, 12 nt, Neisseria meningitidis Z2491
aacaaaaaccag

SEQ ID NO: 1382655 - RNA, 16 nt, Neisseria meningitidis Z2491
aacaaaaaccaguaca

SEQ ID NO: 1382656 - RNA, 12 nt, Neisseria meningitidis Z2491
aacaaaaaauau

SEQ ID NO: 1382657 - RNA, 17 nt, Neisseria meningitidis Z2491
aacaaacaggcagccua

SEQ ID NO: 1382658 - RNA, 20 nt, Neisseria meningitidis Z2491
aacaaaauguucagacggca

SEQ ID NO: 1382659 - RNA, 16 nt, Neisseria meningitidis Z2491
aaauuuaaaagggaac

SEQ ID NO: 1382660 - RNA, 16 nt, Neisseria meningitidis Z2491
aaauuuauaaacaaaa

SEQ ID NO: 1382661 - RNA, 19 nt, Neisseria meningitidis Z2491
aaauuuauccgaaaucaca

SEQ ID NO: 1382662 - RNA, 14 nt, Neisseria meningitidis Z2491
aaauuuauuaugua

SEQ ID NO: 1382663 - RNA, 11 nt, Neisseria meningitidis Z2491
aaauuuuaugc

SEQ ID NO: 1382664 - RNA, 17 nt, Neisseria meningitidis Z2491
aaauugccaacaccguu

SEQ ID NO: 1382665 - RNA, 12 nt, Neisseria meningitidis Z2491
aaauuccagcaa

SEQ ID NO: 1382666 - RNA, 20 nt, Neisseria meningitidis Z2491
aaauugaaauucgucauucc

SEQ ID NO: 1382667 - RNA, 11 nt, Neisseria meningitidis Z2491
caacugaaacc

SEQ ID NO: 1382668 - RNA, 21 nt, Neisseria meningitidis Z2491
caacugauuguuuuucagaga

SEQ ID NO: 1382669 - RNA, 23 nt, Neisseria meningitidis Z2491
caacugauuguuuuucagagaaa

SEQ ID NO: 1382670 - RNA, 23 nt, Neisseria meningitidis Z2491
caacgccucgccgaacgagccgu

SEQ ID NO: 1382671 - RNA, 22 nt, Neisseria meningitidis Z2491
caacuuuuuucgauaugaaaag

SEQ ID NO: 1382672 - RNA, 15 nt, Neisseria meningitidis Z2491
caagcaauaccgcaa

SEQ ID NO: 1382673 - RNA, 16 nt, Neisseria meningitidis Z2491
caagcccugaaaggga

SEQ ID NO: 1382674 - RNA, 16 nt, Neisseria meningitidis Z2491
caagcguucacgccag

SEQ ID NO: 1382675 - RNA, 21 nt, Neisseria meningitidis Z2491
caagcguucacgccagcaaca

SEQ ID NO: 1382676 - RNA, 15 nt, Neisseria meningitidis Z2491
caaggcgacagccgc

SEQ ID NO: 1382677 - RNA, 13 nt, Neisseria meningitidis Z2491
caaggcggcggcg

SEQ ID NO: 1382678 - RNA, 23 nt, Neisseria meningitidis Z2491
caaggcggcggcguucaaaucau

SEQ ID NO: 1382679 - RNA, 23 nt, Neisseria meningitidis Z2491
caaggcggcgggauugugaucga

SEQ ID NO: 1382680 - RNA, 17 nt, Neisseria meningitidis Z2491
caaggucgaggaaauuc

SEQ ID NO: 1382681 - RNA, 16 nt, Neisseria meningitidis Z2491
caauagccaaaaauuc

SEQ ID NO: 1382682 - RNA, 11 nt, Neisseria meningitidis Z2491
caauaccaaac

SEQ ID NO: 1382683 - RNA, 19 nt, Neisseria meningitidis Z2491
caauaugcggcaggccaaa

SEQ ID NO: 1382684 - RNA, 16 nt, Neisseria meningitidis Z2491
caauauaacgacugua

SEQ ID NO: 1382685 - RNA, 20 nt, Neisseria meningitidis Z2491
caauauuaagaaaaacagca

SEQ ID NO: 1382686 - RNA, 21 nt, Neisseria meningitidis Z2491
caauauuaagaaaaacagcaa

SEQ ID NO: 1382687 - RNA, 23 nt, Neisseria meningitidis Z2491
caagguucggacggcguuuuuua

SEQ ID NO: 1382688 - RNA, 21 nt, Neisseria meningitidis Z2491
caauaacauagguuacuaaaa

SEQ ID NO: 1382689 - RNA, 17 nt, Neisseria meningitidis Z2491
caaugcgccgauuuucc

SEQ ID NO: 1382690 - RNA, 15 nt, Neisseria meningitidis Z2491
caaugccgucugaau

SEQ ID NO: 1382691 - RNA, 14 nt, Neisseria meningitidis Z2491
caaugccguuaaug

SEQ ID NO: 1382692 - RNA, 15 nt, Neisseria meningitidis Z2491
caaugcaaaaacauc

SEQ ID NO: 1382693 - RNA, 20 nt, Neisseria meningitidis Z2491
caaugaggcaauagaagcca

SEQ ID NO: 1382694 - RNA, 21 nt, Neisseria meningitidis Z2491
caauccgcccgaauaaaaaau

SEQ ID NO: 1382695 - RNA, 16 nt, Neisseria meningitidis Z2491
caauauucauacugug

SEQ ID NO: 1382696 - RNA, 21 nt, Neisseria meningitidis Z2491
caauauucuuugaaaacaggu

SEQ ID NO: 1382697 - RNA, 19 nt, Neisseria meningitidis Z2491
caauauugcuccugacggc

SEQ ID NO: 1382698 - RNA, 22 nt, Neisseria meningitidis Z2491
caauccggucuuggcagcagau

SEQ ID NO: 1382699 - RNA, 13 nt, Neisseria meningitidis Z2491
caauccugccuuc

SEQ ID NO: 1382700 - RNA, 22 nt, Neisseria meningitidis Z2491
caauccugcacgcgcuucaaau

SEQ ID NO: 1382701 - RNA, 18 nt, Neisseria meningitidis Z2491
caaucggcucgccgccuu

SEQ ID NO: 1382702 - RNA, 16 nt, Neisseria meningitidis Z2491
caaccaacgaaacacu

SEQ ID NO: 1382703 - RNA, 12 nt, Neisseria meningitidis Z2491
caaccaaaaccg

SEQ ID NO: 1382704 - RNA, 18 nt, Neisseria meningitidis Z2491
caaccaaaaucaucacgc

SEQ ID NO: 1382705 - RNA, 23 nt, Neisseria meningitidis Z2491
caaccaaaaaaucugauaagcaa

SEQ ID NO: 1382706 - RNA, 17 nt, Neisseria meningitidis Z2491
caacauaaccgaaaccu

SEQ ID NO: 1382707 - RNA, 22 nt, Neisseria meningitidis Z2491
caacaggcgggcguuccacaaa

SEQ ID NO: 1382708 - RNA, 16 nt, Neisseria meningitidis Z2491
caacagcuuaaaaucc

SEQ ID NO: 1382709 - RNA, 16 nt, Neisseria meningitidis Z2491
caacaggaauuuaucc

SEQ ID NO: 1382710 - RNA, 17 nt, Neisseria meningitidis Z2491
caaccuguuuuucaaag

SEQ ID NO: 1382711 - RNA, 17 nt, Neisseria meningitidis Z2491
caaccuuuccgccguca

SEQ ID NO: 1382712 - RNA, 18 nt, Neisseria meningitidis Z2491
caacgaaacacucggccu

SEQ ID NO: 1382713 - RNA, 14 nt, Neisseria meningitidis Z2491
caacgacagcagca

SEQ ID NO: 1382714 - RNA, 15 nt, Neisseria meningitidis Z2491
caacgacagcagcag

SEQ ID NO: 1382715 - RNA, 19 nt, Neisseria meningitidis Z2491
caacgacuuccagcaccag

SEQ ID NO: 1382716 - RNA, 13 nt, Neisseria meningitidis Z2491
caaaugccgccag

SEQ ID NO: 1382717 - RNA, 13 nt, Neisseria meningitidis Z2491
caaaugccgucug

SEQ ID NO: 1382718 - RNA, 16 nt, Neisseria meningitidis Z2491
caaaugccgucugaaa

SEQ ID NO: 1382719 - RNA, 18 nt, Neisseria meningitidis Z2491
caaaugccgucugaaaac

SEQ ID NO: 1382720 - RNA, 20 nt, Neisseria meningitidis Z2491
caaaugccgucugaaaacag

SEQ ID NO: 1382721 - RNA, 23 nt, Neisseria meningitidis Z2491
caaaugccgucugaaaacagcaa

SEQ ID NO: 1382722 - RNA, 24 nt, Neisseria meningitidis Z2491
caaaugccgucugaaaacagcaaa

SEQ ID NO: 1382723 - RNA, 19 nt, Neisseria meningitidis Z2491
caaaugccgucugaaaugu

SEQ ID NO: 1382724 - RNA, 21 nt, Neisseria meningitidis Z2491
caaaugccgucugaaauguuc

SEQ ID NO: 1382725 - RNA, 16 nt, Neisseria meningitidis Z2491
caaaugccgucugaag

SEQ ID NO: 1382726 - RNA, 22 nt, Neisseria meningitidis Z2491
caaaugccgucugaagcccugc

SEQ ID NO: 1382727 - RNA, 16 nt, Neisseria meningitidis Z2491
caaaugcugucugaaa

SEQ ID NO: 1382728 - RNA, 22 nt, Neisseria meningitidis Z2491
caaauuauaccauaaauuuuaa

SEQ ID NO: 1382729 - RNA, 16 nt, Neisseria meningitidis Z2491
caaauugauuuuuagc

SEQ ID NO: 1382730 - RNA, 21 nt, Neisseria meningitidis Z2491
caaauugaaaugccgucugaa

SEQ ID NO: 1382731 - RNA, 14 nt, Neisseria meningitidis Z2491
caaauuuuugauuu

SEQ ID NO: 1382732 - RNA, 15 nt, Neisseria meningitidis Z2491
caacacaaaauaaaa

SEQ ID NO: 1382733 - RNA, 21 nt, Neisseria meningitidis Z2491
caacagauugucaaaauacau

SEQ ID NO: 1382734 - RNA, 13 nt, Neisseria meningitidis Z2491
caacacgcggcgc

SEQ ID NO: 1382735 - RNA, 19 nt, Neisseria meningitidis Z2491
caacacgcaaaacacaacu

SEQ ID NO: 1382736 - RNA, 22 nt, Neisseria meningitidis Z2491
caacacgcagccgagcagcagu

SEQ ID NO: 1382737 - RNA, 23 nt, Neisseria meningitidis Z2491
caacacgcagccgagcagcaguc

SEQ ID NO: 1382738 - RNA, 20 nt, Neisseria meningitidis Z2491
caacacgucggcagucugua

SEQ ID NO: 1382739 - RNA, 15 nt, Neisseria meningitidis Z2491
caaagcgguuucuug

SEQ ID NO: 1382740 - RNA, 14 nt, Neisseria meningitidis Z2491
caaagcuuuaaacu

SEQ ID NO: 1382741 - RNA, 21 nt, Neisseria meningitidis Z2491
caaagcuuuaaacuauagugg

SEQ ID NO: 1382742 - RNA, 19 nt, Neisseria meningitidis Z2491
caaaggggacagacggcca

SEQ ID NO: 1382743 - RNA, 14 nt, Neisseria meningitidis Z2491
caaacuauaucuau

SEQ ID NO: 1382744 - RNA, 22 nt, Neisseria meningitidis Z2491
caaacugcccgaccuguaaaau

SEQ ID NO: 1382745 - RNA, 20 nt, Neisseria meningitidis Z2491
caaagagaaagaacccaaac

SEQ ID NO: 1382746 - RNA, 16 nt, Neisseria meningitidis Z2491
caaaguuauuaaguga

SEQ ID NO: 1382747 - RNA, 17 nt, Neisseria meningitidis Z2491
caaaggucucuauuugu

SEQ ID NO: 1382748 - RNA, 21 nt, Neisseria meningitidis Z2491
caaaggucucuauuuguucga

SEQ ID NO: 1382749 - RNA, 19 nt, Neisseria meningitidis Z2491
caaauacccaaaugcagaa

SEQ ID NO: 1382750 - RNA, 13 nt, Neisseria meningitidis Z2491
caaauaauugaaa

SEQ ID NO: 1382751 - RNA, 17 nt, Neisseria meningitidis Z2491
caaaaugccgccgucga

SEQ ID NO: 1382752 - RNA, 16 nt, Neisseria meningitidis Z2491
caaaaugccgccugaa

SEQ ID NO: 1382753 - RNA, 21 nt, Neisseria meningitidis Z2491
caaaaugccguccgaaccgca

SEQ ID NO: 1382754 - RNA, 19 nt, Neisseria meningitidis Z2491
caaaaugccgucugaacga

SEQ ID NO: 1382755 - RNA, 17 nt, Neisseria meningitidis Z2491
caaaaugccgucugaag

SEQ ID NO: 1382756 - RNA, 14 nt, Neisseria meningitidis Z2491
caaaauuucagauu

SEQ ID NO: 1382757 - RNA, 22 nt, Neisseria meningitidis Z2491
caaaauuuauucuaaauagcug

SEQ ID NO: 1382758 - RNA, 13 nt, Neisseria meningitidis Z2491
caaaauuuauccg

SEQ ID NO: 1382759 - RNA, 15 nt, Neisseria meningitidis Z2491
caaaauaaaaaacaa

SEQ ID NO: 1382760 - RNA, 18 nt, Neisseria meningitidis Z2491
caaaauaaacuugauugc

SEQ ID NO: 1382761 - RNA, 16 nt, Neisseria meningitidis Z2491
caaaauauucaauuga

SEQ ID NO: 1382762 - RNA, 16 nt, Neisseria meningitidis Z2491
caaaaucagcacaaau

SEQ ID NO: 1382763 - RNA, 23 nt, Neisseria meningitidis Z2491
caaaaucagcacaaaugccaaag

SEQ ID NO: 1382764 - RNA, 12 nt, Neisseria meningitidis Z2491
caaaaucagaaa

SEQ ID NO: 1382765 - RNA, 19 nt, Neisseria meningitidis Z2491
caaaaucagaaaccuaaaa

SEQ ID NO: 1382766 - RNA, 14 nt, Neisseria meningitidis Z2491
caaacauuacugaa

SEQ ID NO: 1382767 - RNA, 16 nt, Neisseria meningitidis Z2491
caaacauuacugaaau

SEQ ID NO: 1382768 - RNA, 18 nt, Neisseria meningitidis Z2491
caaacaucggcggacagg

SEQ ID NO: 1382769 - RNA, 12 nt, Neisseria meningitidis Z2491
caaacaucugau

SEQ ID NO: 1382770 - RNA, 13 nt, Neisseria meningitidis Z2491
caaacaucugauu

SEQ ID NO: 1382771 - RNA, 18 nt, Neisseria meningitidis Z2491
caaacaucugauuuuucu

SEQ ID NO: 1382772 - RNA, 19 nt, Neisseria meningitidis Z2491
caaacaggcagccuaaaac

SEQ ID NO: 1382773 - RNA, 14 nt, Neisseria meningitidis Z2491
caaacaccagcauc

SEQ ID NO: 1382774 - RNA, 23 nt, Neisseria meningitidis Z2491
caaacaccagcaucugauacacc

SEQ ID NO: 1382775 - RNA, 13 nt, Neisseria meningitidis Z2491
caaacaccggcug

SEQ ID NO: 1382776 - RNA, 15 nt, Neisseria meningitidis Z2491
caaacagaaaaacaa

SEQ ID NO: 1382777 - RNA, 16 nt, Neisseria meningitidis Z2491
caaacagaaaaacaau

SEQ ID NO: 1382778 - RNA, 16 nt, Neisseria meningitidis Z2491
caaacgccagcacaaa

SEQ ID NO: 1382779 - RNA, 17 nt, Neisseria meningitidis Z2491
caaacgcugcauuuguu

SEQ ID NO: 1382780 - RNA, 23 nt, Neisseria meningitidis Z2491
caaacguuuuuccaaaccuuuga

SEQ ID NO: 1382781 - RNA, 18 nt, Neisseria meningitidis Z2491
caaaccccucaacacacc

SEQ ID NO: 1382782 - RNA, 16 nt, Neisseria meningitidis Z2491
caaacccaaugcuuca

SEQ ID NO: 1382783 - RNA, 17 nt, Neisseria meningitidis Z2491
caaacccaaugcuucaa

SEQ ID NO: 1382784 - RNA, 16 nt, Neisseria meningitidis Z2491
caaacccuccgccucu

SEQ ID NO: 1382785 - RNA, 14 nt, Neisseria meningitidis Z2491
caaacccuuuuucu

SEQ ID NO: 1382786 - RNA, 16 nt, Neisseria meningitidis Z2491
caaaccgaugccguca

SEQ ID NO: 1382787 - RNA, 21 nt, Neisseria meningitidis Z2491
caaaccgaugggcuucaucag

SEQ ID NO: 1382788 - RNA, 13 nt, Neisseria meningitidis Z2491
cacgguuuuccuc

SEQ ID NO: 1382789 - RNA, 23 nt, Neisseria meningitidis Z2491
cacguccgccauuuccaaaccca

SEQ ID NO: 1382790 - RNA, 21 nt, Neisseria meningitidis Z2491
cacgcuucugaugccgucugu

SEQ ID NO: 1382791 - RNA, 21 nt, Neisseria meningitidis Z2491
cacggcguucaacauccgcag

SEQ ID NO: 1382792 - RNA, 13 nt, Neisseria meningitidis Z2491
cacgaacugccuc

SEQ ID NO: 1382793 - RNA, 14 nt, Neisseria meningitidis Z2491
cacgaacugccucc

SEQ ID NO: 1382794 - RNA, 12 nt, Neisseria meningitidis Z2491
cacgaagaugaa

SEQ ID NO: 1382795 - RNA, 22 nt, Neisseria meningitidis Z2491
caccuuugggcucaaugaaaau

SEQ ID NO: 1382796 - RNA, 21 nt, Neisseria meningitidis Z2491
cacgccgccgcgccccaagcc

SEQ ID NO: 1382797 - RNA, 15 nt, Neisseria meningitidis Z2491
cacgcccgcaucuuu

SEQ ID NO: 1382798 - RNA, 14 nt, Neisseria meningitidis Z2491
cacgcccaagcggu

SEQ ID NO: 1382799 - RNA, 16 nt, Neisseria meningitidis Z2491
cacgccaaaccgaugg

SEQ ID NO: 1382800 - RNA, 13 nt, Neisseria meningitidis Z2491
cacgcaggaaauu

SEQ ID NO: 1382801 - RNA, 16 nt, Neisseria meningitidis Z2491
cacgcaggcgaccgcc

SEQ ID NO: 1382802 - RNA, 19 nt, Neisseria meningitidis Z2491
aaaauaacgggauuucagc

SEQ ID NO: 1382803 - RNA, 18 nt, Neisseria meningitidis Z2491
caccugaacggcacaaac

SEQ ID NO: 1382804 - RNA, 13 nt, Neisseria meningitidis Z2491
caccgugauuuua

SEQ ID NO: 1382805 - RNA, 19 nt, Neisseria meningitidis Z2491
caccgccgcuccgcaaaca

SEQ ID NO: 1382806 - RNA, 22 nt, Neisseria meningitidis Z2491
caccgccaucaggaaugcaaac

SEQ ID NO: 1382807 - RNA, 13 nt, Neisseria meningitidis Z2491
cacccucaauucu

SEQ ID NO: 1382808 - RNA, 14 nt, Neisseria meningitidis Z2491
caccagcccgccgc

SEQ ID NO: 1382809 - RNA, 17 nt, Neisseria meningitidis Z2491
aaaaguugcaagaauga

SEQ ID NO: 1382810 - RNA, 20 nt, Neisseria meningitidis Z2491
aaaaguuuugcauuuugaaa

SEQ ID NO: 1382811 - RNA, 20 nt, Neisseria meningitidis Z2491
caccaguucgucaugcaccu

SEQ ID NO: 1382812 - RNA, 17 nt, Neisseria meningitidis Z2491
caccaucgagcugccuu

SEQ ID NO: 1382813 - RNA, 19 nt, Neisseria meningitidis Z2491
caccaucggcaaaguuauu

SEQ ID NO: 1382814 - RNA, 13 nt, Neisseria meningitidis Z2491
caccaauucuuca

SEQ ID NO: 1382815 - RNA, 15 nt, Neisseria meningitidis Z2491
caccaauucuucaaa

SEQ ID NO: 1382816 - RNA, 13 nt, Neisseria meningitidis Z2491
cacauaaacagca

SEQ ID NO: 1382817 - RNA, 14 nt, Neisseria meningitidis Z2491
caauugacaaaaac

SEQ ID NO: 1382818 - RNA, 14 nt, Neisseria meningitidis Z2491
cacaaaauaaaaaa

SEQ ID NO: 1382819 - RNA, 22 nt, Neisseria meningitidis Z2491
cacaaacgccagcacaaacagc

SEQ ID NO: 1382820 - RNA, 13 nt, Neisseria meningitidis Z2491
cacaaaaaagcca

SEQ ID NO: 1382821 - RNA, 18 nt, Neisseria meningitidis Z2491
cacaaaaaagccagcagc

SEQ ID NO: 1382822 - RNA, 15 nt, Neisseria meningitidis Z2491
cacaaaagauacaca

SEQ ID NO: 1382823 - RNA, 16 nt, Neisseria meningitidis Z2491
cacaaaagauacacac

SEQ ID NO: 1382824 - RNA, 19 nt, Neisseria meningitidis Z2491
cacaaaagauacacacacc

SEQ ID NO: 1382825 - RNA, 15 nt, Neisseria meningitidis Z2491
caauuuuuuaaaugu

SEQ ID NO: 1382826 - RNA, 20 nt, Neisseria meningitidis Z2491
caauuuaaacacuucuucau

SEQ ID NO: 1382827 - RNA, 23 nt, Neisseria meningitidis Z2491
caauuuaucggaaaaaaccgaag

SEQ ID NO: 1382828 - RNA, 18 nt, Neisseria meningitidis Z2491
caauuuguauucaagcaa

SEQ ID NO: 1382829 - RNA, 22 nt, Neisseria meningitidis Z2491
cacagugauggcuucuaaaaau

SEQ ID NO: 1382830 - RNA, 22 nt, Neisseria meningitidis Z2491
cacagccuauuuuucugaaaaa

SEQ ID NO: 1382831 - RNA, 20 nt, Neisseria meningitidis Z2491
cacaggaaaaaugcuuaauc

SEQ ID NO: 1382832 - RNA, 17 nt, Neisseria meningitidis Z2491
cacagacauagacugua

SEQ ID NO: 1382833 - RNA, 19 nt, Neisseria meningitidis Z2491
cacaaaugccaaaggcagu

SEQ ID NO: 1382834 - RNA, 14 nt, Neisseria meningitidis Z2491
cacacaagcgcaug

SEQ ID NO: 1382835 - RNA, 17 nt, Neisseria meningitidis Z2491
cacacccaugccauacu

SEQ ID NO: 1382836 - RNA, 14 nt, Neisseria meningitidis Z2491
auuuccacaaaaaa

SEQ ID NO: 1382837 - RNA, 16 nt, Neisseria meningitidis Z2491
auuuccacaaaaaaca

SEQ ID NO: 1382838 - RNA, 19 nt, Neisseria meningitidis Z2491
auuuccacaaaaaacagaa

SEQ ID NO: 1382839 - RNA, 15 nt, Neisseria meningitidis Z2491
auuuccuuaaaaaag

SEQ ID NO: 1382840 - RNA, 13 nt, Neisseria meningitidis Z2491
auuucgauacacc

SEQ ID NO: 1382841 - RNA, 16 nt, Neisseria meningitidis Z2491
auuucuauuuuuuacc

SEQ ID NO: 1382842 - RNA, 18 nt, Neisseria meningitidis Z2491
auuucuagggaaaugccc

SEQ ID NO: 1382843 - RNA, 15 nt, Neisseria meningitidis Z2491
auuucuagauuccca

SEQ ID NO: 1382844 - RNA, 15 nt, Neisseria meningitidis Z2491
auuucuaauuuuuau

SEQ ID NO: 1382845 - RNA, 12 nt, Neisseria meningitidis Z2491
auuuaguucacu

SEQ ID NO: 1382846 - RNA, 18 nt, Neisseria meningitidis Z2491
auuucagacggcauuuga

SEQ ID NO: 1382847 - RNA, 12 nt, Neisseria meningitidis Z2491
auuucacuucca

SEQ ID NO: 1382848 - RNA, 15 nt, Neisseria meningitidis Z2491
auuucaucauuccca

SEQ ID NO: 1382849 - RNA, 17 nt, Neisseria meningitidis Z2491
auuuggcagcugaagcc

SEQ ID NO: 1382850 - RNA, 19 nt, Neisseria meningitidis Z2491
auuuguuccaauuccugua

SEQ ID NO: 1382851 - RNA, 21 nt, Neisseria meningitidis Z2491
auuuguccgacacaaugaaag

SEQ ID NO: 1382852 - RNA, 23 nt, Neisseria meningitidis Z2491
auuuguccauucggcuuaaaccu

SEQ ID NO: 1382853 - RNA, 13 nt, Neisseria meningitidis Z2491
auuugcacaucag

SEQ ID NO: 1382854 - RNA, 23 nt, Neisseria meningitidis Z2491
auuugccgcguaugcguucaaau

SEQ ID NO: 1382855 - RNA, 22 nt, Neisseria meningitidis Z2491
auuugacuugaaggcguguuug

SEQ ID NO: 1382856 - RNA, 19 nt, Neisseria meningitidis Z2491
auuugaugcguuucgguuu

SEQ ID NO: 1382857 - RNA, 16 nt, Neisseria meningitidis Z2491
auuugacgcauaaaaa

SEQ ID NO: 1382858 - RNA, 15 nt, Neisseria meningitidis Z2491
auuugacccauuacu

SEQ ID NO: 1382859 - RNA, 19 nt, Neisseria meningitidis Z2491
auuuuuaugcgucaaauuu

SEQ ID NO: 1382860 - RNA, 21 nt, Neisseria meningitidis Z2491
auuuuuaugcgucaaauuucg

SEQ ID NO: 1382861 - RNA, 18 nt, Neisseria meningitidis Z2491
auuuuuaucguguuuccu

SEQ ID NO: 1382862 - RNA, 15 nt, Neisseria meningitidis Z2491
auuuuuugaauuuca

SEQ ID NO: 1382863 - RNA, 15 nt, Neisseria meningitidis Z2491
auuuuuguuaaucca

SEQ ID NO: 1382864 - RNA, 21 nt, Neisseria meningitidis Z2491
auuuuuguuaauccacuauac

SEQ ID NO: 1382865 - RNA, 18 nt, Neisseria meningitidis Z2491
auuuuuguuuaucuuuca

SEQ ID NO: 1382866 - RNA, 19 nt, Neisseria meningitidis Z2491
auuuuugcccgauuuaaag

SEQ ID NO: 1382867 - RNA, 15 nt, Neisseria meningitidis Z2491
auuuuugggaaguaa

SEQ ID NO: 1382868 - RNA, 13 nt, Neisseria meningitidis Z2491
caaaaaacacaac

SEQ ID NO: 1382869 - RNA, 14 nt, Neisseria meningitidis Z2491
caaaaaacagcaac

SEQ ID NO: 1382870 - RNA, 11 nt, Neisseria meningitidis Z2491
caaaaaacaac

SEQ ID NO: 1382871 - RNA, 17 nt, Neisseria meningitidis Z2491
caaaaaacaacaggaau

SEQ ID NO: 1382872 - RNA, 11 nt, Neisseria meningitidis Z2491
caaaaaagcca

SEQ ID NO: 1382873 - RNA, 21 nt, Neisseria meningitidis Z2491
auuuuuuuauuuaaagcauca

SEQ ID NO: 1382874 - RNA, 19 nt, Neisseria meningitidis Z2491
auuuuuuggcgcauuuuua

SEQ ID NO: 1382875 - RNA, 13 nt, Neisseria meningitidis Z2491
caaaaacacaaaa

SEQ ID NO: 1382876 - RNA, 10 nt, Neisseria meningitidis Z2491
caaaaacaga

SEQ ID NO: 1382877 - RNA, 16 nt, Neisseria meningitidis Z2491
caaaaacagaaaacca

SEQ ID NO: 1382878 - RNA, 17 nt, Neisseria meningitidis Z2491
caaaaacagaaaaccaa

SEQ ID NO: 1382879 - RNA, 19 nt, Neisseria meningitidis Z2491
caaaaacagaaaaccaaaa

SEQ ID NO: 1382880 - RNA, 21 nt, Neisseria meningitidis Z2491
caaaaacagaaaaccaaaaac

SEQ ID NO: 1382881 - RNA, 19 nt, Neisseria meningitidis Z2491
caaaaacagaaaccuaaaa

SEQ ID NO: 1382882 - RNA, 21 nt, Neisseria meningitidis Z2491
caaaaacagaaaccugaaaac

SEQ ID NO: 1382883 - RNA, 21 nt, Neisseria meningitidis Z2491
caaaaacagaaauucaaaaac

SEQ ID NO: 1382884 - RNA, 18 nt, Neisseria meningitidis Z2491
caaaaacagcaaccugaa

SEQ ID NO: 1382885 - RNA, 22 nt, Neisseria meningitidis Z2491
caaaaacagcaaccugaaauuc

SEQ ID NO: 1382886 - RNA, 17 nt, Neisseria meningitidis Z2491
caaaaauaccgucugaa

SEQ ID NO: 1382887 - RNA, 21 nt, Neisseria meningitidis Z2491
caaaaauacgcguaagcggag

SEQ ID NO: 1382888 - RNA, 15 nt, Neisseria meningitidis Z2491
caaaaaucaggacaa

SEQ ID NO: 1382889 - RNA, 17 nt, Neisseria meningitidis Z2491
caaaaaugccgucugaa

SEQ ID NO: 1382890 - RNA, 18 nt, Neisseria meningitidis Z2491
caaaaaugccgucugaaa

SEQ ID NO: 1382891 - RNA, 21 nt, Neisseria meningitidis Z2491
caaaaaugccgucugaagccu

SEQ ID NO: 1382892 - RNA, 13 nt, Neisseria meningitidis Z2491
caaaacaaaccca

SEQ ID NO: 1382893 - RNA, 18 nt, Neisseria meningitidis Z2491
caaaacagaaaccuaaaa

SEQ ID NO: 1382894 - RNA, 20 nt, Neisseria meningitidis Z2491
caaaacagaaaccuaaaauu

SEQ ID NO: 1382895 - RNA, 13 nt, Neisseria meningitidis Z2491
caaaacaucgaca

SEQ ID NO: 1382896 - RNA, 15 nt, Neisseria meningitidis Z2491
auuuuuagcccaugu

SEQ ID NO: 1382897 - RNA, 19 nt, Neisseria meningitidis Z2491
auuuugacuuuggaacaaa

SEQ ID NO: 1382898 - RNA, 22 nt, Neisseria meningitidis Z2491
auuuugacuuuggaacaaaaaa

SEQ ID NO: 1382899 - RNA, 23 nt, Neisseria meningitidis Z2491
auuuugcagcccugauaaaaaau

SEQ ID NO: 1382900 - RNA, 10 nt, Neisseria meningitidis Z2491
auuuugauug

SEQ ID NO: 1382901 - RNA, 23 nt, Neisseria meningitidis Z2491
auuuugaaaaugagauugagcau

SEQ ID NO: 1382902 - RNA, 19 nt, Neisseria meningitidis Z2491
auuuugaaacucuaauccc

SEQ ID NO: 1382903 - RNA, 13 nt, Neisseria meningitidis Z2491
auuuucuugaguu

SEQ ID NO: 1382904 - RNA, 21 nt, Neisseria meningitidis Z2491
auuuucuugaguuucuguauu

SEQ ID NO: 1382905 - RNA, 22 nt, Neisseria meningitidis Z2491
auuuuccauaaaauacaugaca

SEQ ID NO: 1382906 - RNA, 21 nt, Neisseria meningitidis Z2491
auuuuccccgugaaaaaaugc

SEQ ID NO: 1382907 - RNA, 18 nt, Neisseria meningitidis Z2491
auuuuccguugccugcga

SEQ ID NO: 1382908 - RNA, 15 nt, Neisseria meningitidis Z2491
auuuuauugauucaa

SEQ ID NO: 1382909 - RNA, 20 nt, Neisseria meningitidis Z2491
auuuuaugcucaaucucauu

SEQ ID NO: 1382910 - RNA, 20 nt, Neisseria meningitidis Z2491
auuuuauggcagguuuuuau

SEQ ID NO: 1382911 - RNA, 20 nt, Neisseria meningitidis Z2491
auucccacuuccgugggaau

SEQ ID NO: 1382912 - RNA, 16 nt, Neisseria meningitidis Z2491
auucccaccguuuccc

SEQ ID NO: 1382913 - RNA, 18 nt, Neisseria meningitidis Z2491
auucccacggaaguggga

SEQ ID NO: 1382914 - RNA, 20 nt, Neisseria meningitidis Z2491
auucccacggaagugggaau

SEQ ID NO: 1382915 - RNA, 21 nt, Neisseria meningitidis Z2491
auucccccgaagaugggaauc

SEQ ID NO: 1382916 - RNA, 15 nt, Neisseria meningitidis Z2491
auuccagauucccgc

SEQ ID NO: 1382917 - RNA, 13 nt, Neisseria meningitidis Z2491
auucauagcaaaa

SEQ ID NO: 1382918 - RNA, 16 nt, Neisseria meningitidis Z2491
auucauagcaaaauaa

SEQ ID NO: 1382919 - RNA, 16 nt, Neisseria meningitidis Z2491
auucauacacagccaa

SEQ ID NO: 1382920 - RNA, 21 nt, Neisseria meningitidis Z2491
auuccgccgauguaaaccuaa

SEQ ID NO: 1382921 - RNA, 16 nt, Neisseria meningitidis Z2491
auuccccucggggucu

SEQ ID NO: 1382922 - RNA, 18 nt, Neisseria meningitidis Z2491
auuccuguaaaaacaaaa

SEQ ID NO: 1382923 - RNA, 23 nt, Neisseria meningitidis Z2491
auuccugcugcuuuucauuucua

SEQ ID NO: 1382924 - RNA, 13 nt, Neisseria meningitidis Z2491
auucgaccagcuc

SEQ ID NO: 1382925 - RNA, 15 nt, Neisseria meningitidis Z2491
auucgaccagcuccc

SEQ ID NO: 1382926 - RNA, 16 nt, Neisseria meningitidis Z2491
auuccugugguuuuuc

SEQ ID NO: 1382927 - RNA, 20 nt, Neisseria meningitidis Z2491
auucgcacgcaugaagccgu

SEQ ID NO: 1382928 - RNA, 19 nt, Neisseria meningitidis Z2491
auucuaaauagcugaaacu

SEQ ID NO: 1382929 - RNA, 15 nt, Neisseria meningitidis Z2491
auucuacccaaauac

SEQ ID NO: 1382930 - RNA, 16 nt, Neisseria meningitidis Z2491
auucuacccaaauacc

SEQ ID NO: 1382931 - RNA, 17 nt, Neisseria meningitidis Z2491
auucggcuuaaaccuua

SEQ ID NO: 1382932 - RNA, 23 nt, Neisseria meningitidis Z2491
auucggagcaagaccaaacagaa

SEQ ID NO: 1382933 - RNA, 14 nt, Neisseria meningitidis Z2491
auucuuaagaugaa

SEQ ID NO: 1382934 - RNA, 16 nt, Neisseria meningitidis Z2491
auucucccaaaggcaa

SEQ ID NO: 1382935 - RNA, 22 nt, Neisseria meningitidis Z2491
auucuccaaguuccaauacauu

SEQ ID NO: 1382936 - RNA, 19 nt, Neisseria meningitidis Z2491
auugaaauucgucauuccc

SEQ ID NO: 1382937 - RNA, 17 nt, Neisseria meningitidis Z2491
auugagaccuuugcaau

SEQ ID NO: 1382938 - RNA, 13 nt, Neisseria meningitidis Z2491
auugacuauuuuu

SEQ ID NO: 1382939 - RNA, 14 nt, Neisseria meningitidis Z2491
auugaccgaaaaau

SEQ ID NO: 1382940 - RNA, 17 nt, Neisseria meningitidis Z2491
auugaccgaaaaauaau

SEQ ID NO: 1382941 - RNA, 13 nt, Neisseria meningitidis Z2491
auugauuuuuaug

SEQ ID NO: 1382942 - RNA, 13 nt, Neisseria meningitidis Z2491
auugaucaaaacc

SEQ ID NO: 1382943 - RNA, 16 nt, Neisseria meningitidis Z2491
aaaaggucuuuucuaa

SEQ ID NO: 1382944 - RNA, 16 nt, Neisseria meningitidis Z2491
auugguaugggauuua

SEQ ID NO: 1382945 - RNA, 14 nt, Neisseria meningitidis Z2491
auugucaaaauaca

SEQ ID NO: 1382946 - RNA, 22 nt, Neisseria meningitidis Z2491
auuguauauuggcauccacauu

SEQ ID NO: 1382947 - RNA, 20 nt, Neisseria meningitidis Z2491
auuggauuuggcuuaaaaau

SEQ ID NO: 1382948 - RNA, 17 nt, Neisseria meningitidis Z2491
auugugcccacggggug

SEQ ID NO: 1382949 - RNA, 20 nt, Neisseria meningitidis Z2491
auuguuuguuuuuuucaggc

SEQ ID NO: 1382950 - RNA, 20 nt, Neisseria meningitidis Z2491
auuuaauccacuauaaucca

SEQ ID NO: 1382951 - RNA, 19 nt, Neisseria meningitidis Z2491
auuuaaacagcaauccauu

SEQ ID NO: 1382952 - RNA, 14 nt, Neisseria meningitidis Z2491
auuuaaaccaguac

SEQ ID NO: 1382953 - RNA, 13 nt, Neisseria meningitidis Z2491
auuuaaggaaugc

SEQ ID NO: 1382954 - RNA, 16 nt, Neisseria meningitidis Z2491
auuuagaaaaaauaua

SEQ ID NO: 1382955 - RNA, 17 nt, Neisseria meningitidis Z2491
auuuaccagaaaaaaca

SEQ ID NO: 1382956 - RNA, 14 nt, Neisseria meningitidis Z2491
augccgucugaaac

SEQ ID NO: 1382957 - RNA, 21 nt, Neisseria meningitidis Z2491
augccgucugaaaccuguuuc

SEQ ID NO: 1382958 - RNA, 14 nt, Neisseria meningitidis Z2491
augccgucugaaau

SEQ ID NO: 1382959 - RNA, 20 nt, Neisseria meningitidis Z2491
augccgucugaacgcuucag

SEQ ID NO: 1382960 - RNA, 20 nt, Neisseria meningitidis Z2491
augccgucugaagccuucag

SEQ ID NO: 1382961 - RNA, 20 nt, Neisseria meningitidis Z2491
augccgucugaagcgguuca

SEQ ID NO: 1382962 - RNA, 19 nt, Neisseria meningitidis Z2491
augccgucugauauaguua

SEQ ID NO: 1382963 - RNA, 20 nt, Neisseria meningitidis Z2491
augcccgccaguccuaccca

SEQ ID NO: 1382964 - RNA, 13 nt, Neisseria meningitidis Z2491
augcccaaaccgc

SEQ ID NO: 1382965 - RNA, 14 nt, Neisseria meningitidis Z2491
augcccacaaucug

SEQ ID NO: 1382966 - RNA, 18 nt, Neisseria meningitidis Z2491
augcccauccgccuuccg

SEQ ID NO: 1382967 - RNA, 19 nt, Neisseria meningitidis Z2491
augcccauuuguuggaugu

SEQ ID NO: 1382968 - RNA, 20 nt, Neisseria meningitidis Z2491
augccccacauaaacagcac

SEQ ID NO: 1382969 - RNA, 14 nt, Neisseria meningitidis Z2491
augccaaaggcagu

SEQ ID NO: 1382970 - RNA, 17 nt, Neisseria meningitidis Z2491
augccaaaggcagugcc

SEQ ID NO: 1382971 - RNA, 20 nt, Neisseria meningitidis Z2491
augcacuacuucauuuuuuc

SEQ ID NO: 1382972 - RNA, 14 nt, Neisseria meningitidis Z2491
augcguuucagagc

SEQ ID NO: 1382973 - RNA, 17 nt, Neisseria meningitidis Z2491
augcguuucagagcauu

SEQ ID NO: 1382974 - RNA, 13 nt, Neisseria meningitidis Z2491
augcuaaggcaau

SEQ ID NO: 1382975 - RNA, 16 nt, Neisseria meningitidis Z2491
augcuaaggcaauuua

SEQ ID NO: 1382976 - RNA, 23 nt, Neisseria meningitidis Z2491
augcucaaucucauuuucaaaau

SEQ ID NO: 1382977 - RNA, 19 nt, Neisseria meningitidis Z2491
augccguccgaaccgcaaa

SEQ ID NO: 1382978 - RNA, 14 nt, Neisseria meningitidis Z2491
augccgucauuccc

SEQ ID NO: 1382979 - RNA, 14 nt, Neisseria meningitidis Z2491
augccgucugaaaa

SEQ ID NO: 1382980 - RNA, 22 nt, Neisseria meningitidis Z2491
augccgucugaaaacaguucag

SEQ ID NO: 1382981 - RNA, 19 nt, Neisseria meningitidis Z2491
augccguuucagacggcau

SEQ ID NO: 1382982 - RNA, 21 nt, Neisseria meningitidis Z2491
augcgggugauggagcugugu

SEQ ID NO: 1382983 - RNA, 12 nt, Neisseria meningitidis Z2491
augcggggaaac

SEQ ID NO: 1382984 - RNA, 13 nt, Neisseria meningitidis Z2491
augcgucuuccaa

SEQ ID NO: 1382985 - RNA, 18 nt, Neisseria meningitidis Z2491
augcguucgagcaggaac

SEQ ID NO: 1382986 - RNA, 19 nt, Neisseria meningitidis Z2491
augcguucaaaucacgccc

SEQ ID NO: 1382987 - RNA, 16 nt, Neisseria meningitidis Z2491
augcguucaaaugccg

SEQ ID NO: 1382988 - RNA, 14 nt, Neisseria meningitidis Z2491
auguauuagaaaug

SEQ ID NO: 1382989 - RNA, 12 nt, Neisseria meningitidis Z2491
auguauaguaau

SEQ ID NO: 1382990 - RNA, 19 nt, Neisseria meningitidis Z2491
auguagguucguaggaaug

SEQ ID NO: 1382991 - RNA, 18 nt, Neisseria meningitidis Z2491
auguagguucgugggaau

SEQ ID NO: 1382992 - RNA, 19 nt, Neisseria meningitidis Z2491
auguacuucuggaaagugg

SEQ ID NO: 1382993 - RNA, 18 nt, Neisseria meningitidis Z2491
auguaauaggcgagcuuc

SEQ ID NO: 1382994 - RNA, 18 nt, Neisseria meningitidis Z2491
auguaaucguaagauaga

SEQ ID NO: 1382995 - RNA, 13 nt, Neisseria meningitidis Z2491
augguuugcaguc

SEQ ID NO: 1382996 - RNA, 20 nt, Neisseria meningitidis Z2491
augggauuuaggguucugau

SEQ ID NO: 1382997 - RNA, 15 nt, Neisseria meningitidis Z2491
auggcuucuaaaaau

SEQ ID NO: 1382998 - RNA, 16 nt, Neisseria meningitidis Z2491
auggcuucuaaaaauu

SEQ ID NO: 1382999 - RNA, 20 nt, Neisseria meningitidis Z2491
auggcggugcgguagccgcc

SEQ ID NO: 1383000 - RNA, 14 nt, Neisseria meningitidis Z2491
auggcaaaauuuca

SEQ ID NO: 1383001 - RNA, 15 nt, Neisseria meningitidis Z2491
auggcgaacaaacaa

SEQ ID NO: 1383002 - RNA, 21 nt, Neisseria meningitidis Z2491
auucacuuggugcuucagcac

SEQ ID NO: 1383003 - RNA, 22 nt, Neisseria meningitidis Z2491
auucacuuggugcuugagcacc

SEQ ID NO: 1383004 - RNA, 16 nt, Neisseria meningitidis Z2491
auucacuuggugcuuc

SEQ ID NO: 1383005 - RNA, 15 nt, Neisseria meningitidis Z2491
auucacuaaauugca

SEQ ID NO: 1383006 - RNA, 19 nt, Neisseria meningitidis Z2491
auucacuaaauugcauuuu

SEQ ID NO: 1383007 - RNA, 20 nt, Neisseria meningitidis Z2491
auucaaauuaaguuagaguu

SEQ ID NO: 1383008 - RNA, 16 nt, Neisseria meningitidis Z2491
auucaauuuaaacacu

SEQ ID NO: 1383009 - RNA, 17 nt, Neisseria meningitidis Z2491
auucaaugcuaaggcaa

SEQ ID NO: 1383010 - RNA, 19 nt, Neisseria meningitidis Z2491
auucaaugcuaaggcaauu

SEQ ID NO: 1383011 - RNA, 20 nt, Neisseria meningitidis Z2491
auuacgaacaggacaaaaau

SEQ ID NO: 1383012 - RNA, 17 nt, Neisseria meningitidis Z2491
auuaggagguauuuggg

SEQ ID NO: 1383013 - RNA, 18 nt, Neisseria meningitidis Z2491
auuaggcgguauuugggg

SEQ ID NO: 1383014 - RNA, 21 nt, Neisseria meningitidis Z2491
auuauaccauaaauuuuaaau

SEQ ID NO: 1383015 - RNA, 21 nt, Neisseria meningitidis Z2491
auuaucugacaggaaauuucc

SEQ ID NO: 1383016 - RNA, 23 nt, Neisseria meningitidis Z2491
auuaucugacaggaaauuuccaa

SEQ ID NO: 1383017 - RNA, 16 nt, Neisseria meningitidis Z2491
auuauauuuguccaug

SEQ ID NO: 1383018 - RNA, 16 nt, Neisseria meningitidis Z2491
auuaucaguauuuucu

SEQ ID NO: 1383019 - RNA, 12 nt, Neisseria meningitidis Z2491
auuaacaaaaau

SEQ ID NO: 1383020 - RNA, 11 nt, Neisseria meningitidis Z2491
auuaacaaaaa

SEQ ID NO: 1383021 - RNA, 12 nt, Neisseria meningitidis Z2491
auuaacaaaaac

SEQ ID NO: 1383022 - RNA, 13 nt, Neisseria meningitidis Z2491
auuaacaaaaacc

SEQ ID NO: 1383023 - RNA, 15 nt, Neisseria meningitidis Z2491
auuaacaaaaaccag

SEQ ID NO: 1383024 - RNA, 19 nt, Neisseria meningitidis Z2491
auuaaggggggauuugggu

SEQ ID NO: 1383025 - RNA, 19 nt, Neisseria meningitidis Z2491
auuaaggggguauuugggu

SEQ ID NO: 1383026 - RNA, 14 nt, Neisseria meningitidis Z2491
aaaagcaucuuguu

SEQ ID NO: 1383027 - RNA, 21 nt, Neisseria meningitidis Z2491
auuaaucuccuuuuuuuucua

SEQ ID NO: 1383028 - RNA, 16 nt, Neisseria meningitidis Z2491
auuaaucaucggaaac

SEQ ID NO: 1383029 - RNA, 15 nt, Neisseria meningitidis Z2491
auuaauuucggaaau

SEQ ID NO: 1383030 - RNA, 15 nt, Neisseria meningitidis Z2491
auuaaugcgaaaugc

SEQ ID NO: 1383031 - RNA, 22 nt, Neisseria meningitidis Z2491
auguuuuuccacaaaagauaca

SEQ ID NO: 1383032 - RNA, 17 nt, Neisseria meningitidis Z2491
auuaaaauaaaaauacu

SEQ ID NO: 1383033 - RNA, 21 nt, Neisseria meningitidis Z2491
auuaaaauuuggcuguauuuu

SEQ ID NO: 1383034 - RNA, 22 nt, Neisseria meningitidis Z2491
auuaaaggggugcguuuuauug

SEQ ID NO: 1383035 - RNA, 21 nt, Neisseria meningitidis Z2491
auuaaagugccauuuaaaauc

SEQ ID NO: 1383036 - RNA, 13 nt, Neisseria meningitidis Z2491
auuaaauuuaaac

SEQ ID NO: 1383037 - RNA, 13 nt, Neisseria meningitidis Z2491
auuaaauuuaaau

SEQ ID NO: 1383038 - RNA, 20 nt, Neisseria meningitidis Z2491
auguugcggcacuagccaaa

SEQ ID NO: 1383039 - RNA, 23 nt, Neisseria meningitidis Z2491
auguugcggcacuagccaaaaaa

SEQ ID NO: 1383040 - RNA, 17 nt, Neisseria meningitidis Z2491
auguuuagcggagcagu

SEQ ID NO: 1383041 - RNA, 20 nt, Neisseria meningitidis Z2491
auguuucaaaccucauucaa

SEQ ID NO: 1383042 - RNA, 18 nt, Neisseria meningitidis Z2491
auguuucaacgccucgcc

SEQ ID NO: 1383043 - RNA, 14 nt, Neisseria meningitidis Z2491
auguucaauaggau

SEQ ID NO: 1383044 - RNA, 20 nt, Neisseria meningitidis Z2491
auguucagacggcauuuucu

SEQ ID NO: 1383045 - RNA, 16 nt, Neisseria meningitidis Z2491
auauugccguuuuccu

SEQ ID NO: 1383046 - RNA, 22 nt, Neisseria meningitidis Z2491
auauugccagcccccuuccaag

SEQ ID NO: 1383047 - RNA, 17 nt, Neisseria meningitidis Z2491
auauucagguaaaacaa

SEQ ID NO: 1383048 - RNA, 18 nt, Neisseria meningitidis Z2491
auauucagguaaaacaaa

SEQ ID NO: 1383049 - RNA, 22 nt, Neisseria meningitidis Z2491
auauucacuaaauugcauuuuu

SEQ ID NO: 1383050 - RNA, 17 nt, Neisseria meningitidis Z2491
auauucaauugacaaaa

SEQ ID NO: 1383051 - RNA, 22 nt, Neisseria meningitidis Z2491
auauuugccggucggcuggcug

SEQ ID NO: 1383052 - RNA, 13 nt, Neisseria meningitidis Z2491
auauuuucuuccg

SEQ ID NO: 1383053 - RNA, 22 nt, Neisseria meningitidis Z2491
auauuuugacuuuggaacaaaa

SEQ ID NO: 1383054 - RNA, 13 nt, Neisseria meningitidis Z2491
aucaaaaccagcc

SEQ ID NO: 1383055 - RNA, 15 nt, Neisseria meningitidis Z2491
auauuguuauuuuua

SEQ ID NO: 1383056 - RNA, 15 nt, Neisseria meningitidis Z2491
auauuggaaagcaau

SEQ ID NO: 1383057 - RNA, 21 nt, Neisseria meningitidis Z2491
auauugguuccgugauaaagc

SEQ ID NO: 1383058 - RNA, 14 nt, Neisseria meningitidis Z2491
aucaaggaauucau

SEQ ID NO: 1383059 - RNA, 16 nt, Neisseria meningitidis Z2491
aucaaguuaccggucu

SEQ ID NO: 1383060 - RNA, 21 nt, Neisseria meningitidis Z2491
aucaacagauugucaaaauac

SEQ ID NO: 1383061 - RNA, 21 nt, Neisseria meningitidis Z2491
aucaacgcgggaauagcucag

SEQ ID NO: 1383062 - RNA, 20 nt, Neisseria meningitidis Z2491
aucaccgucgccauaaucag

SEQ ID NO: 1383063 - RNA, 16 nt, Neisseria meningitidis Z2491
aucaauuaaaaacaaa

SEQ ID NO: 1383064 - RNA, 21 nt, Neisseria meningitidis Z2491
aucaaugugccucuucccaau

SEQ ID NO: 1383065 - RNA, 23 nt, Neisseria meningitidis Z2491
aucacuuggaauaugaauacggc

SEQ ID NO: 1383066 - RNA, 17 nt, Neisseria meningitidis Z2491
aucagacauuaaaaaau

SEQ ID NO: 1383067 - RNA, 20 nt, Neisseria meningitidis Z2491
aucagacauuaaaaaauaca

SEQ ID NO: 1383068 - RNA, 19 nt, Neisseria meningitidis Z2491
aucacguccgccauuucca

SEQ ID NO: 1383069 - RNA, 20 nt, Neisseria meningitidis Z2491
aucacguccgccauuuccaa

SEQ ID NO: 1383070 - RNA, 15 nt, Neisseria meningitidis Z2491
aucacuucgcucugc

SEQ ID NO: 1383071 - RNA, 19 nt, Neisseria meningitidis Z2491
aucagcauagggacgaaaa

SEQ ID NO: 1383072 - RNA, 18 nt, Neisseria meningitidis Z2491
aucagauugauaaaagca

SEQ ID NO: 1383073 - RNA, 16 nt, Neisseria meningitidis Z2491
aucauaugcaucagca

SEQ ID NO: 1383074 - RNA, 12 nt, Neisseria meningitidis Z2491
aucauccacagc

SEQ ID NO: 1383075 - RNA, 15 nt, Neisseria meningitidis Z2491
aucaucccaaacauc

SEQ ID NO: 1383076 - RNA, 18 nt, Neisseria meningitidis Z2491
aaaacgccgcuguuacgc

SEQ ID NO: 1383077 - RNA, 15 nt, Neisseria meningitidis Z2491
aaaacgccaauuugu

SEQ ID NO: 1383078 - RNA, 16 nt, Neisseria meningitidis Z2491
aaaacgccaauuugua

SEQ ID NO: 1383079 - RNA, 17 nt, Neisseria meningitidis Z2491
aucaggacaaggcaacg

SEQ ID NO: 1383080 - RNA, 22 nt, Neisseria meningitidis Z2491
aucaggaacaucagcaccacug

SEQ ID NO: 1383081 - RNA, 17 nt, Neisseria meningitidis Z2491
auaucuucuccgaccua

SEQ ID NO: 1383082 - RNA, 23 nt, Neisseria meningitidis Z2491
auaucgggacgcugcgguacaag

SEQ ID NO: 1383083 - RNA, 19 nt, Neisseria meningitidis Z2491
auauauugggcaacaccau

SEQ ID NO: 1383084 - RNA, 16 nt, Neisseria meningitidis Z2491
auaucgccucauacag

SEQ ID NO: 1383085 - RNA, 15 nt, Neisseria meningitidis Z2491
auagcugaaacucaa

SEQ ID NO: 1383086 - RNA, 16 nt, Neisseria meningitidis Z2491
auagcugaaacucaac

SEQ ID NO: 1383087 - RNA, 17 nt, Neisseria meningitidis Z2491
auaguggauuaaauuua

SEQ ID NO: 1383088 - RNA, 18 nt, Neisseria meningitidis Z2491
auaguggauuaaauuuaa

SEQ ID NO: 1383089 - RNA, 15 nt, Neisseria meningitidis Z2491
auaguggauuaacaa

SEQ ID NO: 1383090 - RNA, 16 nt, Neisseria meningitidis Z2491
auaguggauuaacaaa

SEQ ID NO: 1383091 - RNA, 17 nt, Neisseria meningitidis Z2491
auaguggauuaacaaaa

SEQ ID NO: 1383092 - RNA, 18 nt, Neisseria meningitidis Z2491
auaguggauuaacaaaaa

SEQ ID NO: 1383093 - RNA, 19 nt, Neisseria meningitidis Z2491
auaguggauuaacaaaaau

SEQ ID NO: 1383094 - RNA, 21 nt, Neisseria meningitidis Z2491
auaguggauuaacaaaaauca

SEQ ID NO: 1383095 - RNA, 20 nt, Neisseria meningitidis Z2491
auaguugauuaaaacaaaaa

SEQ ID NO: 1383096 - RNA, 23 nt, Neisseria meningitidis Z2491
auaguugauuaaaacaaaaauga

SEQ ID NO: 1383097 - RNA, 16 nt, Neisseria meningitidis Z2491
auauacucaauaggau

SEQ ID NO: 1383098 - RNA, 14 nt, Neisseria meningitidis Z2491
auauagacauuuuu

SEQ ID NO: 1383099 - RNA, 20 nt, Neisseria meningitidis Z2491
auauaauccggagcagaauc

SEQ ID NO: 1383100 - RNA, 14 nt, Neisseria meningitidis Z2491
auagcaaaauaaaa

SEQ ID NO: 1383101 - RNA, 15 nt, Neisseria meningitidis Z2491
auagaaaaucaaaaa

SEQ ID NO: 1383102 - RNA, 21 nt, Neisseria meningitidis Z2491
auacucugcggacuuaagaaa

SEQ ID NO: 1383103 - RNA, 20 nt, Neisseria meningitidis Z2491
auacuuggcaaaaucuggau

SEQ ID NO: 1383104 - RNA, 16 nt, Neisseria meningitidis Z2491
auacuggcaaauugaa

SEQ ID NO: 1383105 - RNA, 12 nt, Neisseria meningitidis Z2491
auacugcugaag

SEQ ID NO: 1383106 - RNA, 20 nt, Neisseria meningitidis Z2491
auacugccuguaaaaccaag

SEQ ID NO: 1383107 - RNA, 13 nt, Neisseria meningitidis Z2491
auaccuccuaauu

SEQ ID NO: 1383108 - RNA, 17 nt, Neisseria meningitidis Z2491
auaccucccaauccugc

SEQ ID NO: 1383109 - RNA, 23 nt, Neisseria meningitidis Z2491
auaccgcaaccugaaaggcacaa

SEQ ID NO: 1383110 - RNA, 15 nt, Neisseria meningitidis Z2491
auacgcgacaauaaa

SEQ ID NO: 1383111 - RNA, 23 nt, Neisseria meningitidis Z2491
aucgagugugggguagccuucaa

SEQ ID NO: 1383112 - RNA, 17 nt, Neisseria meningitidis Z2491
auccugccuucauucuu

SEQ ID NO: 1383113 - RNA, 19 nt, Neisseria meningitidis Z2491
auccugccuucauucuuga

SEQ ID NO: 1383114 - RNA, 18 nt, Neisseria meningitidis Z2491
auccgcuuaaaaaacaac

SEQ ID NO: 1383115 - RNA, 22 nt, Neisseria meningitidis Z2491
auccgcuauaacagcaacccug

SEQ ID NO: 1383116 - RNA, 13 nt, Neisseria meningitidis Z2491
aucgaaagccuca

SEQ ID NO: 1383117 - RNA, 14 nt, Neisseria meningitidis Z2491
aucgaaagccucau

SEQ ID NO: 1383118 - RNA, 15 nt, Neisseria meningitidis Z2491
aucgaacacgaugcu

SEQ ID NO: 1383119 - RNA, 22 nt, Neisseria meningitidis Z2491
aucgaaccaaauaaacaagguc

SEQ ID NO: 1383120 - RNA, 12 nt, Neisseria meningitidis Z2491
aucgggaaucac

SEQ ID NO: 1383121 - RNA, 15 nt, Neisseria meningitidis Z2491
aucggcucgccgccu

SEQ ID NO: 1383122 - RNA, 12 nt, Neisseria meningitidis Z2491
aucgggaaaaau

SEQ ID NO: 1383123 - RNA, 14 nt, Neisseria meningitidis Z2491
aucgggaaaaauag

SEQ ID NO: 1383124 - RNA, 21 nt, Neisseria meningitidis Z2491
aucgggaaaaauagaaucuuu

SEQ ID NO: 1383125 - RNA, 17 nt, Neisseria meningitidis Z2491
aucgggcgggaauagcu

SEQ ID NO: 1383126 - RNA, 19 nt, Neisseria meningitidis Z2491
aucgggcgggaauagcuca

SEQ ID NO: 1383127 - RNA, 22 nt, Neisseria meningitidis Z2491
aucggggcggcaacggaaauau

SEQ ID NO: 1383128 - RNA, 18 nt, Neisseria meningitidis Z2491
aucgguacgcagcaguuu

SEQ ID NO: 1383129 - RNA, 17 nt, Neisseria meningitidis Z2491
aucguacugguuuaaau

SEQ ID NO: 1383130 - RNA, 18 nt, Neisseria meningitidis Z2491
aucguacugguuuaaauu

SEQ ID NO: 1383131 - RNA, 15 nt, Neisseria meningitidis Z2491
aucguaaaaaugccg

SEQ ID NO: 1383132 - RNA, 14 nt, Neisseria meningitidis Z2491
aucgguuucgggcg

SEQ ID NO: 1383133 - RNA, 21 nt, Neisseria meningitidis Z2491
aucggacggauguucaaacac

SEQ ID NO: 1383134 - RNA, 16 nt, Neisseria meningitidis Z2491
aucgcgcccaauucuu

SEQ ID NO: 1383135 - RNA, 23 nt, Neisseria meningitidis Z2491
aucgcgcccaauucuucuuuaua

SEQ ID NO: 1383136 - RNA, 14 nt, Neisseria meningitidis Z2491
auccgaaacaacaa

SEQ ID NO: 1383137 - RNA, 20 nt, Neisseria meningitidis Z2491
auccgaaacaacagaaacca

SEQ ID NO: 1383138 - RNA, 18 nt, Neisseria meningitidis Z2491
aucccugacaaucaggaa

SEQ ID NO: 1383139 - RNA, 17 nt, Neisseria meningitidis Z2491
aucccuguguccuuauu

SEQ ID NO: 1383140 - RNA, 16 nt, Neisseria meningitidis Z2491
aucccguuauuuucac

SEQ ID NO: 1383141 - RNA, 16 nt, Neisseria meningitidis Z2491
aucccgucauucccgc

SEQ ID NO: 1383142 - RNA, 23 nt, Neisseria meningitidis Z2491
auccgaguggcuuccuuuuuaaa

SEQ ID NO: 1383143 - RNA, 21 nt, Neisseria meningitidis Z2491
auccgcccgaauaaaaaauau

SEQ ID NO: 1383144 - RNA, 17 nt, Neisseria meningitidis Z2491
auccgccugucuuugcg

SEQ ID NO: 1383145 - RNA, 16 nt, Neisseria meningitidis Z2491
auccauucccucuccc

SEQ ID NO: 1383146 - RNA, 21 nt, Neisseria meningitidis Z2491
auccauucgccgacuuugguu

SEQ ID NO: 1383147 - RNA, 20 nt, Neisseria meningitidis Z2491
auccagacauucaaugcuaa

SEQ ID NO: 1383148 - RNA, 13 nt, Neisseria meningitidis Z2491
auccaauaauccg

SEQ ID NO: 1383149 - RNA, 12 nt, Neisseria meningitidis Z2491
auccaccagccc

SEQ ID NO: 1383150 - RNA, 22 nt, Neisseria meningitidis Z2491
aaaacuuuucugauuuuuccua

SEQ ID NO: 1383151 - RNA, 12 nt, Neisseria meningitidis Z2491
aucugacaggcg

SEQ ID NO: 1383152 - RNA, 15 nt, Neisseria meningitidis Z2491
aucuuauccauccca

SEQ ID NO: 1383153 - RNA, 19 nt, Neisseria meningitidis Z2491
aucgucaccgcuuuucuuu

SEQ ID NO: 1383154 - RNA, 22 nt, Neisseria meningitidis Z2491
aucgucauucccgcaaaaacaa

SEQ ID NO: 1383155 - RNA, 21 nt, Neisseria meningitidis Z2491
aucguauuuuuaucuuuuaau

SEQ ID NO: 1383156 - RNA, 20 nt, Neisseria meningitidis Z2491
aucuagaaaugaaaaacgac

SEQ ID NO: 1383157 - RNA, 13 nt, Neisseria meningitidis Z2491
aucuagaaauuua

SEQ ID NO: 1383158 - RNA, 19 nt, Neisseria meningitidis Z2491
aucuagacauucaaugcua

SEQ ID NO: 1383159 - RNA, 20 nt, Neisseria meningitidis Z2491
aucuagacauucaaugcuaa

SEQ ID NO: 1383160 - RNA, 24 nt, Neisseria meningitidis Z2491
aucuagacauucaaugcuaaggca

SEQ ID NO: 1383161 - RNA, 12 nt, Neisseria meningitidis Z2491
aucuagaaccca

SEQ ID NO: 1383162 - RNA, 14 nt, Neisseria meningitidis Z2491
aucuagaacgugga

SEQ ID NO: 1383163 - RNA, 20 nt, Neisseria meningitidis Z2491
aucuaguacagccccuuaaa

SEQ ID NO: 1383164 - RNA, 22 nt, Neisseria meningitidis Z2491
aucuaguacagccccuuaaagu

SEQ ID NO: 1383165 - RNA, 17 nt, Neisseria meningitidis Z2491
aucucauuuucaaaaug

SEQ ID NO: 1383166 - RNA, 22 nt, Neisseria meningitidis Z2491
aucucauuuucaaaaugcaaaa

SEQ ID NO: 1383167 - RNA, 16 nt, Neisseria meningitidis Z2491
augaucaguaaaaaac

SEQ ID NO: 1383168 - RNA, 18 nt, Neisseria meningitidis Z2491
augauacgcgacaauaaa

SEQ ID NO: 1383169 - RNA, 16 nt, Neisseria meningitidis Z2491
augacauuaagauguu

SEQ ID NO: 1383170 - RNA, 15 nt, Neisseria meningitidis Z2491
augacugaaacucaa

SEQ ID NO: 1383171 - RNA, 16 nt, Neisseria meningitidis Z2491
augacugaaacucaaa

SEQ ID NO: 1383172 - RNA, 17 nt, Neisseria meningitidis Z2491
augacugaaacucaaaa

SEQ ID NO: 1383173 - RNA, 18 nt, Neisseria meningitidis Z2491
augacugaaacucaaaaa

SEQ ID NO: 1383174 - RNA, 18 nt, Neisseria meningitidis Z2491
augacugaagcucaaaaa

SEQ ID NO: 1383175 - RNA, 20 nt, Neisseria meningitidis Z2491
augaauuuaaacaggcacag

SEQ ID NO: 1383176 - RNA, 22 nt, Neisseria meningitidis Z2491
augaacgauuugaaccauuucc

SEQ ID NO: 1383177 - RNA, 23 nt, Neisseria meningitidis Z2491
augaacgauuugaaccauuucca

SEQ ID NO: 1383178 - RNA, 17 nt, Neisseria meningitidis Z2491
augaacaauccauacau

SEQ ID NO: 1383179 - RNA, 16 nt, Neisseria meningitidis Z2491
aucuucgaggaacaaa

SEQ ID NO: 1383180 - RNA, 22 nt, Neisseria meningitidis Z2491
aucuucgaggaacaaaaugccg

SEQ ID NO: 1383181 - RNA, 19 nt, Neisseria meningitidis Z2491
aguuauucggaucaacguu

SEQ ID NO: 1383182 - RNA, 23 nt, Neisseria meningitidis Z2491
aguuauuaagugaguaaaaacaa

SEQ ID NO: 1383183 - RNA, 22 nt, Neisseria meningitidis Z2491
aguguaucggugucaaaacaag

SEQ ID NO: 1383184 - RNA, 13 nt, Neisseria meningitidis Z2491
aguuccaaagccu

SEQ ID NO: 1383185 - RNA, 22 nt, Neisseria meningitidis Z2491
aguucgggaucggagagacugu

SEQ ID NO: 1383186 - RNA, 24 nt, Neisseria meningitidis Z2491
aguucgggaucggagagacugugc

SEQ ID NO: 1383187 - RNA, 22 nt, Neisseria meningitidis Z2491
aguucgucgaaacggcaaaaca

SEQ ID NO: 1383188 - RNA, 13 nt, Neisseria meningitidis Z2491
aguucgugcaggg

SEQ ID NO: 1383189 - RNA, 16 nt, Neisseria meningitidis Z2491
aguugauuaaaacaaa

SEQ ID NO: 1383190 - RNA, 18 nt, Neisseria meningitidis Z2491
aguugauuaaaacaaaaa

SEQ ID NO: 1383191 - RNA, 22 nt, Neisseria meningitidis Z2491
aguugauuaaaacaaaaaugag

SEQ ID NO: 1383192 - RNA, 17 nt, Neisseria meningitidis Z2491
aguuucggucauuuccg

SEQ ID NO: 1383193 - RNA, 18 nt, Neisseria meningitidis Z2491
aguuucggucauuuccga

SEQ ID NO: 1383194 - RNA, 19 nt, Neisseria meningitidis Z2491
aguuucugccccuggcugc

SEQ ID NO: 1383195 - RNA, 17 nt, Neisseria meningitidis Z2491
aguuuccacuaaaugcu

SEQ ID NO: 1383196 - RNA, 16 nt, Neisseria meningitidis Z2491
aguuucagucauuccc

SEQ ID NO: 1383197 - RNA, 14 nt, Neisseria meningitidis Z2491
aguuucagucauuu

SEQ ID NO: 1383198 - RNA, 20 nt, Neisseria meningitidis Z2491
aguuuguuguucaaauaaau

SEQ ID NO: 1383199 - RNA, 14 nt, Neisseria meningitidis Z2491
aguuugaaaucaac

SEQ ID NO: 1383200 - RNA, 19 nt, Neisseria meningitidis Z2491
aguuugcgcaugauggcaa

SEQ ID NO: 1383201 - RNA, 18 nt, Neisseria meningitidis Z2491
aguuuaaaggaaaugccg

SEQ ID NO: 1383202 - RNA, 19 nt, Neisseria meningitidis Z2491
aguuucaaaauuuauucua

SEQ ID NO: 1383203 - RNA, 19 nt, Neisseria meningitidis Z2491
aguugccgucaaagaacac

SEQ ID NO: 1383204 - RNA, 17 nt, Neisseria meningitidis Z2491
aguggauuaaauuuaaa

SEQ ID NO: 1383205 - RNA, 19 nt, Neisseria meningitidis Z2491
aguggauuaaauuuaaacc

SEQ ID NO: 1383206 - RNA, 21 nt, Neisseria meningitidis Z2491
aguggauuaaauuuaaaccag

SEQ ID NO: 1383207 - RNA, 14 nt, Neisseria meningitidis Z2491
aguggauuaacaaa

SEQ ID NO: 1383208 - RNA, 18 nt, Neisseria meningitidis Z2491
aguggauuaacaaaaacc

SEQ ID NO: 1383209 - RNA, 17 nt, Neisseria meningitidis Z2491
agugauggcaagcuuuu

SEQ ID NO: 1383210 - RNA, 19 nt, Neisseria meningitidis Z2491
agugauggcuucuaaaaau

SEQ ID NO: 1383211 - RNA, 11 nt, Neisseria meningitidis Z2491
agugauuuccc

SEQ ID NO: 1383212 - RNA, 21 nt, Neisseria meningitidis Z2491
aguauuuuacaaucagaauac

SEQ ID NO: 1383213 - RNA, 20 nt, Neisseria meningitidis Z2491
aguccuacccaaaaggaagu

SEQ ID NO: 1383214 - RNA, 15 nt, Neisseria meningitidis Z2491
agucugcgaaacaga

SEQ ID NO: 1383215 - RNA, 16 nt, Neisseria meningitidis Z2491
agucugcgaaacagac

SEQ ID NO: 1383216 - RNA, 19 nt, Neisseria meningitidis Z2491
agucugcgaaacagacauu

SEQ ID NO: 1383217 - RNA, 21 nt, Neisseria meningitidis Z2491
auaacauagguuacuaaaauu

SEQ ID NO: 1383218 - RNA, 22 nt, Neisseria meningitidis Z2491
auaacauagguuacuaaaauuu

SEQ ID NO: 1383219 - RNA, 12 nt, Neisseria meningitidis Z2491
auaaauuuuugc

SEQ ID NO: 1383220 - RNA, 20 nt, Neisseria meningitidis Z2491
auaaccuucguaauuuuucu

SEQ ID NO: 1383221 - RNA, 16 nt, Neisseria meningitidis Z2491
auaacgggauuucagc

SEQ ID NO: 1383222 - RNA, 17 nt, Neisseria meningitidis Z2491
auaaagccuaaauacaa

SEQ ID NO: 1383223 - RNA, 13 nt, Neisseria meningitidis Z2491
auaaaaugccguc

SEQ ID NO: 1383224 - RNA, 14 nt, Neisseria meningitidis Z2491
auaaaauuggaaau

SEQ ID NO: 1383225 - RNA, 14 nt, Neisseria meningitidis Z2491
auaaacaaaauaaa

SEQ ID NO: 1383226 - RNA, 18 nt, Neisseria meningitidis Z2491
auaaacaaaauaaacuca

SEQ ID NO: 1383227 - RNA, 19 nt, Neisseria meningitidis Z2491
auacacuguaaucucaaau

SEQ ID NO: 1383228 - RNA, 15 nt, Neisseria meningitidis Z2491
auacacuuaaaaaua

SEQ ID NO: 1383229 - RNA, 16 nt, Neisseria meningitidis Z2491
auacacaagguuauuu

SEQ ID NO: 1383230 - RNA, 19 nt, Neisseria meningitidis Z2491
auacacaagguuauuuucu

SEQ ID NO: 1383231 - RNA, 13 nt, Neisseria meningitidis Z2491
auacacaaaaaag

SEQ ID NO: 1383232 - RNA, 20 nt, Neisseria meningitidis Z2491
auaauugucuuuucccuugc

SEQ ID NO: 1383233 - RNA, 22 nt, Neisseria meningitidis Z2491
auaauuggggucaguuuuccuu

SEQ ID NO: 1383234 - RNA, 21 nt, Neisseria meningitidis Z2491
auacaaacaucugauuuuucu

SEQ ID NO: 1383235 - RNA, 21 nt, Neisseria meningitidis Z2491
auacaaaaggccgucugaaau

SEQ ID NO: 1383236 - RNA, 21 nt, Neisseria meningitidis Z2491
auacaaaaugccgucugaaac

SEQ ID NO: 1383237 - RNA, 20 nt, Neisseria meningitidis Z2491
auaauuuuuaaaauuuuuau

SEQ ID NO: 1383238 - RNA, 18 nt, Neisseria meningitidis Z2491
auaaucagcccgaaauaa

SEQ ID NO: 1383239 - RNA, 21 nt, Neisseria meningitidis Z2491
auaauccuuaucggcaaaaaa

SEQ ID NO: 1383240 - RNA, 19 nt, Neisseria meningitidis Z2491
auaaucuuccuucugaaau

SEQ ID NO: 1383241 - RNA, 21 nt, Neisseria meningitidis Z2491
auaauggaacaaagaaagcag

SEQ ID NO: 1383242 - RNA, 21 nt, Neisseria meningitidis Z2491
auaaugaaaaugugcauuucu

SEQ ID NO: 1383243 - RNA, 23 nt, Neisseria meningitidis Z2491
auaaguuuccgcaccgacagacc

SEQ ID NO: 1383244 - RNA, 20 nt, Neisseria meningitidis Z2491
agcuuugaguuucuagauuc

SEQ ID NO: 1383245 - RNA, 23 nt, Neisseria meningitidis Z2491
aggaaauuuccaaauauaaaaaa

SEQ ID NO: 1383246 - RNA, 20 nt, Neisseria meningitidis Z2491
aggagaaaucagaaaaguuu

SEQ ID NO: 1383247 - RNA, 11 nt, Neisseria meningitidis Z2491
aggacaaagcg

SEQ ID NO: 1383248 - RNA, 22 nt, Neisseria meningitidis Z2491
aggacaaagcguucaggugcuu

SEQ ID NO: 1383249 - RNA, 14 nt, Neisseria meningitidis Z2491
aggacaaaaauccu

SEQ ID NO: 1383250 - RNA, 23 nt, Neisseria meningitidis Z2491
agcuuguggguauuuaccagaaa

SEQ ID NO: 1383251 - RNA, 22 nt, Neisseria meningitidis Z2491
agcuugguaaugucggcauuuu

SEQ ID NO: 1383252 - RNA, 23 nt, Neisseria meningitidis Z2491
agcuucgccaguuugcgcaugau

SEQ ID NO: 1383253 - RNA, 23 nt, Neisseria meningitidis Z2491
agcuucgcgacgguauugauguc

SEQ ID NO: 1383254 - RNA, 15 nt, Neisseria meningitidis Z2491
agcuucgucauuccc

SEQ ID NO: 1383255 - RNA, 19 nt, Neisseria meningitidis Z2491
agcuuccaacucggcaaac

SEQ ID NO: 1383256 - RNA, 13 nt, Neisseria meningitidis Z2491
agcucccaauccc

SEQ ID NO: 1383257 - RNA, 21 nt, Neisseria meningitidis Z2491
aggcaagcguucacgccagca

SEQ ID NO: 1383258 - RNA, 14 nt, Neisseria meningitidis Z2491
aggcaagcagcucg

SEQ ID NO: 1383259 - RNA, 22 nt, Neisseria meningitidis Z2491
aggcaacgccguacugguuuuu

SEQ ID NO: 1383260 - RNA, 23 nt, Neisseria meningitidis Z2491
aggcaacaccguacugguuuaaa

SEQ ID NO: 1383261 - RNA, 23 nt, Neisseria meningitidis Z2491
aggcaacaucguacugguuuaaa

SEQ ID NO: 1383262 - RNA, 20 nt, Neisseria meningitidis Z2491
aggcaacccgcuuuaugguu

SEQ ID NO: 1383263 - RNA, 16 nt, Neisseria meningitidis Z2491
aggagcaauuaaauuu

SEQ ID NO: 1383264 - RNA, 16 nt, Neisseria meningitidis Z2491
aggcacgguaaaccgc

SEQ ID NO: 1383265 - RNA, 19 nt, Neisseria meningitidis Z2491
aggcacgguaaaccgccag

SEQ ID NO: 1383266 - RNA, 14 nt, Neisseria meningitidis Z2491
aggcagaaauccaa

SEQ ID NO: 1383267 - RNA, 15 nt, Neisseria meningitidis Z2491
aggcacgaagcccuc

SEQ ID NO: 1383268 - RNA, 18 nt, Neisseria meningitidis Z2491
aggcacgaaucuuaucca

SEQ ID NO: 1383269 - RNA, 19 nt, Neisseria meningitidis Z2491
aggcacgaaucuuauccac

SEQ ID NO: 1383270 - RNA, 15 nt, Neisseria meningitidis Z2491
aggcauuauuuuuca

SEQ ID NO: 1383271 - RNA, 16 nt, Neisseria meningitidis Z2491
aggcauugaaauucca

SEQ ID NO: 1383272 - RNA, 21 nt, Neisseria meningitidis Z2491
aggcauugaaauuccagauuc

SEQ ID NO: 1383273 - RNA, 21 nt, Neisseria meningitidis Z2491
aggcauugaaauucuagauuc

SEQ ID NO: 1383274 - RNA, 23 nt, Neisseria meningitidis Z2491
aggcauuuaucggauaaaacaga

SEQ ID NO: 1383275 - RNA, 14 nt, Neisseria meningitidis Z2491
aggcccaaaacaaa

SEQ ID NO: 1383276 - RNA, 17 nt, Neisseria meningitidis Z2491
aggcgcguccaacacgc

SEQ ID NO: 1383277 - RNA, 12 nt, Neisseria meningitidis Z2491
aggcgacgguuu

SEQ ID NO: 1383278 - RNA, 20 nt, Neisseria meningitidis Z2491
aggccuuugggcgacggcaa

SEQ ID NO: 1383279 - RNA, 13 nt, Neisseria meningitidis Z2491
aggccgucugaaa

SEQ ID NO: 1383280 - RNA, 19 nt, Neisseria meningitidis Z2491
agggugauuucuguggaga

SEQ ID NO: 1383281 - RNA, 15 nt, Neisseria meningitidis Z2491
agguaacgguuuuuu

SEQ ID NO: 1383282 - RNA, 13 nt, Neisseria meningitidis Z2491
agguagcggcuga

SEQ ID NO: 1383283 - RNA, 17 nt, Neisseria meningitidis Z2491
aggucggacauuugacu

SEQ ID NO: 1383284 - RNA, 13 nt, Neisseria meningitidis Z2491
aggucgucugaaa

SEQ ID NO: 1383285 - RNA, 15 nt, Neisseria meningitidis Z2491
aggucgucugaaaag

SEQ ID NO: 1383286 - RNA, 21 nt, Neisseria meningitidis Z2491
aggucucauauucacuaaauu

SEQ ID NO: 1383287 - RNA, 22 nt, Neisseria meningitidis Z2491
aggugcagguuuuuuugauuca

SEQ ID NO: 1383288 - RNA, 16 nt, Neisseria meningitidis Z2491
agggcugcaaaauuua

SEQ ID NO: 1383289 - RNA, 22 nt, Neisseria meningitidis Z2491
agggaauggccgauuuuggguu

SEQ ID NO: 1383290 - RNA, 17 nt, Neisseria meningitidis Z2491
aggcuuuguuauuuuua

SEQ ID NO: 1383291 - RNA, 16 nt, Neisseria meningitidis Z2491
aggcuuuugaggcugc

SEQ ID NO: 1383292 - RNA, 19 nt, Neisseria meningitidis Z2491
aggcuuuuucgccagcauc

SEQ ID NO: 1383293 - RNA, 18 nt, Neisseria meningitidis Z2491
agggaaagugauuuuguc

SEQ ID NO: 1383294 - RNA, 13 nt, Neisseria meningitidis Z2491
agggaaagcagca

SEQ ID NO: 1383295 - RNA, 14 nt, Neisseria meningitidis Z2491
aggcuuucagauag

SEQ ID NO: 1383296 - RNA, 17 nt, Neisseria meningitidis Z2491
aguauguauaaugccca

SEQ ID NO: 1383297 - RNA, 21 nt, Neisseria meningitidis Z2491
aguauaguggauuaacaaaaa

SEQ ID NO: 1383298 - RNA, 18 nt, Neisseria meningitidis Z2491
aguacauuuugguuguuc

SEQ ID NO: 1383299 - RNA, 23 nt, Neisseria meningitidis Z2491
aguaaucacaacggcguuuucaa

SEQ ID NO: 1383300 - RNA, 14 nt, Neisseria meningitidis Z2491
aguaauaaauuaau

SEQ ID NO: 1383301 - RNA, 18 nt, Neisseria meningitidis Z2491
agguugugggaauccaga

SEQ ID NO: 1383302 - RNA, 18 nt, Neisseria meningitidis Z2491
agguuugagcaguuuuuu

SEQ ID NO: 1383303 - RNA, 14 nt, Neisseria meningitidis Z2491
aguaaaauuuauua

SEQ ID NO: 1383304 - RNA, 19 nt, Neisseria meningitidis Z2491
agcuacggcucguuuaauu

SEQ ID NO: 1383305 - RNA, 15 nt, Neisseria meningitidis Z2491
agcguugccucgccu

SEQ ID NO: 1383306 - RNA, 23 nt, Neisseria meningitidis Z2491
agcuauccgcacagaaaccugca

SEQ ID NO: 1383307 - RNA, 19 nt, Neisseria meningitidis Z2491
agcucagacggcauuuguc

SEQ ID NO: 1383308 - RNA, 23 nt, Neisseria meningitidis Z2491
agcucaguugguagagcgcaacc

SEQ ID NO: 1383309 - RNA, 20 nt, Neisseria meningitidis Z2491
agcggcugggcaugcagcau

SEQ ID NO: 1383310 - RNA, 17 nt, Neisseria meningitidis Z2491
agcgggaaucuaaaaau

SEQ ID NO: 1383311 - RNA, 18 nt, Neisseria meningitidis Z2491
agcgggaaucuagaaucu

SEQ ID NO: 1383312 - RNA, 17 nt, Neisseria meningitidis Z2491
agcgggcgcacuuagcc

SEQ ID NO: 1383313 - RNA, 23 nt, Neisseria meningitidis Z2491
agcggccgccaucaaaaaggcuu

SEQ ID NO: 1383314 - RNA, 17 nt, Neisseria meningitidis Z2491
agcgcguuuucauccac

SEQ ID NO: 1383315 - RNA, 13 nt, Neisseria meningitidis Z2491
agcgguuucuguu

SEQ ID NO: 1383316 - RNA, 23 nt, Neisseria meningitidis Z2491
agcguguuccgcaucgucgggaa

SEQ ID NO: 1383317 - RNA, 21 nt, Neisseria meningitidis Z2491
agcgugcggacguucaaaccc

SEQ ID NO: 1383318 - RNA, 21 nt, Neisseria meningitidis Z2491
agcgcaaccuugccaagguug

SEQ ID NO: 1383319 - RNA, 23 nt, Neisseria meningitidis Z2491
agcgcaaccuugccaagguugag

SEQ ID NO: 1383320 - RNA, 23 nt, Neisseria meningitidis Z2491
agcgaugucguugucaaccaaaa

SEQ ID NO: 1383321 - RNA, 15 nt, Neisseria meningitidis Z2491
agcgauuauuuuuua

SEQ ID NO: 1383322 - RNA, 16 nt, Neisseria meningitidis Z2491
agccugcccaucgccu

SEQ ID NO: 1383323 - RNA, 19 nt, Neisseria meningitidis Z2491
agccugcccaucgccucuu

SEQ ID NO: 1383324 - RNA, 13 nt, Neisseria meningitidis Z2491
agccugcagcaga

SEQ ID NO: 1383325 - RNA, 19 nt, Neisseria meningitidis Z2491
agccugcucggccugcccu

SEQ ID NO: 1383326 - RNA, 21 nt, Neisseria meningitidis Z2491
agccugcucggccugcccugc

SEQ ID NO: 1383327 - RNA, 20 nt, Neisseria meningitidis Z2491
agccuguuggccgcuuucaa

SEQ ID NO: 1383328 - RNA, 20 nt, Neisseria meningitidis Z2491
agccuuaacagggaaagcag

SEQ ID NO: 1383329 - RNA, 16 nt, Neisseria meningitidis Z2491
agcagugccgcaccac

SEQ ID NO: 1383330 - RNA, 19 nt, Neisseria meningitidis Z2491
agcaucauauugguuccgu

SEQ ID NO: 1383331 - RNA, 21 nt, Neisseria meningitidis Z2491
agcaucuuguuuuucaaucaa

SEQ ID NO: 1383332 - RNA, 18 nt, Neisseria meningitidis Z2491
agcaggcguuuuucagac

SEQ ID NO: 1383333 - RNA, 12 nt, Neisseria meningitidis Z2491
agcaguaaaauu

SEQ ID NO: 1383334 - RNA, 20 nt, Neisseria meningitidis Z2491
agcaguaaaauuuauuaugu

SEQ ID NO: 1383335 - RNA, 21 nt, Neisseria meningitidis Z2491
agcaguaaaauuuauuaugua

SEQ ID NO: 1383336 - RNA, 13 nt, Neisseria meningitidis Z2491
agcagagcugugc

SEQ ID NO: 1383337 - RNA, 23 nt, Neisseria meningitidis Z2491
agcagaugaagcugcaacugaaa

SEQ ID NO: 1383338 - RNA, 20 nt, Neisseria meningitidis Z2491
agcaccguuuaaaacagcau

SEQ ID NO: 1383339 - RNA, 21 nt, Neisseria meningitidis Z2491
agcaccguuuaaaacagcauu

SEQ ID NO: 1383340 - RNA, 16 nt, Neisseria meningitidis Z2491
agcccaaucccgcaac

SEQ ID NO: 1383341 - RNA, 22 nt, Neisseria meningitidis Z2491
agccacgccaaaaaugcggccg

SEQ ID NO: 1383342 - RNA, 14 nt, Neisseria meningitidis Z2491
agccccaccauugu

SEQ ID NO: 1383343 - RNA, 18 nt, Neisseria meningitidis Z2491
agcccacccuaccauugu

SEQ ID NO: 1383344 - RNA, 15 nt, Neisseria meningitidis Z2491
agccgacuuuuucca

SEQ ID NO: 1383345 - RNA, 12 nt, Neisseria meningitidis Z2491
agcccuuucaga

SEQ ID NO: 1383346 - RNA, 14 nt, Neisseria meningitidis Z2491
agcccgagauaacu

SEQ ID NO: 1383347 - RNA, 21 nt, Neisseria meningitidis Z2491
agcccgccccggcugguguug

SEQ ID NO: 1383348 - RNA, 14 nt, Neisseria meningitidis Z2491
agcaaaaaaugccg

SEQ ID NO: 1383349 - RNA, 21 nt, Neisseria meningitidis Z2491
agauuuuuuuauuuaaacagc

SEQ ID NO: 1383350 - RNA, 19 nt, Neisseria meningitidis Z2491
agcaaaaagguuuucagac

SEQ ID NO: 1383351 - RNA, 19 nt, Neisseria meningitidis Z2491
agcaaaauauggcugacua

SEQ ID NO: 1383352 - RNA, 11 nt, Neisseria meningitidis Z2491
agcaacagaaa

SEQ ID NO: 1383353 - RNA, 15 nt, Neisseria meningitidis Z2491
agcaaaucgaugcgu

SEQ ID NO: 1383354 - RNA, 14 nt, Neisseria meningitidis Z2491
agauuguuucccag

SEQ ID NO: 1383355 - RNA, 15 nt, Neisseria meningitidis Z2491
agauuucaccgcugc

SEQ ID NO: 1383356 - RNA, 20 nt, Neisseria meningitidis Z2491
agauuuccgccgucauuccc

SEQ ID NO: 1383357 - RNA, 20 nt, Neisseria meningitidis Z2491
agauuuuuguuuaucuuuca

SEQ ID NO: 1383358 - RNA, 16 nt, Neisseria meningitidis Z2491
agauucccgcuuucac

SEQ ID NO: 1383359 - RNA, 23 nt, Neisseria meningitidis Z2491
agauucccgcuuuugcgggaaug

SEQ ID NO: 1383360 - RNA, 19 nt, Neisseria meningitidis Z2491
agauucuagauucccgcuu

SEQ ID NO: 1383361 - RNA, 23 nt, Neisseria meningitidis Z2491
agauugaggaucuugauguguuu

SEQ ID NO: 1383362 - RNA, 19 nt, Neisseria meningitidis Z2491
agauugauaaaagcacaaa

SEQ ID NO: 1383363 - RNA, 23 nt, Neisseria meningitidis Z2491
agauugauaaaagcacaaauuaa

SEQ ID NO: 1383364 - RNA, 23 nt, Neisseria meningitidis Z2491
agauucccgccugcgcgggaaug

SEQ ID NO: 1383365 - RNA, 23 nt, Neisseria meningitidis Z2491
agauucccgccuucgcgggaaug

SEQ ID NO: 1383366 - RNA, 15 nt, Neisseria meningitidis Z2491
aaaaccgaaacagaa

SEQ ID NO: 1383367 - RNA, 18 nt, Neisseria meningitidis Z2491
agaucauaccuaccgccu

SEQ ID NO: 1383368 - RNA, 14 nt, Neisseria meningitidis Z2491
agauauuguucaga

SEQ ID NO: 1383369 - RNA, 15 nt, Neisseria meningitidis Z2491
agauagcauauaaca

SEQ ID NO: 1383370 - RNA, 21 nt, Neisseria meningitidis Z2491
agauauaguggauuaacaaaa

SEQ ID NO: 1383371 - RNA, 23 nt, Neisseria meningitidis Z2491
agauauaguggauuaacaaaaac

SEQ ID NO: 1383372 - RNA, 20 nt, Neisseria meningitidis Z2491
agaggcauaccguugcgugu

SEQ ID NO: 1383373 - RNA, 13 nt, Neisseria meningitidis Z2491
aaaaccaaaaaca

SEQ ID NO: 1383374 - RNA, 17 nt, Neisseria meningitidis Z2491
aaaaccaaaaacagcaa

SEQ ID NO: 1383375 - RNA, 18 nt, Neisseria meningitidis Z2491
aaaaccaaaaacagcaac

SEQ ID NO: 1383376 - RNA, 21 nt, Neisseria meningitidis Z2491
agaggucuugcagguggaauu

SEQ ID NO: 1383377 - RNA, 13 nt, Neisseria meningitidis Z2491
agagcugugcagu

SEQ ID NO: 1383378 - RNA, 14 nt, Neisseria meningitidis Z2491
agaccaaacagaac

SEQ ID NO: 1383379 - RNA, 16 nt, Neisseria meningitidis Z2491
agacaguacaaauagu

SEQ ID NO: 1383380 - RNA, 23 nt, Neisseria meningitidis Z2491
agacaucucgaauuuuuuccaua

SEQ ID NO: 1383381 - RNA, 23 nt, Neisseria meningitidis Z2491
agacaucccccaaccaauauuca

SEQ ID NO: 1383382 - RNA, 16 nt, Neisseria meningitidis Z2491
agacauugcuaaaaca

SEQ ID NO: 1383383 - RNA, 13 nt, Neisseria meningitidis Z2491
agacauuaaaaaa

SEQ ID NO: 1383384 - RNA, 14 nt, Neisseria meningitidis Z2491
agacauuaaaaaau

SEQ ID NO: 1383385 - RNA, 17 nt, Neisseria meningitidis Z2491
agacauucaaugcuaag

SEQ ID NO: 1383386 - RNA, 21 nt, Neisseria meningitidis Z2491
agacauucaaugcuaaggcaa

SEQ ID NO: 1383387 - RNA, 22 nt, Neisseria meningitidis Z2491
agacauucaaugcuaaggcaau

SEQ ID NO: 1383388 - RNA, 12 nt, Neisseria meningitidis Z2491
agacgguacaaa

SEQ ID NO: 1383389 - RNA, 23 nt, Neisseria meningitidis Z2491
agacggugugccgaaguuaaauc

SEQ ID NO: 1383390 - RNA, 19 nt, Neisseria meningitidis Z2491
agacgguauucuuucgcuu

SEQ ID NO: 1383391 - RNA, 20 nt, Neisseria meningitidis Z2491
aaaacaguccacauuuggaa

SEQ ID NO: 1383392 - RNA, 18 nt, Neisseria meningitidis Z2491
aaaacagcaaccugaaau

SEQ ID NO: 1383393 - RNA, 17 nt, Neisseria meningitidis Z2491
aaaacagccgaaaacag

SEQ ID NO: 1383394 - RNA, 16 nt, Neisseria meningitidis Z2491
aaaacagccgaaaacc

SEQ ID NO: 1383395 - RNA, 18 nt, Neisseria meningitidis Z2491
aaaacagccgaaaaccug

SEQ ID NO: 1383396 - RNA, 17 nt, Neisseria meningitidis Z2491
agaccgaauuuaaucaa

SEQ ID NO: 1383397 - RNA, 22 nt, Neisseria meningitidis Z2491
agaccgaauuuaaucaagucuu

SEQ ID NO: 1383398 - RNA, 16 nt, Neisseria meningitidis Z2491
agaauugauucuccca

SEQ ID NO: 1383399 - RNA, 19 nt, Neisseria meningitidis Z2491
agacaaccgacaauacggc

SEQ ID NO: 1383400 - RNA, 17 nt, Neisseria meningitidis Z2491
agacaauggagcaggca

SEQ ID NO: 1383401 - RNA, 14 nt, Neisseria meningitidis Z2491
agaacagaaaacca

SEQ ID NO: 1383402 - RNA, 14 nt, Neisseria meningitidis Z2491
agaaccgaacacag

SEQ ID NO: 1383403 - RNA, 19 nt, Neisseria meningitidis Z2491
aaaacacagccaaaauauu

SEQ ID NO: 1383404 - RNA, 18 nt, Neisseria meningitidis Z2491
agaaccggauucccgccu

SEQ ID NO: 1383405 - RNA, 19 nt, Neisseria meningitidis Z2491
agaagauuuuuguuuaucu

SEQ ID NO: 1383406 - RNA, 16 nt, Neisseria meningitidis Z2491
agaaaaccaaaaacag

SEQ ID NO: 1383407 - RNA, 13 nt, Neisseria meningitidis Z2491
agaaaaccaaaau

SEQ ID NO: 1383408 - RNA, 14 nt, Neisseria meningitidis Z2491
agaaaaccaaaauc

SEQ ID NO: 1383409 - RNA, 23 nt, Neisseria meningitidis Z2491
agaaaacgccgucugaaauuuca

SEQ ID NO: 1383410 - RNA, 23 nt, Neisseria meningitidis Z2491
agaaaacagaaagccaaaaacag

SEQ ID NO: 1383411 - RNA, 14 nt, Neisseria meningitidis Z2491
agaaacccaaaauc

SEQ ID NO: 1383412 - RNA, 17 nt, Neisseria meningitidis Z2491
agaaagcaaaaccgccg

SEQ ID NO: 1383413 - RNA, 13 nt, Neisseria meningitidis Z2491
agaaaguggaauu

SEQ ID NO: 1383414 - RNA, 21 nt, Neisseria meningitidis Z2491
acccaugccauacugccugcc

SEQ ID NO: 1383415 - RNA, 22 nt, Neisseria meningitidis Z2491
accccgauuuguccgacacaau

SEQ ID NO: 1383416 - RNA, 16 nt, Neisseria meningitidis Z2491
accccaggauaaaggg

SEQ ID NO: 1383417 - RNA, 22 nt, Neisseria meningitidis Z2491
acccaaaaucggccauucccuc

SEQ ID NO: 1383418 - RNA, 20 nt, Neisseria meningitidis Z2491
acccaacaggguuccgaaau

SEQ ID NO: 1383419 - RNA, 14 nt, Neisseria meningitidis Z2491
accauuucuuuggc

SEQ ID NO: 1383420 - RNA, 14 nt, Neisseria meningitidis Z2491
acccaaugacugcc

SEQ ID NO: 1383421 - RNA, 17 nt, Neisseria meningitidis Z2491
acccaacuuacgcaacc

SEQ ID NO: 1383422 - RNA, 12 nt, Neisseria meningitidis Z2491
accauuguuucc

SEQ ID NO: 1383423 - RNA, 14 nt, Neisseria meningitidis Z2491
accagaaaaaacag

SEQ ID NO: 1383424 - RNA, 22 nt, Neisseria meningitidis Z2491
accauaccgccuucaucaaaau

SEQ ID NO: 1383425 - RNA, 20 nt, Neisseria meningitidis Z2491
accgcgaacaucaucuaaau

SEQ ID NO: 1383426 - RNA, 14 nt, Neisseria meningitidis Z2491
accgcgcugcucgg

SEQ ID NO: 1383427 - RNA, 22 nt, Neisseria meningitidis Z2491
accggauuccuacgaaaacagg

SEQ ID NO: 1383428 - RNA, 20 nt, Neisseria meningitidis Z2491
acccucuccccgacccuccc

SEQ ID NO: 1383429 - RNA, 12 nt, Neisseria meningitidis Z2491
accgcacccccg

SEQ ID NO: 1383430 - RNA, 19 nt, Neisseria meningitidis Z2491
accgccauuccccggcauc

SEQ ID NO: 1383431 - RNA, 11 nt, Neisseria meningitidis Z2491
accgccagccu

SEQ ID NO: 1383432 - RNA, 21 nt, Neisseria meningitidis Z2491
accgccgccaacaccgcgccu

SEQ ID NO: 1383433 - RNA, 17 nt, Neisseria meningitidis Z2491
acgccagcaacauuucc

SEQ ID NO: 1383434 - RNA, 18 nt, Neisseria meningitidis Z2491
acgccagcacaaacagca

SEQ ID NO: 1383435 - RNA, 20 nt, Neisseria meningitidis Z2491
acgcaggguuaagaaaaccu

SEQ ID NO: 1383436 - RNA, 14 nt, Neisseria meningitidis Z2491
acgcaauaccaaac

SEQ ID NO: 1383437 - RNA, 13 nt, Neisseria meningitidis Z2491
acgcacuggauuc

SEQ ID NO: 1383438 - RNA, 17 nt, Neisseria meningitidis Z2491
acgagucagaaguuacu

SEQ ID NO: 1383439 - RNA, 22 nt, Neisseria meningitidis Z2491
acgagucagaaguuacucgaaa

SEQ ID NO: 1383440 - RNA, 22 nt, Neisseria meningitidis Z2491
acgaaggcuaucacgguugugc

SEQ ID NO: 1383441 - RNA, 20 nt, Neisseria meningitidis Z2491
acgaagaacgccaaacccaa

SEQ ID NO: 1383442 - RNA, 21 nt, Neisseria meningitidis Z2491
acgaagcccucagcuaugccu

SEQ ID NO: 1383443 - RNA, 22 nt, Neisseria meningitidis Z2491
acgcaaaacacaacuuuuccca

SEQ ID NO: 1383444 - RNA, 23 nt, Neisseria meningitidis Z2491
acgcaaacuaacuuauacacacg

SEQ ID NO: 1383445 - RNA, 17 nt, Neisseria meningitidis Z2491
acgauuuugugccguuc

SEQ ID NO: 1383446 - RNA, 18 nt, Neisseria meningitidis Z2491
accuguuuuucaaagccc

SEQ ID NO: 1383447 - RNA, 14 nt, Neisseria meningitidis Z2491
accuuaacaaucac

SEQ ID NO: 1383448 - RNA, 16 nt, Neisseria meningitidis Z2491
accuuaacaaucacua

SEQ ID NO: 1383449 - RNA, 12 nt, Neisseria meningitidis Z2491
accuuauagugg

SEQ ID NO: 1383450 - RNA, 15 nt, Neisseria meningitidis Z2491
accuugagccaagca

SEQ ID NO: 1383451 - RNA, 17 nt, Neisseria meningitidis Z2491
acgaacaggacaaaaau

SEQ ID NO: 1383452 - RNA, 16 nt, Neisseria meningitidis Z2491
acgaaccuacauuccg

SEQ ID NO: 1383453 - RNA, 15 nt, Neisseria meningitidis Z2491
acgaaaacaggaauc

SEQ ID NO: 1383454 - RNA, 14 nt, Neisseria meningitidis Z2491
accuagauucccgc

SEQ ID NO: 1383455 - RNA, 20 nt, Neisseria meningitidis Z2491
accuagauucccgccugcgc

SEQ ID NO: 1383456 - RNA, 14 nt, Neisseria meningitidis Z2491
accugaaaacagaa

SEQ ID NO: 1383457 - RNA, 20 nt, Neisseria meningitidis Z2491
accugaaaggcacaacgagc

SEQ ID NO: 1383458 - RNA, 18 nt, Neisseria meningitidis Z2491
accucgccgcgcgucagc

SEQ ID NO: 1383459 - RNA, 22 nt, Neisseria meningitidis Z2491
acggcggaagggguaaauccuc

SEQ ID NO: 1383460 - RNA, 22 nt, Neisseria meningitidis Z2491
acggcguucaacauccgcagac

SEQ ID NO: 1383461 - RNA, 21 nt, Neisseria meningitidis Z2491
acggcguucccucgccuugcc

SEQ ID NO: 1383462 - RNA, 20 nt, Neisseria meningitidis Z2491
acggcguuuuuuauauggcg

SEQ ID NO: 1383463 - RNA, 18 nt, Neisseria meningitidis Z2491
acggcaaggcgaggcaac

SEQ ID NO: 1383464 - RNA, 13 nt, Neisseria meningitidis Z2491
acggcacaaacgc

SEQ ID NO: 1383465 - RNA, 15 nt, Neisseria meningitidis Z2491
acggcaacguucagg

SEQ ID NO: 1383466 - RNA, 14 nt, Neisseria meningitidis Z2491
acggcaaacugcgu

SEQ ID NO: 1383467 - RNA, 17 nt, Neisseria meningitidis Z2491
acgggccguuuuuacug

SEQ ID NO: 1383468 - RNA, 18 nt, Neisseria meningitidis Z2491
acgggaaguuuuuugugu

SEQ ID NO: 1383469 - RNA, 16 nt, Neisseria meningitidis Z2491
acgggugauuuaagga

SEQ ID NO: 1383470 - RNA, 20 nt, Neisseria meningitidis Z2491
acggguuugccgcugacgaa

SEQ ID NO: 1383471 - RNA, 20 nt, Neisseria meningitidis Z2491
acggguuugcuuucgcugcc

SEQ ID NO: 1383472 - RNA, 15 nt, Neisseria meningitidis Z2491
acgguaaacacgggg

SEQ ID NO: 1383473 - RNA, 21 nt, Neisseria meningitidis Z2491
acgguugugccguguuucauc

SEQ ID NO: 1383474 - RNA, 19 nt, Neisseria meningitidis Z2491
acguaaaaucuauagugga

SEQ ID NO: 1383475 - RNA, 17 nt, Neisseria meningitidis Z2491
acgguuugaaacggaca

SEQ ID NO: 1383476 - RNA, 23 nt, Neisseria meningitidis Z2491
acgguuugagcgcgucaaacaga

SEQ ID NO: 1383477 - RNA, 17 nt, Neisseria meningitidis Z2491
acgguuugucugccgag

SEQ ID NO: 1383478 - RNA, 18 nt, Neisseria meningitidis Z2491
acggaaaguggaacagaa

SEQ ID NO: 1383479 - RNA, 15 nt, Neisseria meningitidis Z2491
acggaaacucaaaaa

SEQ ID NO: 1383480 - RNA, 22 nt, Neisseria meningitidis Z2491
acggaaacuuaucggauaaaac

SEQ ID NO: 1383481 - RNA, 14 nt, Neisseria meningitidis Z2491
acggagauuuuguu

SEQ ID NO: 1383482 - RNA, 13 nt, Neisseria meningitidis Z2491
acggagccagccc

SEQ ID NO: 1383483 - RNA, 17 nt, Neisseria meningitidis Z2491
acggacgcaggugcaga

SEQ ID NO: 1383484 - RNA, 19 nt, Neisseria meningitidis Z2491
acggauuguuuggaaaugu

SEQ ID NO: 1383485 - RNA, 15 nt, Neisseria meningitidis Z2491
acggcaaaaacagaa

SEQ ID NO: 1383486 - RNA, 15 nt, Neisseria meningitidis Z2491
acggcaaaaauuuau

SEQ ID NO: 1383487 - RNA, 15 nt, Neisseria meningitidis Z2491
acgcucguaaaacgc

SEQ ID NO: 1383488 - RNA, 13 nt, Neisseria meningitidis Z2491
acgcuaccgcaua

SEQ ID NO: 1383489 - RNA, 14 nt, Neisseria meningitidis Z2491
acguugccuucuuc

SEQ ID NO: 1383490 - RNA, 15 nt, Neisseria meningitidis Z2491
acuaaaauuuuaugc

SEQ ID NO: 1383491 - RNA, 18 nt, Neisseria meningitidis Z2491
acuaaaaaauccaaaaau

SEQ ID NO: 1383492 - RNA, 20 nt, Neisseria meningitidis Z2491
acgucuuacucaauaagucu

SEQ ID NO: 1383493 - RNA, 16 nt, Neisseria meningitidis Z2491
acuaacuuauacacac

SEQ ID NO: 1383494 - RNA, 17 nt, Neisseria meningitidis Z2491
acuaacuuauacacacg

SEQ ID NO: 1383495 - RNA, 13 nt, Neisseria meningitidis Z2491
acuagccaaaaaa

SEQ ID NO: 1383496 - RNA, 19 nt, Neisseria meningitidis Z2491
acuagccaaaaaaaccgaa

SEQ ID NO: 1383497 - RNA, 12 nt, Neisseria meningitidis Z2491
acuauaaaaaau

SEQ ID NO: 1383498 - RNA, 19 nt, Neisseria meningitidis Z2491
acuauaaaaggucuuuucu

SEQ ID NO: 1383499 - RNA, 11 nt, Neisseria meningitidis Z2491
acuauaaaauu

SEQ ID NO: 1383500 - RNA, 19 nt, Neisseria meningitidis Z2491
acuauaggaacauuuagaa

SEQ ID NO: 1383501 - RNA, 17 nt, Neisseria meningitidis Z2491
acuauaguggauuaaca

SEQ ID NO: 1383502 - RNA, 15 nt, Neisseria meningitidis Z2491
acuauaucauugcuu

SEQ ID NO: 1383503 - RNA, 16 nt, Neisseria meningitidis Z2491
acuauaucgucauucc

SEQ ID NO: 1383504 - RNA, 20 nt, Neisseria meningitidis Z2491
acuauaauuuauugaagaug

SEQ ID NO: 1383505 - RNA, 13 nt, Neisseria meningitidis Z2491
acugucugcggcu

SEQ ID NO: 1383506 - RNA, 14 nt, Neisseria meningitidis Z2491
acugucugcggcuu

SEQ ID NO: 1383507 - RNA, 22 nt, Neisseria meningitidis Z2491
acugucugcggcuucgucgccu

SEQ ID NO: 1383508 - RNA, 20 nt, Neisseria meningitidis Z2491
acuuagcucgaagagaacga

SEQ ID NO: 1383509 - RNA, 16 nt, Neisseria meningitidis Z2491
acuucaaaccccuuca

SEQ ID NO: 1383510 - RNA, 15 nt, Neisseria meningitidis Z2491
acuucagacggcauu

SEQ ID NO: 1383511 - RNA, 14 nt, Neisseria meningitidis Z2491
acuucaauaguggg

SEQ ID NO: 1383512 - RNA, 14 nt, Neisseria meningitidis Z2491
acuuccagcaccag

SEQ ID NO: 1383513 - RNA, 13 nt, Neisseria meningitidis Z2491
acuuccaaaccgc

SEQ ID NO: 1383514 - RNA, 20 nt, Neisseria meningitidis Z2491
acuuccaaaccgccauuccc

SEQ ID NO: 1383515 - RNA, 14 nt, Neisseria meningitidis Z2491
acuucgauugccaa

SEQ ID NO: 1383516 - RNA, 15 nt, Neisseria meningitidis Z2491
acuucgauugccaag

SEQ ID NO: 1383517 - RNA, 13 nt, Neisseria meningitidis Z2491
acucuuaaaacac

SEQ ID NO: 1383518 - RNA, 16 nt, Neisseria meningitidis Z2491
acucuccgucauuccc

SEQ ID NO: 1383519 - RNA, 19 nt, Neisseria meningitidis Z2491
acucuccgucauucccacg

SEQ ID NO: 1383520 - RNA, 20 nt, Neisseria meningitidis Z2491
acucuaaucccgucauuccc

SEQ ID NO: 1383521 - RNA, 22 nt, Neisseria meningitidis Z2491
acucugcggacuuaagaaacaa

SEQ ID NO: 1383522 - RNA, 22 nt, Neisseria meningitidis Z2491
acuauuuguacugucugcagcu

SEQ ID NO: 1383523 - RNA, 21 nt, Neisseria meningitidis Z2491
acuauuuguacugucugcggc

SEQ ID NO: 1383524 - RNA, 22 nt, Neisseria meningitidis Z2491
acuauuuguacugucugcggcu

SEQ ID NO: 1383525 - RNA, 14 nt, Neisseria meningitidis Z2491
acuauuuuugcaaa

SEQ ID NO: 1383526 - RNA, 13 nt, Neisseria meningitidis Z2491
acuauuuuuuaau

SEQ ID NO: 1383527 - RNA, 13 nt, Neisseria meningitidis Z2491
acugccucuuuuc

SEQ ID NO: 1383528 - RNA, 13 nt, Neisseria meningitidis Z2491
acugccugccgca

SEQ ID NO: 1383529 - RNA, 13 nt, Neisseria meningitidis Z2491
acugccugccuuc

SEQ ID NO: 1383530 - RNA, 16 nt, Neisseria meningitidis Z2491
acugauuuauauuguu

SEQ ID NO: 1383531 - RNA, 18 nt, Neisseria meningitidis Z2491
acugaaauaucgucauuc

SEQ ID NO: 1383532 - RNA, 15 nt, Neisseria meningitidis Z2491
acugaaacucaaaaa

SEQ ID NO: 1383533 - RNA, 18 nt, Neisseria meningitidis Z2491
acugaaacucaaaaaaac

SEQ ID NO: 1383534 - RNA, 19 nt, Neisseria meningitidis Z2491
aauccagugcguugaguuu

SEQ ID NO: 1383535 - RNA, 20 nt, Neisseria meningitidis Z2491
aauccagguucguugaguuu

SEQ ID NO: 1383536 - RNA, 21 nt, Neisseria meningitidis Z2491
aauccacgcaaucaagaagaa

SEQ ID NO: 1383537 - RNA, 22 nt, Neisseria meningitidis Z2491
aaucaucguauuuuuaucuuuu

SEQ ID NO: 1383538 - RNA, 19 nt, Neisseria meningitidis Z2491
aaucauguuauuauuuucc

SEQ ID NO: 1383539 - RNA, 15 nt, Neisseria meningitidis Z2491
aaucaucccaaacau

SEQ ID NO: 1383540 - RNA, 19 nt, Neisseria meningitidis Z2491
aaucaucccaaacaucgcu

SEQ ID NO: 1383541 - RNA, 10 nt, Neisseria meningitidis Z2491
aaaaauuccu

SEQ ID NO: 1383542 - RNA, 16 nt, Neisseria meningitidis Z2491
aaucagcccgaaauaa

SEQ ID NO: 1383543 - RNA, 20 nt, Neisseria meningitidis Z2491
aaucagcuauauauaguuga

SEQ ID NO: 1383544 - RNA, 16 nt, Neisseria meningitidis Z2491
aaucagcuuuuuguga

SEQ ID NO: 1383545 - RNA, 21 nt, Neisseria meningitidis Z2491
aaaaauuaaauuuuauuuaaa

SEQ ID NO: 1383546 - RNA, 12 nt, Neisseria meningitidis Z2491
aaucaguuuuuu

SEQ ID NO: 1383547 - RNA, 18 nt, Neisseria meningitidis Z2491
aaaaauuucauuuuccca

SEQ ID NO: 1383548 - RNA, 19 nt, Neisseria meningitidis Z2491
aaucgcggcggcacuguca

SEQ ID NO: 1383549 - RNA, 14 nt, Neisseria meningitidis Z2491
aaaaauuuucagac

SEQ ID NO: 1383550 - RNA, 22 nt, Neisseria meningitidis Z2491
aauccugaaugcccauuuguug

SEQ ID NO: 1383551 - RNA, 23 nt, Neisseria meningitidis Z2491
aaucccauuauuuucacaaaaac

SEQ ID NO: 1383552 - RNA, 19 nt, Neisseria meningitidis Z2491
aaucuccuuuuuuuucuau

SEQ ID NO: 1383553 - RNA, 21 nt, Neisseria meningitidis Z2491
aaucuauaguggauuaacaaa

SEQ ID NO: 1383554 - RNA, 22 nt, Neisseria meningitidis Z2491
aaucuauaguggauuaacaaaa

SEQ ID NO: 1383555 - RNA, 12 nt, Neisseria meningitidis Z2491
aaucguuucugu

SEQ ID NO: 1383556 - RNA, 16 nt, Neisseria meningitidis Z2491
aaucuaaaaauccaac

SEQ ID NO: 1383557 - RNA, 16 nt, Neisseria meningitidis Z2491
aaucuagacauucaau

SEQ ID NO: 1383558 - RNA, 19 nt, Neisseria meningitidis Z2491
aaucuagacauucaaugcu

SEQ ID NO: 1383559 - RNA, 22 nt, Neisseria meningitidis Z2491
aaucuagacauucaaugcuaag

SEQ ID NO: 1383560 - RNA, 16 nt, Neisseria meningitidis Z2491
aaucggccauucccuc

SEQ ID NO: 1383561 - RNA, 14 nt, Neisseria meningitidis Z2491
aaucggguuucaga

SEQ ID NO: 1383562 - RNA, 14 nt, Neisseria meningitidis Z2491
aaucguucucuuug

SEQ ID NO: 1383563 - RNA, 17 nt, Neisseria meningitidis Z2491
aaucguucucuuugagc

SEQ ID NO: 1383564 - RNA, 15 nt, Neisseria meningitidis Z2491
aaugccguccgaacc

SEQ ID NO: 1383565 - RNA, 22 nt, Neisseria meningitidis Z2491
aaugccgucugaaaaaccuuuc

SEQ ID NO: 1383566 - RNA, 16 nt, Neisseria meningitidis Z2491
aaugccgucugaaaac

SEQ ID NO: 1383567 - RNA, 21 nt, Neisseria meningitidis Z2491
aaugccgucugaaaacagcaa

SEQ ID NO: 1383568 - RNA, 21 nt, Neisseria meningitidis Z2491
aaugccgucugaaaaccuuuc

SEQ ID NO: 1383569 - RNA, 17 nt, Neisseria meningitidis Z2491
aaugccgucugaaaaga

SEQ ID NO: 1383570 - RNA, 16 nt, Neisseria meningitidis Z2491
aaugccgucugaaaca

SEQ ID NO: 1383571 - RNA, 20 nt, Neisseria meningitidis Z2491
aaugccgucugaaacagguu

SEQ ID NO: 1383572 - RNA, 22 nt, Neisseria meningitidis Z2491
aaugccgucugaaaccuuuuuu

SEQ ID NO: 1383573 - RNA, 17 nt, Neisseria meningitidis Z2491
aaugccgucugaaaguc

SEQ ID NO: 1383574 - RNA, 15 nt, Neisseria meningitidis Z2491
aaugccgucugaagc

SEQ ID NO: 1383575 - RNA, 19 nt, Neisseria meningitidis Z2491
aaugccgucugaagcccug

SEQ ID NO: 1383576 - RNA, 19 nt, Neisseria meningitidis Z2491
aaugccgucugaagccuuc

SEQ ID NO: 1383577 - RNA, 17 nt, Neisseria meningitidis Z2491
aaugccgucugaagcgu

SEQ ID NO: 1383578 - RNA, 15 nt, Neisseria meningitidis Z2491
aaugcguaugcccca

SEQ ID NO: 1383579 - RNA, 14 nt, Neisseria meningitidis Z2491
aaugcuaaggcaau

SEQ ID NO: 1383580 - RNA, 14 nt, Neisseria meningitidis Z2491
aauggcaaaauuuc

SEQ ID NO: 1383581 - RNA, 16 nt, Neisseria meningitidis Z2491
aaugccgcaaaugccg

SEQ ID NO: 1383582 - RNA, 17 nt, Neisseria meningitidis Z2491
aaugccgcaaccucaaa

SEQ ID NO: 1383583 - RNA, 19 nt, Neisseria meningitidis Z2491
aaugccgccgcaacugccu

SEQ ID NO: 1383584 - RNA, 15 nt, Neisseria meningitidis Z2491
aaugauucauaaaau

SEQ ID NO: 1383585 - RNA, 23 nt, Neisseria meningitidis Z2491
aaugacggcggagcgguuucugu

SEQ ID NO: 1383586 - RNA, 24 nt, Neisseria meningitidis Z2491
aaugacggcggaggguugcuguuu

SEQ ID NO: 1383587 - RNA, 22 nt, Neisseria meningitidis Z2491
aaugacgcgaacagaaaccuca

SEQ ID NO: 1383588 - RNA, 23 nt, Neisseria meningitidis Z2491
aaugacggcagagcgguuucugu

SEQ ID NO: 1383589 - RNA, 20 nt, Neisseria meningitidis Z2491
aaugacgggauuuuagguuu

SEQ ID NO: 1383590 - RNA, 17 nt, Neisseria meningitidis Z2491
aaugacggggguuuggc

SEQ ID NO: 1383591 - RNA, 17 nt, Neisseria meningitidis Z2491
aaugacgguaaagauug

SEQ ID NO: 1383592 - RNA, 17 nt, Neisseria meningitidis Z2491
aaugacgaaaaguugca

SEQ ID NO: 1383593 - RNA, 14 nt, Neisseria meningitidis Z2491
aaugacgaaauuuu

SEQ ID NO: 1383594 - RNA, 17 nt, Neisseria meningitidis Z2491
aaugacgaaguuucaga

SEQ ID NO: 1383595 - RNA, 15 nt, Neisseria meningitidis Z2491
aaugacggaaacuca

SEQ ID NO: 1383596 - RNA, 23 nt, Neisseria meningitidis Z2491
aaugacgaugaaaagauuguugu

SEQ ID NO: 1383597 - RNA, 20 nt, Neisseria meningitidis Z2491
aaugacgauucauaaguuuc

SEQ ID NO: 1383598 - RNA, 18 nt, Neisseria meningitidis Z2491
aaugagauugagcauaaa

SEQ ID NO: 1383599 - RNA, 20 nt, Neisseria meningitidis Z2491
aaugacugcccgucccgacu

SEQ ID NO: 1383600 - RNA, 15 nt, Neisseria meningitidis Z2491
aaugacugaaacuca

SEQ ID NO: 1383601 - RNA, 21 nt, Neisseria meningitidis Z2491
aaugacugaaacucaaaaaac

SEQ ID NO: 1383602 - RNA, 15 nt, Neisseria meningitidis Z2491
aaugacugaagcuca

SEQ ID NO: 1383603 - RNA, 16 nt, Neisseria meningitidis Z2491
aaugacugaagcucaa

SEQ ID NO: 1383604 - RNA, 14 nt, Neisseria meningitidis Z2491
aaugacuccguaaa

SEQ ID NO: 1383605 - RNA, 11 nt, Neisseria meningitidis Z2491
aaucuuuggca

SEQ ID NO: 1383606 - RNA, 17 nt, Neisseria meningitidis Z2491
aaucuuugaauauugcc

SEQ ID NO: 1383607 - RNA, 20 nt, Neisseria meningitidis Z2491
aaugaaaauuugguaaugca

SEQ ID NO: 1383608 - RNA, 22 nt, Neisseria meningitidis Z2491
aaugaaaauuugguaaugcaaa

SEQ ID NO: 1383609 - RNA, 15 nt, Neisseria meningitidis Z2491
aauucggcaauuuga

SEQ ID NO: 1383610 - RNA, 18 nt, Neisseria meningitidis Z2491
aauuccuaaaacuuaaaa

SEQ ID NO: 1383611 - RNA, 15 nt, Neisseria meningitidis Z2491
aauucccgccaucua

SEQ ID NO: 1383612 - RNA, 13 nt, Neisseria meningitidis Z2491
aauucaaaaaacc

SEQ ID NO: 1383613 - RNA, 12 nt, Neisseria meningitidis Z2491
aaaaauuuuugg

SEQ ID NO: 1383614 - RNA, 14 nt, Neisseria meningitidis Z2491
aaaacaaaaaaaau

SEQ ID NO: 1383615 - RNA, 15 nt, Neisseria meningitidis Z2491
aaaacaaaaaaaauc

SEQ ID NO: 1383616 - RNA, 17 nt, Neisseria meningitidis Z2491
aaaacaaaaaaucaaaa

SEQ ID NO: 1383617 - RNA, 22 nt, Neisseria meningitidis Z2491
aaaacaaaaaaucaaaaacaga

SEQ ID NO: 1383618 - RNA, 13 nt, Neisseria meningitidis Z2491
aaaacaaaaauga

SEQ ID NO: 1383619 - RNA, 21 nt, Neisseria meningitidis Z2491
aauucuugcagcuuugaguuu

SEQ ID NO: 1383620 - RNA, 18 nt, Neisseria meningitidis Z2491
aauucuucuuuccaucca

SEQ ID NO: 1383621 - RNA, 21 nt, Neisseria meningitidis Z2491
aauucuugccgcauuaaaauu

SEQ ID NO: 1383622 - RNA, 23 nt, Neisseria meningitidis Z2491
aaugguaucgggcauaaaauuug

SEQ ID NO: 1383623 - RNA, 18 nt, Neisseria meningitidis Z2491
aauguauuagaaaugacu

SEQ ID NO: 1383624 - RNA, 15 nt, Neisseria meningitidis Z2491
aauuaggagguauuu

SEQ ID NO: 1383625 - RNA, 16 nt, Neisseria meningitidis Z2491
aauuuguauucaagca

SEQ ID NO: 1383626 - RNA, 20 nt, Neisseria meningitidis Z2491
aauuuguuggcaguaaucca

SEQ ID NO: 1383627 - RNA, 14 nt, Neisseria meningitidis Z2491
aauuuuaaauaaau

SEQ ID NO: 1383628 - RNA, 13 nt, Neisseria meningitidis Z2491
aauuucuugauuu

SEQ ID NO: 1383629 - RNA, 14 nt, Neisseria meningitidis Z2491
aauuuuuaaaaccg

SEQ ID NO: 1383630 - RNA, 17 nt, Neisseria meningitidis Z2491
aauuuuuaaaaccguuc

SEQ ID NO: 1383631 - RNA, 12 nt, Neisseria meningitidis Z2491
aauuuugcaaag

SEQ ID NO: 1383632 - RNA, 22 nt, Neisseria meningitidis Z2491
aauuuugcaaaggucucaaaua

SEQ ID NO: 1383633 - RNA, 17 nt, Neisseria meningitidis Z2491
aauuuugaacaucuugu

SEQ ID NO: 1383634 - RNA, 23 nt, Neisseria meningitidis Z2491
aauuuuagguuucugauuuugau

SEQ ID NO: 1383635 - RNA, 16 nt, Neisseria meningitidis Z2491
aauuuuauugauucaa

SEQ ID NO: 1383636 - RNA, 19 nt, Neisseria meningitidis Z2491
aauugcgccgacagcagcu

SEQ ID NO: 1383637 - RNA, 13 nt, Neisseria meningitidis Z2491
aauuuauuaugua

SEQ ID NO: 1383638 - RNA, 18 nt, Neisseria meningitidis Z2491
aauuuauuggucaacucu

SEQ ID NO: 1383639 - RNA, 17 nt, Neisseria meningitidis Z2491
aauuucaauacgcaaac

SEQ ID NO: 1383640 - RNA, 16 nt, Neisseria meningitidis Z2491
aauuuauccgaaacaa

SEQ ID NO: 1383641 - RNA, 18 nt, Neisseria meningitidis Z2491
aauuuauccgaaacaaca

SEQ ID NO: 1383642 - RNA, 21 nt, Neisseria meningitidis Z2491
aauuuauccgaaacaacaaaa

SEQ ID NO: 1383643 - RNA, 14 nt, Neisseria meningitidis Z2491
aauuuaucggaaaa

SEQ ID NO: 1383644 - RNA, 18 nt, Neisseria meningitidis Z2491
aauuuaucggaaaugacu

SEQ ID NO: 1383645 - RNA, 16 nt, Neisseria meningitidis Z2491
aauuucggaaaugcgu

SEQ ID NO: 1383646 - RNA, 17 nt, Neisseria meningitidis Z2491
aauuuccgaccaacucc

SEQ ID NO: 1383647 - RNA, 16 nt, Neisseria meningitidis Z2491
aauuuccacaauucaa

SEQ ID NO: 1383648 - RNA, 12 nt, Neisseria meningitidis Z2491
aauuucauuuuu

SEQ ID NO: 1383649 - RNA, 17 nt, Neisseria meningitidis Z2491
accaccagccacaacac

SEQ ID NO: 1383650 - RNA, 17 nt, Neisseria meningitidis Z2491
accacccguguggauca

SEQ ID NO: 1383651 - RNA, 17 nt, Neisseria meningitidis Z2491
accacuguugccacaau

SEQ ID NO: 1383652 - RNA, 20 nt, Neisseria meningitidis Z2491
accacgucauucccacgaaa

SEQ ID NO: 1383653 - RNA, 16 nt, Neisseria meningitidis Z2491
accaauauucauacug

SEQ ID NO: 1383654 - RNA, 13 nt, Neisseria meningitidis Z2491
accaauaccgccu

SEQ ID NO: 1383655 - RNA, 16 nt, Neisseria meningitidis Z2491
accaacgaaacacucg

SEQ ID NO: 1383656 - RNA, 16 nt, Neisseria meningitidis Z2491
acaucgacacccgccc

SEQ ID NO: 1383657 - RNA, 16 nt, Neisseria meningitidis Z2491
acaucccgucauuccc

SEQ ID NO: 1383658 - RNA, 23 nt, Neisseria meningitidis Z2491
acaucccccagccgaaaauacug

SEQ ID NO: 1383659 - RNA, 13 nt, Neisseria meningitidis Z2491
acaugcaagcaua

SEQ ID NO: 1383660 - RNA, 22 nt, Neisseria meningitidis Z2491
acauggcggugcgguagccgcc

SEQ ID NO: 1383661 - RNA, 16 nt, Neisseria meningitidis Z2491
acauugcuaaaacaac

SEQ ID NO: 1383662 - RNA, 16 nt, Neisseria meningitidis Z2491
acauuucagacggcau

SEQ ID NO: 1383663 - RNA, 16 nt, Neisseria meningitidis Z2491
acauuccgucauuccc

SEQ ID NO: 1383664 - RNA, 20 nt, Neisseria meningitidis Z2491
acauugccaaauagaaaaua

SEQ ID NO: 1383665 - RNA, 21 nt, Neisseria meningitidis Z2491
acauucucuuggucaaaaugu

SEQ ID NO: 1383666 - RNA, 15 nt, Neisseria meningitidis Z2491
acauuccaucaacaa

SEQ ID NO: 1383667 - RNA, 17 nt, Neisseria meningitidis Z2491
acauuccaucaacaaaa

SEQ ID NO: 1383668 - RNA, 12 nt, Neisseria meningitidis Z2491
acauuaaaaaau

SEQ ID NO: 1383669 - RNA, 23 nt, Neisseria meningitidis Z2491
acaucagcaccacuguugccaca

SEQ ID NO: 1383670 - RNA, 21 nt, Neisseria meningitidis Z2491
acauauuucgccgcuucuuuc

SEQ ID NO: 1383671 - RNA, 22 nt, Neisseria meningitidis Z2491
acauaugccgucugaaaacagg

SEQ ID NO: 1383672 - RNA, 22 nt, Neisseria meningitidis Z2491
acauaccgccccuaaaaugccc

SEQ ID NO: 1383673 - RNA, 13 nt, Neisseria meningitidis Z2491
acauaauucaaau

SEQ ID NO: 1383674 - RNA, 21 nt, Neisseria meningitidis Z2491
acaggcagccuaaaacaucaa

SEQ ID NO: 1383675 - RNA, 16 nt, Neisseria meningitidis Z2491
acauagguuacuaaaa

SEQ ID NO: 1383676 - RNA, 20 nt, Neisseria meningitidis Z2491
acauagcguguauuuuggua

SEQ ID NO: 1383677 - RNA, 20 nt, Neisseria meningitidis Z2491
acauagauggggaugauggg

SEQ ID NO: 1383678 - RNA, 22 nt, Neisseria meningitidis Z2491
acauacggauacuccaaaccuu

SEQ ID NO: 1383679 - RNA, 17 nt, Neisseria meningitidis Z2491
acagacggaauaggaca

SEQ ID NO: 1383680 - RNA, 16 nt, Neisseria meningitidis Z2491
acagacggccaaacac

SEQ ID NO: 1383681 - RNA, 17 nt, Neisseria meningitidis Z2491
acagacggccaaacaca

SEQ ID NO: 1383682 - RNA, 15 nt, Neisseria meningitidis Z2491
acagacuauuuuugc

SEQ ID NO: 1383683 - RNA, 17 nt, Neisseria meningitidis Z2491
acagaaugauaacccaa

SEQ ID NO: 1383684 - RNA, 12 nt, Neisseria meningitidis Z2491
acagaaaaacaa

SEQ ID NO: 1383685 - RNA, 14 nt, Neisseria meningitidis Z2491
acagaaaaccaaaa

SEQ ID NO: 1383686 - RNA, 20 nt, Neisseria meningitidis Z2491
acagaaaaccaaaaacagaa

SEQ ID NO: 1383687 - RNA, 23 nt, Neisseria meningitidis Z2491
acagaaaaccaaaaacagaaacc

SEQ ID NO: 1383688 - RNA, 13 nt, Neisseria meningitidis Z2491
acagaaaacgccg

SEQ ID NO: 1383689 - RNA, 15 nt, Neisseria meningitidis Z2491
acagaaagccaaaaa

SEQ ID NO: 1383690 - RNA, 19 nt, Neisseria meningitidis Z2491
acagaaagccaaaaacaga

SEQ ID NO: 1383691 - RNA, 20 nt, Neisseria meningitidis Z2491
acagaaagccaaaaacagaa

SEQ ID NO: 1383692 - RNA, 16 nt, Neisseria meningitidis Z2491
acagaaacccaaaauc

SEQ ID NO: 1383693 - RNA, 15 nt, Neisseria meningitidis Z2491
acagaaaccugaaaa

SEQ ID NO: 1383694 - RNA, 13 nt, Neisseria meningitidis Z2491
acagaaaccugca

SEQ ID NO: 1383695 - RNA, 19 nt, Neisseria meningitidis Z2491
acagaaaaucaaaaacaga

SEQ ID NO: 1383696 - RNA, 17 nt, Neisseria meningitidis Z2491
acagaaaauugaaauuc

SEQ ID NO: 1383697 - RNA, 18 nt, Neisseria meningitidis Z2491
acacucuucgucauuccc

SEQ ID NO: 1383698 - RNA, 19 nt, Neisseria meningitidis Z2491
acagauugugcauaaggca

SEQ ID NO: 1383699 - RNA, 13 nt, Neisseria meningitidis Z2491
acagauuuuuugc

SEQ ID NO: 1383700 - RNA, 14 nt, Neisseria meningitidis Z2491
acagcauccuuucc

SEQ ID NO: 1383701 - RNA, 22 nt, Neisseria meningitidis Z2491
acagcauccuuuccucuuucau

SEQ ID NO: 1383702 - RNA, 20 nt, Neisseria meningitidis Z2491
acagcauauagccgagcauc

SEQ ID NO: 1383703 - RNA, 22 nt, Neisseria meningitidis Z2491
acagcacgauacacaaaaaagc

SEQ ID NO: 1383704 - RNA, 13 nt, Neisseria meningitidis Z2491
acagcacugccuc

SEQ ID NO: 1383705 - RNA, 14 nt, Neisseria meningitidis Z2491
acagcacugccucu

SEQ ID NO: 1383706 - RNA, 19 nt, Neisseria meningitidis Z2491
acagagcgccgucuccauu

SEQ ID NO: 1383707 - RNA, 15 nt, Neisseria meningitidis Z2491
acagcugaaaacagc

SEQ ID NO: 1383708 - RNA, 16 nt, Neisseria meningitidis Z2491
acaggacaaaaauccu

SEQ ID NO: 1383709 - RNA, 14 nt, Neisseria meningitidis Z2491
acagccgaaaaccu

SEQ ID NO: 1383710 - RNA, 18 nt, Neisseria meningitidis Z2491
acagccgaaacccaaaca

SEQ ID NO: 1383711 - RNA, 20 nt, Neisseria meningitidis Z2491
acagccgaaacccaaacaca

SEQ ID NO: 1383712 - RNA, 19 nt, Neisseria meningitidis Z2491
acagcggccgccaucaaaa

SEQ ID NO: 1383713 - RNA, 22 nt, Neisseria meningitidis Z2491
acagcggccgccaucaaaaagg

SEQ ID NO: 1383714 - RNA, 17 nt, Neisseria meningitidis Z2491
acagccccuaaauuuaa

SEQ ID NO: 1383715 - RNA, 23 nt, Neisseria meningitidis Z2491
acagccccuaaauuuaaaccagu

SEQ ID NO: 1383716 - RNA, 15 nt, Neisseria meningitidis Z2491
acagcauuugcgguu

SEQ ID NO: 1383717 - RNA, 18 nt, Neisseria meningitidis Z2491
acacagguauuguucagc

SEQ ID NO: 1383718 - RNA, 22 nt, Neisseria meningitidis Z2491
acacagguuuucgucuauuuuc

SEQ ID NO: 1383719 - RNA, 15 nt, Neisseria meningitidis Z2491
acacacgguuuucac

SEQ ID NO: 1383720 - RNA, 19 nt, Neisseria meningitidis Z2491
acaauuucuccgccagccu

SEQ ID NO: 1383721 - RNA, 18 nt, Neisseria meningitidis Z2491
acacacaagccguacaua

SEQ ID NO: 1383722 - RNA, 23 nt, Neisseria meningitidis Z2491
acacacaagccguacauaaggaa

SEQ ID NO: 1383723 - RNA, 15 nt, Neisseria meningitidis Z2491
acacacacguuuuau

SEQ ID NO: 1383724 - RNA, 23 nt, Neisseria meningitidis Z2491
acaauuaguaaaaucaaguuuau

SEQ ID NO: 1383725 - RNA, 21 nt, Neisseria meningitidis Z2491
acaaucuuuucaucgucauuc

SEQ ID NO: 1383726 - RNA, 20 nt, Neisseria meningitidis Z2491
acaagcccgcacauuccauc

SEQ ID NO: 1383727 - RNA, 22 nt, Neisseria meningitidis Z2491
acaacggucguggcaacuucca

SEQ ID NO: 1383728 - RNA, 18 nt, Neisseria meningitidis Z2491
aauuuuuggcgcauuuuu

SEQ ID NO: 1383729 - RNA, 19 nt, Neisseria meningitidis Z2491
aauuuuuuggcgcauuuuu

SEQ ID NO: 1383730 - RNA, 18 nt, Neisseria meningitidis Z2491
acaacucuuucgggcugc

SEQ ID NO: 1383731 - RNA, 22 nt, Neisseria meningitidis Z2491
acaacugcaauuauaagguaag

SEQ ID NO: 1383732 - RNA, 20 nt, Neisseria meningitidis Z2491
aagccuauccauuccugcgu

SEQ ID NO: 1383733 - RNA, 14 nt, Neisseria meningitidis Z2491
aagccuuucaacaa

SEQ ID NO: 1383734 - RNA, 22 nt, Neisseria meningitidis Z2491
aagaucauaccuaccgccuauc

SEQ ID NO: 1383735 - RNA, 17 nt, Neisseria meningitidis Z2491
aagccguacauaaggaa

SEQ ID NO: 1383736 - RNA, 20 nt, Neisseria meningitidis Z2491
aagccgugugaaaauuuaaa

SEQ ID NO: 1383737 - RNA, 20 nt, Neisseria meningitidis Z2491
aagccggcggcaacaaugcc

SEQ ID NO: 1383738 - RNA, 21 nt, Neisseria meningitidis Z2491
aagcgcggccuuugcaaaacc

SEQ ID NO: 1383739 - RNA, 22 nt, Neisseria meningitidis Z2491
aagcggcggcaucccaguuuug

SEQ ID NO: 1383740 - RNA, 17 nt, Neisseria meningitidis Z2491
aagcggcggcaucugcu

SEQ ID NO: 1383741 - RNA, 19 nt, Neisseria meningitidis Z2491
aagcggugggcugaagccc

SEQ ID NO: 1383742 - RNA, 13 nt, Neisseria meningitidis Z2491
aagcgguuuuugc

SEQ ID NO: 1383743 - RNA, 16 nt, Neisseria meningitidis Z2491
aagcuggauucccacu

SEQ ID NO: 1383744 - RNA, 22 nt, Neisseria meningitidis Z2491
aaggacgggcagggcaaguuug

SEQ ID NO: 1383745 - RNA, 17 nt, Neisseria meningitidis Z2491
aaggcuguguuugaaua

SEQ ID NO: 1383746 - RNA, 12 nt, Neisseria meningitidis Z2491
aaggcugcggca

SEQ ID NO: 1383747 - RNA, 17 nt, Neisseria meningitidis Z2491
aaggcuucgagugcuuc

SEQ ID NO: 1383748 - RNA, 17 nt, Neisseria meningitidis Z2491
aaggcuuuaagcaauca

SEQ ID NO: 1383749 - RNA, 23 nt, Neisseria meningitidis Z2491
aaggcauacggggaggaaagucc

SEQ ID NO: 1383750 - RNA, 20 nt, Neisseria meningitidis Z2491
aaguuccagacggcauuuuu

SEQ ID NO: 1383751 - RNA, 20 nt, Neisseria meningitidis Z2491
aaguuacucgaaacuuaaaa

SEQ ID NO: 1383752 - RNA, 12 nt, Neisseria meningitidis Z2491
aaguuaaaucga

SEQ ID NO: 1383753 - RNA, 16 nt, Neisseria meningitidis Z2491
aagugcggucaaaauu

SEQ ID NO: 1383754 - RNA, 22 nt, Neisseria meningitidis Z2491
aaguccggcauaaauccuucac

SEQ ID NO: 1383755 - RNA, 13 nt, Neisseria meningitidis Z2491
aaguccuucacgc

SEQ ID NO: 1383756 - RNA, 20 nt, Neisseria meningitidis Z2491
aaguaggagaaaucagaaaa

SEQ ID NO: 1383757 - RNA, 13 nt, Neisseria meningitidis Z2491
aaguaguuucccu

SEQ ID NO: 1383758 - RNA, 17 nt, Neisseria meningitidis Z2491
aaguaguuucccuguuu

SEQ ID NO: 1383759 - RNA, 15 nt, Neisseria meningitidis Z2491
aaguauuucuauuuu

SEQ ID NO: 1383760 - RNA, 11 nt, Neisseria meningitidis Z2491
aagguuuuugc

SEQ ID NO: 1383761 - RNA, 23 nt, Neisseria meningitidis Z2491
aaguacaaaaugccgucugaagc

SEQ ID NO: 1383762 - RNA, 20 nt, Neisseria meningitidis Z2491
aauauccccagugcgaugac

SEQ ID NO: 1383763 - RNA, 16 nt, Neisseria meningitidis Z2491
aauaucagauuuugga

SEQ ID NO: 1383764 - RNA, 21 nt, Neisseria meningitidis Z2491
aauaucuucuccgaccuauag

SEQ ID NO: 1383765 - RNA, 14 nt, Neisseria meningitidis Z2491
aauaugaaaccauu

SEQ ID NO: 1383766 - RNA, 20 nt, Neisseria meningitidis Z2491
aauauacugauuuauauugu

SEQ ID NO: 1383767 - RNA, 13 nt, Neisseria meningitidis Z2491
aauaguacaauau

SEQ ID NO: 1383768 - RNA, 15 nt, Neisseria meningitidis Z2491
aauaggauaggcugc

SEQ ID NO: 1383769 - RNA, 19 nt, Neisseria meningitidis Z2491
aauaggauaggucucuucc

SEQ ID NO: 1383770 - RNA, 14 nt, Neisseria meningitidis Z2491
aauagucaggcugc

SEQ ID NO: 1383771 - RNA, 12 nt, Neisseria meningitidis Z2491
aauauaaaaaau

SEQ ID NO: 1383772 - RNA, 13 nt, Neisseria meningitidis Z2491
aauagcugaaacu

SEQ ID NO: 1383773 - RNA, 22 nt, Neisseria meningitidis Z2491
aauagcugaaacucaacgcacu

SEQ ID NO: 1383774 - RNA, 20 nt, Neisseria meningitidis Z2491
aauaccuuguuuuuucaggc

SEQ ID NO: 1383775 - RNA, 16 nt, Neisseria meningitidis Z2491
aauacccaaaugcaga

SEQ ID NO: 1383776 - RNA, 20 nt, Neisseria meningitidis Z2491
aauacccaaaugcagaauaa

SEQ ID NO: 1383777 - RNA, 17 nt, Neisseria meningitidis Z2491
aaaaaugccgucugaaa

SEQ ID NO: 1383778 - RNA, 19 nt, Neisseria meningitidis Z2491
aaaaaugccgucugaaaaa

SEQ ID NO: 1383779 - RNA, 18 nt, Neisseria meningitidis Z2491
aaaaaugcgccaaaaaau

SEQ ID NO: 1383780 - RNA, 22 nt, Neisseria meningitidis Z2491
aauacaaaaaugccgucugaaa

SEQ ID NO: 1383781 - RNA, 19 nt, Neisseria meningitidis Z2491
aauacacaagguuauuuuc

SEQ ID NO: 1383782 - RNA, 23 nt, Neisseria meningitidis Z2491
aauacacaagguuauuuucuuga

SEQ ID NO: 1383783 - RNA, 17 nt, Neisseria meningitidis Z2491
aauaauggcaaccaaaa

SEQ ID NO: 1383784 - RNA, 14 nt, Neisseria meningitidis Z2491
aauaauggaacaaa

SEQ ID NO: 1383785 - RNA, 17 nt, Neisseria meningitidis Z2491
aauaauggaacaaagaa

SEQ ID NO: 1383786 - RNA, 19 nt, Neisseria meningitidis Z2491
aauaauggccuuuucccuu

SEQ ID NO: 1383787 - RNA, 16 nt, Neisseria meningitidis Z2491
aauaacuuauauauau

SEQ ID NO: 1383788 - RNA, 22 nt, Neisseria meningitidis Z2491
aauaaaucaagcgguaagugau

SEQ ID NO: 1383789 - RNA, 15 nt, Neisseria meningitidis Z2491
aauaagucagcgugc

SEQ ID NO: 1383790 - RNA, 18 nt, Neisseria meningitidis Z2491
aauaagucugcgaaacag

SEQ ID NO: 1383791 - RNA, 12 nt, Neisseria meningitidis Z2491
aagauacacaca

SEQ ID NO: 1383792 - RNA, 14 nt, Neisseria meningitidis Z2491
aagauauuggaaca

SEQ ID NO: 1383793 - RNA, 18 nt, Neisseria meningitidis Z2491
aagacaucguuuuuuuag

SEQ ID NO: 1383794 - RNA, 20 nt, Neisseria meningitidis Z2491
aagacauugccaaauagaaa

SEQ ID NO: 1383795 - RNA, 22 nt, Neisseria meningitidis Z2491
aagaaaccguuuuauccgauaa

SEQ ID NO: 1383796 - RNA, 16 nt, Neisseria meningitidis Z2491
aagacgaagaaauagc

SEQ ID NO: 1383797 - RNA, 16 nt, Neisseria meningitidis Z2491
aacucggcaaacgcuu

SEQ ID NO: 1383798 - RNA, 14 nt, Neisseria meningitidis Z2491
aacugacuagguaa

SEQ ID NO: 1383799 - RNA, 20 nt, Neisseria meningitidis Z2491
aacucuggucgaaccauugc

SEQ ID NO: 1383800 - RNA, 21 nt, Neisseria meningitidis Z2491
aacucucuauaaaaucccccg

SEQ ID NO: 1383801 - RNA, 13 nt, Neisseria meningitidis Z2491
aacucuaaaccgu

SEQ ID NO: 1383802 - RNA, 15 nt, Neisseria meningitidis Z2491
aacgggaggaccuca

SEQ ID NO: 1383803 - RNA, 14 nt, Neisseria meningitidis Z2491
aacggcggaaaaau

SEQ ID NO: 1383804 - RNA, 22 nt, Neisseria meningitidis Z2491
aacuauaguggauuaacaaaaa

SEQ ID NO: 1383805 - RNA, 13 nt, Neisseria meningitidis Z2491
aacucaucaucgg

SEQ ID NO: 1383806 - RNA, 15 nt, Neisseria meningitidis Z2491
aacuccaaagagaaa

SEQ ID NO: 1383807 - RNA, 15 nt, Neisseria meningitidis Z2491
aacucaggcuucaga

SEQ ID NO: 1383808 - RNA, 16 nt, Neisseria meningitidis Z2491
aacuuuuuaugccugu

SEQ ID NO: 1383809 - RNA, 17 nt, Neisseria meningitidis Z2491
aacuuuucauaucaugc

SEQ ID NO: 1383810 - RNA, 15 nt, Neisseria meningitidis Z2491
aacuuuaauuuuguc

SEQ ID NO: 1383811 - RNA, 13 nt, Neisseria meningitidis Z2491
aacuuccgcccgg

SEQ ID NO: 1383812 - RNA, 22 nt, Neisseria meningitidis Z2491
aacggcauaucccgacagaaca

SEQ ID NO: 1383813 - RNA, 17 nt, Neisseria meningitidis Z2491
aacggcacggcgcaggc

SEQ ID NO: 1383814 - RNA, 18 nt, Neisseria meningitidis Z2491
aacggcacggcgcaggca

SEQ ID NO: 1383815 - RNA, 17 nt, Neisseria meningitidis Z2491
aacggauaaaguuugaa

SEQ ID NO: 1383816 - RNA, 22 nt, Neisseria meningitidis Z2491
aacggagauucccguuucagac

SEQ ID NO: 1383817 - RNA, 15 nt, Neisseria meningitidis Z2491
aacgcgaaaaugccg

SEQ ID NO: 1383818 - RNA, 14 nt, Neisseria meningitidis Z2491
aacgcgcaaacccg

SEQ ID NO: 1383819 - RNA, 23 nt, Neisseria meningitidis Z2491
aacgcgcaaacgcugcauuuguu

SEQ ID NO: 1383820 - RNA, 14 nt, Neisseria meningitidis Z2491
aacgacagcagcag

SEQ ID NO: 1383821 - RNA, 20 nt, Neisseria meningitidis Z2491
aacgacgguauaaaccaaaa

SEQ ID NO: 1383822 - RNA, 21 nt, Neisseria meningitidis Z2491
aacgacgguauaaaccaaaau

SEQ ID NO: 1383823 - RNA, 22 nt, Neisseria meningitidis Z2491
aacgacgguauaaaccaaaaug

SEQ ID NO: 1383824 - RNA, 20 nt, Neisseria meningitidis Z2491
aacgacuuccaacucuacgg

SEQ ID NO: 1383825 - RNA, 18 nt, Neisseria meningitidis Z2491
aacgacuuccagcaccag

SEQ ID NO: 1383826 - RNA, 13 nt, Neisseria meningitidis Z2491
aacgcagccagca

SEQ ID NO: 1383827 - RNA, 19 nt, Neisseria meningitidis Z2491
aaccgugccgacaaaaccc

SEQ ID NO: 1383828 - RNA, 20 nt, Neisseria meningitidis Z2491
aaccgucguuuuuuuccugc

SEQ ID NO: 1383829 - RNA, 17 nt, Neisseria meningitidis Z2491
aaccguaucaaacaaga

SEQ ID NO: 1383830 - RNA, 18 nt, Neisseria meningitidis Z2491
aacccgauuccuguuuuc

SEQ ID NO: 1383831 - RNA, 15 nt, Neisseria meningitidis Z2491
aaccucagccaccag

SEQ ID NO: 1383832 - RNA, 16 nt, Neisseria meningitidis Z2491
aaccucagccaccagc

SEQ ID NO: 1383833 - RNA, 20 nt, Neisseria meningitidis Z2491
aaccuaaaauccgucauucc

SEQ ID NO: 1383834 - RNA, 17 nt, Neisseria meningitidis Z2491
aaccuaaaauucgucau

SEQ ID NO: 1383835 - RNA, 20 nt, Neisseria meningitidis Z2491
aaccuaaaauucgucauucc

SEQ ID NO: 1383836 - RNA, 18 nt, Neisseria meningitidis Z2491
aaccucguucggacggca

SEQ ID NO: 1383837 - RNA, 15 nt, Neisseria meningitidis Z2491
aaccugaaaggcaca

SEQ ID NO: 1383838 - RNA, 20 nt, Neisseria meningitidis Z2491
aaccuuauaguggauuaaau

SEQ ID NO: 1383839 - RNA, 23 nt, Neisseria meningitidis Z2491
aaccuuauccauauccaaacgca

SEQ ID NO: 1383840 - RNA, 17 nt, Neisseria meningitidis Z2491
aaccuuaacaaucacua

SEQ ID NO: 1383841 - RNA, 12 nt, Neisseria meningitidis Z2491
aaccuugccaag

SEQ ID NO: 1383842 - RNA, 22 nt, Neisseria meningitidis Z2491
aacgaaauuugacgcauaaaaa

SEQ ID NO: 1383843 - RNA, 18 nt, Neisseria meningitidis Z2491
aacgaaaagcuaaagcaa

SEQ ID NO: 1383844 - RNA, 23 nt, Neisseria meningitidis Z2491
aaccagccccaagccuauccauu

SEQ ID NO: 1383845 - RNA, 18 nt, Neisseria meningitidis Z2491
aaccagggauuuuucaaa

SEQ ID NO: 1383846 - RNA, 19 nt, Neisseria meningitidis Z2491
aaccccauucggagcaaga

SEQ ID NO: 1383847 - RNA, 18 nt, Neisseria meningitidis Z2491
aacccccgucauucccgc

SEQ ID NO: 1383848 - RNA, 17 nt, Neisseria meningitidis Z2491
aacccgaaccaaaccgu

SEQ ID NO: 1383849 - RNA, 15 nt, Neisseria meningitidis Z2491
aacccgacuucugac

SEQ ID NO: 1383850 - RNA, 14 nt, Neisseria meningitidis Z2491
aacccgauguuuuc

SEQ ID NO: 1383851 - RNA, 16 nt, Neisseria meningitidis Z2491
aaccaguacgguguug

SEQ ID NO: 1383852 - RNA, 18 nt, Neisseria meningitidis Z2491
aaccaccgccaucaggaa

SEQ ID NO: 1383853 - RNA, 13 nt, Neisseria meningitidis Z2491
aaccaaaaugccc

SEQ ID NO: 1383854 - RNA, 14 nt, Neisseria meningitidis Z2491
aaccaaaaucagaa

SEQ ID NO: 1383855 - RNA, 12 nt, Neisseria meningitidis Z2491
aaccaaaagcca

SEQ ID NO: 1383856 - RNA, 19 nt, Neisseria meningitidis Z2491
aaccaaaagccaaaaaaca

SEQ ID NO: 1383857 - RNA, 16 nt, Neisseria meningitidis Z2491
aaccaaaaaacaacag

SEQ ID NO: 1383858 - RNA, 21 nt, Neisseria meningitidis Z2491
aaccaaaaacagcaaccugaa

SEQ ID NO: 1383859 - RNA, 23 nt, Neisseria meningitidis Z2491
aacauuuuugcguauucgccggu

SEQ ID NO: 1383860 - RNA, 12 nt, Neisseria meningitidis Z2491
aacauuucagac

SEQ ID NO: 1383861 - RNA, 13 nt, Neisseria meningitidis Z2491
aacaguucagacg

SEQ ID NO: 1383862 - RNA, 13 nt, Neisseria meningitidis Z2491
aacaguuucagca

SEQ ID NO: 1383863 - RNA, 14 nt, Neisseria meningitidis Z2491
aacauaaaaugccg

SEQ ID NO: 1383864 - RNA, 15 nt, Neisseria meningitidis Z2491
aacauaaacaaagcc

SEQ ID NO: 1383865 - RNA, 18 nt, Neisseria meningitidis Z2491
aacaucaaguuaccgguc

SEQ ID NO: 1383866 - RNA, 20 nt, Neisseria meningitidis Z2491
aacauagguuacuaaaauuu

SEQ ID NO: 1383867 - RNA, 14 nt, Neisseria meningitidis Z2491
aacagcucagacgg

SEQ ID NO: 1383868 - RNA, 15 nt, Neisseria meningitidis Z2491
aacagcugaaaacag

SEQ ID NO: 1383869 - RNA, 15 nt, Neisseria meningitidis Z2491
aacagcuguacgcug

SEQ ID NO: 1383870 - RNA, 13 nt, Neisseria meningitidis Z2491
aacagcuuaaaau

SEQ ID NO: 1383871 - RNA, 14 nt, Neisseria meningitidis Z2491
aacagcuuaaaauc

SEQ ID NO: 1383872 - RNA, 14 nt, Neisseria meningitidis Z2491
aacaggacaaaaau

SEQ ID NO: 1383873 - RNA, 17 nt, Neisseria meningitidis Z2491
aacagggaaagcagcag

SEQ ID NO: 1383874 - RNA, 18 nt, Neisseria meningitidis Z2491
aacagggaaagcagcagc

SEQ ID NO: 1383875 - RNA, 13 nt, Neisseria meningitidis Z2491
cgcgacggcggca

SEQ ID NO: 1383876 - RNA, 20 nt, Neisseria meningitidis Z2491
cgccgccggaaagcugcccc

SEQ ID NO: 1383877 - RNA, 19 nt, Neisseria meningitidis Z2491
cgccgucauucccgcaaaa

SEQ ID NO: 1383878 - RNA, 21 nt, Neisseria meningitidis Z2491
cgccgucauucccgcaaaagc

SEQ ID NO: 1383879 - RNA, 22 nt, Neisseria meningitidis Z2491
cgccguguuucaaggcggcggc

SEQ ID NO: 1383880 - RNA, 16 nt, Neisseria meningitidis Z2491
cgccguguucgagcag

SEQ ID NO: 1383881 - RNA, 15 nt, Neisseria meningitidis Z2491
cgccguuuugcagug

SEQ ID NO: 1383882 - RNA, 20 nt, Neisseria meningitidis Z2491
cgccuccgaagccucgcccg

SEQ ID NO: 1383883 - RNA, 18 nt, Neisseria meningitidis Z2491
cgcgcgaaugugcgccgg

SEQ ID NO: 1383884 - RNA, 19 nt, Neisseria meningitidis Z2491
cgcgcgaaugugcgccggu

SEQ ID NO: 1383885 - RNA, 13 nt, Neisseria meningitidis Z2491
cgcgcaccagcaa

SEQ ID NO: 1383886 - RNA, 15 nt, Neisseria meningitidis Z2491
cgcgcaauuccugca

SEQ ID NO: 1383887 - RNA, 22 nt, Neisseria meningitidis Z2491
cgcgcauauugcccaacagcag

SEQ ID NO: 1383888 - RNA, 15 nt, Neisseria meningitidis Z2491
cgcggcgcggcgggc

SEQ ID NO: 1383889 - RNA, 18 nt, Neisseria meningitidis Z2491
cgcggauucgacggcgga

SEQ ID NO: 1383890 - RNA, 22 nt, Neisseria meningitidis Z2491
cgcuucaucuuuacuuguuucg

SEQ ID NO: 1383891 - RNA, 15 nt, Neisseria meningitidis Z2491
cgcuuaaaaaacaac

SEQ ID NO: 1383892 - RNA, 21 nt, Neisseria meningitidis Z2491
cgcuucagacggcauuuugau

SEQ ID NO: 1383893 - RNA, 20 nt, Neisseria meningitidis Z2491
cgcuguacgaauccgccggc

SEQ ID NO: 1383894 - RNA, 19 nt, Neisseria meningitidis Z2491
cgcuguauuugcgccgccc

SEQ ID NO: 1383895 - RNA, 19 nt, Neisseria meningitidis Z2491
cgcuggaugccgcgccgcc

SEQ ID NO: 1383896 - RNA, 14 nt, Neisseria meningitidis Z2491
cgcugccgccgccc

SEQ ID NO: 1383897 - RNA, 19 nt, Neisseria meningitidis Z2491
cgcguccagcuuccgcagg

SEQ ID NO: 1383898 - RNA, 17 nt, Neisseria meningitidis Z2491
cgcguccaacacgcagc

SEQ ID NO: 1383899 - RNA, 16 nt, Neisseria meningitidis Z2491
cgcuauaacagcaacc

SEQ ID NO: 1383900 - RNA, 15 nt, Neisseria meningitidis Z2491
cgcuauauauucuga

SEQ ID NO: 1383901 - RNA, 17 nt, Neisseria meningitidis Z2491
cgcucaaacacccccga

SEQ ID NO: 1383902 - RNA, 19 nt, Neisseria meningitidis Z2491
cgcucaaacacccccgaau

SEQ ID NO: 1383903 - RNA, 24 nt, Neisseria meningitidis Z2491
cgcucgcguauccagccgccaucc

SEQ ID NO: 1383904 - RNA, 17 nt, Neisseria meningitidis Z2491
cgauuaucgggaaaaau

SEQ ID NO: 1383905 - RNA, 15 nt, Neisseria meningitidis Z2491
cgaugcagaacggcg

SEQ ID NO: 1383906 - RNA, 22 nt, Neisseria meningitidis Z2491
cgauccguuugguuuuauagug

SEQ ID NO: 1383907 - RNA, 21 nt, Neisseria meningitidis Z2491
cgauauaguggauuaacaaaa

SEQ ID NO: 1383908 - RNA, 22 nt, Neisseria meningitidis Z2491
cgauauaguggauuaacaaaaa

SEQ ID NO: 1383909 - RNA, 14 nt, Neisseria meningitidis Z2491
aaacgguaccugau

SEQ ID NO: 1383910 - RNA, 12 nt, Neisseria meningitidis Z2491
aaacgguuuuuc

SEQ ID NO: 1383911 - RNA, 12 nt, Neisseria meningitidis Z2491
aaacgguuucuc

SEQ ID NO: 1383912 - RNA, 20 nt, Neisseria meningitidis Z2491
aaacgguuucuugagauuuu

SEQ ID NO: 1383913 - RNA, 15 nt, Neisseria meningitidis Z2491
cgcagguuguuggaa

SEQ ID NO: 1383914 - RNA, 19 nt, Neisseria meningitidis Z2491
cgcaguuuuucgauguggu

SEQ ID NO: 1383915 - RNA, 15 nt, Neisseria meningitidis Z2491
cgcagccgagcagca

SEQ ID NO: 1383916 - RNA, 13 nt, Neisseria meningitidis Z2491
cgcaauucguuuu

SEQ ID NO: 1383917 - RNA, 19 nt, Neisseria meningitidis Z2491
cgcaauccgcccucucauu

SEQ ID NO: 1383918 - RNA, 21 nt, Neisseria meningitidis Z2491
cgcaauccgcccucucauuug

SEQ ID NO: 1383919 - RNA, 17 nt, Neisseria meningitidis Z2491
cgcagacaguacaaaua

SEQ ID NO: 1383920 - RNA, 15 nt, Neisseria meningitidis Z2491
cgcagacaguacaga

SEQ ID NO: 1383921 - RNA, 18 nt, Neisseria meningitidis Z2491
cgcagaccguccacaagc

SEQ ID NO: 1383922 - RNA, 15 nt, Neisseria meningitidis Z2491
cgccacuucgcgccg

SEQ ID NO: 1383923 - RNA, 17 nt, Neisseria meningitidis Z2491
cgcauaaccguaaccca

SEQ ID NO: 1383924 - RNA, 20 nt, Neisseria meningitidis Z2491
cgcauccgagccgccguugg

SEQ ID NO: 1383925 - RNA, 23 nt, Neisseria meningitidis Z2491
cgccauauaaaaaacgccguccg

SEQ ID NO: 1383926 - RNA, 12 nt, Neisseria meningitidis Z2491
cgccauuuccaa

SEQ ID NO: 1383927 - RNA, 20 nt, Neisseria meningitidis Z2491
cgcccaucgguuugacgcag

SEQ ID NO: 1383928 - RNA, 14 nt, Neisseria meningitidis Z2491
cgccgacagcagcu

SEQ ID NO: 1383929 - RNA, 13 nt, Neisseria meningitidis Z2491
cgccgaaccgcgc

SEQ ID NO: 1383930 - RNA, 14 nt, Neisseria meningitidis Z2491
cgccgauguccuga

SEQ ID NO: 1383931 - RNA, 22 nt, Neisseria meningitidis Z2491
cgccgaugggcaaggcgccggc

SEQ ID NO: 1383932 - RNA, 13 nt, Neisseria meningitidis Z2491
cgccgauguaaac

SEQ ID NO: 1383933 - RNA, 13 nt, Neisseria meningitidis Z2491
cgccgaucugccc

SEQ ID NO: 1383934 - RNA, 17 nt, Neisseria meningitidis Z2491
cgccgacaucccccagc

SEQ ID NO: 1383935 - RNA, 13 nt, Neisseria meningitidis Z2491
cggccaaacacau

SEQ ID NO: 1383936 - RNA, 22 nt, Neisseria meningitidis Z2491
cggcauauuuuuuggacggcgc

SEQ ID NO: 1383937 - RNA, 14 nt, Neisseria meningitidis Z2491
cggcaucaaaaacu

SEQ ID NO: 1383938 - RNA, 19 nt, Neisseria meningitidis Z2491
cggcaucgguuucuucuuc

SEQ ID NO: 1383939 - RNA, 20 nt, Neisseria meningitidis Z2491
cggcaucgguuucuucuucg

SEQ ID NO: 1383940 - RNA, 13 nt, Neisseria meningitidis Z2491
cggcaucuuccuu

SEQ ID NO: 1383941 - RNA, 22 nt, Neisseria meningitidis Z2491
cgcuugaggcgaguccgcgcga

SEQ ID NO: 1383942 - RNA, 22 nt, Neisseria meningitidis Z2491
cgcuugaccgcagccgaaccca

SEQ ID NO: 1383943 - RNA, 23 nt, Neisseria meningitidis Z2491
cggcagccugcucgagcggcagg

SEQ ID NO: 1383944 - RNA, 11 nt, Neisseria meningitidis Z2491
cggcagccugc

SEQ ID NO: 1383945 - RNA, 17 nt, Neisseria meningitidis Z2491
cggcacggcgcaggcaa

SEQ ID NO: 1383946 - RNA, 16 nt, Neisseria meningitidis Z2491
cggcacggcagggaca

SEQ ID NO: 1383947 - RNA, 22 nt, Neisseria meningitidis Z2491
cggcaggucuucgggcagggug

SEQ ID NO: 1383948 - RNA, 20 nt, Neisseria meningitidis Z2491
cggcagguaaaaaauagaaa

SEQ ID NO: 1383949 - RNA, 13 nt, Neisseria meningitidis Z2491
cggcauaacacac

SEQ ID NO: 1383950 - RNA, 15 nt, Neisseria meningitidis Z2491
cggcagugauuuccc

SEQ ID NO: 1383951 - RNA, 17 nt, Neisseria meningitidis Z2491
cggcaguuuccaauaca

SEQ ID NO: 1383952 - RNA, 12 nt, Neisseria meningitidis Z2491
cggcgcaggcaa

SEQ ID NO: 1383953 - RNA, 15 nt, Neisseria meningitidis Z2491
cggcgagccgcagac

SEQ ID NO: 1383954 - RNA, 21 nt, Neisseria meningitidis Z2491
cggcgguuauuucggaugcgc

SEQ ID NO: 1383955 - RNA, 15 nt, Neisseria meningitidis Z2491
cggcggugucggaca

SEQ ID NO: 1383956 - RNA, 21 nt, Neisseria meningitidis Z2491
cggcggcaaauuccgucagca

SEQ ID NO: 1383957 - RNA, 23 nt, Neisseria meningitidis Z2491
cggcggauuucagugcugcgccc

SEQ ID NO: 1383958 - RNA, 18 nt, Neisseria meningitidis Z2491
cggcgcguaucggcggca

SEQ ID NO: 1383959 - RNA, 22 nt, Neisseria meningitidis Z2491
cggcggggggauuucuguuuuu

SEQ ID NO: 1383960 - RNA, 16 nt, Neisseria meningitidis Z2491
cggcgggacgcgcgcc

SEQ ID NO: 1383961 - RNA, 14 nt, Neisseria meningitidis Z2491
cggcgggcaggcgg

SEQ ID NO: 1383962 - RNA, 11 nt, Neisseria meningitidis Z2491
cggcggcggca

SEQ ID NO: 1383963 - RNA, 15 nt, Neisseria meningitidis Z2491
cggcggcggcaggca

SEQ ID NO: 1383964 - RNA, 14 nt, Neisseria meningitidis Z2491
cggcggcgcgggcg

SEQ ID NO: 1383965 - RNA, 17 nt, Neisseria meningitidis Z2491
cggcggcgagcaggguu

SEQ ID NO: 1383966 - RNA, 16 nt, Neisseria meningitidis Z2491
ccaguccguucaguuu

SEQ ID NO: 1383967 - RNA, 21 nt, Neisseria meningitidis Z2491
ccaguccuacccaaaaggaag

SEQ ID NO: 1383968 - RNA, 15 nt, Neisseria meningitidis Z2491
ccagugcaucgacca

SEQ ID NO: 1383969 - RNA, 19 nt, Neisseria meningitidis Z2491
ccauacggaaaccugcauc

SEQ ID NO: 1383970 - RNA, 21 nt, Neisseria meningitidis Z2491
ccauacaaacaggcuucagac

SEQ ID NO: 1383971 - RNA, 15 nt, Neisseria meningitidis Z2491
ccauaaucugcggca

SEQ ID NO: 1383972 - RNA, 11 nt, Neisseria meningitidis Z2491
ccauaaaaacg

SEQ ID NO: 1383973 - RNA, 15 nt, Neisseria meningitidis Z2491
ccauuugagccgcac

SEQ ID NO: 1383974 - RNA, 18 nt, Neisseria meningitidis Z2491
ccauuucuuccugacgga

SEQ ID NO: 1383975 - RNA, 18 nt, Neisseria meningitidis Z2491
cccaagccgaauugcagc

SEQ ID NO: 1383976 - RNA, 15 nt, Neisseria meningitidis Z2491
ccauuacaaaugcuc

SEQ ID NO: 1383977 - RNA, 19 nt, Neisseria meningitidis Z2491
ccaugucgaacaguucuuu

SEQ ID NO: 1383978 - RNA, 16 nt, Neisseria meningitidis Z2491
ccauauggaaaaaucu

SEQ ID NO: 1383979 - RNA, 17 nt, Neisseria meningitidis Z2491
aaacaaucaguuuuugu

SEQ ID NO: 1383980 - RNA, 12 nt, Neisseria meningitidis Z2491
ccauauuuuuua

SEQ ID NO: 1383981 - RNA, 22 nt, Neisseria meningitidis Z2491
ccaucaguuuccacuaaaugcu

SEQ ID NO: 1383982 - RNA, 22 nt, Neisseria meningitidis Z2491
ccaucgcgauugaaacaucauu

SEQ ID NO: 1383983 - RNA, 23 nt, Neisseria meningitidis Z2491
cccauacuacgcggcugaaaaaa

SEQ ID NO: 1383984 - RNA, 17 nt, Neisseria meningitidis Z2491
cccaucgccucuucaau

SEQ ID NO: 1383985 - RNA, 16 nt, Neisseria meningitidis Z2491
aaacacaaaacugaaa

SEQ ID NO: 1383986 - RNA, 17 nt, Neisseria meningitidis Z2491
ccccguaccgggcaggc

SEQ ID NO: 1383987 - RNA, 14 nt, Neisseria meningitidis Z2491
ccccgugaaaaaau

SEQ ID NO: 1383988 - RNA, 19 nt, Neisseria meningitidis Z2491
cccgaaaccgaaugccaca

SEQ ID NO: 1383989 - RNA, 18 nt, Neisseria meningitidis Z2491
cccgcagccggggcaggc

SEQ ID NO: 1383990 - RNA, 15 nt, Neisseria meningitidis Z2491
cccgccgaucugccc

SEQ ID NO: 1383991 - RNA, 19 nt, Neisseria meningitidis Z2491
cccauuuguagggcgugcc

SEQ ID NO: 1383992 - RNA, 13 nt, Neisseria meningitidis Z2491
cccccaccgccgc

SEQ ID NO: 1383993 - RNA, 20 nt, Neisseria meningitidis Z2491
cccccuuaauccucuccgga

SEQ ID NO: 1383994 - RNA, 15 nt, Neisseria meningitidis Z2491
cccugccgcuucaca

SEQ ID NO: 1383995 - RNA, 13 nt, Neisseria meningitidis Z2491
cccucuuggauaa

SEQ ID NO: 1383996 - RNA, 12 nt, Neisseria meningitidis Z2491
cccucuugccuu

SEQ ID NO: 1383997 - RNA, 20 nt, Neisseria meningitidis Z2491
cccugauuucgcuuucgggc

SEQ ID NO: 1383998 - RNA, 21 nt, Neisseria meningitidis Z2491
cccucgaagcggcagagcaag

SEQ ID NO: 1383999 - RNA, 16 nt, Neisseria meningitidis Z2491
cccucgaaagcgggaa

SEQ ID NO: 1384000 - RNA, 16 nt, Neisseria meningitidis Z2491
cccuccugcgcgggaa

SEQ ID NO: 1384001 - RNA, 18 nt, Neisseria meningitidis Z2491
cccuccugcgcgggaaug

SEQ ID NO: 1384002 - RNA, 21 nt, Neisseria meningitidis Z2491
cccucggauggggugcggcac

SEQ ID NO: 1384003 - RNA, 18 nt, Neisseria meningitidis Z2491
cccucggcauucccgcca

SEQ ID NO: 1384004 - RNA, 22 nt, Neisseria meningitidis Z2491
cccuauguguugcccugauucg

SEQ ID NO: 1384005 - RNA, 13 nt, Neisseria meningitidis Z2491
cccgucauucccu

SEQ ID NO: 1384006 - RNA, 17 nt, Neisseria meningitidis Z2491
cccgucauuccucaaaa

SEQ ID NO: 1384007 - RNA, 16 nt, Neisseria meningitidis Z2491
cccgucauucccgcca

SEQ ID NO: 1384008 - RNA, 19 nt, Neisseria meningitidis Z2491
aaacaccggcuguguuuau

SEQ ID NO: 1384009 - RNA, 18 nt, Neisseria meningitidis Z2491
cccgugaaaacgggaauc

SEQ ID NO: 1384010 - RNA, 17 nt, Neisseria meningitidis Z2491
cccguuaaggcagagau

SEQ ID NO: 1384011 - RNA, 18 nt, Neisseria meningitidis Z2491
cccguuuucacgggaaug

SEQ ID NO: 1384012 - RNA, 21 nt, Neisseria meningitidis Z2491
cccgguaacgaagaacgccaa

SEQ ID NO: 1384013 - RNA, 15 nt, Neisseria meningitidis Z2491
cccguaugccgccug

SEQ ID NO: 1384014 - RNA, 18 nt, Neisseria meningitidis Z2491
cccguaugccgccugccu

SEQ ID NO: 1384015 - RNA, 17 nt, Neisseria meningitidis Z2491
ccgacagugcggacacc

SEQ ID NO: 1384016 - RNA, 16 nt, Neisseria meningitidis Z2491
aaacauuaucugacag

SEQ ID NO: 1384017 - RNA, 21 nt, Neisseria meningitidis Z2491
ccgacuuuuucaacuuggugg

SEQ ID NO: 1384018 - RNA, 15 nt, Neisseria meningitidis Z2491
ccgacuucugacagc

SEQ ID NO: 1384019 - RNA, 19 nt, Neisseria meningitidis Z2491
ccgacuuugccguauuuca

SEQ ID NO: 1384020 - RNA, 19 nt, Neisseria meningitidis Z2491
ccgagcaucaaggaauuca

SEQ ID NO: 1384021 - RNA, 16 nt, Neisseria meningitidis Z2491
ccgaaaccaaaagcca

SEQ ID NO: 1384022 - RNA, 17 nt, Neisseria meningitidis Z2491
ccgaaaccaaaagccaa

SEQ ID NO: 1384023 - RNA, 18 nt, Neisseria meningitidis Z2491
ccgaaacagaaacccaaa

SEQ ID NO: 1384024 - RNA, 23 nt, Neisseria meningitidis Z2491
ccgaaacagaaacccaaaaucgg

SEQ ID NO: 1384025 - RNA, 19 nt, Neisseria meningitidis Z2491
ccgaauauccccagugcga

SEQ ID NO: 1384026 - RNA, 14 nt, Neisseria meningitidis Z2491
ccgaauaaaaaaua

SEQ ID NO: 1384027 - RNA, 19 nt, Neisseria meningitidis Z2491
ccgaagcauaagccgccau

SEQ ID NO: 1384028 - RNA, 13 nt, Neisseria meningitidis Z2491
ccgaagacaguac

SEQ ID NO: 1384029 - RNA, 18 nt, Neisseria meningitidis Z2491
aaacaucgcucaaauucu

SEQ ID NO: 1384030 - RNA, 21 nt, Neisseria meningitidis Z2491
aaacaucgcucaaauucuguu

SEQ ID NO: 1384031 - RNA, 23 nt, Neisseria meningitidis Z2491
aaacaucgcucaaauucuguuug

SEQ ID NO: 1384032 - RNA, 17 nt, Neisseria meningitidis Z2491
aaacagcugaaaacagc

SEQ ID NO: 1384033 - RNA, 14 nt, Neisseria meningitidis Z2491
aaacagcaaccuuu

SEQ ID NO: 1384034 - RNA, 13 nt, Neisseria meningitidis Z2491
ccgaaaaaauaau

SEQ ID NO: 1384035 - RNA, 15 nt, Neisseria meningitidis Z2491
aaacagguuuaaguc

SEQ ID NO: 1384036 - RNA, 19 nt, Neisseria meningitidis Z2491
aaacaggcagccuaaaaca

SEQ ID NO: 1384037 - RNA, 17 nt, Neisseria meningitidis Z2491
cccuuaucccaauauua

SEQ ID NO: 1384038 - RNA, 14 nt, Neisseria meningitidis Z2491
aaacagagugcgua

SEQ ID NO: 1384039 - RNA, 21 nt, Neisseria meningitidis Z2491
aaacagcacgauacacaaaaa

SEQ ID NO: 1384040 - RNA, 22 nt, Neisseria meningitidis Z2491
aaacagcacgauacacaaaaaa

SEQ ID NO: 1384041 - RNA, 14 nt, Neisseria meningitidis Z2491
aaacagcacugccu

SEQ ID NO: 1384042 - RNA, 22 nt, Neisseria meningitidis Z2491
aaacagcaauccauucccucuc

SEQ ID NO: 1384043 - RNA, 14 nt, Neisseria meningitidis Z2491
aaacagcaaucuga

SEQ ID NO: 1384044 - RNA, 15 nt, Neisseria meningitidis Z2491
ccgcagacaguacag

SEQ ID NO: 1384045 - RNA, 15 nt, Neisseria meningitidis Z2491
ccgauguucugucuc

SEQ ID NO: 1384046 - RNA, 18 nt, Neisseria meningitidis Z2491
ccgauguugccacacaca

SEQ ID NO: 1384047 - RNA, 17 nt, Neisseria meningitidis Z2491
ccgagcguucggguagg

SEQ ID NO: 1384048 - RNA, 17 nt, Neisseria meningitidis Z2491
ccgcacacgaacugccu

SEQ ID NO: 1384049 - RNA, 14 nt, Neisseria meningitidis Z2491
ccgcacagaaaccu

SEQ ID NO: 1384050 - RNA, 12 nt, Neisseria meningitidis Z2491
ccgcaaacaaaa

SEQ ID NO: 1384051 - RNA, 13 nt, Neisseria meningitidis Z2491
ccgcaaacaaaau

SEQ ID NO: 1384052 - RNA, 16 nt, Neisseria meningitidis Z2491
ccgcaaacaccagcau

SEQ ID NO: 1384053 - RNA, 11 nt, Neisseria meningitidis Z2491
ccgcaaaccuu

SEQ ID NO: 1384054 - RNA, 21 nt, Neisseria meningitidis Z2491
ccgcaaaagcgggaaucuaga

SEQ ID NO: 1384055 - RNA, 16 nt, Neisseria meningitidis Z2491
ccgauuuuggguuucu

SEQ ID NO: 1384056 - RNA, 22 nt, Neisseria meningitidis Z2491
ccgcacauuccaucaacaaaau

SEQ ID NO: 1384057 - RNA, 15 nt, Neisseria meningitidis Z2491
ccgccauccagcaaa

SEQ ID NO: 1384058 - RNA, 15 nt, Neisseria meningitidis Z2491
aaaccaguacggugu

SEQ ID NO: 1384059 - RNA, 15 nt, Neisseria meningitidis Z2491
aaaccauauggaaaa

SEQ ID NO: 1384060 - RNA, 15 nt, Neisseria meningitidis Z2491
ccgccacacccccgu

SEQ ID NO: 1384061 - RNA, 12 nt, Neisseria meningitidis Z2491
ccgccaaacccu

SEQ ID NO: 1384062 - RNA, 17 nt, Neisseria meningitidis Z2491
ccgccacguuugccaag

SEQ ID NO: 1384063 - RNA, 14 nt, Neisseria meningitidis Z2491
aaacccggaaaaaa

SEQ ID NO: 1384064 - RNA, 17 nt, Neisseria meningitidis Z2491
aaacccccgucauuccc

SEQ ID NO: 1384065 - RNA, 22 nt, Neisseria meningitidis Z2491
ccgcccuauauuugccggucgg

SEQ ID NO: 1384066 - RNA, 22 nt, Neisseria meningitidis Z2491
ccgccccuuggcggcuccuccg

SEQ ID NO: 1384067 - RNA, 18 nt, Neisseria meningitidis Z2491
ccgccgcacaaaccgcgc

SEQ ID NO: 1384068 - RNA, 14 nt, Neisseria meningitidis Z2491
ccgccguauccuca

SEQ ID NO: 1384069 - RNA, 23 nt, Neisseria meningitidis Z2491
ccgucugaaacccgauuccuguu

SEQ ID NO: 1384070 - RNA, 14 nt, Neisseria meningitidis Z2491
ccgucugaaacggc

SEQ ID NO: 1384071 - RNA, 20 nt, Neisseria meningitidis Z2491
ccgucugaaacggcggcagg

SEQ ID NO: 1384072 - RNA, 11 nt, Neisseria meningitidis Z2491
ccgucugaaau

SEQ ID NO: 1384073 - RNA, 21 nt, Neisseria meningitidis Z2491
ccgucugaaauccuauuuuca

SEQ ID NO: 1384074 - RNA, 14 nt, Neisseria meningitidis Z2491
ccgucugaacccgu

SEQ ID NO: 1384075 - RNA, 23 nt, Neisseria meningitidis Z2491
ccgucugaacgcuucagacggca

SEQ ID NO: 1384076 - RNA, 10 nt, Neisseria meningitidis Z2491
ccgucugaag

SEQ ID NO: 1384077 - RNA, 14 nt, Neisseria meningitidis Z2491
ccgucugaagcccu

SEQ ID NO: 1384078 - RNA, 15 nt, Neisseria meningitidis Z2491
ccgucugaagcccug

SEQ ID NO: 1384079 - RNA, 19 nt, Neisseria meningitidis Z2491
ccgucugaagccuucagac

SEQ ID NO: 1384080 - RNA, 13 nt, Neisseria meningitidis Z2491
ccgucugaaaaac

SEQ ID NO: 1384081 - RNA, 23 nt, Neisseria meningitidis Z2491
ccgucugaaaaaccuuucccguu

SEQ ID NO: 1384082 - RNA, 23 nt, Neisseria meningitidis Z2491
ccgucugaaaacagcaaaaaggu

SEQ ID NO: 1384083 - RNA, 17 nt, Neisseria meningitidis Z2491
ccgugccgacaaaaccc

SEQ ID NO: 1384084 - RNA, 12 nt, Neisseria meningitidis Z2491
ccgugucaggau

SEQ ID NO: 1384085 - RNA, 18 nt, Neisseria meningitidis Z2491
aaacgacgagaauuuauc

SEQ ID NO: 1384086 - RNA, 18 nt, Neisseria meningitidis Z2491
ccgguuuaauccgccgcg

SEQ ID NO: 1384087 - RNA, 19 nt, Neisseria meningitidis Z2491
ccuaaauacggcaauagaa

SEQ ID NO: 1384088 - RNA, 17 nt, Neisseria meningitidis Z2491
ccuaaccgaaaaaauaa

SEQ ID NO: 1384089 - RNA, 20 nt, Neisseria meningitidis Z2491
ccuaaaauucgucauuccca

SEQ ID NO: 1384090 - RNA, 18 nt, Neisseria meningitidis Z2491
ccuaaaaauuuaauaacu

SEQ ID NO: 1384091 - RNA, 19 nt, Neisseria meningitidis Z2491
ccuaaaaacuaaaugccaa

SEQ ID NO: 1384092 - RNA, 20 nt, Neisseria meningitidis Z2491
ccguuuccuccucgccgucu

SEQ ID NO: 1384093 - RNA, 22 nt, Neisseria meningitidis Z2491
ccguuuggcggcauuuucucua

SEQ ID NO: 1384094 - RNA, 16 nt, Neisseria meningitidis Z2491
ccguuuuggcugaaaa

SEQ ID NO: 1384095 - RNA, 18 nt, Neisseria meningitidis Z2491
ccguuuuacccucucccc

SEQ ID NO: 1384096 - RNA, 19 nt, Neisseria meningitidis Z2491
ccguuuucacgggaaugac

SEQ ID NO: 1384097 - RNA, 14 nt, Neisseria meningitidis Z2491
ccguuuuccuuucu

SEQ ID NO: 1384098 - RNA, 22 nt, Neisseria meningitidis Z2491
ccguuaaggcagagauaaaagc

SEQ ID NO: 1384099 - RNA, 18 nt, Neisseria meningitidis Z2491
ccguucaauucaaaauug

SEQ ID NO: 1384100 - RNA, 20 nt, Neisseria meningitidis Z2491
ccguuucaggaauuugcggc

SEQ ID NO: 1384101 - RNA, 19 nt, Neisseria meningitidis Z2491
ccguugcucuaccaacuga

SEQ ID NO: 1384102 - RNA, 16 nt, Neisseria meningitidis Z2491
ccguugcccauugcca

SEQ ID NO: 1384103 - RNA, 19 nt, Neisseria meningitidis Z2491
ccucgccgucuuucaggaa

SEQ ID NO: 1384104 - RNA, 14 nt, Neisseria meningitidis Z2491
ccucgccuuagcuc

SEQ ID NO: 1384105 - RNA, 22 nt, Neisseria meningitidis Z2491
ccucgccuugccguacuauuug

SEQ ID NO: 1384106 - RNA, 22 nt, Neisseria meningitidis Z2491
ccuccaucagcacgccgccugc

SEQ ID NO: 1384107 - RNA, 20 nt, Neisseria meningitidis Z2491
ccuccaaaggagcaauuaaa

SEQ ID NO: 1384108 - RNA, 20 nt, Neisseria meningitidis Z2491
ccucaucguucaacagcagc

SEQ ID NO: 1384109 - RNA, 21 nt, Neisseria meningitidis Z2491
ccucaucguucaacagcagcg

SEQ ID NO: 1384110 - RNA, 21 nt, Neisseria meningitidis Z2491
ccuauaguggauuaacaaaaa

SEQ ID NO: 1384111 - RNA, 12 nt, Neisseria meningitidis Z2491
ccucagccaucu

SEQ ID NO: 1384112 - RNA, 21 nt, Neisseria meningitidis Z2491
ccucagccaucuacaaaauaa

SEQ ID NO: 1384113 - RNA, 22 nt, Neisseria meningitidis Z2491
ccucagccaucuacaaaauaau

SEQ ID NO: 1384114 - RNA, 15 nt, Neisseria meningitidis Z2491
ccucaaaaacagaaa

SEQ ID NO: 1384115 - RNA, 23 nt, Neisseria meningitidis Z2491
ccucaaaaacagaaaaccaaaau

SEQ ID NO: 1384116 - RNA, 16 nt, Neisseria meningitidis Z2491
ccuaauucuacccaaa

SEQ ID NO: 1384117 - RNA, 17 nt, Neisseria meningitidis Z2491
ccuaaugcuuucgcuuu

SEQ ID NO: 1384118 - RNA, 15 nt, Neisseria meningitidis Z2491
ccuaauguacuucug

SEQ ID NO: 1384119 - RNA, 18 nt, Neisseria meningitidis Z2491
ccggauugcggccgucgg

SEQ ID NO: 1384120 - RNA, 16 nt, Neisseria meningitidis Z2491
ccggauacggaugucc

SEQ ID NO: 1384121 - RNA, 21 nt, Neisseria meningitidis Z2491
ccgcuguacgaauccgccggc

SEQ ID NO: 1384122 - RNA, 20 nt, Neisseria meningitidis Z2491
ccgcuguauuugcgccgccc

SEQ ID NO: 1384123 - RNA, 19 nt, Neisseria meningitidis Z2491
ccgcuuucacgggaaugac

SEQ ID NO: 1384124 - RNA, 19 nt, Neisseria meningitidis Z2491
ccgcuuuacgcgcgccguc

SEQ ID NO: 1384125 - RNA, 20 nt, Neisseria meningitidis Z2491
ccgcuuuacgcgcgccgucc

SEQ ID NO: 1384126 - RNA, 19 nt, Neisseria meningitidis Z2491
ccggcauaaauccuucacc

SEQ ID NO: 1384127 - RNA, 19 nt, Neisseria meningitidis Z2491
ccggcauaacccaaaccgu

SEQ ID NO: 1384128 - RNA, 21 nt, Neisseria meningitidis Z2491
ccggcaugauuuucuuuuuga

SEQ ID NO: 1384129 - RNA, 17 nt, Neisseria meningitidis Z2491
ccggcauucugcacgcc

SEQ ID NO: 1384130 - RNA, 21 nt, Neisseria meningitidis Z2491
ccggcgguuaccagcgguagc

SEQ ID NO: 1384131 - RNA, 22 nt, Neisseria meningitidis Z2491
aaaccgugcugucgguuucauc

SEQ ID NO: 1384132 - RNA, 14 nt, Neisseria meningitidis Z2491
aaaccuaaaauccg

SEQ ID NO: 1384133 - RNA, 21 nt, Neisseria meningitidis Z2491
ccggcuguguuuaucuuuucu

SEQ ID NO: 1384134 - RNA, 18 nt, Neisseria meningitidis Z2491
ccgggcuccgcaggguag

SEQ ID NO: 1384135 - RNA, 23 nt, Neisseria meningitidis Z2491
ccgguagugauggcaagcuuuuu

SEQ ID NO: 1384136 - RNA, 21 nt, Neisseria meningitidis Z2491
cgacaauuucuccgccagccu

SEQ ID NO: 1384137 - RNA, 13 nt, Neisseria meningitidis Z2491
cgacaauacggcg

SEQ ID NO: 1384138 - RNA, 18 nt, Neisseria meningitidis Z2491
cgacaauacggcggcggc

SEQ ID NO: 1384139 - RNA, 13 nt, Neisseria meningitidis Z2491
cgacacccgcccc

SEQ ID NO: 1384140 - RNA, 16 nt, Neisseria meningitidis Z2491
cgacacccgccccgcc

SEQ ID NO: 1384141 - RNA, 20 nt, Neisseria meningitidis Z2491
cgacaaccgcccagccgaau

SEQ ID NO: 1384142 - RNA, 18 nt, Neisseria meningitidis Z2491
cgacaaagccgcagacag

SEQ ID NO: 1384143 - RNA, 12 nt, Neisseria meningitidis Z2491
cgacaaauuccu

SEQ ID NO: 1384144 - RNA, 15 nt, Neisseria meningitidis Z2491
cgacagcagcagccc

SEQ ID NO: 1384145 - RNA, 16 nt, Neisseria meningitidis Z2491
cgacagccgaaaccca

SEQ ID NO: 1384146 - RNA, 22 nt, Neisseria meningitidis Z2491
cgacagccgaaacccaaacaca

SEQ ID NO: 1384147 - RNA, 22 nt, Neisseria meningitidis Z2491
cgacagcggccgccaucaaaaa

SEQ ID NO: 1384148 - RNA, 22 nt, Neisseria meningitidis Z2491
cgacagccuacuugcccgccuu

SEQ ID NO: 1384149 - RNA, 13 nt, Neisseria meningitidis Z2491
cgacaucccccag

SEQ ID NO: 1384150 - RNA, 14 nt, Neisseria meningitidis Z2491
cgacaggcggcgga

SEQ ID NO: 1384151 - RNA, 22 nt, Neisseria meningitidis Z2491
cgaaucugcugcaaaccgucug

SEQ ID NO: 1384152 - RNA, 17 nt, Neisseria meningitidis Z2491
cgaaucuuauccacaga

SEQ ID NO: 1384153 - RNA, 21 nt, Neisseria meningitidis Z2491
cgaauauauaguggcuuaaau

SEQ ID NO: 1384154 - RNA, 13 nt, Neisseria meningitidis Z2491
cgaaguuuaaaga

SEQ ID NO: 1384155 - RNA, 19 nt, Neisseria meningitidis Z2491
cgaauaaaaaauauggauc

SEQ ID NO: 1384156 - RNA, 22 nt, Neisseria meningitidis Z2491
ccuuuuguaaaggaaguuuugu

SEQ ID NO: 1384157 - RNA, 20 nt, Neisseria meningitidis Z2491
cgaagaaauagccgccgccg

SEQ ID NO: 1384158 - RNA, 16 nt, Neisseria meningitidis Z2491
cgaacugccugcaacg

SEQ ID NO: 1384159 - RNA, 14 nt, Neisseria meningitidis Z2491
cgaagcgguuuugu

SEQ ID NO: 1384160 - RNA, 21 nt, Neisseria meningitidis Z2491
cgaccggauagguugaccaga

SEQ ID NO: 1384161 - RNA, 21 nt, Neisseria meningitidis Z2491
cgaccgccgccgccuuugcca

SEQ ID NO: 1384162 - RNA, 19 nt, Neisseria meningitidis Z2491
cgacccgaaucacaaacau

SEQ ID NO: 1384163 - RNA, 12 nt, Neisseria meningitidis Z2491
cgaccaccacuu

SEQ ID NO: 1384164 - RNA, 14 nt, Neisseria meningitidis Z2491
cgacaugcaagcau

SEQ ID NO: 1384165 - RNA, 16 nt, Neisseria meningitidis Z2491
cgaccaacgccgccga

SEQ ID NO: 1384166 - RNA, 15 nt, Neisseria meningitidis Z2491
cgacgaagcugcaga

SEQ ID NO: 1384167 - RNA, 14 nt, Neisseria meningitidis Z2491
cgacgaagccgcag

SEQ ID NO: 1384168 - RNA, 16 nt, Neisseria meningitidis Z2491
cgacgaccaaugccuc

SEQ ID NO: 1384169 - RNA, 21 nt, Neisseria meningitidis Z2491
cgacgaugccgaacagcuugg

SEQ ID NO: 1384170 - RNA, 15 nt, Neisseria meningitidis Z2491
cgacgagaauuuauc

SEQ ID NO: 1384171 - RNA, 14 nt, Neisseria meningitidis Z2491
cgacggcggcaggg

SEQ ID NO: 1384172 - RNA, 22 nt, Neisseria meningitidis Z2491
ccuuugggcgacggcaauauuc

SEQ ID NO: 1384173 - RNA, 22 nt, Neisseria meningitidis Z2491
ccuuugggcggcggcaauauuc

SEQ ID NO: 1384174 - RNA, 23 nt, Neisseria meningitidis Z2491
ccuuugccaccaauaccgccuug

SEQ ID NO: 1384175 - RNA, 22 nt, Neisseria meningitidis Z2491
ccuuucagacggcaucaaaaug

SEQ ID NO: 1384176 - RNA, 21 nt, Neisseria meningitidis Z2491
ccuuucagacggcauuuuuuu

SEQ ID NO: 1384177 - RNA, 20 nt, Neisseria meningitidis Z2491
ccuuucaacacgcccuucca

SEQ ID NO: 1384178 - RNA, 15 nt, Neisseria meningitidis Z2491
ccuuuaugcuguuug

SEQ ID NO: 1384179 - RNA, 16 nt, Neisseria meningitidis Z2491
ccuuguuuuuucaggc

SEQ ID NO: 1384180 - RNA, 20 nt, Neisseria meningitidis Z2491
ccuuuaauuaagauccuccc

SEQ ID NO: 1384181 - RNA, 18 nt, Neisseria meningitidis Z2491
ccuuguccugauuuuugu

SEQ ID NO: 1384182 - RNA, 17 nt, Neisseria meningitidis Z2491
ccuugugccugcuccau

SEQ ID NO: 1384183 - RNA, 22 nt, Neisseria meningitidis Z2491
ccuucagcucucccucuuuaaa

SEQ ID NO: 1384184 - RNA, 13 nt, Neisseria meningitidis Z2491
ccuuccgcuucuu

SEQ ID NO: 1384185 - RNA, 20 nt, Neisseria meningitidis Z2491
ccuucuucuaaaaauacaua

SEQ ID NO: 1384186 - RNA, 14 nt, Neisseria meningitidis Z2491
ccuuaauccuccac

SEQ ID NO: 1384187 - RNA, 16 nt, Neisseria meningitidis Z2491
ccuuauccauauccaa

SEQ ID NO: 1384188 - RNA, 13 nt, Neisseria meningitidis Z2491
ccuuaugccuuuu

SEQ ID NO: 1384189 - RNA, 19 nt, Neisseria meningitidis Z2491
ccuuaugccuuuuucaaac

SEQ ID NO: 1384190 - RNA, 23 nt, Neisseria meningitidis Z2491
ccuuauguauaguaauaaauuaa

SEQ ID NO: 1384191 - RNA, 14 nt, Neisseria meningitidis Z2491
ccuucacgccgccg

SEQ ID NO: 1384192 - RNA, 23 nt, Neisseria meningitidis Z2491
ccuucagauggcuuugugcacuc

SEQ ID NO: 1384193 - RNA, 16 nt, Neisseria meningitidis Z2491
ccugcucgagcggcag

SEQ ID NO: 1384194 - RNA, 15 nt, Neisseria meningitidis Z2491
ccugccgaccccgau

SEQ ID NO: 1384195 - RNA, 16 nt, Neisseria meningitidis Z2491
ccugcccgacagccgc

SEQ ID NO: 1384196 - RNA, 16 nt, Neisseria meningitidis Z2491
ccugcccaaauccagc

SEQ ID NO: 1384197 - RNA, 17 nt, Neisseria meningitidis Z2491
ccugcccaaauccagca

SEQ ID NO: 1384198 - RNA, 20 nt, Neisseria meningitidis Z2491
ccugcaccacgucauuccca

SEQ ID NO: 1384199 - RNA, 19 nt, Neisseria meningitidis Z2491
ccugcaggcguaugccuuu

SEQ ID NO: 1384200 - RNA, 20 nt, Neisseria meningitidis Z2491
ccugcaggcguaugccuuug

SEQ ID NO: 1384201 - RNA, 14 nt, Neisseria meningitidis Z2491
cauugaaauuccag

SEQ ID NO: 1384202 - RNA, 18 nt, Neisseria meningitidis Z2491
cauucccgcaaaaacaaa

SEQ ID NO: 1384203 - RNA, 19 nt, Neisseria meningitidis Z2491
cauucccgcaaaaacaaaa

SEQ ID NO: 1384204 - RNA, 21 nt, Neisseria meningitidis Z2491
cauucccgcaaaaacaaaaaa

SEQ ID NO: 1384205 - RNA, 15 nt, Neisseria meningitidis Z2491
cauucccgcgcagau

SEQ ID NO: 1384206 - RNA, 22 nt, Neisseria meningitidis Z2491
cauucccacgaaagugggaauc

SEQ ID NO: 1384207 - RNA, 21 nt, Neisseria meningitidis Z2491
cauucccacggaagugggaau

SEQ ID NO: 1384208 - RNA, 22 nt, Neisseria meningitidis Z2491
cauucccacggaagugggaauc

SEQ ID NO: 1384209 - RNA, 17 nt, Neisseria meningitidis Z2491
cauucccucaaaaacag

SEQ ID NO: 1384210 - RNA, 18 nt, Neisseria meningitidis Z2491
cauucccucaaaaacaga

SEQ ID NO: 1384211 - RNA, 15 nt, Neisseria meningitidis Z2491
cauucuccguuucag

SEQ ID NO: 1384212 - RNA, 17 nt, Neisseria meningitidis Z2491
cauucucacaaaaacag

SEQ ID NO: 1384213 - RNA, 14 nt, Neisseria meningitidis Z2491
cauucaaugcuaag

SEQ ID NO: 1384214 - RNA, 17 nt, Neisseria meningitidis Z2491
cauucaaugcuaaggca

SEQ ID NO: 1384215 - RNA, 20 nt, Neisseria meningitidis Z2491
cauucaaugcuaaggcaauu

SEQ ID NO: 1384216 - RNA, 16 nt, Neisseria meningitidis Z2491
cauuaucaguauuuuc

SEQ ID NO: 1384217 - RNA, 18 nt, Neisseria meningitidis Z2491
cauuaucaguauuuucua

SEQ ID NO: 1384218 - RNA, 20 nt, Neisseria meningitidis Z2491
cauguaguagcgcgccaccg

SEQ ID NO: 1384219 - RNA, 16 nt, Neisseria meningitidis Z2491
cauguucgugcaucau

SEQ ID NO: 1384220 - RNA, 22 nt, Neisseria meningitidis Z2491
caugcgugcccgguuggaaggc

SEQ ID NO: 1384221 - RNA, 20 nt, Neisseria meningitidis Z2491
caugcggcgggcuuggaaau

SEQ ID NO: 1384222 - RNA, 15 nt, Neisseria meningitidis Z2491
cauggcgacaaucuc

SEQ ID NO: 1384223 - RNA, 16 nt, Neisseria meningitidis Z2491
caugcaccugcauaau

SEQ ID NO: 1384224 - RNA, 22 nt, Neisseria meningitidis Z2491
caugcagcauauguuugcugcu

SEQ ID NO: 1384225 - RNA, 17 nt, Neisseria meningitidis Z2491
caugccauacugccugc

SEQ ID NO: 1384226 - RNA, 20 nt, Neisseria meningitidis Z2491
caugccgcuugaccgcagcc

SEQ ID NO: 1384227 - RNA, 16 nt, Neisseria meningitidis Z2491
caucguuacaaauuua

SEQ ID NO: 1384228 - RNA, 17 nt, Neisseria meningitidis Z2491
caucguuacaaauuuaa

SEQ ID NO: 1384229 - RNA, 18 nt, Neisseria meningitidis Z2491
caucuuuagacugcuucc

SEQ ID NO: 1384230 - RNA, 13 nt, Neisseria meningitidis Z2491
cauccacagccgc

SEQ ID NO: 1384231 - RNA, 15 nt, Neisseria meningitidis Z2491
cauccaccagcccgc

SEQ ID NO: 1384232 - RNA, 22 nt, Neisseria meningitidis Z2491
cauccaccagcccgccgcgccc

SEQ ID NO: 1384233 - RNA, 20 nt, Neisseria meningitidis Z2491
caucagccaaaccgcagcaa

SEQ ID NO: 1384234 - RNA, 20 nt, Neisseria meningitidis Z2491
cauccauacggaaaccugca

SEQ ID NO: 1384235 - RNA, 21 nt, Neisseria meningitidis Z2491
cauccaucacgccgguaccca

SEQ ID NO: 1384236 - RNA, 22 nt, Neisseria meningitidis Z2491
cauccccgcgaaagcgggaauc

SEQ ID NO: 1384237 - RNA, 21 nt, Neisseria meningitidis Z2491
cauccuuuccucuuucaucau

SEQ ID NO: 1384238 - RNA, 22 nt, Neisseria meningitidis Z2491
caucgcaucagguuaucacuug

SEQ ID NO: 1384239 - RNA, 15 nt, Neisseria meningitidis Z2491
caucgggccggcuuc

SEQ ID NO: 1384240 - RNA, 21 nt, Neisseria meningitidis Z2491
caucacuccgucuuucauuuu

SEQ ID NO: 1384241 - RNA, 20 nt, Neisseria meningitidis Z2491
caucaacauuugcgcagccu

SEQ ID NO: 1384242 - RNA, 22 nt, Neisseria meningitidis Z2491
cauauuccggugcgaccguaug

SEQ ID NO: 1384243 - RNA, 15 nt, Neisseria meningitidis Z2491
cauaucggcaaucac

SEQ ID NO: 1384244 - RNA, 19 nt, Neisseria meningitidis Z2491
cauagcguguauuuuggua

SEQ ID NO: 1384245 - RNA, 20 nt, Neisseria meningitidis Z2491
cauagcguguauuuugguag

SEQ ID NO: 1384246 - RNA, 16 nt, Neisseria meningitidis Z2491
cauagccuucacgcac

SEQ ID NO: 1384247 - RNA, 16 nt, Neisseria meningitidis Z2491
cauagguuacuaaaau

SEQ ID NO: 1384248 - RNA, 21 nt, Neisseria meningitidis Z2491
cauagguuacuaaaauuuuau

SEQ ID NO: 1384249 - RNA, 14 nt, Neisseria meningitidis Z2491
cauauaacaccuuu

SEQ ID NO: 1384250 - RNA, 18 nt, Neisseria meningitidis Z2491
cauacugugggaaacuuu

SEQ ID NO: 1384251 - RNA, 15 nt, Neisseria meningitidis Z2491
cauagauaaauuuca

SEQ ID NO: 1384252 - RNA, 16 nt, Neisseria meningitidis Z2491
cauagauaaauuucag

SEQ ID NO: 1384253 - RNA, 17 nt, Neisseria meningitidis Z2491
cauagacuguaccaaau

SEQ ID NO: 1384254 - RNA, 21 nt, Neisseria meningitidis Z2491
cauagacuguaccaaauuauu

SEQ ID NO: 1384255 - RNA, 12 nt, Neisseria meningitidis Z2491
cauagaaaggga

SEQ ID NO: 1384256 - RNA, 17 nt, Neisseria meningitidis Z2491
ccagcagguugauggcg

SEQ ID NO: 1384257 - RNA, 19 nt, Neisseria meningitidis Z2491
ccagcagugccgcaccacc

SEQ ID NO: 1384258 - RNA, 14 nt, Neisseria meningitidis Z2491
ccagccagccguau

SEQ ID NO: 1384259 - RNA, 22 nt, Neisseria meningitidis Z2491
ccagccacaacacgcaaaacac

SEQ ID NO: 1384260 - RNA, 16 nt, Neisseria meningitidis Z2491
ccagcaacauuuccug

SEQ ID NO: 1384261 - RNA, 12 nt, Neisseria meningitidis Z2491
ccagcagcagcc

SEQ ID NO: 1384262 - RNA, 13 nt, Neisseria meningitidis Z2491
ccagcagcagccc

SEQ ID NO: 1384263 - RNA, 13 nt, Neisseria meningitidis Z2491
ccagagggaaagu

SEQ ID NO: 1384264 - RNA, 16 nt, Neisseria meningitidis Z2491
ccagaggcggaaucga

SEQ ID NO: 1384265 - RNA, 15 nt, Neisseria meningitidis Z2491
ccagacauucaaugc

SEQ ID NO: 1384266 - RNA, 18 nt, Neisseria meningitidis Z2491
ccagacggagauuuuguu

SEQ ID NO: 1384267 - RNA, 18 nt, Neisseria meningitidis Z2491
ccagacggcauuuuucau

SEQ ID NO: 1384268 - RNA, 13 nt, Neisseria meningitidis Z2491
ccagauucccgcu

SEQ ID NO: 1384269 - RNA, 20 nt, Neisseria meningitidis Z2491
ccacuuucgccauaaucugc

SEQ ID NO: 1384270 - RNA, 20 nt, Neisseria meningitidis Z2491
ccacuuuuuucaagccuugc

SEQ ID NO: 1384271 - RNA, 22 nt, Neisseria meningitidis Z2491
ccagaaucucuaaagcuucagc

SEQ ID NO: 1384272 - RNA, 14 nt, Neisseria meningitidis Z2491
ccacuucaaccgcg

SEQ ID NO: 1384273 - RNA, 21 nt, Neisseria meningitidis Z2491
ccacuucaaccgcgauguguc

SEQ ID NO: 1384274 - RNA, 20 nt, Neisseria meningitidis Z2491
ccacgccaacguaccgucca

SEQ ID NO: 1384275 - RNA, 12 nt, Neisseria meningitidis Z2491
ccacgccaaaaa

SEQ ID NO: 1384276 - RNA, 14 nt, Neisseria meningitidis Z2491
ccacgccaaaccga

SEQ ID NO: 1384277 - RNA, 16 nt, Neisseria meningitidis Z2491
ccacugccagccgccg

SEQ ID NO: 1384278 - RNA, 17 nt, Neisseria meningitidis Z2491
ccacugccagccgccga

SEQ ID NO: 1384279 - RNA, 23 nt, Neisseria meningitidis Z2491
ccacaguuuuuccaguuugaaau

SEQ ID NO: 1384280 - RNA, 14 nt, Neisseria meningitidis Z2491
ccacacgcaggcga

SEQ ID NO: 1384281 - RNA, 19 nt, Neisseria meningitidis Z2491
ccacaccguucagcccgaa

SEQ ID NO: 1384282 - RNA, 20 nt, Neisseria meningitidis Z2491
ccacauuuggaaauguuuga

SEQ ID NO: 1384283 - RNA, 20 nt, Neisseria meningitidis Z2491
ccaauuccugcgccaaugcu

SEQ ID NO: 1384284 - RNA, 16 nt, Neisseria meningitidis Z2491
ccaaugccgucugaaa

SEQ ID NO: 1384285 - RNA, 20 nt, Neisseria meningitidis Z2491
ccaaugccgucugaaacccg

SEQ ID NO: 1384286 - RNA, 20 nt, Neisseria meningitidis Z2491
ccaaugacugcgggcuuugu

SEQ ID NO: 1384287 - RNA, 14 nt, Neisseria meningitidis Z2491
ccaccagcccgccg

SEQ ID NO: 1384288 - RNA, 22 nt, Neisseria meningitidis Z2491
ccaccagcccgccgcgcccgca

SEQ ID NO: 1384289 - RNA, 11 nt, Neisseria meningitidis Z2491
ccaccaacugg

SEQ ID NO: 1384290 - RNA, 13 nt, Neisseria meningitidis Z2491
ccaccgcgcgcca

SEQ ID NO: 1384291 - RNA, 22 nt, Neisseria meningitidis Z2491
ccaccgugcgcugucaaacccu

SEQ ID NO: 1384292 - RNA, 21 nt, Neisseria meningitidis Z2491
ccaaauuauugccagcauuaa

SEQ ID NO: 1384293 - RNA, 15 nt, Neisseria meningitidis Z2491
ccaaagagaaagaac

SEQ ID NO: 1384294 - RNA, 14 nt, Neisseria meningitidis Z2491
ccaaacuuccaaau

SEQ ID NO: 1384295 - RNA, 19 nt, Neisseria meningitidis Z2491
ccaaauaaagucugauucu

SEQ ID NO: 1384296 - RNA, 19 nt, Neisseria meningitidis Z2491
ccaaauaccgccuaauucu

SEQ ID NO: 1384297 - RNA, 18 nt, Neisseria meningitidis Z2491
ccaaaucuugcaaacccc

SEQ ID NO: 1384298 - RNA, 20 nt, Neisseria meningitidis Z2491
ccaaaucuugcaaaccccuc

SEQ ID NO: 1384299 - RNA, 18 nt, Neisseria meningitidis Z2491
ccaaaugcagaauaaggc

SEQ ID NO: 1384300 - RNA, 19 nt, Neisseria meningitidis Z2491
ccaaaugcagaauaaggca

SEQ ID NO: 1384301 - RNA, 16 nt, Neisseria meningitidis Z2491
ccaacucgacauuuuc

SEQ ID NO: 1384302 - RNA, 20 nt, Neisseria meningitidis Z2491
ccaagccgaauugcagcgcg

SEQ ID NO: 1384303 - RNA, 23 nt, Neisseria meningitidis Z2491
ccaagggcaggguguuguagccu

SEQ ID NO: 1384304 - RNA, 14 nt, Neisseria meningitidis Z2491
ccaagguugucuga

SEQ ID NO: 1384305 - RNA, 20 nt, Neisseria meningitidis Z2491
ccaaaaacggcacggcgcag

SEQ ID NO: 1384306 - RNA, 18 nt, Neisseria meningitidis Z2491
ccaaaaacagaaaccuaa

SEQ ID NO: 1384307 - RNA, 23 nt, Neisseria meningitidis Z2491
ccaaaaacagaaaccuaaaaucu

SEQ ID NO: 1384308 - RNA, 22 nt, Neisseria meningitidis Z2491
ccaaaaacagaaaccuaaaauu

SEQ ID NO: 1384309 - RNA, 23 nt, Neisseria meningitidis Z2491
ccaaaaacagaaaccugaaaaca

SEQ ID NO: 1384310 - RNA, 13 nt, Neisseria meningitidis Z2491
ccaaaacaaauac

SEQ ID NO: 1384311 - RNA, 17 nt, Neisseria meningitidis Z2491
ccaaaacagaaaccuaa

SEQ ID NO: 1384312 - RNA, 21 nt, Neisseria meningitidis Z2491
ccaaaacagaaaccuaaaauu

SEQ ID NO: 1384313 - RNA, 20 nt, Neisseria meningitidis Z2491
ccaaaaucggccauucccuc

SEQ ID NO: 1384314 - RNA, 13 nt, Neisseria meningitidis Z2491
ccaaaaucagaaa

SEQ ID NO: 1384315 - RNA, 16 nt, Neisseria meningitidis Z2491
ccaaaaucagaaaccu

SEQ ID NO: 1384316 - RNA, 13 nt, Neisseria meningitidis Z2491
ccaaacacagguu

SEQ ID NO: 1384317 - RNA, 14 nt, Neisseria meningitidis Z2491
ccaaacccgcccgc

SEQ ID NO: 1384318 - RNA, 18 nt, Neisseria meningitidis Z2491
ccaaacgagcaauauugg

SEQ ID NO: 1384319 - RNA, 21 nt, Neisseria meningitidis Z2491
cauuuugauuguacggcagcc

SEQ ID NO: 1384320 - RNA, 20 nt, Neisseria meningitidis Z2491
cauuuugucgaacgccgcuu

SEQ ID NO: 1384321 - RNA, 21 nt, Neisseria meningitidis Z2491
cauuuugucgaacgccgcuuc

SEQ ID NO: 1384322 - RNA, 16 nt, Neisseria meningitidis Z2491
cauuuuuggcuugaca

SEQ ID NO: 1384323 - RNA, 17 nt, Neisseria meningitidis Z2491
cauuuuuuucggguuca

SEQ ID NO: 1384324 - RNA, 21 nt, Neisseria meningitidis Z2491
ccaaaaaaaccgaaaccgaac

SEQ ID NO: 1384325 - RNA, 16 nt, Neisseria meningitidis Z2491
cauuuuuaucuuuuuu

SEQ ID NO: 1384326 - RNA, 19 nt, Neisseria meningitidis Z2491
cauuuuuaauuucuucuau

SEQ ID NO: 1384327 - RNA, 16 nt, Neisseria meningitidis Z2491
cagguuuugguacacg

SEQ ID NO: 1384328 - RNA, 18 nt, Neisseria meningitidis Z2491
cagguuuuguuuuuccaa

SEQ ID NO: 1384329 - RNA, 23 nt, Neisseria meningitidis Z2491
aaacaaagccggcggcaacaaug

SEQ ID NO: 1384330 - RNA, 20 nt, Neisseria meningitidis Z2491
aaacaaagcuuuaaacuaua

SEQ ID NO: 1384331 - RNA, 22 nt, Neisseria meningitidis Z2491
aaacaaagcuuuaaacuauagu

SEQ ID NO: 1384332 - RNA, 19 nt, Neisseria meningitidis Z2491
aaacaaauacccaaaugca

SEQ ID NO: 1384333 - RNA, 14 nt, Neisseria meningitidis Z2491
aaacaacagaaacc

SEQ ID NO: 1384334 - RNA, 17 nt, Neisseria meningitidis Z2491
aaacaacaaauuuuuga

SEQ ID NO: 1384335 - RNA, 15 nt, Neisseria meningitidis Z2491
caggucgugcgccgu

SEQ ID NO: 1384336 - RNA, 14 nt, Neisseria meningitidis Z2491
caggugcagauguu

SEQ ID NO: 1384337 - RNA, 19 nt, Neisseria meningitidis Z2491
caguacggcguugccucgc

SEQ ID NO: 1384338 - RNA, 22 nt, Neisseria meningitidis Z2491
caguacgcgcugugcaaagaaa

SEQ ID NO: 1384339 - RNA, 23 nt, Neisseria meningitidis Z2491
caguauagugaauuaaauuuaaa

SEQ ID NO: 1384340 - RNA, 16 nt, Neisseria meningitidis Z2491
caguaugauucgcuuu

SEQ ID NO: 1384341 - RNA, 22 nt, Neisseria meningitidis Z2491
caguauuagaaccgaacacaga

SEQ ID NO: 1384342 - RNA, 16 nt, Neisseria meningitidis Z2491
caguccacauuuggaa

SEQ ID NO: 1384343 - RNA, 14 nt, Neisseria meningitidis Z2491
caguccuacccaaa

SEQ ID NO: 1384344 - RNA, 20 nt, Neisseria meningitidis Z2491
cagucugucgccgucggcuu

SEQ ID NO: 1384345 - RNA, 21 nt, Neisseria meningitidis Z2491
cagucuuccaacccuccgccg

SEQ ID NO: 1384346 - RNA, 22 nt, Neisseria meningitidis Z2491
cagucuuccaacccuccgccgc

SEQ ID NO: 1384347 - RNA, 16 nt, Neisseria meningitidis Z2491
caggcccaaaacaaau

SEQ ID NO: 1384348 - RNA, 12 nt, Neisseria meningitidis Z2491
caggcauuauuu

SEQ ID NO: 1384349 - RNA, 16 nt, Neisseria meningitidis Z2491
cagggacagcggacgc

SEQ ID NO: 1384350 - RNA, 21 nt, Neisseria meningitidis Z2491
cagggaccuuuaauuacacgg

SEQ ID NO: 1384351 - RNA, 17 nt, Neisseria meningitidis Z2491
caggcuucagacggcau

SEQ ID NO: 1384352 - RNA, 19 nt, Neisseria meningitidis Z2491
caggaacgaaucaggcaaa

SEQ ID NO: 1384353 - RNA, 18 nt, Neisseria meningitidis Z2491
caggaauccggagucuca

SEQ ID NO: 1384354 - RNA, 17 nt, Neisseria meningitidis Z2491
aaaauuucuugauuuuu

SEQ ID NO: 1384355 - RNA, 22 nt, Neisseria meningitidis Z2491
aaaauuucuugauuuuucugaa

SEQ ID NO: 1384356 - RNA, 15 nt, Neisseria meningitidis Z2491
caggagcaacagaaa

SEQ ID NO: 1384357 - RNA, 14 nt, Neisseria meningitidis Z2491
aaaauuuuaugcuc

SEQ ID NO: 1384358 - RNA, 17 nt, Neisseria meningitidis Z2491
cagcuugagaacggaug

SEQ ID NO: 1384359 - RNA, 23 nt, Neisseria meningitidis Z2491
caggaaaacagcgaguuuuucgc

SEQ ID NO: 1384360 - RNA, 17 nt, Neisseria meningitidis Z2491
cagcuucaccgcgccgu

SEQ ID NO: 1384361 - RNA, 22 nt, Neisseria meningitidis Z2491
cagcuucauaccccacugccag

SEQ ID NO: 1384362 - RNA, 21 nt, Neisseria meningitidis Z2491
cagcuauuuagaauaaauuuu

SEQ ID NO: 1384363 - RNA, 18 nt, Neisseria meningitidis Z2491
aaaauuuaugaaauacau

SEQ ID NO: 1384364 - RNA, 19 nt, Neisseria meningitidis Z2491
aaaauuuauccgaaacaac

SEQ ID NO: 1384365 - RNA, 20 nt, Neisseria meningitidis Z2491
aaaauuuauccgaaacaaca

SEQ ID NO: 1384366 - RNA, 22 nt, Neisseria meningitidis Z2491
aaaauuuauccgaagcgacaac

SEQ ID NO: 1384367 - RNA, 23 nt, Neisseria meningitidis Z2491
cagcucgauauccgacugugccg

SEQ ID NO: 1384368 - RNA, 15 nt, Neisseria meningitidis Z2491
cacuuucgugggaau

SEQ ID NO: 1384369 - RNA, 15 nt, Neisseria meningitidis Z2491
cacuuucauucacac

SEQ ID NO: 1384370 - RNA, 22 nt, Neisseria meningitidis Z2491
cacuuucgccauaaucugcggc

SEQ ID NO: 1384371 - RNA, 17 nt, Neisseria meningitidis Z2491
cacgucuaucauggcgc

SEQ ID NO: 1384372 - RNA, 19 nt, Neisseria meningitidis Z2491
cacgucgucgguaaucaca

SEQ ID NO: 1384373 - RNA, 22 nt, Neisseria meningitidis Z2491
cagaaacccaaaaucggccauu

SEQ ID NO: 1384374 - RNA, 23 nt, Neisseria meningitidis Z2491
cagaaaaacaaugccgucugaua

SEQ ID NO: 1384375 - RNA, 16 nt, Neisseria meningitidis Z2491
cagaaaauugaaauuc

SEQ ID NO: 1384376 - RNA, 15 nt, Neisseria meningitidis Z2491
cagaaaauuucuuga

SEQ ID NO: 1384377 - RNA, 17 nt, Neisseria meningitidis Z2491
cagaaaauuucuugauu

SEQ ID NO: 1384378 - RNA, 13 nt, Neisseria meningitidis Z2491
cagaaauaaggau

SEQ ID NO: 1384379 - RNA, 11 nt, Neisseria meningitidis Z2491
cagaaaccuaa

SEQ ID NO: 1384380 - RNA, 15 nt, Neisseria meningitidis Z2491
cagaaaccuaaaauc

SEQ ID NO: 1384381 - RNA, 17 nt, Neisseria meningitidis Z2491
cagaaaccuaaaauccg

SEQ ID NO: 1384382 - RNA, 16 nt, Neisseria meningitidis Z2491
cagaaaccuaaaauuc

SEQ ID NO: 1384383 - RNA, 17 nt, Neisseria meningitidis Z2491
cagaaaccuaaaauucg

SEQ ID NO: 1384384 - RNA, 14 nt, Neisseria meningitidis Z2491
cagaaaugacugaa

SEQ ID NO: 1384385 - RNA, 16 nt, Neisseria meningitidis Z2491
cagaaaugacugaaau

SEQ ID NO: 1384386 - RNA, 22 nt, Neisseria meningitidis Z2491
cagaaaugacugaaauucaaaa

SEQ ID NO: 1384387 - RNA, 19 nt, Neisseria meningitidis Z2491
cagaaauuuauaaacaaaa

SEQ ID NO: 1384388 - RNA, 21 nt, Neisseria meningitidis Z2491
cagaaauuuauaaacaaaaaa

SEQ ID NO: 1384389 - RNA, 22 nt, Neisseria meningitidis Z2491
cagaaauuuauaaacaaaaaac

SEQ ID NO: 1384390 - RNA, 24 nt, Neisseria meningitidis Z2491
cagaauuuauuugaacaacaaacu

SEQ ID NO: 1384391 - RNA, 18 nt, Neisseria meningitidis Z2491
cagacaaucagaucggca

SEQ ID NO: 1384392 - RNA, 19 nt, Neisseria meningitidis Z2491
cagacguucggcaaaaucc

SEQ ID NO: 1384393 - RNA, 11 nt, Neisseria meningitidis Z2491
aaaaucaaaaa

SEQ ID NO: 1384394 - RNA, 13 nt, Neisseria meningitidis Z2491
aaaaucaguauag

SEQ ID NO: 1384395 - RNA, 22 nt, Neisseria meningitidis Z2491
aaaaucaggggauuauuuauuu

SEQ ID NO: 1384396 - RNA, 19 nt, Neisseria meningitidis Z2491
cagagagccgcaggcaaau

SEQ ID NO: 1384397 - RNA, 16 nt, Neisseria meningitidis Z2491
aaaauccaaaaauacg

SEQ ID NO: 1384398 - RNA, 18 nt, Neisseria meningitidis Z2491
cagauuacuaaaacacag

SEQ ID NO: 1384399 - RNA, 18 nt, Neisseria meningitidis Z2491
cagauuuuacguucugga

SEQ ID NO: 1384400 - RNA, 17 nt, Neisseria meningitidis Z2491
cagauggcguuaccaau

SEQ ID NO: 1384401 - RNA, 15 nt, Neisseria meningitidis Z2491
aaaaucugauaagca

SEQ ID NO: 1384402 - RNA, 15 nt, Neisseria meningitidis Z2491
aaaaucucgucauuc

SEQ ID NO: 1384403 - RNA, 21 nt, Neisseria meningitidis Z2491
cagauaacggucgaaacuuuc

SEQ ID NO: 1384404 - RNA, 15 nt, Neisseria meningitidis Z2491
cagaucggcaaaccc

SEQ ID NO: 1384405 - RNA, 12 nt, Neisseria meningitidis Z2491
cagcacugccuc

SEQ ID NO: 1384406 - RNA, 14 nt, Neisseria meningitidis Z2491
cagcacugccucuu

SEQ ID NO: 1384407 - RNA, 18 nt, Neisseria meningitidis Z2491
cagcacugccucuuuuca

SEQ ID NO: 1384408 - RNA, 17 nt, Neisseria meningitidis Z2491
cagcacgauacacaaaa

SEQ ID NO: 1384409 - RNA, 18 nt, Neisseria meningitidis Z2491
cagcacaucgucugcaag

SEQ ID NO: 1384410 - RNA, 18 nt, Neisseria meningitidis Z2491
aaaaugacacaaagccuu

SEQ ID NO: 1384411 - RNA, 16 nt, Neisseria meningitidis Z2491
cagcaacauuuccugc

SEQ ID NO: 1384412 - RNA, 18 nt, Neisseria meningitidis Z2491
cagcaacauuuccugcau

SEQ ID NO: 1384413 - RNA, 12 nt, Neisseria meningitidis Z2491
cagcaaccugaa

SEQ ID NO: 1384414 - RNA, 14 nt, Neisseria meningitidis Z2491
cagcacaaacagca

SEQ ID NO: 1384415 - RNA, 16 nt, Neisseria meningitidis Z2491
cagcacaaacagcaug

SEQ ID NO: 1384416 - RNA, 13 nt, Neisseria meningitidis Z2491
cagcaaugcgucu

SEQ ID NO: 1384417 - RNA, 16 nt, Neisseria meningitidis Z2491
cagcaaucagggccuu

SEQ ID NO: 1384418 - RNA, 16 nt, Neisseria meningitidis Z2491
cagcauuaauauacuu

SEQ ID NO: 1384419 - RNA, 20 nt, Neisseria meningitidis Z2491
cagccaggcgcagguuuugu

SEQ ID NO: 1384420 - RNA, 15 nt, Neisseria meningitidis Z2491
cagccacgccaaaaa

SEQ ID NO: 1384421 - RNA, 14 nt, Neisseria meningitidis Z2491
cagccaccagcggu

SEQ ID NO: 1384422 - RNA, 20 nt, Neisseria meningitidis Z2491
cagcauaguggggaguccuu

SEQ ID NO: 1384423 - RNA, 16 nt, Neisseria meningitidis Z2491
cagcauauagccgagc

SEQ ID NO: 1384424 - RNA, 13 nt, Neisseria meningitidis Z2491
cagcauaacaccu

SEQ ID NO: 1384425 - RNA, 19 nt, Neisseria meningitidis Z2491
cagcaggggauugccgccc

SEQ ID NO: 1384426 - RNA, 17 nt, Neisseria meningitidis Z2491
cagcaggaaggcggcaa

SEQ ID NO: 1384427 - RNA, 21 nt, Neisseria meningitidis Z2491
cagcagaaucuguugcggccc

SEQ ID NO: 1384428 - RNA, 22 nt, Neisseria meningitidis Z2491
cagcagagcugugcagucgggc

SEQ ID NO: 1384429 - RNA, 16 nt, Neisseria meningitidis Z2491
cagcgaagacaggcag

SEQ ID NO: 1384430 - RNA, 12 nt, Neisseria meningitidis Z2491
cagccugcucga

SEQ ID NO: 1384431 - RNA, 16 nt, Neisseria meningitidis Z2491
cagccugccgcugaug

SEQ ID NO: 1384432 - RNA, 23 nt, Neisseria meningitidis Z2491
cagccugccgcugaugaugaugg

SEQ ID NO: 1384433 - RNA, 21 nt, Neisseria meningitidis Z2491
cagcccucuugccuuaucccg

SEQ ID NO: 1384434 - RNA, 18 nt, Neisseria meningitidis Z2491
cagcgcgaugucgcugcc

SEQ ID NO: 1384435 - RNA, 16 nt, Neisseria meningitidis Z2491
uuuuuguuaauccacu

SEQ ID NO: 1384436 - RNA, 15 nt, Neisseria meningitidis Z2491
uuuuugguguuugca

SEQ ID NO: 1384437 - RNA, 18 nt, Neisseria meningitidis Z2491
uuuuugggcggucaggcu

SEQ ID NO: 1384438 - RNA, 19 nt, Neisseria meningitidis Z2491
uuuuugaauuucgggcaac

SEQ ID NO: 1384439 - RNA, 22 nt, Neisseria meningitidis Z2491
uuuuucggcacaagaugcccca

SEQ ID NO: 1384440 - RNA, 13 nt, Neisseria meningitidis Z2491
uuuuucugaaaaa

SEQ ID NO: 1384441 - RNA, 21 nt, Neisseria meningitidis Z2491
uuuugaugguuuugccgcugc

SEQ ID NO: 1384442 - RNA, 19 nt, Neisseria meningitidis Z2491
uuuuuccgacaaauuccua

SEQ ID NO: 1384443 - RNA, 17 nt, Neisseria meningitidis Z2491
uuuuuccgauaaauucc

SEQ ID NO: 1384444 - RNA, 13 nt, Neisseria meningitidis Z2491
uuuuuccaaaccu

SEQ ID NO: 1384445 - RNA, 15 nt, Neisseria meningitidis Z2491
uuuuuccacaaaaga

SEQ ID NO: 1384446 - RNA, 15 nt, Neisseria meningitidis Z2491
uuuuuccaguuugaa

SEQ ID NO: 1384447 - RNA, 20 nt, Neisseria meningitidis Z2491
uuugugcaggcauuauuuuu

SEQ ID NO: 1384448 - RNA, 16 nt, Neisseria meningitidis Z2491
uuugugaauccacuau

SEQ ID NO: 1384449 - RNA, 14 nt, Neisseria meningitidis Z2491
uuugucggcuuuug

SEQ ID NO: 1384450 - RNA, 15 nt, Neisseria meningitidis Z2491
uuugucgguaaaaau

SEQ ID NO: 1384451 - RNA, 20 nt, Neisseria meningitidis Z2491
uuugucgguaaaaauggaaa

SEQ ID NO: 1384452 - RNA, 23 nt, Neisseria meningitidis Z2491
uuuguuaauccacuauacauccc

SEQ ID NO: 1384453 - RNA, 18 nt, Neisseria meningitidis Z2491
uuuguuaauccgcuauau

SEQ ID NO: 1384454 - RNA, 21 nt, Neisseria meningitidis Z2491
uuuuaaacaacaaauuuuuga

SEQ ID NO: 1384455 - RNA, 16 nt, Neisseria meningitidis Z2491
uuuuaaaaccguuccu

SEQ ID NO: 1384456 - RNA, 20 nt, Neisseria meningitidis Z2491
uuuuaaaaggggcuguacua

SEQ ID NO: 1384457 - RNA, 22 nt, Neisseria meningitidis Z2491
uuugguuuccagauucccaccu

SEQ ID NO: 1384458 - RNA, 18 nt, Neisseria meningitidis Z2491
uuugguaaugcaaaaagu

SEQ ID NO: 1384459 - RNA, 20 nt, Neisseria meningitidis Z2491
uuugguaaugcaaaaagucc

SEQ ID NO: 1384460 - RNA, 13 nt, Neisseria meningitidis Z2491
uuuggucaguguu

SEQ ID NO: 1384461 - RNA, 18 nt, Neisseria meningitidis Z2491
uuuggcgcauuuuuaugc

SEQ ID NO: 1384462 - RNA, 21 nt, Neisseria meningitidis Z2491
uuuggcgcauuuuuucugcca

SEQ ID NO: 1384463 - RNA, 22 nt, Neisseria meningitidis Z2491
uuuggcgcauuuuuucugccau

SEQ ID NO: 1384464 - RNA, 14 nt, Neisseria meningitidis Z2491
uuuggcggcggcag

SEQ ID NO: 1384465 - RNA, 13 nt, Neisseria meningitidis Z2491
uuugggcguucag

SEQ ID NO: 1384466 - RNA, 21 nt, Neisseria meningitidis Z2491
uuuggcuucgguuguauuuuu

SEQ ID NO: 1384467 - RNA, 17 nt, Neisseria meningitidis Z2491
uuugguuuucuauuuuu

SEQ ID NO: 1384468 - RNA, 14 nt, Neisseria meningitidis Z2491
uuuguauaguggau

SEQ ID NO: 1384469 - RNA, 19 nt, Neisseria meningitidis Z2491
uuuguagggcgugccgaug

SEQ ID NO: 1384470 - RNA, 22 nt, Neisseria meningitidis Z2491
uuugcuggaagcauugaccacu

SEQ ID NO: 1384471 - RNA, 21 nt, Neisseria meningitidis Z2491
uuugcugcuguauuuuuccaa

SEQ ID NO: 1384472 - RNA, 17 nt, Neisseria meningitidis Z2491
uuugcugacguaaaaaa

SEQ ID NO: 1384473 - RNA, 16 nt, Neisseria meningitidis Z2491
uuugcggcuugccgcc

SEQ ID NO: 1384474 - RNA, 12 nt, Neisseria meningitidis Z2491
uuugcgcuguug

SEQ ID NO: 1384475 - RNA, 16 nt, Neisseria meningitidis Z2491
uuugcgcuccauugcc

SEQ ID NO: 1384476 - RNA, 14 nt, Neisseria meningitidis Z2491
uuuggaaaugucuu

SEQ ID NO: 1384477 - RNA, 19 nt, Neisseria meningitidis Z2491
uuuuaccguucaauuucaa

SEQ ID NO: 1384478 - RNA, 19 nt, Neisseria meningitidis Z2491
uuuuaccgagccuaaugcu

SEQ ID NO: 1384479 - RNA, 21 nt, Neisseria meningitidis Z2491
uuuuauaguggauuaacaaaa

SEQ ID NO: 1384480 - RNA, 16 nt, Neisseria meningitidis Z2491
uuuuagguuucugauu

SEQ ID NO: 1384481 - RNA, 16 nt, Neisseria meningitidis Z2491
uuuuagccuuuuguuu

SEQ ID NO: 1384482 - RNA, 16 nt, Neisseria meningitidis Z2491
uuuuagggaaacguuu

SEQ ID NO: 1384483 - RNA, 22 nt, Neisseria meningitidis Z2491
uuuuaggcaauugaaaaauuuu

SEQ ID NO: 1384484 - RNA, 21 nt, Neisseria meningitidis Z2491
uuuuaggcaauugaaaauuuu

SEQ ID NO: 1384485 - RNA, 14 nt, Neisseria meningitidis Z2491
uuuuaugcgucaaa

SEQ ID NO: 1384486 - RNA, 19 nt, Neisseria meningitidis Z2491
uuuuaugcgucaaauuucg

SEQ ID NO: 1384487 - RNA, 14 nt, Neisseria meningitidis Z2491
uuuuaucuuuuaau

SEQ ID NO: 1384488 - RNA, 15 nt, Neisseria meningitidis Z2491
uuuuaucuuuuaauu

SEQ ID NO: 1384489 - RNA, 22 nt, Neisseria meningitidis Z2491
uuuuaucagggcugcaaaauuu

SEQ ID NO: 1384490 - RNA, 17 nt, Neisseria meningitidis Z2491
uuuucccugacaaacag

SEQ ID NO: 1384491 - RNA, 18 nt, Neisseria meningitidis Z2491
uuuuccccgugaaaaaau

SEQ ID NO: 1384492 - RNA, 13 nt, Neisseria meningitidis Z2491
uuuucuaaauguu

SEQ ID NO: 1384493 - RNA, 16 nt, Neisseria meningitidis Z2491
uuuucuaaaauaugca

SEQ ID NO: 1384494 - RNA, 17 nt, Neisseria meningitidis Z2491
uuuucguuaucccaaca

SEQ ID NO: 1384495 - RNA, 22 nt, Neisseria meningitidis Z2491
uuuucucaaaguuauuaaguga

SEQ ID NO: 1384496 - RNA, 13 nt, Neisseria meningitidis Z2491
uuuucuuuuugau

SEQ ID NO: 1384497 - RNA, 13 nt, Neisseria meningitidis Z2491
uuuuaugcucaau

SEQ ID NO: 1384498 - RNA, 16 nt, Neisseria meningitidis Z2491
uuuuauuuucaaacau

SEQ ID NO: 1384499 - RNA, 12 nt, Neisseria meningitidis Z2491
uuuucauuuuug

SEQ ID NO: 1384500 - RNA, 13 nt, Neisseria meningitidis Z2491
uuuucauuuuugg

SEQ ID NO: 1384501 - RNA, 14 nt, Neisseria meningitidis Z2491
uuuucacaaaaaca

SEQ ID NO: 1384502 - RNA, 19 nt, Neisseria meningitidis Z2491
uuuucacaaaaacagaaaa

SEQ ID NO: 1384503 - RNA, 17 nt, Neisseria meningitidis Z2491
uuuuccacaaaagauac

SEQ ID NO: 1384504 - RNA, 18 nt, Neisseria meningitidis Z2491
uuuuccacaaaagauaca

SEQ ID NO: 1384505 - RNA, 13 nt, Neisseria meningitidis Z2491
uuuuccaguuuga

SEQ ID NO: 1384506 - RNA, 14 nt, Neisseria meningitidis Z2491
uuuuccaguuugaa

SEQ ID NO: 1384507 - RNA, 16 nt, Neisseria meningitidis Z2491
uuuuccaguuugaaau

SEQ ID NO: 1384508 - RNA, 15 nt, Neisseria meningitidis Z2491
uuuucaagccuuccc

SEQ ID NO: 1384509 - RNA, 14 nt, Neisseria meningitidis Z2491
uuuacggcauaugc

SEQ ID NO: 1384510 - RNA, 19 nt, Neisseria meningitidis Z2491
uuuacgauaugcaaaugca

SEQ ID NO: 1384511 - RNA, 17 nt, Neisseria meningitidis Z2491
uuuacggucagaaaauu

SEQ ID NO: 1384512 - RNA, 23 nt, Neisseria meningitidis Z2491
uuuacggucagaaaauuucuuga

SEQ ID NO: 1384513 - RNA, 19 nt, Neisseria meningitidis Z2491
uuuacagcggauuaaaaua

SEQ ID NO: 1384514 - RNA, 16 nt, Neisseria meningitidis Z2491
uuuagaaaaaauauac

SEQ ID NO: 1384515 - RNA, 13 nt, Neisseria meningitidis Z2491
uuuagaauaaauu

SEQ ID NO: 1384516 - RNA, 14 nt, Neisseria meningitidis Z2491
uuuagcuuuuucuu

SEQ ID NO: 1384517 - RNA, 21 nt, Neisseria meningitidis Z2491
uuuagcggagcaguuuuucaa

SEQ ID NO: 1384518 - RNA, 19 nt, Neisseria meningitidis Z2491
uuuaggcaauugaaaaauu

SEQ ID NO: 1384519 - RNA, 15 nt, Neisseria meningitidis Z2491
uuuagguuuuuguuu

SEQ ID NO: 1384520 - RNA, 13 nt, Neisseria meningitidis Z2491
uuuaugaaauaca

SEQ ID NO: 1384521 - RNA, 17 nt, Neisseria meningitidis Z2491
uuuaugcgucaaauuuc

SEQ ID NO: 1384522 - RNA, 13 nt, Neisseria meningitidis Z2491
uuuaugccuguuc

SEQ ID NO: 1384523 - RNA, 22 nt, Neisseria meningitidis Z2491
uuuaucgggaaugacugaaacu

SEQ ID NO: 1384524 - RNA, 20 nt, Neisseria meningitidis Z2491
uuuaucgcuguaauaaacag

SEQ ID NO: 1384525 - RNA, 16 nt, Neisseria meningitidis Z2491
uuuaucggaaaagcag

SEQ ID NO: 1384526 - RNA, 18 nt, Neisseria meningitidis Z2491
uuuauccgaaacaacaaa

SEQ ID NO: 1384527 - RNA, 19 nt, Neisseria meningitidis Z2491
uuuauccgaaacaacaaaa

SEQ ID NO: 1384528 - RNA, 16 nt, Neisseria meningitidis Z2491
uuuauacccucucaaa

SEQ ID NO: 1384529 - RNA, 19 nt, Neisseria meningitidis Z2491
uuuauagugauuaacaaaa

SEQ ID NO: 1384530 - RNA, 19 nt, Neisseria meningitidis Z2491
uuuauaguggauuaacaaa

SEQ ID NO: 1384531 - RNA, 22 nt, Neisseria meningitidis Z2491
uuuauaguggauuaacaaaaau

SEQ ID NO: 1384532 - RNA, 15 nt, Neisseria meningitidis Z2491
uuuauaaacaaaaaa

SEQ ID NO: 1384533 - RNA, 17 nt, Neisseria meningitidis Z2491
uuuauaaacaaaaaaca

SEQ ID NO: 1384534 - RNA, 13 nt, Neisseria meningitidis Z2491
uuuauauucugau

SEQ ID NO: 1384535 - RNA, 17 nt, Neisseria meningitidis Z2491
uuuccacaaaagauaca

SEQ ID NO: 1384536 - RNA, 21 nt, Neisseria meningitidis Z2491
uuuccacaaaagauacacaca

SEQ ID NO: 1384537 - RNA, 16 nt, Neisseria meningitidis Z2491
uuuccaauacaacaaa

SEQ ID NO: 1384538 - RNA, 18 nt, Neisseria meningitidis Z2491
uuucauuuuucauaucau

SEQ ID NO: 1384539 - RNA, 17 nt, Neisseria meningitidis Z2491
uuuccaaaccugaaguu

SEQ ID NO: 1384540 - RNA, 19 nt, Neisseria meningitidis Z2491
uuuccaaaccugagacucc

SEQ ID NO: 1384541 - RNA, 15 nt, Neisseria meningitidis Z2491
uuuccaaauauaaaa

SEQ ID NO: 1384542 - RNA, 21 nt, Neisseria meningitidis Z2491
uuucauuucuagauucccacu

SEQ ID NO: 1384543 - RNA, 14 nt, Neisseria meningitidis Z2491
uuucauuucugaaa

SEQ ID NO: 1384544 - RNA, 21 nt, Neisseria meningitidis Z2491
uuucauuucuggauucccacu

SEQ ID NO: 1384545 - RNA, 22 nt, Neisseria meningitidis Z2491
uuucauuucuggauucccacuu

SEQ ID NO: 1384546 - RNA, 15 nt, Neisseria meningitidis Z2491
uuucaucauaugcau

SEQ ID NO: 1384547 - RNA, 17 nt, Neisseria meningitidis Z2491
uuucagcccgagauaac

SEQ ID NO: 1384548 - RNA, 17 nt, Neisseria meningitidis Z2491
uuucagcuguuuucagc

SEQ ID NO: 1384549 - RNA, 17 nt, Neisseria meningitidis Z2491
uuucagacggucugcca

SEQ ID NO: 1384550 - RNA, 15 nt, Neisseria meningitidis Z2491
uuucagagcauugcg

SEQ ID NO: 1384551 - RNA, 14 nt, Neisseria meningitidis Z2491
uuucagauuauuua

SEQ ID NO: 1384552 - RNA, 21 nt, Neisseria meningitidis Z2491
uuucagacggcauaaaugcgu

SEQ ID NO: 1384553 - RNA, 21 nt, Neisseria meningitidis Z2491
uuucagacggcaucaaaauga

SEQ ID NO: 1384554 - RNA, 20 nt, Neisseria meningitidis Z2491
uuucagacggcauugccucu

SEQ ID NO: 1384555 - RNA, 18 nt, Neisseria meningitidis Z2491
uuucagacggcauuuccc

SEQ ID NO: 1384556 - RNA, 21 nt, Neisseria meningitidis Z2491
uuucagacggcauuuccuuua

SEQ ID NO: 1384557 - RNA, 19 nt, Neisseria meningitidis Z2491
uuucagacggcauuucggc

SEQ ID NO: 1384558 - RNA, 22 nt, Neisseria meningitidis Z2491
uuucagacggcauuucggcagu

SEQ ID NO: 1384559 - RNA, 18 nt, Neisseria meningitidis Z2491
uuucagacggcauuucuu

SEQ ID NO: 1384560 - RNA, 23 nt, Neisseria meningitidis Z2491
uuucagacggcauuuugcugccg

SEQ ID NO: 1384561 - RNA, 13 nt, Neisseria meningitidis Z2491
uuucagacggccu

SEQ ID NO: 1384562 - RNA, 15 nt, Neisseria meningitidis Z2491
uuucagacggccuuu

SEQ ID NO: 1384563 - RNA, 21 nt, Neisseria meningitidis Z2491
uuucagacggcguuuuuguuu

SEQ ID NO: 1384564 - RNA, 22 nt, Neisseria meningitidis Z2491
uuucaguuugaaagcaaagccu

SEQ ID NO: 1384565 - RNA, 14 nt, Neisseria meningitidis Z2491
uuucaggguguuug

SEQ ID NO: 1384566 - RNA, 19 nt, Neisseria meningitidis Z2491
uuucaggcacaaacaaggc

SEQ ID NO: 1384567 - RNA, 21 nt, Neisseria meningitidis Z2491
uuucaggaagucgggcaaagc

SEQ ID NO: 1384568 - RNA, 15 nt, Neisseria meningitidis Z2491
uuucacaaaaacaga

SEQ ID NO: 1384569 - RNA, 17 nt, Neisseria meningitidis Z2491
uuucacaaaaacagaaa

SEQ ID NO: 1384570 - RNA, 13 nt, Neisseria meningitidis Z2491
uuucacggcggca

SEQ ID NO: 1384571 - RNA, 18 nt, Neisseria meningitidis Z2491
uuucaagugcaacacuag

SEQ ID NO: 1384572 - RNA, 23 nt, Neisseria meningitidis Z2491
uuucaagugcaacacuaguguau

SEQ ID NO: 1384573 - RNA, 20 nt, Neisseria meningitidis Z2491
uuucaacugauuguuuuuca

SEQ ID NO: 1384574 - RNA, 12 nt, Neisseria meningitidis Z2491
uuuauuauguau

SEQ ID NO: 1384575 - RNA, 16 nt, Neisseria meningitidis Z2491
uuuauuggucaacucu

SEQ ID NO: 1384576 - RNA, 17 nt, Neisseria meningitidis Z2491
uuuauuuaaauaaagau

SEQ ID NO: 1384577 - RNA, 22 nt, Neisseria meningitidis Z2491
uuuauuuaugaaccgucauucu

SEQ ID NO: 1384578 - RNA, 22 nt, Neisseria meningitidis Z2491
uuuauuuugugcaggcauuauu

SEQ ID NO: 1384579 - RNA, 20 nt, Neisseria meningitidis Z2491
uuuauuugagauuuugaauc

SEQ ID NO: 1384580 - RNA, 19 nt, Neisseria meningitidis Z2491
uuucaaauucggaagacau

SEQ ID NO: 1384581 - RNA, 12 nt, Neisseria meningitidis Z2491
uuucaaaaugca

SEQ ID NO: 1384582 - RNA, 19 nt, Neisseria meningitidis Z2491
uuugaauacacuuaaaaau

SEQ ID NO: 1384583 - RNA, 20 nt, Neisseria meningitidis Z2491
uuugaauggaaaugccgucu

SEQ ID NO: 1384584 - RNA, 22 nt, Neisseria meningitidis Z2491
uuugacacuucacauuuucuau

SEQ ID NO: 1384585 - RNA, 23 nt, Neisseria meningitidis Z2491
uuugacacuucacauuuucuauu

SEQ ID NO: 1384586 - RNA, 16 nt, Neisseria meningitidis Z2491
uuugaaaacagguuua

SEQ ID NO: 1384587 - RNA, 18 nt, Neisseria meningitidis Z2491
uuugaaacgguuguucaa

SEQ ID NO: 1384588 - RNA, 23 nt, Neisseria meningitidis Z2491
uuugaaacgguuguucaaaucga

SEQ ID NO: 1384589 - RNA, 14 nt, Neisseria meningitidis Z2491
uuugaaagagaaaa

SEQ ID NO: 1384590 - RNA, 22 nt, Neisseria meningitidis Z2491
uuugaacaacaaacuagauucc

SEQ ID NO: 1384591 - RNA, 23 nt, Neisseria meningitidis Z2491
uuugaacgcgcgggaauagcuca

SEQ ID NO: 1384592 - RNA, 20 nt, Neisseria meningitidis Z2491
uuucuguuucgguuuucuau

SEQ ID NO: 1384593 - RNA, 21 nt, Neisseria meningitidis Z2491
uuucuguuucgguuuucuauu

SEQ ID NO: 1384594 - RNA, 14 nt, Neisseria meningitidis Z2491
uuucuucaaaauac

SEQ ID NO: 1384595 - RNA, 15 nt, Neisseria meningitidis Z2491
uuucuugaguuucug

SEQ ID NO: 1384596 - RNA, 14 nt, Neisseria meningitidis Z2491
uuucuuccagcguu

SEQ ID NO: 1384597 - RNA, 15 nt, Neisseria meningitidis Z2491
uuucuucaguuguuu

SEQ ID NO: 1384598 - RNA, 12 nt, Neisseria meningitidis Z2491
uuucuucaucca

SEQ ID NO: 1384599 - RNA, 19 nt, Neisseria meningitidis Z2491
uuucuucgcgggacauucu

SEQ ID NO: 1384600 - RNA, 11 nt, Neisseria meningitidis Z2491
uuucuucuucg

SEQ ID NO: 1384601 - RNA, 14 nt, Neisseria meningitidis Z2491
uuugacuuucaggg

SEQ ID NO: 1384602 - RNA, 15 nt, Neisseria meningitidis Z2491
uuugagcaaaugccg

SEQ ID NO: 1384603 - RNA, 16 nt, Neisseria meningitidis Z2491
uuugagggaauggccg

SEQ ID NO: 1384604 - RNA, 23 nt, Neisseria meningitidis Z2491
uuugauauggcguugacaaacau

SEQ ID NO: 1384605 - RNA, 17 nt, Neisseria meningitidis Z2491
uuugaugguuuuccaau

SEQ ID NO: 1384606 - RNA, 12 nt, Neisseria meningitidis Z2491
uuugauuucuau

SEQ ID NO: 1384607 - RNA, 13 nt, Neisseria meningitidis Z2491
uuugauuucuauu

SEQ ID NO: 1384608 - RNA, 23 nt, Neisseria meningitidis Z2491
uuugccgcgauuccggcgcggcg

SEQ ID NO: 1384609 - RNA, 20 nt, Neisseria meningitidis Z2491
uuugccgcguaugcguucaa

SEQ ID NO: 1384610 - RNA, 22 nt, Neisseria meningitidis Z2491
uuugccgacccgaaucacaaac

SEQ ID NO: 1384611 - RNA, 23 nt, Neisseria meningitidis Z2491
uuugccguguuggguucuagauu

SEQ ID NO: 1384612 - RNA, 18 nt, Neisseria meningitidis Z2491
uuugccgaguuuuuggua

SEQ ID NO: 1384613 - RNA, 20 nt, Neisseria meningitidis Z2491
uuugcgauaggauuugccau

SEQ ID NO: 1384614 - RNA, 18 nt, Neisseria meningitidis Z2491
uuugccuguucggucaua

SEQ ID NO: 1384615 - RNA, 16 nt, Neisseria meningitidis Z2491
uuugccugauccaaac

SEQ ID NO: 1384616 - RNA, 23 nt, Neisseria meningitidis Z2491
uuugcgccagcggcaccaauucu

SEQ ID NO: 1384617 - RNA, 16 nt, Neisseria meningitidis Z2491
uuugcgcagccugcag

SEQ ID NO: 1384618 - RNA, 24 nt, Neisseria meningitidis Z2491
uuugcaagaauggcaaaauuucag

SEQ ID NO: 1384619 - RNA, 19 nt, Neisseria meningitidis Z2491
uuugcacacguuugccguu

SEQ ID NO: 1384620 - RNA, 17 nt, Neisseria meningitidis Z2491
uuugcaauaacauaggu

SEQ ID NO: 1384621 - RNA, 21 nt, Neisseria meningitidis Z2491
uuucgcaaccguugcagccau

SEQ ID NO: 1384622 - RNA, 22 nt, Neisseria meningitidis Z2491
uuuccgcgccgauguuuuccug

SEQ ID NO: 1384623 - RNA, 20 nt, Neisseria meningitidis Z2491
uuuccguugucggaacagca

SEQ ID NO: 1384624 - RNA, 17 nt, Neisseria meningitidis Z2491
uuuccgucauuucugau

SEQ ID NO: 1384625 - RNA, 24 nt, Neisseria meningitidis Z2491
uuuccugcaucagcuucauacccc

SEQ ID NO: 1384626 - RNA, 13 nt, Neisseria meningitidis Z2491
uuuccucuuucaa

SEQ ID NO: 1384627 - RNA, 20 nt, Neisseria meningitidis Z2491
uuuccgccggaaagguaucg

SEQ ID NO: 1384628 - RNA, 13 nt, Neisseria meningitidis Z2491
uuuccgauaaauu

SEQ ID NO: 1384629 - RNA, 18 nt, Neisseria meningitidis Z2491
uuuccccuguaaacagau

SEQ ID NO: 1384630 - RNA, 17 nt, Neisseria meningitidis Z2491
uuucccgaaauuccaac

SEQ ID NO: 1384631 - RNA, 23 nt, Neisseria meningitidis Z2491
uuuccaugcuuaaacagcacugc

SEQ ID NO: 1384632 - RNA, 19 nt, Neisseria meningitidis Z2491
uuucgcgcaccagcaaauc

SEQ ID NO: 1384633 - RNA, 16 nt, Neisseria meningitidis Z2491
uuucgcguaccaaaac

SEQ ID NO: 1384634 - RNA, 15 nt, Neisseria meningitidis Z2491
uuucgcugccgccgc

SEQ ID NO: 1384635 - RNA, 15 nt, Neisseria meningitidis Z2491
uuucguuaacagacu

SEQ ID NO: 1384636 - RNA, 11 nt, Neisseria meningitidis Z2491
uuucuaaaaua

SEQ ID NO: 1384637 - RNA, 17 nt, Neisseria meningitidis Z2491
uuucuagggaaaugccc

SEQ ID NO: 1384638 - RNA, 14 nt, Neisseria meningitidis Z2491
uuucugaaaaauuu

SEQ ID NO: 1384639 - RNA, 15 nt, Neisseria meningitidis Z2491
uuucugaaaaauuua

SEQ ID NO: 1384640 - RNA, 14 nt, Neisseria meningitidis Z2491
uuucugacaaaaau

SEQ ID NO: 1384641 - RNA, 18 nt, Neisseria meningitidis Z2491
uuucugcaacccuagaau

SEQ ID NO: 1384642 - RNA, 15 nt, Neisseria meningitidis Z2491
uuucuggauucccac

SEQ ID NO: 1384643 - RNA, 13 nt, Neisseria meningitidis Z2491
uuucugauaaauu

SEQ ID NO: 1384644 - RNA, 21 nt, Neisseria meningitidis Z2491
uuucugaugaucaguaaaaaa

SEQ ID NO: 1384645 - RNA, 13 nt, Neisseria meningitidis Z2491
uuucuauuuuaca

SEQ ID NO: 1384646 - RNA, 17 nt, Neisseria meningitidis Z2491
uuucuauuugauuuuca

SEQ ID NO: 1384647 - RNA, 18 nt, Neisseria meningitidis Z2491
uugccgcgaccgaaaugc

SEQ ID NO: 1384648 - RNA, 16 nt, Neisseria meningitidis Z2491
uugccgcauuaaaauu

SEQ ID NO: 1384649 - RNA, 23 nt, Neisseria meningitidis Z2491
uugcgccucgccuuucacaaagg

SEQ ID NO: 1384650 - RNA, 19 nt, Neisseria meningitidis Z2491
uugcgccgguacccaaacu

SEQ ID NO: 1384651 - RNA, 14 nt, Neisseria meningitidis Z2491
uugcucaauauuag

SEQ ID NO: 1384652 - RNA, 22 nt, Neisseria meningitidis Z2491
uugcguuucuagauucccacuu

SEQ ID NO: 1384653 - RNA, 22 nt, Neisseria meningitidis Z2491
uugcagauagucgccgagcaga

SEQ ID NO: 1384654 - RNA, 18 nt, Neisseria meningitidis Z2491
uugcagacaaucagaucg

SEQ ID NO: 1384655 - RNA, 16 nt, Neisseria meningitidis Z2491
uugcacgguuuuccuc

SEQ ID NO: 1384656 - RNA, 18 nt, Neisseria meningitidis Z2491
uugcauuuugaaaaugag

SEQ ID NO: 1384657 - RNA, 16 nt, Neisseria meningitidis Z2491
uugcccggaaaaaauu

SEQ ID NO: 1384658 - RNA, 10 nt, Neisseria meningitidis Z2491
uugccgaccc

SEQ ID NO: 1384659 - RNA, 20 nt, Neisseria meningitidis Z2491
uugccgaaagcgcggccuuu

SEQ ID NO: 1384660 - RNA, 23 nt, Neisseria meningitidis Z2491
uugccacaauauaaucaaacuca

SEQ ID NO: 1384661 - RNA, 22 nt, Neisseria meningitidis Z2491
uugcccgacgacgaccuccuga

SEQ ID NO: 1384662 - RNA, 22 nt, Neisseria meningitidis Z2491
uugggcggcggcaauauucaaa

SEQ ID NO: 1384663 - RNA, 22 nt, Neisseria meningitidis Z2491
uugggcgacggcaauauucaaa

SEQ ID NO: 1384664 - RNA, 22 nt, Neisseria meningitidis Z2491
uugggcucaaugaaaauuuggu

SEQ ID NO: 1384665 - RNA, 13 nt, Neisseria meningitidis Z2491
uugggcguucagc

SEQ ID NO: 1384666 - RNA, 22 nt, Neisseria meningitidis Z2491
uuggcguaaaacgguguggaga

SEQ ID NO: 1384667 - RNA, 13 nt, Neisseria meningitidis Z2491
uuggcggcauuuu

SEQ ID NO: 1384668 - RNA, 20 nt, Neisseria meningitidis Z2491
uuggcauuuuuaucuuuuuu

SEQ ID NO: 1384669 - RNA, 21 nt, Neisseria meningitidis Z2491
uuggcaucgcgcacuugagcc

SEQ ID NO: 1384670 - RNA, 17 nt, Neisseria meningitidis Z2491
uuggcagcugaagcccc

SEQ ID NO: 1384671 - RNA, 15 nt, Neisseria meningitidis Z2491
uuggagauucuagau

SEQ ID NO: 1384672 - RNA, 22 nt, Neisseria meningitidis Z2491
uugcuuuguaagaguucguccc

SEQ ID NO: 1384673 - RNA, 22 nt, Neisseria meningitidis Z2491
uugcugcaucacguucugaaaa

SEQ ID NO: 1384674 - RNA, 13 nt, Neisseria meningitidis Z2491
uugcuguuguucu

SEQ ID NO: 1384675 - RNA, 17 nt, Neisseria meningitidis Z2491
uuguacguggccuuuuc

SEQ ID NO: 1384676 - RNA, 14 nt, Neisseria meningitidis Z2491
uuguacggcagcca

SEQ ID NO: 1384677 - RNA, 18 nt, Neisseria meningitidis Z2491
uuguaccggguacuguug

SEQ ID NO: 1384678 - RNA, 19 nt, Neisseria meningitidis Z2491
uugucggcuuuugacagca

SEQ ID NO: 1384679 - RNA, 22 nt, Neisseria meningitidis Z2491
uugucgcuucggauaaauuuuu

SEQ ID NO: 1384680 - RNA, 23 nt, Neisseria meningitidis Z2491
uuguccauuuuucugaugaucag

SEQ ID NO: 1384681 - RNA, 17 nt, Neisseria meningitidis Z2491
uuguuaaguauuucuau

SEQ ID NO: 1384682 - RNA, 22 nt, Neisseria meningitidis Z2491
uuguuaauccacuauaaaaggu

SEQ ID NO: 1384683 - RNA, 21 nt, Neisseria meningitidis Z2491
uuguuaauccacuauaugaau

SEQ ID NO: 1384684 - RNA, 21 nt, Neisseria meningitidis Z2491
uuguuaauccacuauauuuuc

SEQ ID NO: 1384685 - RNA, 18 nt, Neisseria meningitidis Z2491
uuguucuaaggucuagau

SEQ ID NO: 1384686 - RNA, 12 nt, Neisseria meningitidis Z2491
uuguuuuuccaa

SEQ ID NO: 1384687 - RNA, 21 nt, Neisseria meningitidis Z2491
uuguuuucggguaagcccuaa

SEQ ID NO: 1384688 - RNA, 18 nt, Neisseria meningitidis Z2491
uuguugucgcuucggaua

SEQ ID NO: 1384689 - RNA, 17 nt, Neisseria meningitidis Z2491
uuguuguucaaauaaau

SEQ ID NO: 1384690 - RNA, 22 nt, Neisseria meningitidis Z2491
uuguuuacggucagaaaauuuc

SEQ ID NO: 1384691 - RNA, 12 nt, Neisseria meningitidis Z2491
uuuaacaaugua

SEQ ID NO: 1384692 - RNA, 23 nt, Neisseria meningitidis Z2491
uuuaaaaccccgauagaaaaugc

SEQ ID NO: 1384693 - RNA, 21 nt, Neisseria meningitidis Z2491
uuuaauuucaauacgcaaacu

SEQ ID NO: 1384694 - RNA, 17 nt, Neisseria meningitidis Z2491
uuuaauucggcaauuug

SEQ ID NO: 1384695 - RNA, 15 nt, Neisseria meningitidis Z2491
uucguucugcauaua

SEQ ID NO: 1384696 - RNA, 19 nt, Neisseria meningitidis Z2491
uucguauauucugcaaaaa

SEQ ID NO: 1384697 - RNA, 15 nt, Neisseria meningitidis Z2491
uuaucagaaaugacu

SEQ ID NO: 1384698 - RNA, 21 nt, Neisseria meningitidis Z2491
uuaucacgauugagacaauca

SEQ ID NO: 1384699 - RNA, 15 nt, Neisseria meningitidis Z2491
uucggcuuggaaugc

SEQ ID NO: 1384700 - RNA, 18 nt, Neisseria meningitidis Z2491
uucggcugucgggaggga

SEQ ID NO: 1384701 - RNA, 15 nt, Neisseria meningitidis Z2491
uucuauugccuuuau

SEQ ID NO: 1384702 - RNA, 18 nt, Neisseria meningitidis Z2491
uucuaaaauaugcagaga

SEQ ID NO: 1384703 - RNA, 12 nt, Neisseria meningitidis Z2491
uucuacccaaau

SEQ ID NO: 1384704 - RNA, 16 nt, Neisseria meningitidis Z2491
uucuacccaaauaccc

SEQ ID NO: 1384705 - RNA, 20 nt, Neisseria meningitidis Z2491
uucuacccaaauacccccuu

SEQ ID NO: 1384706 - RNA, 18 nt, Neisseria meningitidis Z2491
uucucacaaaaacagaaa

SEQ ID NO: 1384707 - RNA, 20 nt, Neisseria meningitidis Z2491
uucucacgcaggcuuuugag

SEQ ID NO: 1384708 - RNA, 11 nt, Neisseria meningitidis Z2491
uucugauuuug

SEQ ID NO: 1384709 - RNA, 18 nt, Neisseria meningitidis Z2491
uucugauuuaaaaccaua

SEQ ID NO: 1384710 - RNA, 18 nt, Neisseria meningitidis Z2491
uucuucuaucauugcaug

SEQ ID NO: 1384711 - RNA, 13 nt, Neisseria meningitidis Z2491
uucuuauguuuaa

SEQ ID NO: 1384712 - RNA, 15 nt, Neisseria meningitidis Z2491
uucuucgaucaucca

SEQ ID NO: 1384713 - RNA, 19 nt, Neisseria meningitidis Z2491
uucuguuucgguuuucuau

SEQ ID NO: 1384714 - RNA, 20 nt, Neisseria meningitidis Z2491
uucuguuucgguuuucuauu

SEQ ID NO: 1384715 - RNA, 16 nt, Neisseria meningitidis Z2491
uucuguucuaaaagca

SEQ ID NO: 1384716 - RNA, 19 nt, Neisseria meningitidis Z2491
uucuguuuuugugggaaug

SEQ ID NO: 1384717 - RNA, 14 nt, Neisseria meningitidis Z2491
uucuguuuuuuccg

SEQ ID NO: 1384718 - RNA, 15 nt, Neisseria meningitidis Z2491
uucuguuuggcuuuu

SEQ ID NO: 1384719 - RNA, 19 nt, Neisseria meningitidis Z2491
uucuguuuggcuuuuuccu

SEQ ID NO: 1384720 - RNA, 18 nt, Neisseria meningitidis Z2491
uucuguuuggcuuuuuuc

SEQ ID NO: 1384721 - RNA, 13 nt, Neisseria meningitidis Z2491
uugauuaaaacaa

SEQ ID NO: 1384722 - RNA, 16 nt, Neisseria meningitidis Z2491
uugauuaaaacaaaaa

SEQ ID NO: 1384723 - RNA, 17 nt, Neisseria meningitidis Z2491
uugauuaaaacaaaaau

SEQ ID NO: 1384724 - RNA, 17 nt, Neisseria meningitidis Z2491
uugaugucgugcagaug

SEQ ID NO: 1384725 - RNA, 22 nt, Neisseria meningitidis Z2491
uugcaaaccccucaacacacca

SEQ ID NO: 1384726 - RNA, 14 nt, Neisseria meningitidis Z2491
uugcaaaauagaaa

SEQ ID NO: 1384727 - RNA, 12 nt, Neisseria meningitidis Z2491
uugcaaaaccgg

SEQ ID NO: 1384728 - RNA, 16 nt, Neisseria meningitidis Z2491
uugcaaauaauugaaa

SEQ ID NO: 1384729 - RNA, 18 nt, Neisseria meningitidis Z2491
uugcaaaggucucaaaua

SEQ ID NO: 1384730 - RNA, 24 nt, Neisseria meningitidis Z2491
uugagggcguuuuuguaaacgaau

SEQ ID NO: 1384731 - RNA, 15 nt, Neisseria meningitidis Z2491
uugaggucuuugaug

SEQ ID NO: 1384732 - RNA, 21 nt, Neisseria meningitidis Z2491
uugauaauaugaaaccauuac

SEQ ID NO: 1384733 - RNA, 15 nt, Neisseria meningitidis Z2491
uugauaguauucuau

SEQ ID NO: 1384734 - RNA, 14 nt, Neisseria meningitidis Z2491
uugacuauuuuuua

SEQ ID NO: 1384735 - RNA, 17 nt, Neisseria meningitidis Z2491
uugacuauuuuuuaauc

SEQ ID NO: 1384736 - RNA, 17 nt, Neisseria meningitidis Z2491
uugacguaguuuacugu

SEQ ID NO: 1384737 - RNA, 17 nt, Neisseria meningitidis Z2491
uugacguuacccucuug

SEQ ID NO: 1384738 - RNA, 19 nt, Neisseria meningitidis Z2491
uugagauggucaauacaca

SEQ ID NO: 1384739 - RNA, 16 nt, Neisseria meningitidis Z2491
uugagauuuugaauca

SEQ ID NO: 1384740 - RNA, 22 nt, Neisseria meningitidis Z2491
uugagcaaaugccgucugaaau

SEQ ID NO: 1384741 - RNA, 12 nt, Neisseria meningitidis Z2491
uugaaaucaaca

SEQ ID NO: 1384742 - RNA, 15 nt, Neisseria meningitidis Z2491
uucuuuuauuuucaa

SEQ ID NO: 1384743 - RNA, 19 nt, Neisseria meningitidis Z2491
uugaccaaagcauuuuucg

SEQ ID NO: 1384744 - RNA, 17 nt, Neisseria meningitidis Z2491
uugacaggcauuugcac

SEQ ID NO: 1384745 - RNA, 22 nt, Neisseria meningitidis Z2491
uugacaggucggacauuugacu

SEQ ID NO: 1384746 - RNA, 15 nt, Neisseria meningitidis Z2491
uugaaauucuagauu

SEQ ID NO: 1384747 - RNA, 17 nt, Neisseria meningitidis Z2491
uugaaauucuagauucc

SEQ ID NO: 1384748 - RNA, 16 nt, Neisseria meningitidis Z2491
ugauuaucauaaaauc

SEQ ID NO: 1384749 - RNA, 18 nt, Neisseria meningitidis Z2491
ugauuaucauaaaaucua

SEQ ID NO: 1384750 - RNA, 21 nt, Neisseria meningitidis Z2491
ugauuaucauaaaaucuauua

SEQ ID NO: 1384751 - RNA, 18 nt, Neisseria meningitidis Z2491
ugaugggcugaaauagaa

SEQ ID NO: 1384752 - RNA, 21 nt, Neisseria meningitidis Z2491
ugauggcugaugacggcagcc

SEQ ID NO: 1384753 - RNA, 12 nt, Neisseria meningitidis Z2491
ugauuuaaauuu

SEQ ID NO: 1384754 - RNA, 13 nt, Neisseria meningitidis Z2491
ugauuguuuuuca

SEQ ID NO: 1384755 - RNA, 22 nt, Neisseria meningitidis Z2491
ugauuuuucuuuuauuuucaaa

SEQ ID NO: 1384756 - RNA, 14 nt, Neisseria meningitidis Z2491
ugcaaaccggcguu

SEQ ID NO: 1384757 - RNA, 19 nt, Neisseria meningitidis Z2491
ugcaaaccccucaacacac

SEQ ID NO: 1384758 - RNA, 23 nt, Neisseria meningitidis Z2491
ugaugacgcgcgccccaguagaa

SEQ ID NO: 1384759 - RNA, 19 nt, Neisseria meningitidis Z2491
ugaucgauaccgagugcca

SEQ ID NO: 1384760 - RNA, 22 nt, Neisseria meningitidis Z2491
ugauauucccugucuuucaaua

SEQ ID NO: 1384761 - RNA, 21 nt, Neisseria meningitidis Z2491
ugauccaaaccguggaacacg

SEQ ID NO: 1384762 - RNA, 15 nt, Neisseria meningitidis Z2491
ugauauuuuuaucuu

SEQ ID NO: 1384763 - RNA, 15 nt, Neisseria meningitidis Z2491
ugcacacguuugccg

SEQ ID NO: 1384764 - RNA, 17 nt, Neisseria meningitidis Z2491
ugcacuugcugaacaaa

SEQ ID NO: 1384765 - RNA, 23 nt, Neisseria meningitidis Z2491
ugcaaugcacuacuucauuuuuu

SEQ ID NO: 1384766 - RNA, 14 nt, Neisseria meningitidis Z2491
ugcaauacacuguu

SEQ ID NO: 1384767 - RNA, 13 nt, Neisseria meningitidis Z2491
ugcaaggcaggca

SEQ ID NO: 1384768 - RNA, 20 nt, Neisseria meningitidis Z2491
ugcaaaggucucauccuguu

SEQ ID NO: 1384769 - RNA, 18 nt, Neisseria meningitidis Z2491
ugcaagcaguugaaauca

SEQ ID NO: 1384770 - RNA, 19 nt, Neisseria meningitidis Z2491
ugcaagcaguugaaaucaa

SEQ ID NO: 1384771 - RNA, 12 nt, Neisseria meningitidis Z2491
ugcaagcagcag

SEQ ID NO: 1384772 - RNA, 16 nt, Neisseria meningitidis Z2491
ugcaagcagcaggcgu

SEQ ID NO: 1384773 - RNA, 14 nt, Neisseria meningitidis Z2491
ugcaaagaaaaaca

SEQ ID NO: 1384774 - RNA, 15 nt, Neisseria meningitidis Z2491
ugcaaagaaaaacau

SEQ ID NO: 1384775 - RNA, 17 nt, Neisseria meningitidis Z2491
ugcaaagaaauguaaau

SEQ ID NO: 1384776 - RNA, 13 nt, Neisseria meningitidis Z2491
ugcaaagaaaaac

SEQ ID NO: 1384777 - RNA, 15 nt, Neisseria meningitidis Z2491
ugcaaagcggcuggg

SEQ ID NO: 1384778 - RNA, 16 nt, Neisseria meningitidis Z2491
ugcaaggcggcggcgu

SEQ ID NO: 1384779 - RNA, 15 nt, Neisseria meningitidis Z2491
ugcaauaacauaggu

SEQ ID NO: 1384780 - RNA, 22 nt, Neisseria meningitidis Z2491
ugcagauucuugucaaaccaac

SEQ ID NO: 1384781 - RNA, 23 nt, Neisseria meningitidis Z2491
ugcagcauauguuugcugcugua

SEQ ID NO: 1384782 - RNA, 21 nt, Neisseria meningitidis Z2491
ugcagcguaccgaagcucugu

SEQ ID NO: 1384783 - RNA, 17 nt, Neisseria meningitidis Z2491
ugcagcuuugaguuucu

SEQ ID NO: 1384784 - RNA, 19 nt, Neisseria meningitidis Z2491
ugcaggcguagucuuagaa

SEQ ID NO: 1384785 - RNA, 20 nt, Neisseria meningitidis Z2491
ugcaggcguagucuuagaag

SEQ ID NO: 1384786 - RNA, 15 nt, Neisseria meningitidis Z2491
ugcaggcauuuaucg

SEQ ID NO: 1384787 - RNA, 14 nt, Neisseria meningitidis Z2491
ugagcuaaggcggg

SEQ ID NO: 1384788 - RNA, 17 nt, Neisseria meningitidis Z2491
ugagcuggauuuucgca

SEQ ID NO: 1384789 - RNA, 20 nt, Neisseria meningitidis Z2491
ugaggaucuugauguguuug

SEQ ID NO: 1384790 - RNA, 17 nt, Neisseria meningitidis Z2491
ugagggcuucuuugacg

SEQ ID NO: 1384791 - RNA, 19 nt, Neisseria meningitidis Z2491
ugaggcauugaaauuccag

SEQ ID NO: 1384792 - RNA, 15 nt, Neisseria meningitidis Z2491
ugagaauggcaagau

SEQ ID NO: 1384793 - RNA, 21 nt, Neisseria meningitidis Z2491
ugagcaaaaaguaggagaaau

SEQ ID NO: 1384794 - RNA, 22 nt, Neisseria meningitidis Z2491
ugagccguauuuuuuaaccaac

SEQ ID NO: 1384795 - RNA, 16 nt, Neisseria meningitidis Z2491
ugagccgucauucccg

SEQ ID NO: 1384796 - RNA, 14 nt, Neisseria meningitidis Z2491
ugacggauuuuagg

SEQ ID NO: 1384797 - RNA, 15 nt, Neisseria meningitidis Z2491
ugacuauuuuuuaau

SEQ ID NO: 1384798 - RNA, 16 nt, Neisseria meningitidis Z2491
ugacuauuuuuuaauc

SEQ ID NO: 1384799 - RNA, 22 nt, Neisseria meningitidis Z2491
ugagaaaaagucgucuaagccg

SEQ ID NO: 1384800 - RNA, 17 nt, Neisseria meningitidis Z2491
ugacuguccgagacaga

SEQ ID NO: 1384801 - RNA, 21 nt, Neisseria meningitidis Z2491
ugacuguccgagacagaaccc

SEQ ID NO: 1384802 - RNA, 21 nt, Neisseria meningitidis Z2491
ugacuuucaggguguuugccg

SEQ ID NO: 1384803 - RNA, 17 nt, Neisseria meningitidis Z2491
ugacuuuggaacaaaaa

SEQ ID NO: 1384804 - RNA, 18 nt, Neisseria meningitidis Z2491
ugacuuuggaacaaaaaa

SEQ ID NO: 1384805 - RNA, 15 nt, Neisseria meningitidis Z2491
ugaccuccagcacca

SEQ ID NO: 1384806 - RNA, 18 nt, Neisseria meningitidis Z2491
ugacacuucacauuuucu

SEQ ID NO: 1384807 - RNA, 13 nt, Neisseria meningitidis Z2491
ugacaggauguag

SEQ ID NO: 1384808 - RNA, 15 nt, Neisseria meningitidis Z2491
ugacagcauuuccac

SEQ ID NO: 1384809 - RNA, 17 nt, Neisseria meningitidis Z2491
ugacagcauuuccacau

SEQ ID NO: 1384810 - RNA, 14 nt, Neisseria meningitidis Z2491
ugacagcaggaugu

SEQ ID NO: 1384811 - RNA, 21 nt, Neisseria meningitidis Z2491
ugacacuuuaucugacgcguu

SEQ ID NO: 1384812 - RNA, 14 nt, Neisseria meningitidis Z2491
ugaaucugacuugc

SEQ ID NO: 1384813 - RNA, 12 nt, Neisseria meningitidis Z2491
ucuuuauuuaaa

SEQ ID NO: 1384814 - RNA, 16 nt, Neisseria meningitidis Z2491
ucuuucaacagccgcu

SEQ ID NO: 1384815 - RNA, 21 nt, Neisseria meningitidis Z2491
ugacacauagccggcgauauu

SEQ ID NO: 1384816 - RNA, 16 nt, Neisseria meningitidis Z2491
ugacaacccuguccgc

SEQ ID NO: 1384817 - RNA, 16 nt, Neisseria meningitidis Z2491
ugaauuucauuuuuca

SEQ ID NO: 1384818 - RNA, 15 nt, Neisseria meningitidis Z2491
ugacaaaaacuuuuc

SEQ ID NO: 1384819 - RNA, 17 nt, Neisseria meningitidis Z2491
ugccgucugaaaccugu

SEQ ID NO: 1384820 - RNA, 20 nt, Neisseria meningitidis Z2491
ugccgucugaaacguuucag

SEQ ID NO: 1384821 - RNA, 18 nt, Neisseria meningitidis Z2491
ugccgucugaaagguuuu

SEQ ID NO: 1384822 - RNA, 14 nt, Neisseria meningitidis Z2491
ugccgucugaaagu

SEQ ID NO: 1384823 - RNA, 13 nt, Neisseria meningitidis Z2491
ugccgucugaaau

SEQ ID NO: 1384824 - RNA, 15 nt, Neisseria meningitidis Z2491
ugccgucugaagccc

SEQ ID NO: 1384825 - RNA, 22 nt, Neisseria meningitidis Z2491
ugccgucugaagcguauuucua

SEQ ID NO: 1384826 - RNA, 22 nt, Neisseria meningitidis Z2491
ugccgucugaaaaaccuuuccc

SEQ ID NO: 1384827 - RNA, 21 nt, Neisseria meningitidis Z2491
ugccgucugaaaacaguuuuu

SEQ ID NO: 1384828 - RNA, 13 nt, Neisseria meningitidis Z2491
ugccgucugaaac

SEQ ID NO: 1384829 - RNA, 14 nt, Neisseria meningitidis Z2491
ugccgucugaaacc

SEQ ID NO: 1384830 - RNA, 16 nt, Neisseria meningitidis Z2491
ugccuauuuuuuaauc

SEQ ID NO: 1384831 - RNA, 17 nt, Neisseria meningitidis Z2491
ugccuacgccgaugggc

SEQ ID NO: 1384832 - RNA, 16 nt, Neisseria meningitidis Z2491
ugccugauacagccac

SEQ ID NO: 1384833 - RNA, 15 nt, Neisseria meningitidis Z2491
ugccuuauccagaaa

SEQ ID NO: 1384834 - RNA, 20 nt, Neisseria meningitidis Z2491
ugccuguuuuucuucaucca

SEQ ID NO: 1384835 - RNA, 22 nt, Neisseria meningitidis Z2491
ugccugugcggcggacauaaac

SEQ ID NO: 1384836 - RNA, 14 nt, Neisseria meningitidis Z2491
ugccuuguaaaaau

SEQ ID NO: 1384837 - RNA, 14 nt, Neisseria meningitidis Z2491
ugccuuuauugugc

SEQ ID NO: 1384838 - RNA, 16 nt, Neisseria meningitidis Z2491
ugccgccgccuugugc

SEQ ID NO: 1384839 - RNA, 17 nt, Neisseria meningitidis Z2491
ugccgccgcccgggccg

SEQ ID NO: 1384840 - RNA, 14 nt, Neisseria meningitidis Z2491
ugccgccgccaugu

SEQ ID NO: 1384841 - RNA, 21 nt, Neisseria meningitidis Z2491
ugccguauuucagacaggauu

SEQ ID NO: 1384842 - RNA, 13 nt, Neisseria meningitidis Z2491
ugccguacuauuu

SEQ ID NO: 1384843 - RNA, 19 nt, Neisseria meningitidis Z2491
ugccgucauugagcagcac

SEQ ID NO: 1384844 - RNA, 18 nt, Neisseria meningitidis Z2491
ugccguccgaaagguuuu

SEQ ID NO: 1384845 - RNA, 14 nt, Neisseria meningitidis Z2491
ugcgaacugccugc

SEQ ID NO: 1384846 - RNA, 17 nt, Neisseria meningitidis Z2491
ugcgaacugccugcaac

SEQ ID NO: 1384847 - RNA, 15 nt, Neisseria meningitidis Z2491
ugcgaaucugcugca

SEQ ID NO: 1384848 - RNA, 23 nt, Neisseria meningitidis Z2491
ugcgcaggcgggaauacaaacau

SEQ ID NO: 1384849 - RNA, 17 nt, Neisseria meningitidis Z2491
ugcccgguuggaaggcg

SEQ ID NO: 1384850 - RNA, 13 nt, Neisseria meningitidis Z2491
ugccgaaaccaaa

SEQ ID NO: 1384851 - RNA, 15 nt, Neisseria meningitidis Z2491
ugcccuuucgcagau

SEQ ID NO: 1384852 - RNA, 20 nt, Neisseria meningitidis Z2491
ugccgcaccaccagccacaa

SEQ ID NO: 1384853 - RNA, 14 nt, Neisseria meningitidis Z2491
ugccgauuucuucg

SEQ ID NO: 1384854 - RNA, 21 nt, Neisseria meningitidis Z2491
ugccgauuucuucgcgggaca

SEQ ID NO: 1384855 - RNA, 21 nt, Neisseria meningitidis Z2491
ugccgacccgaaucacaaaca

SEQ ID NO: 1384856 - RNA, 15 nt, Neisseria meningitidis Z2491
ugccgacgcgcugcu

SEQ ID NO: 1384857 - RNA, 18 nt, Neisseria meningitidis Z2491
ugccgaagguaaggagca

SEQ ID NO: 1384858 - RNA, 20 nt, Neisseria meningitidis Z2491
ugcccauugccacgccgaac

SEQ ID NO: 1384859 - RNA, 17 nt, Neisseria meningitidis Z2491
ugcccauuuguuggaug

SEQ ID NO: 1384860 - RNA, 18 nt, Neisseria meningitidis Z2491
ugcccauccgccuuccgc

SEQ ID NO: 1384861 - RNA, 16 nt, Neisseria meningitidis Z2491
ugcccauagaaaggga

SEQ ID NO: 1384862 - RNA, 17 nt, Neisseria meningitidis Z2491
ugcccauagaaagggaa

SEQ ID NO: 1384863 - RNA, 11 nt, Neisseria meningitidis Z2491
ugccagcuccg

SEQ ID NO: 1384864 - RNA, 16 nt, Neisseria meningitidis Z2491
ugcccaacagcagcau

SEQ ID NO: 1384865 - RNA, 21 nt, Neisseria meningitidis Z2491
ugccauacaaacaggcuucag

SEQ ID NO: 1384866 - RNA, 22 nt, Neisseria meningitidis Z2491
ugccauacaaacaggcuucaga

SEQ ID NO: 1384867 - RNA, 20 nt, Neisseria meningitidis Z2491
ugccagucuuuaaauucaac

SEQ ID NO: 1384868 - RNA, 19 nt, Neisseria meningitidis Z2491
ugccaguucggcaaacggc

SEQ ID NO: 1384869 - RNA, 23 nt, Neisseria meningitidis Z2491
ugccaacccuugugcuucuucga

SEQ ID NO: 1384870 - RNA, 18 nt, Neisseria meningitidis Z2491
ugcagguuucugugcgga

SEQ ID NO: 1384871 - RNA, 15 nt, Neisseria meningitidis Z2491
ugcagguagcggcug

SEQ ID NO: 1384872 - RNA, 15 nt, Neisseria meningitidis Z2491
ugccacauuuguucc

SEQ ID NO: 1384873 - RNA, 23 nt, Neisseria meningitidis Z2491
ugcguucagacggcaucaaaaac

SEQ ID NO: 1384874 - RNA, 16 nt, Neisseria meningitidis Z2491
ugcguguuggagauaa

SEQ ID NO: 1384875 - RNA, 20 nt, Neisseria meningitidis Z2491
ugcguguuggagauaauagu

SEQ ID NO: 1384876 - RNA, 17 nt, Neisseria meningitidis Z2491
ugcguacuccuguuuuu

SEQ ID NO: 1384877 - RNA, 23 nt, Neisseria meningitidis Z2491
ugcguaucaaaaaauaaaguaau

SEQ ID NO: 1384878 - RNA, 17 nt, Neisseria meningitidis Z2491
ugcgggauuacugccgc

SEQ ID NO: 1384879 - RNA, 16 nt, Neisseria meningitidis Z2491
ugcggcaacgggagga

SEQ ID NO: 1384880 - RNA, 19 nt, Neisseria meningitidis Z2491
ugcggcacuagccaaaaaa

SEQ ID NO: 1384881 - RNA, 15 nt, Neisseria meningitidis Z2491
ugcuagauauuuagc

SEQ ID NO: 1384882 - RNA, 14 nt, Neisseria meningitidis Z2491
ugcuaaauuucuag

SEQ ID NO: 1384883 - RNA, 15 nt, Neisseria meningitidis Z2491
ugcuaaauuucuaga

SEQ ID NO: 1384884 - RNA, 20 nt, Neisseria meningitidis Z2491
ugcuaaauaucuagcaaaaa

SEQ ID NO: 1384885 - RNA, 16 nt, Neisseria meningitidis Z2491
ugcguucgagcaggaa

SEQ ID NO: 1384886 - RNA, 12 nt, Neisseria meningitidis Z2491
ugcguuuuucgg

SEQ ID NO: 1384887 - RNA, 13 nt, Neisseria meningitidis Z2491
ugcuaaggcaauu

SEQ ID NO: 1384888 - RNA, 17 nt, Neisseria meningitidis Z2491
ugcucugauagccgccc

SEQ ID NO: 1384889 - RNA, 21 nt, Neisseria meningitidis Z2491
ugcucuacgauaacgccgccg

SEQ ID NO: 1384890 - RNA, 18 nt, Neisseria meningitidis Z2491
ugcucccgauaaaugccg

SEQ ID NO: 1384891 - RNA, 23 nt, Neisseria meningitidis Z2491
uggacauucucuuggucaaaaug

SEQ ID NO: 1384892 - RNA, 13 nt, Neisseria meningitidis Z2491
uggaauaugaaua

SEQ ID NO: 1384893 - RNA, 14 nt, Neisseria meningitidis Z2491
uggaauuuauuggu

SEQ ID NO: 1384894 - RNA, 16 nt, Neisseria meningitidis Z2491
uggaaggcgggcaggc

SEQ ID NO: 1384895 - RNA, 19 nt, Neisseria meningitidis Z2491
uggaacgcgucaaccuuaa

SEQ ID NO: 1384896 - RNA, 12 nt, Neisseria meningitidis Z2491
uggaacaaaaaa

SEQ ID NO: 1384897 - RNA, 13 nt, Neisseria meningitidis Z2491
uggaacaaagaaa

SEQ ID NO: 1384898 - RNA, 17 nt, Neisseria meningitidis Z2491
uggaacagaaagcaaaa

SEQ ID NO: 1384899 - RNA, 15 nt, Neisseria meningitidis Z2491
uggaaaccaaaaaac

SEQ ID NO: 1384900 - RNA, 16 nt, Neisseria meningitidis Z2491
uggaaaccaaaaaaca

SEQ ID NO: 1384901 - RNA, 20 nt, Neisseria meningitidis Z2491
uggaaaccaaaaaacaacag

SEQ ID NO: 1384902 - RNA, 16 nt, Neisseria meningitidis Z2491
uggaaaggcaaaugcc

SEQ ID NO: 1384903 - RNA, 20 nt, Neisseria meningitidis Z2491
uggaaauuaucggucagcuc

SEQ ID NO: 1384904 - RNA, 14 nt, Neisseria meningitidis Z2491
ugcuugcgcggcau

SEQ ID NO: 1384905 - RNA, 18 nt, Neisseria meningitidis Z2491
ugcuuugagcuuguccag

SEQ ID NO: 1384906 - RNA, 14 nt, Neisseria meningitidis Z2491
ugcuucaucggcaa

SEQ ID NO: 1384907 - RNA, 22 nt, Neisseria meningitidis Z2491
ugcuuacaauccgcuuuuuaaa

SEQ ID NO: 1384908 - RNA, 20 nt, Neisseria meningitidis Z2491
ugcuuccgaggcggcuuuca

SEQ ID NO: 1384909 - RNA, 21 nt, Neisseria meningitidis Z2491
ugcuguauuuuucgaggcgca

SEQ ID NO: 1384910 - RNA, 13 nt, Neisseria meningitidis Z2491
ugcugucugaaac

SEQ ID NO: 1384911 - RNA, 15 nt, Neisseria meningitidis Z2491
ugcugguaacauuaa

SEQ ID NO: 1384912 - RNA, 23 nt, Neisseria meningitidis Z2491
uuauaguggauuaacaaaaauca

SEQ ID NO: 1384913 - RNA, 18 nt, Neisseria meningitidis Z2491
uuauagugauuaacaaaa

SEQ ID NO: 1384914 - RNA, 19 nt, Neisseria meningitidis Z2491
uuauaguggauuaacaaaa

SEQ ID NO: 1384915 - RNA, 15 nt, Neisseria meningitidis Z2491
uuauaccauaaauuu

SEQ ID NO: 1384916 - RNA, 18 nt, Neisseria meningitidis Z2491
uuauaugcuaucuuuauu

SEQ ID NO: 1384917 - RNA, 18 nt, Neisseria meningitidis Z2491
uuagugguuggaacagau

SEQ ID NO: 1384918 - RNA, 12 nt, Neisseria meningitidis Z2491
uuaguuucgguc

SEQ ID NO: 1384919 - RNA, 16 nt, Neisseria meningitidis Z2491
uuaggguaauuuaucc

SEQ ID NO: 1384920 - RNA, 23 nt, Neisseria meningitidis Z2491
uuagguugguuugaaagagaaaa

SEQ ID NO: 1384921 - RNA, 23 nt, Neisseria meningitidis Z2491
uuaggcaauugaaaauuuuuugg

SEQ ID NO: 1384922 - RNA, 17 nt, Neisseria meningitidis Z2491
uuagcggagcaguuuuu

SEQ ID NO: 1384923 - RNA, 20 nt, Neisseria meningitidis Z2491
uuagcggagcaguuuuucaa

SEQ ID NO: 1384924 - RNA, 17 nt, Neisseria meningitidis Z2491
uuagccuuuuguuuugg

SEQ ID NO: 1384925 - RNA, 17 nt, Neisseria meningitidis Z2491
uuagcauugaaugucua

SEQ ID NO: 1384926 - RNA, 23 nt, Neisseria meningitidis Z2491
uuagauuccacguucuagauucc

SEQ ID NO: 1384927 - RNA, 14 nt, Neisseria meningitidis Z2491
uuagaaaugacuga

SEQ ID NO: 1384928 - RNA, 19 nt, Neisseria meningitidis Z2491
uuagaaaugacugaaacuc

SEQ ID NO: 1384929 - RNA, 13 nt, Neisseria meningitidis Z2491
uuagaacaacagu

SEQ ID NO: 1384930 - RNA, 17 nt, Neisseria meningitidis Z2491
uuaccuugaggucuuug

SEQ ID NO: 1384931 - RNA, 20 nt, Neisseria meningitidis Z2491
uuacgaacaaugcaaaaaca

SEQ ID NO: 1384932 - RNA, 13 nt, Neisseria meningitidis Z2491
uuacccucucccc

SEQ ID NO: 1384933 - RNA, 14 nt, Neisseria meningitidis Z2491
uuacccucuccccg

SEQ ID NO: 1384934 - RNA, 18 nt, Neisseria meningitidis Z2491
uuacccucuccccgaccc

SEQ ID NO: 1384935 - RNA, 13 nt, Neisseria meningitidis Z2491
uuacacaaauaua

SEQ ID NO: 1384936 - RNA, 22 nt, Neisseria meningitidis Z2491
uuaauccgcuauauauucugau

SEQ ID NO: 1384937 - RNA, 20 nt, Neisseria meningitidis Z2491
uuaauccgcuuccaaaacca

SEQ ID NO: 1384938 - RNA, 22 nt, Neisseria meningitidis Z2491
uuaauccgcuuccaaaaccacu

SEQ ID NO: 1384939 - RNA, 19 nt, Neisseria meningitidis Z2491
uuaauucggcaauuugaca

SEQ ID NO: 1384940 - RNA, 18 nt, Neisseria meningitidis Z2491
uuaauuucggaaaugcgu

SEQ ID NO: 1384941 - RNA, 22 nt, Neisseria meningitidis Z2491
uuaauaauguguugauuaaaua

SEQ ID NO: 1384942 - RNA, 18 nt, Neisseria meningitidis Z2491
uuaauccacaguuuuucc

SEQ ID NO: 1384943 - RNA, 15 nt, Neisseria meningitidis Z2491
uuaauccacuauaaa

SEQ ID NO: 1384944 - RNA, 18 nt, Neisseria meningitidis Z2491
uuaauccacuauaaaaaa

SEQ ID NO: 1384945 - RNA, 20 nt, Neisseria meningitidis Z2491
uuaauccacuauaaaaacga

SEQ ID NO: 1384946 - RNA, 22 nt, Neisseria meningitidis Z2491
uuaauccacuauaauacaaaaa

SEQ ID NO: 1384947 - RNA, 23 nt, Neisseria meningitidis Z2491
uuaauccacuauaauuuauugaa

SEQ ID NO: 1384948 - RNA, 14 nt, Neisseria meningitidis Z2491
uguguuugaauauu

SEQ ID NO: 1384949 - RNA, 17 nt, Neisseria meningitidis Z2491
uguggcgguuauugugc

SEQ ID NO: 1384950 - RNA, 17 nt, Neisseria meningitidis Z2491
ugugggaauccagaccu

SEQ ID NO: 1384951 - RNA, 19 nt, Neisseria meningitidis Z2491
ugugggcgauuaucgggaa

SEQ ID NO: 1384952 - RNA, 14 nt, Neisseria meningitidis Z2491
ugugguagagaaaa

SEQ ID NO: 1384953 - RNA, 20 nt, Neisseria meningitidis Z2491
ugugcggucgauguggcuga

SEQ ID NO: 1384954 - RNA, 15 nt, Neisseria meningitidis Z2491
ugugcgccacgccau

SEQ ID NO: 1384955 - RNA, 18 nt, Neisseria meningitidis Z2491
ugugcauccgacaggcaa

SEQ ID NO: 1384956 - RNA, 19 nt, Neisseria meningitidis Z2491
ugugcauccgacaggcaaa

SEQ ID NO: 1384957 - RNA, 17 nt, Neisseria meningitidis Z2491
uguuggccgcuuucaaa

SEQ ID NO: 1384958 - RNA, 13 nt, Neisseria meningitidis Z2491
uguuguuuuaaag

SEQ ID NO: 1384959 - RNA, 20 nt, Neisseria meningitidis Z2491
uguugcuuuucauuucuaga

SEQ ID NO: 1384960 - RNA, 16 nt, Neisseria meningitidis Z2491
uguugccacaauauaa

SEQ ID NO: 1384961 - RNA, 14 nt, Neisseria meningitidis Z2491
uguugccacacaca

SEQ ID NO: 1384962 - RNA, 22 nt, Neisseria meningitidis Z2491
uguuccgcaucgucgggaaaaa

SEQ ID NO: 1384963 - RNA, 17 nt, Neisseria meningitidis Z2491
uguucgugcaucaucac

SEQ ID NO: 1384964 - RNA, 19 nt, Neisseria meningitidis Z2491
uguucgacggaaaucaauc

SEQ ID NO: 1384965 - RNA, 22 nt, Neisseria meningitidis Z2491
uguuaugaugcguucaaaucac

SEQ ID NO: 1384966 - RNA, 15 nt, Neisseria meningitidis Z2491
uguucagaaaauccg

SEQ ID NO: 1384967 - RNA, 19 nt, Neisseria meningitidis Z2491
uguuugccugauccaaacc

SEQ ID NO: 1384968 - RNA, 17 nt, Neisseria meningitidis Z2491
uguuugcagauaaauuu

SEQ ID NO: 1384969 - RNA, 22 nt, Neisseria meningitidis Z2491
uguuugcaguauccggcaagaa

SEQ ID NO: 1384970 - RNA, 15 nt, Neisseria meningitidis Z2491
uguuuggauaugccg

SEQ ID NO: 1384971 - RNA, 23 nt, Neisseria meningitidis Z2491
uguuugcuuagaagccuugcgcc

SEQ ID NO: 1384972 - RNA, 16 nt, Neisseria meningitidis Z2491
uguuuggaaaugucuu

SEQ ID NO: 1384973 - RNA, 16 nt, Neisseria meningitidis Z2491
uguuugagccugugcc

SEQ ID NO: 1384974 - RNA, 20 nt, Neisseria meningitidis Z2491
uguuugaguccgaccgccgc

SEQ ID NO: 1384975 - RNA, 21 nt, Neisseria meningitidis Z2491
uguuugaguccgaccgccgcc

SEQ ID NO: 1384976 - RNA, 14 nt, Neisseria meningitidis Z2491
uguuucuuuuugcu

SEQ ID NO: 1384977 - RNA, 21 nt, Neisseria meningitidis Z2491
uguuucggagaaguuucugca

SEQ ID NO: 1384978 - RNA, 16 nt, Neisseria meningitidis Z2491
uguuucggauaaauuc

SEQ ID NO: 1384979 - RNA, 20 nt, Neisseria meningitidis Z2491
uguuucggcgcaucccgcaa

SEQ ID NO: 1384980 - RNA, 23 nt, Neisseria meningitidis Z2491
uguuucggcgcaucccgcaaaaa

SEQ ID NO: 1384981 - RNA, 15 nt, Neisseria meningitidis Z2491
uguuugguaaucagu

SEQ ID NO: 1384982 - RNA, 14 nt, Neisseria meningitidis Z2491
uguuuugauauggc

SEQ ID NO: 1384983 - RNA, 17 nt, Neisseria meningitidis Z2491
uguuuuauuuuuuggcu

SEQ ID NO: 1384984 - RNA, 23 nt, Neisseria meningitidis Z2491
uguuucagacggcauuugacuuu

SEQ ID NO: 1384985 - RNA, 15 nt, Neisseria meningitidis Z2491
uguuucagacggccu

SEQ ID NO: 1384986 - RNA, 14 nt, Neisseria meningitidis Z2491
uguuuauugagaau

SEQ ID NO: 1384987 - RNA, 16 nt, Neisseria meningitidis Z2491
uguuuaucuuuucuua

SEQ ID NO: 1384988 - RNA, 22 nt, Neisseria meningitidis Z2491
uguuuagacagcaucgccgccg

SEQ ID NO: 1384989 - RNA, 22 nt, Neisseria meningitidis Z2491
uguuuacggucagaaaauuucu

SEQ ID NO: 1384990 - RNA, 22 nt, Neisseria meningitidis Z2491
uguuuuucagagaaauggcagu

SEQ ID NO: 1384991 - RNA, 13 nt, Neisseria meningitidis Z2491
uguuuuuccacaa

SEQ ID NO: 1384992 - RNA, 15 nt, Neisseria meningitidis Z2491
uguuuuuccacaaaa

SEQ ID NO: 1384993 - RNA, 21 nt, Neisseria meningitidis Z2491
uguuuuuccgacaaauuccua

SEQ ID NO: 1384994 - RNA, 12 nt, Neisseria meningitidis Z2491
uuaaaaacaaaa

SEQ ID NO: 1384995 - RNA, 12 nt, Neisseria meningitidis Z2491
uuaaaacaaaaa

SEQ ID NO: 1384996 - RNA, 14 nt, Neisseria meningitidis Z2491
uuaaaacaaaaaug

SEQ ID NO: 1384997 - RNA, 20 nt, Neisseria meningitidis Z2491
uuaaaauuucaucauuccca

SEQ ID NO: 1384998 - RNA, 15 nt, Neisseria meningitidis Z2491
uuaaaauuuggcugu

SEQ ID NO: 1384999 - RNA, 21 nt, Neisseria meningitidis Z2491
uuaaaguuucagaauuuauuu

SEQ ID NO: 1385000 - RNA, 21 nt, Neisseria meningitidis Z2491
uuaaaguuaggguaauuuauc

SEQ ID NO: 1385001 - RNA, 23 nt, Neisseria meningitidis Z2491
uuaaacuauaguggauuaacaaa

SEQ ID NO: 1385002 - RNA, 17 nt, Neisseria meningitidis Z2491
uggauuaacaaaaauca

SEQ ID NO: 1385003 - RNA, 15 nt, Neisseria meningitidis Z2491
uggauuaaauuuaaa

SEQ ID NO: 1385004 - RNA, 18 nt, Neisseria meningitidis Z2491
uggauuaaauuuaaacca

SEQ ID NO: 1385005 - RNA, 12 nt, Neisseria meningitidis Z2491
uggauucccacu

SEQ ID NO: 1385006 - RNA, 14 nt, Neisseria meningitidis Z2491
uggcaaaauuucag

SEQ ID NO: 1385007 - RNA, 20 nt, Neisseria meningitidis Z2491
uggcaagcuuuuuaauccac

SEQ ID NO: 1385008 - RNA, 16 nt, Neisseria meningitidis Z2491
uggcaaugucuucaua

SEQ ID NO: 1385009 - RNA, 15 nt, Neisseria meningitidis Z2491
uggcaacuuccagcg

SEQ ID NO: 1385010 - RNA, 15 nt, Neisseria meningitidis Z2491
uggcagcagaugaag

SEQ ID NO: 1385011 - RNA, 14 nt, Neisseria meningitidis Z2491
uggcaguaauccaa

SEQ ID NO: 1385012 - RNA, 22 nt, Neisseria meningitidis Z2491
uggcaguggcaauuuuuuaaau

SEQ ID NO: 1385013 - RNA, 17 nt, Neisseria meningitidis Z2491
uggauagcgagacggca

SEQ ID NO: 1385014 - RNA, 17 nt, Neisseria meningitidis Z2491
uggauaccgucugaaca

SEQ ID NO: 1385015 - RNA, 19 nt, Neisseria meningitidis Z2491
uggauaugccguauucccg

SEQ ID NO: 1385016 - RNA, 21 nt, Neisseria meningitidis Z2491
uggauauugccguuuuccuuu

SEQ ID NO: 1385017 - RNA, 20 nt, Neisseria meningitidis Z2491
uggagaaaauauagccgacc

SEQ ID NO: 1385018 - RNA, 22 nt, Neisseria meningitidis Z2491
uggagaaugaaaucgggcggga

SEQ ID NO: 1385019 - RNA, 15 nt, Neisseria meningitidis Z2491
uggagcaguaaaauu

SEQ ID NO: 1385020 - RNA, 12 nt, Neisseria meningitidis Z2491
uggagcaggcac

SEQ ID NO: 1385021 - RNA, 17 nt, Neisseria meningitidis Z2491
uggcgagcgauucuucg

SEQ ID NO: 1385022 - RNA, 15 nt, Neisseria meningitidis Z2491
uggccuuuucuuccu

SEQ ID NO: 1385023 - RNA, 20 nt, Neisseria meningitidis Z2491
uggccuuuacucauucaauc

SEQ ID NO: 1385024 - RNA, 23 nt, Neisseria meningitidis Z2491
uggccggaaaccguauauuuccc

SEQ ID NO: 1385025 - RNA, 15 nt, Neisseria meningitidis Z2491
uggcauuuuuaucuu

SEQ ID NO: 1385026 - RNA, 21 nt, Neisseria meningitidis Z2491
uggccgaccauuucuuccagc

SEQ ID NO: 1385027 - RNA, 18 nt, Neisseria meningitidis Z2491
uguacccgcccgccgccg

SEQ ID NO: 1385028 - RNA, 11 nt, Neisseria meningitidis Z2491
uguacugguuu

SEQ ID NO: 1385029 - RNA, 19 nt, Neisseria meningitidis Z2491
uguacugguuuaaauuuaa

SEQ ID NO: 1385030 - RNA, 17 nt, Neisseria meningitidis Z2491
uguacugguuuuuguua

SEQ ID NO: 1385031 - RNA, 16 nt, Neisseria meningitidis Z2491
uguacugucugcagcu

SEQ ID NO: 1385032 - RNA, 22 nt, Neisseria meningitidis Z2491
uguaccaagcccaaucccgcaa

SEQ ID NO: 1385033 - RNA, 20 nt, Neisseria meningitidis Z2491
ugucaaaauacauccuaaaa

SEQ ID NO: 1385034 - RNA, 12 nt, Neisseria meningitidis Z2491
uguauuuuggua

SEQ ID NO: 1385035 - RNA, 19 nt, Neisseria meningitidis Z2491
uguauucggauucccuccu

SEQ ID NO: 1385036 - RNA, 17 nt, Neisseria meningitidis Z2491
uguaucgguauagugaa

SEQ ID NO: 1385037 - RNA, 15 nt, Neisseria meningitidis Z2491
uguaucggugucaaa

SEQ ID NO: 1385038 - RNA, 19 nt, Neisseria meningitidis Z2491
uguauaguaauaaauuaau

SEQ ID NO: 1385039 - RNA, 22 nt, Neisseria meningitidis Z2491
uguagauuuuuuuauuuaaaca

SEQ ID NO: 1385040 - RNA, 14 nt, Neisseria meningitidis Z2491
uggguuuucuguuc

SEQ ID NO: 1385041 - RNA, 18 nt, Neisseria meningitidis Z2491
ugguaaaacgccaauuug

SEQ ID NO: 1385042 - RNA, 12 nt, Neisseria meningitidis Z2491
ugggugguuuuc

SEQ ID NO: 1385043 - RNA, 21 nt, Neisseria meningitidis Z2491
ugguaucugcauuauuuggga

SEQ ID NO: 1385044 - RNA, 22 nt, Neisseria meningitidis Z2491
ugguauagaggauuaacaaaaa

SEQ ID NO: 1385045 - RNA, 13 nt, Neisseria meningitidis Z2491
uggucguucaaau

SEQ ID NO: 1385046 - RNA, 16 nt, Neisseria meningitidis Z2491
ugggcuuaaugccagu

SEQ ID NO: 1385047 - RNA, 18 nt, Neisseria meningitidis Z2491
uggggauuuauucuguug

SEQ ID NO: 1385048 - RNA, 19 nt, Neisseria meningitidis Z2491
uggggauuuauugggaaua

SEQ ID NO: 1385049 - RNA, 21 nt, Neisseria meningitidis Z2491
uggggauuuauugggaauaau

SEQ ID NO: 1385050 - RNA, 14 nt, Neisseria meningitidis Z2491
ugggcugaagccca

SEQ ID NO: 1385051 - RNA, 16 nt, Neisseria meningitidis Z2491
ugggcgaccagccucc

SEQ ID NO: 1385052 - RNA, 16 nt, Neisseria meningitidis Z2491
ugggccgccaccgcca

SEQ ID NO: 1385053 - RNA, 21 nt, Neisseria meningitidis Z2491
uggguaagucuggaguccugc

SEQ ID NO: 1385054 - RNA, 17 nt, Neisseria meningitidis Z2491
ugggauauuuucuuccg

SEQ ID NO: 1385055 - RNA, 23 nt, Neisseria meningitidis Z2491
ugggaugauuuuguucugguugc

SEQ ID NO: 1385056 - RNA, 15 nt, Neisseria meningitidis Z2491
ugggcacguuugagu

SEQ ID NO: 1385057 - RNA, 17 nt, Neisseria meningitidis Z2491
uggcuuugaagccgagc

SEQ ID NO: 1385058 - RNA, 14 nt, Neisseria meningitidis Z2491
ucuggauucccacu

SEQ ID NO: 1385059 - RNA, 15 nt, Neisseria meningitidis Z2491
ucuggggaauaaucu

SEQ ID NO: 1385060 - RNA, 16 nt, Neisseria meningitidis Z2491
ucuguuguuucggaua

SEQ ID NO: 1385061 - RNA, 13 nt, Neisseria meningitidis Z2491
ucuguuuggcuuu

SEQ ID NO: 1385062 - RNA, 22 nt, Neisseria meningitidis Z2491
ucuguuuggcuuuuuucuguuu

SEQ ID NO: 1385063 - RNA, 16 nt, Neisseria meningitidis Z2491
ucuguuucgguuuucu

SEQ ID NO: 1385064 - RNA, 12 nt, Neisseria meningitidis Z2491
ucuguuuuuucc

SEQ ID NO: 1385065 - RNA, 20 nt, Neisseria meningitidis Z2491
ucuguuuuuuccgauaaauu

SEQ ID NO: 1385066 - RNA, 23 nt, Neisseria meningitidis Z2491
ucuguuuuuuccgauaaauuccu

SEQ ID NO: 1385067 - RNA, 17 nt, Neisseria meningitidis Z2491
ucugcagcuucgucgcc

SEQ ID NO: 1385068 - RNA, 17 nt, Neisseria meningitidis Z2491
ucugauuuuaaggcggu

SEQ ID NO: 1385069 - RNA, 15 nt, Neisseria meningitidis Z2491
ucugauuuauuuccu

SEQ ID NO: 1385070 - RNA, 18 nt, Neisseria meningitidis Z2491
ucugcauauaggcaagca

SEQ ID NO: 1385071 - RNA, 13 nt, Neisseria meningitidis Z2491
ucugccagcuccg

SEQ ID NO: 1385072 - RNA, 18 nt, Neisseria meningitidis Z2491
ucugccugauacagccac

SEQ ID NO: 1385073 - RNA, 21 nt, Neisseria meningitidis Z2491
ucugcgaaagggcaguuggga

SEQ ID NO: 1385074 - RNA, 15 nt, Neisseria meningitidis Z2491
ucugcgaaacagaca

SEQ ID NO: 1385075 - RNA, 21 nt, Neisseria meningitidis Z2491
ucugccccguuuuacccucuc

SEQ ID NO: 1385076 - RNA, 15 nt, Neisseria meningitidis Z2491
ucugaacaucuuuca

SEQ ID NO: 1385077 - RNA, 14 nt, Neisseria meningitidis Z2491
ucugaaauguucag

SEQ ID NO: 1385078 - RNA, 18 nt, Neisseria meningitidis Z2491
ucugaaacccggaaaaaa

SEQ ID NO: 1385079 - RNA, 16 nt, Neisseria meningitidis Z2491
ucugaaaccaaaucgg

SEQ ID NO: 1385080 - RNA, 15 nt, Neisseria meningitidis Z2491
ucugaaaccugcaac

SEQ ID NO: 1385081 - RNA, 17 nt, Neisseria meningitidis Z2491
ucugaaaccuuuuuuua

SEQ ID NO: 1385082 - RNA, 16 nt, Neisseria meningitidis Z2491
ucuccuuuuuuuucua

SEQ ID NO: 1385083 - RNA, 16 nt, Neisseria meningitidis Z2491
ucugacagcauuucca

SEQ ID NO: 1385084 - RNA, 13 nt, Neisseria meningitidis Z2491
ucuucuuuccauc

SEQ ID NO: 1385085 - RNA, 21 nt, Neisseria meningitidis Z2491
ucuucuucgacguugccuucu

SEQ ID NO: 1385086 - RNA, 14 nt, Neisseria meningitidis Z2491
ucuucuuacccaau

SEQ ID NO: 1385087 - RNA, 19 nt, Neisseria meningitidis Z2491
ucuugaaacccgucauucc

SEQ ID NO: 1385088 - RNA, 22 nt, Neisseria meningitidis Z2491
ucuugagauuuuacguucuaga

SEQ ID NO: 1385089 - RNA, 18 nt, Neisseria meningitidis Z2491
ucuugaguugauaauaug

SEQ ID NO: 1385090 - RNA, 23 nt, Neisseria meningitidis Z2491
ucuugaggcauugaaauuccaga

SEQ ID NO: 1385091 - RNA, 18 nt, Neisseria meningitidis Z2491
ucuugauaguauucuauu

SEQ ID NO: 1385092 - RNA, 20 nt, Neisseria meningitidis Z2491
ucuugaguuucagucauucc

SEQ ID NO: 1385093 - RNA, 18 nt, Neisseria meningitidis Z2491
ucuugaguuucuguauuu

SEQ ID NO: 1385094 - RNA, 19 nt, Neisseria meningitidis Z2491
ucuugcaaaauagaaaacc

SEQ ID NO: 1385095 - RNA, 16 nt, Neisseria meningitidis Z2491
ucuugcaaaccccuca

SEQ ID NO: 1385096 - RNA, 13 nt, Neisseria meningitidis Z2491
ucuugauuuuucu

SEQ ID NO: 1385097 - RNA, 18 nt, Neisseria meningitidis Z2491
ucuugccauucucacaaa

SEQ ID NO: 1385098 - RNA, 22 nt, Neisseria meningitidis Z2491
ucuuuaaacuucgguuuuuucc

SEQ ID NO: 1385099 - RNA, 13 nt, Neisseria meningitidis Z2491
ucuuuaaauuuaa

SEQ ID NO: 1385100 - RNA, 14 nt, Neisseria meningitidis Z2491
ucuuuaaauuuaaa

SEQ ID NO: 1385101 - RNA, 15 nt, Neisseria meningitidis Z2491
ucuuuaaauuuaaaa

SEQ ID NO: 1385102 - RNA, 13 nt, Neisseria meningitidis Z2491
ucuuuagauuuua

SEQ ID NO: 1385103 - RNA, 15 nt, Neisseria meningitidis Z2491
ucuucuaaaaauaca

SEQ ID NO: 1385104 - RNA, 20 nt, Neisseria meningitidis Z2491
ucuucuaguguugcaaucac

SEQ ID NO: 1385105 - RNA, 17 nt, Neisseria meningitidis Z2491
ucuucgcaguuggaaca

SEQ ID NO: 1385106 - RNA, 16 nt, Neisseria meningitidis Z2491
ucuucgcguacuuuau

SEQ ID NO: 1385107 - RNA, 13 nt, Neisseria meningitidis Z2491
ucuuccuucugaa

SEQ ID NO: 1385108 - RNA, 15 nt, Neisseria meningitidis Z2491
ucuuccuucugaaau

SEQ ID NO: 1385109 - RNA, 14 nt, Neisseria meningitidis Z2491
ucuucgagggcaua

SEQ ID NO: 1385110 - RNA, 21 nt, Neisseria meningitidis Z2491
ucuucgaggaacaaaaugccg

SEQ ID NO: 1385111 - RNA, 17 nt, Neisseria meningitidis Z2491
ucuucauacgacucaaa

SEQ ID NO: 1385112 - RNA, 22 nt, Neisseria meningitidis Z2491
ucuucauacgacucaaaaucau

SEQ ID NO: 1385113 - RNA, 18 nt, Neisseria meningitidis Z2491
ucuuaauacguuuuucuc

SEQ ID NO: 1385114 - RNA, 18 nt, Neisseria meningitidis Z2491
ucuuccgugucaggaugu

SEQ ID NO: 1385115 - RNA, 13 nt, Neisseria meningitidis Z2491
ucuuccgguucga

SEQ ID NO: 1385116 - RNA, 16 nt, Neisseria meningitidis Z2491
ucuucauguucgugca

SEQ ID NO: 1385117 - RNA, 19 nt, Neisseria meningitidis Z2491
ucuucauguucgugcauca

SEQ ID NO: 1385118 - RNA, 12 nt, Neisseria meningitidis Z2491
ucuucauuccgc

SEQ ID NO: 1385119 - RNA, 14 nt, Neisseria meningitidis Z2491
ucgucauucccacg

SEQ ID NO: 1385120 - RNA, 13 nt, Neisseria meningitidis Z2491
ucgucauuuccac

SEQ ID NO: 1385121 - RNA, 20 nt, Neisseria meningitidis Z2491
ucgucuuuuccuuccaaaag

SEQ ID NO: 1385122 - RNA, 18 nt, Neisseria meningitidis Z2491
ucgucugaaaaauuuuca

SEQ ID NO: 1385123 - RNA, 16 nt, Neisseria meningitidis Z2491
ucgugcaggguuuucu

SEQ ID NO: 1385124 - RNA, 19 nt, Neisseria meningitidis Z2491
ucgucagaccccuuucggc

SEQ ID NO: 1385125 - RNA, 16 nt, Neisseria meningitidis Z2491
ucguaggcuuuuucca

SEQ ID NO: 1385126 - RNA, 14 nt, Neisseria meningitidis Z2491
ucggcagcuuuuuu

SEQ ID NO: 1385127 - RNA, 17 nt, Neisseria meningitidis Z2491
ucgguuccguacuauuu

SEQ ID NO: 1385128 - RNA, 15 nt, Neisseria meningitidis Z2491
ucgguuucgugccuu

SEQ ID NO: 1385129 - RNA, 17 nt, Neisseria meningitidis Z2491
ucuaaucgcgucauucc

SEQ ID NO: 1385130 - RNA, 17 nt, Neisseria meningitidis Z2491
ucguugcguaggaugcc

SEQ ID NO: 1385131 - RNA, 15 nt, Neisseria meningitidis Z2491
ucuaaccagccaacc

SEQ ID NO: 1385132 - RNA, 23 nt, Neisseria meningitidis Z2491
ucuaaacgguauucauaccuccc

SEQ ID NO: 1385133 - RNA, 16 nt, Neisseria meningitidis Z2491
ucuaaaccgucauucc

SEQ ID NO: 1385134 - RNA, 16 nt, Neisseria meningitidis Z2491
ucuagauucccacuuu

SEQ ID NO: 1385135 - RNA, 14 nt, Neisseria meningitidis Z2491
ucuagauucccgcc

SEQ ID NO: 1385136 - RNA, 13 nt, Neisseria meningitidis Z2491
ucuagacauucaa

SEQ ID NO: 1385137 - RNA, 16 nt, Neisseria meningitidis Z2491
ucuagacauucaaugc

SEQ ID NO: 1385138 - RNA, 17 nt, Neisseria meningitidis Z2491
ucuagacauucaaugcu

SEQ ID NO: 1385139 - RNA, 23 nt, Neisseria meningitidis Z2491
ucuagacauucaaugcuaaggca

SEQ ID NO: 1385140 - RNA, 16 nt, Neisseria meningitidis Z2491
ucuagaaaugaaaaac

SEQ ID NO: 1385141 - RNA, 12 nt, Neisseria meningitidis Z2491
ucuagaaacuca

SEQ ID NO: 1385142 - RNA, 21 nt, Neisseria meningitidis Z2491
ucuagaaucccggacuuucag

SEQ ID NO: 1385143 - RNA, 21 nt, Neisseria meningitidis Z2491
ucuagaaucucggacuuucag

SEQ ID NO: 1385144 - RNA, 20 nt, Neisseria meningitidis Z2491
ucuauaaagccuaaauacaa

SEQ ID NO: 1385145 - RNA, 20 nt, Neisseria meningitidis Z2491
ucuaguuuuuugaguuucag

SEQ ID NO: 1385146 - RNA, 20 nt, Neisseria meningitidis Z2491
ucuagugcguugaguuucag

SEQ ID NO: 1385147 - RNA, 20 nt, Neisseria meningitidis Z2491
ucuauaucuucguccgugcc

SEQ ID NO: 1385148 - RNA, 21 nt, Neisseria meningitidis Z2491
ucuauaguggauuaacaaaaa

SEQ ID NO: 1385149 - RNA, 13 nt, Neisseria meningitidis Z2491
ucuauguuaugug

SEQ ID NO: 1385150 - RNA, 15 nt, Neisseria meningitidis Z2491
ucuauguuaugugcu

SEQ ID NO: 1385151 - RNA, 15 nt, Neisseria meningitidis Z2491
ucucacacucuucgu

SEQ ID NO: 1385152 - RNA, 17 nt, Neisseria meningitidis Z2491
ucucagacuauuucggc

SEQ ID NO: 1385153 - RNA, 17 nt, Neisseria meningitidis Z2491
ucucaaacguugagccu

SEQ ID NO: 1385154 - RNA, 21 nt, Neisseria meningitidis Z2491
ucuauuuucgccccaaauacc

SEQ ID NO: 1385155 - RNA, 17 nt, Neisseria meningitidis Z2491
ucuauuggauauaauuu

SEQ ID NO: 1385156 - RNA, 12 nt, Neisseria meningitidis Z2491
ucucauuuucaa

SEQ ID NO: 1385157 - RNA, 14 nt, Neisseria meningitidis Z2491
ucucauuuucaaaa

SEQ ID NO: 1385158 - RNA, 15 nt, Neisseria meningitidis Z2491
uccgcgauaaggcgc

SEQ ID NO: 1385159 - RNA, 22 nt, Neisseria meningitidis Z2491
uccgccacguuugccaaggcgg

SEQ ID NO: 1385160 - RNA, 16 nt, Neisseria meningitidis Z2491
uccgccaaaaacggca

SEQ ID NO: 1385161 - RNA, 21 nt, Neisseria meningitidis Z2491
uccgccaaaaacggcacggcg

SEQ ID NO: 1385162 - RNA, 12 nt, Neisseria meningitidis Z2491
uccgccaaacca

SEQ ID NO: 1385163 - RNA, 16 nt, Neisseria meningitidis Z2491
uccgcauaauaaaaau

SEQ ID NO: 1385164 - RNA, 14 nt, Neisseria meningitidis Z2491
uccgcaggcuccuu

SEQ ID NO: 1385165 - RNA, 15 nt, Neisseria meningitidis Z2491
uccguaccgcgcgcc

SEQ ID NO: 1385166 - RNA, 11 nt, Neisseria meningitidis Z2491
uccgucagcac

SEQ ID NO: 1385167 - RNA, 15 nt, Neisseria meningitidis Z2491
uccguaaauugucca

SEQ ID NO: 1385168 - RNA, 23 nt, Neisseria meningitidis Z2491
uccggcugcgcguaaucccauuu

SEQ ID NO: 1385169 - RNA, 14 nt, Neisseria meningitidis Z2491
uccggcuuuccaug

SEQ ID NO: 1385170 - RNA, 13 nt, Neisseria meningitidis Z2491
uccggcagccugc

SEQ ID NO: 1385171 - RNA, 16 nt, Neisseria meningitidis Z2491
uccggccaaaaaaacg

SEQ ID NO: 1385172 - RNA, 14 nt, Neisseria meningitidis Z2491
uccguuugguuuua

SEQ ID NO: 1385173 - RNA, 23 nt, Neisseria meningitidis Z2491
uccgugucaggaugucugccuga

SEQ ID NO: 1385174 - RNA, 14 nt, Neisseria meningitidis Z2491
uccguguguauagu

SEQ ID NO: 1385175 - RNA, 21 nt, Neisseria meningitidis Z2491
uccuaauucuacccaaauacc

SEQ ID NO: 1385176 - RNA, 13 nt, Neisseria meningitidis Z2491
uccuaaaacuuaa

SEQ ID NO: 1385177 - RNA, 21 nt, Neisseria meningitidis Z2491
uccuaaaacuuaaaauuccgu

SEQ ID NO: 1385178 - RNA, 13 nt, Neisseria meningitidis Z2491
uccuaaaaauuua

SEQ ID NO: 1385179 - RNA, 17 nt, Neisseria meningitidis Z2491
uccucccacucuuucaa

SEQ ID NO: 1385180 - RNA, 14 nt, Neisseria meningitidis Z2491
uccuccgcaaacac

SEQ ID NO: 1385181 - RNA, 16 nt, Neisseria meningitidis Z2491
uccucccuccccccgu

SEQ ID NO: 1385182 - RNA, 19 nt, Neisseria meningitidis Z2491
uccuccacuaaaaaaucca

SEQ ID NO: 1385183 - RNA, 16 nt, Neisseria meningitidis Z2491
uccucaucguucaaca

SEQ ID NO: 1385184 - RNA, 22 nt, Neisseria meningitidis Z2491
uccucaucguucaacagcagcg

SEQ ID NO: 1385185 - RNA, 21 nt, Neisseria meningitidis Z2491
uccucacugccgccaauccug

SEQ ID NO: 1385186 - RNA, 13 nt, Neisseria meningitidis Z2491
uccucaacuuauu

SEQ ID NO: 1385187 - RNA, 22 nt, Neisseria meningitidis Z2491
uccucaaaaacagaaaaccaaa

SEQ ID NO: 1385188 - RNA, 20 nt, Neisseria meningitidis Z2491
uccucuuucaacggcacggc

SEQ ID NO: 1385189 - RNA, 16 nt, Neisseria meningitidis Z2491
uccucuuucaucauau

SEQ ID NO: 1385190 - RNA, 21 nt, Neisseria meningitidis Z2491
uccuguucaaggcgacagccg

SEQ ID NO: 1385191 - RNA, 12 nt, Neisseria meningitidis Z2491
uccugauuuaaa

SEQ ID NO: 1385192 - RNA, 15 nt, Neisseria meningitidis Z2491
uccugauuuaaauuu

SEQ ID NO: 1385193 - RNA, 18 nt, Neisseria meningitidis Z2491
uccugauuuaaauuuaau

SEQ ID NO: 1385194 - RNA, 21 nt, Neisseria meningitidis Z2491
uccugauuuuuguuaauccac

SEQ ID NO: 1385195 - RNA, 17 nt, Neisseria meningitidis Z2491
ucgauguuuuugucuuu

SEQ ID NO: 1385196 - RNA, 13 nt, Neisseria meningitidis Z2491
ucgaugccgaugc

SEQ ID NO: 1385197 - RNA, 14 nt, Neisseria meningitidis Z2491
ucgagcggcagguc

SEQ ID NO: 1385198 - RNA, 21 nt, Neisseria meningitidis Z2491
ucgccacauaauucaaaugcg

SEQ ID NO: 1385199 - RNA, 22 nt, Neisseria meningitidis Z2491
ucgcaucggcggcguauuugcu

SEQ ID NO: 1385200 - RNA, 13 nt, Neisseria meningitidis Z2491
uccuguuuuuaac

SEQ ID NO: 1385201 - RNA, 13 nt, Neisseria meningitidis Z2491
uccuuaaaaaagg

SEQ ID NO: 1385202 - RNA, 15 nt, Neisseria meningitidis Z2491
uccuuaaaaaaggcu

SEQ ID NO: 1385203 - RNA, 13 nt, Neisseria meningitidis Z2491
ucgaccagcuccc

SEQ ID NO: 1385204 - RNA, 21 nt, Neisseria meningitidis Z2491
ucgacgauggaccucaggccg

SEQ ID NO: 1385205 - RNA, 23 nt, Neisseria meningitidis Z2491
ucgaccugcuguuugagccugug

SEQ ID NO: 1385206 - RNA, 16 nt, Neisseria meningitidis Z2491
ucgagccaugcgugcc

SEQ ID NO: 1385207 - RNA, 11 nt, Neisseria meningitidis Z2491
ucgcggcggca

SEQ ID NO: 1385208 - RNA, 16 nt, Neisseria meningitidis Z2491
ucgcgcaauuccugca

SEQ ID NO: 1385209 - RNA, 19 nt, Neisseria meningitidis Z2491
ucgccaggcguauauggcu

SEQ ID NO: 1385210 - RNA, 16 nt, Neisseria meningitidis Z2491
ucgccgccuuguccug

SEQ ID NO: 1385211 - RNA, 16 nt, Neisseria meningitidis Z2491
ucggacauuugacuug

SEQ ID NO: 1385212 - RNA, 23 nt, Neisseria meningitidis Z2491
ucggacauuugacuugaaggcgu

SEQ ID NO: 1385213 - RNA, 16 nt, Neisseria meningitidis Z2491
ucggacacgcccgacu

SEQ ID NO: 1385214 - RNA, 14 nt, Neisseria meningitidis Z2491
ucggcacaagaugc

SEQ ID NO: 1385215 - RNA, 23 nt, Neisseria meningitidis Z2491
ucggcaauccggucuuggcagca

SEQ ID NO: 1385216 - RNA, 11 nt, Neisseria meningitidis Z2491
ucggcaaugcc

SEQ ID NO: 1385217 - RNA, 14 nt, Neisseria meningitidis Z2491
ucggacaagggaaa

SEQ ID NO: 1385218 - RNA, 21 nt, Neisseria meningitidis Z2491
ucggaaaugacugaaacucaa

SEQ ID NO: 1385219 - RNA, 17 nt, Neisseria meningitidis Z2491
ucgcuucggauaaauuu

SEQ ID NO: 1385220 - RNA, 15 nt, Neisseria meningitidis Z2491
ucgcucaaauucugu

SEQ ID NO: 1385221 - RNA, 16 nt, Neisseria meningitidis Z2491
ucgcguaccaaaaccg

SEQ ID NO: 1385222 - RNA, 16 nt, Neisseria meningitidis Z2491
uccgaggcuguggagc

SEQ ID NO: 1385223 - RNA, 17 nt, Neisseria meningitidis Z2491
uccgaggcuguggagca

SEQ ID NO: 1385224 - RNA, 16 nt, Neisseria meningitidis Z2491
uccgaguggcuuccuu

SEQ ID NO: 1385225 - RNA, 23 nt, Neisseria meningitidis Z2491
uccgaguggcuuccuuuuuaaag

SEQ ID NO: 1385226 - RNA, 17 nt, Neisseria meningitidis Z2491
uccgauaaauuccuaaa

SEQ ID NO: 1385227 - RNA, 19 nt, Neisseria meningitidis Z2491
uccgcaacgcgcaaacccg

SEQ ID NO: 1385228 - RNA, 18 nt, Neisseria meningitidis Z2491
uccgcaaacaccagcauc

SEQ ID NO: 1385229 - RNA, 14 nt, Neisseria meningitidis Z2491
uccgaccgccgccg

SEQ ID NO: 1385230 - RNA, 19 nt, Neisseria meningitidis Z2491
uccgaccaacucccaguuc

SEQ ID NO: 1385231 - RNA, 21 nt, Neisseria meningitidis Z2491
uccgacgugugaguagcggug

SEQ ID NO: 1385232 - RNA, 16 nt, Neisseria meningitidis Z2491
uccgaaagguuuucgg

SEQ ID NO: 1385233 - RNA, 18 nt, Neisseria meningitidis Z2491
uccgaaauauuacccaac

SEQ ID NO: 1385234 - RNA, 13 nt, Neisseria meningitidis Z2491
uccgaaacaacaa

SEQ ID NO: 1385235 - RNA, 19 nt, Neisseria meningitidis Z2491
uccgaaacaacaaaaccua

SEQ ID NO: 1385236 - RNA, 12 nt, Neisseria meningitidis Z2491
uccgaaaccaag

SEQ ID NO: 1385237 - RNA, 17 nt, Neisseria meningitidis Z2491
uccgacaaauuccuaaa

SEQ ID NO: 1385238 - RNA, 19 nt, Neisseria meningitidis Z2491
uccgaacgcgaaaaugccg

SEQ ID NO: 1385239 - RNA, 17 nt, Neisseria meningitidis Z2491
uccgaaucaacacgccu

SEQ ID NO: 1385240 - RNA, 17 nt, Neisseria meningitidis Z2491
ucccuucccucccgaca

SEQ ID NO: 1385241 - RNA, 15 nt, Neisseria meningitidis Z2491
ucccucgccuugccg

SEQ ID NO: 1385242 - RNA, 23 nt, Neisseria meningitidis Z2491
ucccugaauaaaacgcgugcagg

SEQ ID NO: 1385243 - RNA, 22 nt, Neisseria meningitidis Z2491
ucccugacaaucaggaaaacag

SEQ ID NO: 1385244 - RNA, 18 nt, Neisseria meningitidis Z2491
ucccguccggcaaacauc

SEQ ID NO: 1385245 - RNA, 21 nt, Neisseria meningitidis Z2491
ucccgcuuuugcgggaaugac

SEQ ID NO: 1385246 - RNA, 20 nt, Neisseria meningitidis Z2491
uccccucggggucuuuggca

SEQ ID NO: 1385247 - RNA, 14 nt, Neisseria meningitidis Z2491
uccccuaugcuuug

SEQ ID NO: 1385248 - RNA, 20 nt, Neisseria meningitidis Z2491
ucccgacagccgaaacccaa

SEQ ID NO: 1385249 - RNA, 20 nt, Neisseria meningitidis Z2491
ucccgacgcuugucccacag

SEQ ID NO: 1385250 - RNA, 15 nt, Neisseria meningitidis Z2491
ucccgauaaaugccg

SEQ ID NO: 1385251 - RNA, 17 nt, Neisseria meningitidis Z2491
ucccgcaaaaacaaaaa

SEQ ID NO: 1385252 - RNA, 23 nt, Neisseria meningitidis Z2491
ucccgcaaaagcgggaauccaaa

SEQ ID NO: 1385253 - RNA, 21 nt, Neisseria meningitidis Z2491
ucccgccugcgcgggaaugac

SEQ ID NO: 1385254 - RNA, 21 nt, Neisseria meningitidis Z2491
ucccacuuuugugggaaugac

SEQ ID NO: 1385255 - RNA, 17 nt, Neisseria meningitidis Z2491
ucccaccguuucccauc

SEQ ID NO: 1385256 - RNA, 14 nt, Neisseria meningitidis Z2491
ucccacggaagugg

SEQ ID NO: 1385257 - RNA, 14 nt, Neisseria meningitidis Z2491
ucccacgggacuuu

SEQ ID NO: 1385258 - RNA, 22 nt, Neisseria meningitidis Z2491
ucccaccauggucgcugacacc

SEQ ID NO: 1385259 - RNA, 13 nt, Neisseria meningitidis Z2491
ucccacgaaagug

SEQ ID NO: 1385260 - RNA, 14 nt, Neisseria meningitidis Z2491
ucccacgaaagugg

SEQ ID NO: 1385261 - RNA, 21 nt, Neisseria meningitidis Z2491
ucccaauauuaagaaaaacag

SEQ ID NO: 1385262 - RNA, 18 nt, Neisseria meningitidis Z2491
uccauucgugggcgcauu

SEQ ID NO: 1385263 - RNA, 12 nt, Neisseria meningitidis Z2491
uccaugauuuuu

SEQ ID NO: 1385264 - RNA, 23 nt, Neisseria meningitidis Z2491
ucccauacuacugcuguuugaca

SEQ ID NO: 1385265 - RNA, 17 nt, Neisseria meningitidis Z2491
ucccccguaccgggcag

SEQ ID NO: 1385266 - RNA, 16 nt, Neisseria meningitidis Z2491
uccacaaaagauacac

SEQ ID NO: 1385267 - RNA, 14 nt, Neisseria meningitidis Z2491
uccaacuuggcaac

SEQ ID NO: 1385268 - RNA, 13 nt, Neisseria meningitidis Z2491
uccaaggcacggu

SEQ ID NO: 1385269 - RNA, 19 nt, Neisseria meningitidis Z2491
uccaaguuuuuuagauaag

SEQ ID NO: 1385270 - RNA, 15 nt, Neisseria meningitidis Z2491
uccaauacaacaaaa

SEQ ID NO: 1385271 - RNA, 13 nt, Neisseria meningitidis Z2491
uccaauacauuuu

SEQ ID NO: 1385272 - RNA, 21 nt, Neisseria meningitidis Z2491
uccaauacauuuuugauauuu

SEQ ID NO: 1385273 - RNA, 19 nt, Neisseria meningitidis Z2491
uccaaguuccaauacauuu

SEQ ID NO: 1385274 - RNA, 16 nt, Neisseria meningitidis Z2491
uccacaccguucagcc

SEQ ID NO: 1385275 - RNA, 18 nt, Neisseria meningitidis Z2491
uccacaccguucagcccg

SEQ ID NO: 1385276 - RNA, 19 nt, Neisseria meningitidis Z2491
uccacagccgcaaaagcca

SEQ ID NO: 1385277 - RNA, 17 nt, Neisseria meningitidis Z2491
uccacccugauuucgcu

SEQ ID NO: 1385278 - RNA, 19 nt, Neisseria meningitidis Z2491
uccacgauauuacgaacaa

SEQ ID NO: 1385279 - RNA, 14 nt, Neisseria meningitidis Z2491
uccacuuucgccau

SEQ ID NO: 1385280 - RNA, 18 nt, Neisseria meningitidis Z2491
uccacuauaugaguguau

SEQ ID NO: 1385281 - RNA, 13 nt, Neisseria meningitidis Z2491
uccacuaaaaaau

SEQ ID NO: 1385282 - RNA, 14 nt, Neisseria meningitidis Z2491
uccagaaucucuaa

SEQ ID NO: 1385283 - RNA, 23 nt, Neisseria meningitidis Z2491
uccagcagcaacacauugccacc

SEQ ID NO: 1385284 - RNA, 15 nt, Neisseria meningitidis Z2491
uccagcaccacaccu

SEQ ID NO: 1385285 - RNA, 14 nt, Neisseria meningitidis Z2491
uccagcaaacggua

SEQ ID NO: 1385286 - RNA, 20 nt, Neisseria meningitidis Z2491
uccagcuccggccaaaaaaa

SEQ ID NO: 1385287 - RNA, 18 nt, Neisseria meningitidis Z2491
uccagcgguuuggucugc

SEQ ID NO: 1385288 - RNA, 16 nt, Neisseria meningitidis Z2491
uccagcgugcggacgu

SEQ ID NO: 1385289 - RNA, 22 nt, Neisseria meningitidis Z2491
uccagcgugcggacguucaaac

SEQ ID NO: 1385290 - RNA, 23 nt, Neisseria meningitidis Z2491
uccagcgugcggacguucaaacc

SEQ ID NO: 1385291 - RNA, 21 nt, Neisseria meningitidis Z2491
uccagugcguugaguuucagc

SEQ ID NO: 1385292 - RNA, 20 nt, Neisseria meningitidis Z2491
uccaucaacaaaaugccguc

SEQ ID NO: 1385293 - RNA, 17 nt, Neisseria meningitidis Z2491
uccauaucuuuaaguga

SEQ ID NO: 1385294 - RNA, 14 nt, Neisseria meningitidis Z2491
uccaucaguuucca

SEQ ID NO: 1385295 - RNA, 19 nt, Neisseria meningitidis Z2491
uccaucaguuuccacuaaa

SEQ ID NO: 1385296 - RNA, 20 nt, Neisseria meningitidis Z2491
uccaucccauauuccacagu

SEQ ID NO: 1385297 - RNA, 18 nt, Neisseria meningitidis Z2491
uccaucgcgucuucaaaa

SEQ ID NO: 1385298 - RNA, 15 nt, Neisseria meningitidis Z2491
uccauagauaaauuu

SEQ ID NO: 1385299 - RNA, 22 nt, Neisseria meningitidis Z2491
uccauaaaauacaugacauuaa

SEQ ID NO: 1385300 - RNA, 15 nt, Neisseria meningitidis Z2491
uccauaauccaagau

SEQ ID NO: 1385301 - RNA, 19 nt, Neisseria meningitidis Z2491
uccauaauccaagauuuca

SEQ ID NO: 1385302 - RNA, 19 nt, Neisseria meningitidis Z2491
ucauuuccgauaaauuccu

SEQ ID NO: 1385303 - RNA, 17 nt, Neisseria meningitidis Z2491
ucauuuccgauaaauuc

SEQ ID NO: 1385304 - RNA, 14 nt, Neisseria meningitidis Z2491
ucauuuccaauuuu

SEQ ID NO: 1385305 - RNA, 13 nt, Neisseria meningitidis Z2491
ucauuuucaaaau

SEQ ID NO: 1385306 - RNA, 16 nt, Neisseria meningitidis Z2491
ucauuuucaaaaugca

SEQ ID NO: 1385307 - RNA, 15 nt, Neisseria meningitidis Z2491
ucauuuaucggaaaa

SEQ ID NO: 1385308 - RNA, 17 nt, Neisseria meningitidis Z2491
uccaacccuccgccgca

SEQ ID NO: 1385309 - RNA, 23 nt, Neisseria meningitidis Z2491
uccaacacgcagccgagcagcag

SEQ ID NO: 1385310 - RNA, 21 nt, Neisseria meningitidis Z2491
uccaaaggagcaauuaaauuu

SEQ ID NO: 1385311 - RNA, 13 nt, Neisseria meningitidis Z2491
uccaaaucggcaa

SEQ ID NO: 1385312 - RNA, 22 nt, Neisseria meningitidis Z2491
uccaaaaauacgcguaagcgga

SEQ ID NO: 1385313 - RNA, 22 nt, Neisseria meningitidis Z2491
uccaaagccucgcggcucgccc

SEQ ID NO: 1385314 - RNA, 22 nt, Neisseria meningitidis Z2491
uccaaacuuguccgcacggaaa

SEQ ID NO: 1385315 - RNA, 16 nt, Neisseria meningitidis Z2491
uccaaacaaaaaugcc

SEQ ID NO: 1385316 - RNA, 17 nt, Neisseria meningitidis Z2491
ucauguucgugcaucau

SEQ ID NO: 1385317 - RNA, 19 nt, Neisseria meningitidis Z2491
ucauguucgugcaucauca

SEQ ID NO: 1385318 - RNA, 14 nt, Neisseria meningitidis Z2491
ucauguuauuauuu

SEQ ID NO: 1385319 - RNA, 19 nt, Neisseria meningitidis Z2491
ucauguuauuauuuuccau

SEQ ID NO: 1385320 - RNA, 20 nt, Neisseria meningitidis Z2491
ucauguuauuauuuuccaua

SEQ ID NO: 1385321 - RNA, 18 nt, Neisseria meningitidis Z2491
ucauguaguagcgcgcca

SEQ ID NO: 1385322 - RNA, 18 nt, Neisseria meningitidis Z2491
ucauugcauggacauucu

SEQ ID NO: 1385323 - RNA, 17 nt, Neisseria meningitidis Z2491
ucauuccuacgaaccua

SEQ ID NO: 1385324 - RNA, 23 nt, Neisseria meningitidis Z2491
ucauuccgcgcaggcggaaauua

SEQ ID NO: 1385325 - RNA, 20 nt, Neisseria meningitidis Z2491
ucauuccucaaaaacagaaa

SEQ ID NO: 1385326 - RNA, 23 nt, Neisseria meningitidis Z2491
ucauuccucaaaaacagaaaacc

SEQ ID NO: 1385327 - RNA, 22 nt, Neisseria meningitidis Z2491
ucauuccuguaaaaacaaaaaa

SEQ ID NO: 1385328 - RNA, 17 nt, Neisseria meningitidis Z2491
ucauucccgauaaauug

SEQ ID NO: 1385329 - RNA, 18 nt, Neisseria meningitidis Z2491
ucauucccgccacuuucc

SEQ ID NO: 1385330 - RNA, 22 nt, Neisseria meningitidis Z2491
ucauucccgcgaaaaauagaaa

SEQ ID NO: 1385331 - RNA, 15 nt, Neisseria meningitidis Z2491
ucauucccacaaaga

SEQ ID NO: 1385332 - RNA, 16 nt, Neisseria meningitidis Z2491
ucauucccacgaaagu

SEQ ID NO: 1385333 - RNA, 19 nt, Neisseria meningitidis Z2491
ucaugaucuucuuacccaa

SEQ ID NO: 1385334 - RNA, 20 nt, Neisseria meningitidis Z2491
ucaugcauccgggccgccuu

SEQ ID NO: 1385335 - RNA, 13 nt, Neisseria meningitidis Z2491
ucaucuuuacuug

SEQ ID NO: 1385336 - RNA, 18 nt, Neisseria meningitidis Z2491
ucaucggcaaucagucau

SEQ ID NO: 1385337 - RNA, 22 nt, Neisseria meningitidis Z2491
ucauccacagccgcaaaagcca

SEQ ID NO: 1385338 - RNA, 13 nt, Neisseria meningitidis Z2491
ucauccaccagcc

SEQ ID NO: 1385339 - RNA, 14 nt, Neisseria meningitidis Z2491
ucauccaccagccc

SEQ ID NO: 1385340 - RNA, 13 nt, Neisseria meningitidis Z2491
ucaucauucccac

SEQ ID NO: 1385341 - RNA, 12 nt, Neisseria meningitidis Z2491
ucaucauuccua

SEQ ID NO: 1385342 - RNA, 14 nt, Neisseria meningitidis Z2491
ucauccguugcuuc

SEQ ID NO: 1385343 - RNA, 20 nt, Neisseria meningitidis Z2491
ucauacguuuugguugcgcc

SEQ ID NO: 1385344 - RNA, 13 nt, Neisseria meningitidis Z2491
ucauacccaaggc

SEQ ID NO: 1385345 - RNA, 19 nt, Neisseria meningitidis Z2491
ucauaccccacugccagcc

SEQ ID NO: 1385346 - RNA, 15 nt, Neisseria meningitidis Z2491
ucauacacagccaaa

SEQ ID NO: 1385347 - RNA, 22 nt, Neisseria meningitidis Z2491
ucauaaguuucccgaaauucca

SEQ ID NO: 1385348 - RNA, 18 nt, Neisseria meningitidis Z2491
ucauauucacuaaauugc

SEQ ID NO: 1385349 - RNA, 13 nt, Neisseria meningitidis Z2491
ucauauccggcgc

SEQ ID NO: 1385350 - RNA, 23 nt, Neisseria meningitidis Z2491
ucaguuccaucgcgucuucaaaa

SEQ ID NO: 1385351 - RNA, 13 nt, Neisseria meningitidis Z2491
ucaguuuuuucag

SEQ ID NO: 1385352 - RNA, 15 nt, Neisseria meningitidis Z2491
ucaguauuuucuauu

SEQ ID NO: 1385353 - RNA, 22 nt, Neisseria meningitidis Z2491
ucaguacggcguugccucgccu

SEQ ID NO: 1385354 - RNA, 19 nt, Neisseria meningitidis Z2491
ucagguuugugucccauug

SEQ ID NO: 1385355 - RNA, 15 nt, Neisseria meningitidis Z2491
ucagcuaugccugcc

SEQ ID NO: 1385356 - RNA, 15 nt, Neisseria meningitidis Z2491
ucaggaacaucagca

SEQ ID NO: 1385357 - RNA, 14 nt, Neisseria meningitidis Z2491
ucaggacaaggcgg

SEQ ID NO: 1385358 - RNA, 14 nt, Neisseria meningitidis Z2491
ucaggaaugcaaac

SEQ ID NO: 1385359 - RNA, 20 nt, Neisseria meningitidis Z2491
ucaggacucgaacaccaauu

SEQ ID NO: 1385360 - RNA, 22 nt, Neisseria meningitidis Z2491
ucaggacggaaauguucuuuca

SEQ ID NO: 1385361 - RNA, 23 nt, Neisseria meningitidis Z2491
ucagcgcaaugcgccugcggcug

SEQ ID NO: 1385362 - RNA, 23 nt, Neisseria meningitidis Z2491
ucagcggcaaaaccgaugcagaa

SEQ ID NO: 1385363 - RNA, 15 nt, Neisseria meningitidis Z2491
ucaggcccuguuugu

SEQ ID NO: 1385364 - RNA, 19 nt, Neisseria meningitidis Z2491
ucaggcggcguucuucuuc

SEQ ID NO: 1385365 - RNA, 17 nt, Neisseria meningitidis Z2491
ucaggaugucugccuga

SEQ ID NO: 1385366 - RNA, 17 nt, Neisseria meningitidis Z2491
ucaggcauccgggcugc

SEQ ID NO: 1385367 - RNA, 16 nt, Neisseria meningitidis Z2491
ucaggguaaacagggc

SEQ ID NO: 1385368 - RNA, 24 nt, Neisseria meningitidis Z2491
ucaggguaaacagggcugcgccuu

SEQ ID NO: 1385369 - RNA, 15 nt, Neisseria meningitidis Z2491
ucaggguguuugccg

SEQ ID NO: 1385370 - RNA, 24 nt, Neisseria meningitidis Z2491
ucagguggcuuugcgcacucacuu

SEQ ID NO: 1385371 - RNA, 19 nt, Neisseria meningitidis Z2491
ucaggcuuuuucgccagca

SEQ ID NO: 1385372 - RNA, 17 nt, Neisseria meningitidis Z2491
ucaggcuuuuuugacga

SEQ ID NO: 1385373 - RNA, 22 nt, Neisseria meningitidis Z2491
ggauuaacaaaaaucaggacaa

SEQ ID NO: 1385374 - RNA, 22 nt, Neisseria meningitidis Z2491
ggauuaauaaaaaucaggacaa

SEQ ID NO: 1385375 - RNA, 13 nt, Neisseria meningitidis Z2491
ggauuaaaauaaa

SEQ ID NO: 1385376 - RNA, 14 nt, Neisseria meningitidis Z2491
ggauuaaaauaaaa

SEQ ID NO: 1385377 - RNA, 19 nt, Neisseria meningitidis Z2491
ggauuaaauuuaaaccagu

SEQ ID NO: 1385378 - RNA, 23 nt, Neisseria meningitidis Z2491
ggauuaaauuuaaaucaggacaa

SEQ ID NO: 1385379 - RNA, 16 nt, Neisseria meningitidis Z2491
ggauuaacaaaaauca

SEQ ID NO: 1385380 - RNA, 23 nt, Neisseria meningitidis Z2491
ggauguucaaacacgggcaaccu

SEQ ID NO: 1385381 - RNA, 17 nt, Neisseria meningitidis Z2491
ggaugccgcgccgccgg

SEQ ID NO: 1385382 - RNA, 15 nt, Neisseria meningitidis Z2491
ggaugcagguuucug

SEQ ID NO: 1385383 - RNA, 23 nt, Neisseria meningitidis Z2491
ggcaacgccguacugguuuuugu

SEQ ID NO: 1385384 - RNA, 20 nt, Neisseria meningitidis Z2491
ggcaaaacggccgcaaaguc

SEQ ID NO: 1385385 - RNA, 12 nt, Neisseria meningitidis Z2491
ggcaaaaauuua

SEQ ID NO: 1385386 - RNA, 21 nt, Neisseria meningitidis Z2491
ggcaaagcggcaaucaaaucc

SEQ ID NO: 1385387 - RNA, 18 nt, Neisseria meningitidis Z2491
ggauuuccuuaaaaaagg

SEQ ID NO: 1385388 - RNA, 15 nt, Neisseria meningitidis Z2491
ggauuuuagguuucu

SEQ ID NO: 1385389 - RNA, 16 nt, Neisseria meningitidis Z2491
ggauuuuagguuucug

SEQ ID NO: 1385390 - RNA, 23 nt, Neisseria meningitidis Z2491
ggcaacuuuuuucgauaugaaaa

SEQ ID NO: 1385391 - RNA, 18 nt, Neisseria meningitidis Z2491
ggcaaggcgccggcggcu

SEQ ID NO: 1385392 - RNA, 18 nt, Neisseria meningitidis Z2491
ggcaaucauuucugucug

SEQ ID NO: 1385393 - RNA, 23 nt, Neisseria meningitidis Z2491
ggcaaguuccaagauggcgagcg

SEQ ID NO: 1385394 - RNA, 16 nt, Neisseria meningitidis Z2491
ggcaauauucuuugaa

SEQ ID NO: 1385395 - RNA, 18 nt, Neisseria meningitidis Z2491
ggcaaguguccggcagcc

SEQ ID NO: 1385396 - RNA, 13 nt, Neisseria meningitidis Z2491
ggcacggcaggga

SEQ ID NO: 1385397 - RNA, 15 nt, Neisseria meningitidis Z2491
ggaguccuuauuggg

SEQ ID NO: 1385398 - RNA, 14 nt, Neisseria meningitidis Z2491
ggauaggcaaaaac

SEQ ID NO: 1385399 - RNA, 15 nt, Neisseria meningitidis Z2491
ggauauuuucuuccg

SEQ ID NO: 1385400 - RNA, 19 nt, Neisseria meningitidis Z2491
ggaggcaguuuuuuauccg

SEQ ID NO: 1385401 - RNA, 23 nt, Neisseria meningitidis Z2491
ggacgcaggguuaagaaaaccug

SEQ ID NO: 1385402 - RNA, 19 nt, Neisseria meningitidis Z2491
ggacgaugaguuuuuugcc

SEQ ID NO: 1385403 - RNA, 12 nt, Neisseria meningitidis Z2491
ggaauagcucag

SEQ ID NO: 1385404 - RNA, 23 nt, Neisseria meningitidis Z2491
ggacaaaaaaccaaaacagaaac

SEQ ID NO: 1385405 - RNA, 13 nt, Neisseria meningitidis Z2491
ggaaugauggggu

SEQ ID NO: 1385406 - RNA, 23 nt, Neisseria meningitidis Z2491
ggaaugacggucgaggguuucug

SEQ ID NO: 1385407 - RNA, 23 nt, Neisseria meningitidis Z2491
ggaaugacggucggggguuucug

SEQ ID NO: 1385408 - RNA, 17 nt, Neisseria meningitidis Z2491
ggaaugacgaaagguug

SEQ ID NO: 1385409 - RNA, 23 nt, Neisseria meningitidis Z2491
ggaaugacgcggaaaaguugcug

SEQ ID NO: 1385410 - RNA, 19 nt, Neisseria meningitidis Z2491
ggaaugacggaauguaggu

SEQ ID NO: 1385411 - RNA, 12 nt, Neisseria meningitidis Z2491
ggaaucuagaaa

SEQ ID NO: 1385412 - RNA, 12 nt, Neisseria meningitidis Z2491
ggaaucuagaac

SEQ ID NO: 1385413 - RNA, 12 nt, Neisseria meningitidis Z2491
ggaaucuagaau

SEQ ID NO: 1385414 - RNA, 14 nt, Neisseria meningitidis Z2491
ggaaucuagacauu

SEQ ID NO: 1385415 - RNA, 23 nt, Neisseria meningitidis Z2491
ggaaucuagacauucaaugcuaa

SEQ ID NO: 1385416 - RNA, 17 nt, Neisseria meningitidis Z2491
ggaaucuagaccugucg

SEQ ID NO: 1385417 - RNA, 19 nt, Neisseria meningitidis Z2491
ggacaaaguuggcaaggaa

SEQ ID NO: 1385418 - RNA, 11 nt, Neisseria meningitidis Z2491
ggacaaaugcc

SEQ ID NO: 1385419 - RNA, 14 nt, Neisseria meningitidis Z2491
ggacaacggcacug

SEQ ID NO: 1385420 - RNA, 22 nt, Neisseria meningitidis Z2491
ggaaguaaccccuuccaaauca

SEQ ID NO: 1385421 - RNA, 13 nt, Neisseria meningitidis Z2491
ggaagugggaauc

SEQ ID NO: 1385422 - RNA, 12 nt, Neisseria meningitidis Z2491
ggacaagggaaa

SEQ ID NO: 1385423 - RNA, 22 nt, Neisseria meningitidis Z2491
ggacagcggcaauauucaaaga

SEQ ID NO: 1385424 - RNA, 19 nt, Neisseria meningitidis Z2491
ggacagcguaacuuccgaa

SEQ ID NO: 1385425 - RNA, 14 nt, Neisseria meningitidis Z2491
ggcaguugggaauc

SEQ ID NO: 1385426 - RNA, 18 nt, Neisseria meningitidis Z2491
ggcagguaaaaaauagaa

SEQ ID NO: 1385427 - RNA, 16 nt, Neisseria meningitidis Z2491
ggcaggucuucgggca

SEQ ID NO: 1385428 - RNA, 17 nt, Neisseria meningitidis Z2491
ggcacuuugcggcagau

SEQ ID NO: 1385429 - RNA, 18 nt, Neisseria meningitidis Z2491
ggcacuugccgcauaaau

SEQ ID NO: 1385430 - RNA, 14 nt, Neisseria meningitidis Z2491
ggcauugaaauucc

SEQ ID NO: 1385431 - RNA, 23 nt, Neisseria meningitidis Z2491
ggcaucugcugcgucaaaccagc

SEQ ID NO: 1385432 - RNA, 20 nt, Neisseria meningitidis Z2491
ggcauuuuuuuaccaaagca

SEQ ID NO: 1385433 - RNA, 19 nt, Neisseria meningitidis Z2491
ggcauuuucaacagcagga

SEQ ID NO: 1385434 - RNA, 14 nt, Neisseria meningitidis Z2491
ggcauuuugcugcc

SEQ ID NO: 1385435 - RNA, 19 nt, Neisseria meningitidis Z2491
ggcauuuugucauuuggaa

SEQ ID NO: 1385436 - RNA, 15 nt, Neisseria meningitidis Z2491
ggcauuuuguuugcg

SEQ ID NO: 1385437 - RNA, 16 nt, Neisseria meningitidis Z2491
ggcauuuuagauuugg

SEQ ID NO: 1385438 - RNA, 14 nt, Neisseria meningitidis Z2491
ggccaauuugcuuu

SEQ ID NO: 1385439 - RNA, 22 nt, Neisseria meningitidis Z2491
ggccggaaaccguauauuuccc

SEQ ID NO: 1385440 - RNA, 14 nt, Neisseria meningitidis Z2491
ggcgcaaaccuuaa

SEQ ID NO: 1385441 - RNA, 20 nt, Neisseria meningitidis Z2491
ggcgauuaucgggaaaaaua

SEQ ID NO: 1385442 - RNA, 15 nt, Neisseria meningitidis Z2491
ggcgauggcgcggcg

SEQ ID NO: 1385443 - RNA, 17 nt, Neisseria meningitidis Z2491
ggcgauggcgcggcgca

SEQ ID NO: 1385444 - RNA, 22 nt, Neisseria meningitidis Z2491
ggcgaguccgcgcgaauagcug

SEQ ID NO: 1385445 - RNA, 14 nt, Neisseria meningitidis Z2491
ggcgauaugcuuca

SEQ ID NO: 1385446 - RNA, 14 nt, Neisseria meningitidis Z2491
ggcgcaccccgaca

SEQ ID NO: 1385447 - RNA, 12 nt, Neisseria meningitidis Z2491
ggcgccggcggc

SEQ ID NO: 1385448 - RNA, 21 nt, Neisseria meningitidis Z2491
ggccugcccugccaaaacuca

SEQ ID NO: 1385449 - RNA, 22 nt, Neisseria meningitidis Z2491
ggcgaggaagaugucgggggcg

SEQ ID NO: 1385450 - RNA, 13 nt, Neisseria meningitidis Z2491
ggcgaccgccugc

SEQ ID NO: 1385451 - RNA, 16 nt, Neisseria meningitidis Z2491
ggcgacgaagccgcag

SEQ ID NO: 1385452 - RNA, 16 nt, Neisseria meningitidis Z2491
ggcgaagccggcggcg

SEQ ID NO: 1385453 - RNA, 16 nt, Neisseria meningitidis Z2491
ggccuuuggcggcggc

SEQ ID NO: 1385454 - RNA, 17 nt, Neisseria meningitidis Z2491
ggcguuuuucagacggc

SEQ ID NO: 1385455 - RNA, 21 nt, Neisseria meningitidis Z2491
ggcguuuuuguuuuauauucu

SEQ ID NO: 1385456 - RNA, 19 nt, Neisseria meningitidis Z2491
ggcguugguugaacguuug

SEQ ID NO: 1385457 - RNA, 13 nt, Neisseria meningitidis Z2491
ggcguucaaauca

SEQ ID NO: 1385458 - RNA, 18 nt, Neisseria meningitidis Z2491
ggcguucaacauccgcag

SEQ ID NO: 1385459 - RNA, 20 nt, Neisseria meningitidis Z2491
ggcgugcgcgcccagaggga

SEQ ID NO: 1385460 - RNA, 14 nt, Neisseria meningitidis Z2491
ggcguggcuggauu

SEQ ID NO: 1385461 - RNA, 17 nt, Neisseria meningitidis Z2491
ggcgguuugcggcggca

SEQ ID NO: 1385462 - RNA, 15 nt, Neisseria meningitidis Z2491
ggcguaggcggcggc

SEQ ID NO: 1385463 - RNA, 16 nt, Neisseria meningitidis Z2491
ggcguaggcggcggcc

SEQ ID NO: 1385464 - RNA, 19 nt, Neisseria meningitidis Z2491
ggcguauaaagauacaaga

SEQ ID NO: 1385465 - RNA, 22 nt, Neisseria meningitidis Z2491
ggcguaggucagcccggcggug

SEQ ID NO: 1385466 - RNA, 18 nt, Neisseria meningitidis Z2491
ggcgggcguuccacaaau

SEQ ID NO: 1385467 - RNA, 23 nt, Neisseria meningitidis Z2491
ggcgggaauccagaaaguggaau

SEQ ID NO: 1385468 - RNA, 16 nt, Neisseria meningitidis Z2491
ggcgggaaucuagaca

SEQ ID NO: 1385469 - RNA, 15 nt, Neisseria meningitidis Z2491
ggcgguaucaggcag

SEQ ID NO: 1385470 - RNA, 16 nt, Neisseria meningitidis Z2491
ggcgguagccguagcg

SEQ ID NO: 1385471 - RNA, 13 nt, Neisseria meningitidis Z2491
ggcgcgguuggcg

SEQ ID NO: 1385472 - RNA, 16 nt, Neisseria meningitidis Z2491
ggcgcgguuggcggcg

SEQ ID NO: 1385473 - RNA, 19 nt, Neisseria meningitidis Z2491
ggcgcgguuggcggcggcg

SEQ ID NO: 1385474 - RNA, 17 nt, Neisseria meningitidis Z2491
ggcgcguaucggcggca

SEQ ID NO: 1385475 - RNA, 17 nt, Neisseria meningitidis Z2491
ggcgcggcugccgaccg

SEQ ID NO: 1385476 - RNA, 11 nt, Neisseria meningitidis Z2491
ggcgcggcugg

SEQ ID NO: 1385477 - RNA, 12 nt, Neisseria meningitidis Z2491
ggcggcggcaga

SEQ ID NO: 1385478 - RNA, 13 nt, Neisseria meningitidis Z2491
ggcggcggcagcg

SEQ ID NO: 1385479 - RNA, 16 nt, Neisseria meningitidis Z2491
ggcggcggcgaggaag

SEQ ID NO: 1385480 - RNA, 19 nt, Neisseria meningitidis Z2491
ggcggcgagcaggguuugc

SEQ ID NO: 1385481 - RNA, 13 nt, Neisseria meningitidis Z2491
ggcggcgagccgc

SEQ ID NO: 1385482 - RNA, 14 nt, Neisseria meningitidis Z2491
ggcggcgagccgca

SEQ ID NO: 1385483 - RNA, 22 nt, Neisseria meningitidis Z2491
ggcggacugcuguugcaaagcc

SEQ ID NO: 1385484 - RNA, 18 nt, Neisseria meningitidis Z2491
ggcggacauaaaccguuu

SEQ ID NO: 1385485 - RNA, 19 nt, Neisseria meningitidis Z2491
ggcggauuaaaauaaaaau

SEQ ID NO: 1385486 - RNA, 23 nt, Neisseria meningitidis Z2491
gucaugcaccugcauaaucaguu

SEQ ID NO: 1385487 - RNA, 16 nt, Neisseria meningitidis Z2491
gucagcgugcgcguga

SEQ ID NO: 1385488 - RNA, 11 nt, Neisseria meningitidis Z2491
gucaggcugcc

SEQ ID NO: 1385489 - RNA, 16 nt, Neisseria meningitidis Z2491
gucaaccaaaaaaucu

SEQ ID NO: 1385490 - RNA, 16 nt, Neisseria meningitidis Z2491
gucaagcaaaaaaugc

SEQ ID NO: 1385491 - RNA, 15 nt, Neisseria meningitidis Z2491
guccguuugcggguu

SEQ ID NO: 1385492 - RNA, 19 nt, Neisseria meningitidis Z2491
guccugccugcgcgagaau

SEQ ID NO: 1385493 - RNA, 14 nt, Neisseria meningitidis Z2491
guccugauuuaaau

SEQ ID NO: 1385494 - RNA, 12 nt, Neisseria meningitidis Z2491
guccugauuuuu

SEQ ID NO: 1385495 - RNA, 24 nt, Neisseria meningitidis Z2491
guccggcagccugcucgagcggca

SEQ ID NO: 1385496 - RNA, 20 nt, Neisseria meningitidis Z2491
guccggcauaaauccuucac

SEQ ID NO: 1385497 - RNA, 16 nt, Neisseria meningitidis Z2491
guccggcaugauuuuc

SEQ ID NO: 1385498 - RNA, 14 nt, Neisseria meningitidis Z2491
guccggcaaacauc

SEQ ID NO: 1385499 - RNA, 15 nt, Neisseria meningitidis Z2491
guccgccauuuccaa

SEQ ID NO: 1385500 - RNA, 17 nt, Neisseria meningitidis Z2491
guccgccauuuccaaac

SEQ ID NO: 1385501 - RNA, 16 nt, Neisseria meningitidis Z2491
guccgcacccgcaacc

SEQ ID NO: 1385502 - RNA, 20 nt, Neisseria meningitidis Z2491
guccaucggcgcgccgcugu

SEQ ID NO: 1385503 - RNA, 13 nt, Neisseria meningitidis Z2491
gucauucccacga

SEQ ID NO: 1385504 - RNA, 21 nt, Neisseria meningitidis Z2491
gucauucccacgaaaguggga

SEQ ID NO: 1385505 - RNA, 19 nt, Neisseria meningitidis Z2491
gucauuccuguaaaaacaa

SEQ ID NO: 1385506 - RNA, 15 nt, Neisseria meningitidis Z2491
gucauucccgcaaaa

SEQ ID NO: 1385507 - RNA, 19 nt, Neisseria meningitidis Z2491
gucauucccgcaaaaacaa

SEQ ID NO: 1385508 - RNA, 16 nt, Neisseria meningitidis Z2491
gucauucccgcaaaag

SEQ ID NO: 1385509 - RNA, 15 nt, Neisseria meningitidis Z2491
gucauucccgcaacu

SEQ ID NO: 1385510 - RNA, 21 nt, Neisseria meningitidis Z2491
gucauucccgccacuuuccgu

SEQ ID NO: 1385511 - RNA, 19 nt, Neisseria meningitidis Z2491
gucauucccgcgaaagagg

SEQ ID NO: 1385512 - RNA, 22 nt, Neisseria meningitidis Z2491
gucauuccuacgaaaacagaaa

SEQ ID NO: 1385513 - RNA, 19 nt, Neisseria meningitidis Z2491
gucauuuccgauaaauucc

SEQ ID NO: 1385514 - RNA, 18 nt, Neisseria meningitidis Z2491
gucgcacauuuuuuucau

SEQ ID NO: 1385515 - RNA, 16 nt, Neisseria meningitidis Z2491
gucgaggguuucuguu

SEQ ID NO: 1385516 - RNA, 19 nt, Neisseria meningitidis Z2491
gucgaggaaccagcggucg

SEQ ID NO: 1385517 - RNA, 22 nt, Neisseria meningitidis Z2491
guccuuccaucacguuuuccaa

SEQ ID NO: 1385518 - RNA, 20 nt, Neisseria meningitidis Z2491
gucgccuuccgcuucuucca

SEQ ID NO: 1385519 - RNA, 23 nt, Neisseria meningitidis Z2491
gucgcccaagccgacuuuuucca

SEQ ID NO: 1385520 - RNA, 17 nt, Neisseria meningitidis Z2491
gucgccgagcagauuga

SEQ ID NO: 1385521 - RNA, 17 nt, Neisseria meningitidis Z2491
guagcgugggucggguu

SEQ ID NO: 1385522 - RNA, 15 nt, Neisseria meningitidis Z2491
guaggcuuuuuccaa

SEQ ID NO: 1385523 - RNA, 22 nt, Neisseria meningitidis Z2491
guaggcguugcccaagucguau

SEQ ID NO: 1385524 - RNA, 22 nt, Neisseria meningitidis Z2491
guaggcggcggcgguuuccugc

SEQ ID NO: 1385525 - RNA, 13 nt, Neisseria meningitidis Z2491
guacuauuuacac

SEQ ID NO: 1385526 - RNA, 18 nt, Neisseria meningitidis Z2491
guacuauuuguacugucu

SEQ ID NO: 1385527 - RNA, 16 nt, Neisseria meningitidis Z2491
guacugucugcagcuu

SEQ ID NO: 1385528 - RNA, 19 nt, Neisseria meningitidis Z2491
guacugguuuaaauuuagu

SEQ ID NO: 1385529 - RNA, 14 nt, Neisseria meningitidis Z2491
guacugguuuuugu

SEQ ID NO: 1385530 - RNA, 15 nt, Neisseria meningitidis Z2491
guaccgcaucuucaa

SEQ ID NO: 1385531 - RNA, 20 nt, Neisseria meningitidis Z2491
guaccggcaaugaaaaccga

SEQ ID NO: 1385532 - RNA, 19 nt, Neisseria meningitidis Z2491
guaccgacggguuugcuuu

SEQ ID NO: 1385533 - RNA, 21 nt, Neisseria meningitidis Z2491
guaccgcagccuauuauuuuc

SEQ ID NO: 1385534 - RNA, 21 nt, Neisseria meningitidis Z2491
guacauuuugguuguucagaa

SEQ ID NO: 1385535 - RNA, 18 nt, Neisseria meningitidis Z2491
guaccaaccguccacaca

SEQ ID NO: 1385536 - RNA, 19 nt, Neisseria meningitidis Z2491
guaaaaucaaguuuauccu

SEQ ID NO: 1385537 - RNA, 15 nt, Neisseria meningitidis Z2491
ggugugcaggcugcc

SEQ ID NO: 1385538 - RNA, 19 nt, Neisseria meningitidis Z2491
ggugugcauccgacaggca

SEQ ID NO: 1385539 - RNA, 17 nt, Neisseria meningitidis Z2491
guaaagcgugcggcggu

SEQ ID NO: 1385540 - RNA, 19 nt, Neisseria meningitidis Z2491
guaaagugcggugaaaucu

SEQ ID NO: 1385541 - RNA, 20 nt, Neisseria meningitidis Z2491
guaacuuuugagccgucauu

SEQ ID NO: 1385542 - RNA, 18 nt, Neisseria meningitidis Z2491
guaagccuucauccgcaa

SEQ ID NO: 1385543 - RNA, 17 nt, Neisseria meningitidis Z2491
guaauauucaaagguua

SEQ ID NO: 1385544 - RNA, 15 nt, Neisseria meningitidis Z2491
ggugaaaaaugaaaa

SEQ ID NO: 1385545 - RNA, 16 nt, Neisseria meningitidis Z2491
ggucuucgacgaaggc

SEQ ID NO: 1385546 - RNA, 17 nt, Neisseria meningitidis Z2491
ggugaacacuucuucgg

SEQ ID NO: 1385547 - RNA, 16 nt, Neisseria meningitidis Z2491
ggucgccgauuucgag

SEQ ID NO: 1385548 - RNA, 16 nt, Neisseria meningitidis Z2491
ggucgcaucggcggcg

SEQ ID NO: 1385549 - RNA, 17 nt, Neisseria meningitidis Z2491
ggugcgguaagggcgca

SEQ ID NO: 1385550 - RNA, 17 nt, Neisseria meningitidis Z2491
ggugcguuuuauuggag

SEQ ID NO: 1385551 - RNA, 14 nt, Neisseria meningitidis Z2491
gguguccguggagg

SEQ ID NO: 1385552 - RNA, 20 nt, Neisseria meningitidis Z2491
gguacagcguuggcucgccu

SEQ ID NO: 1385553 - RNA, 13 nt, Neisseria meningitidis Z2491
gguagagaaaauu

SEQ ID NO: 1385554 - RNA, 22 nt, Neisseria meningitidis Z2491
gguagagcgcaaccuugccaag

SEQ ID NO: 1385555 - RNA, 16 nt, Neisseria meningitidis Z2491
gguaacuuccaaaccg

SEQ ID NO: 1385556 - RNA, 19 nt, Neisseria meningitidis Z2491
gguaacuucgccuuugaaa

SEQ ID NO: 1385557 - RNA, 14 nt, Neisseria meningitidis Z2491
gguaaaaauggaaa

SEQ ID NO: 1385558 - RNA, 23 nt, Neisseria meningitidis Z2491
gguaaagugcggugaaaucuuau

SEQ ID NO: 1385559 - RNA, 18 nt, Neisseria meningitidis Z2491
gguaaagauguagaccca

SEQ ID NO: 1385560 - RNA, 13 nt, Neisseria meningitidis Z2491
gguaaaaaaaugc

SEQ ID NO: 1385561 - RNA, 21 nt, Neisseria meningitidis Z2491
ggguuucuguuucgguuuucu

SEQ ID NO: 1385562 - RNA, 18 nt, Neisseria meningitidis Z2491
ggguuguucgugccggca

SEQ ID NO: 1385563 - RNA, 15 nt, Neisseria meningitidis Z2491
ggguugaagaaaccg

SEQ ID NO: 1385564 - RNA, 14 nt, Neisseria meningitidis Z2491
ggguucggacggcg

SEQ ID NO: 1385565 - RNA, 20 nt, Neisseria meningitidis Z2491
ggguucuguaucauacagaa

SEQ ID NO: 1385566 - RNA, 21 nt, Neisseria meningitidis Z2491
ggguggcgaagccggcggcga

SEQ ID NO: 1385567 - RNA, 21 nt, Neisseria meningitidis Z2491
ggggaauuaugaugcggacgg

SEQ ID NO: 1385568 - RNA, 23 nt, Neisseria meningitidis Z2491
gggcauccauaaucaaaaccagc

SEQ ID NO: 1385569 - RNA, 20 nt, Neisseria meningitidis Z2491
gggcagugggauuuugguuu

SEQ ID NO: 1385570 - RNA, 19 nt, Neisseria meningitidis Z2491
gggcagguuuugguacacg

SEQ ID NO: 1385571 - RNA, 21 nt, Neisseria meningitidis Z2491
gggcaggcggcugcgggcgcg

SEQ ID NO: 1385572 - RNA, 20 nt, Neisseria meningitidis Z2491
gggcauuguuaaguauuucu

SEQ ID NO: 1385573 - RNA, 18 nt, Neisseria meningitidis Z2491
gggaaagguucagcagga

SEQ ID NO: 1385574 - RNA, 14 nt, Neisseria meningitidis Z2491
gggaaagcagcagc

SEQ ID NO: 1385575 - RNA, 14 nt, Neisseria meningitidis Z2491
gggaaauaaaacaa

SEQ ID NO: 1385576 - RNA, 23 nt, Neisseria meningitidis Z2491
gggcgaaaauagacgaaaaccug

SEQ ID NO: 1385577 - RNA, 20 nt, Neisseria meningitidis Z2491
ggggaaaccaacaggcgggc

SEQ ID NO: 1385578 - RNA, 13 nt, Neisseria meningitidis Z2491
gggcugcggucgg

SEQ ID NO: 1385579 - RNA, 18 nt, Neisseria meningitidis Z2491
gggcugcgucgcgggcgg

SEQ ID NO: 1385580 - RNA, 23 nt, Neisseria meningitidis Z2491
gggcgugccaauucaaaaaccug

SEQ ID NO: 1385581 - RNA, 19 nt, Neisseria meningitidis Z2491
gggcgugccgaugaguccg

SEQ ID NO: 1385582 - RNA, 18 nt, Neisseria meningitidis Z2491
gggcgguuugcggcggca

SEQ ID NO: 1385583 - RNA, 19 nt, Neisseria meningitidis Z2491
gggcgcgguuggcggcggc

SEQ ID NO: 1385584 - RNA, 12 nt, Neisseria meningitidis Z2491
ggcuuuuuccug

SEQ ID NO: 1385585 - RNA, 18 nt, Neisseria meningitidis Z2491
gggaaaauacggacggga

SEQ ID NO: 1385586 - RNA, 19 nt, Neisseria meningitidis Z2491
ggcuucgucgccuuguccu

SEQ ID NO: 1385587 - RNA, 15 nt, Neisseria meningitidis Z2491
ggcuugggcgacggc

SEQ ID NO: 1385588 - RNA, 16 nt, Neisseria meningitidis Z2491
ggcuugggcgacggcg

SEQ ID NO: 1385589 - RNA, 16 nt, Neisseria meningitidis Z2491
ggcuugguuuugcuuc

SEQ ID NO: 1385590 - RNA, 14 nt, Neisseria meningitidis Z2491
ggcuuaaaccuuau

SEQ ID NO: 1385591 - RNA, 16 nt, Neisseria meningitidis Z2491
ggcuuaaaccuuaucc

SEQ ID NO: 1385592 - RNA, 17 nt, Neisseria meningitidis Z2491
ggcuguucgccgacauc

SEQ ID NO: 1385593 - RNA, 16 nt, Neisseria meningitidis Z2491
ggcuggggauguuuug

SEQ ID NO: 1385594 - RNA, 22 nt, Neisseria meningitidis Z2491
ggcuguaugccgucugaaaccu

SEQ ID NO: 1385595 - RNA, 23 nt, Neisseria meningitidis Z2491
ggcuguaugccgucugaaaccug

SEQ ID NO: 1385596 - RNA, 19 nt, Neisseria meningitidis Z2491
ggcugcuuuuuaggcggca

SEQ ID NO: 1385597 - RNA, 20 nt, Neisseria meningitidis Z2491
ggcugcuuugguaaaaaaau

SEQ ID NO: 1385598 - RNA, 12 nt, Neisseria meningitidis Z2491
ggcugcccugcu

SEQ ID NO: 1385599 - RNA, 16 nt, Neisseria meningitidis Z2491
ggcugcgucgcgggcg

SEQ ID NO: 1385600 - RNA, 13 nt, Neisseria meningitidis Z2491
ggcugaaauagaa

SEQ ID NO: 1385601 - RNA, 13 nt, Neisseria meningitidis Z2491
ggcucucaaaaua

SEQ ID NO: 1385602 - RNA, 15 nt, Neisseria meningitidis Z2491
ggcugaaaaaaugcc

SEQ ID NO: 1385603 - RNA, 20 nt, Neisseria meningitidis Z2491
ggcuccuucgggcgcuugga

SEQ ID NO: 1385604 - RNA, 17 nt, Neisseria meningitidis Z2491
ggcucaaugaaaauuug

SEQ ID NO: 1385605 - RNA, 14 nt, Neisseria meningitidis Z2491
uaauccacuauaau

SEQ ID NO: 1385606 - RNA, 20 nt, Neisseria meningitidis Z2491
uaauccacuauaauacaaaa

SEQ ID NO: 1385607 - RNA, 23 nt, Neisseria meningitidis Z2491
uaaucauaauaggcuguuugcga

SEQ ID NO: 1385608 - RNA, 20 nt, Neisseria meningitidis Z2491
uaaucaauuaaaaacaaaau

SEQ ID NO: 1385609 - RNA, 12 nt, Neisseria meningitidis Z2491
uaaucaaacuca

SEQ ID NO: 1385610 - RNA, 15 nt, Neisseria meningitidis Z2491
uaaucaaaaccagcc

SEQ ID NO: 1385611 - RNA, 19 nt, Neisseria meningitidis Z2491
uaaucuccuuuuuuuucua

SEQ ID NO: 1385612 - RNA, 23 nt, Neisseria meningitidis Z2491
uaaucuaguacagccccuuaaag

SEQ ID NO: 1385613 - RNA, 21 nt, Neisseria meningitidis Z2491
uaaucuuugaauauuacuguu

SEQ ID NO: 1385614 - RNA, 21 nt, Neisseria meningitidis Z2491
uaaucuuugaauauugcuguu

SEQ ID NO: 1385615 - RNA, 21 nt, Neisseria meningitidis Z2491
uaaggcuuauuucacuuccaa

SEQ ID NO: 1385616 - RNA, 22 nt, Neisseria meningitidis Z2491
uaaggcuuauuucacuuccaac

SEQ ID NO: 1385617 - RNA, 20 nt, Neisseria meningitidis Z2491
uaaggcauacggggaggaaa

SEQ ID NO: 1385618 - RNA, 12 nt, Neisseria meningitidis Z2491
uaaggcaauuua

SEQ ID NO: 1385619 - RNA, 19 nt, Neisseria meningitidis Z2491
uaaggcagagauaaaagca

SEQ ID NO: 1385620 - RNA, 19 nt, Neisseria meningitidis Z2491
uaaggucuagauucccgcc

SEQ ID NO: 1385621 - RNA, 16 nt, Neisseria meningitidis Z2491
uaaguguuggacaaau

SEQ ID NO: 1385622 - RNA, 17 nt, Neisseria meningitidis Z2491
uaagugaguaaaaacaa

SEQ ID NO: 1385623 - RNA, 13 nt, Neisseria meningitidis Z2491
uaaguuggguuau

SEQ ID NO: 1385624 - RNA, 17 nt, Neisseria meningitidis Z2491
uaaguguuuucaagaac

SEQ ID NO: 1385625 - RNA, 16 nt, Neisseria meningitidis Z2491
uaauacaaaaaugccg

SEQ ID NO: 1385626 - RNA, 17 nt, Neisseria meningitidis Z2491
uaauacguuuuucucgu

SEQ ID NO: 1385627 - RNA, 19 nt, Neisseria meningitidis Z2491
uacgcucggcguuuuucag

SEQ ID NO: 1385628 - RNA, 16 nt, Neisseria meningitidis Z2491
uacguggccuuuucuu

SEQ ID NO: 1385629 - RNA, 20 nt, Neisseria meningitidis Z2491
uacuacgcggcugaaaaaau

SEQ ID NO: 1385630 - RNA, 20 nt, Neisseria meningitidis Z2491
uacgcccacaaauccugcug

SEQ ID NO: 1385631 - RNA, 21 nt, Neisseria meningitidis Z2491
uacgcaaacuaacuuauacac

SEQ ID NO: 1385632 - RNA, 13 nt, Neisseria meningitidis Z2491
uaccaucuucuuc

SEQ ID NO: 1385633 - RNA, 15 nt, Neisseria meningitidis Z2491
uaccaucuucuucaa

SEQ ID NO: 1385634 - RNA, 17 nt, Neisseria meningitidis Z2491
uaccauaaauuuuaaau

SEQ ID NO: 1385635 - RNA, 14 nt, Neisseria meningitidis Z2491
uaccccacugccag

SEQ ID NO: 1385636 - RNA, 15 nt, Neisseria meningitidis Z2491
uaccucgccuugccg

SEQ ID NO: 1385637 - RNA, 23 nt, Neisseria meningitidis Z2491
uaccuccuaauucuacccaaaua

SEQ ID NO: 1385638 - RNA, 17 nt, Neisseria meningitidis Z2491
uaccugccguauuuauu

SEQ ID NO: 1385639 - RNA, 19 nt, Neisseria meningitidis Z2491
uaccugcccgacugugccc

SEQ ID NO: 1385640 - RNA, 23 nt, Neisseria meningitidis Z2491
uaccgagccuaaugcuuucgcuu

SEQ ID NO: 1385641 - RNA, 14 nt, Neisseria meningitidis Z2491
uaccgauacauccg

SEQ ID NO: 1385642 - RNA, 15 nt, Neisseria meningitidis Z2491
uaccguuauucugcc

SEQ ID NO: 1385643 - RNA, 20 nt, Neisseria meningitidis Z2491
uaccguuauucugccguggg

SEQ ID NO: 1385644 - RNA, 13 nt, Neisseria meningitidis Z2491
uaccgucugaaac

SEQ ID NO: 1385645 - RNA, 14 nt, Neisseria meningitidis Z2491
uaccgucugaaacc

SEQ ID NO: 1385646 - RNA, 15 nt, Neisseria meningitidis Z2491
uaccgucugaacacg

SEQ ID NO: 1385647 - RNA, 14 nt, Neisseria meningitidis Z2491
uaccaacugagcua

SEQ ID NO: 1385648 - RNA, 23 nt, Neisseria meningitidis Z2491
uaccaaauuauugccagcauuaa

SEQ ID NO: 1385649 - RNA, 16 nt, Neisseria meningitidis Z2491
uaccaaacggcauauc

SEQ ID NO: 1385650 - RNA, 17 nt, Neisseria meningitidis Z2491
uacauuuuugauauuuu

SEQ ID NO: 1385651 - RNA, 19 nt, Neisseria meningitidis Z2491
uacagcggauuaaaauauc

SEQ ID NO: 1385652 - RNA, 20 nt, Neisseria meningitidis Z2491
uacauaggguuaauaucaga

SEQ ID NO: 1385653 - RNA, 14 nt, Neisseria meningitidis Z2491
uacauccaauaauc

SEQ ID NO: 1385654 - RNA, 22 nt, Neisseria meningitidis Z2491
uacaucaggcggcguucuucuu

SEQ ID NO: 1385655 - RNA, 12 nt, Neisseria meningitidis Z2491
uacaaauucacg

SEQ ID NO: 1385656 - RNA, 14 nt, Neisseria meningitidis Z2491
uacacaauucccac

SEQ ID NO: 1385657 - RNA, 15 nt, Neisseria meningitidis Z2491
uacacaauucccacc

SEQ ID NO: 1385658 - RNA, 14 nt, Neisseria meningitidis Z2491
uagaagccaaaaua

SEQ ID NO: 1385659 - RNA, 16 nt, Neisseria meningitidis Z2491
uagaagccaaaauauc

SEQ ID NO: 1385660 - RNA, 20 nt, Neisseria meningitidis Z2491
uagaacguggaaucuaaaga

SEQ ID NO: 1385661 - RNA, 18 nt, Neisseria meningitidis Z2491
uagaaccucuaaacuuuc

SEQ ID NO: 1385662 - RNA, 20 nt, Neisseria meningitidis Z2491
uagaauuuauacccucucaa

SEQ ID NO: 1385663 - RNA, 13 nt, Neisseria meningitidis Z2491
uagaaucuuuccg

SEQ ID NO: 1385664 - RNA, 14 nt, Neisseria meningitidis Z2491
uacuaucuguacug

SEQ ID NO: 1385665 - RNA, 11 nt, Neisseria meningitidis Z2491
uagaaaaugcc

SEQ ID NO: 1385666 - RNA, 23 nt, Neisseria meningitidis Z2491
uagaaaugacugaaacucaaaaa

SEQ ID NO: 1385667 - RNA, 18 nt, Neisseria meningitidis Z2491
uagaaacucaaagcugca

SEQ ID NO: 1385668 - RNA, 23 nt, Neisseria meningitidis Z2491
uagagugaccgcgaacaucaucu

SEQ ID NO: 1385669 - RNA, 16 nt, Neisseria meningitidis Z2491
uagacggcauuucauu

SEQ ID NO: 1385670 - RNA, 18 nt, Neisseria meningitidis Z2491
uagagaaucguucucuuu

SEQ ID NO: 1385671 - RNA, 15 nt, Neisseria meningitidis Z2491
uagacauucaaugcu

SEQ ID NO: 1385672 - RNA, 14 nt, Neisseria meningitidis Z2491
uaggauaggcugcu

SEQ ID NO: 1385673 - RNA, 14 nt, Neisseria meningitidis Z2491
uagggguuucagac

SEQ ID NO: 1385674 - RNA, 18 nt, Neisseria meningitidis Z2491
uaggguuaauaucagauu

SEQ ID NO: 1385675 - RNA, 17 nt, Neisseria meningitidis Z2491
uagggaaauucaaauua

SEQ ID NO: 1385676 - RNA, 22 nt, Neisseria meningitidis Z2491
uagcucaguugguagagcgcaa

SEQ ID NO: 1385677 - RNA, 20 nt, Neisseria meningitidis Z2491
uagcauauaacaccuuucaa

SEQ ID NO: 1385678 - RNA, 12 nt, Neisseria meningitidis Z2491
uagccaaaaaaa

SEQ ID NO: 1385679 - RNA, 15 nt, Neisseria meningitidis Z2491
uagccaaaaaaaccg

SEQ ID NO: 1385680 - RNA, 24 nt, Neisseria meningitidis Z2491
uagccaaaaaaaccgaaaccgaac

SEQ ID NO: 1385681 - RNA, 19 nt, Neisseria meningitidis Z2491
uagccggccaacaucagca

SEQ ID NO: 1385682 - RNA, 17 nt, Neisseria meningitidis Z2491
uagccgucgccccaaaa

SEQ ID NO: 1385683 - RNA, 16 nt, Neisseria meningitidis Z2491
uaucuguacugucugc

SEQ ID NO: 1385684 - RNA, 16 nt, Neisseria meningitidis Z2491
uaucccuuaagaaucg

SEQ ID NO: 1385685 - RNA, 19 nt, Neisseria meningitidis Z2491
uauccgcacacgaacugcc

SEQ ID NO: 1385686 - RNA, 14 nt, Neisseria meningitidis Z2491
uauccgcacagaaa

SEQ ID NO: 1385687 - RNA, 20 nt, Neisseria meningitidis Z2491
uaucaucagauugauaaaag

SEQ ID NO: 1385688 - RNA, 21 nt, Neisseria meningitidis Z2491
uauauaguggauuaaauuuaa

SEQ ID NO: 1385689 - RNA, 16 nt, Neisseria meningitidis Z2491
uauaugaguguaucgg

SEQ ID NO: 1385690 - RNA, 15 nt, Neisseria meningitidis Z2491
uauauucugauuuau

SEQ ID NO: 1385691 - RNA, 17 nt, Neisseria meningitidis Z2491
uauauucgaccagcucc

SEQ ID NO: 1385692 - RNA, 21 nt, Neisseria meningitidis Z2491
uaucagggcugcaaaauuuau

SEQ ID NO: 1385693 - RNA, 14 nt, Neisseria meningitidis Z2491
uaucaguauuuucu

SEQ ID NO: 1385694 - RNA, 15 nt, Neisseria meningitidis Z2491
uaucaguauuuucua

SEQ ID NO: 1385695 - RNA, 19 nt, Neisseria meningitidis Z2491
uaucauacauagcaggcau

SEQ ID NO: 1385696 - RNA, 19 nt, Neisseria meningitidis Z2491
uaucauaaaaucuauuauu

SEQ ID NO: 1385697 - RNA, 13 nt, Neisseria meningitidis Z2491
uauacuggcaaau

SEQ ID NO: 1385698 - RNA, 23 nt, Neisseria meningitidis Z2491
uauacuggcaaauugaaaugccg

SEQ ID NO: 1385699 - RNA, 19 nt, Neisseria meningitidis Z2491
uauacacacgguuuucaca

SEQ ID NO: 1385700 - RNA, 20 nt, Neisseria meningitidis Z2491
uauacacacgguuuucacau

SEQ ID NO: 1385701 - RNA, 17 nt, Neisseria meningitidis Z2491
uagucuuuuuuauucaa

SEQ ID NO: 1385702 - RNA, 15 nt, Neisseria meningitidis Z2491
uagguauuuugcgcc

SEQ ID NO: 1385703 - RNA, 14 nt, Neisseria meningitidis Z2491
uaguggauuaaauu

SEQ ID NO: 1385704 - RNA, 18 nt, Neisseria meningitidis Z2491
uaguggauuaaauuuaaa

SEQ ID NO: 1385705 - RNA, 23 nt, Neisseria meningitidis Z2491
uaguggauuaaauuuaaaccagu

SEQ ID NO: 1385706 - RNA, 17 nt, Neisseria meningitidis Z2491
uaguggauuaaauuuau

SEQ ID NO: 1385707 - RNA, 15 nt, Neisseria meningitidis Z2491
uaguggauuaacaaa

SEQ ID NO: 1385708 - RNA, 22 nt, Neisseria meningitidis Z2491
uaguggauuaacaaaaaucagg

SEQ ID NO: 1385709 - RNA, 21 nt, Neisseria meningitidis Z2491
uaguuuccggcaagcagggcu

SEQ ID NO: 1385710 - RNA, 14 nt, Neisseria meningitidis Z2491
uauaaaauuggaaa

SEQ ID NO: 1385711 - RNA, 15 nt, Neisseria meningitidis Z2491
uauaaaauuggaaau

SEQ ID NO: 1385712 - RNA, 15 nt, Neisseria meningitidis Z2491
uauaaacaaaaaaca

SEQ ID NO: 1385713 - RNA, 16 nt, Neisseria meningitidis Z2491
uaagcaaucaucucuu

SEQ ID NO: 1385714 - RNA, 16 nt, Neisseria meningitidis Z2491
uaagauguuuuuccac

SEQ ID NO: 1385715 - RNA, 18 nt, Neisseria meningitidis Z2491
uaagauguuuuuccacaa

SEQ ID NO: 1385716 - RNA, 22 nt, Neisseria meningitidis Z2491
uaagaagaagacgugcaauaca

SEQ ID NO: 1385717 - RNA, 12 nt, Neisseria meningitidis Z2491
uaacuuccacac

SEQ ID NO: 1385718 - RNA, 14 nt, Neisseria meningitidis Z2491
uaagaguuuaaagg

SEQ ID NO: 1385719 - RNA, 16 nt, Neisseria meningitidis Z2491
uaacguacaaaugccg

SEQ ID NO: 1385720 - RNA, 15 nt, Neisseria meningitidis Z2491
uaacgguuuggcauu

SEQ ID NO: 1385721 - RNA, 19 nt, Neisseria meningitidis Z2491
uaacgccgccguccaucac

SEQ ID NO: 1385722 - RNA, 17 nt, Neisseria meningitidis Z2491
uaacgggcaauuuucaa

SEQ ID NO: 1385723 - RNA, 20 nt, Neisseria meningitidis Z2491
uaacuauaguggauuaacaa

SEQ ID NO: 1385724 - RNA, 16 nt, Neisseria meningitidis Z2491
uaacuagggaaauuca

SEQ ID NO: 1385725 - RNA, 21 nt, Neisseria meningitidis Z2491
uaacucuaaaccgucauuccu

SEQ ID NO: 1385726 - RNA, 18 nt, Neisseria meningitidis Z2491
uaacauagguuacuaaaa

SEQ ID NO: 1385727 - RNA, 17 nt, Neisseria meningitidis Z2491
uaacaaucacuauuaaa

SEQ ID NO: 1385728 - RNA, 13 nt, Neisseria meningitidis Z2491
uaacaaaaaccag

SEQ ID NO: 1385729 - RNA, 19 nt, Neisseria meningitidis Z2491
uaacaaaaaccaguacagc

SEQ ID NO: 1385730 - RNA, 14 nt, Neisseria meningitidis Z2491
uaacaaaaaccggu

SEQ ID NO: 1385731 - RNA, 14 nt, Neisseria meningitidis Z2491
uaacaaaaaucagg

SEQ ID NO: 1385732 - RNA, 16 nt, Neisseria meningitidis Z2491
uaacaaaaaucaggac

SEQ ID NO: 1385733 - RNA, 18 nt, Neisseria meningitidis Z2491
uaacaaaaaucaggacaa

SEQ ID NO: 1385734 - RNA, 19 nt, Neisseria meningitidis Z2491
uaacaaaaaucaggacaag

SEQ ID NO: 1385735 - RNA, 17 nt, Neisseria meningitidis Z2491
uaaaugccgcaaucuca

SEQ ID NO: 1385736 - RNA, 17 nt, Neisseria meningitidis Z2491
uaaaugccgcaauuuca

SEQ ID NO: 1385737 - RNA, 16 nt, Neisseria meningitidis Z2491
uaaauuuuuaaaaccg

SEQ ID NO: 1385738 - RNA, 12 nt, Neisseria meningitidis Z2491
uaaacagcacga

SEQ ID NO: 1385739 - RNA, 14 nt, Neisseria meningitidis Z2491
uaaaccgaucaaac

SEQ ID NO: 1385740 - RNA, 17 nt, Neisseria meningitidis Z2491
uaaaccaguacggcguu

SEQ ID NO: 1385741 - RNA, 17 nt, Neisseria meningitidis Z2491
uaaaccaguacgguguu

SEQ ID NO: 1385742 - RNA, 13 nt, Neisseria meningitidis Z2491
uaaaggaaguuuu

SEQ ID NO: 1385743 - RNA, 13 nt, Neisseria meningitidis Z2491
uaaagcaauuuau

SEQ ID NO: 1385744 - RNA, 19 nt, Neisseria meningitidis Z2491
uaaagcaauuuaucggaaa

SEQ ID NO: 1385745 - RNA, 21 nt, Neisseria meningitidis Z2491
uaaagcaauuuaucggaaaaa

SEQ ID NO: 1385746 - RNA, 14 nt, Neisseria meningitidis Z2491
uaaagauacaagaa

SEQ ID NO: 1385747 - RNA, 17 nt, Neisseria meningitidis Z2491
uaaagauacaagaacuu

SEQ ID NO: 1385748 - RNA, 13 nt, Neisseria meningitidis Z2491
uaaagauaaaucu

SEQ ID NO: 1385749 - RNA, 15 nt, Neisseria meningitidis Z2491
uaaagauaaaucuau

SEQ ID NO: 1385750 - RNA, 19 nt, Neisseria meningitidis Z2491
uaaaguccgauaaaauccg

SEQ ID NO: 1385751 - RNA, 19 nt, Neisseria meningitidis Z2491
uaaaguuaggguaauuuau

SEQ ID NO: 1385752 - RNA, 21 nt, Neisseria meningitidis Z2491
uaaagugcggugaaaucuuau

SEQ ID NO: 1385753 - RNA, 22 nt, Neisseria meningitidis Z2491
uaaauaaggcaaaauugcugca

SEQ ID NO: 1385754 - RNA, 16 nt, Neisseria meningitidis Z2491
uaaauccuucaccauc

SEQ ID NO: 1385755 - RNA, 22 nt, Neisseria meningitidis Z2491
uaaacacuucuucauuacggau

SEQ ID NO: 1385756 - RNA, 22 nt, Neisseria meningitidis Z2491
uaaacaacacgcugccgcccaa

SEQ ID NO: 1385757 - RNA, 22 nt, Neisseria meningitidis Z2491
uaaacaaggucucggcauagcu

SEQ ID NO: 1385758 - RNA, 17 nt, Neisseria meningitidis Z2491
uaaacaaaauaaacuca

SEQ ID NO: 1385759 - RNA, 18 nt, Neisseria meningitidis Z2491
uaaaauuccguuauuccc

SEQ ID NO: 1385760 - RNA, 22 nt, Neisseria meningitidis Z2491
uaaaauucgucauucccacgaa

SEQ ID NO: 1385761 - RNA, 18 nt, Neisseria meningitidis Z2491
uaaaauuucaucauuccc

SEQ ID NO: 1385762 - RNA, 21 nt, Neisseria meningitidis Z2491
uaaaauuucaucauucccaca

SEQ ID NO: 1385763 - RNA, 13 nt, Neisseria meningitidis Z2491
uaaacaaaaaaca

SEQ ID NO: 1385764 - RNA, 14 nt, Neisseria meningitidis Z2491
uaaacaaaaaacag

SEQ ID NO: 1385765 - RNA, 9 nt, Neisseria meningitidis Z2491
uaaaaugcc

SEQ ID NO: 1385766 - RNA, 12 nt, Neisseria meningitidis Z2491
uaaaaugcccau

SEQ ID NO: 1385767 - RNA, 21 nt, Neisseria meningitidis Z2491
uaaaaucccccgcaaaugaug

SEQ ID NO: 1385768 - RNA, 19 nt, Neisseria meningitidis Z2491
guuugaguccgaccgccgc

SEQ ID NO: 1385769 - RNA, 19 nt, Neisseria meningitidis Z2491
uaaaaccgauaaacaacac

SEQ ID NO: 1385770 - RNA, 18 nt, Neisseria meningitidis Z2491
uaaaaccaaguagcagac

SEQ ID NO: 1385771 - RNA, 11 nt, Neisseria meningitidis Z2491
uaaaacaaaaa

SEQ ID NO: 1385772 - RNA, 20 nt, Neisseria meningitidis Z2491
uaaaaaugccgucugaaagc

SEQ ID NO: 1385773 - RNA, 22 nt, Neisseria meningitidis Z2491
guuuagcggagcaguuuuucaa

SEQ ID NO: 1385774 - RNA, 14 nt, Neisseria meningitidis Z2491
guuuaauuuuguug

SEQ ID NO: 1385775 - RNA, 17 nt, Neisseria meningitidis Z2491
guuuaaauuuaauccac

SEQ ID NO: 1385776 - RNA, 17 nt, Neisseria meningitidis Z2491
guuguuguuugaauaca

SEQ ID NO: 1385777 - RNA, 14 nt, Neisseria meningitidis Z2491
guuuaaaacagcau

SEQ ID NO: 1385778 - RNA, 17 nt, Neisseria meningitidis Z2491
guugucaaccaaaaaau

SEQ ID NO: 1385779 - RNA, 16 nt, Neisseria meningitidis Z2491
guuugaaagagaaaag

SEQ ID NO: 1385780 - RNA, 19 nt, Neisseria meningitidis Z2491
guuugaaccggcacaggcu

SEQ ID NO: 1385781 - RNA, 12 nt, Neisseria meningitidis Z2491
guuuccugcagg

SEQ ID NO: 1385782 - RNA, 23 nt, Neisseria meningitidis Z2491
guuuccuccucgccgucuuucag

SEQ ID NO: 1385783 - RNA, 20 nt, Neisseria meningitidis Z2491
guuucccccguaccgggcag

SEQ ID NO: 1385784 - RNA, 13 nt, Neisseria meningitidis Z2491
guuuaucuuuucu

SEQ ID NO: 1385785 - RNA, 14 nt, Neisseria meningitidis Z2491
guuuaucuuuucuu

SEQ ID NO: 1385786 - RNA, 18 nt, Neisseria meningitidis Z2491
guuuauccguucaauugc

SEQ ID NO: 1385787 - RNA, 19 nt, Neisseria meningitidis Z2491
guuuauccguucaauugcu

SEQ ID NO: 1385788 - RNA, 20 nt, Neisseria meningitidis Z2491
guugcuguauguuacaaaac

SEQ ID NO: 1385789 - RNA, 17 nt, Neisseria meningitidis Z2491
guuggaaggcggcggca

SEQ ID NO: 1385790 - RNA, 14 nt, Neisseria meningitidis Z2491
guuggaauccaguu

SEQ ID NO: 1385791 - RNA, 12 nt, Neisseria meningitidis Z2491
guuggcagcaaa

SEQ ID NO: 1385792 - RNA, 18 nt, Neisseria meningitidis Z2491
guugccucgccuugcugu

SEQ ID NO: 1385793 - RNA, 18 nt, Neisseria meningitidis Z2491
guugccgucaacgacuuu

SEQ ID NO: 1385794 - RNA, 14 nt, Neisseria meningitidis Z2491
guugcccauugcca

SEQ ID NO: 1385795 - RNA, 15 nt, Neisseria meningitidis Z2491
guugcggaugaauuu

SEQ ID NO: 1385796 - RNA, 20 nt, Neisseria meningitidis Z2491
guugcgccgaagcccauguc

SEQ ID NO: 1385797 - RNA, 16 nt, Neisseria meningitidis Z2491
guugcgucugccuucu

SEQ ID NO: 1385798 - RNA, 14 nt, Neisseria meningitidis Z2491
guugcggugcugcu

SEQ ID NO: 1385799 - RNA, 23 nt, Neisseria meningitidis Z2491
guucuucuucgacguugccuucu

SEQ ID NO: 1385800 - RNA, 18 nt, Neisseria meningitidis Z2491
guucgucuaagaaaacca

SEQ ID NO: 1385801 - RNA, 19 nt, Neisseria meningitidis Z2491
guucgugcaggguuuucuu

SEQ ID NO: 1385802 - RNA, 20 nt, Neisseria meningitidis Z2491
guucgugcaggguuuucuuc

SEQ ID NO: 1385803 - RNA, 12 nt, Neisseria meningitidis Z2491
guucuagauucc

SEQ ID NO: 1385804 - RNA, 20 nt, Neisseria meningitidis Z2491
guucagacggcaucaaaaac

SEQ ID NO: 1385805 - RNA, 15 nt, Neisseria meningitidis Z2491
guucagacggcauuu

SEQ ID NO: 1385806 - RNA, 17 nt, Neisseria meningitidis Z2491
guucagacggcauuuuc

SEQ ID NO: 1385807 - RNA, 17 nt, Neisseria meningitidis Z2491
guucagacggcauuuuu

SEQ ID NO: 1385808 - RNA, 18 nt, Neisseria meningitidis Z2491
guucagacggcauuuuug

SEQ ID NO: 1385809 - RNA, 16 nt, Neisseria meningitidis Z2491
guuccaaaagccgccc

SEQ ID NO: 1385810 - RNA, 15 nt, Neisseria meningitidis Z2491
guuccguacuauuug

SEQ ID NO: 1385811 - RNA, 22 nt, Neisseria meningitidis Z2491
guucgccgacaucuucgaggaa

SEQ ID NO: 1385812 - RNA, 23 nt, Neisseria meningitidis Z2491
guucggaaucacuucgcucugcg

SEQ ID NO: 1385813 - RNA, 21 nt, Neisseria meningitidis Z2491
guucggcagccuuaacaggga

SEQ ID NO: 1385814 - RNA, 20 nt, Neisseria meningitidis Z2491
guucggacggcauuuuguuu

SEQ ID NO: 1385815 - RNA, 17 nt, Neisseria meningitidis Z2491
guucggacggcauuuuu

SEQ ID NO: 1385816 - RNA, 14 nt, Neisseria meningitidis Z2491
guucgauauuuuug

SEQ ID NO: 1385817 - RNA, 21 nt, Neisseria meningitidis Z2491
guuccuccacuaaaaaaucca

SEQ ID NO: 1385818 - RNA, 12 nt, Neisseria meningitidis Z2491
guuacuaaaauu

SEQ ID NO: 1385819 - RNA, 15 nt, Neisseria meningitidis Z2491
guuacuaaaauuuua

SEQ ID NO: 1385820 - RNA, 21 nt, Neisseria meningitidis Z2491
guuacuaaaauuuuaugcuca

SEQ ID NO: 1385821 - RNA, 12 nt, Neisseria meningitidis Z2491
guuacagaaauu

SEQ ID NO: 1385822 - RNA, 16 nt, Neisseria meningitidis Z2491
guuaaguauuucuauu

SEQ ID NO: 1385823 - RNA, 16 nt, Neisseria meningitidis Z2491
guguugcccugauucg

SEQ ID NO: 1385824 - RNA, 18 nt, Neisseria meningitidis Z2491
gugugcauccgacaggca

SEQ ID NO: 1385825 - RNA, 21 nt, Neisseria meningitidis Z2491
guguaccgucaaauucuuuuu

SEQ ID NO: 1385826 - RNA, 22 nt, Neisseria meningitidis Z2491
guguacggugaacacuucuucg

SEQ ID NO: 1385827 - RNA, 18 nt, Neisseria meningitidis Z2491
guguaacugcaagaacag

SEQ ID NO: 1385828 - RNA, 20 nt, Neisseria meningitidis Z2491
guggucaggcccuguuuguu

SEQ ID NO: 1385829 - RNA, 16 nt, Neisseria meningitidis Z2491
guggcugaugcggacg

SEQ ID NO: 1385830 - RNA, 16 nt, Neisseria meningitidis Z2491
guggcugcccaaccga

SEQ ID NO: 1385831 - RNA, 21 nt, Neisseria meningitidis Z2491
guggguucgucaaacaacauc

SEQ ID NO: 1385832 - RNA, 16 nt, Neisseria meningitidis Z2491
gugguagagaaaauua

SEQ ID NO: 1385833 - RNA, 14 nt, Neisseria meningitidis Z2491
guggauuaaauuua

SEQ ID NO: 1385834 - RNA, 17 nt, Neisseria meningitidis Z2491
guggauuaaauuuaaau

SEQ ID NO: 1385835 - RNA, 14 nt, Neisseria meningitidis Z2491
guggauuaacaaaa

SEQ ID NO: 1385836 - RNA, 17 nt, Neisseria meningitidis Z2491
gugcugucgguuucauc

SEQ ID NO: 1385837 - RNA, 21 nt, Neisseria meningitidis Z2491
gugaugauguccgacugggca

SEQ ID NO: 1385838 - RNA, 17 nt, Neisseria meningitidis Z2491
gugcuggcugccgaugu

SEQ ID NO: 1385839 - RNA, 14 nt, Neisseria meningitidis Z2491
gugcgccgacuuuu

SEQ ID NO: 1385840 - RNA, 22 nt, Neisseria meningitidis Z2491
gugcgaccguaugcaaaaacaa

SEQ ID NO: 1385841 - RNA, 15 nt, Neisseria meningitidis Z2491
gugcgcguacugcuu

SEQ ID NO: 1385842 - RNA, 20 nt, Neisseria meningitidis Z2491
gugcggcaaaacgccuucuu

SEQ ID NO: 1385843 - RNA, 17 nt, Neisseria meningitidis Z2491
gugcggcaucggaaaca

SEQ ID NO: 1385844 - RNA, 15 nt, Neisseria meningitidis Z2491
gccuuccugcaggcg

SEQ ID NO: 1385845 - RNA, 18 nt, Neisseria meningitidis Z2491
gccuuccgcuucuuccag

SEQ ID NO: 1385846 - RNA, 20 nt, Neisseria meningitidis Z2491
gccuuccgcuucuuccagca

SEQ ID NO: 1385847 - RNA, 23 nt, Neisseria meningitidis Z2491
gccuucaugcggcgggcuuggaa

SEQ ID NO: 1385848 - RNA, 13 nt, Neisseria meningitidis Z2491
gccuuagcauuga

SEQ ID NO: 1385849 - RNA, 19 nt, Neisseria meningitidis Z2491
gccuguucggucauagcca

SEQ ID NO: 1385850 - RNA, 12 nt, Neisseria meningitidis Z2491
gccuuguccuga

SEQ ID NO: 1385851 - RNA, 19 nt, Neisseria meningitidis Z2491
gccuuguccugauuuuugu

SEQ ID NO: 1385852 - RNA, 19 nt, Neisseria meningitidis Z2491
gccuugccuucaaauucug

SEQ ID NO: 1385853 - RNA, 14 nt, Neisseria meningitidis Z2491
gccuucgggauaau

SEQ ID NO: 1385854 - RNA, 15 nt, Neisseria meningitidis Z2491
gccuucuucuaaaaa

SEQ ID NO: 1385855 - RNA, 13 nt, Neisseria meningitidis Z2491
gccuucuucuuug

SEQ ID NO: 1385856 - RNA, 20 nt, Neisseria meningitidis Z2491
gccuuuacucauucaauccu

SEQ ID NO: 1385857 - RNA, 23 nt, Neisseria meningitidis Z2491
gccuuuacucauucaauccucaa

SEQ ID NO: 1385858 - RNA, 16 nt, Neisseria meningitidis Z2491
gccuuucacaaaggag

SEQ ID NO: 1385859 - RNA, 16 nt, Neisseria meningitidis Z2491
gccuuuggcggcggca

SEQ ID NO: 1385860 - RNA, 24 nt, Neisseria meningitidis Z2491
gccuuuuaccuugaggucuuugau

SEQ ID NO: 1385861 - RNA, 14 nt, Neisseria meningitidis Z2491
gccuuuuucaaacg

SEQ ID NO: 1385862 - RNA, 13 nt, Neisseria meningitidis Z2491
gccuuuucuuccu

SEQ ID NO: 1385863 - RNA, 18 nt, Neisseria meningitidis Z2491
gccuuuucuuccuugcca

SEQ ID NO: 1385864 - RNA, 18 nt, Neisseria meningitidis Z2491
gcgaacagaaaccucaaa

SEQ ID NO: 1385865 - RNA, 18 nt, Neisseria meningitidis Z2491
gcgaacagaaggggcgga

SEQ ID NO: 1385866 - RNA, 12 nt, Neisseria meningitidis Z2491
gcgaaaaauaga

SEQ ID NO: 1385867 - RNA, 21 nt, Neisseria meningitidis Z2491
gcgauuucgcguaccaaaacc

SEQ ID NO: 1385868 - RNA, 21 nt, Neisseria meningitidis Z2491
gcgauuaucgggaaaaauaga

SEQ ID NO: 1385869 - RNA, 17 nt, Neisseria meningitidis Z2491
gcgcaaucgaaaaagcc

SEQ ID NO: 1385870 - RNA, 19 nt, Neisseria meningitidis Z2491
gcgaggacgcgugcaauca

SEQ ID NO: 1385871 - RNA, 14 nt, Neisseria meningitidis Z2491
gcgagauagcaaag

SEQ ID NO: 1385872 - RNA, 23 nt, Neisseria meningitidis Z2491
gcgauauaugcgccgcguuucau

SEQ ID NO: 1385873 - RNA, 18 nt, Neisseria meningitidis Z2491
gcgccgagguaguuuuug

SEQ ID NO: 1385874 - RNA, 19 nt, Neisseria meningitidis Z2491
gcgcgggcguucagauucc

SEQ ID NO: 1385875 - RNA, 22 nt, Neisseria meningitidis Z2491
gcgcggacacgguucugcaccg

SEQ ID NO: 1385876 - RNA, 13 nt, Neisseria meningitidis Z2491
gcgcggcgcaggc

SEQ ID NO: 1385877 - RNA, 13 nt, Neisseria meningitidis Z2491
gcgcgggaaugac

SEQ ID NO: 1385878 - RNA, 13 nt, Neisseria meningitidis Z2491
gcgcgggaaugau

SEQ ID NO: 1385879 - RNA, 14 nt, Neisseria meningitidis Z2491
gcgcggcaaaagua

SEQ ID NO: 1385880 - RNA, 15 nt, Neisseria meningitidis Z2491
gcgcgccgauguucu

SEQ ID NO: 1385881 - RNA, 14 nt, Neisseria meningitidis Z2491
gcguuuuggcucau

SEQ ID NO: 1385882 - RNA, 19 nt, Neisseria meningitidis Z2491
gcguuuugacaaaaucagu

SEQ ID NO: 1385883 - RNA, 13 nt, Neisseria meningitidis Z2491
gcguugaguuuca

SEQ ID NO: 1385884 - RNA, 20 nt, Neisseria meningitidis Z2491
gcguugaguuucagcuauuu

SEQ ID NO: 1385885 - RNA, 20 nt, Neisseria meningitidis Z2491
gcgugggucggguucaacau

SEQ ID NO: 1385886 - RNA, 20 nt, Neisseria meningitidis Z2491
gcguucaacauccgcagacg

SEQ ID NO: 1385887 - RNA, 16 nt, Neisseria meningitidis Z2491
gcguaucaaaaaauaa

SEQ ID NO: 1385888 - RNA, 17 nt, Neisseria meningitidis Z2491
gcguaucaaaaaauaaa

SEQ ID NO: 1385889 - RNA, 18 nt, Neisseria meningitidis Z2491
gcguauccagccgccauc

SEQ ID NO: 1385890 - RNA, 17 nt, Neisseria meningitidis Z2491
gcuaaaacaacugcaau

SEQ ID NO: 1385891 - RNA, 16 nt, Neisseria meningitidis Z2491
gcuaaaaucccauuau

SEQ ID NO: 1385892 - RNA, 16 nt, Neisseria meningitidis Z2491
gcuaaaaucccguuau

SEQ ID NO: 1385893 - RNA, 17 nt, Neisseria meningitidis Z2491
gcuaaggcaauuuaucg

SEQ ID NO: 1385894 - RNA, 18 nt, Neisseria meningitidis Z2491
gcuaaggcaauuuaucgg

SEQ ID NO: 1385895 - RNA, 17 nt, Neisseria meningitidis Z2491
gcucauaguuuggacgg

SEQ ID NO: 1385896 - RNA, 17 nt, Neisseria meningitidis Z2491
gcucauuuuuguauaaa

SEQ ID NO: 1385897 - RNA, 18 nt, Neisseria meningitidis Z2491
gcucaaucccguugccaa

SEQ ID NO: 1385898 - RNA, 20 nt, Neisseria meningitidis Z2491
gcucaaucccguugccaaac

SEQ ID NO: 1385899 - RNA, 18 nt, Neisseria meningitidis Z2491
gcucaaucucauuuucaa

SEQ ID NO: 1385900 - RNA, 15 nt, Neisseria meningitidis Z2491
gcuccgcaaacaaaa

SEQ ID NO: 1385901 - RNA, 21 nt, Neisseria meningitidis Z2491
gcuccgcaggguagaaugccg

SEQ ID NO: 1385902 - RNA, 18 nt, Neisseria meningitidis Z2491
gcuccugacggcaaacug

SEQ ID NO: 1385903 - RNA, 18 nt, Neisseria meningitidis Z2491
gcucgcguauccagccgc

SEQ ID NO: 1385904 - RNA, 20 nt, Neisseria meningitidis Z2491
gcggcagggucggcgacggc

SEQ ID NO: 1385905 - RNA, 14 nt, Neisseria meningitidis Z2491
gcggcaggcagggu

SEQ ID NO: 1385906 - RNA, 12 nt, Neisseria meningitidis Z2491
gcggccugguug

SEQ ID NO: 1385907 - RNA, 14 nt, Neisseria meningitidis Z2491
gcggcgagcagggu

SEQ ID NO: 1385908 - RNA, 12 nt, Neisseria meningitidis Z2491
gcggcgcggcgg

SEQ ID NO: 1385909 - RNA, 14 nt, Neisseria meningitidis Z2491
gcgguuugcggcgg

SEQ ID NO: 1385910 - RNA, 19 nt, Neisseria meningitidis Z2491
gcguaacaaugcggaaaug

SEQ ID NO: 1385911 - RNA, 14 nt, Neisseria meningitidis Z2491
gcgguuggcggcgg

SEQ ID NO: 1385912 - RNA, 19 nt, Neisseria meningitidis Z2491
gcggugugcgccgccggug

SEQ ID NO: 1385913 - RNA, 18 nt, Neisseria meningitidis Z2491
gcguacuuuauccaccaa

SEQ ID NO: 1385914 - RNA, 22 nt, Neisseria meningitidis Z2491
gcggucggagaggucuugcagg

SEQ ID NO: 1385915 - RNA, 23 nt, Neisseria meningitidis Z2491
gcggugcgcuaaggagcuguucg

SEQ ID NO: 1385916 - RNA, 19 nt, Neisseria meningitidis Z2491
gcggucgcaucggcggcgu

SEQ ID NO: 1385917 - RNA, 14 nt, Neisseria meningitidis Z2491
gcggucauuuaucg

SEQ ID NO: 1385918 - RNA, 23 nt, Neisseria meningitidis Z2491
gcgguccaaaacggcggcagccu

SEQ ID NO: 1385919 - RNA, 15 nt, Neisseria meningitidis Z2491
gcgggcaggcggcug

SEQ ID NO: 1385920 - RNA, 13 nt, Neisseria meningitidis Z2491
gcggcuugccgcc

SEQ ID NO: 1385921 - RNA, 13 nt, Neisseria meningitidis Z2491
gcggcuugggcga

SEQ ID NO: 1385922 - RNA, 15 nt, Neisseria meningitidis Z2491
gcggcugaauguguu

SEQ ID NO: 1385923 - RNA, 20 nt, Neisseria meningitidis Z2491
gcgggccuuuggcggcggca

SEQ ID NO: 1385924 - RNA, 13 nt, Neisseria meningitidis Z2491
gccugcgcgggaa

SEQ ID NO: 1385925 - RNA, 22 nt, Neisseria meningitidis Z2491
gccugcgcgggaaugacgaagc

SEQ ID NO: 1385926 - RNA, 15 nt, Neisseria meningitidis Z2491
gccugcgcgcggacg

SEQ ID NO: 1385927 - RNA, 14 nt, Neisseria meningitidis Z2491
gccugugcggcgga

SEQ ID NO: 1385928 - RNA, 14 nt, Neisseria meningitidis Z2491
gccugauccaaacc

SEQ ID NO: 1385929 - RNA, 18 nt, Neisseria meningitidis Z2491
gccugaugauuuuuucaa

SEQ ID NO: 1385930 - RNA, 13 nt, Neisseria meningitidis Z2491
gccugauggcuga

SEQ ID NO: 1385931 - RNA, 19 nt, Neisseria meningitidis Z2491
gccugcgcgagaauaauga

SEQ ID NO: 1385932 - RNA, 23 nt, Neisseria meningitidis Z2491
gccugccuguuuuucuucaucca

SEQ ID NO: 1385933 - RNA, 23 nt, Neisseria meningitidis Z2491
gccugcccugccaaaacucaauc

SEQ ID NO: 1385934 - RNA, 16 nt, Neisseria meningitidis Z2491
gccugccauuccccua

SEQ ID NO: 1385935 - RNA, 13 nt, Neisseria meningitidis Z2491
gccucaaucgcgg

SEQ ID NO: 1385936 - RNA, 18 nt, Neisseria meningitidis Z2491
gccgggguuuaucagaaa

SEQ ID NO: 1385937 - RNA, 22 nt, Neisseria meningitidis Z2491
gccguugaggagguuuugcacg

SEQ ID NO: 1385938 - RNA, 14 nt, Neisseria meningitidis Z2491
gccgugccggcggc

SEQ ID NO: 1385939 - RNA, 21 nt, Neisseria meningitidis Z2491
gccuccaucagcacgccgccu

SEQ ID NO: 1385940 - RNA, 23 nt, Neisseria meningitidis Z2491
gccuccaucagcacgccgccugc

SEQ ID NO: 1385941 - RNA, 15 nt, Neisseria meningitidis Z2491
gccucgcccggccga

SEQ ID NO: 1385942 - RNA, 16 nt, Neisseria meningitidis Z2491
gccucgucauuuccac

SEQ ID NO: 1385943 - RNA, 21 nt, Neisseria meningitidis Z2491
gccgcuguacgaauccgccgg

SEQ ID NO: 1385944 - RNA, 19 nt, Neisseria meningitidis Z2491
gccgcuguauuugcgccgc

SEQ ID NO: 1385945 - RNA, 20 nt, Neisseria meningitidis Z2491
gccgcuguauuugcgccgcc

SEQ ID NO: 1385946 - RNA, 22 nt, Neisseria meningitidis Z2491
gccggaaaaccuugccgcccgu

SEQ ID NO: 1385947 - RNA, 14 nt, Neisseria meningitidis Z2491
gccggggcaaacau

SEQ ID NO: 1385948 - RNA, 19 nt, Neisseria meningitidis Z2491
gccggccuuaaggcggcug

SEQ ID NO: 1385949 - RNA, 22 nt, Neisseria meningitidis Z2491
gccggcauuucugcgaaagcgg

SEQ ID NO: 1385950 - RNA, 15 nt, Neisseria meningitidis Z2491
gccggccaacaucag

SEQ ID NO: 1385951 - RNA, 13 nt, Neisseria meningitidis Z2491
gccgauguccuga

SEQ ID NO: 1385952 - RNA, 14 nt, Neisseria meningitidis Z2491
gccgauguccugac

SEQ ID NO: 1385953 - RNA, 16 nt, Neisseria meningitidis Z2491
gccgcagacaguacaa

SEQ ID NO: 1385954 - RNA, 22 nt, Neisseria meningitidis Z2491
gccgcauugucccugugcgccg

SEQ ID NO: 1385955 - RNA, 22 nt, Neisseria meningitidis Z2491
gccgccgccaugucgcgggcgg

SEQ ID NO: 1385956 - RNA, 15 nt, Neisseria meningitidis Z2491
gccgccgcccgggcc

SEQ ID NO: 1385957 - RNA, 12 nt, Neisseria meningitidis Z2491
gccgccgcaacc

SEQ ID NO: 1385958 - RNA, 18 nt, Neisseria meningitidis Z2491
gccgccgucuugggaaau

SEQ ID NO: 1385959 - RNA, 14 nt, Neisseria meningitidis Z2491
gccgccuccgaagc

SEQ ID NO: 1385960 - RNA, 23 nt, Neisseria meningitidis Z2491
gccgccugaacauuucagacggc

SEQ ID NO: 1385961 - RNA, 19 nt, Neisseria meningitidis Z2491
gccgcccgucccgaugccg

SEQ ID NO: 1385962 - RNA, 23 nt, Neisseria meningitidis Z2491
gccgcccgucccgaugccgcaac

SEQ ID NO: 1385963 - RNA, 14 nt, Neisseria meningitidis Z2491
gccgccccaaugcg

SEQ ID NO: 1385964 - RNA, 18 nt, Neisseria meningitidis Z2491
gccgccaugucgcgggcg

SEQ ID NO: 1385965 - RNA, 14 nt, Neisseria meningitidis Z2491
gccacgccgacugc

SEQ ID NO: 1385966 - RNA, 20 nt, Neisseria meningitidis Z2491
gccacgccgacugccgccgc

SEQ ID NO: 1385967 - RNA, 14 nt, Neisseria meningitidis Z2491
gccacgccaaaaau

SEQ ID NO: 1385968 - RNA, 22 nt, Neisseria meningitidis Z2491
gccacgccaaaaaugcggccgc

SEQ ID NO: 1385969 - RNA, 19 nt, Neisseria meningitidis Z2491
gccacauaauucaaaugcg

SEQ ID NO: 1385970 - RNA, 19 nt, Neisseria meningitidis Z2491
gcauacgaaacggguucug

SEQ ID NO: 1385971 - RNA, 19 nt, Neisseria meningitidis Z2491
gccacggcuuucgcgccgc

SEQ ID NO: 1385972 - RNA, 21 nt, Neisseria meningitidis Z2491
gccacggcuuucgcgccgcgc

SEQ ID NO: 1385973 - RNA, 19 nt, Neisseria meningitidis Z2491
gccaucggguugccgccga

SEQ ID NO: 1385974 - RNA, 19 nt, Neisseria meningitidis Z2491
gccauauucgcacgcauga

SEQ ID NO: 1385975 - RNA, 20 nt, Neisseria meningitidis Z2491
gccaguucggcaaacggcag

SEQ ID NO: 1385976 - RNA, 14 nt, Neisseria meningitidis Z2491
gccagccguauuug

SEQ ID NO: 1385977 - RNA, 22 nt, Neisseria meningitidis Z2491
gccagccguauuugucuuccgc

SEQ ID NO: 1385978 - RNA, 18 nt, Neisseria meningitidis Z2491
gccccacauaaacagcac

SEQ ID NO: 1385979 - RNA, 14 nt, Neisseria meningitidis Z2491
gccccaauaccaac

SEQ ID NO: 1385980 - RNA, 17 nt, Neisseria meningitidis Z2491
gccccaaaaagccgccu

SEQ ID NO: 1385981 - RNA, 16 nt, Neisseria meningitidis Z2491
gcccaucgucuagagg

SEQ ID NO: 1385982 - RNA, 16 nt, Neisseria meningitidis Z2491
gccaugcggcaaaaag

SEQ ID NO: 1385983 - RNA, 20 nt, Neisseria meningitidis Z2491
gcccacggggugcggguggc

SEQ ID NO: 1385984 - RNA, 23 nt, Neisseria meningitidis Z2491
gcccauacuacgcggcugaaaaa

SEQ ID NO: 1385985 - RNA, 23 nt, Neisseria meningitidis Z2491
gcccuccccagauuaucacgauu

SEQ ID NO: 1385986 - RNA, 17 nt, Neisseria meningitidis Z2491
gcccgucccgacucaua

SEQ ID NO: 1385987 - RNA, 19 nt, Neisseria meningitidis Z2491
gcccgucccgaugccgcaa

SEQ ID NO: 1385988 - RNA, 18 nt, Neisseria meningitidis Z2491
gcccgagauuacagaaac

SEQ ID NO: 1385989 - RNA, 21 nt, Neisseria meningitidis Z2491
gcccgcagccggggcaggcgg

SEQ ID NO: 1385990 - RNA, 17 nt, Neisseria meningitidis Z2491
gccccuggcugcggacg

SEQ ID NO: 1385991 - RNA, 15 nt, Neisseria meningitidis Z2491
gcccgacagccgcaa

SEQ ID NO: 1385992 - RNA, 17 nt, Neisseria meningitidis Z2491
gcccgacaucaagcugu

SEQ ID NO: 1385993 - RNA, 14 nt, Neisseria meningitidis Z2491
gccccuuaaaguuu

SEQ ID NO: 1385994 - RNA, 19 nt, Neisseria meningitidis Z2491
gcccgacaaccgcccagcc

SEQ ID NO: 1385995 - RNA, 22 nt, Neisseria meningitidis Z2491
gcaaccugaaauucgucauucc

SEQ ID NO: 1385996 - RNA, 23 nt, Neisseria meningitidis Z2491
gcaaccugaaauucgucauuccc

SEQ ID NO: 1385997 - RNA, 23 nt, Neisseria meningitidis Z2491
gcaaccuuuccgccgucauuccc

SEQ ID NO: 1385998 - RNA, 15 nt, Neisseria meningitidis Z2491
gcaacgacagcagca

SEQ ID NO: 1385999 - RNA, 18 nt, Neisseria meningitidis Z2491
gcaacgacagcagcagcc

SEQ ID NO: 1386000 - RNA, 14 nt, Neisseria meningitidis Z2491
gcaacgcuguacug

SEQ ID NO: 1386001 - RNA, 21 nt, Neisseria meningitidis Z2491
gcaacgccguacugguuuuug

SEQ ID NO: 1386002 - RNA, 16 nt, Neisseria meningitidis Z2491
gcaacauaaacaaagc

SEQ ID NO: 1386003 - RNA, 19 nt, Neisseria meningitidis Z2491
gcaaccaaaaccgaccaug

SEQ ID NO: 1386004 - RNA, 15 nt, Neisseria meningitidis Z2491
gcaaaaccggcuuga

SEQ ID NO: 1386005 - RNA, 20 nt, Neisseria meningitidis Z2491
gcaaaacuuuucugauuuuu

SEQ ID NO: 1386006 - RNA, 22 nt, Neisseria meningitidis Z2491
gcaaaacuuuucugauuuuucc

SEQ ID NO: 1386007 - RNA, 20 nt, Neisseria meningitidis Z2491
gcaauccacgcaaucaagaa

SEQ ID NO: 1386008 - RNA, 20 nt, Neisseria meningitidis Z2491
gcaaucgaaaaagccgccgg

SEQ ID NO: 1386009 - RNA, 18 nt, Neisseria meningitidis Z2491
gcaauaauggcaaccaaa

SEQ ID NO: 1386010 - RNA, 23 nt, Neisseria meningitidis Z2491
gcaaguuccaagauggcgagcga

SEQ ID NO: 1386011 - RNA, 19 nt, Neisseria meningitidis Z2491
gcaacucuccgucauuccc

SEQ ID NO: 1386012 - RNA, 14 nt, Neisseria meningitidis Z2491
gcaacguuucagac

SEQ ID NO: 1386013 - RNA, 16 nt, Neisseria meningitidis Z2491
gcaaggcaaggcaaca

SEQ ID NO: 1386014 - RNA, 14 nt, Neisseria meningitidis Z2491
gcaccaauucuuca

SEQ ID NO: 1386015 - RNA, 19 nt, Neisseria meningitidis Z2491
gcaccaaguaaaucgguuc

SEQ ID NO: 1386016 - RNA, 19 nt, Neisseria meningitidis Z2491
gcaccaagugaaucgguuc

SEQ ID NO: 1386017 - RNA, 16 nt, Neisseria meningitidis Z2491
gcacauuccaucaaca

SEQ ID NO: 1386018 - RNA, 19 nt, Neisseria meningitidis Z2491
gcaccauugacguaguuua

SEQ ID NO: 1386019 - RNA, 16 nt, Neisseria meningitidis Z2491
gcacaaacgccagcac

SEQ ID NO: 1386020 - RNA, 17 nt, Neisseria meningitidis Z2491
gcacaaacgccagcaca

SEQ ID NO: 1386021 - RNA, 21 nt, Neisseria meningitidis Z2491
gcacaaacgccagcacaaaca

SEQ ID NO: 1386022 - RNA, 17 nt, Neisseria meningitidis Z2491
gcacacgcauuccgaca

SEQ ID NO: 1386023 - RNA, 20 nt, Neisseria meningitidis Z2491
gcacagcgugcgcguguuug

SEQ ID NO: 1386024 - RNA, 20 nt, Neisseria meningitidis Z2491
gcacgaaucuuauccacaga

SEQ ID NO: 1386025 - RNA, 19 nt, Neisseria meningitidis Z2491
gcacgcaugaagccgucuu

SEQ ID NO: 1386026 - RNA, 16 nt, Neisseria meningitidis Z2491
gcagggcuuuugccag

SEQ ID NO: 1386027 - RNA, 17 nt, Neisseria meningitidis Z2491
gcauaaaucaacagcag

SEQ ID NO: 1386028 - RNA, 11 nt, Neisseria meningitidis Z2491
gcauaaauccu

SEQ ID NO: 1386029 - RNA, 14 nt, Neisseria meningitidis Z2491
gcauaaauccuuca

SEQ ID NO: 1386030 - RNA, 16 nt, Neisseria meningitidis Z2491
gcauaaauccuucacc

SEQ ID NO: 1386031 - RNA, 18 nt, Neisseria meningitidis Z2491
gcaguucggacaaaccgu

SEQ ID NO: 1386032 - RNA, 20 nt, Neisseria meningitidis Z2491
gcaguucguugcuuuccagu

SEQ ID NO: 1386033 - RNA, 18 nt, Neisseria meningitidis Z2491
gcaguugugcgccgacuu

SEQ ID NO: 1386034 - RNA, 22 nt, Neisseria meningitidis Z2491
gcaguugggcgauggcgcggcg

SEQ ID NO: 1386035 - RNA, 17 nt, Neisseria meningitidis Z2491
gcagucuuccaacccuc

SEQ ID NO: 1386036 - RNA, 20 nt, Neisseria meningitidis Z2491
gcagucuaucaguucuacac

SEQ ID NO: 1386037 - RNA, 15 nt, Neisseria meningitidis Z2491
gcaggaacacggcgg

SEQ ID NO: 1386038 - RNA, 22 nt, Neisseria meningitidis Z2491
gcagcuucgucgccuuguccug

SEQ ID NO: 1386039 - RNA, 18 nt, Neisseria meningitidis Z2491
gcagcuuaugcuguugca

SEQ ID NO: 1386040 - RNA, 14 nt, Neisseria meningitidis Z2491
gcaggacggggcgg

SEQ ID NO: 1386041 - RNA, 16 nt, Neisseria meningitidis Z2491
gcaggacggggcggcu

SEQ ID NO: 1386042 - RNA, 12 nt, Neisseria meningitidis Z2491
gcagcuccgaac

SEQ ID NO: 1386043 - RNA, 15 nt, Neisseria meningitidis Z2491
gcaggcugccgcaca

SEQ ID NO: 1386044 - RNA, 17 nt, Neisseria meningitidis Z2491
gcagcaacgacagcagc

SEQ ID NO: 1386045 - RNA, 18 nt, Neisseria meningitidis Z2491
gcagauggcuguguuccg

SEQ ID NO: 1386046 - RNA, 16 nt, Neisseria meningitidis Z2491
gcagccggggcaggcg

SEQ ID NO: 1386047 - RNA, 17 nt, Neisseria meningitidis Z2491
gcagccggggcaggcgg

SEQ ID NO: 1386048 - RNA, 13 nt, Neisseria meningitidis Z2491
gcagccgagcagc

SEQ ID NO: 1386049 - RNA, 15 nt, Neisseria meningitidis Z2491
gcagccuaaaacauc

SEQ ID NO: 1386050 - RNA, 13 nt, Neisseria meningitidis Z2491
gcagccugcagca

SEQ ID NO: 1386051 - RNA, 16 nt, Neisseria meningitidis Z2491
gcagccagcaucgcag

SEQ ID NO: 1386052 - RNA, 11 nt, Neisseria meningitidis Z2491
gcagaaauaag

SEQ ID NO: 1386053 - RNA, 14 nt, Neisseria meningitidis Z2491
gcagaaaaaggguu

SEQ ID NO: 1386054 - RNA, 12 nt, Neisseria meningitidis Z2491
gcagacaguaca

SEQ ID NO: 1386055 - RNA, 16 nt, Neisseria meningitidis Z2491
gcagacaguacaaaua

SEQ ID NO: 1386056 - RNA, 20 nt, Neisseria meningitidis Z2491
gcagacaaucagaucggcaa

SEQ ID NO: 1386057 - RNA, 19 nt, Neisseria meningitidis Z2491
gaguuuuugguaggcaagu

SEQ ID NO: 1386058 - RNA, 22 nt, Neisseria meningitidis Z2491
gauaaauucuugaggcauugaa

SEQ ID NO: 1386059 - RNA, 24 nt, Neisseria meningitidis Z2491
gauaaaugccgcaauuucaaaucc

SEQ ID NO: 1386060 - RNA, 19 nt, Neisseria meningitidis Z2491
gaguggcgggguuucaacc

SEQ ID NO: 1386061 - RNA, 16 nt, Neisseria meningitidis Z2491
gaguuucagcuauuua

SEQ ID NO: 1386062 - RNA, 20 nt, Neisseria meningitidis Z2491
gagucccaguucgccgcaga

SEQ ID NO: 1386063 - RNA, 21 nt, Neisseria meningitidis Z2491
gagguuacaguuuaaucccuu

SEQ ID NO: 1386064 - RNA, 13 nt, Neisseria meningitidis Z2491
gagguucuagauu

SEQ ID NO: 1386065 - RNA, 17 nt, Neisseria meningitidis Z2491
gaggucuugcaggugga

SEQ ID NO: 1386066 - RNA, 14 nt, Neisseria meningitidis Z2491
gagguaguuuuugg

SEQ ID NO: 1386067 - RNA, 16 nt, Neisseria meningitidis Z2491
gagguguuggaaucag

SEQ ID NO: 1386068 - RNA, 14 nt, Neisseria meningitidis Z2491
gagggcguuuuugu

SEQ ID NO: 1386069 - RNA, 22 nt, Neisseria meningitidis Z2491
gagggcuucuuugacggcgggc

SEQ ID NO: 1386070 - RNA, 14 nt, Neisseria meningitidis Z2491
gagggugagggaga

SEQ ID NO: 1386071 - RNA, 13 nt, Neisseria meningitidis Z2491
gaggguuugggau

SEQ ID NO: 1386072 - RNA, 16 nt, Neisseria meningitidis Z2491
gauacuccaaaccuuu

SEQ ID NO: 1386073 - RNA, 17 nt, Neisseria meningitidis Z2491
gauaccgucugaacacg

SEQ ID NO: 1386074 - RNA, 13 nt, Neisseria meningitidis Z2491
gauaaguuuccgu

SEQ ID NO: 1386075 - RNA, 20 nt, Neisseria meningitidis Z2491
gauaagcuguuugcgcuguu

SEQ ID NO: 1386076 - RNA, 17 nt, Neisseria meningitidis Z2491
gauagcuucgucauucc

SEQ ID NO: 1386077 - RNA, 23 nt, Neisseria meningitidis Z2491
gaucaccgucgccauaaucagcc

SEQ ID NO: 1386078 - RNA, 12 nt, Neisseria meningitidis Z2491
gauauaguuaca

SEQ ID NO: 1386079 - RNA, 15 nt, Neisseria meningitidis Z2491
gauauagguuuccgu

SEQ ID NO: 1386080 - RNA, 18 nt, Neisseria meningitidis Z2491
gauauucagguaaaacaa

SEQ ID NO: 1386081 - RNA, 17 nt, Neisseria meningitidis Z2491
gaugaaauuuagauaau

SEQ ID NO: 1386082 - RNA, 16 nt, Neisseria meningitidis Z2491
gaugaaacgaugacgg

SEQ ID NO: 1386083 - RNA, 16 nt, Neisseria meningitidis Z2491
gaucugcccguauuug

SEQ ID NO: 1386084 - RNA, 16 nt, Neisseria meningitidis Z2491
gaugaggcggaacgcg

SEQ ID NO: 1386085 - RNA, 21 nt, Neisseria meningitidis Z2491
gaugauuuuuucaacaccaaa

SEQ ID NO: 1386086 - RNA, 13 nt, Neisseria meningitidis Z2491
gaugaugcggaaa

SEQ ID NO: 1386087 - RNA, 16 nt, Neisseria meningitidis Z2491
gaugaugcggaaaucg

SEQ ID NO: 1386088 - RNA, 17 nt, Neisseria meningitidis Z2491
gaugcggacggcuugga

SEQ ID NO: 1386089 - RNA, 14 nt, Neisseria meningitidis Z2491
gaugccgucuaaag

SEQ ID NO: 1386090 - RNA, 20 nt, Neisseria meningitidis Z2491
gauucgccuuaaaaaacaaa

SEQ ID NO: 1386091 - RNA, 19 nt, Neisseria meningitidis Z2491
gauucgucauucccgcgca

SEQ ID NO: 1386092 - RNA, 16 nt, Neisseria meningitidis Z2491
gauugucaaaauacau

SEQ ID NO: 1386093 - RNA, 16 nt, Neisseria meningitidis Z2491
gauuguacggcagcca

SEQ ID NO: 1386094 - RNA, 23 nt, Neisseria meningitidis Z2491
gauuucguaauccgcaauauuca

SEQ ID NO: 1386095 - RNA, 12 nt, Neisseria meningitidis Z2491
gauuuugcagcu

SEQ ID NO: 1386096 - RNA, 20 nt, Neisseria meningitidis Z2491
gauuuuucuuuuauuuucaa

SEQ ID NO: 1386097 - RNA, 15 nt, Neisseria meningitidis Z2491
gauuuuuucaacacc

SEQ ID NO: 1386098 - RNA, 14 nt, Neisseria meningitidis Z2491
gcaaaaauuuaucc

SEQ ID NO: 1386099 - RNA, 22 nt, Neisseria meningitidis Z2491
gcaaaaauuuauccgaagcgac

SEQ ID NO: 1386100 - RNA, 15 nt, Neisseria meningitidis Z2491
gauucccgccugcgc

SEQ ID NO: 1386101 - RNA, 20 nt, Neisseria meningitidis Z2491
gauucccgagaaaacagaaa

SEQ ID NO: 1386102 - RNA, 20 nt, Neisseria meningitidis Z2491
gauuccguuguauaguggau

SEQ ID NO: 1386103 - RNA, 20 nt, Neisseria meningitidis Z2491
gauuccuacgaaaacaggaa

SEQ ID NO: 1386104 - RNA, 20 nt, Neisseria meningitidis Z2491
gauucccacuuucgugggaa

SEQ ID NO: 1386105 - RNA, 21 nt, Neisseria meningitidis Z2491
gauucaauaggauaggcugcu

SEQ ID NO: 1386106 - RNA, 21 nt, Neisseria meningitidis Z2491
gauucaaucggugucuuuccg

SEQ ID NO: 1386107 - RNA, 14 nt, Neisseria meningitidis Z2491
gauucauaaaauau

SEQ ID NO: 1386108 - RNA, 22 nt, Neisseria meningitidis Z2491
gauucacuuggugcuucagcac

SEQ ID NO: 1386109 - RNA, 21 nt, Neisseria meningitidis Z2491
gauuagguugguuugaaagag

SEQ ID NO: 1386110 - RNA, 21 nt, Neisseria meningitidis Z2491
gauucaaccccaggauaaagg

SEQ ID NO: 1386111 - RNA, 20 nt, Neisseria meningitidis Z2491
gauuauaguggauuaaauuu

SEQ ID NO: 1386112 - RNA, 15 nt, Neisseria meningitidis Z2491
gauuauauuugucca

SEQ ID NO: 1386113 - RNA, 13 nt, Neisseria meningitidis Z2491
gauguucugucuc

SEQ ID NO: 1386114 - RNA, 17 nt, Neisseria meningitidis Z2491
gauuacagaaaccuaaa

SEQ ID NO: 1386115 - RNA, 21 nt, Neisseria meningitidis Z2491
gauuaauuccggaaucagacc

SEQ ID NO: 1386116 - RNA, 22 nt, Neisseria meningitidis Z2491
gauuaauccgcuuccaaaacca

SEQ ID NO: 1386117 - RNA, 13 nt, Neisseria meningitidis Z2491
gauggcugaaauu

SEQ ID NO: 1386118 - RNA, 14 nt, Neisseria meningitidis Z2491
gauggcugaaauug

SEQ ID NO: 1386119 - RNA, 19 nt, Neisseria meningitidis Z2491
gauggcugcuuuggcagca

SEQ ID NO: 1386120 - RNA, 20 nt, Neisseria meningitidis Z2491
gauggcugcuuuggcagcac

SEQ ID NO: 1386121 - RNA, 22 nt, Neisseria meningitidis Z2491
gauguggguuugcccauagaaa

SEQ ID NO: 1386122 - RNA, 18 nt, Neisseria meningitidis Z2491
gaugugguagagaaaauu

SEQ ID NO: 1386123 - RNA, 18 nt, Neisseria meningitidis Z2491
gauguggguaaacggcag

SEQ ID NO: 1386124 - RNA, 23 nt, Neisseria meningitidis Z2491
gagcaugaguuccugcgagccuu

SEQ ID NO: 1386125 - RNA, 14 nt, Neisseria meningitidis Z2491
gagcauaaaauuuu

SEQ ID NO: 1386126 - RNA, 15 nt, Neisseria meningitidis Z2491
gagccaauagccgcc

SEQ ID NO: 1386127 - RNA, 11 nt, Neisseria meningitidis Z2491
gagcaggcagc

SEQ ID NO: 1386128 - RNA, 17 nt, Neisseria meningitidis Z2491
gagcaagaccaaacaga

SEQ ID NO: 1386129 - RNA, 19 nt, Neisseria meningitidis Z2491
gagcaagaccaaacagaac

SEQ ID NO: 1386130 - RNA, 24 nt, Neisseria meningitidis Z2491
gagauuucgcgguagguauuuugc

SEQ ID NO: 1386131 - RNA, 12 nt, Neisseria meningitidis Z2491
gagcaaaaagua

SEQ ID NO: 1386132 - RNA, 10 nt, Neisseria meningitidis Z2491
gagcaaaaag

SEQ ID NO: 1386133 - RNA, 21 nt, Neisseria meningitidis Z2491
gagcaccuuagagaaucguuc

SEQ ID NO: 1386134 - RNA, 15 nt, Neisseria meningitidis Z2491
gaggauuaagggggu

SEQ ID NO: 1386135 - RNA, 18 nt, Neisseria meningitidis Z2491
gaggcggaaucgaaccgc

SEQ ID NO: 1386136 - RNA, 17 nt, Neisseria meningitidis Z2491
gaggcauugaaauucca

SEQ ID NO: 1386137 - RNA, 20 nt, Neisseria meningitidis Z2491
gaggcauugaaauucuagau

SEQ ID NO: 1386138 - RNA, 19 nt, Neisseria meningitidis Z2491
gagcgacgaccauuuccaa

SEQ ID NO: 1386139 - RNA, 21 nt, Neisseria meningitidis Z2491
gagcuaaggcgaggcaacgcc

SEQ ID NO: 1386140 - RNA, 24 nt, Neisseria meningitidis Z2491
gagcucggucagauagcggucgga

SEQ ID NO: 1386141 - RNA, 22 nt, Neisseria meningitidis Z2491
gacggcggaagggguaaauccu

SEQ ID NO: 1386142 - RNA, 14 nt, Neisseria meningitidis Z2491
gacgggaaguuuuu

SEQ ID NO: 1386143 - RNA, 22 nt, Neisseria meningitidis Z2491
gacggcguuucggcgacagcuu

SEQ ID NO: 1386144 - RNA, 21 nt, Neisseria meningitidis Z2491
gacggcguuucuuguuuuugg

SEQ ID NO: 1386145 - RNA, 23 nt, Neisseria meningitidis Z2491
gacggggguuuggcgggaaugcc

SEQ ID NO: 1386146 - RNA, 18 nt, Neisseria meningitidis Z2491
gacgggauuuuagguuuc

SEQ ID NO: 1386147 - RNA, 22 nt, Neisseria meningitidis Z2491
gacgggauuuuagguuucugau

SEQ ID NO: 1386148 - RNA, 17 nt, Neisseria meningitidis Z2491
gacgggauauagguuuc

SEQ ID NO: 1386149 - RNA, 19 nt, Neisseria meningitidis Z2491
gacguaguuuacugugucg

SEQ ID NO: 1386150 - RNA, 19 nt, Neisseria meningitidis Z2491
gacguacaucaggcggcgu

SEQ ID NO: 1386151 - RNA, 18 nt, Neisseria meningitidis Z2491
gacgguucguccagcagc

SEQ ID NO: 1386152 - RNA, 21 nt, Neisseria meningitidis Z2491
gacguaaaaucuauaguggau

SEQ ID NO: 1386153 - RNA, 21 nt, Neisseria meningitidis Z2491
gacgguaucgccguuuugcag

SEQ ID NO: 1386154 - RNA, 13 nt, Neisseria meningitidis Z2491
gacggucaggaag

SEQ ID NO: 1386155 - RNA, 13 nt, Neisseria meningitidis Z2491
gacgguaucugug

SEQ ID NO: 1386156 - RNA, 13 nt, Neisseria meningitidis Z2491
gacguugccuucu

SEQ ID NO: 1386157 - RNA, 15 nt, Neisseria meningitidis Z2491
gacuaaccgaaaaua

SEQ ID NO: 1386158 - RNA, 16 nt, Neisseria meningitidis Z2491
gacuaaccgaaaauaa

SEQ ID NO: 1386159 - RNA, 23 nt, Neisseria meningitidis Z2491
gacuaaaccgccaacugauuaag

SEQ ID NO: 1386160 - RNA, 18 nt, Neisseria meningitidis Z2491
gacuagauucccgccugc

SEQ ID NO: 1386161 - RNA, 21 nt, Neisseria meningitidis Z2491
gacuagguaauacauaaccuu

SEQ ID NO: 1386162 - RNA, 13 nt, Neisseria meningitidis Z2491
gacuauuuuugca

SEQ ID NO: 1386163 - RNA, 21 nt, Neisseria meningitidis Z2491
gacucgcuugcugguaacauu

SEQ ID NO: 1386164 - RNA, 19 nt, Neisseria meningitidis Z2491
gacugcaguaacuucaaac

SEQ ID NO: 1386165 - RNA, 18 nt, Neisseria meningitidis Z2491
gacugaaacucaaaaaaa

SEQ ID NO: 1386166 - RNA, 22 nt, Neisseria meningitidis Z2491
gagaacgauucucuaaggugcu

SEQ ID NO: 1386167 - RNA, 13 nt, Neisseria meningitidis Z2491
gagaaguuucugc

SEQ ID NO: 1386168 - RNA, 21 nt, Neisseria meningitidis Z2491
gagaggcuuucagacggccuu

SEQ ID NO: 1386169 - RNA, 16 nt, Neisseria meningitidis Z2491
gagagcucggucagau

SEQ ID NO: 1386170 - RNA, 14 nt, Neisseria meningitidis Z2491
gagacggugugccg

SEQ ID NO: 1386171 - RNA, 13 nt, Neisseria meningitidis Z2491
gagaaaacagaaa

SEQ ID NO: 1386172 - RNA, 12 nt, Neisseria meningitidis Z2491
gagaacagaaaa

SEQ ID NO: 1386173 - RNA, 23 nt, Neisseria meningitidis Z2491
gagaacagaaaaccaaaaacaga

SEQ ID NO: 1386174 - RNA, 15 nt, Neisseria meningitidis Z2491
gacuuuggaacaaaa

SEQ ID NO: 1386175 - RNA, 20 nt, Neisseria meningitidis Z2491
gacuuuggaacaaaaaauau

SEQ ID NO: 1386176 - RNA, 12 nt, Neisseria meningitidis Z2491
gacuuuuuccag

SEQ ID NO: 1386177 - RNA, 15 nt, Neisseria meningitidis Z2491
gacuuaagaaacaaa

SEQ ID NO: 1386178 - RNA, 16 nt, Neisseria meningitidis Z2491
gacuucgauugccaag

SEQ ID NO: 1386179 - RNA, 14 nt, Neisseria meningitidis Z2491
gacuucgggcgcgu

SEQ ID NO: 1386180 - RNA, 20 nt, Neisseria meningitidis Z2491
gacuucugacagcauuucca

SEQ ID NO: 1386181 - RNA, 18 nt, Neisseria meningitidis Z2491
gacaguuuggagauauug

SEQ ID NO: 1386182 - RNA, 16 nt, Neisseria meningitidis Z2491
gacauacucuucaaca

SEQ ID NO: 1386183 - RNA, 22 nt, Neisseria meningitidis Z2491
gacaguaaccguagcaacugaa

SEQ ID NO: 1386184 - RNA, 14 nt, Neisseria meningitidis Z2491
gacaguacaaauag

SEQ ID NO: 1386185 - RNA, 15 nt, Neisseria meningitidis Z2491
gacauuaaaaaauac

SEQ ID NO: 1386186 - RNA, 16 nt, Neisseria meningitidis Z2491
gacaugguuugcaguc

SEQ ID NO: 1386187 - RNA, 19 nt, Neisseria meningitidis Z2491
gacauucgcguucggcuuu

SEQ ID NO: 1386188 - RNA, 22 nt, Neisseria meningitidis Z2491
gacauucucuuggucaaaaugu

SEQ ID NO: 1386189 - RNA, 12 nt, Neisseria meningitidis Z2491
gacauugcuaaa

SEQ ID NO: 1386190 - RNA, 22 nt, Neisseria meningitidis Z2491
gaccagcggcgcgguauuccca

SEQ ID NO: 1386191 - RNA, 13 nt, Neisseria meningitidis Z2491
gaccaaacagaac

SEQ ID NO: 1386192 - RNA, 18 nt, Neisseria meningitidis Z2491
gaccagagcggcauuucg

SEQ ID NO: 1386193 - RNA, 22 nt, Neisseria meningitidis Z2491
gaccacgaccagugcgccggca

SEQ ID NO: 1386194 - RNA, 14 nt, Neisseria meningitidis Z2491
cuuugguaaaaaaa

SEQ ID NO: 1386195 - RNA, 16 nt, Neisseria meningitidis Z2491
cuuugguaaaaaaaug

SEQ ID NO: 1386196 - RNA, 17 nt, Neisseria meningitidis Z2491
cuuuguaagaguucguc

SEQ ID NO: 1386197 - RNA, 12 nt, Neisseria meningitidis Z2491
gaauuuugcaaa

SEQ ID NO: 1386198 - RNA, 12 nt, Neisseria meningitidis Z2491
gacaaaauaccg

SEQ ID NO: 1386199 - RNA, 16 nt, Neisseria meningitidis Z2491
gacaaaugccgccagc

SEQ ID NO: 1386200 - RNA, 19 nt, Neisseria meningitidis Z2491
gacaaaugccgccagccac

SEQ ID NO: 1386201 - RNA, 21 nt, Neisseria meningitidis Z2491
gacaagacgacaggcggcgga

SEQ ID NO: 1386202 - RNA, 19 nt, Neisseria meningitidis Z2491
gacaaggccgacaggcguu

SEQ ID NO: 1386203 - RNA, 17 nt, Neisseria meningitidis Z2491
gacaaggcggcgaagcc

SEQ ID NO: 1386204 - RNA, 15 nt, Neisseria meningitidis Z2491
gacaaggcggcgagc

SEQ ID NO: 1386205 - RNA, 23 nt, Neisseria meningitidis Z2491
gacaacggucguggcaacuucca

SEQ ID NO: 1386206 - RNA, 14 nt, Neisseria meningitidis Z2491
gacaaucaggccgg

SEQ ID NO: 1386207 - RNA, 11 nt, Neisseria meningitidis Z2491
gacaaucacag

SEQ ID NO: 1386208 - RNA, 22 nt, Neisseria meningitidis Z2491
gacaauggagcaggcacaaggc

SEQ ID NO: 1386209 - RNA, 17 nt, Neisseria meningitidis Z2491
gacaauacggcggcggc

SEQ ID NO: 1386210 - RNA, 20 nt, Neisseria meningitidis Z2491
gacaauacggcggcggcagg

SEQ ID NO: 1386211 - RNA, 13 nt, Neisseria meningitidis Z2491
gacagauguuuuc

SEQ ID NO: 1386212 - RNA, 23 nt, Neisseria meningitidis Z2491
gacagaccuagauucccgccugc

SEQ ID NO: 1386213 - RNA, 12 nt, Neisseria meningitidis Z2491
gacagcauuucc

SEQ ID NO: 1386214 - RNA, 20 nt, Neisseria meningitidis Z2491
gacagccgaaacccaaacac

SEQ ID NO: 1386215 - RNA, 13 nt, Neisseria meningitidis Z2491
gacacaaugaaag

SEQ ID NO: 1386216 - RNA, 11 nt, Neisseria meningitidis Z2491
gacgaugaaaa

SEQ ID NO: 1386217 - RNA, 17 nt, Neisseria meningitidis Z2491
gacgaugaguuuuuugc

SEQ ID NO: 1386218 - RNA, 18 nt, Neisseria meningitidis Z2491
gacgaugaguuuuuugcc

SEQ ID NO: 1386219 - RNA, 22 nt, Neisseria meningitidis Z2491
gacgaugaguuuuuugccuucg

SEQ ID NO: 1386220 - RNA, 18 nt, Neisseria meningitidis Z2491
gacgaaaaucggcgcagu

SEQ ID NO: 1386221 - RNA, 20 nt, Neisseria meningitidis Z2491
gacgaagaaauagccgccgc

SEQ ID NO: 1386222 - RNA, 21 nt, Neisseria meningitidis Z2491
gacgaagaaauagccgccgcc

SEQ ID NO: 1386223 - RNA, 22 nt, Neisseria meningitidis Z2491
gacgaagaaauagccgccgccg

SEQ ID NO: 1386224 - RNA, 15 nt, Neisseria meningitidis Z2491
gacgaaggcaagggu

SEQ ID NO: 1386225 - RNA, 16 nt, Neisseria meningitidis Z2491
gacgacaggcggcgga

SEQ ID NO: 1386226 - RNA, 15 nt, Neisseria meningitidis Z2491
gacgcguuuugccug

SEQ ID NO: 1386227 - RNA, 13 nt, Neisseria meningitidis Z2491
gacgcggcugcug

SEQ ID NO: 1386228 - RNA, 14 nt, Neisseria meningitidis Z2491
gacggaaacucaaa

SEQ ID NO: 1386229 - RNA, 17 nt, Neisseria meningitidis Z2491
gacggaaacucaaaaaa

SEQ ID NO: 1386230 - RNA, 18 nt, Neisseria meningitidis Z2491
gacggaaacucaaaaaac

SEQ ID NO: 1386231 - RNA, 20 nt, Neisseria meningitidis Z2491
gacggcauauguuuuuuccu

SEQ ID NO: 1386232 - RNA, 22 nt, Neisseria meningitidis Z2491
gacggcauauguuuuuuccugu

SEQ ID NO: 1386233 - RNA, 14 nt, Neisseria meningitidis Z2491
gacggcaucuuccu

SEQ ID NO: 1386234 - RNA, 17 nt, Neisseria meningitidis Z2491
gacggaucauagacauc

SEQ ID NO: 1386235 - RNA, 14 nt, Neisseria meningitidis Z2491
gacggacggcggca

SEQ ID NO: 1386236 - RNA, 21 nt, Neisseria meningitidis Z2491
gacggccuucgcgguuuuccg

SEQ ID NO: 1386237 - RNA, 13 nt, Neisseria meningitidis Z2491
gacggcgaggcug

SEQ ID NO: 1386238 - RNA, 15 nt, Neisseria meningitidis Z2491
gacggcgaggcugca

SEQ ID NO: 1386239 - RNA, 17 nt, Neisseria meningitidis Z2491
gacggcauuuuucauuu

SEQ ID NO: 1386240 - RNA, 22 nt, Neisseria meningitidis Z2491
gacggcauuuuuguguggcggu

SEQ ID NO: 1386241 - RNA, 16 nt, Neisseria meningitidis Z2491
gacggcauuuuuucac

SEQ ID NO: 1386242 - RNA, 17 nt, Neisseria meningitidis Z2491
gacggcauuaaaauuug

SEQ ID NO: 1386243 - RNA, 15 nt, Neisseria meningitidis Z2491
gacgcgaacagaaac

SEQ ID NO: 1386244 - RNA, 14 nt, Neisseria meningitidis Z2491
gaccauaaagagca

SEQ ID NO: 1386245 - RNA, 15 nt, Neisseria meningitidis Z2491
gaccauaaagagcag

SEQ ID NO: 1386246 - RNA, 18 nt, Neisseria meningitidis Z2491
gaccauaaagagcaggac

SEQ ID NO: 1386247 - RNA, 23 nt, Neisseria meningitidis Z2491
gacccaccaaacaugggcuaaaa

SEQ ID NO: 1386248 - RNA, 15 nt, Neisseria meningitidis Z2491
gaccauuucuuccag

SEQ ID NO: 1386249 - RNA, 19 nt, Neisseria meningitidis Z2491
gacccauucugacaaggcc

SEQ ID NO: 1386250 - RNA, 13 nt, Neisseria meningitidis Z2491
gacccgaaucaca

SEQ ID NO: 1386251 - RNA, 23 nt, Neisseria meningitidis Z2491
gaccgaaacucaacgaaccugga

SEQ ID NO: 1386252 - RNA, 21 nt, Neisseria meningitidis Z2491
gacccucccccacaggggagg

SEQ ID NO: 1386253 - RNA, 14 nt, Neisseria meningitidis Z2491
gaccuguaaaauau

SEQ ID NO: 1386254 - RNA, 14 nt, Neisseria meningitidis Z2491
gaccguguuuccaa

SEQ ID NO: 1386255 - RNA, 13 nt, Neisseria meningitidis Z2491
gaccuccagcacc

SEQ ID NO: 1386256 - RNA, 21 nt, Neisseria meningitidis Z2491
gaccgccgccgcaaccgccga

SEQ ID NO: 1386257 - RNA, 14 nt, Neisseria meningitidis Z2491
gaccgccgccgccu

SEQ ID NO: 1386258 - RNA, 16 nt, Neisseria meningitidis Z2491
cgucauucccgcgcag

SEQ ID NO: 1386259 - RNA, 12 nt, Neisseria meningitidis Z2491
cgucauucccac

SEQ ID NO: 1386260 - RNA, 20 nt, Neisseria meningitidis Z2491
cguccaaaaggacguagucg

SEQ ID NO: 1386261 - RNA, 22 nt, Neisseria meningitidis Z2491
cguccaaaugccgcaaaugccg

SEQ ID NO: 1386262 - RNA, 16 nt, Neisseria meningitidis Z2491
cguccaacacgcagcc

SEQ ID NO: 1386263 - RNA, 20 nt, Neisseria meningitidis Z2491
cguccaacacgcagccgagc

SEQ ID NO: 1386264 - RNA, 14 nt, Neisseria meningitidis Z2491
cguccaaccuuccc

SEQ ID NO: 1386265 - RNA, 17 nt, Neisseria meningitidis Z2491
cguccacaagccgccga

SEQ ID NO: 1386266 - RNA, 20 nt, Neisseria meningitidis Z2491
cguuccacaaauccgccugu

SEQ ID NO: 1386267 - RNA, 20 nt, Neisseria meningitidis Z2491
cguuccaaauauuuccugca

SEQ ID NO: 1386268 - RNA, 22 nt, Neisseria meningitidis Z2491
cguucgggaauauucugauagg

SEQ ID NO: 1386269 - RNA, 22 nt, Neisseria meningitidis Z2491
cguucuagauucccgccugcgc

SEQ ID NO: 1386270 - RNA, 15 nt, Neisseria meningitidis Z2491
cguugaaccacguuu

SEQ ID NO: 1386271 - RNA, 22 nt, Neisseria meningitidis Z2491
cguugagccuucacgccgccgc

SEQ ID NO: 1386272 - RNA, 23 nt, Neisseria meningitidis Z2491
cuaaagccguccguaagccuuca

SEQ ID NO: 1386273 - RNA, 15 nt, Neisseria meningitidis Z2491
cuaaaauuuuaugcu

SEQ ID NO: 1386274 - RNA, 18 nt, Neisseria meningitidis Z2491
cuaaaauccgucauuccc

SEQ ID NO: 1386275 - RNA, 21 nt, Neisseria meningitidis Z2491
cguuuuccaaggcgguuuugu

SEQ ID NO: 1386276 - RNA, 13 nt, Neisseria meningitidis Z2491
cguuuuccaccgc

SEQ ID NO: 1386277 - RNA, 21 nt, Neisseria meningitidis Z2491
cguuuucacgggaaugacgaa

SEQ ID NO: 1386278 - RNA, 15 nt, Neisseria meningitidis Z2491
cguuucuuguuuuug

SEQ ID NO: 1386279 - RNA, 19 nt, Neisseria meningitidis Z2491
cguuuugaugguuuuccaa

SEQ ID NO: 1386280 - RNA, 17 nt, Neisseria meningitidis Z2491
cguuucuagauucccac

SEQ ID NO: 1386281 - RNA, 13 nt, Neisseria meningitidis Z2491
cguuucuauuuuc

SEQ ID NO: 1386282 - RNA, 21 nt, Neisseria meningitidis Z2491
cguuucagacggcauuuucaa

SEQ ID NO: 1386283 - RNA, 16 nt, Neisseria meningitidis Z2491
cuaaggcaauuuaucg

SEQ ID NO: 1386284 - RNA, 14 nt, Neisseria meningitidis Z2491
cuaacucuauuucc

SEQ ID NO: 1386285 - RNA, 15 nt, Neisseria meningitidis Z2491
cuaauucgugauucc

SEQ ID NO: 1386286 - RNA, 16 nt, Neisseria meningitidis Z2491
cuaauucuacccaaau

SEQ ID NO: 1386287 - RNA, 16 nt, Neisseria meningitidis Z2491
cuaaucgcgucauucc

SEQ ID NO: 1386288 - RNA, 17 nt, Neisseria meningitidis Z2491
cuacauuccgucauucc

SEQ ID NO: 1386289 - RNA, 18 nt, Neisseria meningitidis Z2491
cuaccauuguuucugaag

SEQ ID NO: 1386290 - RNA, 22 nt, Neisseria meningitidis Z2491
cuccaaguuccaauacauuuuu

SEQ ID NO: 1386291 - RNA, 20 nt, Neisseria meningitidis Z2491
cucaacgaaccuggauuccc

SEQ ID NO: 1386292 - RNA, 13 nt, Neisseria meningitidis Z2491
cucaagacaauca

SEQ ID NO: 1386293 - RNA, 10 nt, Neisseria meningitidis Z2491
cuauugccuu

SEQ ID NO: 1386294 - RNA, 17 nt, Neisseria meningitidis Z2491
cuauugccuuuauugug

SEQ ID NO: 1386295 - RNA, 12 nt, Neisseria meningitidis Z2491
cucaaaaacaga

SEQ ID NO: 1386296 - RNA, 14 nt, Neisseria meningitidis Z2491
cucaaaaacagaaa

SEQ ID NO: 1386297 - RNA, 17 nt, Neisseria meningitidis Z2491
cucaaaaacagaaaacc

SEQ ID NO: 1386298 - RNA, 18 nt, Neisseria meningitidis Z2491
cucaaaaacagaaaacca

SEQ ID NO: 1386299 - RNA, 23 nt, Neisseria meningitidis Z2491
cucaaaaacagaaaaccaaaauc

SEQ ID NO: 1386300 - RNA, 20 nt, Neisseria meningitidis Z2491
cucacgcaggcuuuugaggc

SEQ ID NO: 1386301 - RNA, 12 nt, Neisseria meningitidis Z2491
cuauaaaaaaac

SEQ ID NO: 1386302 - RNA, 16 nt, Neisseria meningitidis Z2491
cuauaguggauuaaca

SEQ ID NO: 1386303 - RNA, 20 nt, Neisseria meningitidis Z2491
cuauaguggauuaacaaaaa

SEQ ID NO: 1386304 - RNA, 21 nt, Neisseria meningitidis Z2491
cuauaguggauuaacaaaaac

SEQ ID NO: 1386305 - RNA, 16 nt, Neisseria meningitidis Z2491
cuauauuuucgcaaga

SEQ ID NO: 1386306 - RNA, 15 nt, Neisseria meningitidis Z2491
cuauccauuccugcg

SEQ ID NO: 1386307 - RNA, 14 nt, Neisseria meningitidis Z2491
cuaucccuuaagaa

SEQ ID NO: 1386308 - RNA, 21 nt, Neisseria meningitidis Z2491
cuauccgcacagaaaccugca

SEQ ID NO: 1386309 - RNA, 12 nt, Neisseria meningitidis Z2491
cuauguuaugug

SEQ ID NO: 1386310 - RNA, 20 nt, Neisseria meningitidis Z2491
cuaguacagccccuuaaagu

SEQ ID NO: 1386311 - RNA, 22 nt, Neisseria meningitidis Z2491
cuaggggcgguuugcggcggca

SEQ ID NO: 1386312 - RNA, 21 nt, Neisseria meningitidis Z2491
cuagauucccgccugcgcggg

SEQ ID NO: 1386313 - RNA, 15 nt, Neisseria meningitidis Z2491
cuagauucccgcuuu

SEQ ID NO: 1386314 - RNA, 21 nt, Neisseria meningitidis Z2491
cuagauucccgcuuuugcggg

SEQ ID NO: 1386315 - RNA, 12 nt, Neisseria meningitidis Z2491
cuagggaaaugc

SEQ ID NO: 1386316 - RNA, 19 nt, Neisseria meningitidis Z2491
cuagaaucucggacuuuca

SEQ ID NO: 1386317 - RNA, 23 nt, Neisseria meningitidis Z2491
cuagaaucucguuauuuccacaa

SEQ ID NO: 1386318 - RNA, 16 nt, Neisseria meningitidis Z2491
cuagacauucaaugcu

SEQ ID NO: 1386319 - RNA, 22 nt, Neisseria meningitidis Z2491
cuagacauucaaugcuaaggca

SEQ ID NO: 1386320 - RNA, 15 nt, Neisseria meningitidis Z2491
cuacuucauuuuuuc

SEQ ID NO: 1386321 - RNA, 19 nt, Neisseria meningitidis Z2491
cuacuucauuuuuucaagc

SEQ ID NO: 1386322 - RNA, 21 nt, Neisseria meningitidis Z2491
cuacccgguuuugcgccucgc

SEQ ID NO: 1386323 - RNA, 20 nt, Neisseria meningitidis Z2491
cugaaaggcuuuuucagacg

SEQ ID NO: 1386324 - RNA, 17 nt, Neisseria meningitidis Z2491
cugaaacccgauuccug

SEQ ID NO: 1386325 - RNA, 14 nt, Neisseria meningitidis Z2491
cugaaacucaaaaa

SEQ ID NO: 1386326 - RNA, 15 nt, Neisseria meningitidis Z2491
cugaaacucaaaaaa

SEQ ID NO: 1386327 - RNA, 16 nt, Neisseria meningitidis Z2491
cugaaacucaaaaaac

SEQ ID NO: 1386328 - RNA, 18 nt, Neisseria meningitidis Z2491
cugaaacucaaaaaaccg

SEQ ID NO: 1386329 - RNA, 18 nt, Neisseria meningitidis Z2491
cugaaacucaaaaagcug

SEQ ID NO: 1386330 - RNA, 22 nt, Neisseria meningitidis Z2491
cugaaacucaacgcacuggauu

SEQ ID NO: 1386331 - RNA, 21 nt, Neisseria meningitidis Z2491
cugaaaccaaaucggcuuuca

SEQ ID NO: 1386332 - RNA, 22 nt, Neisseria meningitidis Z2491
cugaaacacuguucagacgguc

SEQ ID NO: 1386333 - RNA, 19 nt, Neisseria meningitidis Z2491
cugaaacggcggcaggguu

SEQ ID NO: 1386334 - RNA, 14 nt, Neisseria meningitidis Z2491
cugaaaaucggguu

SEQ ID NO: 1386335 - RNA, 19 nt, Neisseria meningitidis Z2491
cugaaaacgcuguuuuuug

SEQ ID NO: 1386336 - RNA, 13 nt, Neisseria meningitidis Z2491
cugaaaacagaaa

SEQ ID NO: 1386337 - RNA, 22 nt, Neisseria meningitidis Z2491
cugaaaacagaaaccuaaaauu

SEQ ID NO: 1386338 - RNA, 19 nt, Neisseria meningitidis Z2491
cugaaaaaccuuucccguu

SEQ ID NO: 1386339 - RNA, 14 nt, Neisseria meningitidis Z2491
cugaaaaaaugccg

SEQ ID NO: 1386340 - RNA, 17 nt, Neisseria meningitidis Z2491
cugaagauauuggaaca

SEQ ID NO: 1386341 - RNA, 19 nt, Neisseria meningitidis Z2491
cugaagcaccaaguaaauc

SEQ ID NO: 1386342 - RNA, 20 nt, Neisseria meningitidis Z2491
cugaagcccacccuaccauu

SEQ ID NO: 1386343 - RNA, 18 nt, Neisseria meningitidis Z2491
cugaagccagccccacca

SEQ ID NO: 1386344 - RNA, 16 nt, Neisseria meningitidis Z2491
cugaagccuucagaca

SEQ ID NO: 1386345 - RNA, 19 nt, Neisseria meningitidis Z2491
cugaagccuucagacaaca

SEQ ID NO: 1386346 - RNA, 20 nt, Neisseria meningitidis Z2491
cugaagccuucagacaacaa

SEQ ID NO: 1386347 - RNA, 23 nt, Neisseria meningitidis Z2491
cugaagccuucagacaacaagcc

SEQ ID NO: 1386348 - RNA, 20 nt, Neisseria meningitidis Z2491
cugaagcccuguuucggguu

SEQ ID NO: 1386349 - RNA, 18 nt, Neisseria meningitidis Z2491
cugaagcccuuucagacg

SEQ ID NO: 1386350 - RNA, 16 nt, Neisseria meningitidis Z2491
cugaacgcuucagacg

SEQ ID NO: 1386351 - RNA, 20 nt, Neisseria meningitidis Z2491
cugaagaaaccguuuuaucc

SEQ ID NO: 1386352 - RNA, 16 nt, Neisseria meningitidis Z2491
cugaacauuucagacg

SEQ ID NO: 1386353 - RNA, 16 nt, Neisseria meningitidis Z2491
cugaaccuuauagugg

SEQ ID NO: 1386354 - RNA, 21 nt, Neisseria meningitidis Z2491
cugaaauaugguucagacggc

SEQ ID NO: 1386355 - RNA, 23 nt, Neisseria meningitidis Z2491
cugaaauccuauuuucagauggc

SEQ ID NO: 1386356 - RNA, 14 nt, Neisseria meningitidis Z2491
cugaaauagaaaau

SEQ ID NO: 1386357 - RNA, 18 nt, Neisseria meningitidis Z2491
cugaaauagaaaauauug

SEQ ID NO: 1386358 - RNA, 21 nt, Neisseria meningitidis Z2491
cugaaauucgucauucccgcu

SEQ ID NO: 1386359 - RNA, 22 nt, Neisseria meningitidis Z2491
cugaaauugaaaguuacagaaa

SEQ ID NO: 1386360 - RNA, 16 nt, Neisseria meningitidis Z2491
cugaaauucaaaaaac

SEQ ID NO: 1386361 - RNA, 16 nt, Neisseria meningitidis Z2491
cugaaauguucagacg

SEQ ID NO: 1386362 - RNA, 15 nt, Neisseria meningitidis Z2491
cugaaauuucagacg

SEQ ID NO: 1386363 - RNA, 16 nt, Neisseria meningitidis Z2491
cugaaauuuugccauu

SEQ ID NO: 1386364 - RNA, 17 nt, Neisseria meningitidis Z2491
cucuucgcguacuuuau

SEQ ID NO: 1386365 - RNA, 20 nt, Neisseria meningitidis Z2491
cucuuggauaaacauuuuug

SEQ ID NO: 1386366 - RNA, 16 nt, Neisseria meningitidis Z2491
cucuuggucaaaaugu

SEQ ID NO: 1386367 - RNA, 15 nt, Neisseria meningitidis Z2491
cucuguucgaccaca

SEQ ID NO: 1386368 - RNA, 19 nt, Neisseria meningitidis Z2491
cugagaccuuugcaaaaau

SEQ ID NO: 1386369 - RNA, 14 nt, Neisseria meningitidis Z2491
cugacgguuuuuuu

SEQ ID NO: 1386370 - RNA, 15 nt, Neisseria meningitidis Z2491
cugacgguauagccc

SEQ ID NO: 1386371 - RNA, 15 nt, Neisseria meningitidis Z2491
cugacggucugcaaa

SEQ ID NO: 1386372 - RNA, 20 nt, Neisseria meningitidis Z2491
cugacgcuccagcuccggcc

SEQ ID NO: 1386373 - RNA, 20 nt, Neisseria meningitidis Z2491
cugacgcgcgauggaacgca

SEQ ID NO: 1386374 - RNA, 18 nt, Neisseria meningitidis Z2491
cugacgcguuuuaccugc

SEQ ID NO: 1386375 - RNA, 20 nt, Neisseria meningitidis Z2491
cugacuaaccgaaaauaauu

SEQ ID NO: 1386376 - RNA, 12 nt, Neisseria meningitidis Z2491
cugaaggcuuca

SEQ ID NO: 1386377 - RNA, 16 nt, Neisseria meningitidis Z2491
cugaagcguauuucua

SEQ ID NO: 1386378 - RNA, 16 nt, Neisseria meningitidis Z2491
cugaagcucaaaaaac

SEQ ID NO: 1386379 - RNA, 21 nt, Neisseria meningitidis Z2491
cugaauugacaugguauagag

SEQ ID NO: 1386380 - RNA, 20 nt, Neisseria meningitidis Z2491
cugaauccaucaauuuccac

SEQ ID NO: 1386381 - RNA, 21 nt, Neisseria meningitidis Z2491
cugaaucagguugaaaaugcc

SEQ ID NO: 1386382 - RNA, 13 nt, Neisseria meningitidis Z2491
cugacaggaaauu

SEQ ID NO: 1386383 - RNA, 16 nt, Neisseria meningitidis Z2491
cugacagcauuuccac

SEQ ID NO: 1386384 - RNA, 17 nt, Neisseria meningitidis Z2491
cucuccccgacccuccc

SEQ ID NO: 1386385 - RNA, 14 nt, Neisseria meningitidis Z2491
cucucccucuuuaa

SEQ ID NO: 1386386 - RNA, 13 nt, Neisseria meningitidis Z2491
cucucaaaauauu

SEQ ID NO: 1386387 - RNA, 13 nt, Neisseria meningitidis Z2491
cucucuauaaaau

SEQ ID NO: 1386388 - RNA, 13 nt, Neisseria meningitidis Z2491
cucugccagcucc

SEQ ID NO: 1386389 - RNA, 15 nt, Neisseria meningitidis Z2491
cucugauagccgccc

SEQ ID NO: 1386390 - RNA, 23 nt, Neisseria meningitidis Z2491
cucugauagccgcccaaugccgu

SEQ ID NO: 1386391 - RNA, 16 nt, Neisseria meningitidis Z2491
cucugaaagccagcgg

SEQ ID NO: 1386392 - RNA, 16 nt, Neisseria meningitidis Z2491
cucugccgucauuccc

SEQ ID NO: 1386393 - RNA, 21 nt, Neisseria meningitidis Z2491
cucugcggacuuaagaaacaa

SEQ ID NO: 1386394 - RNA, 17 nt, Neisseria meningitidis Z2491
cucguuauuuccacaaa

SEQ ID NO: 1386395 - RNA, 18 nt, Neisseria meningitidis Z2491
cucguuauuuccacaaaa

SEQ ID NO: 1386396 - RNA, 19 nt, Neisseria meningitidis Z2491
cucguuauuuccacaaaaa

SEQ ID NO: 1386397 - RNA, 14 nt, Neisseria meningitidis Z2491
cucgucauuuccac

SEQ ID NO: 1386398 - RNA, 18 nt, Neisseria meningitidis Z2491
cucgccuuagcucaaaga

SEQ ID NO: 1386399 - RNA, 20 nt, Neisseria meningitidis Z2491
cucgccuuucguauccaaau

SEQ ID NO: 1386400 - RNA, 21 nt, Neisseria meningitidis Z2491
cucggcagacaaaccgucccc

SEQ ID NO: 1386401 - RNA, 13 nt, Neisseria meningitidis Z2491
cucggccugcccu

SEQ ID NO: 1386402 - RNA, 16 nt, Neisseria meningitidis Z2491
cucggccugcccugcc

SEQ ID NO: 1386403 - RNA, 19 nt, Neisseria meningitidis Z2491
cuccuucgggcgcuuggaa

SEQ ID NO: 1386404 - RNA, 14 nt, Neisseria meningitidis Z2491
cuccggauuccugu

SEQ ID NO: 1386405 - RNA, 13 nt, Neisseria meningitidis Z2491
cuccgucaaaaca

SEQ ID NO: 1386406 - RNA, 16 nt, Neisseria meningitidis Z2491
cuccgccgucauuccc

SEQ ID NO: 1386407 - RNA, 20 nt, Neisseria meningitidis Z2491
cuccgccucugccagcuccg

SEQ ID NO: 1386408 - RNA, 17 nt, Neisseria meningitidis Z2491
cuccgccuguaugcggc

SEQ ID NO: 1386409 - RNA, 22 nt, Neisseria meningitidis Z2491
cuccccuacgccaaccucagcc

SEQ ID NO: 1386410 - RNA, 13 nt, Neisseria meningitidis Z2491
cugugguuuaacu

SEQ ID NO: 1386411 - RNA, 15 nt, Neisseria meningitidis Z2491
cuguggauaaguaaa

SEQ ID NO: 1386412 - RNA, 21 nt, Neisseria meningitidis Z2491
cuguggauucgccuuaaaaaa

SEQ ID NO: 1386413 - RNA, 11 nt, Neisseria meningitidis Z2491
cuguguuucaa

SEQ ID NO: 1386414 - RNA, 13 nt, Neisseria meningitidis Z2491
cuguguuucaaua

SEQ ID NO: 1386415 - RNA, 18 nt, Neisseria meningitidis Z2491
cuguguuccgggccgaug

SEQ ID NO: 1386416 - RNA, 20 nt, Neisseria meningitidis Z2491
cugugcccacacguuuugca

SEQ ID NO: 1386417 - RNA, 17 nt, Neisseria meningitidis Z2491
cugugagaacaagccug

SEQ ID NO: 1386418 - RNA, 16 nt, Neisseria meningitidis Z2491
cuguacugguuuaaau

SEQ ID NO: 1386419 - RNA, 20 nt, Neisseria meningitidis Z2491
cuguacugguuuaaauuuaa

SEQ ID NO: 1386420 - RNA, 16 nt, Neisseria meningitidis Z2491
cuguacugucugcggc

SEQ ID NO: 1386421 - RNA, 14 nt, Neisseria meningitidis Z2491
cuguacuagauuag

SEQ ID NO: 1386422 - RNA, 22 nt, Neisseria meningitidis Z2491
cuguccagacggagauuuuguu

SEQ ID NO: 1386423 - RNA, 16 nt, Neisseria meningitidis Z2491
cuguccaaagccucgc

SEQ ID NO: 1386424 - RNA, 17 nt, Neisseria meningitidis Z2491
cuguaugccgucugaaa

SEQ ID NO: 1386425 - RNA, 19 nt, Neisseria meningitidis Z2491
cuguaugcggcuugggcga

SEQ ID NO: 1386426 - RNA, 16 nt, Neisseria meningitidis Z2491
cugguguugauaauca

SEQ ID NO: 1386427 - RNA, 21 nt, Neisseria meningitidis Z2491
cugguguugauaaucaucacu

SEQ ID NO: 1386428 - RNA, 21 nt, Neisseria meningitidis Z2491
cugguuuaaauuuaauucacu

SEQ ID NO: 1386429 - RNA, 19 nt, Neisseria meningitidis Z2491
cugguuuaaauuuaguuca

SEQ ID NO: 1386430 - RNA, 12 nt, Neisseria meningitidis Z2491
cuggcugccgau

SEQ ID NO: 1386431 - RNA, 20 nt, Neisseria meningitidis Z2491
cugcuucggcggagaggcuu

SEQ ID NO: 1386432 - RNA, 15 nt, Neisseria meningitidis Z2491
cugcuguugcaaagc

SEQ ID NO: 1386433 - RNA, 16 nt, Neisseria meningitidis Z2491
cugcuguugcaaagcc

SEQ ID NO: 1386434 - RNA, 18 nt, Neisseria meningitidis Z2491
cuggcaaauugaaaugcc

SEQ ID NO: 1386435 - RNA, 19 nt, Neisseria meningitidis Z2491
cuggaugccgcgccgccgg

SEQ ID NO: 1386436 - RNA, 19 nt, Neisseria meningitidis Z2491
cugcugaagucgugaauua

SEQ ID NO: 1386437 - RNA, 13 nt, Neisseria meningitidis Z2491
cugcugccgcccc

SEQ ID NO: 1386438 - RNA, 14 nt, Neisseria meningitidis Z2491
cugcugccaucuca

SEQ ID NO: 1386439 - RNA, 23 nt, Neisseria meningitidis Z2491
cugcugacuaaccgaaaauaauu

SEQ ID NO: 1386440 - RNA, 21 nt, Neisseria meningitidis Z2491
cugcugcaaaccgucugccaa

SEQ ID NO: 1386441 - RNA, 17 nt, Neisseria meningitidis Z2491
cugcugcuuuucauuuc

SEQ ID NO: 1386442 - RNA, 17 nt, Neisseria meningitidis Z2491
cugcuggcagucuauca

SEQ ID NO: 1386443 - RNA, 18 nt, Neisseria meningitidis Z2491
cugcuggaaauugccuuc

SEQ ID NO: 1386444 - RNA, 14 nt, Neisseria meningitidis Z2491
cugccuucuucuuu

SEQ ID NO: 1386445 - RNA, 15 nt, Neisseria meningitidis Z2491
cugccgccgccuugu

SEQ ID NO: 1386446 - RNA, 14 nt, Neisseria meningitidis Z2491
cugccgccgcccgg

SEQ ID NO: 1386447 - RNA, 19 nt, Neisseria meningitidis Z2491
cugccgccgcccgggccgg

SEQ ID NO: 1386448 - RNA, 13 nt, Neisseria meningitidis Z2491
cugccgccccauu

SEQ ID NO: 1386449 - RNA, 23 nt, Neisseria meningitidis Z2491
cugcgccacggcuuucgcgccgc

SEQ ID NO: 1386450 - RNA, 14 nt, Neisseria meningitidis Z2491
cugcgucaaaccag

SEQ ID NO: 1386451 - RNA, 15 nt, Neisseria meningitidis Z2491
cugcgucaaaccagc

SEQ ID NO: 1386452 - RNA, 19 nt, Neisseria meningitidis Z2491
cugaugaugauggcggcaa

SEQ ID NO: 1386453 - RNA, 17 nt, Neisseria meningitidis Z2491
cugauggccgguaaaca

SEQ ID NO: 1386454 - RNA, 20 nt, Neisseria meningitidis Z2491
cugauugaccgaaaaauaau

SEQ ID NO: 1386455 - RNA, 12 nt, Neisseria meningitidis Z2491
cugauuuuuccu

SEQ ID NO: 1386456 - RNA, 19 nt, Neisseria meningitidis Z2491
cugauuuuuccuacuuuuu

SEQ ID NO: 1386457 - RNA, 16 nt, Neisseria meningitidis Z2491
cugauuuuguuuuuga

SEQ ID NO: 1386458 - RNA, 17 nt, Neisseria meningitidis Z2491
cugauuuuguuuuugag

SEQ ID NO: 1386459 - RNA, 14 nt, Neisseria meningitidis Z2491
cugauuuugagaaa

SEQ ID NO: 1386460 - RNA, 16 nt, Neisseria meningitidis Z2491
cugauuuugauuuucc

SEQ ID NO: 1386461 - RNA, 15 nt, Neisseria meningitidis Z2491
cugauuuuuguuaau

SEQ ID NO: 1386462 - RNA, 19 nt, Neisseria meningitidis Z2491
cugcaccacgucauuccca

SEQ ID NO: 1386463 - RNA, 13 nt, Neisseria meningitidis Z2491
cugccaaaacuca

SEQ ID NO: 1386464 - RNA, 18 nt, Neisseria meningitidis Z2491
cugccaauagaauuuaua

SEQ ID NO: 1386465 - RNA, 23 nt, Neisseria meningitidis Z2491
cugcaugagcgagcgggcgugau

SEQ ID NO: 1386466 - RNA, 20 nt, Neisseria meningitidis Z2491
cugcagcuucgucgccuugu

SEQ ID NO: 1386467 - RNA, 22 nt, Neisseria meningitidis Z2491
cugcaucccgucauuccucaaa

SEQ ID NO: 1386468 - RNA, 14 nt, Neisseria meningitidis Z2491
cugcauauaggcaa

SEQ ID NO: 1386469 - RNA, 18 nt, Neisseria meningitidis Z2491
cugcccgaaugcggggaa

SEQ ID NO: 1386470 - RNA, 21 nt, Neisseria meningitidis Z2491
cugccccguuuuacccucucc

SEQ ID NO: 1386471 - RNA, 15 nt, Neisseria meningitidis Z2491
cugccgcacaagccc

SEQ ID NO: 1386472 - RNA, 16 nt, Neisseria meningitidis Z2491
cugccgcacaagcccu

SEQ ID NO: 1386473 - RNA, 17 nt, Neisseria meningitidis Z2491
cugccgcacaagcccua

SEQ ID NO: 1386474 - RNA, 14 nt, Neisseria meningitidis Z2491
cugccgauuucuuc

SEQ ID NO: 1386475 - RNA, 19 nt, Neisseria meningitidis Z2491
cugcccaaauccagcaaug

SEQ ID NO: 1386476 - RNA, 12 nt, Neisseria meningitidis Z2491
cugccauuaguu

SEQ ID NO: 1386477 - RNA, 19 nt, Neisseria meningitidis Z2491
cuucaucucgccaaucuca

SEQ ID NO: 1386478 - RNA, 21 nt, Neisseria meningitidis Z2491
cuuccaaagcugcaguugggc

SEQ ID NO: 1386479 - RNA, 18 nt, Neisseria meningitidis Z2491
cuucagacggcauuuuuc

SEQ ID NO: 1386480 - RNA, 18 nt, Neisseria meningitidis Z2491
cuucagacggcauuuuuu

SEQ ID NO: 1386481 - RNA, 20 nt, Neisseria meningitidis Z2491
cuuccagcaauuucugcacu

SEQ ID NO: 1386482 - RNA, 20 nt, Neisseria meningitidis Z2491
cuuccacaccguucagcccg

SEQ ID NO: 1386483 - RNA, 18 nt, Neisseria meningitidis Z2491
cuuccgucaaaaaugccu

SEQ ID NO: 1386484 - RNA, 23 nt, Neisseria meningitidis Z2491
cuuccgugucaggaugucugccu

SEQ ID NO: 1386485 - RNA, 18 nt, Neisseria meningitidis Z2491
cuuccguguguauagugg

SEQ ID NO: 1386486 - RNA, 19 nt, Neisseria meningitidis Z2491
cuuccguguguauagugga

SEQ ID NO: 1386487 - RNA, 12 nt, Neisseria meningitidis Z2491
cuucccucccga

SEQ ID NO: 1386488 - RNA, 18 nt, Neisseria meningitidis Z2491
cuucccgcaaaaacggaa

SEQ ID NO: 1386489 - RNA, 11 nt, Neisseria meningitidis Z2491
cuucguauucc

SEQ ID NO: 1386490 - RNA, 22 nt, Neisseria meningitidis Z2491
cuucgucgccuuguccugauuu

SEQ ID NO: 1386491 - RNA, 15 nt, Neisseria meningitidis Z2491
cuucgucuuuuccuu

SEQ ID NO: 1386492 - RNA, 15 nt, Neisseria meningitidis Z2491
cuucuauaaagccua

SEQ ID NO: 1386493 - RNA, 17 nt, Neisseria meningitidis Z2491
cuucuaacaaauaaugu

SEQ ID NO: 1386494 - RNA, 17 nt, Neisseria meningitidis Z2491
cuucuaaaaauucuucu

SEQ ID NO: 1386495 - RNA, 20 nt, Neisseria meningitidis Z2491
cuucuaaaaauucuucuuuc

SEQ ID NO: 1386496 - RNA, 22 nt, Neisseria meningitidis Z2491
cuucuaaaaauucuucuuucca

SEQ ID NO: 1386497 - RNA, 16 nt, Neisseria meningitidis Z2491
cuucgcucugcgcgcu

SEQ ID NO: 1386498 - RNA, 13 nt, Neisseria meningitidis Z2491
cuucgggcgugcc

SEQ ID NO: 1386499 - RNA, 21 nt, Neisseria meningitidis Z2491
cuucgggcagcggcaauauuc

SEQ ID NO: 1386500 - RNA, 17 nt, Neisseria meningitidis Z2491
cuuauuuaucaaaacag

SEQ ID NO: 1386501 - RNA, 15 nt, Neisseria meningitidis Z2491
cuuauuuucaaaaug

SEQ ID NO: 1386502 - RNA, 12 nt, Neisseria meningitidis Z2491
cuucaaaggaaa

SEQ ID NO: 1386503 - RNA, 16 nt, Neisseria meningitidis Z2491
cuuaugcuguugcaca

SEQ ID NO: 1386504 - RNA, 23 nt, Neisseria meningitidis Z2491
cuuauguauaguaauaaauuaau

SEQ ID NO: 1386505 - RNA, 12 nt, Neisseria meningitidis Z2491
cuuaaggcggcu

SEQ ID NO: 1386506 - RNA, 15 nt, Neisseria meningitidis Z2491
cuuaauacguuuuuc

SEQ ID NO: 1386507 - RNA, 16 nt, Neisseria meningitidis Z2491
cuuaauacguuuuucu

SEQ ID NO: 1386508 - RNA, 21 nt, Neisseria meningitidis Z2491
cuuaacagggaaagcagcagc

SEQ ID NO: 1386509 - RNA, 23 nt, Neisseria meningitidis Z2491
cuuaacccugaacauaaaugccg

SEQ ID NO: 1386510 - RNA, 14 nt, Neisseria meningitidis Z2491
cuuagcucaaagag

SEQ ID NO: 1386511 - RNA, 17 nt, Neisseria meningitidis Z2491
cuuagcucaaagagaac

SEQ ID NO: 1386512 - RNA, 21 nt, Neisseria meningitidis Z2491
cuuagaaggugggucaauggg

SEQ ID NO: 1386513 - RNA, 14 nt, Neisseria meningitidis Z2491
cuuugaguuaaggc

SEQ ID NO: 1386514 - RNA, 20 nt, Neisseria meningitidis Z2491
cuuugaacauggacaacagc

SEQ ID NO: 1386515 - RNA, 12 nt, Neisseria meningitidis Z2491
cuuugacaaaau

SEQ ID NO: 1386516 - RNA, 23 nt, Neisseria meningitidis Z2491
cuuugaauauuacuguuguucua

SEQ ID NO: 1386517 - RNA, 15 nt, Neisseria meningitidis Z2491
cuuugaagacgauuu

SEQ ID NO: 1386518 - RNA, 19 nt, Neisseria meningitidis Z2491
cuuugcggcugugcagcuc

SEQ ID NO: 1386519 - RNA, 14 nt, Neisseria meningitidis Z2491
cuuuggaacaaaaa

SEQ ID NO: 1386520 - RNA, 10 nt, Neisseria meningitidis Z2491
cuuuggcuuc

SEQ ID NO: 1386521 - RNA, 22 nt, Neisseria meningitidis Z2491
cuuuggcuuccagaccagccgc

SEQ ID NO: 1386522 - RNA, 15 nt, Neisseria meningitidis Z2491
cuuuggcugauaagg

SEQ ID NO: 1386523 - RNA, 18 nt, Neisseria meningitidis Z2491
cuuugcgcacucacuuua

SEQ ID NO: 1386524 - RNA, 18 nt, Neisseria meningitidis Z2491
cuuugcagaaagcuucca

SEQ ID NO: 1386525 - RNA, 14 nt, Neisseria meningitidis Z2491
cuuugcaauaacau

SEQ ID NO: 1386526 - RNA, 19 nt, Neisseria meningitidis Z2491
cuuugcaaaauuccuuucc

SEQ ID NO: 1386527 - RNA, 16 nt, Neisseria meningitidis Z2491
cuuugauuucggcguu

SEQ ID NO: 1386528 - RNA, 12 nt, Neisseria meningitidis Z2491
cuugucggcuuc

SEQ ID NO: 1386529 - RNA, 18 nt, Neisseria meningitidis Z2491
cuugucggcuucguauuc

SEQ ID NO: 1386530 - RNA, 14 nt, Neisseria meningitidis Z2491
cuugucgggauugu

SEQ ID NO: 1386531 - RNA, 21 nt, Neisseria meningitidis Z2491
cuuuacgcgcgccguccaaaa

SEQ ID NO: 1386532 - RNA, 20 nt, Neisseria meningitidis Z2491
cuuucagauaaucuuugaau

SEQ ID NO: 1386533 - RNA, 22 nt, Neisseria meningitidis Z2491
cuuucaacagguucaaacacau

SEQ ID NO: 1386534 - RNA, 18 nt, Neisseria meningitidis Z2491
cuuucagacggcaucaaa

SEQ ID NO: 1386535 - RNA, 16 nt, Neisseria meningitidis Z2491
cuuucagacggcauuu

SEQ ID NO: 1386536 - RNA, 20 nt, Neisseria meningitidis Z2491
cuuucagacggcauuuuaug

SEQ ID NO: 1386537 - RNA, 20 nt, Neisseria meningitidis Z2491
cuuucaaaagguucaaacac

SEQ ID NO: 1386538 - RNA, 19 nt, Neisseria meningitidis Z2491
cuuucaacacgcccuucca

SEQ ID NO: 1386539 - RNA, 18 nt, Neisseria meningitidis Z2491
cuuuagggguuucagacg

SEQ ID NO: 1386540 - RNA, 18 nt, Neisseria meningitidis Z2491
cuugcugguaacauuaac

SEQ ID NO: 1386541 - RNA, 19 nt, Neisseria meningitidis Z2491
cuugcugugaacggacgca

SEQ ID NO: 1386542 - RNA, 15 nt, Neisseria meningitidis Z2491
cuuggcaaaaucugg

SEQ ID NO: 1386543 - RNA, 19 nt, Neisseria meningitidis Z2491
cuuggcagcagaugaagcu

SEQ ID NO: 1386544 - RNA, 20 nt, Neisseria meningitidis Z2491
cuuguauggauaacgagauu

SEQ ID NO: 1386545 - RNA, 13 nt, Neisseria meningitidis Z2491
cuugguuuugcuu

SEQ ID NO: 1386546 - RNA, 15 nt, Neisseria meningitidis Z2491
cuuggcgggaagcca

SEQ ID NO: 1386547 - RNA, 19 nt, Neisseria meningitidis Z2491
cuugguagauuggauuugg

SEQ ID NO: 1386548 - RNA, 21 nt, Neisseria meningitidis Z2491
cuugggcggcaggcuugcccu

SEQ ID NO: 1386549 - RNA, 16 nt, Neisseria meningitidis Z2491
cuugcaacuuugcguu

SEQ ID NO: 1386550 - RNA, 14 nt, Neisseria meningitidis Z2491
cuugccccaaaaag

SEQ ID NO: 1386551 - RNA, 21 nt, Neisseria meningitidis Z2491
cuugcaaaccccucaacacac

SEQ ID NO: 1386552 - RNA, 14 nt, Neisseria meningitidis Z2491
cuucuuuccaucca

SEQ ID NO: 1386553 - RNA, 21 nt, Neisseria meningitidis Z2491
cuugaagucggcuucuuccuc

SEQ ID NO: 1386554 - RNA, 15 nt, Neisseria meningitidis Z2491
cgccuuccgcuucuu

SEQ ID NO: 1386555 - RNA, 18 nt, Neisseria meningitidis Z2491
cgccuuccgcuucuucca

SEQ ID NO: 1386556 - RNA, 18 nt, Neisseria meningitidis Z2491
cgccuuguccugauuuuu

SEQ ID NO: 1386557 - RNA, 16 nt, Neisseria meningitidis Z2491
cgccuuaaaaaacaaa

SEQ ID NO: 1386558 - RNA, 18 nt, Neisseria meningitidis Z2491
cgccugcguuugccgcca

SEQ ID NO: 1386559 - RNA, 21 nt, Neisseria meningitidis Z2491
cgccugcgcgggaaugacgau

SEQ ID NO: 1386560 - RNA, 13 nt, Neisseria meningitidis Z2491
cgccucaaucgcg

SEQ ID NO: 1386561 - RNA, 15 nt, Neisseria meningitidis Z2491
cgccgucggcuucca

SEQ ID NO: 1386562 - RNA, 23 nt, Neisseria meningitidis Z2491
cgccguguuucaaggcggcggcg

SEQ ID NO: 1386563 - RNA, 13 nt, Neisseria meningitidis Z2491
cgccucgccgaac

SEQ ID NO: 1386564 - RNA, 20 nt, Neisseria meningitidis Z2491
cgccuccgcaccguuuucca

SEQ ID NO: 1386565 - RNA, 19 nt, Neisseria meningitidis Z2491
cgcgcccaauucuucuuua

SEQ ID NO: 1386566 - RNA, 22 nt, Neisseria meningitidis Z2491
cgcgcccacgcccucggcggcg

SEQ ID NO: 1386567 - RNA, 22 nt, Neisseria meningitidis Z2491
cgcgccgaauauccccagugcg

SEQ ID NO: 1386568 - RNA, 21 nt, Neisseria meningitidis Z2491
cgcgccgauguuuuccugcca

SEQ ID NO: 1386569 - RNA, 13 nt, Neisseria meningitidis Z2491
cgcgccgcgcgcc

SEQ ID NO: 1386570 - RNA, 23 nt, Neisseria meningitidis Z2491
cgcgcaggcgggaaucuagaccu

SEQ ID NO: 1386571 - RNA, 15 nt, Neisseria meningitidis Z2491
cgcgcaccugacgcu

SEQ ID NO: 1386572 - RNA, 12 nt, Neisseria meningitidis Z2491
cgcgcaucgcca

SEQ ID NO: 1386573 - RNA, 15 nt, Neisseria meningitidis Z2491
cgcgacggcggcagg

SEQ ID NO: 1386574 - RNA, 23 nt, Neisseria meningitidis Z2491
cgcgaggcgugccuugccuucaa

SEQ ID NO: 1386575 - RNA, 14 nt, Neisseria meningitidis Z2491
cgcgauaaggcgcg

SEQ ID NO: 1386576 - RNA, 17 nt, Neisseria meningitidis Z2491
cgcgcaaacccgccuga

SEQ ID NO: 1386577 - RNA, 20 nt, Neisseria meningitidis Z2491
cgccgucauucccgcgcagg

SEQ ID NO: 1386578 - RNA, 14 nt, Neisseria meningitidis Z2491
cgccgguggcggca

SEQ ID NO: 1386579 - RNA, 12 nt, Neisseria meningitidis Z2491
cgccgguuuugc

SEQ ID NO: 1386580 - RNA, 21 nt, Neisseria meningitidis Z2491
cgccgggguuuaucagaaaug

SEQ ID NO: 1386581 - RNA, 21 nt, Neisseria meningitidis Z2491
cgccggggauuuggcugacca

SEQ ID NO: 1386582 - RNA, 14 nt, Neisseria meningitidis Z2491
cgccggaaagcugg

SEQ ID NO: 1386583 - RNA, 13 nt, Neisseria meningitidis Z2491
cgccgcgccgcuu

SEQ ID NO: 1386584 - RNA, 13 nt, Neisseria meningitidis Z2491
cgcccuauauuug

SEQ ID NO: 1386585 - RNA, 14 nt, Neisseria meningitidis Z2491
cgccgacauccccc

SEQ ID NO: 1386586 - RNA, 19 nt, Neisseria meningitidis Z2491
cgccgaacccgacuucuga

SEQ ID NO: 1386587 - RNA, 23 nt, Neisseria meningitidis Z2491
cgcccuuugcccguggcgacggc

SEQ ID NO: 1386588 - RNA, 20 nt, Neisseria meningitidis Z2491
cgccgacugccgccgcgccu

SEQ ID NO: 1386589 - RNA, 23 nt, Neisseria meningitidis Z2491
cgccgccgacaucccccagccga

SEQ ID NO: 1386590 - RNA, 13 nt, Neisseria meningitidis Z2491
cgccgccguaacc

SEQ ID NO: 1386591 - RNA, 21 nt, Neisseria meningitidis Z2491
cgccgccggaaagcugccccg

SEQ ID NO: 1386592 - RNA, 16 nt, Neisseria meningitidis Z2491
cgccgauguuuuccug

SEQ ID NO: 1386593 - RNA, 19 nt, Neisseria meningitidis Z2491
cgccgccaacaccgcgccu

SEQ ID NO: 1386594 - RNA, 17 nt, Neisseria meningitidis Z2491
cgccgauggcugcuuug

SEQ ID NO: 1386595 - RNA, 17 nt, Neisseria meningitidis Z2491
cgccauaaucagcccga

SEQ ID NO: 1386596 - RNA, 20 nt, Neisseria meningitidis Z2491
cgccaucaacauuugcgcag

SEQ ID NO: 1386597 - RNA, 18 nt, Neisseria meningitidis Z2491
cgccauauagacauuuuu

SEQ ID NO: 1386598 - RNA, 17 nt, Neisseria meningitidis Z2491
cgccaguccuacccaaa

SEQ ID NO: 1386599 - RNA, 20 nt, Neisseria meningitidis Z2491
cgccaaugccgucugaagcc

SEQ ID NO: 1386600 - RNA, 14 nt, Neisseria meningitidis Z2491
cgcauaauaaaaau

SEQ ID NO: 1386601 - RNA, 23 nt, Neisseria meningitidis Z2491
cgcauaaaaaugcgccaaaaaau

SEQ ID NO: 1386602 - RNA, 22 nt, Neisseria meningitidis Z2491
cgccagccuuucaacacgcccu

SEQ ID NO: 1386603 - RNA, 15 nt, Neisseria meningitidis Z2491
cgccagccaccacgu

SEQ ID NO: 1386604 - RNA, 16 nt, Neisseria meningitidis Z2491
cgcccagagccgcgac

SEQ ID NO: 1386605 - RNA, 19 nt, Neisseria meningitidis Z2491
cgcccacgcgguaugcggc

SEQ ID NO: 1386606 - RNA, 13 nt, Neisseria meningitidis Z2491
cgcccagcagccc

SEQ ID NO: 1386607 - RNA, 18 nt, Neisseria meningitidis Z2491
cgccaugucgcgggcggu

SEQ ID NO: 1386608 - RNA, 18 nt, Neisseria meningitidis Z2491
cgcccaaccgugcggcac

SEQ ID NO: 1386609 - RNA, 21 nt, Neisseria meningitidis Z2491
cgccauuggaagaagauuuuu

SEQ ID NO: 1386610 - RNA, 17 nt, Neisseria meningitidis Z2491
cgccaucacguccgcca

SEQ ID NO: 1386611 - RNA, 11 nt, Neisseria meningitidis Z2491
cgccccgccga

SEQ ID NO: 1386612 - RNA, 16 nt, Neisseria meningitidis Z2491
cgccccaaauaccucc

SEQ ID NO: 1386613 - RNA, 22 nt, Neisseria meningitidis Z2491
cgauaacgccgccguccaucac

SEQ ID NO: 1386614 - RNA, 13 nt, Neisseria meningitidis Z2491
cgauaaaauccgg

SEQ ID NO: 1386615 - RNA, 18 nt, Neisseria meningitidis Z2491
ccuucauggcguucaaca

SEQ ID NO: 1386616 - RNA, 13 nt, Neisseria meningitidis Z2491
ccuucauccgcaa

SEQ ID NO: 1386617 - RNA, 23 nt, Neisseria meningitidis Z2491
cgauauaguggauuaacaaaaau

SEQ ID NO: 1386618 - RNA, 11 nt, Neisseria meningitidis Z2491
cgauauaugcg

SEQ ID NO: 1386619 - RNA, 19 nt, Neisseria meningitidis Z2491
cgaugauguguuucaacac

SEQ ID NO: 1386620 - RNA, 22 nt, Neisseria meningitidis Z2491
cgaugauguguuucaacaccgc

SEQ ID NO: 1386621 - RNA, 20 nt, Neisseria meningitidis Z2491
cgaugaugacggucaggaag

SEQ ID NO: 1386622 - RNA, 12 nt, Neisseria meningitidis Z2491
cgauguaaaccu

SEQ ID NO: 1386623 - RNA, 15 nt, Neisseria meningitidis Z2491
cgcaaacgcugcauu

SEQ ID NO: 1386624 - RNA, 20 nt, Neisseria meningitidis Z2491
cgcaaacgcugcauuuguuc

SEQ ID NO: 1386625 - RNA, 22 nt, Neisseria meningitidis Z2491
cgcaaacggcaggcaaaaaaaa

SEQ ID NO: 1386626 - RNA, 19 nt, Neisseria meningitidis Z2491
cgauucacuuggugcuuca

SEQ ID NO: 1386627 - RNA, 13 nt, Neisseria meningitidis Z2491
cgcaaacaccagc

SEQ ID NO: 1386628 - RNA, 20 nt, Neisseria meningitidis Z2491
cgcaaacaccagcaucugau

SEQ ID NO: 1386629 - RNA, 13 nt, Neisseria meningitidis Z2491
cgauuauuuuuua

SEQ ID NO: 1386630 - RNA, 15 nt, Neisseria meningitidis Z2491
cgauuauuuuuuaga

SEQ ID NO: 1386631 - RNA, 20 nt, Neisseria meningitidis Z2491
cgauuaagguuaauuaaaau

SEQ ID NO: 1386632 - RNA, 19 nt, Neisseria meningitidis Z2491
cgcaaaucggcuucagaca

SEQ ID NO: 1386633 - RNA, 14 nt, Neisseria meningitidis Z2491
cgcaaaugccgucu

SEQ ID NO: 1386634 - RNA, 17 nt, Neisseria meningitidis Z2491
cgcaaaugcguaugccc

SEQ ID NO: 1386635 - RNA, 16 nt, Neisseria meningitidis Z2491
cgcaaucaagaagaaa

SEQ ID NO: 1386636 - RNA, 16 nt, Neisseria meningitidis Z2491
cgcaaggucggcggcg

SEQ ID NO: 1386637 - RNA, 21 nt, Neisseria meningitidis Z2491
cgcaccugacgcuccagcucc

SEQ ID NO: 1386638 - RNA, 13 nt, Neisseria meningitidis Z2491
cgcacccgcaacc

SEQ ID NO: 1386639 - RNA, 21 nt, Neisseria meningitidis Z2491
cgcaccccgaccgacacccug

SEQ ID NO: 1386640 - RNA, 20 nt, Neisseria meningitidis Z2491
cgcagcaguauuagaaccga

SEQ ID NO: 1386641 - RNA, 13 nt, Neisseria meningitidis Z2491
cgcagccugcagc

SEQ ID NO: 1386642 - RNA, 16 nt, Neisseria meningitidis Z2491
cgcaggugcagauguu

SEQ ID NO: 1386643 - RNA, 21 nt, Neisseria meningitidis Z2491
cgcaggcuuuugaggcugccg

SEQ ID NO: 1386644 - RNA, 20 nt, Neisseria meningitidis Z2491
cgcagguguaacugcaagaa

SEQ ID NO: 1386645 - RNA, 22 nt, Neisseria meningitidis Z2491
cgcaggcgggaauacaaacauc

SEQ ID NO: 1386646 - RNA, 23 nt, Neisseria meningitidis Z2491
cgcaggcgggaaucuagacauuc

SEQ ID NO: 1386647 - RNA, 20 nt, Neisseria meningitidis Z2491
cgcaggcgggaaucuagacc

SEQ ID NO: 1386648 - RNA, 23 nt, Neisseria meningitidis Z2491
cgcagguuuuguuuuuccaaacg

SEQ ID NO: 1386649 - RNA, 18 nt, Neisseria meningitidis Z2491
cggagccuaucaucagau

SEQ ID NO: 1386650 - RNA, 15 nt, Neisseria meningitidis Z2491
cggauaaaguuugaa

SEQ ID NO: 1386651 - RNA, 13 nt, Neisseria meningitidis Z2491
cggauaaaacaga

SEQ ID NO: 1386652 - RNA, 17 nt, Neisseria meningitidis Z2491
cggauaaaacgguuucu

SEQ ID NO: 1386653 - RNA, 16 nt, Neisseria meningitidis Z2491
cggagcaguuuuucaa

SEQ ID NO: 1386654 - RNA, 21 nt, Neisseria meningitidis Z2491
cggaaaugacugaaacucaaa

SEQ ID NO: 1386655 - RNA, 17 nt, Neisseria meningitidis Z2491
cggauguccgcgcccac

SEQ ID NO: 1386656 - RNA, 22 nt, Neisseria meningitidis Z2491
cggauguccgcgcccacgcccu

SEQ ID NO: 1386657 - RNA, 13 nt, Neisseria meningitidis Z2491
cggauucccgccu

SEQ ID NO: 1386658 - RNA, 11 nt, Neisseria meningitidis Z2491
cggauuccugu

SEQ ID NO: 1386659 - RNA, 16 nt, Neisseria meningitidis Z2491
cggauuuuagguuucu

SEQ ID NO: 1386660 - RNA, 21 nt, Neisseria meningitidis Z2491
cggauuuuagguuucugauuu

SEQ ID NO: 1386661 - RNA, 16 nt, Neisseria meningitidis Z2491
cggcaaaaauuuaucc

SEQ ID NO: 1386662 - RNA, 19 nt, Neisseria meningitidis Z2491
cggauuuauacgcccagca

SEQ ID NO: 1386663 - RNA, 16 nt, Neisseria meningitidis Z2491
cggauuucuccgucgg

SEQ ID NO: 1386664 - RNA, 17 nt, Neisseria meningitidis Z2491
cggauuuccuuaaaaaa

SEQ ID NO: 1386665 - RNA, 16 nt, Neisseria meningitidis Z2491
cggcauauguuuucug

SEQ ID NO: 1386666 - RNA, 19 nt, Neisseria meningitidis Z2491
cggcauauuuuuuggacgg

SEQ ID NO: 1386667 - RNA, 22 nt, Neisseria meningitidis Z2491
cggcauaucccgacagaacaga

SEQ ID NO: 1386668 - RNA, 10 nt, Neisseria meningitidis Z2491
cggcauauca

SEQ ID NO: 1386669 - RNA, 11 nt, Neisseria meningitidis Z2491
cggcaggaauu

SEQ ID NO: 1386670 - RNA, 15 nt, Neisseria meningitidis Z2491
cggcaggaacacggc

SEQ ID NO: 1386671 - RNA, 18 nt, Neisseria meningitidis Z2491
cggcagccugccgcugau

SEQ ID NO: 1386672 - RNA, 17 nt, Neisseria meningitidis Z2491
cggcagccugcucgagc

SEQ ID NO: 1386673 - RNA, 21 nt, Neisseria meningitidis Z2491
cggcagccuuaacagggaaag

SEQ ID NO: 1386674 - RNA, 20 nt, Neisseria meningitidis Z2491
cggccugcccugccaaaacu

SEQ ID NO: 1386675 - RNA, 15 nt, Neisseria meningitidis Z2491
cggccggaaaaccuu

SEQ ID NO: 1386676 - RNA, 21 nt, Neisseria meningitidis Z2491
cggcccgaauugcgccgacag

SEQ ID NO: 1386677 - RNA, 22 nt, Neisseria meningitidis Z2491
cggcccgaauugcgccgacagc

SEQ ID NO: 1386678 - RNA, 16 nt, Neisseria meningitidis Z2491
cggcaucgcaacucca

SEQ ID NO: 1386679 - RNA, 24 nt, Neisseria meningitidis Z2491
cggccauugugcccacggggugcg

SEQ ID NO: 1386680 - RNA, 17 nt, Neisseria meningitidis Z2491
cgcguuuuaccugcccg

SEQ ID NO: 1386681 - RNA, 15 nt, Neisseria meningitidis Z2491
cgcguuugaccauaa

SEQ ID NO: 1386682 - RNA, 13 nt, Neisseria meningitidis Z2491
cgcgugcaggcgc

SEQ ID NO: 1386683 - RNA, 17 nt, Neisseria meningitidis Z2491
cgcgugauuugccgcca

SEQ ID NO: 1386684 - RNA, 16 nt, Neisseria meningitidis Z2491
cgcggauucgacggcg

SEQ ID NO: 1386685 - RNA, 23 nt, Neisseria meningitidis Z2491
cgcggcccgugaaccaaugccgu

SEQ ID NO: 1386686 - RNA, 21 nt, Neisseria meningitidis Z2491
cgcuguacugguuuaaauuua

SEQ ID NO: 1386687 - RNA, 21 nt, Neisseria meningitidis Z2491
cgcuguauuugcgccgcccga

SEQ ID NO: 1386688 - RNA, 16 nt, Neisseria meningitidis Z2491
cgcuguuccaaaagcc

SEQ ID NO: 1386689 - RNA, 21 nt, Neisseria meningitidis Z2491
cgcuguuccaaaagccgcccg

SEQ ID NO: 1386690 - RNA, 15 nt, Neisseria meningitidis Z2491
cgcuggucggcagua

SEQ ID NO: 1386691 - RNA, 14 nt, Neisseria meningitidis Z2491
cgcuuuauuuugug

SEQ ID NO: 1386692 - RNA, 19 nt, Neisseria meningitidis Z2491
cgcuugauuuucggcggcg

SEQ ID NO: 1386693 - RNA, 18 nt, Neisseria meningitidis Z2491
cggaaaccguauauuucc

SEQ ID NO: 1386694 - RNA, 19 nt, Neisseria meningitidis Z2491
cggaaaccguauauuuccc

SEQ ID NO: 1386695 - RNA, 23 nt, Neisseria meningitidis Z2491
cggaaaccguauauuucccgucu

SEQ ID NO: 1386696 - RNA, 13 nt, Neisseria meningitidis Z2491
cgcugcucggcuu

SEQ ID NO: 1386697 - RNA, 21 nt, Neisseria meningitidis Z2491
cgcugccgaaaccaaaagcca

SEQ ID NO: 1386698 - RNA, 10 nt, Neisseria meningitidis Z2491
cgcugccuuu

SEQ ID NO: 1386699 - RNA, 17 nt, Neisseria meningitidis Z2491
cgcucugccgucauucc

SEQ ID NO: 1386700 - RNA, 16 nt, Neisseria meningitidis Z2491
cgggcggugcgcggca

SEQ ID NO: 1386701 - RNA, 23 nt, Neisseria meningitidis Z2491
cgggcguucgucuaagaaaacca

SEQ ID NO: 1386702 - RNA, 16 nt, Neisseria meningitidis Z2491
cgggcguuccacaaau

SEQ ID NO: 1386703 - RNA, 16 nt, Neisseria meningitidis Z2491
cgggcuuuucgggaag

SEQ ID NO: 1386704 - RNA, 15 nt, Neisseria meningitidis Z2491
cggggcggucagcgg

SEQ ID NO: 1386705 - RNA, 21 nt, Neisseria meningitidis Z2491
cggggguuuggcgggaaugcc

SEQ ID NO: 1386706 - RNA, 12 nt, Neisseria meningitidis Z2491
cgggcaggcuga

SEQ ID NO: 1386707 - RNA, 14 nt, Neisseria meningitidis Z2491
cgggcaggcggcug

SEQ ID NO: 1386708 - RNA, 20 nt, Neisseria meningitidis Z2491
cgggaaugacgaauuucagg

SEQ ID NO: 1386709 - RNA, 19 nt, Neisseria meningitidis Z2491
cgggaaugacggcagagcg

SEQ ID NO: 1386710 - RNA, 13 nt, Neisseria meningitidis Z2491
cgggaaugacuga

SEQ ID NO: 1386711 - RNA, 19 nt, Neisseria meningitidis Z2491
cgggaaugacugaaacuca

SEQ ID NO: 1386712 - RNA, 13 nt, Neisseria meningitidis Z2491
cgggaaucuagaa

SEQ ID NO: 1386713 - RNA, 16 nt, Neisseria meningitidis Z2491
cgggaaucuagacauu

SEQ ID NO: 1386714 - RNA, 14 nt, Neisseria meningitidis Z2491
cgggaaucuagacc

SEQ ID NO: 1386715 - RNA, 18 nt, Neisseria meningitidis Z2491
cgggaauccgguuuuuug

SEQ ID NO: 1386716 - RNA, 19 nt, Neisseria meningitidis Z2491
cgggaauccgguuuuuuga

SEQ ID NO: 1386717 - RNA, 22 nt, Neisseria meningitidis Z2491
cgggaauccgguuuuuugaguu

SEQ ID NO: 1386718 - RNA, 16 nt, Neisseria meningitidis Z2491
cgggaauccagacauu

SEQ ID NO: 1386719 - RNA, 12 nt, Neisseria meningitidis Z2491
cgggaauccagg

SEQ ID NO: 1386720 - RNA, 12 nt, Neisseria meningitidis Z2491
cgggaauccagu

SEQ ID NO: 1386721 - RNA, 23 nt, Neisseria meningitidis Z2491
cgggaaaaauaucgggacgcugc

SEQ ID NO: 1386722 - RNA, 21 nt, Neisseria meningitidis Z2491
cgggcaggcccaaaacaaaua

SEQ ID NO: 1386723 - RNA, 22 nt, Neisseria meningitidis Z2491
cgggaaugacaaaauuaaaguu

SEQ ID NO: 1386724 - RNA, 18 nt, Neisseria meningitidis Z2491
cgggccuuuggcggcggc

SEQ ID NO: 1386725 - RNA, 14 nt, Neisseria meningitidis Z2491
cggcuuauggcgaa

SEQ ID NO: 1386726 - RNA, 14 nt, Neisseria meningitidis Z2491
cggcuucgcgggcu

SEQ ID NO: 1386727 - RNA, 16 nt, Neisseria meningitidis Z2491
cggcuucgcgggcugc

SEQ ID NO: 1386728 - RNA, 13 nt, Neisseria meningitidis Z2491
cggcuuucagacg

SEQ ID NO: 1386729 - RNA, 16 nt, Neisseria meningitidis Z2491
cggcuuucgcgccgcg

SEQ ID NO: 1386730 - RNA, 17 nt, Neisseria meningitidis Z2491
cggcuuuggucggagug

SEQ ID NO: 1386731 - RNA, 17 nt, Neisseria meningitidis Z2491
cggcuuuguuuacaugg

SEQ ID NO: 1386732 - RNA, 18 nt, Neisseria meningitidis Z2491
cggcugccgaccgcgcac

SEQ ID NO: 1386733 - RNA, 13 nt, Neisseria meningitidis Z2491
cggcucgccgccu

SEQ ID NO: 1386734 - RNA, 20 nt, Neisseria meningitidis Z2491
cggcguggaggggcaaugca

SEQ ID NO: 1386735 - RNA, 14 nt, Neisseria meningitidis Z2491
cggcguggaaggca

SEQ ID NO: 1386736 - RNA, 22 nt, Neisseria meningitidis Z2491
cggcgggcaggcggcugcgggc

SEQ ID NO: 1386737 - RNA, 17 nt, Neisseria meningitidis Z2491
cggcgggacgcgcgcca

SEQ ID NO: 1386738 - RNA, 18 nt, Neisseria meningitidis Z2491
cggcggcgguuuccugca

SEQ ID NO: 1386739 - RNA, 10 nt, Neisseria meningitidis Z2491
cggcggcggc

SEQ ID NO: 1386740 - RNA, 18 nt, Neisseria meningitidis Z2491
cggcggcguucaaaucau

SEQ ID NO: 1386741 - RNA, 19 nt, Neisseria meningitidis Z2491
cggcgcguucggcgcggcu

SEQ ID NO: 1386742 - RNA, 23 nt, Neisseria meningitidis Z2491
cgucaaaucggauaggcaaaaac

SEQ ID NO: 1386743 - RNA, 21 nt, Neisseria meningitidis Z2491
cgucaaauuucguuaacagac

SEQ ID NO: 1386744 - RNA, 13 nt, Neisseria meningitidis Z2491
cgucaacacaaaa

SEQ ID NO: 1386745 - RNA, 17 nt, Neisseria meningitidis Z2491
cgucaacacaaaauaaa

SEQ ID NO: 1386746 - RNA, 20 nt, Neisseria meningitidis Z2491
cgucagcgauacaucucugg

SEQ ID NO: 1386747 - RNA, 21 nt, Neisseria meningitidis Z2491
cguauugcuaaauuucuagaa

SEQ ID NO: 1386748 - RNA, 17 nt, Neisseria meningitidis Z2491
cguauuggggcaaagcg

SEQ ID NO: 1386749 - RNA, 14 nt, Neisseria meningitidis Z2491
cguauuugagugcg

SEQ ID NO: 1386750 - RNA, 18 nt, Neisseria meningitidis Z2491
cgucaaacagaaaaacaa

SEQ ID NO: 1386751 - RNA, 14 nt, Neisseria meningitidis Z2491
cguauguggucagg

SEQ ID NO: 1386752 - RNA, 21 nt, Neisseria meningitidis Z2491
cguaugaaacaauccgcccga

SEQ ID NO: 1386753 - RNA, 14 nt, Neisseria meningitidis Z2491
cguaugcaaaaaca

SEQ ID NO: 1386754 - RNA, 21 nt, Neisseria meningitidis Z2491
cguauccauagauaaauuuca

SEQ ID NO: 1386755 - RNA, 18 nt, Neisseria meningitidis Z2491
cguauauucugcaaaaau

SEQ ID NO: 1386756 - RNA, 16 nt, Neisseria meningitidis Z2491
cguaucaaaaaacaac

SEQ ID NO: 1386757 - RNA, 16 nt, Neisseria meningitidis Z2491
cguaucaaaaaauaaa

SEQ ID NO: 1386758 - RNA, 13 nt, Neisseria meningitidis Z2491
cguauccagccgc

SEQ ID NO: 1386759 - RNA, 17 nt, Neisseria meningitidis Z2491
cguauccagccgccauc

SEQ ID NO: 1386760 - RNA, 21 nt, Neisseria meningitidis Z2491
cguaucaaacaagaaaugaua

SEQ ID NO: 1386761 - RNA, 14 nt, Neisseria meningitidis Z2491
cguaggcggcggcg

SEQ ID NO: 1386762 - RNA, 18 nt, Neisseria meningitidis Z2491
cguagccggccaacauca

SEQ ID NO: 1386763 - RNA, 14 nt, Neisseria meningitidis Z2491
cggucggaccaguc

SEQ ID NO: 1386764 - RNA, 16 nt, Neisseria meningitidis Z2491
cgggucgcuuuauuuu

SEQ ID NO: 1386765 - RNA, 19 nt, Neisseria meningitidis Z2491
cggugucuucaauuccugc

SEQ ID NO: 1386766 - RNA, 16 nt, Neisseria meningitidis Z2491
cggugugcaggcugcc

SEQ ID NO: 1386767 - RNA, 14 nt, Neisseria meningitidis Z2491
cgguuuucuauuuu

SEQ ID NO: 1386768 - RNA, 14 nt, Neisseria meningitidis Z2491
cgguuuccaacuga

SEQ ID NO: 1386769 - RNA, 23 nt, Neisseria meningitidis Z2491
cgguugcguaucaaaaaauaaag

SEQ ID NO: 1386770 - RNA, 17 nt, Neisseria meningitidis Z2491
cgguuggaaggcggcgg

SEQ ID NO: 1386771 - RNA, 18 nt, Neisseria meningitidis Z2491
cccgcgcaggcgggaauc

SEQ ID NO: 1386772 - RNA, 13 nt, Neisseria meningitidis Z2491
cccgccugcgcgg

SEQ ID NO: 1386773 - RNA, 13 nt, Neisseria meningitidis Z2491
cccgcccgcccuu

SEQ ID NO: 1386774 - RNA, 18 nt, Neisseria meningitidis Z2491
cccgccacacccccguca

SEQ ID NO: 1386775 - RNA, 14 nt, Neisseria meningitidis Z2491
cccgccaaacccuc

SEQ ID NO: 1386776 - RNA, 16 nt, Neisseria meningitidis Z2491
cccgcuuucgcgggaa

SEQ ID NO: 1386777 - RNA, 16 nt, Neisseria meningitidis Z2491
cccgcucaggcgggaa

SEQ ID NO: 1386778 - RNA, 19 nt, Neisseria meningitidis Z2491
cccgucauuccucaaaaac

SEQ ID NO: 1386779 - RNA, 14 nt, Neisseria meningitidis Z2491
cccgucauucccac

SEQ ID NO: 1386780 - RNA, 17 nt, Neisseria meningitidis Z2491
cccgucauucccacgca

SEQ ID NO: 1386781 - RNA, 18 nt, Neisseria meningitidis Z2491
cccgucauucccgcaaaa

SEQ ID NO: 1386782 - RNA, 20 nt, Neisseria meningitidis Z2491
cccgucauucccgcaaaagc

SEQ ID NO: 1386783 - RNA, 17 nt, Neisseria meningitidis Z2491
cccgguuggaaggcggc

SEQ ID NO: 1386784 - RNA, 18 nt, Neisseria meningitidis Z2491
cccgugcaggcgggaauc

SEQ ID NO: 1386785 - RNA, 15 nt, Neisseria meningitidis Z2491
cccguuuuacccucu

SEQ ID NO: 1386786 - RNA, 19 nt, Neisseria meningitidis Z2491
cccguuauuuucacaaaaa

SEQ ID NO: 1386787 - RNA, 14 nt, Neisseria meningitidis Z2491
cccuaaaggcuuca

SEQ ID NO: 1386788 - RNA, 18 nt, Neisseria meningitidis Z2491
cccguuuuuacgggaaug

SEQ ID NO: 1386789 - RNA, 17 nt, Neisseria meningitidis Z2491
cccuaccauuguuucug

SEQ ID NO: 1386790 - RNA, 22 nt, Neisseria meningitidis Z2491
cccucaauucuucgaucaucca

SEQ ID NO: 1386791 - RNA, 17 nt, Neisseria meningitidis Z2491
cccucaaaaacagaaaa

SEQ ID NO: 1386792 - RNA, 23 nt, Neisseria meningitidis Z2491
cccucccgacagccgaaacccaa

SEQ ID NO: 1386793 - RNA, 16 nt, Neisseria meningitidis Z2491
cccuccgccucugcca

SEQ ID NO: 1386794 - RNA, 22 nt, Neisseria meningitidis Z2491
cccggcgcgaacggagccagcc

SEQ ID NO: 1386795 - RNA, 13 nt, Neisseria meningitidis Z2491
ccauugccgcgcu

SEQ ID NO: 1386796 - RNA, 17 nt, Neisseria meningitidis Z2491
ccauuguuuccgcuucc

SEQ ID NO: 1386797 - RNA, 13 nt, Neisseria meningitidis Z2491
ccauuuaaaaucu

SEQ ID NO: 1386798 - RNA, 14 nt, Neisseria meningitidis Z2491
ccauuugagccgca

SEQ ID NO: 1386799 - RNA, 16 nt, Neisseria meningitidis Z2491
cccaaaaagaggcaua

SEQ ID NO: 1386800 - RNA, 22 nt, Neisseria meningitidis Z2491
cccaaaaagccgccuuuuucca

SEQ ID NO: 1386801 - RNA, 19 nt, Neisseria meningitidis Z2491
cccaaaaggaagucaugcc

SEQ ID NO: 1386802 - RNA, 20 nt, Neisseria meningitidis Z2491
cccaaacaaucccaccaugg

SEQ ID NO: 1386803 - RNA, 13 nt, Neisseria meningitidis Z2491
cccacggaagugg

SEQ ID NO: 1386804 - RNA, 16 nt, Neisseria meningitidis Z2491
cccacggaagugggaa

SEQ ID NO: 1386805 - RNA, 24 nt, Neisseria meningitidis Z2491
cccacggaagugggaaucuagaaa

SEQ ID NO: 1386806 - RNA, 17 nt, Neisseria meningitidis Z2491
cccaccguuucccauca

SEQ ID NO: 1386807 - RNA, 20 nt, Neisseria meningitidis Z2491
cccaccguuucccaucaucc

SEQ ID NO: 1386808 - RNA, 24 nt, Neisseria meningitidis Z2491
cccaaaggcaauaacuauagugga

SEQ ID NO: 1386809 - RNA, 18 nt, Neisseria meningitidis Z2491
cccaaaucuugcaaaccc

SEQ ID NO: 1386810 - RNA, 16 nt, Neisseria meningitidis Z2491
cccaaccgugcggcac

SEQ ID NO: 1386811 - RNA, 20 nt, Neisseria meningitidis Z2491
cccacaagcuaaaaucccau

SEQ ID NO: 1386812 - RNA, 20 nt, Neisseria meningitidis Z2491
cccacgggacuuugcggcug

SEQ ID NO: 1386813 - RNA, 22 nt, Neisseria meningitidis Z2491
cccaggauuuucaaaucuuccu

SEQ ID NO: 1386814 - RNA, 23 nt, Neisseria meningitidis Z2491
cccaggauuuucaaaucuuccug

SEQ ID NO: 1386815 - RNA, 20 nt, Neisseria meningitidis Z2491
cccaugcguucgagcaggaa

SEQ ID NO: 1386816 - RNA, 11 nt, Neisseria meningitidis Z2491
cccauucccac

SEQ ID NO: 1386817 - RNA, 19 nt, Neisseria meningitidis Z2491
cccauucccacgcgcccau

SEQ ID NO: 1386818 - RNA, 20 nt, Neisseria meningitidis Z2491
cccauuauuuucacaaaaac

SEQ ID NO: 1386819 - RNA, 18 nt, Neisseria meningitidis Z2491
cccauuuggagucgccuu

SEQ ID NO: 1386820 - RNA, 13 nt, Neisseria meningitidis Z2491
cccgauaaaugcc

SEQ ID NO: 1386821 - RNA, 22 nt, Neisseria meningitidis Z2491
cccgaauugcgccgacagcagc

SEQ ID NO: 1386822 - RNA, 13 nt, Neisseria meningitidis Z2491
cccgaaauuccaa

SEQ ID NO: 1386823 - RNA, 23 nt, Neisseria meningitidis Z2491
ccaggcguauauggcugucuuug

SEQ ID NO: 1386824 - RNA, 15 nt, Neisseria meningitidis Z2491
ccauaaauuuuaaau

SEQ ID NO: 1386825 - RNA, 22 nt, Neisseria meningitidis Z2491
ccauaaauuuuaaauaaaucaa

SEQ ID NO: 1386826 - RNA, 20 nt, Neisseria meningitidis Z2491
ccaguucggcaaacggcagg

SEQ ID NO: 1386827 - RNA, 22 nt, Neisseria meningitidis Z2491
ccauccgcacggaaaccugcac

SEQ ID NO: 1386828 - RNA, 18 nt, Neisseria meningitidis Z2491
ccaucggcaaaguuauuc

SEQ ID NO: 1386829 - RNA, 18 nt, Neisseria meningitidis Z2491
ccaucgcaaucauggcgc

SEQ ID NO: 1386830 - RNA, 15 nt, Neisseria meningitidis Z2491
ccaucuucuucaaca

SEQ ID NO: 1386831 - RNA, 14 nt, Neisseria meningitidis Z2491
ccaucaauuuccac

SEQ ID NO: 1386832 - RNA, 20 nt, Neisseria meningitidis Z2491
ccaucaauuuccacaauuca

SEQ ID NO: 1386833 - RNA, 15 nt, Neisseria meningitidis Z2491
ccaucagcacgccgc

SEQ ID NO: 1386834 - RNA, 13 nt, Neisseria meningitidis Z2491
ccaucaggaaugc

SEQ ID NO: 1386835 - RNA, 21 nt, Neisseria meningitidis Z2491
ccaucaggaaugcaaaccggc

SEQ ID NO: 1386836 - RNA, 18 nt, Neisseria meningitidis Z2491
ccauacaaacaggcuuca

SEQ ID NO: 1386837 - RNA, 20 nt, Neisseria meningitidis Z2491
ccagccgaaaauacugagga

SEQ ID NO: 1386838 - RNA, 19 nt, Neisseria meningitidis Z2491
ccaaaaaacaacaggaauu

SEQ ID NO: 1386839 - RNA, 12 nt, Neisseria meningitidis Z2491
cauuuuuuucau

SEQ ID NO: 1386840 - RNA, 21 nt, Neisseria meningitidis Z2491
ccacgccaaaaaugcggccgc

SEQ ID NO: 1386841 - RNA, 15 nt, Neisseria meningitidis Z2491
ccacgcucaaacacc

SEQ ID NO: 1386842 - RNA, 15 nt, Neisseria meningitidis Z2491
ccacgucauucccac

SEQ ID NO: 1386843 - RNA, 23 nt, Neisseria meningitidis Z2491
ccacgucauucccacgaaagugg

SEQ ID NO: 1386844 - RNA, 13 nt, Neisseria meningitidis Z2491
ccacuauaaaauu

SEQ ID NO: 1386845 - RNA, 14 nt, Neisseria meningitidis Z2491
ccacuauauuuucg

SEQ ID NO: 1386846 - RNA, 18 nt, Neisseria meningitidis Z2491
ccacucggauuaauccga

SEQ ID NO: 1386847 - RNA, 18 nt, Neisseria meningitidis Z2491
ccuuauaguggauuaaau

SEQ ID NO: 1386848 - RNA, 18 nt, Neisseria meningitidis Z2491
ccuuauccagaaaaucgg

SEQ ID NO: 1386849 - RNA, 18 nt, Neisseria meningitidis Z2491
ccuuaucccaauauuaag

SEQ ID NO: 1386850 - RNA, 15 nt, Neisseria meningitidis Z2491
ccuuaucccgauuug

SEQ ID NO: 1386851 - RNA, 22 nt, Neisseria meningitidis Z2491
ccuuagagaaucguucucuuug

SEQ ID NO: 1386852 - RNA, 22 nt, Neisseria meningitidis Z2491
ccuuaccgaccaccacuuuuuu

SEQ ID NO: 1386853 - RNA, 15 nt, Neisseria meningitidis Z2491
ccuucagcucucccu

SEQ ID NO: 1386854 - RNA, 17 nt, Neisseria meningitidis Z2491
ccuuaugccuuuuucaa

SEQ ID NO: 1386855 - RNA, 16 nt, Neisseria meningitidis Z2491
ccuguuuuuaaccuua

SEQ ID NO: 1386856 - RNA, 12 nt, Neisseria meningitidis Z2491
ccuguuuuucaa

SEQ ID NO: 1386857 - RNA, 18 nt, Neisseria meningitidis Z2491
ccuguuuuucaaagccca

SEQ ID NO: 1386858 - RNA, 15 nt, Neisseria meningitidis Z2491
ccuguuucgcuguuu

SEQ ID NO: 1386859 - RNA, 14 nt, Neisseria meningitidis Z2491
ccuuaaaaaacaaa

SEQ ID NO: 1386860 - RNA, 23 nt, Neisseria meningitidis Z2491
ccuguuauuuucacaaaaacaga

SEQ ID NO: 1386861 - RNA, 12 nt, Neisseria meningitidis Z2491
ccuguaaacaga

SEQ ID NO: 1386862 - RNA, 16 nt, Neisseria meningitidis Z2491
ccuguaaaaacaaaaa

SEQ ID NO: 1386863 - RNA, 17 nt, Neisseria meningitidis Z2491
ccuguaaaaacaaaaaa

SEQ ID NO: 1386864 - RNA, 22 nt, Neisseria meningitidis Z2491
ccugguugaugucgugcaauac

SEQ ID NO: 1386865 - RNA, 21 nt, Neisseria meningitidis Z2491
ccugugagaacaagccuguuu

SEQ ID NO: 1386866 - RNA, 16 nt, Neisseria meningitidis Z2491
ccucagccaccagcgg

SEQ ID NO: 1386867 - RNA, 20 nt, Neisseria meningitidis Z2491
ccucagcuaugccugccgac

SEQ ID NO: 1386868 - RNA, 13 nt, Neisseria meningitidis Z2491
ccucgccuuagcu

SEQ ID NO: 1386869 - RNA, 15 nt, Neisseria meningitidis Z2491
ccucgccgcgcguca

SEQ ID NO: 1386870 - RNA, 19 nt, Neisseria meningitidis Z2491
ccucgucauucccgcaaaa

SEQ ID NO: 1386871 - RNA, 21 nt, Neisseria meningitidis Z2491
ccugauugaccgaaaaauaau

SEQ ID NO: 1386872 - RNA, 17 nt, Neisseria meningitidis Z2491
ccugaugauuuuuucaa

SEQ ID NO: 1386873 - RNA, 23 nt, Neisseria meningitidis Z2491
ccugaugaaauuuagauaaugug

SEQ ID NO: 1386874 - RNA, 17 nt, Neisseria meningitidis Z2491
ccugaucuaaaaauucu

SEQ ID NO: 1386875 - RNA, 22 nt, Neisseria meningitidis Z2491
ccugauacagccacgccaaaaa

SEQ ID NO: 1386876 - RNA, 17 nt, Neisseria meningitidis Z2491
ccugauagcagacgaac

SEQ ID NO: 1386877 - RNA, 14 nt, Neisseria meningitidis Z2491
ccugauaaaaaaua

SEQ ID NO: 1386878 - RNA, 17 nt, Neisseria meningitidis Z2491
ccugagcaaaugccuua

SEQ ID NO: 1386879 - RNA, 14 nt, Neisseria meningitidis Z2491
ccugacgcuccagc

SEQ ID NO: 1386880 - RNA, 22 nt, Neisseria meningitidis Z2491
ccguccgaaccgcaaaugcugu

SEQ ID NO: 1386881 - RNA, 13 nt, Neisseria meningitidis Z2491
ccgucauucccac

SEQ ID NO: 1386882 - RNA, 18 nt, Neisseria meningitidis Z2491
ccgucauucccgcgcagg

SEQ ID NO: 1386883 - RNA, 14 nt, Neisseria meningitidis Z2491
ccgucauuccugua

SEQ ID NO: 1386884 - RNA, 14 nt, Neisseria meningitidis Z2491
ccgucaaaacaucg

SEQ ID NO: 1386885 - RNA, 12 nt, Neisseria meningitidis Z2491
ccguaugcaaaa

SEQ ID NO: 1386886 - RNA, 18 nt, Neisseria meningitidis Z2491
ccguaugccgccugccug

SEQ ID NO: 1386887 - RNA, 17 nt, Neisseria meningitidis Z2491
ccguaucauacauagca

SEQ ID NO: 1386888 - RNA, 14 nt, Neisseria meningitidis Z2491
ccguaccgggcagg

SEQ ID NO: 1386889 - RNA, 15 nt, Neisseria meningitidis Z2491
ccguaccgggcaggc

SEQ ID NO: 1386890 - RNA, 16 nt, Neisseria meningitidis Z2491
ccgguuggaaggcggc

SEQ ID NO: 1386891 - RNA, 20 nt, Neisseria meningitidis Z2491
ccgguuggaaggcggcggca

SEQ ID NO: 1386892 - RNA, 22 nt, Neisseria meningitidis Z2491
ccggugugcauccgacaggcaa

SEQ ID NO: 1386893 - RNA, 22 nt, Neisseria meningitidis Z2491
ccgguacagcguuggcucgccu

SEQ ID NO: 1386894 - RNA, 19 nt, Neisseria meningitidis Z2491
ccgguacccaaacuuccaa

SEQ ID NO: 1386895 - RNA, 14 nt, Neisseria meningitidis Z2491
ccgggcaagacgaa

SEQ ID NO: 1386896 - RNA, 14 nt, Neisseria meningitidis Z2491
ccuacacaucgugu

SEQ ID NO: 1386897 - RNA, 14 nt, Neisseria meningitidis Z2491
ccuaucacuuccag

SEQ ID NO: 1386898 - RNA, 22 nt, Neisseria meningitidis Z2491
ccuauaguggauuaacaaaaau

SEQ ID NO: 1386899 - RNA, 13 nt, Neisseria meningitidis Z2491
ccgugggaaugac

SEQ ID NO: 1386900 - RNA, 14 nt, Neisseria meningitidis Z2491
ccguuaccaaguuu

SEQ ID NO: 1386901 - RNA, 20 nt, Neisseria meningitidis Z2491
ccguguucggguacaaccaa

SEQ ID NO: 1386902 - RNA, 13 nt, Neisseria meningitidis Z2491
ccuaaaggcuuca

SEQ ID NO: 1386903 - RNA, 13 nt, Neisseria meningitidis Z2491
ccuaaagccgucc

SEQ ID NO: 1386904 - RNA, 12 nt, Neisseria meningitidis Z2491
ccguuuuuacug

SEQ ID NO: 1386905 - RNA, 16 nt, Neisseria meningitidis Z2491
ccuaaaacuuaaaauu

SEQ ID NO: 1386906 - RNA, 13 nt, Neisseria meningitidis Z2491
ccuaaaacaucaa

SEQ ID NO: 1386907 - RNA, 15 nt, Neisseria meningitidis Z2491
ccuaaaaccuuccua

SEQ ID NO: 1386908 - RNA, 21 nt, Neisseria meningitidis Z2491
ccguuggucacggagaaggca

SEQ ID NO: 1386909 - RNA, 17 nt, Neisseria meningitidis Z2491
ccggagucucagggcug

SEQ ID NO: 1386910 - RNA, 13 nt, Neisseria meningitidis Z2491
ccggaugcaugau

SEQ ID NO: 1386911 - RNA, 14 nt, Neisseria meningitidis Z2491
ccggaugcaugauu

SEQ ID NO: 1386912 - RNA, 16 nt, Neisseria meningitidis Z2491
ccggcgcguucggcgc

SEQ ID NO: 1386913 - RNA, 12 nt, Neisseria meningitidis Z2491
ccggcgcggcgc

SEQ ID NO: 1386914 - RNA, 23 nt, Neisseria meningitidis Z2491
ccggcgcagcuccucccuccccc

SEQ ID NO: 1386915 - RNA, 18 nt, Neisseria meningitidis Z2491
ccggccuuaaggcggcug

SEQ ID NO: 1386916 - RNA, 20 nt, Neisseria meningitidis Z2491
ccgcgccaauuccuucaugg

SEQ ID NO: 1386917 - RNA, 23 nt, Neisseria meningitidis Z2491
ccgcgcugacuuuggaagccucc

SEQ ID NO: 1386918 - RNA, 13 nt, Neisseria meningitidis Z2491
ccgcgcuguguug

SEQ ID NO: 1386919 - RNA, 16 nt, Neisseria meningitidis Z2491
ccgccugucgggcuuc

SEQ ID NO: 1386920 - RNA, 22 nt, Neisseria meningitidis Z2491
ccgcgauaaggcgcguccaaca

SEQ ID NO: 1386921 - RNA, 23 nt, Neisseria meningitidis Z2491
ccgcugcgggccaucacccugcc

SEQ ID NO: 1386922 - RNA, 14 nt, Neisseria meningitidis Z2491
ccgcugguaucuuu

SEQ ID NO: 1386923 - RNA, 17 nt, Neisseria meningitidis Z2491
ccgcuguauuugcgccg

SEQ ID NO: 1386924 - RNA, 17 nt, Neisseria meningitidis Z2491
ccgcugacgaaaccaga

SEQ ID NO: 1386925 - RNA, 17 nt, Neisseria meningitidis Z2491
ccgcguguccgcgcguu

SEQ ID NO: 1386926 - RNA, 18 nt, Neisseria meningitidis Z2491
ccgcuauauuccaccauc

SEQ ID NO: 1386927 - RNA, 23 nt, Neisseria meningitidis Z2491
ccgaggauaaaaaaugccgucug

SEQ ID NO: 1386928 - RNA, 14 nt, Neisseria meningitidis Z2491
ccgacugccgccgc

SEQ ID NO: 1386929 - RNA, 15 nt, Neisseria meningitidis Z2491
ccgagcaggacggcu

SEQ ID NO: 1386930 - RNA, 21 nt, Neisseria meningitidis Z2491
ccgacccugccgucugaaacc

SEQ ID NO: 1386931 - RNA, 16 nt, Neisseria meningitidis Z2491
ccgaccgccgccgccu

SEQ ID NO: 1386932 - RNA, 14 nt, Neisseria meningitidis Z2491
ccgacacaaugaaa

SEQ ID NO: 1386933 - RNA, 23 nt, Neisseria meningitidis Z2491
ccgacaaaauaccgucugaaacc

SEQ ID NO: 1386934 - RNA, 17 nt, Neisseria meningitidis Z2491
ccgacaauacggcggcg

SEQ ID NO: 1386935 - RNA, 12 nt, Neisseria meningitidis Z2491
ccgaagggaaag

SEQ ID NO: 1386936 - RNA, 13 nt, Neisseria meningitidis Z2491
ccgaagggaaagc

SEQ ID NO: 1386937 - RNA, 18 nt, Neisseria meningitidis Z2491
ccgaauugcagcgcgccc

SEQ ID NO: 1386938 - RNA, 18 nt, Neisseria meningitidis Z2491
ccgaauugcgccgacagc

SEQ ID NO: 1386939 - RNA, 20 nt, Neisseria meningitidis Z2491
ccgaaugauucauaaaauau

SEQ ID NO: 1386940 - RNA, 22 nt, Neisseria meningitidis Z2491
ccgaagcgacaacaaucuuuuc

SEQ ID NO: 1386941 - RNA, 17 nt, Neisseria meningitidis Z2491
ccgaaggacagaugucc

SEQ ID NO: 1386942 - RNA, 20 nt, Neisseria meningitidis Z2491
ccgacagcagcuuuugcgcc

SEQ ID NO: 1386943 - RNA, 16 nt, Neisseria meningitidis Z2491
ccgacaucccccagcc

SEQ ID NO: 1386944 - RNA, 19 nt, Neisseria meningitidis Z2491
ccgacagugcggacaccgc

SEQ ID NO: 1386945 - RNA, 23 nt, Neisseria meningitidis Z2491
ccgaaaguuugagguucuagauu

SEQ ID NO: 1386946 - RNA, 15 nt, Neisseria meningitidis Z2491
ccgaaaucauccaca

SEQ ID NO: 1386947 - RNA, 22 nt, Neisseria meningitidis Z2491
ccgaaauaucggcaacaccgcu

SEQ ID NO: 1386948 - RNA, 19 nt, Neisseria meningitidis Z2491
ccgaaaugguuuaagagcu

SEQ ID NO: 1386949 - RNA, 21 nt, Neisseria meningitidis Z2491
ccgaaccgcgcucauuuuugu

SEQ ID NO: 1386950 - RNA, 16 nt, Neisseria meningitidis Z2491
ccgaacacgauggcgc

SEQ ID NO: 1386951 - RNA, 17 nt, Neisseria meningitidis Z2491
cccucggcauucccgcc

SEQ ID NO: 1386952 - RNA, 22 nt, Neisseria meningitidis Z2491
cccucggauggggugcggcacg

SEQ ID NO: 1386953 - RNA, 21 nt, Neisseria meningitidis Z2491
ccgcauauuccggugcgaccg

SEQ ID NO: 1386954 - RNA, 19 nt, Neisseria meningitidis Z2491
ccgcauugccgcaaucgcc

SEQ ID NO: 1386955 - RNA, 17 nt, Neisseria meningitidis Z2491
ccgccaaaaacggcacg

SEQ ID NO: 1386956 - RNA, 15 nt, Neisseria meningitidis Z2491
ccgccaaagugccaa

SEQ ID NO: 1386957 - RNA, 13 nt, Neisseria meningitidis Z2491
ccgccaaacccuc

SEQ ID NO: 1386958 - RNA, 13 nt, Neisseria meningitidis Z2491
ccgccaacaccgc

SEQ ID NO: 1386959 - RNA, 16 nt, Neisseria meningitidis Z2491
ccgccaaugccgucug

SEQ ID NO: 1386960 - RNA, 11 nt, Neisseria meningitidis Z2491
ccgcagacagu

SEQ ID NO: 1386961 - RNA, 19 nt, Neisseria meningitidis Z2491
ccgcagacaguacaaauag

SEQ ID NO: 1386962 - RNA, 16 nt, Neisseria meningitidis Z2491
ccgcagccggggcagg

SEQ ID NO: 1386963 - RNA, 17 nt, Neisseria meningitidis Z2491
ccgcagccggggcaggc

SEQ ID NO: 1386964 - RNA, 21 nt, Neisseria meningitidis Z2491
ccgcacaaaccgcgcaucgcc

SEQ ID NO: 1386965 - RNA, 16 nt, Neisseria meningitidis Z2491
ccgcaccgacagaccu

SEQ ID NO: 1386966 - RNA, 17 nt, Neisseria meningitidis Z2491
ccgccaguccuacccaa

SEQ ID NO: 1386967 - RNA, 13 nt, Neisseria meningitidis Z2491
ccgccaucaggaa

SEQ ID NO: 1386968 - RNA, 13 nt, Neisseria meningitidis Z2491
ccgcccagccgaa

SEQ ID NO: 1386969 - RNA, 22 nt, Neisseria meningitidis Z2491
cauccuguuauuuucacaaaaa

SEQ ID NO: 1386970 - RNA, 16 nt, Neisseria meningitidis Z2491
caucgacacccgcccc

SEQ ID NO: 1386971 - RNA, 17 nt, Neisseria meningitidis Z2491
caucgacacccgccccg

SEQ ID NO: 1386972 - RNA, 20 nt, Neisseria meningitidis Z2491
caucgacacccgccccgccg

SEQ ID NO: 1386973 - RNA, 23 nt, Neisseria meningitidis Z2491
cauccuaaaaauuuaauaacuua

SEQ ID NO: 1386974 - RNA, 17 nt, Neisseria meningitidis Z2491
caucgagugugggguag

SEQ ID NO: 1386975 - RNA, 15 nt, Neisseria meningitidis Z2491
caucgagcugccuuu

SEQ ID NO: 1386976 - RNA, 23 nt, Neisseria meningitidis Z2491
caucgagcugccuuuuaccuuga

SEQ ID NO: 1386977 - RNA, 20 nt, Neisseria meningitidis Z2491
caucgcgcccaauucuucuu

SEQ ID NO: 1386978 - RNA, 18 nt, Neisseria meningitidis Z2491
caucgcucaaauucuguu

SEQ ID NO: 1386979 - RNA, 17 nt, Neisseria meningitidis Z2491
caucggcguaauaauau

SEQ ID NO: 1386980 - RNA, 23 nt, Neisseria meningitidis Z2491
caucuucuucaacaccugcagau

SEQ ID NO: 1386981 - RNA, 18 nt, Neisseria meningitidis Z2491
caucuuguuuuucaauca

SEQ ID NO: 1386982 - RNA, 14 nt, Neisseria meningitidis Z2491
caucuucaaaggaa

SEQ ID NO: 1386983 - RNA, 22 nt, Neisseria meningitidis Z2491
caucuuauuuauuuuuucucaa

SEQ ID NO: 1386984 - RNA, 12 nt, Neisseria meningitidis Z2491
caucugauuuuu

SEQ ID NO: 1386985 - RNA, 14 nt, Neisseria meningitidis Z2491
caucugauuuuucu

SEQ ID NO: 1386986 - RNA, 16 nt, Neisseria meningitidis Z2491
caucugauacaccggu

SEQ ID NO: 1386987 - RNA, 15 nt, Neisseria meningitidis Z2491
caucgguuucuucuu

SEQ ID NO: 1386988 - RNA, 16 nt, Neisseria meningitidis Z2491
caucgguuucuucuuc

SEQ ID NO: 1386989 - RNA, 13 nt, Neisseria meningitidis Z2491
caucaucacaaug

SEQ ID NO: 1386990 - RNA, 20 nt, Neisseria meningitidis Z2491
caucaucggcguaauaauau

SEQ ID NO: 1386991 - RNA, 18 nt, Neisseria meningitidis Z2491
caucauccugcuuuaauu

SEQ ID NO: 1386992 - RNA, 22 nt, Neisseria meningitidis Z2491
caucauccugcuuuaauucucc

SEQ ID NO: 1386993 - RNA, 16 nt, Neisseria meningitidis Z2491
caucaaaccauaugga

SEQ ID NO: 1386994 - RNA, 14 nt, Neisseria meningitidis Z2491
cauauuuucaguuu

SEQ ID NO: 1386995 - RNA, 23 nt, Neisseria meningitidis Z2491
cauaucaacgcgggaauagcuca

SEQ ID NO: 1386996 - RNA, 20 nt, Neisseria meningitidis Z2491
cauauaacaccuuucaauca

SEQ ID NO: 1386997 - RNA, 22 nt, Neisseria meningitidis Z2491
cauacuuuguuucaaaauguuc

SEQ ID NO: 1386998 - RNA, 16 nt, Neisseria meningitidis Z2491
cauaugccgucugaag

SEQ ID NO: 1386999 - RNA, 18 nt, Neisseria meningitidis Z2491
cauauggaaaaaucugug

SEQ ID NO: 1387000 - RNA, 18 nt, Neisseria meningitidis Z2491
cauauguuuuuuccuguu

SEQ ID NO: 1387001 - RNA, 16 nt, Neisseria meningitidis Z2491
cauugaaauuccagau

SEQ ID NO: 1387002 - RNA, 19 nt, Neisseria meningitidis Z2491
cauugacauauccggcucc

SEQ ID NO: 1387003 - RNA, 19 nt, Neisseria meningitidis Z2491
cauucucacaaaaacagaa

SEQ ID NO: 1387004 - RNA, 22 nt, Neisseria meningitidis Z2491
cauucgugggcgcauucggggc

SEQ ID NO: 1387005 - RNA, 13 nt, Neisseria meningitidis Z2491
cauuuuuggcuug

SEQ ID NO: 1387006 - RNA, 16 nt, Neisseria meningitidis Z2491
cauuuuguuuuuaaga

SEQ ID NO: 1387007 - RNA, 22 nt, Neisseria meningitidis Z2491
cauuuucaaaaugcaaaacuuu

SEQ ID NO: 1387008 - RNA, 23 nt, Neisseria meningitidis Z2491
cauuuucaaaaugcaaaacuuuu

SEQ ID NO: 1387009 - RNA, 17 nt, Neisseria meningitidis Z2491
cauuuuccguugccugc

SEQ ID NO: 1387010 - RNA, 19 nt, Neisseria meningitidis Z2491
cauuuguuccaauuccugu

SEQ ID NO: 1387011 - RNA, 21 nt, Neisseria meningitidis Z2491
cauuugcacacguuugccguu

SEQ ID NO: 1387012 - RNA, 19 nt, Neisseria meningitidis Z2491
cauuugacccauuacugcu

SEQ ID NO: 1387013 - RNA, 19 nt, Neisseria meningitidis Z2491
cauuugacuuucagggugu

SEQ ID NO: 1387014 - RNA, 17 nt, Neisseria meningitidis Z2491
cauuucuuccugacgga

SEQ ID NO: 1387015 - RNA, 23 nt, Neisseria meningitidis Z2491
cauuucuggauucccacuuuugu

SEQ ID NO: 1387016 - RNA, 20 nt, Neisseria meningitidis Z2491
cauuaagauguuuuuccaca

SEQ ID NO: 1387017 - RNA, 13 nt, Neisseria meningitidis Z2491
cauuaaaaaauac

SEQ ID NO: 1387018 - RNA, 22 nt, Neisseria meningitidis Z2491
cauuaaaggggugcguuuuauu

SEQ ID NO: 1387019 - RNA, 19 nt, Neisseria meningitidis Z2491
cauuaaagugccauuuaaa

SEQ ID NO: 1387020 - RNA, 12 nt, Neisseria meningitidis Z2491
cauuaaaauucu

SEQ ID NO: 1387021 - RNA, 12 nt, Neisseria meningitidis Z2491
caugcggcgggc

SEQ ID NO: 1387022 - RNA, 21 nt, Neisseria meningitidis Z2491
cauaccgaugaugacggucag

SEQ ID NO: 1387023 - RNA, 17 nt, Neisseria meningitidis Z2491
cauaccgccuucaucaa

SEQ ID NO: 1387024 - RNA, 21 nt, Neisseria meningitidis Z2491
cauaccgccuucaucaaaauc

SEQ ID NO: 1387025 - RNA, 23 nt, Neisseria meningitidis Z2491
cauacggaugucgaguucuuuua

SEQ ID NO: 1387026 - RNA, 22 nt, Neisseria meningitidis Z2491
cauacuacgcggcugaaaaaau

SEQ ID NO: 1387027 - RNA, 23 nt, Neisseria meningitidis Z2491
cauacuacgcggcugaaaaaaug

SEQ ID NO: 1387028 - RNA, 14 nt, Neisseria meningitidis Z2491
cauacuacugcugu

SEQ ID NO: 1387029 - RNA, 20 nt, Neisseria meningitidis Z2491
cauacguuuugguugcgccg

SEQ ID NO: 1387030 - RNA, 12 nt, Neisseria meningitidis Z2491
cauaacccaaac

SEQ ID NO: 1387031 - RNA, 13 nt, Neisseria meningitidis Z2491
cauaccaugcgaa

SEQ ID NO: 1387032 - RNA, 17 nt, Neisseria meningitidis Z2491
caguugaaaucaacaga

SEQ ID NO: 1387033 - RNA, 16 nt, Neisseria meningitidis Z2491
cauaacacacccaugc

SEQ ID NO: 1387034 - RNA, 18 nt, Neisseria meningitidis Z2491
cauaaccgcuugacgcua

SEQ ID NO: 1387035 - RNA, 14 nt, Neisseria meningitidis Z2491
cauaaauuuuaaau

SEQ ID NO: 1387036 - RNA, 22 nt, Neisseria meningitidis Z2491
cauaaauuuuaaauaaaucaag

SEQ ID NO: 1387037 - RNA, 15 nt, Neisseria meningitidis Z2491
cauaaaugccgucug

SEQ ID NO: 1387038 - RNA, 14 nt, Neisseria meningitidis Z2491
cauaaaucaacagc

SEQ ID NO: 1387039 - RNA, 17 nt, Neisseria meningitidis Z2491
caggguuaagaaaaccu

SEQ ID NO: 1387040 - RNA, 14 nt, Neisseria meningitidis Z2491
caggguuaaggcuu

SEQ ID NO: 1387041 - RNA, 22 nt, Neisseria meningitidis Z2491
caggguucggacggcauuaaaa

SEQ ID NO: 1387042 - RNA, 17 nt, Neisseria meningitidis Z2491
cagguaaaaaauagaaa

SEQ ID NO: 1387043 - RNA, 20 nt, Neisseria meningitidis Z2491
cagguaaaaaauagaaauac

SEQ ID NO: 1387044 - RNA, 18 nt, Neisseria meningitidis Z2491
cagguuuuuauagaauua

SEQ ID NO: 1387045 - RNA, 23 nt, Neisseria meningitidis Z2491
cagguuuuuauagaauuauccac

SEQ ID NO: 1387046 - RNA, 20 nt, Neisseria meningitidis Z2491
cagguuuucgucuauuuucg

SEQ ID NO: 1387047 - RNA, 22 nt, Neisseria meningitidis Z2491
caguaaaauuuauuauguauau

SEQ ID NO: 1387048 - RNA, 15 nt, Neisseria meningitidis Z2491
caguaucaaucuggu

SEQ ID NO: 1387049 - RNA, 19 nt, Neisseria meningitidis Z2491
caguggcaauuuuuuaaau

SEQ ID NO: 1387050 - RNA, 23 nt, Neisseria meningitidis Z2491
caguguauucgacgcgcuugaug

SEQ ID NO: 1387051 - RNA, 13 nt, Neisseria meningitidis Z2491
caguccuuaucug

SEQ ID NO: 1387052 - RNA, 17 nt, Neisseria meningitidis Z2491
cagucugucgccgucgg

SEQ ID NO: 1387053 - RNA, 15 nt, Neisseria meningitidis Z2491
caggaugucugccug

SEQ ID NO: 1387054 - RNA, 19 nt, Neisseria meningitidis Z2491
caggaucuuauccauccca

SEQ ID NO: 1387055 - RNA, 17 nt, Neisseria meningitidis Z2491
caggacggcuuugaaca

SEQ ID NO: 1387056 - RNA, 23 nt, Neisseria meningitidis Z2491
caggaacgggccguuuuuacugg

SEQ ID NO: 1387057 - RNA, 16 nt, Neisseria meningitidis Z2491
caggacgacacauaaa

SEQ ID NO: 1387058 - RNA, 12 nt, Neisseria meningitidis Z2491
caggacaaaaau

SEQ ID NO: 1387059 - RNA, 18 nt, Neisseria meningitidis Z2491
caggacaaaaauccugcu

SEQ ID NO: 1387060 - RNA, 14 nt, Neisseria meningitidis Z2491
caggaauuuauccg

SEQ ID NO: 1387061 - RNA, 21 nt, Neisseria meningitidis Z2491
caggaauuuaucggaaaaaca

SEQ ID NO: 1387062 - RNA, 20 nt, Neisseria meningitidis Z2491
caggaaucggguuucagacg

SEQ ID NO: 1387063 - RNA, 17 nt, Neisseria meningitidis Z2491
cagcuguuuucggcugu

SEQ ID NO: 1387064 - RNA, 16 nt, Neisseria meningitidis Z2491
cagcuaugccugccga

SEQ ID NO: 1387065 - RNA, 14 nt, Neisseria meningitidis Z2491
cagcuccggccaaa

SEQ ID NO: 1387066 - RNA, 16 nt, Neisseria meningitidis Z2491
cagcuccggccaaaaa

SEQ ID NO: 1387067 - RNA, 13 nt, Neisseria meningitidis Z2491
cagggcagggcau

SEQ ID NO: 1387068 - RNA, 17 nt, Neisseria meningitidis Z2491
caggggauugccgcccc

SEQ ID NO: 1387069 - RNA, 12 nt, Neisseria meningitidis Z2491
cagggucauggc

SEQ ID NO: 1387070 - RNA, 13 nt, Neisseria meningitidis Z2491
caggguaaugacc

SEQ ID NO: 1387071 - RNA, 16 nt, Neisseria meningitidis Z2491
caggcguuuccaaagu

SEQ ID NO: 1387072 - RNA, 12 nt, Neisseria meningitidis Z2491
caggcggcggca

SEQ ID NO: 1387073 - RNA, 19 nt, Neisseria meningitidis Z2491
caggcggcguucuucuucg

SEQ ID NO: 1387074 - RNA, 14 nt, Neisseria meningitidis Z2491
caggcgggaaucca

SEQ ID NO: 1387075 - RNA, 19 nt, Neisseria meningitidis Z2491
caggcgggaauccaggacg

SEQ ID NO: 1387076 - RNA, 14 nt, Neisseria meningitidis Z2491
caggcgggaaucua

SEQ ID NO: 1387077 - RNA, 18 nt, Neisseria meningitidis Z2491
caggcgggaaucuagacc

SEQ ID NO: 1387078 - RNA, 20 nt, Neisseria meningitidis Z2491
caggcgggcguuccacaaau

SEQ ID NO: 1387079 - RNA, 13 nt, Neisseria meningitidis Z2491
caggcaguuugau

SEQ ID NO: 1387080 - RNA, 18 nt, Neisseria meningitidis Z2491
caggcagcagaucgaccg

SEQ ID NO: 1387081 - RNA, 16 nt, Neisseria meningitidis Z2491
cacuuucgugggaaug

SEQ ID NO: 1387082 - RNA, 14 nt, Neisseria meningitidis Z2491
cagaaaaccaaaaa

SEQ ID NO: 1387083 - RNA, 16 nt, Neisseria meningitidis Z2491
cagaaaaccaaaauca

SEQ ID NO: 1387084 - RNA, 21 nt, Neisseria meningitidis Z2491
cagaaaaaggguuugacagcg

SEQ ID NO: 1387085 - RNA, 20 nt, Neisseria meningitidis Z2491
cacuuccagcgcaccuccau

SEQ ID NO: 1387086 - RNA, 20 nt, Neisseria meningitidis Z2491
cacuucaaccagccagccgu

SEQ ID NO: 1387087 - RNA, 15 nt, Neisseria meningitidis Z2491
cacuuccgugggaau

SEQ ID NO: 1387088 - RNA, 22 nt, Neisseria meningitidis Z2491
cacuugaaauccgaauccaagg

SEQ ID NO: 1387089 - RNA, 17 nt, Neisseria meningitidis Z2491
cacuguuuccaagccgc

SEQ ID NO: 1387090 - RNA, 16 nt, Neisseria meningitidis Z2491
cacuuaaaaauaccua

SEQ ID NO: 1387091 - RNA, 17 nt, Neisseria meningitidis Z2491
caaugugcccgaaggga

SEQ ID NO: 1387092 - RNA, 14 nt, Neisseria meningitidis Z2491
caauuaaaaacaaa

SEQ ID NO: 1387093 - RNA, 15 nt, Neisseria meningitidis Z2491
caauuaaaaacaaaa

SEQ ID NO: 1387094 - RNA, 16 nt, Neisseria meningitidis Z2491
caauuaaaaacaaaau

SEQ ID NO: 1387095 - RNA, 15 nt, Neisseria meningitidis Z2491
cacugccucuuuuca

SEQ ID NO: 1387096 - RNA, 17 nt, Neisseria meningitidis Z2491
cacugccucuuuucaga

SEQ ID NO: 1387097 - RNA, 18 nt, Neisseria meningitidis Z2491
cacugccagccgccgagc

SEQ ID NO: 1387098 - RNA, 11 nt, Neisseria meningitidis Z2491
cagaaaugacu

SEQ ID NO: 1387099 - RNA, 14 nt, Neisseria meningitidis Z2491
cagaaaauuucuug

SEQ ID NO: 1387100 - RNA, 23 nt, Neisseria meningitidis Z2491
cagaaaauuucuugauuuuucug

SEQ ID NO: 1387101 - RNA, 13 nt, Neisseria meningitidis Z2491
cagaaacccaaaa

SEQ ID NO: 1387102 - RNA, 17 nt, Neisseria meningitidis Z2491
cagaaacagcgaagaca

SEQ ID NO: 1387103 - RNA, 23 nt, Neisseria meningitidis Z2491
cagaaaccacccugccgucauuc

SEQ ID NO: 1387104 - RNA, 20 nt, Neisseria meningitidis Z2491
cagaaaccgcucugccguca

SEQ ID NO: 1387105 - RNA, 23 nt, Neisseria meningitidis Z2491
cagaaaccgcucugccgucauuc

SEQ ID NO: 1387106 - RNA, 13 nt, Neisseria meningitidis Z2491
cagaaaccuaaaa

SEQ ID NO: 1387107 - RNA, 17 nt, Neisseria meningitidis Z2491
cagaaaccuaaaauccc

SEQ ID NO: 1387108 - RNA, 17 nt, Neisseria meningitidis Z2491
cagaaaguggaauugag

SEQ ID NO: 1387109 - RNA, 16 nt, Neisseria meningitidis Z2491
cagaaagccaaaaaca

SEQ ID NO: 1387110 - RNA, 15 nt, Neisseria meningitidis Z2491
cagaaagcaaaaccg

SEQ ID NO: 1387111 - RNA, 19 nt, Neisseria meningitidis Z2491
cagaacgguuucuguuuuu

SEQ ID NO: 1387112 - RNA, 16 nt, Neisseria meningitidis Z2491
cagaacguaaaaucug

SEQ ID NO: 1387113 - RNA, 18 nt, Neisseria meningitidis Z2491
cagaacguaaaaucugaa

SEQ ID NO: 1387114 - RNA, 16 nt, Neisseria meningitidis Z2491
cagaaguuacucgaaa

SEQ ID NO: 1387115 - RNA, 15 nt, Neisseria meningitidis Z2491
cagaaucugcaugag

SEQ ID NO: 1387116 - RNA, 15 nt, Neisseria meningitidis Z2491
cagaaucaaauauua

SEQ ID NO: 1387117 - RNA, 16 nt, Neisseria meningitidis Z2491
cagacaguacaaauag

SEQ ID NO: 1387118 - RNA, 14 nt, Neisseria meningitidis Z2491
cagacauuaaaaaa

SEQ ID NO: 1387119 - RNA, 16 nt, Neisseria meningitidis Z2491
cagacauuaaaaaaua

SEQ ID NO: 1387120 - RNA, 22 nt, Neisseria meningitidis Z2491
cagacauugcuaaaacaacugc

SEQ ID NO: 1387121 - RNA, 18 nt, Neisseria meningitidis Z2491
cagacagcccucuugccu

SEQ ID NO: 1387122 - RNA, 15 nt, Neisseria meningitidis Z2491
cagacggcaucagua

SEQ ID NO: 1387123 - RNA, 17 nt, Neisseria meningitidis Z2491
cagacggcaucuuuuuu

SEQ ID NO: 1387124 - RNA, 16 nt, Neisseria meningitidis Z2491
cagacggcauuguuuc

SEQ ID NO: 1387125 - RNA, 16 nt, Neisseria meningitidis Z2491
cagacggcauuugucc

SEQ ID NO: 1387126 - RNA, 19 nt, Neisseria meningitidis Z2491
cagacggcauuuguccauu

SEQ ID NO: 1387127 - RNA, 14 nt, Neisseria meningitidis Z2491
cagacggcauuuug

SEQ ID NO: 1387128 - RNA, 15 nt, Neisseria meningitidis Z2491
cagacggcauuuugc

SEQ ID NO: 1387129 - RNA, 19 nt, Neisseria meningitidis Z2491
cagacggcauuuuuauugc

SEQ ID NO: 1387130 - RNA, 18 nt, Neisseria meningitidis Z2491
cagacggcauuuuuucac

SEQ ID NO: 1387131 - RNA, 13 nt, Neisseria meningitidis Z2491
cagacggucugcc

SEQ ID NO: 1387132 - RNA, 14 nt, Neisseria meningitidis Z2491
cagacggucugcca

SEQ ID NO: 1387133 - RNA, 14 nt, Neisseria meningitidis Z2491
cagacuauuuuugc

SEQ ID NO: 1387134 - RNA, 16 nt, Neisseria meningitidis Z2491
cagacgaacaccagcc

SEQ ID NO: 1387135 - RNA, 22 nt, Neisseria meningitidis Z2491
cagauagcugaacugcuugaau

SEQ ID NO: 1387136 - RNA, 20 nt, Neisseria meningitidis Z2491
cagauaguacggaaccgauu

SEQ ID NO: 1387137 - RNA, 20 nt, Neisseria meningitidis Z2491
cagauaguugcgguaauuuc

SEQ ID NO: 1387138 - RNA, 18 nt, Neisseria meningitidis Z2491
cagauagcgcggacggcg

SEQ ID NO: 1387139 - RNA, 13 nt, Neisseria meningitidis Z2491
cagauacaacaaa

SEQ ID NO: 1387140 - RNA, 23 nt, Neisseria meningitidis Z2491
cagauaaauacccauaccgaccg

SEQ ID NO: 1387141 - RNA, 18 nt, Neisseria meningitidis Z2491
cagagugcguacccaaaa

SEQ ID NO: 1387142 - RNA, 17 nt, Neisseria meningitidis Z2491
cagagguguuggaauca

SEQ ID NO: 1387143 - RNA, 18 nt, Neisseria meningitidis Z2491
cagagccucuucgcgcgc

SEQ ID NO: 1387144 - RNA, 13 nt, Neisseria meningitidis Z2491
cagcaauaaaaua

SEQ ID NO: 1387145 - RNA, 10 nt, Neisseria meningitidis Z2491
cagcaaccug

SEQ ID NO: 1387146 - RNA, 18 nt, Neisseria meningitidis Z2491
cagcaaccugaaauucgu

SEQ ID NO: 1387147 - RNA, 15 nt, Neisseria meningitidis Z2491
cagcaacgacagcag

SEQ ID NO: 1387148 - RNA, 16 nt, Neisseria meningitidis Z2491
cagcaacgacagcagc

SEQ ID NO: 1387149 - RNA, 18 nt, Neisseria meningitidis Z2491
cagcaacgacagcagcag

SEQ ID NO: 1387150 - RNA, 14 nt, Neisseria meningitidis Z2491
cagcaacauuuccu

SEQ ID NO: 1387151 - RNA, 16 nt, Neisseria meningitidis Z2491
cagcacaucgucugca

SEQ ID NO: 1387152 - RNA, 12 nt, Neisseria meningitidis Z2491
cagcacaggcaa

SEQ ID NO: 1387153 - RNA, 12 nt, Neisseria meningitidis Z2491
cagcaaucaggg

SEQ ID NO: 1387154 - RNA, 19 nt, Neisseria meningitidis Z2491
cagcaauccauucccucuc

SEQ ID NO: 1387155 - RNA, 22 nt, Neisseria meningitidis Z2491
cagcaauccauucccucucccg

SEQ ID NO: 1387156 - RNA, 15 nt, Neisseria meningitidis Z2491
cagcaauacgcaaaa

SEQ ID NO: 1387157 - RNA, 11 nt, Neisseria meningitidis Z2491
cagcacaaaca

SEQ ID NO: 1387158 - RNA, 14 nt, Neisseria meningitidis Z2491
cagcacaaaugcca

SEQ ID NO: 1387159 - RNA, 18 nt, Neisseria meningitidis Z2491
cagcacaaaugccaaagg

SEQ ID NO: 1387160 - RNA, 19 nt, Neisseria meningitidis Z2491
cagcacaaaugccaaaggc

SEQ ID NO: 1387161 - RNA, 22 nt, Neisseria meningitidis Z2491
cagcacaaaugccaaaggcagu

SEQ ID NO: 1387162 - RNA, 15 nt, Neisseria meningitidis Z2491
cagauugucaaaaua

SEQ ID NO: 1387163 - RNA, 19 nt, Neisseria meningitidis Z2491
cagcaaaauauggcugacu

SEQ ID NO: 1387164 - RNA, 20 nt, Neisseria meningitidis Z2491
cagaugugguggacgaugag

SEQ ID NO: 1387165 - RNA, 16 nt, Neisseria meningitidis Z2491
cagauucuugucaaac

SEQ ID NO: 1387166 - RNA, 22 nt, Neisseria meningitidis Z2491
cagauucuacguucuagauucc

SEQ ID NO: 1387167 - RNA, 18 nt, Neisseria meningitidis Z2491
cagauuccgaauaccauu

SEQ ID NO: 1387168 - RNA, 15 nt, Neisseria meningitidis Z2491
cagauucaacgcaag

SEQ ID NO: 1387169 - RNA, 16 nt, Neisseria meningitidis Z2491
cagauggccuuuacuc

SEQ ID NO: 1387170 - RNA, 16 nt, Neisseria meningitidis Z2491
cagaugccgucugaaa

SEQ ID NO: 1387171 - RNA, 14 nt, Neisseria meningitidis Z2491
cagccacaacacgc

SEQ ID NO: 1387172 - RNA, 18 nt, Neisseria meningitidis Z2491
cagccaccacguccaccu

SEQ ID NO: 1387173 - RNA, 14 nt, Neisseria meningitidis Z2491
cagcauuuccacau

SEQ ID NO: 1387174 - RNA, 15 nt, Neisseria meningitidis Z2491
cagcauuuccacauc

SEQ ID NO: 1387175 - RNA, 13 nt, Neisseria meningitidis Z2491
cagcauuaauaua

SEQ ID NO: 1387176 - RNA, 21 nt, Neisseria meningitidis Z2491
cagcauuaauauacuuggcaa

SEQ ID NO: 1387177 - RNA, 16 nt, Neisseria meningitidis Z2491
cagcaucgcagauucg

SEQ ID NO: 1387178 - RNA, 15 nt, Neisseria meningitidis Z2491
cagccaucuacaaaa

SEQ ID NO: 1387179 - RNA, 12 nt, Neisseria meningitidis Z2491
cagccauauuuu

SEQ ID NO: 1387180 - RNA, 13 nt, Neisseria meningitidis Z2491
cagccauauuuuu

SEQ ID NO: 1387181 - RNA, 16 nt, Neisseria meningitidis Z2491
cagcccauuacggcaa

SEQ ID NO: 1387182 - RNA, 22 nt, Neisseria meningitidis Z2491
cagccccaugcguucgagcagg

SEQ ID NO: 1387183 - RNA, 22 nt, Neisseria meningitidis Z2491
cagccccuuaaaguuugucccg

SEQ ID NO: 1387184 - RNA, 19 nt, Neisseria meningitidis Z2491
cagccagcaucgcagauuc

SEQ ID NO: 1387185 - RNA, 20 nt, Neisseria meningitidis Z2491
cagcaggggauugccgcccc

SEQ ID NO: 1387186 - RNA, 21 nt, Neisseria meningitidis Z2491
cagcaggggauugccgccccu

SEQ ID NO: 1387187 - RNA, 16 nt, Neisseria meningitidis Z2491
cagcagcccuccccag

SEQ ID NO: 1387188 - RNA, 14 nt, Neisseria meningitidis Z2491
cagcagcgaaggcg

SEQ ID NO: 1387189 - RNA, 15 nt, Neisseria meningitidis Z2491
cagcagcgaaggcgc

SEQ ID NO: 1387190 - RNA, 16 nt, Neisseria meningitidis Z2491
cagcaccgauggauuu

SEQ ID NO: 1387191 - RNA, 23 nt, Neisseria meningitidis Z2491
cagcaccguuuaaaacagcauug

SEQ ID NO: 1387192 - RNA, 23 nt, Neisseria meningitidis Z2491
cagcacgauacacaaaaaagcca

SEQ ID NO: 1387193 - RNA, 14 nt, Neisseria meningitidis Z2491
cagcccuccccaga

SEQ ID NO: 1387194 - RNA, 18 nt, Neisseria meningitidis Z2491
cagccgaaugauucauaa

SEQ ID NO: 1387195 - RNA, 22 nt, Neisseria meningitidis Z2491
cagccgaaugauucauaaaaua

SEQ ID NO: 1387196 - RNA, 17 nt, Neisseria meningitidis Z2491
cagccgaaaacagcuga

SEQ ID NO: 1387197 - RNA, 16 nt, Neisseria meningitidis Z2491
cagccgaaacccaaac

SEQ ID NO: 1387198 - RNA, 16 nt, Neisseria meningitidis Z2491
cagccgcuucaccgac

SEQ ID NO: 1387199 - RNA, 19 nt, Neisseria meningitidis Z2491
cagccgcuucaccgacacc

SEQ ID NO: 1387200 - RNA, 18 nt, Neisseria meningitidis Z2491
cagcgacacccucaauuc

SEQ ID NO: 1387201 - RNA, 23 nt, Neisseria meningitidis Z2491
cagcgacacccucaauucuucga

SEQ ID NO: 1387202 - RNA, 20 nt, Neisseria meningitidis Z2491
cagccugcucggccugcccu

SEQ ID NO: 1387203 - RNA, 21 nt, Neisseria meningitidis Z2491
cagccuaauguacuucuggaa

SEQ ID NO: 1387204 - RNA, 19 nt, Neisseria meningitidis Z2491
cagccuacuugcccgccuu

SEQ ID NO: 1387205 - RNA, 15 nt, Neisseria meningitidis Z2491
cagccuauuuuucug

SEQ ID NO: 1387206 - RNA, 15 nt, Neisseria meningitidis Z2491
cagcgaguuuuucgc

SEQ ID NO: 1387207 - RNA, 11 nt, Neisseria meningitidis Z2491
cagcggacagu

SEQ ID NO: 1387208 - RNA, 22 nt, Neisseria meningitidis Z2491
cagcggauuguucggaucggca

SEQ ID NO: 1387209 - RNA, 18 nt, Neisseria meningitidis Z2491
cagcgcguuuucauccac

SEQ ID NO: 1387210 - RNA, 14 nt, Neisseria meningitidis Z2491
caacccuccgccgc

SEQ ID NO: 1387211 - RNA, 18 nt, Neisseria meningitidis Z2491
caacccguaugccgccug

SEQ ID NO: 1387212 - RNA, 15 nt, Neisseria meningitidis Z2491
caaccgguccuucca

SEQ ID NO: 1387213 - RNA, 19 nt, Neisseria meningitidis Z2491
caaccgguccuuccaucac

SEQ ID NO: 1387214 - RNA, 17 nt, Neisseria meningitidis Z2491
caaccgcccagccgaau

SEQ ID NO: 1387215 - RNA, 16 nt, Neisseria meningitidis Z2491
caaccgcccuauauuu

SEQ ID NO: 1387216 - RNA, 16 nt, Neisseria meningitidis Z2491
caaccaagaagcggcg

SEQ ID NO: 1387217 - RNA, 22 nt, Neisseria meningitidis Z2491
caaccagccagccguauuuguc

SEQ ID NO: 1387218 - RNA, 21 nt, Neisseria meningitidis Z2491
caacaggguuccgaaaucauc

SEQ ID NO: 1387219 - RNA, 14 nt, Neisseria meningitidis Z2491
caacaggcgggcgu

SEQ ID NO: 1387220 - RNA, 13 nt, Neisseria meningitidis Z2491
caaccaaaaaauc

SEQ ID NO: 1387221 - RNA, 15 nt, Neisseria meningitidis Z2491
caacauuuccugcau

SEQ ID NO: 1387222 - RNA, 16 nt, Neisseria meningitidis Z2491
caacauuuccugcauc

SEQ ID NO: 1387223 - RNA, 17 nt, Neisseria meningitidis Z2491
caacauuugcgcagccu

SEQ ID NO: 1387224 - RNA, 17 nt, Neisseria meningitidis Z2491
caacgccacccauauaa

SEQ ID NO: 1387225 - RNA, 16 nt, Neisseria meningitidis Z2491
caacgcgggaauagcu

SEQ ID NO: 1387226 - RNA, 12 nt, Neisseria meningitidis Z2491
caacugaaacca

SEQ ID NO: 1387227 - RNA, 19 nt, Neisseria meningitidis Z2491
caacugaaccgucauuccc

SEQ ID NO: 1387228 - RNA, 23 nt, Neisseria meningitidis Z2491
caacugaccgacccauucugaca

SEQ ID NO: 1387229 - RNA, 11 nt, Neisseria meningitidis Z2491
caacacgccca

SEQ ID NO: 1387230 - RNA, 20 nt, Neisseria meningitidis Z2491
caacacgcccuuccacgcgc

SEQ ID NO: 1387231 - RNA, 14 nt, Neisseria meningitidis Z2491
caacaggaauuuau

SEQ ID NO: 1387232 - RNA, 15 nt, Neisseria meningitidis Z2491
caacaggaauuuauc

SEQ ID NO: 1387233 - RNA, 17 nt, Neisseria meningitidis Z2491
caacagaaauaaaagca

SEQ ID NO: 1387234 - RNA, 20 nt, Neisseria meningitidis Z2491
caacacuaguguauuagugg

SEQ ID NO: 1387235 - RNA, 13 nt, Neisseria meningitidis Z2491
caaauuuacagcu

SEQ ID NO: 1387236 - RNA, 17 nt, Neisseria meningitidis Z2491
caaaucaggguaaacag

SEQ ID NO: 1387237 - RNA, 18 nt, Neisseria meningitidis Z2491
caaaucaggguaaacagg

SEQ ID NO: 1387238 - RNA, 23 nt, Neisseria meningitidis Z2491
caaaucgaugcguuccugccaga

SEQ ID NO: 1387239 - RNA, 23 nt, Neisseria meningitidis Z2491
caaaucggacggauguucaaaca

SEQ ID NO: 1387240 - RNA, 20 nt, Neisseria meningitidis Z2491
caaaugcacgguuacacaaa

SEQ ID NO: 1387241 - RNA, 15 nt, Neisseria meningitidis Z2491
caaaugccgucugaa

SEQ ID NO: 1387242 - RNA, 21 nt, Neisseria meningitidis Z2491
caaaugccgucugaaaacagc

SEQ ID NO: 1387243 - RNA, 23 nt, Neisseria meningitidis Z2491
caaaugccgucugaaaacaguuc

SEQ ID NO: 1387244 - RNA, 23 nt, Neisseria meningitidis Z2491
caaaugccgucugaaaggcuuca

SEQ ID NO: 1387245 - RNA, 15 nt, Neisseria meningitidis Z2491
caaaugccaaaggca

SEQ ID NO: 1387246 - RNA, 19 nt, Neisseria meningitidis Z2491
caaauugaaaugccgucug

SEQ ID NO: 1387247 - RNA, 22 nt, Neisseria meningitidis Z2491
caaauugaaaugccgucugaaa

SEQ ID NO: 1387248 - RNA, 23 nt, Neisseria meningitidis Z2491
caaauugauuuuuagcccauguu

SEQ ID NO: 1387249 - RNA, 18 nt, Neisseria meningitidis Z2491
caaagccucgucauuucc

SEQ ID NO: 1387250 - RNA, 14 nt, Neisseria meningitidis Z2491
caaagccggcggca

SEQ ID NO: 1387251 - RNA, 20 nt, Neisseria meningitidis Z2491
caaagacagaaaaccaaaaa

SEQ ID NO: 1387252 - RNA, 22 nt, Neisseria meningitidis Z2491
caaacuuucagauaaucuuuga

SEQ ID NO: 1387253 - RNA, 22 nt, Neisseria meningitidis Z2491
caaacuuucggauaaucuuuga

SEQ ID NO: 1387254 - RNA, 14 nt, Neisseria meningitidis Z2491
caaaaggccgucug

SEQ ID NO: 1387255 - RNA, 21 nt, Neisseria meningitidis Z2491
caaaagcgcgcguaucaaaaa

SEQ ID NO: 1387256 - RNA, 23 nt, Neisseria meningitidis Z2491
caaaggucucauccuguuauuuu

SEQ ID NO: 1387257 - RNA, 15 nt, Neisseria meningitidis Z2491
caaaggucucuauuu

SEQ ID NO: 1387258 - RNA, 15 nt, Neisseria meningitidis Z2491
caaagucauauuaau

SEQ ID NO: 1387259 - RNA, 23 nt, Neisseria meningitidis Z2491
caaagucauauuaauuauagugg

SEQ ID NO: 1387260 - RNA, 11 nt, Neisseria meningitidis Z2491
caaauaguacg

SEQ ID NO: 1387261 - RNA, 14 nt, Neisseria meningitidis Z2491
caaauaauguucaa

SEQ ID NO: 1387262 - RNA, 14 nt, Neisseria meningitidis Z2491
caaggcggcgagcc

SEQ ID NO: 1387263 - RNA, 17 nt, Neisseria meningitidis Z2491
caaggcggcgagccgca

SEQ ID NO: 1387264 - RNA, 18 nt, Neisseria meningitidis Z2491
caaggcggcgagccgcag

SEQ ID NO: 1387265 - RNA, 17 nt, Neisseria meningitidis Z2491
caaggcgcggcacacgc

SEQ ID NO: 1387266 - RNA, 12 nt, Neisseria meningitidis Z2491
caaggcgacagc

SEQ ID NO: 1387267 - RNA, 12 nt, Neisseria meningitidis Z2491
caaggcgacgaa

SEQ ID NO: 1387268 - RNA, 20 nt, Neisseria meningitidis Z2491
caaggucgaggaaauucugc

SEQ ID NO: 1387269 - RNA, 14 nt, Neisseria meningitidis Z2491
caagcgguaaguga

SEQ ID NO: 1387270 - RNA, 20 nt, Neisseria meningitidis Z2491
caagcgguaagugauuuucc

SEQ ID NO: 1387271 - RNA, 15 nt, Neisseria meningitidis Z2491
caagcguguccugac

SEQ ID NO: 1387272 - RNA, 14 nt, Neisseria meningitidis Z2491
caagcuaaaauccc

SEQ ID NO: 1387273 - RNA, 19 nt, Neisseria meningitidis Z2491
caaggaaugccagcagguu

SEQ ID NO: 1387274 - RNA, 14 nt, Neisseria meningitidis Z2491
caacuuccgcccgg

SEQ ID NO: 1387275 - RNA, 15 nt, Neisseria meningitidis Z2491
caacuucaauagugg

SEQ ID NO: 1387276 - RNA, 23 nt, Neisseria meningitidis Z2491
caacuuaaaaccucgucauuccc

SEQ ID NO: 1387277 - RNA, 23 nt, Neisseria meningitidis Z2491
caacuuauugcggcuuuuucugc

SEQ ID NO: 1387278 - RNA, 14 nt, Neisseria meningitidis Z2491
caagcagcaggcgu

SEQ ID NO: 1387279 - RNA, 15 nt, Neisseria meningitidis Z2491
caagccaguauccuu

SEQ ID NO: 1387280 - RNA, 15 nt, Neisseria meningitidis Z2491
caagccgcauugucc

SEQ ID NO: 1387281 - RNA, 17 nt, Neisseria meningitidis Z2491
caagccgacuucuuuua

SEQ ID NO: 1387282 - RNA, 12 nt, Neisseria meningitidis Z2491
caaguuuauccu

SEQ ID NO: 1387283 - RNA, 13 nt, Neisseria meningitidis Z2491
caaguuugccgcc

SEQ ID NO: 1387284 - RNA, 16 nt, Neisseria meningitidis Z2491
caauaauaaacgccau

SEQ ID NO: 1387285 - RNA, 18 nt, Neisseria meningitidis Z2491
caauaagucugcgaaaca

SEQ ID NO: 1387286 - RNA, 21 nt, Neisseria meningitidis Z2491
caauaaaccgucaaacaaaau

SEQ ID NO: 1387287 - RNA, 15 nt, Neisseria meningitidis Z2491
caauacggucgagga

SEQ ID NO: 1387288 - RNA, 14 nt, Neisseria meningitidis Z2491
caauacaacaaaau

SEQ ID NO: 1387289 - RNA, 17 nt, Neisseria meningitidis Z2491
caauaggauaggcugcu

SEQ ID NO: 1387290 - RNA, 20 nt, Neisseria meningitidis Z2491
caauaggauaggucucuucc

SEQ ID NO: 1387291 - RNA, 13 nt, Neisseria meningitidis Z2491
caauauaaacaag

SEQ ID NO: 1387292 - RNA, 13 nt, Neisseria meningitidis Z2491
caauauccgacca

SEQ ID NO: 1387293 - RNA, 14 nt, Neisseria meningitidis Z2491
caaugcuaaggcaa

SEQ ID NO: 1387294 - RNA, 19 nt, Neisseria meningitidis Z2491
caaugcuaaggcaauuuau

SEQ ID NO: 1387295 - RNA, 13 nt, Neisseria meningitidis Z2491
caaugcuucaacc

SEQ ID NO: 1387296 - RNA, 17 nt, Neisseria meningitidis Z2491
caaugcuucaaccacgc

SEQ ID NO: 1387297 - RNA, 13 nt, Neisseria meningitidis Z2491
caaugccuuuucc

SEQ ID NO: 1387298 - RNA, 14 nt, Neisseria meningitidis Z2491
caaugccuuuuccg

SEQ ID NO: 1387299 - RNA, 15 nt, Neisseria meningitidis Z2491
caaugccgucugaaa

SEQ ID NO: 1387300 - RNA, 21 nt, Neisseria meningitidis Z2491
caaugccgucugaaaaccuuu

SEQ ID NO: 1387301 - RNA, 15 nt, Neisseria meningitidis Z2491
caaugccgucugaag

SEQ ID NO: 1387302 - RNA, 16 nt, Neisseria meningitidis Z2491
caaugccgucugaauc

SEQ ID NO: 1387303 - RNA, 19 nt, Neisseria meningitidis Z2491
caaugcgcccgauguaguc

SEQ ID NO: 1387304 - RNA, 16 nt, Neisseria meningitidis Z2491
caaugcccgcaagcgu

SEQ ID NO: 1387305 - RNA, 15 nt, Neisseria meningitidis Z2491
caaugacugcgggcu

SEQ ID NO: 1387306 - RNA, 14 nt, Neisseria meningitidis Z2491
caaugaaaauuugg

SEQ ID NO: 1387307 - RNA, 13 nt, Neisseria meningitidis Z2491
caaugcaaaaaca

SEQ ID NO: 1387308 - RNA, 14 nt, Neisseria meningitidis Z2491
caaugcaaaaacau

SEQ ID NO: 1387309 - RNA, 19 nt, Neisseria meningitidis Z2491
caaugcaaaaacaucagcc

SEQ ID NO: 1387310 - RNA, 18 nt, Neisseria meningitidis Z2491
caauccacgcaaucaaga

SEQ ID NO: 1387311 - RNA, 20 nt, Neisseria meningitidis Z2491
caauccgcccgaauaaaaaa

SEQ ID NO: 1387312 - RNA, 22 nt, Neisseria meningitidis Z2491
caauccgcccgaauaaaaaaua

SEQ ID NO: 1387313 - RNA, 21 nt, Neisseria meningitidis Z2491
caauccgcccucucauuugcc

SEQ ID NO: 1387314 - RNA, 15 nt, Neisseria meningitidis Z2491
caauccauucccucu

SEQ ID NO: 1387315 - RNA, 17 nt, Neisseria meningitidis Z2491
caauccauucccucucc

SEQ ID NO: 1387316 - RNA, 22 nt, Neisseria meningitidis Z2491
caaucaucaucacaauggcgga

SEQ ID NO: 1387317 - RNA, 17 nt, Neisseria meningitidis Z2491
caauauucaaagauuau

SEQ ID NO: 1387318 - RNA, 11 nt, Neisseria meningitidis Z2491
caauccugccg

SEQ ID NO: 1387319 - RNA, 14 nt, Neisseria meningitidis Z2491
caaucugaaauuuu

SEQ ID NO: 1387320 - RNA, 20 nt, Neisseria meningitidis Z2491
caaucuggucgccguucaaa

SEQ ID NO: 1387321 - RNA, 22 nt, Neisseria meningitidis Z2491
caaucuggucgccguucaaagu

SEQ ID NO: 1387322 - RNA, 22 nt, Neisseria meningitidis Z2491
caaucguuucugucgccagcau

SEQ ID NO: 1387323 - RNA, 17 nt, Neisseria meningitidis Z2491
caaucucauuuucaaaa

SEQ ID NO: 1387324 - RNA, 21 nt, Neisseria meningitidis Z2491
caaucucauuuucaaaaugca

SEQ ID NO: 1387325 - RNA, 23 nt, Neisseria meningitidis Z2491
caaucucaaaucccgucauuccc

SEQ ID NO: 1387326 - RNA, 12 nt, Neisseria meningitidis Z2491
caaaaaacaaca

SEQ ID NO: 1387327 - RNA, 14 nt, Neisseria meningitidis Z2491
caaaaaacaacaau

SEQ ID NO: 1387328 - RNA, 14 nt, Neisseria meningitidis Z2491
caaaaaaacuagau

SEQ ID NO: 1387329 - RNA, 16 nt, Neisseria meningitidis Z2491
caaaaaagccagcagc

SEQ ID NO: 1387330 - RNA, 15 nt, Neisseria meningitidis Z2491
auuuuuuuauuuaaa

SEQ ID NO: 1387331 - RNA, 22 nt, Neisseria meningitidis Z2491
auuuuuuuguugcggaaaucuu

SEQ ID NO: 1387332 - RNA, 17 nt, Neisseria meningitidis Z2491
auuuuuuuucuaaccag

SEQ ID NO: 1387333 - RNA, 13 nt, Neisseria meningitidis Z2491
caaaaaaaaaccu

SEQ ID NO: 1387334 - RNA, 18 nt, Neisseria meningitidis Z2491
auuuuuuggcgcauuuuu

SEQ ID NO: 1387335 - RNA, 13 nt, Neisseria meningitidis Z2491
auuuuuuggcuuu

SEQ ID NO: 1387336 - RNA, 23 nt, Neisseria meningitidis Z2491
auuuuuugaauuucauuuuucau

SEQ ID NO: 1387337 - RNA, 12 nt, Neisseria meningitidis Z2491
auuuuuucugcc

SEQ ID NO: 1387338 - RNA, 15 nt, Neisseria meningitidis Z2491
auuuuuucuaaaugu

SEQ ID NO: 1387339 - RNA, 17 nt, Neisseria meningitidis Z2491
auuuuuucuaaauguuc

SEQ ID NO: 1387340 - RNA, 13 nt, Neisseria meningitidis Z2491
auuuuuuaaucau

SEQ ID NO: 1387341 - RNA, 21 nt, Neisseria meningitidis Z2491
auuuuuuaaucaucguauuuu

SEQ ID NO: 1387342 - RNA, 22 nt, Neisseria meningitidis Z2491
auuuuuguuaauccacuauaaa

SEQ ID NO: 1387343 - RNA, 23 nt, Neisseria meningitidis Z2491
auuuuuguuaauccacuauaaaa

SEQ ID NO: 1387344 - RNA, 18 nt, Neisseria meningitidis Z2491
auuuuuggcgcauuuuua

SEQ ID NO: 1387345 - RNA, 12 nt, Neisseria meningitidis Z2491
auuuuugcaaag

SEQ ID NO: 1387346 - RNA, 20 nt, Neisseria meningitidis Z2491
auuuuugcaaaggucucuau

SEQ ID NO: 1387347 - RNA, 12 nt, Neisseria meningitidis Z2491
auuuuugauuuc

SEQ ID NO: 1387348 - RNA, 15 nt, Neisseria meningitidis Z2491
auuuuuccagcuuga

SEQ ID NO: 1387349 - RNA, 22 nt, Neisseria meningitidis Z2491
auuuuguuuuugagagaaugaa

SEQ ID NO: 1387350 - RNA, 17 nt, Neisseria meningitidis Z2491
auuuuucugaaaaauuu

SEQ ID NO: 1387351 - RNA, 16 nt, Neisseria meningitidis Z2491
caaaaaaucaaaaaca

SEQ ID NO: 1387352 - RNA, 23 nt, Neisseria meningitidis Z2491
caaaaaccggcucaauauauugg

SEQ ID NO: 1387353 - RNA, 13 nt, Neisseria meningitidis Z2491
caaaaagaggcau

SEQ ID NO: 1387354 - RNA, 18 nt, Neisseria meningitidis Z2491
caaaaaaugccgucugaa

SEQ ID NO: 1387355 - RNA, 13 nt, Neisseria meningitidis Z2491
caaaaacaaaaaa

SEQ ID NO: 1387356 - RNA, 14 nt, Neisseria meningitidis Z2491
caaaaacaaaaaaa

SEQ ID NO: 1387357 - RNA, 19 nt, Neisseria meningitidis Z2491
caaaaacagcaaccugaaa

SEQ ID NO: 1387358 - RNA, 15 nt, Neisseria meningitidis Z2491
caaaaacacaaaacu

SEQ ID NO: 1387359 - RNA, 12 nt, Neisseria meningitidis Z2491
caaaaacagaaa

SEQ ID NO: 1387360 - RNA, 13 nt, Neisseria meningitidis Z2491
caaaaacagaaaa

SEQ ID NO: 1387361 - RNA, 14 nt, Neisseria meningitidis Z2491
caaaaacagaaaac

SEQ ID NO: 1387362 - RNA, 14 nt, Neisseria meningitidis Z2491
caaaaacagaaaau

SEQ ID NO: 1387363 - RNA, 21 nt, Neisseria meningitidis Z2491
caaaaacagaaaccuaaaauc

SEQ ID NO: 1387364 - RNA, 21 nt, Neisseria meningitidis Z2491
caaaaacagaaaccuaaaauu

SEQ ID NO: 1387365 - RNA, 20 nt, Neisseria meningitidis Z2491
caaaaacagaaaccugaaaa

SEQ ID NO: 1387366 - RNA, 16 nt, Neisseria meningitidis Z2491
caaaaacagaaauccc

SEQ ID NO: 1387367 - RNA, 19 nt, Neisseria meningitidis Z2491
caaaaacagaauccauaau

SEQ ID NO: 1387368 - RNA, 11 nt, Neisseria meningitidis Z2491
caaaaaauaaa

SEQ ID NO: 1387369 - RNA, 15 nt, Neisseria meningitidis Z2491
caaaaaguccuucac

SEQ ID NO: 1387370 - RNA, 19 nt, Neisseria meningitidis Z2491
caaaaaugccgucugaagg

SEQ ID NO: 1387371 - RNA, 20 nt, Neisseria meningitidis Z2491
caaaaauacgcguaagcgga

SEQ ID NO: 1387372 - RNA, 12 nt, Neisseria meningitidis Z2491
caaaaaucagga

SEQ ID NO: 1387373 - RNA, 21 nt, Neisseria meningitidis Z2491
caaaacaagcgauuauuuuuu

SEQ ID NO: 1387374 - RNA, 12 nt, Neisseria meningitidis Z2491
caaaaauuuauc

SEQ ID NO: 1387375 - RNA, 20 nt, Neisseria meningitidis Z2491
caaaacggcggcagccugaa

SEQ ID NO: 1387376 - RNA, 21 nt, Neisseria meningitidis Z2491
caaaacggcggcagccugaaa

SEQ ID NO: 1387377 - RNA, 15 nt, Neisseria meningitidis Z2491
caaaacucaaucaaa

SEQ ID NO: 1387378 - RNA, 15 nt, Neisseria meningitidis Z2491
caaaagccaaaaaac

SEQ ID NO: 1387379 - RNA, 11 nt, Neisseria meningitidis Z2491
caaaagccagc

SEQ ID NO: 1387380 - RNA, 17 nt, Neisseria meningitidis Z2491
caaaagaccgucugaac

SEQ ID NO: 1387381 - RNA, 15 nt, Neisseria meningitidis Z2491
auuuucacaaaaaca

SEQ ID NO: 1387382 - RNA, 18 nt, Neisseria meningitidis Z2491
auuuucacaaaaacagaa

SEQ ID NO: 1387383 - RNA, 14 nt, Neisseria meningitidis Z2491
auuuuaugcucaau

SEQ ID NO: 1387384 - RNA, 17 nt, Neisseria meningitidis Z2491
auuuuaugcucaaucuc

SEQ ID NO: 1387385 - RNA, 16 nt, Neisseria meningitidis Z2491
auuuuacguucuagau

SEQ ID NO: 1387386 - RNA, 20 nt, Neisseria meningitidis Z2491
auuuuaagcuguugagacgg

SEQ ID NO: 1387387 - RNA, 13 nt, Neisseria meningitidis Z2491
auuuuaaauaaau

SEQ ID NO: 1387388 - RNA, 21 nt, Neisseria meningitidis Z2491
auuuucggcggcguguuugaa

SEQ ID NO: 1387389 - RNA, 18 nt, Neisseria meningitidis Z2491
auuuucgccccaaauacc

SEQ ID NO: 1387390 - RNA, 19 nt, Neisseria meningitidis Z2491
auuuucgccccaaauaccu

SEQ ID NO: 1387391 - RNA, 23 nt, Neisseria meningitidis Z2491
auuuuccgcgccgauguuuuccu

SEQ ID NO: 1387392 - RNA, 16 nt, Neisseria meningitidis Z2491
auuuuguugaauuuua

SEQ ID NO: 1387393 - RNA, 17 nt, Neisseria meningitidis Z2491
auuuuguugaauuuuau

SEQ ID NO: 1387394 - RNA, 11 nt, Neisseria meningitidis Z2491
auuuucuuccg

SEQ ID NO: 1387395 - RNA, 20 nt, Neisseria meningitidis Z2491
auuuugacuuuggaacaaaa

SEQ ID NO: 1387396 - RNA, 10 nt, Neisseria meningitidis Z2491
auuuugauuu

SEQ ID NO: 1387397 - RNA, 20 nt, Neisseria meningitidis Z2491
auuuugcaaaggucucaaau

SEQ ID NO: 1387398 - RNA, 23 nt, Neisseria meningitidis Z2491
auuuugcaagaauggcaaaauuu

SEQ ID NO: 1387399 - RNA, 17 nt, Neisseria meningitidis Z2491
auuugguaaugcaaaaa

SEQ ID NO: 1387400 - RNA, 12 nt, Neisseria meningitidis Z2491
auuugucggcaa

SEQ ID NO: 1387401 - RNA, 16 nt, Neisseria meningitidis Z2491
auuuguucgauauuuu

SEQ ID NO: 1387402 - RNA, 19 nt, Neisseria meningitidis Z2491
auuuguucgauauuuuuga

SEQ ID NO: 1387403 - RNA, 18 nt, Neisseria meningitidis Z2491
auuuggggcgaaaacagc

SEQ ID NO: 1387404 - RNA, 13 nt, Neisseria meningitidis Z2491
auuugcgccgccc

SEQ ID NO: 1387405 - RNA, 12 nt, Neisseria meningitidis Z2491
auuugccgccga

SEQ ID NO: 1387406 - RNA, 21 nt, Neisseria meningitidis Z2491
auuucguuaacagacuauuuu

SEQ ID NO: 1387407 - RNA, 14 nt, Neisseria meningitidis Z2491
auuucuauuuuuua

SEQ ID NO: 1387408 - RNA, 12 nt, Neisseria meningitidis Z2491
auuucuuauguu

SEQ ID NO: 1387409 - RNA, 16 nt, Neisseria meningitidis Z2491
auuucuuauguuuaau

SEQ ID NO: 1387410 - RNA, 15 nt, Neisseria meningitidis Z2491
auuucuucuaucauu

SEQ ID NO: 1387411 - RNA, 16 nt, Neisseria meningitidis Z2491
auuucuugauuuuucu

SEQ ID NO: 1387412 - RNA, 20 nt, Neisseria meningitidis Z2491
auuugaguuuugguauuuuu

SEQ ID NO: 1387413 - RNA, 21 nt, Neisseria meningitidis Z2491
auuucaacugauuguuuuuca

SEQ ID NO: 1387414 - RNA, 14 nt, Neisseria meningitidis Z2491
auuuauuauguaua

SEQ ID NO: 1387415 - RNA, 22 nt, Neisseria meningitidis Z2491
auuuauucuaaauagcugaaac

SEQ ID NO: 1387416 - RNA, 14 nt, Neisseria meningitidis Z2491
auuuauucuguugu

SEQ ID NO: 1387417 - RNA, 18 nt, Neisseria meningitidis Z2491
auuuauucuguuguggaa

SEQ ID NO: 1387418 - RNA, 23 nt, Neisseria meningitidis Z2491
auuuauugaagauggcugaaauu

SEQ ID NO: 1387419 - RNA, 14 nt, Neisseria meningitidis Z2491
auuuauugggaaua

SEQ ID NO: 1387420 - RNA, 20 nt, Neisseria meningitidis Z2491
auuuauugggaauaauggaa

SEQ ID NO: 1387421 - RNA, 18 nt, Neisseria meningitidis Z2491
auuuauuugaacaacaaa

SEQ ID NO: 1387422 - RNA, 14 nt, Neisseria meningitidis Z2491
auuuauuuugaaaa

SEQ ID NO: 1387423 - RNA, 16 nt, Neisseria meningitidis Z2491
auuuauuuugaaaaug

SEQ ID NO: 1387424 - RNA, 13 nt, Neisseria meningitidis Z2491
auuuaauccacua

SEQ ID NO: 1387425 - RNA, 20 nt, Neisseria meningitidis Z2491
auuuaauccacuauaaaaac

SEQ ID NO: 1387426 - RNA, 20 nt, Neisseria meningitidis Z2491
auuuaauccacuauaucggu

SEQ ID NO: 1387427 - RNA, 20 nt, Neisseria meningitidis Z2491
auuuaucgggaaugacugaa

SEQ ID NO: 1387428 - RNA, 21 nt, Neisseria meningitidis Z2491
auuuaucgggaaugacugaaa

SEQ ID NO: 1387429 - RNA, 14 nt, Neisseria meningitidis Z2491
auuuaucggaaaaa

SEQ ID NO: 1387430 - RNA, 17 nt, Neisseria meningitidis Z2491
auuuaucggaaaaaacc

SEQ ID NO: 1387431 - RNA, 15 nt, Neisseria meningitidis Z2491
auuuaucggaaaaac

SEQ ID NO: 1387432 - RNA, 20 nt, Neisseria meningitidis Z2491
auuuaucggaaaagcagaaa

SEQ ID NO: 1387433 - RNA, 19 nt, Neisseria meningitidis Z2491
auuuaucggaaaugacuga

SEQ ID NO: 1387434 - RNA, 20 nt, Neisseria meningitidis Z2491
auuuaucggaaaugacugaa

SEQ ID NO: 1387435 - RNA, 22 nt, Neisseria meningitidis Z2491
auuuaucggaaaugacugaaac

SEQ ID NO: 1387436 - RNA, 17 nt, Neisseria meningitidis Z2491
auuuaucggauaaaaca

SEQ ID NO: 1387437 - RNA, 20 nt, Neisseria meningitidis Z2491
auuuaucggauaaaacagaa

SEQ ID NO: 1387438 - RNA, 23 nt, Neisseria meningitidis Z2491
auuuauccgaaauaacaacaauc

SEQ ID NO: 1387439 - RNA, 23 nt, Neisseria meningitidis Z2491
auuuauccgaaaucacagcaacu

SEQ ID NO: 1387440 - RNA, 21 nt, Neisseria meningitidis Z2491
auuuauccgaagcgacaacaa

SEQ ID NO: 1387441 - RNA, 22 nt, Neisseria meningitidis Z2491
auuuauccgaagcgacaacaau

SEQ ID NO: 1387442 - RNA, 23 nt, Neisseria meningitidis Z2491
auuuauccgaagcgacaacaauc

SEQ ID NO: 1387443 - RNA, 11 nt, Neisseria meningitidis Z2491
auuuauagugg

SEQ ID NO: 1387444 - RNA, 19 nt, Neisseria meningitidis Z2491
auuuauaguggauuaacaa

SEQ ID NO: 1387445 - RNA, 21 nt, Neisseria meningitidis Z2491
auuuauaguggauuaacaaaa

SEQ ID NO: 1387446 - RNA, 23 nt, Neisseria meningitidis Z2491
auuuauaguggauuaacaaaaau

SEQ ID NO: 1387447 - RNA, 16 nt, Neisseria meningitidis Z2491
auuuauaaacaaaaaa

SEQ ID NO: 1387448 - RNA, 15 nt, Neisseria meningitidis Z2491
auuguccauuuuucu

SEQ ID NO: 1387449 - RNA, 17 nt, Neisseria meningitidis Z2491
auugucccugugcgccg

SEQ ID NO: 1387450 - RNA, 14 nt, Neisseria meningitidis Z2491
auuguauauuggca

SEQ ID NO: 1387451 - RNA, 16 nt, Neisseria meningitidis Z2491
auuguuuagcuuuuuc

SEQ ID NO: 1387452 - RNA, 16 nt, Neisseria meningitidis Z2491
auuuaaauaaaauuua

SEQ ID NO: 1387453 - RNA, 12 nt, Neisseria meningitidis Z2491
auuguuucccag

SEQ ID NO: 1387454 - RNA, 22 nt, Neisseria meningitidis Z2491
auuguuucugaagccagcccca

SEQ ID NO: 1387455 - RNA, 19 nt, Neisseria meningitidis Z2491
auugcgaacugccugcaac

SEQ ID NO: 1387456 - RNA, 22 nt, Neisseria meningitidis Z2491
auugccuuuucccugacaaaca

SEQ ID NO: 1387457 - RNA, 13 nt, Neisseria meningitidis Z2491
auugccuguucuu

SEQ ID NO: 1387458 - RNA, 11 nt, Neisseria meningitidis Z2491
auugccuucau

SEQ ID NO: 1387459 - RNA, 18 nt, Neisseria meningitidis Z2491
auuggauuuggcuuaaaa

SEQ ID NO: 1387460 - RNA, 14 nt, Neisseria meningitidis Z2491
auuggggcaaagcg

SEQ ID NO: 1387461 - RNA, 14 nt, Neisseria meningitidis Z2491
auugcuuauuuguu

SEQ ID NO: 1387462 - RNA, 15 nt, Neisseria meningitidis Z2491
auugccguuuuccuu

SEQ ID NO: 1387463 - RNA, 12 nt, Neisseria meningitidis Z2491
auugagcaaaaa

SEQ ID NO: 1387464 - RNA, 17 nt, Neisseria meningitidis Z2491
auugacguaguuuacug

SEQ ID NO: 1387465 - RNA, 20 nt, Neisseria meningitidis Z2491
auugacuauuuuuuaaucau

SEQ ID NO: 1387466 - RNA, 21 nt, Neisseria meningitidis Z2491
auugacgcguguucggacuuu

SEQ ID NO: 1387467 - RNA, 23 nt, Neisseria meningitidis Z2491
auugacggacggcggcagauaaa

SEQ ID NO: 1387468 - RNA, 18 nt, Neisseria meningitidis Z2491
auugaagcgucccaaaua

SEQ ID NO: 1387469 - RNA, 17 nt, Neisseria meningitidis Z2491
auucucuaaggugcuga

SEQ ID NO: 1387470 - RNA, 15 nt, Neisseria meningitidis Z2491
auucuauuggauaua

SEQ ID NO: 1387471 - RNA, 14 nt, Neisseria meningitidis Z2491
augccgucugaaag

SEQ ID NO: 1387472 - RNA, 22 nt, Neisseria meningitidis Z2491
augccgucugaaagccuuucag

SEQ ID NO: 1387473 - RNA, 18 nt, Neisseria meningitidis Z2491
augccgucugaaaggcuu

SEQ ID NO: 1387474 - RNA, 23 nt, Neisseria meningitidis Z2491
augccgucugaaaggcuucagac

SEQ ID NO: 1387475 - RNA, 23 nt, Neisseria meningitidis Z2491
augccgucugaaaggcuuuuuca

SEQ ID NO: 1387476 - RNA, 15 nt, Neisseria meningitidis Z2491
augccgucugaaaug

SEQ ID NO: 1387477 - RNA, 20 nt, Neisseria meningitidis Z2491
augccgucugaaauguucgu

SEQ ID NO: 1387478 - RNA, 20 nt, Neisseria meningitidis Z2491
augccgucugaacacagggu

SEQ ID NO: 1387479 - RNA, 14 nt, Neisseria meningitidis Z2491
augccgucugaaga

SEQ ID NO: 1387480 - RNA, 20 nt, Neisseria meningitidis Z2491
augccgucugaaggcuucag

SEQ ID NO: 1387481 - RNA, 21 nt, Neisseria meningitidis Z2491
augccgucugaaggcuucaga

SEQ ID NO: 1387482 - RNA, 22 nt, Neisseria meningitidis Z2491
augccgucugaaacgcauucag

SEQ ID NO: 1387483 - RNA, 18 nt, Neisseria meningitidis Z2491
augccgucugaaacuucg

SEQ ID NO: 1387484 - RNA, 20 nt, Neisseria meningitidis Z2491
augccguccgaacagcucag

SEQ ID NO: 1387485 - RNA, 22 nt, Neisseria meningitidis Z2491
augccguccgaaccgcaaaugc

SEQ ID NO: 1387486 - RNA, 15 nt, Neisseria meningitidis Z2491
augccgcgccgccgg

SEQ ID NO: 1387487 - RNA, 13 nt, Neisseria meningitidis Z2491
augccuauuuuuu

SEQ ID NO: 1387488 - RNA, 14 nt, Neisseria meningitidis Z2491
augccuauuuuuua

SEQ ID NO: 1387489 - RNA, 19 nt, Neisseria meningitidis Z2491
augccuauuuuuuaaucau

SEQ ID NO: 1387490 - RNA, 21 nt, Neisseria meningitidis Z2491
augccugcuucggcggagagg

SEQ ID NO: 1387491 - RNA, 19 nt, Neisseria meningitidis Z2491
augcccuucauccggcagg

SEQ ID NO: 1387492 - RNA, 18 nt, Neisseria meningitidis Z2491
augccgaacagcuuggua

SEQ ID NO: 1387493 - RNA, 14 nt, Neisseria meningitidis Z2491
augccgaacaggcg

SEQ ID NO: 1387494 - RNA, 14 nt, Neisseria meningitidis Z2491
augccgagcaaaau

SEQ ID NO: 1387495 - RNA, 16 nt, Neisseria meningitidis Z2491
augccgaggguuuggg

SEQ ID NO: 1387496 - RNA, 16 nt, Neisseria meningitidis Z2491
augccgcaauuucaaa

SEQ ID NO: 1387497 - RNA, 18 nt, Neisseria meningitidis Z2491
augccgcaccuaaaggga

SEQ ID NO: 1387498 - RNA, 18 nt, Neisseria meningitidis Z2491
augcccgaaccgucauuc

SEQ ID NO: 1387499 - RNA, 16 nt, Neisseria meningitidis Z2491
augcccgcaaucugaa

SEQ ID NO: 1387500 - RNA, 22 nt, Neisseria meningitidis Z2491
augccaccgugcgcugucaaac

SEQ ID NO: 1387501 - RNA, 21 nt, Neisseria meningitidis Z2491
augcaguugaguuugaugaaa

SEQ ID NO: 1387502 - RNA, 16 nt, Neisseria meningitidis Z2491
augauuuggguuucag

SEQ ID NO: 1387503 - RNA, 17 nt, Neisseria meningitidis Z2491
augauguguuucaacac

SEQ ID NO: 1387504 - RNA, 17 nt, Neisseria meningitidis Z2491
augaugggcugaaauag

SEQ ID NO: 1387505 - RNA, 20 nt, Neisseria meningitidis Z2491
augaugacggucaggaagau

SEQ ID NO: 1387506 - RNA, 12 nt, Neisseria meningitidis Z2491
augaguuuuuug

SEQ ID NO: 1387507 - RNA, 17 nt, Neisseria meningitidis Z2491
augacauuaagauguuu

SEQ ID NO: 1387508 - RNA, 23 nt, Neisseria meningitidis Z2491
augacauuaagauguuuuuccac

SEQ ID NO: 1387509 - RNA, 23 nt, Neisseria meningitidis Z2491
augaauuugacuugcggauugcc

SEQ ID NO: 1387510 - RNA, 19 nt, Neisseria meningitidis Z2491
augacgaauccauccgcac

SEQ ID NO: 1387511 - RNA, 15 nt, Neisseria meningitidis Z2491
augacgaauuucagg

SEQ ID NO: 1387512 - RNA, 22 nt, Neisseria meningitidis Z2491
augacgaaggaaguaacgggcg

SEQ ID NO: 1387513 - RNA, 13 nt, Neisseria meningitidis Z2491
augaagaggauga

SEQ ID NO: 1387514 - RNA, 16 nt, Neisseria meningitidis Z2491
augaaacucaauauaa

SEQ ID NO: 1387515 - RNA, 13 nt, Neisseria meningitidis Z2491
aucuuguuuuuca

SEQ ID NO: 1387516 - RNA, 16 nt, Neisseria meningitidis Z2491
aucuuucagacggcau

SEQ ID NO: 1387517 - RNA, 14 nt, Neisseria meningitidis Z2491
aucgcgcugaaugu

SEQ ID NO: 1387518 - RNA, 13 nt, Neisseria meningitidis Z2491
aucgccucauaca

SEQ ID NO: 1387519 - RNA, 19 nt, Neisseria meningitidis Z2491
aucgcgcacuugagccgca

SEQ ID NO: 1387520 - RNA, 23 nt, Neisseria meningitidis Z2491
aucagcuucauaccccacugcca

SEQ ID NO: 1387521 - RNA, 19 nt, Neisseria meningitidis Z2491
aucagcuauauauaguuga

SEQ ID NO: 1387522 - RNA, 22 nt, Neisseria meningitidis Z2491
aucguggcgguguccggcugaa

SEQ ID NO: 1387523 - RNA, 15 nt, Neisseria meningitidis Z2491
aucguguaggcaguu

SEQ ID NO: 1387524 - RNA, 16 nt, Neisseria meningitidis Z2491
aucguccaaccuuccc

SEQ ID NO: 1387525 - RNA, 15 nt, Neisseria meningitidis Z2491
aucggcaacuuugac

SEQ ID NO: 1387526 - RNA, 14 nt, Neisseria meningitidis Z2491
aucggcaaacccuu

SEQ ID NO: 1387527 - RNA, 15 nt, Neisseria meningitidis Z2491
aucggauaaaacaga

SEQ ID NO: 1387528 - RNA, 15 nt, Neisseria meningitidis Z2491
aucgcguaaggcaua

SEQ ID NO: 1387529 - RNA, 15 nt, Neisseria meningitidis Z2491
aucggagugauuauc

SEQ ID NO: 1387530 - RNA, 16 nt, Neisseria meningitidis Z2491
aucggagugauuauca

SEQ ID NO: 1387531 - RNA, 11 nt, Neisseria meningitidis Z2491
aucggcuucag

SEQ ID NO: 1387532 - RNA, 12 nt, Neisseria meningitidis Z2491
aucggcuucaga

SEQ ID NO: 1387533 - RNA, 20 nt, Neisseria meningitidis Z2491
aucugccccguuuuacccuc

SEQ ID NO: 1387534 - RNA, 20 nt, Neisseria meningitidis Z2491
aucugccgcaauucguuuuc

SEQ ID NO: 1387535 - RNA, 21 nt, Neisseria meningitidis Z2491
aucugacgcguuuuaccugcc

SEQ ID NO: 1387536 - RNA, 22 nt, Neisseria meningitidis Z2491
aucugacaggaaauuuccaaau

SEQ ID NO: 1387537 - RNA, 20 nt, Neisseria meningitidis Z2491
aucugagaccuuugcaaaaa

SEQ ID NO: 1387538 - RNA, 13 nt, Neisseria meningitidis Z2491
aucugacuugcca

SEQ ID NO: 1387539 - RNA, 13 nt, Neisseria meningitidis Z2491
aucucuuaaccau

SEQ ID NO: 1387540 - RNA, 13 nt, Neisseria meningitidis Z2491
aucucguuaucca

SEQ ID NO: 1387541 - RNA, 22 nt, Neisseria meningitidis Z2491
aucucguuauuuccacaaaaaa

SEQ ID NO: 1387542 - RNA, 11 nt, Neisseria meningitidis Z2491
aucuagacauu

SEQ ID NO: 1387543 - RNA, 18 nt, Neisseria meningitidis Z2491
aucuagacauucaaugcu

SEQ ID NO: 1387544 - RNA, 12 nt, Neisseria meningitidis Z2491
aucuagaaauga

SEQ ID NO: 1387545 - RNA, 14 nt, Neisseria meningitidis Z2491
aucuagaaauuuaa

SEQ ID NO: 1387546 - RNA, 11 nt, Neisseria meningitidis Z2491
aucuauagugg

SEQ ID NO: 1387547 - RNA, 23 nt, Neisseria meningitidis Z2491
aucuauaguggauuaacaaaaac

SEQ ID NO: 1387548 - RNA, 23 nt, Neisseria meningitidis Z2491
aucucaacugacgguacacgucg

SEQ ID NO: 1387549 - RNA, 19 nt, Neisseria meningitidis Z2491
aucucauuuucaaaaugca

SEQ ID NO: 1387550 - RNA, 21 nt, Neisseria meningitidis Z2491
aucucauuuucaaaaugcaaa

SEQ ID NO: 1387551 - RNA, 15 nt, Neisseria meningitidis Z2491
augugguagagaaaa

SEQ ID NO: 1387552 - RNA, 23 nt, Neisseria meningitidis Z2491
augucuucauacgacucaaaauc

SEQ ID NO: 1387553 - RNA, 19 nt, Neisseria meningitidis Z2491
augucgaguucuuuuaaag

SEQ ID NO: 1387554 - RNA, 18 nt, Neisseria meningitidis Z2491
auguccgaaugccgcaaa

SEQ ID NO: 1387555 - RNA, 15 nt, Neisseria meningitidis Z2491
auguccguuuucuuc

SEQ ID NO: 1387556 - RNA, 15 nt, Neisseria meningitidis Z2491
auguauuagaaauga

SEQ ID NO: 1387557 - RNA, 16 nt, Neisseria meningitidis Z2491
auguauuagaaaugac

SEQ ID NO: 1387558 - RNA, 21 nt, Neisseria meningitidis Z2491
auguauauaauccggagcaga

SEQ ID NO: 1387559 - RNA, 16 nt, Neisseria meningitidis Z2491
augccuuuuucaaacg

SEQ ID NO: 1387560 - RNA, 20 nt, Neisseria meningitidis Z2491
auggcgggaaauaaaacaaa

SEQ ID NO: 1387561 - RNA, 22 nt, Neisseria meningitidis Z2491
augggaauccgggauuuuaaag

SEQ ID NO: 1387562 - RNA, 14 nt, Neisseria meningitidis Z2491
auggggaggcgcgg

SEQ ID NO: 1387563 - RNA, 16 nt, Neisseria meningitidis Z2491
augggcuucaucaguu

SEQ ID NO: 1387564 - RNA, 22 nt, Neisseria meningitidis Z2491
augguuaagagauuggcauuua

SEQ ID NO: 1387565 - RNA, 18 nt, Neisseria meningitidis Z2491
auuaaggggguauuuggg

SEQ ID NO: 1387566 - RNA, 17 nt, Neisseria meningitidis Z2491
auuaagguuaauuaaaa

SEQ ID NO: 1387567 - RNA, 21 nt, Neisseria meningitidis Z2491
auuaagguuaauuaaaauacg

SEQ ID NO: 1387568 - RNA, 23 nt, Neisseria meningitidis Z2491
auuaauauacuuggcaaaaucug

SEQ ID NO: 1387569 - RNA, 14 nt, Neisseria meningitidis Z2491
auuaagaaaaacag

SEQ ID NO: 1387570 - RNA, 18 nt, Neisseria meningitidis Z2491
auuaagaaaaacagcaau

SEQ ID NO: 1387571 - RNA, 20 nt, Neisseria meningitidis Z2491
auuaacaaaaaucaggacaa

SEQ ID NO: 1387572 - RNA, 19 nt, Neisseria meningitidis Z2491
auuaaauuuccagauuccc

SEQ ID NO: 1387573 - RNA, 19 nt, Neisseria meningitidis Z2491
auuaaauuuuauuuaaaua

SEQ ID NO: 1387574 - RNA, 15 nt, Neisseria meningitidis Z2491
auuaaauuuaaacca

SEQ ID NO: 1387575 - RNA, 15 nt, Neisseria meningitidis Z2491
auuaaauuuaaauca

SEQ ID NO: 1387576 - RNA, 19 nt, Neisseria meningitidis Z2491
auuaaaaaccggauuuauu

SEQ ID NO: 1387577 - RNA, 12 nt, Neisseria meningitidis Z2491
auuaaaaacaaa

SEQ ID NO: 1387578 - RNA, 14 nt, Neisseria meningitidis Z2491
auuaaaacaaaaau

SEQ ID NO: 1387579 - RNA, 12 nt, Neisseria meningitidis Z2491
auuaaaauaaaa

SEQ ID NO: 1387580 - RNA, 15 nt, Neisseria meningitidis Z2491
auuaaaauaaaaaua

SEQ ID NO: 1387581 - RNA, 20 nt, Neisseria meningitidis Z2491
auuaaagugccauuuaaaau

SEQ ID NO: 1387582 - RNA, 12 nt, Neisseria meningitidis Z2491
auuaaaauuugg

SEQ ID NO: 1387583 - RNA, 19 nt, Neisseria meningitidis Z2491
auguugcccgucaacacaa

SEQ ID NO: 1387584 - RNA, 14 nt, Neisseria meningitidis Z2491
auguugcggcacua

SEQ ID NO: 1387585 - RNA, 12 nt, Neisseria meningitidis Z2491
auguucaaugaa

SEQ ID NO: 1387586 - RNA, 15 nt, Neisseria meningitidis Z2491
auguucagacggcau

SEQ ID NO: 1387587 - RNA, 19 nt, Neisseria meningitidis Z2491
auguucagacggcauuuuc

SEQ ID NO: 1387588 - RNA, 19 nt, Neisseria meningitidis Z2491
auguuugcugcuguauuuu

SEQ ID NO: 1387589 - RNA, 17 nt, Neisseria meningitidis Z2491
auuaggaagguuuuagg

SEQ ID NO: 1387590 - RNA, 16 nt, Neisseria meningitidis Z2491
auuauaagguaaguuu

SEQ ID NO: 1387591 - RNA, 13 nt, Neisseria meningitidis Z2491
auuagaaaugacu

SEQ ID NO: 1387592 - RNA, 17 nt, Neisseria meningitidis Z2491
auuagaaaugacugaaa

SEQ ID NO: 1387593 - RNA, 20 nt, Neisseria meningitidis Z2491
auuagaguuucaaaauuuau

SEQ ID NO: 1387594 - RNA, 21 nt, Neisseria meningitidis Z2491
auuaccgguauuuuuuucuua

SEQ ID NO: 1387595 - RNA, 15 nt, Neisseria meningitidis Z2491
auuaccgccaccuuu

SEQ ID NO: 1387596 - RNA, 18 nt, Neisseria meningitidis Z2491
auuacccaacgccucuuc

SEQ ID NO: 1387597 - RNA, 17 nt, Neisseria meningitidis Z2491
auuacgggacgacaugc

SEQ ID NO: 1387598 - RNA, 22 nt, Neisseria meningitidis Z2491
auuaauuauaguggauuaacaa

SEQ ID NO: 1387599 - RNA, 21 nt, Neisseria meningitidis Z2491
auucaaucggugucuuuccgc

SEQ ID NO: 1387600 - RNA, 15 nt, Neisseria meningitidis Z2491
auucaaagauuaucu

SEQ ID NO: 1387601 - RNA, 14 nt, Neisseria meningitidis Z2491
auucaaacgguuuu

SEQ ID NO: 1387602 - RNA, 22 nt, Neisseria meningitidis Z2491
auucaaacgguuuuuucugcca

SEQ ID NO: 1387603 - RNA, 17 nt, Neisseria meningitidis Z2491
auuauuuuuuagaggcu

SEQ ID NO: 1387604 - RNA, 20 nt, Neisseria meningitidis Z2491
auucaaaaaccugcuuguuu

SEQ ID NO: 1387605 - RNA, 15 nt, Neisseria meningitidis Z2491
auuauuuauuuugaa

SEQ ID NO: 1387606 - RNA, 16 nt, Neisseria meningitidis Z2491
auuauuuucacaaaaa

SEQ ID NO: 1387607 - RNA, 21 nt, Neisseria meningitidis Z2491
auuauuuucacaaaaacagaa

SEQ ID NO: 1387608 - RNA, 21 nt, Neisseria meningitidis Z2491
auucacuaaauugcauuuuua

SEQ ID NO: 1387609 - RNA, 18 nt, Neisseria meningitidis Z2491
auucacuauacugcugaa

SEQ ID NO: 1387610 - RNA, 18 nt, Neisseria meningitidis Z2491
auucacuuggugcuucag

SEQ ID NO: 1387611 - RNA, 16 nt, Neisseria meningitidis Z2491
auucaauugacaaaaa

SEQ ID NO: 1387612 - RNA, 14 nt, Neisseria meningitidis Z2491
auucaaugcuaagg

SEQ ID NO: 1387613 - RNA, 14 nt, Neisseria meningitidis Z2491
auucaauuuaaaca

SEQ ID NO: 1387614 - RNA, 19 nt, Neisseria meningitidis Z2491
auucaauuuaaacacuucu

SEQ ID NO: 1387615 - RNA, 15 nt, Neisseria meningitidis Z2491
auuauugccagcauu

SEQ ID NO: 1387616 - RNA, 23 nt, Neisseria meningitidis Z2491
auuauugccagcauuaauauacu

SEQ ID NO: 1387617 - RNA, 16 nt, Neisseria meningitidis Z2491
auuaucugacaggaaa

SEQ ID NO: 1387618 - RNA, 22 nt, Neisseria meningitidis Z2491
auuaucugacaggaaauuucca

SEQ ID NO: 1387619 - RNA, 18 nt, Neisseria meningitidis Z2491
auuauauuuguccaugau

SEQ ID NO: 1387620 - RNA, 16 nt, Neisseria meningitidis Z2491
auuaucaucgauguuu

SEQ ID NO: 1387621 - RNA, 20 nt, Neisseria meningitidis Z2491
auuaucaguauuuucuauuu

SEQ ID NO: 1387622 - RNA, 22 nt, Neisseria meningitidis Z2491
auaguggauuaacaaaaaucag

SEQ ID NO: 1387623 - RNA, 20 nt, Neisseria meningitidis Z2491
auaguggauuaauaaaaauc

SEQ ID NO: 1387624 - RNA, 19 nt, Neisseria meningitidis Z2491
auaguggauuaacaaaaac

SEQ ID NO: 1387625 - RNA, 23 nt, Neisseria meningitidis Z2491
auaguggauuaacaaaaaccagu

SEQ ID NO: 1387626 - RNA, 21 nt, Neisseria meningitidis Z2491
auaguggauuaaauuuaaauc

SEQ ID NO: 1387627 - RNA, 14 nt, Neisseria meningitidis Z2491
auaguggauuaaca

SEQ ID NO: 1387628 - RNA, 13 nt, Neisseria meningitidis Z2491
auaguauagugga

SEQ ID NO: 1387629 - RNA, 17 nt, Neisseria meningitidis Z2491
auagugccgucaaauua

SEQ ID NO: 1387630 - RNA, 22 nt, Neisseria meningitidis Z2491
auaguuuguaaaaucucuugcc

SEQ ID NO: 1387631 - RNA, 21 nt, Neisseria meningitidis Z2491
auauaacaccuuucaaucaau

SEQ ID NO: 1387632 - RNA, 23 nt, Neisseria meningitidis Z2491
auauaaaaaaugccguccgaaca

SEQ ID NO: 1387633 - RNA, 15 nt, Neisseria meningitidis Z2491
auauacaaaaugccg

SEQ ID NO: 1387634 - RNA, 15 nt, Neisseria meningitidis Z2491
auaggauuugccauc

SEQ ID NO: 1387635 - RNA, 13 nt, Neisseria meningitidis Z2491
auaggacaaaugc

SEQ ID NO: 1387636 - RNA, 15 nt, Neisseria meningitidis Z2491
auaggacaaaugccg

SEQ ID NO: 1387637 - RNA, 16 nt, Neisseria meningitidis Z2491
auaggguuaauaucag

SEQ ID NO: 1387638 - RNA, 20 nt, Neisseria meningitidis Z2491
auagguugaccagaaucacu

SEQ ID NO: 1387639 - RNA, 22 nt, Neisseria meningitidis Z2491
auaguacggaaccgauucacuu

SEQ ID NO: 1387640 - RNA, 13 nt, Neisseria meningitidis Z2491
auaucuauacuaa

SEQ ID NO: 1387641 - RNA, 15 nt, Neisseria meningitidis Z2491
auaucuauacuaaaa

SEQ ID NO: 1387642 - RNA, 12 nt, Neisseria meningitidis Z2491
auauauucugau

SEQ ID NO: 1387643 - RNA, 22 nt, Neisseria meningitidis Z2491
auaucaacgcgggaauagcuca

SEQ ID NO: 1387644 - RNA, 20 nt, Neisseria meningitidis Z2491
auagcugaacugcuugaauu

SEQ ID NO: 1387645 - RNA, 18 nt, Neisseria meningitidis Z2491
auagcgcggacggcggca

SEQ ID NO: 1387646 - RNA, 16 nt, Neisseria meningitidis Z2491
auagacuguaccaaau

SEQ ID NO: 1387647 - RNA, 19 nt, Neisseria meningitidis Z2491
auacuuuguuucaaaaugu

SEQ ID NO: 1387648 - RNA, 16 nt, Neisseria meningitidis Z2491
auaccuccuaauucua

SEQ ID NO: 1387649 - RNA, 22 nt, Neisseria meningitidis Z2491
auacgggcggcucucaaaauau

SEQ ID NO: 1387650 - RNA, 20 nt, Neisseria meningitidis Z2491
auacggugucuucaauuccu

SEQ ID NO: 1387651 - RNA, 14 nt, Neisseria meningitidis Z2491
auacgcaaaacaaa

SEQ ID NO: 1387652 - RNA, 21 nt, Neisseria meningitidis Z2491
auacgaugccgucugaacaca

SEQ ID NO: 1387653 - RNA, 23 nt, Neisseria meningitidis Z2491
auacgcaaacuaacuuauacaca

SEQ ID NO: 1387654 - RNA, 19 nt, Neisseria meningitidis Z2491
auacugccuguaaaaccaa

SEQ ID NO: 1387655 - RNA, 22 nt, Neisseria meningitidis Z2491
auacuguccggcaugauuuucu

SEQ ID NO: 1387656 - RNA, 13 nt, Neisseria meningitidis Z2491
auacugcugaagu

SEQ ID NO: 1387657 - RNA, 17 nt, Neisseria meningitidis Z2491
auacuguaaucagggau

SEQ ID NO: 1387658 - RNA, 14 nt, Neisseria meningitidis Z2491
aucaauuaaaaaca

SEQ ID NO: 1387659 - RNA, 15 nt, Neisseria meningitidis Z2491
aucaauuaaaaacaa

SEQ ID NO: 1387660 - RNA, 18 nt, Neisseria meningitidis Z2491
aucaauuaaaaacaaaau

SEQ ID NO: 1387661 - RNA, 15 nt, Neisseria meningitidis Z2491
aucaaugugccucuu

SEQ ID NO: 1387662 - RNA, 19 nt, Neisseria meningitidis Z2491
aucaacgcgggaauagcuc

SEQ ID NO: 1387663 - RNA, 17 nt, Neisseria meningitidis Z2491
aucaaaccauauggaaa

SEQ ID NO: 1387664 - RNA, 16 nt, Neisseria meningitidis Z2491
aucaaacaagaaauga

SEQ ID NO: 1387665 - RNA, 18 nt, Neisseria meningitidis Z2491
auauugccguuuuccuuu

SEQ ID NO: 1387666 - RNA, 12 nt, Neisseria meningitidis Z2491
auauugcggcuu

SEQ ID NO: 1387667 - RNA, 17 nt, Neisseria meningitidis Z2491
auauuguuauucccccg

SEQ ID NO: 1387668 - RNA, 16 nt, Neisseria meningitidis Z2491
auauuguuauuuuuau

SEQ ID NO: 1387669 - RNA, 14 nt, Neisseria meningitidis Z2491
aucaaaaaauaaag

SEQ ID NO: 1387670 - RNA, 14 nt, Neisseria meningitidis Z2491
aucaaaaacagaaa

SEQ ID NO: 1387671 - RNA, 16 nt, Neisseria meningitidis Z2491
aucaaaaaacaacaau

SEQ ID NO: 1387672 - RNA, 13 nt, Neisseria meningitidis Z2491
aucaaaaaauaaa

SEQ ID NO: 1387673 - RNA, 15 nt, Neisseria meningitidis Z2491
auauucaaagauuau

SEQ ID NO: 1387674 - RNA, 16 nt, Neisseria meningitidis Z2491
auauucaaagauuauc

SEQ ID NO: 1387675 - RNA, 13 nt, Neisseria meningitidis Z2491
auauucaaagguu

SEQ ID NO: 1387676 - RNA, 18 nt, Neisseria meningitidis Z2491
auauucaauugacaaaaa

SEQ ID NO: 1387677 - RNA, 20 nt, Neisseria meningitidis Z2491
auauucaauugacaaaaacu

SEQ ID NO: 1387678 - RNA, 23 nt, Neisseria meningitidis Z2491
auauucacuaaauugcauuuuua

SEQ ID NO: 1387679 - RNA, 15 nt, Neisseria meningitidis Z2491
auauucugauuuaaa

SEQ ID NO: 1387680 - RNA, 14 nt, Neisseria meningitidis Z2491
auauucugauuuau

SEQ ID NO: 1387681 - RNA, 17 nt, Neisseria meningitidis Z2491
auauucgaccagcuccc

SEQ ID NO: 1387682 - RNA, 13 nt, Neisseria meningitidis Z2491
auauucagguaaa

SEQ ID NO: 1387683 - RNA, 14 nt, Neisseria meningitidis Z2491
auauucagguaaaa

SEQ ID NO: 1387684 - RNA, 22 nt, Neisseria meningitidis Z2491
auauucgcguaaccguuuaauu

SEQ ID NO: 1387685 - RNA, 20 nt, Neisseria meningitidis Z2491
aucagauugauaaaagcaca

SEQ ID NO: 1387686 - RNA, 21 nt, Neisseria meningitidis Z2491
aucagauuuuggagcaguaaa

SEQ ID NO: 1387687 - RNA, 13 nt, Neisseria meningitidis Z2491
aucagaucggcaa

SEQ ID NO: 1387688 - RNA, 17 nt, Neisseria meningitidis Z2491
aucagaucggcaaaccc

SEQ ID NO: 1387689 - RNA, 21 nt, Neisseria meningitidis Z2491
aucagaccgaauuuaaucaag

SEQ ID NO: 1387690 - RNA, 17 nt, Neisseria meningitidis Z2491
aucagaauacugccugu

SEQ ID NO: 1387691 - RNA, 11 nt, Neisseria meningitidis Z2491
aucagaaauga

SEQ ID NO: 1387692 - RNA, 13 nt, Neisseria meningitidis Z2491
aucagaaaugacg

SEQ ID NO: 1387693 - RNA, 14 nt, Neisseria meningitidis Z2491
aucagaaaugacug

SEQ ID NO: 1387694 - RNA, 15 nt, Neisseria meningitidis Z2491
aucagaaaugacuga

SEQ ID NO: 1387695 - RNA, 17 nt, Neisseria meningitidis Z2491
aucagaaaugacugaaa

SEQ ID NO: 1387696 - RNA, 17 nt, Neisseria meningitidis Z2491
aucacuuggucuuugcc

SEQ ID NO: 1387697 - RNA, 18 nt, Neisseria meningitidis Z2491
aucagccaaaccgcagca

SEQ ID NO: 1387698 - RNA, 21 nt, Neisseria meningitidis Z2491
aucagcauagggacgaaaauc

SEQ ID NO: 1387699 - RNA, 18 nt, Neisseria meningitidis Z2491
aucagcaguucguucugc

SEQ ID NO: 1387700 - RNA, 19 nt, Neisseria meningitidis Z2491
aucacguucugaaaaauau

SEQ ID NO: 1387701 - RNA, 20 nt, Neisseria meningitidis Z2491
aucacuauaccaaacggcau

SEQ ID NO: 1387702 - RNA, 15 nt, Neisseria meningitidis Z2491
aucacuccgucuuuc

SEQ ID NO: 1387703 - RNA, 22 nt, Neisseria meningitidis Z2491
aucacgcgguagggcaguucca

SEQ ID NO: 1387704 - RNA, 22 nt, Neisseria meningitidis Z2491
aguuucuguauuuguauagugg

SEQ ID NO: 1387705 - RNA, 17 nt, Neisseria meningitidis Z2491
aguuucccgaaauucca

SEQ ID NO: 1387706 - RNA, 13 nt, Neisseria meningitidis Z2491
aguuuuuugacuu

SEQ ID NO: 1387707 - RNA, 15 nt, Neisseria meningitidis Z2491
aguuuuuugccuucg

SEQ ID NO: 1387708 - RNA, 19 nt, Neisseria meningitidis Z2491
aguuuguuguucaaauaaa

SEQ ID NO: 1387709 - RNA, 14 nt, Neisseria meningitidis Z2491
aguugauuaaaaca

SEQ ID NO: 1387710 - RNA, 22 nt, Neisseria meningitidis Z2491
aguuguuugguaaucaguuuuu

SEQ ID NO: 1387711 - RNA, 19 nt, Neisseria meningitidis Z2491
aguuacucgaaacuuaaaa

SEQ ID NO: 1387712 - RNA, 15 nt, Neisseria meningitidis Z2491
aguucgguuucaacg

SEQ ID NO: 1387713 - RNA, 18 nt, Neisseria meningitidis Z2491
aguuccuccacuaaaaaa

SEQ ID NO: 1387714 - RNA, 15 nt, Neisseria meningitidis Z2491
aguuaggguaauuua

SEQ ID NO: 1387715 - RNA, 14 nt, Neisseria meningitidis Z2491
agugggaauccaga

SEQ ID NO: 1387716 - RNA, 19 nt, Neisseria meningitidis Z2491
agugucaaggaagcaaaag

SEQ ID NO: 1387717 - RNA, 13 nt, Neisseria meningitidis Z2491
agugcgaugacga

SEQ ID NO: 1387718 - RNA, 22 nt, Neisseria meningitidis Z2491
agugcgugcaguucguugcuuu

SEQ ID NO: 1387719 - RNA, 19 nt, Neisseria meningitidis Z2491
agugcguacgcaggcuggg

SEQ ID NO: 1387720 - RNA, 22 nt, Neisseria meningitidis Z2491
aguggauuaaauuuaaaccagu

SEQ ID NO: 1387721 - RNA, 16 nt, Neisseria meningitidis Z2491
aguggauuaacaaaaa

SEQ ID NO: 1387722 - RNA, 20 nt, Neisseria meningitidis Z2491
aguggauuaacaaaaaccag

SEQ ID NO: 1387723 - RNA, 17 nt, Neisseria meningitidis Z2491
aguggauuaacaaaaau

SEQ ID NO: 1387724 - RNA, 21 nt, Neisseria meningitidis Z2491
aguggauuaacaaaaaucagg

SEQ ID NO: 1387725 - RNA, 16 nt, Neisseria meningitidis Z2491
aguggauuaauaaaaa

SEQ ID NO: 1387726 - RNA, 17 nt, Neisseria meningitidis Z2491
aguggauuaauaaaaau

SEQ ID NO: 1387727 - RNA, 12 nt, Neisseria meningitidis Z2491
aguccguucagu

SEQ ID NO: 1387728 - RNA, 14 nt, Neisseria meningitidis Z2491
aguaccguuuuuuu

SEQ ID NO: 1387729 - RNA, 23 nt, Neisseria meningitidis Z2491
aguccggcauaaauccuucacca

SEQ ID NO: 1387730 - RNA, 11 nt, Neisseria meningitidis Z2491
agucugauucu

SEQ ID NO: 1387731 - RNA, 13 nt, Neisseria meningitidis Z2491
agucugauucuac

SEQ ID NO: 1387732 - RNA, 18 nt, Neisseria meningitidis Z2491
agucugauucuaccgccc

SEQ ID NO: 1387733 - RNA, 13 nt, Neisseria meningitidis Z2491
agucuucggcuuu

SEQ ID NO: 1387734 - RNA, 23 nt, Neisseria meningitidis Z2491
agucugucgccgucggcuuccac

SEQ ID NO: 1387735 - RNA, 19 nt, Neisseria meningitidis Z2491
agugaauuaaauuuaaacc

SEQ ID NO: 1387736 - RNA, 23 nt, Neisseria meningitidis Z2491
auaacuagggaaauucaaauuaa

SEQ ID NO: 1387737 - RNA, 12 nt, Neisseria meningitidis Z2491
auaacagcaacc

SEQ ID NO: 1387738 - RNA, 16 nt, Neisseria meningitidis Z2491
auaaauuugaauagca

SEQ ID NO: 1387739 - RNA, 14 nt, Neisseria meningitidis Z2491
auaaauuuuugccg

SEQ ID NO: 1387740 - RNA, 20 nt, Neisseria meningitidis Z2491
auaaacucauugagcuauuu

SEQ ID NO: 1387741 - RNA, 19 nt, Neisseria meningitidis Z2491
auaaagauacaagaacuuu

SEQ ID NO: 1387742 - RNA, 15 nt, Neisseria meningitidis Z2491
auaaacaagauuucc

SEQ ID NO: 1387743 - RNA, 15 nt, Neisseria meningitidis Z2491
auaaaauuuuaguaa

SEQ ID NO: 1387744 - RNA, 13 nt, Neisseria meningitidis Z2491
auaaacaaaaaac

SEQ ID NO: 1387745 - RNA, 15 nt, Neisseria meningitidis Z2491
auaaaauuuggcugu

SEQ ID NO: 1387746 - RNA, 16 nt, Neisseria meningitidis Z2491
auaaagccuaaauaca

SEQ ID NO: 1387747 - RNA, 13 nt, Neisseria meningitidis Z2491
auaagguaaguuu

SEQ ID NO: 1387748 - RNA, 20 nt, Neisseria meningitidis Z2491
auaaguuucccgaaauucca

SEQ ID NO: 1387749 - RNA, 19 nt, Neisseria meningitidis Z2491
auaagucugcgaaacagac

SEQ ID NO: 1387750 - RNA, 15 nt, Neisseria meningitidis Z2491
auaaugcccauuccc

SEQ ID NO: 1387751 - RNA, 20 nt, Neisseria meningitidis Z2491
auaauggccuuuucccuugc

SEQ ID NO: 1387752 - RNA, 17 nt, Neisseria meningitidis Z2491
auaaucaauuaaaaaca

SEQ ID NO: 1387753 - RNA, 15 nt, Neisseria meningitidis Z2491
auaaucaguuugcuu

SEQ ID NO: 1387754 - RNA, 16 nt, Neisseria meningitidis Z2491
auaaucaguuugcuuu

SEQ ID NO: 1387755 - RNA, 20 nt, Neisseria meningitidis Z2491
auaaucagcccgaaauaacu

SEQ ID NO: 1387756 - RNA, 20 nt, Neisseria meningitidis Z2491
auaaucuuccuucugaaaua

SEQ ID NO: 1387757 - RNA, 14 nt, Neisseria meningitidis Z2491
auaauaauccuuca

SEQ ID NO: 1387758 - RNA, 21 nt, Neisseria meningitidis Z2491
aggcaacgcuguacugguuua

SEQ ID NO: 1387759 - RNA, 22 nt, Neisseria meningitidis Z2491
aggcaacgccguaccgguuuuu

SEQ ID NO: 1387760 - RNA, 19 nt, Neisseria meningitidis Z2491
aggcaacgccguacugguu

SEQ ID NO: 1387761 - RNA, 20 nt, Neisseria meningitidis Z2491
aggcaacgccguacugguuu

SEQ ID NO: 1387762 - RNA, 23 nt, Neisseria meningitidis Z2491
aggcaacgccguacugguuuuug

SEQ ID NO: 1387763 - RNA, 17 nt, Neisseria meningitidis Z2491
aggcaagcagcucggca

SEQ ID NO: 1387764 - RNA, 21 nt, Neisseria meningitidis Z2491
aggcaagcagcucggcaauuu

SEQ ID NO: 1387765 - RNA, 15 nt, Neisseria meningitidis Z2491
aggcaaauuucaguc

SEQ ID NO: 1387766 - RNA, 14 nt, Neisseria meningitidis Z2491
aggcaaggcaacau

SEQ ID NO: 1387767 - RNA, 15 nt, Neisseria meningitidis Z2491
aggcaaguuccaaga

SEQ ID NO: 1387768 - RNA, 19 nt, Neisseria meningitidis Z2491
aggcaagcguucacgccag

SEQ ID NO: 1387769 - RNA, 18 nt, Neisseria meningitidis Z2491
aggcaauaauaaacgcca

SEQ ID NO: 1387770 - RNA, 17 nt, Neisseria meningitidis Z2491
aggcacgaagcccucag

SEQ ID NO: 1387771 - RNA, 22 nt, Neisseria meningitidis Z2491
aggcacgaagcccucagcuaug

SEQ ID NO: 1387772 - RNA, 16 nt, Neisseria meningitidis Z2491
aggcacgaaucuuauc

SEQ ID NO: 1387773 - RNA, 16 nt, Neisseria meningitidis Z2491
aggcaaaaaaagaugc

SEQ ID NO: 1387774 - RNA, 14 nt, Neisseria meningitidis Z2491
aggaugucugccug

SEQ ID NO: 1387775 - RNA, 16 nt, Neisseria meningitidis Z2491
aggaugggguuucaga

SEQ ID NO: 1387776 - RNA, 17 nt, Neisseria meningitidis Z2491
aggaugggguuucagau

SEQ ID NO: 1387777 - RNA, 19 nt, Neisseria meningitidis Z2491
aggcauugaaauucuagau

SEQ ID NO: 1387778 - RNA, 23 nt, Neisseria meningitidis Z2491
aggcaggguaaugacccacgcca

SEQ ID NO: 1387779 - RNA, 19 nt, Neisseria meningitidis Z2491
aggcagccuaaaacaucaa

SEQ ID NO: 1387780 - RNA, 22 nt, Neisseria meningitidis Z2491
aggcaguuuuuuuauaguggau

SEQ ID NO: 1387781 - RNA, 15 nt, Neisseria meningitidis Z2491
aggcauacggggagg

SEQ ID NO: 1387782 - RNA, 20 nt, Neisseria meningitidis Z2491
aggcauacggggaggaaagu

SEQ ID NO: 1387783 - RNA, 12 nt, Neisseria meningitidis Z2491
aggccaguuugu

SEQ ID NO: 1387784 - RNA, 11 nt, Neisseria meningitidis Z2491
aggaaugcaaa

SEQ ID NO: 1387785 - RNA, 15 nt, Neisseria meningitidis Z2491
aggacaaagcguuca

SEQ ID NO: 1387786 - RNA, 20 nt, Neisseria meningitidis Z2491
aggacaaaguuggcaaggaa

SEQ ID NO: 1387787 - RNA, 18 nt, Neisseria meningitidis Z2491
aggacaaggcgacgaagc

SEQ ID NO: 1387788 - RNA, 21 nt, Neisseria meningitidis Z2491
aggaaauuuccaaauauaaaa

SEQ ID NO: 1387789 - RNA, 23 nt, Neisseria meningitidis Z2491
aggagugaauguucgccaacaau

SEQ ID NO: 1387790 - RNA, 15 nt, Neisseria meningitidis Z2491
aggagguauuugggg

SEQ ID NO: 1387791 - RNA, 17 nt, Neisseria meningitidis Z2491
aggauagagaacgauuc

SEQ ID NO: 1387792 - RNA, 14 nt, Neisseria meningitidis Z2491
aggagcaacagaaa

SEQ ID NO: 1387793 - RNA, 14 nt, Neisseria meningitidis Z2491
aggacggcuuugcc

SEQ ID NO: 1387794 - RNA, 18 nt, Neisseria meningitidis Z2491
agcuuuagagauucugga

SEQ ID NO: 1387795 - RNA, 24 nt, Neisseria meningitidis Z2491
agcuucauaccccacugccagccg

SEQ ID NO: 1387796 - RNA, 17 nt, Neisseria meningitidis Z2491
agcugugguuugccgag

SEQ ID NO: 1387797 - RNA, 12 nt, Neisseria meningitidis Z2491
agcugaaaacag

SEQ ID NO: 1387798 - RNA, 13 nt, Neisseria meningitidis Z2491
agcugaaaacagc

SEQ ID NO: 1387799 - RNA, 22 nt, Neisseria meningitidis Z2491
agcucucccucuuuaaauuuaa

SEQ ID NO: 1387800 - RNA, 17 nt, Neisseria meningitidis Z2491
agcucaguugguagagc

SEQ ID NO: 1387801 - RNA, 21 nt, Neisseria meningitidis Z2491
agcggaauacggcaacaucau

SEQ ID NO: 1387802 - RNA, 13 nt, Neisseria meningitidis Z2491
agcgggaaucuag

SEQ ID NO: 1387803 - RNA, 19 nt, Neisseria meningitidis Z2491
agcggcguuugaacagccu

SEQ ID NO: 1387804 - RNA, 22 nt, Neisseria meningitidis Z2491
agcgugcggacguucaaacccu

SEQ ID NO: 1387805 - RNA, 14 nt, Neisseria meningitidis Z2491
agcguggauuuuuu

SEQ ID NO: 1387806 - RNA, 17 nt, Neisseria meningitidis Z2491
agcuauccgcacagaaa

SEQ ID NO: 1387807 - RNA, 20 nt, Neisseria meningitidis Z2491
agcuaucuggccuuugucug

SEQ ID NO: 1387808 - RNA, 22 nt, Neisseria meningitidis Z2491
agcucaaagagaacaauucucu

SEQ ID NO: 1387809 - RNA, 22 nt, Neisseria meningitidis Z2491
agcguucagacggcauuuuuga

SEQ ID NO: 1387810 - RNA, 19 nt, Neisseria meningitidis Z2491
agcguuacuuugcguucac

SEQ ID NO: 1387811 - RNA, 18 nt, Neisseria meningitidis Z2491
agcuaaggcgaggcaacg

SEQ ID NO: 1387812 - RNA, 22 nt, Neisseria meningitidis Z2491
agcuaaggcgaggcaacgcugu

SEQ ID NO: 1387813 - RNA, 14 nt, Neisseria meningitidis Z2491
agggaaagcagcag

SEQ ID NO: 1387814 - RNA, 16 nt, Neisseria meningitidis Z2491
agggaaagcagcagcc

SEQ ID NO: 1387815 - RNA, 19 nt, Neisseria meningitidis Z2491
aggcuuuuucagacggcau

SEQ ID NO: 1387816 - RNA, 15 nt, Neisseria meningitidis Z2491
aggcuuuuuucuguu

SEQ ID NO: 1387817 - RNA, 22 nt, Neisseria meningitidis Z2491
aggcuuuuuucuguuuggcuuu

SEQ ID NO: 1387818 - RNA, 19 nt, Neisseria meningitidis Z2491
agggauaauucauacaaau

SEQ ID NO: 1387819 - RNA, 12 nt, Neisseria meningitidis Z2491
aggcuuucagac

SEQ ID NO: 1387820 - RNA, 16 nt, Neisseria meningitidis Z2491
aggcuucagacggcau

SEQ ID NO: 1387821 - RNA, 20 nt, Neisseria meningitidis Z2491
aggcuguggagcaugaguuc

SEQ ID NO: 1387822 - RNA, 22 nt, Neisseria meningitidis Z2491
aggcuuacucguucggcagccu

SEQ ID NO: 1387823 - RNA, 14 nt, Neisseria meningitidis Z2491
aggcuuauuucacu

SEQ ID NO: 1387824 - RNA, 19 nt, Neisseria meningitidis Z2491
aggcugccgcacaagcccu

SEQ ID NO: 1387825 - RNA, 20 nt, Neisseria meningitidis Z2491
aggcugccgcacaagcccua

SEQ ID NO: 1387826 - RNA, 18 nt, Neisseria meningitidis Z2491
aggcuggaaaacagcugu

SEQ ID NO: 1387827 - RNA, 22 nt, Neisseria meningitidis Z2491
aggcuguaugccgucugaaacc

SEQ ID NO: 1387828 - RNA, 17 nt, Neisseria meningitidis Z2491
aggcuggggauguuuug

SEQ ID NO: 1387829 - RNA, 23 nt, Neisseria meningitidis Z2491
aggguaauuuauccgaaauaaca

SEQ ID NO: 1387830 - RNA, 14 nt, Neisseria meningitidis Z2491
agggguaaauccuc

SEQ ID NO: 1387831 - RNA, 13 nt, Neisseria meningitidis Z2491
agggcgcaccgcg

SEQ ID NO: 1387832 - RNA, 17 nt, Neisseria meningitidis Z2491
agggcacagucggcaua

SEQ ID NO: 1387833 - RNA, 18 nt, Neisseria meningitidis Z2491
agggcaaguuugccgccu

SEQ ID NO: 1387834 - RNA, 17 nt, Neisseria meningitidis Z2491
aggcgaggcaacaccgu

SEQ ID NO: 1387835 - RNA, 14 nt, Neisseria meningitidis Z2491
aggcgagccaacgc

SEQ ID NO: 1387836 - RNA, 20 nt, Neisseria meningitidis Z2491
aggcggaaucgaaccgccga

SEQ ID NO: 1387837 - RNA, 23 nt, Neisseria meningitidis Z2491
aggcggauuugaaguuucuccac

SEQ ID NO: 1387838 - RNA, 20 nt, Neisseria meningitidis Z2491
aggcguaggucagcccggcg

SEQ ID NO: 1387839 - RNA, 16 nt, Neisseria meningitidis Z2491
aggcggcguucuucuu

SEQ ID NO: 1387840 - RNA, 15 nt, Neisseria meningitidis Z2491
aggcgggaauacaaa

SEQ ID NO: 1387841 - RNA, 13 nt, Neisseria meningitidis Z2491
aggcgggcaggca

SEQ ID NO: 1387842 - RNA, 16 nt, Neisseria meningitidis Z2491
aggcguugggaaaggu

SEQ ID NO: 1387843 - RNA, 14 nt, Neisseria meningitidis Z2491
aggcguguuugccg

SEQ ID NO: 1387844 - RNA, 17 nt, Neisseria meningitidis Z2491
aggcguguuugccgcga

SEQ ID NO: 1387845 - RNA, 20 nt, Neisseria meningitidis Z2491
aggcucuuggauucggauuu

SEQ ID NO: 1387846 - RNA, 13 nt, Neisseria meningitidis Z2491
aguaauaaauuaa

SEQ ID NO: 1387847 - RNA, 16 nt, Neisseria meningitidis Z2491
aguaacuucaaacccc

SEQ ID NO: 1387848 - RNA, 19 nt, Neisseria meningitidis Z2491
aguacagccccuuaaaguu

SEQ ID NO: 1387849 - RNA, 20 nt, Neisseria meningitidis Z2491
aguacagccccuuaaaguuu

SEQ ID NO: 1387850 - RNA, 17 nt, Neisseria meningitidis Z2491
aguaauauucaaagguu

SEQ ID NO: 1387851 - RNA, 19 nt, Neisseria meningitidis Z2491
agguugaccagaaucacuu

SEQ ID NO: 1387852 - RNA, 22 nt, Neisseria meningitidis Z2491
agguugcgucugccuucuucuu

SEQ ID NO: 1387853 - RNA, 13 nt, Neisseria meningitidis Z2491
agguucagucauu

SEQ ID NO: 1387854 - RNA, 14 nt, Neisseria meningitidis Z2491
agguucagucauuu

SEQ ID NO: 1387855 - RNA, 18 nt, Neisseria meningitidis Z2491
agguucaaacacaucgcc

SEQ ID NO: 1387856 - RNA, 14 nt, Neisseria meningitidis Z2491
agguuacuaaaauu

SEQ ID NO: 1387857 - RNA, 13 nt, Neisseria meningitidis Z2491
agguuuugcugcc

SEQ ID NO: 1387858 - RNA, 18 nt, Neisseria meningitidis Z2491
agguuuuguuuuuccaaa

SEQ ID NO: 1387859 - RNA, 21 nt, Neisseria meningitidis Z2491
agguuuucgucuauuuucgcc

SEQ ID NO: 1387860 - RNA, 22 nt, Neisseria meningitidis Z2491
agguugguuugaaagagaaaag

SEQ ID NO: 1387861 - RNA, 16 nt, Neisseria meningitidis Z2491
agguugucugaaaacu

SEQ ID NO: 1387862 - RNA, 19 nt, Neisseria meningitidis Z2491
aguaaaaacaauuuuaugg

SEQ ID NO: 1387863 - RNA, 22 nt, Neisseria meningitidis Z2491
aggguucggacggcauuaaaau

SEQ ID NO: 1387864 - RNA, 17 nt, Neisseria meningitidis Z2491
aggguuccgaaaucauc

SEQ ID NO: 1387865 - RNA, 23 nt, Neisseria meningitidis Z2491
aggguuccgaaaucauccacagc

SEQ ID NO: 1387866 - RNA, 14 nt, Neisseria meningitidis Z2491
agguaaaaaauaga

SEQ ID NO: 1387867 - RNA, 17 nt, Neisseria meningitidis Z2491
agguaaaaaauagaaau

SEQ ID NO: 1387868 - RNA, 18 nt, Neisseria meningitidis Z2491
agguaaaaaauagaaaua

SEQ ID NO: 1387869 - RNA, 14 nt, Neisseria meningitidis Z2491
agguaaggagcagg

SEQ ID NO: 1387870 - RNA, 14 nt, Neisseria meningitidis Z2491
agguaacgguuuuu

SEQ ID NO: 1387871 - RNA, 13 nt, Neisseria meningitidis Z2491
agggugguuucug

SEQ ID NO: 1387872 - RNA, 22 nt, Neisseria meningitidis Z2491
agguauuuggggcgaaaacagc

SEQ ID NO: 1387873 - RNA, 16 nt, Neisseria meningitidis Z2491
agguaaucguuuuuuc

SEQ ID NO: 1387874 - RNA, 20 nt, Neisseria meningitidis Z2491
agguagcggcugagggcuuc

SEQ ID NO: 1387875 - RNA, 19 nt, Neisseria meningitidis Z2491
aggucgucugaaaagaugc

SEQ ID NO: 1387876 - RNA, 17 nt, Neisseria meningitidis Z2491
aggucuuuucuaaaaua

SEQ ID NO: 1387877 - RNA, 18 nt, Neisseria meningitidis Z2491
aggucuuuucuaaaauau

SEQ ID NO: 1387878 - RNA, 17 nt, Neisseria meningitidis Z2491
aggucuucagcuugagc

SEQ ID NO: 1387879 - RNA, 12 nt, Neisseria meningitidis Z2491
aggucucagacu

SEQ ID NO: 1387880 - RNA, 13 nt, Neisseria meningitidis Z2491
aggugcagauguu

SEQ ID NO: 1387881 - RNA, 15 nt, Neisseria meningitidis Z2491
agguguaacugcaag

SEQ ID NO: 1387882 - RNA, 16 nt, Neisseria meningitidis Z2491
acggucagaaaauuuc

SEQ ID NO: 1387883 - RNA, 22 nt, Neisseria meningitidis Z2491
acggucaacccguaugccgccu

SEQ ID NO: 1387884 - RNA, 11 nt, Neisseria meningitidis Z2491
acguaaaaaac

SEQ ID NO: 1387885 - RNA, 16 nt, Neisseria meningitidis Z2491
acgguucguccagcag

SEQ ID NO: 1387886 - RNA, 17 nt, Neisseria meningitidis Z2491
acgguguugccucgccu

SEQ ID NO: 1387887 - RNA, 16 nt, Neisseria meningitidis Z2491
acgguauaaaccaaaa

SEQ ID NO: 1387888 - RNA, 22 nt, Neisseria meningitidis Z2491
acgguaucgccguuuugcagug

SEQ ID NO: 1387889 - RNA, 15 nt, Neisseria meningitidis Z2491
acgguacaggaaagu

SEQ ID NO: 1387890 - RNA, 14 nt, Neisseria meningitidis Z2491
acggcggcagccug

SEQ ID NO: 1387891 - RNA, 15 nt, Neisseria meningitidis Z2491
acggcggcaacagaa

SEQ ID NO: 1387892 - RNA, 17 nt, Neisseria meningitidis Z2491
acggcggcaggguuuua

SEQ ID NO: 1387893 - RNA, 13 nt, Neisseria meningitidis Z2491
acggcggaaaggu

SEQ ID NO: 1387894 - RNA, 22 nt, Neisseria meningitidis Z2491
acgggguugccugcaaugcacu

SEQ ID NO: 1387895 - RNA, 13 nt, Neisseria meningitidis Z2491
acggacggcggca

SEQ ID NO: 1387896 - RNA, 16 nt, Neisseria meningitidis Z2491
acggaaacucaaaaaa

SEQ ID NO: 1387897 - RNA, 17 nt, Neisseria meningitidis Z2491
acggaaaguggaacaga

SEQ ID NO: 1387898 - RNA, 15 nt, Neisseria meningitidis Z2491
acgcuguaccgguuu

SEQ ID NO: 1387899 - RNA, 23 nt, Neisseria meningitidis Z2491
acgcuguuuuuuguugccugauu

SEQ ID NO: 1387900 - RNA, 21 nt, Neisseria meningitidis Z2491
acggcauuuuuacaaggcagc

SEQ ID NO: 1387901 - RNA, 18 nt, Neisseria meningitidis Z2491
acggcauuuuuauugcuu

SEQ ID NO: 1387902 - RNA, 21 nt, Neisseria meningitidis Z2491
acggcauuuuuauugcuucau

SEQ ID NO: 1387903 - RNA, 13 nt, Neisseria meningitidis Z2491
acggcauuuuuga

SEQ ID NO: 1387904 - RNA, 13 nt, Neisseria meningitidis Z2491
acggcauuuuugc

SEQ ID NO: 1387905 - RNA, 18 nt, Neisseria meningitidis Z2491
acggcauuucggcaguuu

SEQ ID NO: 1387906 - RNA, 23 nt, Neisseria meningitidis Z2491
acggcauuucggcaguuuucaac

SEQ ID NO: 1387907 - RNA, 18 nt, Neisseria meningitidis Z2491
acggcauuucuuauguuu

SEQ ID NO: 1387908 - RNA, 14 nt, Neisseria meningitidis Z2491
acggcauuugaccc

SEQ ID NO: 1387909 - RNA, 14 nt, Neisseria meningitidis Z2491
acggcauuuucaac

SEQ ID NO: 1387910 - RNA, 16 nt, Neisseria meningitidis Z2491
acggcauuuugauugc

SEQ ID NO: 1387911 - RNA, 22 nt, Neisseria meningitidis Z2491
acggcauuuugccgacaggcuc

SEQ ID NO: 1387912 - RNA, 15 nt, Neisseria meningitidis Z2491
acggcaauauucaaa

SEQ ID NO: 1387913 - RNA, 15 nt, Neisseria meningitidis Z2491
acggcaacaaaaugc

SEQ ID NO: 1387914 - RNA, 13 nt, Neisseria meningitidis Z2491
acggcaacaucau

SEQ ID NO: 1387915 - RNA, 17 nt, Neisseria meningitidis Z2491
acggcaacaucauagaa

SEQ ID NO: 1387916 - RNA, 15 nt, Neisseria meningitidis Z2491
acggcaaccggccgg

SEQ ID NO: 1387917 - RNA, 16 nt, Neisseria meningitidis Z2491
acggauuguuuggaaa

SEQ ID NO: 1387918 - RNA, 23 nt, Neisseria meningitidis Z2491
acggaugucgaguucuuuuaaag

SEQ ID NO: 1387919 - RNA, 18 nt, Neisseria meningitidis Z2491
acggccggcgcagcuccu

SEQ ID NO: 1387920 - RNA, 15 nt, Neisseria meningitidis Z2491
acucaaagcugcaag

SEQ ID NO: 1387921 - RNA, 14 nt, Neisseria meningitidis Z2491
acucaaaaaaccgg

SEQ ID NO: 1387922 - RNA, 19 nt, Neisseria meningitidis Z2491
acuauuaccgguauuuuuu

SEQ ID NO: 1387923 - RNA, 18 nt, Neisseria meningitidis Z2491
acuacgcggcugaaaaaa

SEQ ID NO: 1387924 - RNA, 19 nt, Neisseria meningitidis Z2491
acuacgcggcugaaaaaau

SEQ ID NO: 1387925 - RNA, 20 nt, Neisseria meningitidis Z2491
acguucaaacccuccgccuc

SEQ ID NO: 1387926 - RNA, 11 nt, Neisseria meningitidis Z2491
acguuuuccaa

SEQ ID NO: 1387927 - RNA, 16 nt, Neisseria meningitidis Z2491
acguuuuuccaaaccu

SEQ ID NO: 1387928 - RNA, 17 nt, Neisseria meningitidis Z2491
acuaaaaaauccaaaaa

SEQ ID NO: 1387929 - RNA, 19 nt, Neisseria meningitidis Z2491
acuaaaaccggucggaaga

SEQ ID NO: 1387930 - RNA, 14 nt, Neisseria meningitidis Z2491
acgucguacagaua

SEQ ID NO: 1387931 - RNA, 21 nt, Neisseria meningitidis Z2491
acgucggcagucuguaccgca

SEQ ID NO: 1387932 - RNA, 19 nt, Neisseria meningitidis Z2491
acgucggcgcggacgauuu

SEQ ID NO: 1387933 - RNA, 14 nt, Neisseria meningitidis Z2491
acguacaaaugccg

SEQ ID NO: 1387934 - RNA, 16 nt, Neisseria meningitidis Z2491
acuucaauagugggaa

SEQ ID NO: 1387935 - RNA, 13 nt, Neisseria meningitidis Z2491
acuuauacacacg

SEQ ID NO: 1387936 - RNA, 21 nt, Neisseria meningitidis Z2491
acuuaaaauuccguuauuccc

SEQ ID NO: 1387937 - RNA, 14 nt, Neisseria meningitidis Z2491
acugucugcagcuu

SEQ ID NO: 1387938 - RNA, 14 nt, Neisseria meningitidis Z2491
acugucugcggcuc

SEQ ID NO: 1387939 - RNA, 19 nt, Neisseria meningitidis Z2491
acugugucgccgacuuugc

SEQ ID NO: 1387940 - RNA, 16 nt, Neisseria meningitidis Z2491
acugguuuuuguuaau

SEQ ID NO: 1387941 - RNA, 16 nt, Neisseria meningitidis Z2491
acugguuuaaauuuaa

SEQ ID NO: 1387942 - RNA, 22 nt, Neisseria meningitidis Z2491
acuguaaagauaaaucuauguu

SEQ ID NO: 1387943 - RNA, 14 nt, Neisseria meningitidis Z2491
acugcuguuugaca

SEQ ID NO: 1387944 - RNA, 23 nt, Neisseria meningitidis Z2491
acugcuuccguguguauagugga

SEQ ID NO: 1387945 - RNA, 22 nt, Neisseria meningitidis Z2491
acugcucgccacauaauucaaa

SEQ ID NO: 1387946 - RNA, 22 nt, Neisseria meningitidis Z2491
acugcucgaucggcugccaauc

SEQ ID NO: 1387947 - RNA, 17 nt, Neisseria meningitidis Z2491
acugcgguucggacggc

SEQ ID NO: 1387948 - RNA, 14 nt, Neisseria meningitidis Z2491
acuggauucccacu

SEQ ID NO: 1387949 - RNA, 17 nt, Neisseria meningitidis Z2491
acugccagucuuuaaau

SEQ ID NO: 1387950 - RNA, 15 nt, Neisseria meningitidis Z2491
acugccagccgccga

SEQ ID NO: 1387951 - RNA, 19 nt, Neisseria meningitidis Z2491
acugccgcaaacggcaggc

SEQ ID NO: 1387952 - RNA, 18 nt, Neisseria meningitidis Z2491
acugccucuuuucagaca

SEQ ID NO: 1387953 - RNA, 17 nt, Neisseria meningitidis Z2491
acugagaccuuugcaau

SEQ ID NO: 1387954 - RNA, 15 nt, Neisseria meningitidis Z2491
acugaaauaucguca

SEQ ID NO: 1387955 - RNA, 19 nt, Neisseria meningitidis Z2491
acugaaauaucgucauucc

SEQ ID NO: 1387956 - RNA, 19 nt, Neisseria meningitidis Z2491
acugaaaaauacgaugccg

SEQ ID NO: 1387957 - RNA, 23 nt, Neisseria meningitidis Z2491
acugcaagaacagcagcagaguu

SEQ ID NO: 1387958 - RNA, 18 nt, Neisseria meningitidis Z2491
acugauuuacgucggcac

SEQ ID NO: 1387959 - RNA, 18 nt, Neisseria meningitidis Z2491
acucggcaaacgcuucgc

SEQ ID NO: 1387960 - RNA, 20 nt, Neisseria meningitidis Z2491
acucuaaucgcgucauuccc

SEQ ID NO: 1387961 - RNA, 21 nt, Neisseria meningitidis Z2491
acucugcggacuuaagaaaca

SEQ ID NO: 1387962 - RNA, 23 nt, Neisseria meningitidis Z2491
acucugcggacuuaagaaacaaa

SEQ ID NO: 1387963 - RNA, 15 nt, Neisseria meningitidis Z2491
acuccuguuuuuaac

SEQ ID NO: 1387964 - RNA, 20 nt, Neisseria meningitidis Z2491
agauuccacguucuagauuc

SEQ ID NO: 1387965 - RNA, 15 nt, Neisseria meningitidis Z2491
agauucccgcuuucg

SEQ ID NO: 1387966 - RNA, 18 nt, Neisseria meningitidis Z2491
agauuaucugaaaguuug

SEQ ID NO: 1387967 - RNA, 19 nt, Neisseria meningitidis Z2491
agauugagcauaaaauuuu

SEQ ID NO: 1387968 - RNA, 23 nt, Neisseria meningitidis Z2491
agauuggauuuggcuuaaaaauc

SEQ ID NO: 1387969 - RNA, 11 nt, Neisseria meningitidis Z2491
agauucuagau

SEQ ID NO: 1387970 - RNA, 19 nt, Neisseria meningitidis Z2491
agauucuugucaaaccaac

SEQ ID NO: 1387971 - RNA, 17 nt, Neisseria meningitidis Z2491
agauucuggauucccac

SEQ ID NO: 1387972 - RNA, 20 nt, Neisseria meningitidis Z2491
agauggucaauacacaaggu

SEQ ID NO: 1387973 - RNA, 18 nt, Neisseria meningitidis Z2491
agauguuuuuccacaaaa

SEQ ID NO: 1387974 - RNA, 22 nt, Neisseria meningitidis Z2491
agauggggaugaugggauuuag

SEQ ID NO: 1387975 - RNA, 19 nt, Neisseria meningitidis Z2491
agaugggaauccgggauuu

SEQ ID NO: 1387976 - RNA, 19 nt, Neisseria meningitidis Z2491
agaugcguauuaaaccaaa

SEQ ID NO: 1387977 - RNA, 17 nt, Neisseria meningitidis Z2491
agaucgaccgcuuccuc

SEQ ID NO: 1387978 - RNA, 15 nt, Neisseria meningitidis Z2491
agaugccgucugaaa

SEQ ID NO: 1387979 - RNA, 15 nt, Neisseria meningitidis Z2491
agaugccugcuucgg

SEQ ID NO: 1387980 - RNA, 13 nt, Neisseria meningitidis Z2491
agauauagauuuc

SEQ ID NO: 1387981 - RNA, 15 nt, Neisseria meningitidis Z2491
agauauagauuuccc

SEQ ID NO: 1387982 - RNA, 14 nt, Neisseria meningitidis Z2491
agauauaacuuuaa

SEQ ID NO: 1387983 - RNA, 17 nt, Neisseria meningitidis Z2491
agauagucgccgagcag

SEQ ID NO: 1387984 - RNA, 14 nt, Neisseria meningitidis Z2491
agauauggaaaugc

SEQ ID NO: 1387985 - RNA, 20 nt, Neisseria meningitidis Z2491
agauacaagaacuuuauccc

SEQ ID NO: 1387986 - RNA, 15 nt, Neisseria meningitidis Z2491
agaguugcgggaaug

SEQ ID NO: 1387987 - RNA, 19 nt, Neisseria meningitidis Z2491
agauagaccgcgacuggca

SEQ ID NO: 1387988 - RNA, 13 nt, Neisseria meningitidis Z2491
agagcgcaaccuu

SEQ ID NO: 1387989 - RNA, 15 nt, Neisseria meningitidis Z2491
agaaaccucaaaucc

SEQ ID NO: 1387990 - RNA, 20 nt, Neisseria meningitidis Z2491
agaaacccgaaacagcaacu

SEQ ID NO: 1387991 - RNA, 13 nt, Neisseria meningitidis Z2491
agaaacccaaaau

SEQ ID NO: 1387992 - RNA, 21 nt, Neisseria meningitidis Z2491
agaaaauuucuugauuuuucu

SEQ ID NO: 1387993 - RNA, 17 nt, Neisseria meningitidis Z2491
agaaaccuaaaauucgu

SEQ ID NO: 1387994 - RNA, 19 nt, Neisseria meningitidis Z2491
agaaaccugaaaacagaaa

SEQ ID NO: 1387995 - RNA, 17 nt, Neisseria meningitidis Z2491
agaaagggaauccuuuc

SEQ ID NO: 1387996 - RNA, 20 nt, Neisseria meningitidis Z2491
agaaagcauacggcugauuu

SEQ ID NO: 1387997 - RNA, 15 nt, Neisseria meningitidis Z2491
agaaagccaaaaaca

SEQ ID NO: 1387998 - RNA, 17 nt, Neisseria meningitidis Z2491
agaaagcagaaauaagg

SEQ ID NO: 1387999 - RNA, 18 nt, Neisseria meningitidis Z2491
acuuuucugauuuuuccu

SEQ ID NO: 1388000 - RNA, 14 nt, Neisseria meningitidis Z2491
acuucgccauuccc

SEQ ID NO: 1388001 - RNA, 20 nt, Neisseria meningitidis Z2491
acuuuugagccgucauuccc

SEQ ID NO: 1388002 - RNA, 22 nt, Neisseria meningitidis Z2491
acuuccugauugaccgaaaaau

SEQ ID NO: 1388003 - RNA, 22 nt, Neisseria meningitidis Z2491
agaaaaaggguuugacagcgca

SEQ ID NO: 1388004 - RNA, 21 nt, Neisseria meningitidis Z2491
acuuuuuucgauaugaaaaga

SEQ ID NO: 1388005 - RNA, 15 nt, Neisseria meningitidis Z2491
agaacgguuucuguu

SEQ ID NO: 1388006 - RNA, 17 nt, Neisseria meningitidis Z2491
agaaccgaacacagaca

SEQ ID NO: 1388007 - RNA, 18 nt, Neisseria meningitidis Z2491
agaaauuuauaaacaaaa

SEQ ID NO: 1388008 - RNA, 15 nt, Neisseria meningitidis Z2491
agaacaauucucuaa

SEQ ID NO: 1388009 - RNA, 21 nt, Neisseria meningitidis Z2491
agaacccaaaccgucauuccc

SEQ ID NO: 1388010 - RNA, 13 nt, Neisseria meningitidis Z2491
agaacagaaaacc

SEQ ID NO: 1388011 - RNA, 19 nt, Neisseria meningitidis Z2491
agaauuuauacccucucaa

SEQ ID NO: 1388012 - RNA, 13 nt, Neisseria meningitidis Z2491
agaauuuaucaga

SEQ ID NO: 1388013 - RNA, 15 nt, Neisseria meningitidis Z2491
agaauuuaucagaaa

SEQ ID NO: 1388014 - RNA, 17 nt, Neisseria meningitidis Z2491
agaauuuaucagaaaug

SEQ ID NO: 1388015 - RNA, 19 nt, Neisseria meningitidis Z2491
agaauuuaucagaaaugac

SEQ ID NO: 1388016 - RNA, 14 nt, Neisseria meningitidis Z2491
agaauuuaucggaa

SEQ ID NO: 1388017 - RNA, 23 nt, Neisseria meningitidis Z2491
agacaaucagaucggcaaacccu

SEQ ID NO: 1388018 - RNA, 17 nt, Neisseria meningitidis Z2491
agacggccuuuuugcuu

SEQ ID NO: 1388019 - RNA, 22 nt, Neisseria meningitidis Z2491
agacggcauuucggcaguuuuc

SEQ ID NO: 1388020 - RNA, 13 nt, Neisseria meningitidis Z2491
agacggcauuucu

SEQ ID NO: 1388021 - RNA, 18 nt, Neisseria meningitidis Z2491
agacggcauuuuccuugc

SEQ ID NO: 1388022 - RNA, 15 nt, Neisseria meningitidis Z2491
agacggcauuuugau

SEQ ID NO: 1388023 - RNA, 18 nt, Neisseria meningitidis Z2491
agacggcauuuugucauu

SEQ ID NO: 1388024 - RNA, 15 nt, Neisseria meningitidis Z2491
agacggcauuuuguu

SEQ ID NO: 1388025 - RNA, 23 nt, Neisseria meningitidis Z2491
agacggcauuuuuacaaggcagc

SEQ ID NO: 1388026 - RNA, 15 nt, Neisseria meningitidis Z2491
agacggcauuuuugc

SEQ ID NO: 1388027 - RNA, 16 nt, Neisseria meningitidis Z2491
agaccgucuaaacggu

SEQ ID NO: 1388028 - RNA, 13 nt, Neisseria meningitidis Z2491
agaccgucugaac

SEQ ID NO: 1388029 - RNA, 23 nt, Neisseria meningitidis Z2491
agaauacugccuguaaaaccaag

SEQ ID NO: 1388030 - RNA, 19 nt, Neisseria meningitidis Z2491
agaaucucguuauuuccac

SEQ ID NO: 1388031 - RNA, 16 nt, Neisseria meningitidis Z2491
agaaugaaggaauuug

SEQ ID NO: 1388032 - RNA, 22 nt, Neisseria meningitidis Z2491
agaaugaaaaugccgucugaag

SEQ ID NO: 1388033 - RNA, 20 nt, Neisseria meningitidis Z2491
agaaugaauagucaggcugc

SEQ ID NO: 1388034 - RNA, 22 nt, Neisseria meningitidis Z2491
agaagauuuuuguuuaucuuuc

SEQ ID NO: 1388035 - RNA, 21 nt, Neisseria meningitidis Z2491
acaggcgggcguuccacaaau

SEQ ID NO: 1388036 - RNA, 20 nt, Neisseria meningitidis Z2491
acaggcggauuugaaguuuc

SEQ ID NO: 1388037 - RNA, 20 nt, Neisseria meningitidis Z2491
acaggucggacauuugacuu

SEQ ID NO: 1388038 - RNA, 14 nt, Neisseria meningitidis Z2491
acaguacagauagu

SEQ ID NO: 1388039 - RNA, 13 nt, Neisseria meningitidis Z2491
acaguacaaauag

SEQ ID NO: 1388040 - RNA, 14 nt, Neisseria meningitidis Z2491
acaguacaaauagu

SEQ ID NO: 1388041 - RNA, 21 nt, Neisseria meningitidis Z2491
acaguacaaauaguacggaac

SEQ ID NO: 1388042 - RNA, 14 nt, Neisseria meningitidis Z2491
acaguguuucagac

SEQ ID NO: 1388043 - RNA, 17 nt, Neisseria meningitidis Z2491
acaucugauuuuucuuu

SEQ ID NO: 1388044 - RNA, 21 nt, Neisseria meningitidis Z2491
acaucguuugcauucugcgga

SEQ ID NO: 1388045 - RNA, 20 nt, Neisseria meningitidis Z2491
acaucguuuuuuuagggaaa

SEQ ID NO: 1388046 - RNA, 23 nt, Neisseria meningitidis Z2491
acaugacauuaagauguuuuucc

SEQ ID NO: 1388047 - RNA, 19 nt, Neisseria meningitidis Z2491
acaugccaccgucauuccc

SEQ ID NO: 1388048 - RNA, 21 nt, Neisseria meningitidis Z2491
acaucacggucuuuuugcuuu

SEQ ID NO: 1388049 - RNA, 21 nt, Neisseria meningitidis Z2491
acauauugagaccuuugcaau

SEQ ID NO: 1388050 - RNA, 15 nt, Neisseria meningitidis Z2491
acacuguuuccaagc

SEQ ID NO: 1388051 - RNA, 18 nt, Neisseria meningitidis Z2491
acacuucacauuuucuau

SEQ ID NO: 1388052 - RNA, 19 nt, Neisseria meningitidis Z2491
acagacauugcuaaaacaa

SEQ ID NO: 1388053 - RNA, 12 nt, Neisseria meningitidis Z2491
acagcagcagcc

SEQ ID NO: 1388054 - RNA, 13 nt, Neisseria meningitidis Z2491
acagcagcagccc

SEQ ID NO: 1388055 - RNA, 21 nt, Neisseria meningitidis Z2491
acagcagcagcccgaacacga

SEQ ID NO: 1388056 - RNA, 12 nt, Neisseria meningitidis Z2491
acagcacugccu

SEQ ID NO: 1388057 - RNA, 20 nt, Neisseria meningitidis Z2491
acagcacugccucuuuucag

SEQ ID NO: 1388058 - RNA, 12 nt, Neisseria meningitidis Z2491
acagcacgcggu

SEQ ID NO: 1388059 - RNA, 20 nt, Neisseria meningitidis Z2491
acagcagccggacagcccau

SEQ ID NO: 1388060 - RNA, 18 nt, Neisseria meningitidis Z2491
acagcagcgaaggcgcga

SEQ ID NO: 1388061 - RNA, 14 nt, Neisseria meningitidis Z2491
acagauuacuaaaa

SEQ ID NO: 1388062 - RNA, 21 nt, Neisseria meningitidis Z2491
acagcaauccauucccucucc

SEQ ID NO: 1388063 - RNA, 19 nt, Neisseria meningitidis Z2491
acaggcagccuaaaacauc

SEQ ID NO: 1388064 - RNA, 12 nt, Neisseria meningitidis Z2491
acaggaauuuau

SEQ ID NO: 1388065 - RNA, 18 nt, Neisseria meningitidis Z2491
acaggacgacacauaaag

SEQ ID NO: 1388066 - RNA, 23 nt, Neisseria meningitidis Z2491
acaggauucguggaugcuuugca

SEQ ID NO: 1388067 - RNA, 15 nt, Neisseria meningitidis Z2491
acagcuuaaaauccu

SEQ ID NO: 1388068 - RNA, 18 nt, Neisseria meningitidis Z2491
acagcuugagauuucgcg

SEQ ID NO: 1388069 - RNA, 20 nt, Neisseria meningitidis Z2491
acagcggccgccaucaaaaa

SEQ ID NO: 1388070 - RNA, 21 nt, Neisseria meningitidis Z2491
acagcggcaauauucaaagau

SEQ ID NO: 1388071 - RNA, 23 nt, Neisseria meningitidis Z2491
acagccuacuugcccgccuucag

SEQ ID NO: 1388072 - RNA, 19 nt, Neisseria meningitidis Z2491
acagccgaaaacagcugaa

SEQ ID NO: 1388073 - RNA, 18 nt, Neisseria meningitidis Z2491
accauuggacagcggcaa

SEQ ID NO: 1388074 - RNA, 19 nt, Neisseria meningitidis Z2491
acccaacaggguuccgaaa

SEQ ID NO: 1388075 - RNA, 14 nt, Neisseria meningitidis Z2491
acccaaauccgcca

SEQ ID NO: 1388076 - RNA, 16 nt, Neisseria meningitidis Z2491
accauuguuuccgcuu

SEQ ID NO: 1388077 - RNA, 14 nt, Neisseria meningitidis Z2491
accauuguuucuga

SEQ ID NO: 1388078 - RNA, 19 nt, Neisseria meningitidis Z2491
accauuguuucugaagcca

SEQ ID NO: 1388079 - RNA, 21 nt, Neisseria meningitidis Z2491
acccaaugcuucaaccacgcu

SEQ ID NO: 1388080 - RNA, 16 nt, Neisseria meningitidis Z2491
acccaacuguuugcgc

SEQ ID NO: 1388081 - RNA, 17 nt, Neisseria meningitidis Z2491
acccccgucauucccgc

SEQ ID NO: 1388082 - RNA, 16 nt, Neisseria meningitidis Z2491
accauaccgccuucau

SEQ ID NO: 1388083 - RNA, 18 nt, Neisseria meningitidis Z2491
accauaccgccuucauca

SEQ ID NO: 1388084 - RNA, 15 nt, Neisseria meningitidis Z2491
accauaaauuuuaaa

SEQ ID NO: 1388085 - RNA, 16 nt, Neisseria meningitidis Z2491
accauaaauuuuaaau

SEQ ID NO: 1388086 - RNA, 17 nt, Neisseria meningitidis Z2491
accauaaauuuuaaaua

SEQ ID NO: 1388087 - RNA, 14 nt, Neisseria meningitidis Z2491
accagucuugcgag

SEQ ID NO: 1388088 - RNA, 18 nt, Neisseria meningitidis Z2491
accaguacagcguugccu

SEQ ID NO: 1388089 - RNA, 16 nt, Neisseria meningitidis Z2491
accaguuugaccaugc

SEQ ID NO: 1388090 - RNA, 14 nt, Neisseria meningitidis Z2491
accagcagugccgc

SEQ ID NO: 1388091 - RNA, 13 nt, Neisseria meningitidis Z2491
accaacugcucga

SEQ ID NO: 1388092 - RNA, 15 nt, Neisseria meningitidis Z2491
accaaccggguauuc

SEQ ID NO: 1388093 - RNA, 22 nt, Neisseria meningitidis Z2491
accaaccggguauucauacaca

SEQ ID NO: 1388094 - RNA, 15 nt, Neisseria meningitidis Z2491
accaaaaaacaacag

SEQ ID NO: 1388095 - RNA, 13 nt, Neisseria meningitidis Z2491
accaaaaacagaa

SEQ ID NO: 1388096 - RNA, 19 nt, Neisseria meningitidis Z2491
accaaaaacagaaaccuaa

SEQ ID NO: 1388097 - RNA, 18 nt, Neisseria meningitidis Z2491
accaaaaacagaaaccug

SEQ ID NO: 1388098 - RNA, 16 nt, Neisseria meningitidis Z2491
accaaaaacagcaacc

SEQ ID NO: 1388099 - RNA, 21 nt, Neisseria meningitidis Z2491
acauuuagaaaaaauauacca

SEQ ID NO: 1388100 - RNA, 13 nt, Neisseria meningitidis Z2491
acauuuaucagga

SEQ ID NO: 1388101 - RNA, 23 nt, Neisseria meningitidis Z2491
acauuuaucaggagcaacagaaa

SEQ ID NO: 1388102 - RNA, 23 nt, Neisseria meningitidis Z2491
acauuuaucgggagcaacagaaa

SEQ ID NO: 1388103 - RNA, 19 nt, Neisseria meningitidis Z2491
acgauacacaaaaaagcca

SEQ ID NO: 1388104 - RNA, 23 nt, Neisseria meningitidis Z2491
acgagguuacaguuuaaucccuu

SEQ ID NO: 1388105 - RNA, 16 nt, Neisseria meningitidis Z2491
acgaugcuggcggggc

SEQ ID NO: 1388106 - RNA, 16 nt, Neisseria meningitidis Z2491
acgaugaguuuuuugc

SEQ ID NO: 1388107 - RNA, 16 nt, Neisseria meningitidis Z2491
acgcaaagcugcaaga

SEQ ID NO: 1388108 - RNA, 17 nt, Neisseria meningitidis Z2491
acgcaaagcugcaagaa

SEQ ID NO: 1388109 - RNA, 12 nt, Neisseria meningitidis Z2491
acgauuuugugc

SEQ ID NO: 1388110 - RNA, 22 nt, Neisseria meningitidis Z2491
acgaacaaugcaaaaacaucag

SEQ ID NO: 1388111 - RNA, 22 nt, Neisseria meningitidis Z2491
acgaaccuacauuccgucauuc

SEQ ID NO: 1388112 - RNA, 13 nt, Neisseria meningitidis Z2491
acgaagccgcaga

SEQ ID NO: 1388113 - RNA, 14 nt, Neisseria meningitidis Z2491
acgaagccgcagac

SEQ ID NO: 1388114 - RNA, 21 nt, Neisseria meningitidis Z2491
acgaagccgcagacaguacaa

SEQ ID NO: 1388115 - RNA, 19 nt, Neisseria meningitidis Z2491
acgaagagcggcaggaauu

SEQ ID NO: 1388116 - RNA, 16 nt, Neisseria meningitidis Z2491
acgacucaaaaucauc

SEQ ID NO: 1388117 - RNA, 17 nt, Neisseria meningitidis Z2491
acgacgcggcugcugcc

SEQ ID NO: 1388118 - RNA, 20 nt, Neisseria meningitidis Z2491
acgaccagugcgccggcaua

SEQ ID NO: 1388119 - RNA, 17 nt, Neisseria meningitidis Z2491
acgaccaacgccgccga

SEQ ID NO: 1388120 - RNA, 22 nt, Neisseria meningitidis Z2491
acgaccauuuccaaugacugcg

SEQ ID NO: 1388121 - RNA, 15 nt, Neisseria meningitidis Z2491
acgacgagaauuuau

SEQ ID NO: 1388122 - RNA, 22 nt, Neisseria meningitidis Z2491
acgacgagaauuuaucagaaau

SEQ ID NO: 1388123 - RNA, 19 nt, Neisseria meningitidis Z2491
acgaaaguuggaauccagu

SEQ ID NO: 1388124 - RNA, 19 nt, Neisseria meningitidis Z2491
acgaaagugggaaucuaga

SEQ ID NO: 1388125 - RNA, 17 nt, Neisseria meningitidis Z2491
acgaaaagcuaaagcaa

SEQ ID NO: 1388126 - RNA, 17 nt, Neisseria meningitidis Z2491
accuuugcaaaauuccu

SEQ ID NO: 1388127 - RNA, 17 nt, Neisseria meningitidis Z2491
accuuugcaauaacaua

SEQ ID NO: 1388128 - RNA, 16 nt, Neisseria meningitidis Z2491
accuuucgucauuccc

SEQ ID NO: 1388129 - RNA, 13 nt, Neisseria meningitidis Z2491
accuuugagcugg

SEQ ID NO: 1388130 - RNA, 20 nt, Neisseria meningitidis Z2491
accuuuccgccgucauuccc

SEQ ID NO: 1388131 - RNA, 22 nt, Neisseria meningitidis Z2491
accuuucagacggcauuuuuau

SEQ ID NO: 1388132 - RNA, 12 nt, Neisseria meningitidis Z2491
accuuguuugau

SEQ ID NO: 1388133 - RNA, 14 nt, Neisseria meningitidis Z2491
accuugcuggcaga

SEQ ID NO: 1388134 - RNA, 18 nt, Neisseria meningitidis Z2491
accuucgggcagcggcaa

SEQ ID NO: 1388135 - RNA, 17 nt, Neisseria meningitidis Z2491
accuucguaauuuuucu

SEQ ID NO: 1388136 - RNA, 21 nt, Neisseria meningitidis Z2491
accuucguaauuuuucuccau

SEQ ID NO: 1388137 - RNA, 15 nt, Neisseria meningitidis Z2491
accugcuguuugagc

SEQ ID NO: 1388138 - RNA, 18 nt, Neisseria meningitidis Z2491
accuuagagaaucguucu

SEQ ID NO: 1388139 - RNA, 21 nt, Neisseria meningitidis Z2491
accuuagagaaucguucucuu

SEQ ID NO: 1388140 - RNA, 22 nt, Neisseria meningitidis Z2491
accuuagagaaucguucucuuu

SEQ ID NO: 1388141 - RNA, 20 nt, Neisseria meningitidis Z2491
accucgucauucccgcaaaa

SEQ ID NO: 1388142 - RNA, 14 nt, Neisseria meningitidis Z2491
accugcaaaacauc

SEQ ID NO: 1388143 - RNA, 14 nt, Neisseria meningitidis Z2491
accugacaguaacc

SEQ ID NO: 1388144 - RNA, 19 nt, Neisseria meningitidis Z2491
accugaaccuuauagugga

SEQ ID NO: 1388145 - RNA, 14 nt, Neisseria meningitidis Z2491
accuccagcaccac

SEQ ID NO: 1388146 - RNA, 16 nt, Neisseria meningitidis Z2491
accucauucaaacggu

SEQ ID NO: 1388147 - RNA, 17 nt, Neisseria meningitidis Z2491
accucauugccgcccgu

SEQ ID NO: 1388148 - RNA, 22 nt, Neisseria meningitidis Z2491
accucauugccgcccguuuaaa

SEQ ID NO: 1388149 - RNA, 12 nt, Neisseria meningitidis Z2491
accuacauuccg

SEQ ID NO: 1388150 - RNA, 20 nt, Neisseria meningitidis Z2491
accuacagauuccgaaggga

SEQ ID NO: 1388151 - RNA, 19 nt, Neisseria meningitidis Z2491
accuaagauauaacuuuaa

SEQ ID NO: 1388152 - RNA, 23 nt, Neisseria meningitidis Z2491
accguugaaugugcgccacgcca

SEQ ID NO: 1388153 - RNA, 15 nt, Neisseria meningitidis Z2491
accguuuaaaacagc

SEQ ID NO: 1388154 - RNA, 20 nt, Neisseria meningitidis Z2491
accguuuaaaacagcauugc

SEQ ID NO: 1388155 - RNA, 16 nt, Neisseria meningitidis Z2491
accguuauggaaaugu

SEQ ID NO: 1388156 - RNA, 17 nt, Neisseria meningitidis Z2491
accguuccgaaaccaag

SEQ ID NO: 1388157 - RNA, 17 nt, Neisseria meningitidis Z2491
accgucaaacaaaaugc

SEQ ID NO: 1388158 - RNA, 16 nt, Neisseria meningitidis Z2491
accguaugcaaaaaca

SEQ ID NO: 1388159 - RNA, 18 nt, Neisseria meningitidis Z2491
accguaugcaaaaacaac

SEQ ID NO: 1388160 - RNA, 18 nt, Neisseria meningitidis Z2491
accgucauucccacgaaa

SEQ ID NO: 1388161 - RNA, 19 nt, Neisseria meningitidis Z2491
accguccacaagccgccga

SEQ ID NO: 1388162 - RNA, 17 nt, Neisseria meningitidis Z2491
accguccaaacuuccga

SEQ ID NO: 1388163 - RNA, 20 nt, Neisseria meningitidis Z2491
accgucggcagugauuuccc

SEQ ID NO: 1388164 - RNA, 19 nt, Neisseria meningitidis Z2491
accgucgggcaucugcagc

SEQ ID NO: 1388165 - RNA, 24 nt, Neisseria meningitidis Z2491
accgguuuguauuugaugcguuuc

SEQ ID NO: 1388166 - RNA, 23 nt, Neisseria meningitidis Z2491
accgguacggcguugccucgccu

SEQ ID NO: 1388167 - RNA, 16 nt, Neisseria meningitidis Z2491
accgguccuuccauca

SEQ ID NO: 1388168 - RNA, 22 nt, Neisseria meningitidis Z2491
accggcuguguuuaucuuuucu

SEQ ID NO: 1388169 - RNA, 21 nt, Neisseria meningitidis Z2491
accggcacaggcucaaacagc

SEQ ID NO: 1388170 - RNA, 19 nt, Neisseria meningitidis Z2491
accgauuaagguuaauuaa

SEQ ID NO: 1388171 - RNA, 14 nt, Neisseria meningitidis Z2491
accgccaucaggaa

SEQ ID NO: 1388172 - RNA, 18 nt, Neisseria meningitidis Z2491
accgccaucaggaaugca

SEQ ID NO: 1388173 - RNA, 20 nt, Neisseria meningitidis Z2491
accgccaucaggaaugcaaa

SEQ ID NO: 1388174 - RNA, 22 nt, Neisseria meningitidis Z2491
accgccaaguggagcuggauga

SEQ ID NO: 1388175 - RNA, 16 nt, Neisseria meningitidis Z2491
accgaugccgucauuc

SEQ ID NO: 1388176 - RNA, 22 nt, Neisseria meningitidis Z2491
accccguucccuguaccagcaa

SEQ ID NO: 1388177 - RNA, 13 nt, Neisseria meningitidis Z2491
accgcgccugcca

SEQ ID NO: 1388178 - RNA, 11 nt, Neisseria meningitidis Z2491
accgcgcgcca

SEQ ID NO: 1388179 - RNA, 16 nt, Neisseria meningitidis Z2491
aaccauuacaaaugcu

SEQ ID NO: 1388180 - RNA, 21 nt, Neisseria meningitidis Z2491
aacccaaaaucggccauuccc

SEQ ID NO: 1388181 - RNA, 21 nt, Neisseria meningitidis Z2491
aacccauucaccguuauggaa

SEQ ID NO: 1388182 - RNA, 13 nt, Neisseria meningitidis Z2491
aaccaguacagcg

SEQ ID NO: 1388183 - RNA, 15 nt, Neisseria meningitidis Z2491
aaccacgcuucugau

SEQ ID NO: 1388184 - RNA, 18 nt, Neisseria meningitidis Z2491
aaccagcccgauaagcug

SEQ ID NO: 1388185 - RNA, 15 nt, Neisseria meningitidis Z2491
aaccagggauuuuuc

SEQ ID NO: 1388186 - RNA, 23 nt, Neisseria meningitidis Z2491
aaccggauuccuacgaaaacagg

SEQ ID NO: 1388187 - RNA, 22 nt, Neisseria meningitidis Z2491
aaccgcuucaaggcgguuuuuu

SEQ ID NO: 1388188 - RNA, 19 nt, Neisseria meningitidis Z2491
aaccgcuugacgcuaccgc

SEQ ID NO: 1388189 - RNA, 19 nt, Neisseria meningitidis Z2491
aaccgggguucgaaucccc

SEQ ID NO: 1388190 - RNA, 14 nt, Neisseria meningitidis Z2491
aaccgguccuucca

SEQ ID NO: 1388191 - RNA, 17 nt, Neisseria meningitidis Z2491
aaccguagcaacugaac

SEQ ID NO: 1388192 - RNA, 18 nt, Neisseria meningitidis Z2491
aaccguauauuucccguc

SEQ ID NO: 1388193 - RNA, 14 nt, Neisseria meningitidis Z2491
aaccguaucaaaca

SEQ ID NO: 1388194 - RNA, 19 nt, Neisseria meningitidis Z2491
aaccgcgcagcaguuuugc

SEQ ID NO: 1388195 - RNA, 18 nt, Neisseria meningitidis Z2491
aacccucggcauucccgc

SEQ ID NO: 1388196 - RNA, 15 nt, Neisseria meningitidis Z2491
aacccguuuucaggu

SEQ ID NO: 1388197 - RNA, 20 nt, Neisseria meningitidis Z2491
aaccgaaguuuaaagaaccg

SEQ ID NO: 1388198 - RNA, 15 nt, Neisseria meningitidis Z2491
aacccuuuuucugcc

SEQ ID NO: 1388199 - RNA, 14 nt, Neisseria meningitidis Z2491
aaccgaaaaaauaa

SEQ ID NO: 1388200 - RNA, 15 nt, Neisseria meningitidis Z2491
aaccgaaaaaauaau

SEQ ID NO: 1388201 - RNA, 17 nt, Neisseria meningitidis Z2491
aaccgaaaaaauaauug

SEQ ID NO: 1388202 - RNA, 14 nt, Neisseria meningitidis Z2491
aaccgaaaauaauu

SEQ ID NO: 1388203 - RNA, 12 nt, Neisseria meningitidis Z2491
aaccgaaaccug

SEQ ID NO: 1388204 - RNA, 20 nt, Neisseria meningitidis Z2491
aacccguaugccgccugccu

SEQ ID NO: 1388205 - RNA, 14 nt, Neisseria meningitidis Z2491
aacauuugcgcagc

SEQ ID NO: 1388206 - RNA, 13 nt, Neisseria meningitidis Z2491
aacauuuugauug

SEQ ID NO: 1388207 - RNA, 13 nt, Neisseria meningitidis Z2491
aaccaaaaaaucu

SEQ ID NO: 1388208 - RNA, 15 nt, Neisseria meningitidis Z2491
aaccaaaaaaucuga

SEQ ID NO: 1388209 - RNA, 18 nt, Neisseria meningitidis Z2491
aaccaaaaaaucugauaa

SEQ ID NO: 1388210 - RNA, 17 nt, Neisseria meningitidis Z2491
aaccaagauauagugga

SEQ ID NO: 1388211 - RNA, 16 nt, Neisseria meningitidis Z2491
aaccaauuuguuggca

SEQ ID NO: 1388212 - RNA, 17 nt, Neisseria meningitidis Z2491
aaccaacgaaacacucg

SEQ ID NO: 1388213 - RNA, 13 nt, Neisseria meningitidis Z2491
aaccaaaagccaa

SEQ ID NO: 1388214 - RNA, 20 nt, Neisseria meningitidis Z2491
aacauuaaauuuccagauuc

SEQ ID NO: 1388215 - RNA, 22 nt, Neisseria meningitidis Z2491
aacauuaucugacaggaaauuu

SEQ ID NO: 1388216 - RNA, 17 nt, Neisseria meningitidis Z2491
aacaucgcucaaauucu

SEQ ID NO: 1388217 - RNA, 20 nt, Neisseria meningitidis Z2491
aacaucgcucaaauucuguu

SEQ ID NO: 1388218 - RNA, 14 nt, Neisseria meningitidis Z2491
aacaucugauuuuu

SEQ ID NO: 1388219 - RNA, 22 nt, Neisseria meningitidis Z2491
aacaucuugugccagcucuuga

SEQ ID NO: 1388220 - RNA, 19 nt, Neisseria meningitidis Z2491
aacaucccgguaacgaaga

SEQ ID NO: 1388221 - RNA, 14 nt, Neisseria meningitidis Z2491
aacauacuuuguuu

SEQ ID NO: 1388222 - RNA, 18 nt, Neisseria meningitidis Z2491
aacauacuuuguuucaaa

SEQ ID NO: 1388223 - RNA, 15 nt, Neisseria meningitidis Z2491
aacaguguuucagac

SEQ ID NO: 1388224 - RNA, 13 nt, Neisseria meningitidis Z2491
aacauaaaugccg

SEQ ID NO: 1388225 - RNA, 13 nt, Neisseria meningitidis Z2491
aacaguucuuuga

SEQ ID NO: 1388226 - RNA, 19 nt, Neisseria meningitidis Z2491
aacaggcagccuaaaacau

SEQ ID NO: 1388227 - RNA, 21 nt, Neisseria meningitidis Z2491
aacaggacaaaaauccugcuu

SEQ ID NO: 1388228 - RNA, 23 nt, Neisseria meningitidis Z2491
aacaggacaaaaauccugcuuau

SEQ ID NO: 1388229 - RNA, 17 nt, Neisseria meningitidis Z2491
aacaggcggcggcauau

SEQ ID NO: 1388230 - RNA, 20 nt, Neisseria meningitidis Z2491
aacaggcggcggcauaucau

SEQ ID NO: 1388231 - RNA, 13 nt, Neisseria meningitidis Z2491
aacagggaaagca

SEQ ID NO: 1388232 - RNA, 19 nt, Neisseria meningitidis Z2491
aacagggaaagcagcagcc

SEQ ID NO: 1388233 - RNA, 15 nt, Neisseria meningitidis Z2491
aacagcugaaaaccu

SEQ ID NO: 1388234 - RNA, 18 nt, Neisseria meningitidis Z2491
aacagcggguaggcggga

SEQ ID NO: 1388235 - RNA, 15 nt, Neisseria meningitidis Z2491
aacagcgaguuuuuc

SEQ ID NO: 1388236 - RNA, 20 nt, Neisseria meningitidis Z2491
aacagcacugccucuuuuca

SEQ ID NO: 1388237 - RNA, 18 nt, Neisseria meningitidis Z2491
aacagcaaccugaaauuc

SEQ ID NO: 1388238 - RNA, 15 nt, Neisseria meningitidis Z2491
aacagcaaucaaaau

SEQ ID NO: 1388239 - RNA, 19 nt, Neisseria meningitidis Z2491
aacagcaauccauucccuc

SEQ ID NO: 1388240 - RNA, 23 nt, Neisseria meningitidis Z2491
aacagcauauagccgagcaucac

SEQ ID NO: 1388241 - RNA, 22 nt, Neisseria meningitidis Z2491
aacagcaucaaaccauauggaa

SEQ ID NO: 1388242 - RNA, 14 nt, Neisseria meningitidis Z2491
aacagccgaaaaca

SEQ ID NO: 1388243 - RNA, 17 nt, Neisseria meningitidis Z2491
aacacgcuuuaccugug

SEQ ID NO: 1388244 - RNA, 22 nt, Neisseria meningitidis Z2491
aacacgucggcgcggacgauuu

SEQ ID NO: 1388245 - RNA, 22 nt, Neisseria meningitidis Z2491
aacacgucguaggcuuuuucca

SEQ ID NO: 1388246 - RNA, 17 nt, Neisseria meningitidis Z2491
aacagauugucaaaaua

SEQ ID NO: 1388247 - RNA, 16 nt, Neisseria meningitidis Z2491
aacagauugugcauaa

SEQ ID NO: 1388248 - RNA, 19 nt, Neisseria meningitidis Z2491
aacagaaaucccaaacccu

SEQ ID NO: 1388249 - RNA, 18 nt, Neisseria meningitidis Z2491
aacagaaaaccaaaauca

SEQ ID NO: 1388250 - RNA, 22 nt, Neisseria meningitidis Z2491
aacagaaacccaaaaucggcca

SEQ ID NO: 1388251 - RNA, 19 nt, Neisseria meningitidis Z2491
aacagaaaccugaaaacag

SEQ ID NO: 1388252 - RNA, 15 nt, Neisseria meningitidis Z2491
aacagacuauuuuug

SEQ ID NO: 1388253 - RNA, 22 nt, Neisseria meningitidis Z2491
aacagacuauuuuugcaaaggu

SEQ ID NO: 1388254 - RNA, 21 nt, Neisseria meningitidis Z2491
aacagacauugcuaaaacaac

SEQ ID NO: 1388255 - RNA, 16 nt, Neisseria meningitidis Z2491
aacacaucgcuuucag

SEQ ID NO: 1388256 - RNA, 15 nt, Neisseria meningitidis Z2491
aacacagccaaaaua

SEQ ID NO: 1388257 - RNA, 21 nt, Neisseria meningitidis Z2491
aacacagguuuucgucuauuu

SEQ ID NO: 1388258 - RNA, 13 nt, Neisseria meningitidis Z2491
aacacaaaugccg

SEQ ID NO: 1388259 - RNA, 13 nt, Neisseria meningitidis Z2491
aacacaaaaaacu

SEQ ID NO: 1388260 - RNA, 22 nt, Neisseria meningitidis Z2491
aacaauccgcccgaauaaaaaa

SEQ ID NO: 1388261 - RNA, 15 nt, Neisseria meningitidis Z2491
aacaaugcaaaaaca

SEQ ID NO: 1388262 - RNA, 16 nt, Neisseria meningitidis Z2491
aacaaugcaaaaacau

SEQ ID NO: 1388263 - RNA, 15 nt, Neisseria meningitidis Z2491
aacaaugcaaagaac

SEQ ID NO: 1388264 - RNA, 19 nt, Neisseria meningitidis Z2491
aacaagcgauuauuuuuua

SEQ ID NO: 1388265 - RNA, 11 nt, Neisseria meningitidis Z2491
aacaaggaagc

SEQ ID NO: 1388266 - RNA, 17 nt, Neisseria meningitidis Z2491
aacaagccuguuuuccu

SEQ ID NO: 1388267 - RNA, 18 nt, Neisseria meningitidis Z2491
aacaacucuuucgggcug

SEQ ID NO: 1388268 - RNA, 21 nt, Neisseria meningitidis Z2491
aacaacugaaaccgcucugcc

SEQ ID NO: 1388269 - RNA, 20 nt, Neisseria meningitidis Z2491
aacaacaaauuuuugauuuc

SEQ ID NO: 1388270 - RNA, 16 nt, Neisseria meningitidis Z2491
aacaaacuagauuccc

SEQ ID NO: 1388271 - RNA, 19 nt, Neisseria meningitidis Z2491
aacaaacccccgcuuuugc

SEQ ID NO: 1388272 - RNA, 17 nt, Neisseria meningitidis Z2491
aacaaacccuuucagac

SEQ ID NO: 1388273 - RNA, 19 nt, Neisseria meningitidis Z2491
aacaaacccuuucagacgg

SEQ ID NO: 1388274 - RNA, 12 nt, Neisseria meningitidis Z2491
aacaaaaugccg

SEQ ID NO: 1388275 - RNA, 15 nt, Neisseria meningitidis Z2491
aacaaaaaucaggac

SEQ ID NO: 1388276 - RNA, 21 nt, Neisseria meningitidis Z2491
aacaaaaaucaggacaaggca

SEQ ID NO: 1388277 - RNA, 21 nt, Neisseria meningitidis Z2491
aaauuuuuuggcgcauuuuua

SEQ ID NO: 1388278 - RNA, 22 nt, Neisseria meningitidis Z2491
aaauuuuuuggcgcauuuuuau

SEQ ID NO: 1388279 - RNA, 21 nt, Neisseria meningitidis Z2491
aaauuuuuggcgcauuuuuau

SEQ ID NO: 1388280 - RNA, 21 nt, Neisseria meningitidis Z2491
aaauuuuuauauucacauaga

SEQ ID NO: 1388281 - RNA, 22 nt, Neisseria meningitidis Z2491
aaauuuuaugcucaaucucauu

SEQ ID NO: 1388282 - RNA, 18 nt, Neisseria meningitidis Z2491
aaauuuuagguuucugau

SEQ ID NO: 1388283 - RNA, 22 nt, Neisseria meningitidis Z2491
aaauuuuagguuucugauuuug

SEQ ID NO: 1388284 - RNA, 21 nt, Neisseria meningitidis Z2491
aaauuuggcuguauuuuaaua

SEQ ID NO: 1388285 - RNA, 17 nt, Neisseria meningitidis Z2491
aaauuugguaaugcaaa

SEQ ID NO: 1388286 - RNA, 15 nt, Neisseria meningitidis Z2491
aaauuuuuaaaaccg

SEQ ID NO: 1388287 - RNA, 22 nt, Neisseria meningitidis Z2491
aaauuuugccauucuugcaaaa

SEQ ID NO: 1388288 - RNA, 16 nt, Neisseria meningitidis Z2491
aaauuuugcagcccug

SEQ ID NO: 1388289 - RNA, 13 nt, Neisseria meningitidis Z2491
aaauuuauccgaa

SEQ ID NO: 1388290 - RNA, 18 nt, Neisseria meningitidis Z2491
aaauuucagauagcugaa

SEQ ID NO: 1388291 - RNA, 16 nt, Neisseria meningitidis Z2491
aaauuucaucauuccc

SEQ ID NO: 1388292 - RNA, 16 nt, Neisseria meningitidis Z2491
aaauuucaucauuccu

SEQ ID NO: 1388293 - RNA, 22 nt, Neisseria meningitidis Z2491
aaauuuccaaauauaaaaaaug

SEQ ID NO: 1388294 - RNA, 23 nt, Neisseria meningitidis Z2491
aaauugcugcaucacguucugaa

SEQ ID NO: 1388295 - RNA, 13 nt, Neisseria meningitidis Z2491
aaauugcauuuuu

SEQ ID NO: 1388296 - RNA, 14 nt, Neisseria meningitidis Z2491
aaauugcauuuuua

SEQ ID NO: 1388297 - RNA, 22 nt, Neisseria meningitidis Z2491
aaauugcauuuuuaauuucuuc

SEQ ID NO: 1388298 - RNA, 22 nt, Neisseria meningitidis Z2491
aaauuuauaguggauuaacaaa

SEQ ID NO: 1388299 - RNA, 23 nt, Neisseria meningitidis Z2491
aaauuuauaguggauuaacaaaa

SEQ ID NO: 1388300 - RNA, 15 nt, Neisseria meningitidis Z2491
aaauuuauaaacaaa

SEQ ID NO: 1388301 - RNA, 15 nt, Neisseria meningitidis Z2491
aaauuuaauccauua

SEQ ID NO: 1388302 - RNA, 13 nt, Neisseria meningitidis Z2491
aaauuuaaaccag

SEQ ID NO: 1388303 - RNA, 14 nt, Neisseria meningitidis Z2491
aaauuuaaaccagu

SEQ ID NO: 1388304 - RNA, 20 nt, Neisseria meningitidis Z2491
aagaaaaacagcaaucaaaa

SEQ ID NO: 1388305 - RNA, 18 nt, Neisseria meningitidis Z2491
aagaacuuuauccccagc

SEQ ID NO: 1388306 - RNA, 13 nt, Neisseria meningitidis Z2491
aagaacagcagca

SEQ ID NO: 1388307 - RNA, 16 nt, Neisseria meningitidis Z2491
aagaacgccaaaccca

SEQ ID NO: 1388308 - RNA, 20 nt, Neisseria meningitidis Z2491
aagaacccaaaccgucauuc

SEQ ID NO: 1388309 - RNA, 14 nt, Neisseria meningitidis Z2491
aacuucuaacaaau

SEQ ID NO: 1388310 - RNA, 19 nt, Neisseria meningitidis Z2491
aacuucuaacaaauaaugu

SEQ ID NO: 1388311 - RNA, 21 nt, Neisseria meningitidis Z2491
aacuucauccguugcuucaau

SEQ ID NO: 1388312 - RNA, 11 nt, Neisseria meningitidis Z2491
aacuuccagcg

SEQ ID NO: 1388313 - RNA, 23 nt, Neisseria meningitidis Z2491
aacuucaaaccccuucaaaccaa

SEQ ID NO: 1388314 - RNA, 16 nt, Neisseria meningitidis Z2491
aacuucaauaguggga

SEQ ID NO: 1388315 - RNA, 21 nt, Neisseria meningitidis Z2491
aacuuauacacacgguuuuca

SEQ ID NO: 1388316 - RNA, 17 nt, Neisseria meningitidis Z2491
aacuugauauugcggcu

SEQ ID NO: 1388317 - RNA, 21 nt, Neisseria meningitidis Z2491
aacuuguccgcacggaaacuu

SEQ ID NO: 1388318 - RNA, 14 nt, Neisseria meningitidis Z2491
aacuuuucugauuu

SEQ ID NO: 1388319 - RNA, 19 nt, Neisseria meningitidis Z2491
aacuuuucugauuuuuccu

SEQ ID NO: 1388320 - RNA, 23 nt, Neisseria meningitidis Z2491
aacuuuucugauuuuuccuacuu

SEQ ID NO: 1388321 - RNA, 18 nt, Neisseria meningitidis Z2491
aacuuuauccguuacacc

SEQ ID NO: 1388322 - RNA, 19 nt, Neisseria meningitidis Z2491
aacugauuguuuuucagag

SEQ ID NO: 1388323 - RNA, 14 nt, Neisseria meningitidis Z2491
aacugauucaacgc

SEQ ID NO: 1388324 - RNA, 17 nt, Neisseria meningitidis Z2491
aacugccuuugaugcug

SEQ ID NO: 1388325 - RNA, 17 nt, Neisseria meningitidis Z2491
aacugcuaugcggcaaa

SEQ ID NO: 1388326 - RNA, 13 nt, Neisseria meningitidis Z2491
aacucuuccauuu

SEQ ID NO: 1388327 - RNA, 21 nt, Neisseria meningitidis Z2491
aacucuuccauuugagccgca

SEQ ID NO: 1388328 - RNA, 18 nt, Neisseria meningitidis Z2491
aacucuuaaaacacguca

SEQ ID NO: 1388329 - RNA, 18 nt, Neisseria meningitidis Z2491
aacucuccgucauucccg

SEQ ID NO: 1388330 - RNA, 13 nt, Neisseria meningitidis Z2491
aacucgauuuccg

SEQ ID NO: 1388331 - RNA, 20 nt, Neisseria meningitidis Z2491
aacucaggcuucagacggca

SEQ ID NO: 1388332 - RNA, 20 nt, Neisseria meningitidis Z2491
aacuauaguggauuaacaaa

SEQ ID NO: 1388333 - RNA, 23 nt, Neisseria meningitidis Z2491
aacuauaguggauuaacaaaaau

SEQ ID NO: 1388334 - RNA, 12 nt, Neisseria meningitidis Z2491
aacucaaaaaac

SEQ ID NO: 1388335 - RNA, 17 nt, Neisseria meningitidis Z2491
aacucaacgaaccugga

SEQ ID NO: 1388336 - RNA, 21 nt, Neisseria meningitidis Z2491
aacgucaagcaaaaaaugccg

SEQ ID NO: 1388337 - RNA, 16 nt, Neisseria meningitidis Z2491
aacguaucggauaaaa

SEQ ID NO: 1388338 - RNA, 18 nt, Neisseria meningitidis Z2491
aacguggggaacagucuu

SEQ ID NO: 1388339 - RNA, 21 nt, Neisseria meningitidis Z2491
aacuagcggcguuugaacagc

SEQ ID NO: 1388340 - RNA, 14 nt, Neisseria meningitidis Z2491
aacgguguggagag

SEQ ID NO: 1388341 - RNA, 20 nt, Neisseria meningitidis Z2491
aacgguguggagaguuuuuc

SEQ ID NO: 1388342 - RNA, 20 nt, Neisseria meningitidis Z2491
aacgguuuuuccaaaccuga

SEQ ID NO: 1388343 - RNA, 16 nt, Neisseria meningitidis Z2491
aacgguuuuuucugcc

SEQ ID NO: 1388344 - RNA, 18 nt, Neisseria meningitidis Z2491
aacgguuuuuucugccaa

SEQ ID NO: 1388345 - RNA, 19 nt, Neisseria meningitidis Z2491
aacggcggcgggcagucau

SEQ ID NO: 1388346 - RNA, 14 nt, Neisseria meningitidis Z2491
aacgggauuucagc

SEQ ID NO: 1388347 - RNA, 14 nt, Neisseria meningitidis Z2491
aacggaaaaucaaa

SEQ ID NO: 1388348 - RNA, 22 nt, Neisseria meningitidis Z2491
aacgcuugugaaugcggcggca

SEQ ID NO: 1388349 - RNA, 19 nt, Neisseria meningitidis Z2491
aacggcaggcaaaaaaaau

SEQ ID NO: 1388350 - RNA, 21 nt, Neisseria meningitidis Z2491
aacggcaggcaaaaaaaauaa

SEQ ID NO: 1388351 - RNA, 17 nt, Neisseria meningitidis Z2491
aacggcacaaacgccag

SEQ ID NO: 1388352 - RNA, 20 nt, Neisseria meningitidis Z2491
aacggcacaaacgccagcac

SEQ ID NO: 1388353 - RNA, 19 nt, Neisseria meningitidis Z2491
aacgccagcacaaacagca

SEQ ID NO: 1388354 - RNA, 20 nt, Neisseria meningitidis Z2491
aacgccagcacaaacagcau

SEQ ID NO: 1388355 - RNA, 22 nt, Neisseria meningitidis Z2491
aacgcccuuuuguaaaggaagu

SEQ ID NO: 1388356 - RNA, 15 nt, Neisseria meningitidis Z2491
aacgcauucagacgg

SEQ ID NO: 1388357 - RNA, 21 nt, Neisseria meningitidis Z2491
aacgccacccauauaaggcug

SEQ ID NO: 1388358 - RNA, 21 nt, Neisseria meningitidis Z2491
aacgccgccgacaucccccag

SEQ ID NO: 1388359 - RNA, 15 nt, Neisseria meningitidis Z2491
aacgccguacugguu

SEQ ID NO: 1388360 - RNA, 16 nt, Neisseria meningitidis Z2491
aacgccguacugguuu

SEQ ID NO: 1388361 - RNA, 19 nt, Neisseria meningitidis Z2491
aacgccguacugguuuuug

SEQ ID NO: 1388362 - RNA, 12 nt, Neisseria meningitidis Z2491
aacgccuucuuc

SEQ ID NO: 1388363 - RNA, 15 nt, Neisseria meningitidis Z2491
aacgcgcaaacgcug

SEQ ID NO: 1388364 - RNA, 16 nt, Neisseria meningitidis Z2491
aacgcgacggaaagug

SEQ ID NO: 1388365 - RNA, 15 nt, Neisseria meningitidis Z2491
aacgacuuccagcac

SEQ ID NO: 1388366 - RNA, 20 nt, Neisseria meningitidis Z2491
aacgacuuuggucaguguug

SEQ ID NO: 1388367 - RNA, 16 nt, Neisseria meningitidis Z2491
aacgacgggauuuuag

SEQ ID NO: 1388368 - RNA, 14 nt, Neisseria meningitidis Z2491
aacgcaaagcugca

SEQ ID NO: 1388369 - RNA, 17 nt, Neisseria meningitidis Z2491
aacgcaaagcugcaaga

SEQ ID NO: 1388370 - RNA, 22 nt, Neisseria meningitidis Z2491
aacgauuuuuuuucuaaccagc

SEQ ID NO: 1388371 - RNA, 19 nt, Neisseria meningitidis Z2491
aacgcagccagcaucgcag

SEQ ID NO: 1388372 - RNA, 13 nt, Neisseria meningitidis Z2491
aaccguaucggau

SEQ ID NO: 1388373 - RNA, 19 nt, Neisseria meningitidis Z2491
aaccgucaaauugauuuuu

SEQ ID NO: 1388374 - RNA, 20 nt, Neisseria meningitidis Z2491
aaccucgucauucccgcaaa

SEQ ID NO: 1388375 - RNA, 13 nt, Neisseria meningitidis Z2491
aacgacagcagca

SEQ ID NO: 1388376 - RNA, 19 nt, Neisseria meningitidis Z2491
aacgaaugccgucugaaag

SEQ ID NO: 1388377 - RNA, 14 nt, Neisseria meningitidis Z2491
aacgaauuucaugu

SEQ ID NO: 1388378 - RNA, 23 nt, Neisseria meningitidis Z2491
aacgaagccguagacaguacaaa

SEQ ID NO: 1388379 - RNA, 19 nt, Neisseria meningitidis Z2491
aaccuguuuuucaaagccc

SEQ ID NO: 1388380 - RNA, 20 nt, Neisseria meningitidis Z2491
aaccuguuuuucaaagccca

SEQ ID NO: 1388381 - RNA, 17 nt, Neisseria meningitidis Z2491
aaccuuauccauaucca

SEQ ID NO: 1388382 - RNA, 19 nt, Neisseria meningitidis Z2491
aaccuugccaagguugagg

SEQ ID NO: 1388383 - RNA, 20 nt, Neisseria meningitidis Z2491
aaccuuucccguuucagacg

SEQ ID NO: 1388384 - RNA, 21 nt, Neisseria meningitidis Z2491
aauccagaacguaaaaucuca

SEQ ID NO: 1388385 - RNA, 21 nt, Neisseria meningitidis Z2491
aauccagaacguaaaaucuga

SEQ ID NO: 1388386 - RNA, 17 nt, Neisseria meningitidis Z2491
aauccacuauaaaaaau

SEQ ID NO: 1388387 - RNA, 17 nt, Neisseria meningitidis Z2491
aauccacuauaauacaa

SEQ ID NO: 1388388 - RNA, 21 nt, Neisseria meningitidis Z2491
aauccacuauauuuucgcaag

SEQ ID NO: 1388389 - RNA, 15 nt, Neisseria meningitidis Z2491
aauccaguuucuuga

SEQ ID NO: 1388390 - RNA, 19 nt, Neisseria meningitidis Z2491
aauccaguuucuugaguuu

SEQ ID NO: 1388391 - RNA, 17 nt, Neisseria meningitidis Z2491
aauccaguucgguuuca

SEQ ID NO: 1388392 - RNA, 23 nt, Neisseria meningitidis Z2491
aauccagguucguugaguuucgg

SEQ ID NO: 1388393 - RNA, 23 nt, Neisseria meningitidis Z2491
aauccaccauauuugaaccugac

SEQ ID NO: 1388394 - RNA, 17 nt, Neisseria meningitidis Z2491
aauccaagguugucuga

SEQ ID NO: 1388395 - RNA, 18 nt, Neisseria meningitidis Z2491
aauccaagauuucaucau

SEQ ID NO: 1388396 - RNA, 14 nt, Neisseria meningitidis Z2491
aauccaacgcugca

SEQ ID NO: 1388397 - RNA, 19 nt, Neisseria meningitidis Z2491
aaucauuucugucuguuuc

SEQ ID NO: 1388398 - RNA, 17 nt, Neisseria meningitidis Z2491
aaucuaggucuuuaaac

SEQ ID NO: 1388399 - RNA, 14 nt, Neisseria meningitidis Z2491
aaucuagacauuca

SEQ ID NO: 1388400 - RNA, 18 nt, Neisseria meningitidis Z2491
aaucuaccguuuccuccu

SEQ ID NO: 1388401 - RNA, 22 nt, Neisseria meningitidis Z2491
aaucuagaaacgcaaagcugca

SEQ ID NO: 1388402 - RNA, 14 nt, Neisseria meningitidis Z2491
aaucuagaaacuca

SEQ ID NO: 1388403 - RNA, 21 nt, Neisseria meningitidis Z2491
aaucuagaaccucaaacuuuc

SEQ ID NO: 1388404 - RNA, 19 nt, Neisseria meningitidis Z2491
aaucgggcgggaauagcuc

SEQ ID NO: 1388405 - RNA, 15 nt, Neisseria meningitidis Z2491
aaucgggugauacuu

SEQ ID NO: 1388406 - RNA, 19 nt, Neisseria meningitidis Z2491
aaucgguuccguacuauuu

SEQ ID NO: 1388407 - RNA, 15 nt, Neisseria meningitidis Z2491
aauccuucagcucuc

SEQ ID NO: 1388408 - RNA, 19 nt, Neisseria meningitidis Z2491
aauccuucagcucucccuc

SEQ ID NO: 1388409 - RNA, 13 nt, Neisseria meningitidis Z2491
aauccgguuuuuu

SEQ ID NO: 1388410 - RNA, 19 nt, Neisseria meningitidis Z2491
aauccgcuuccaaaaccac

SEQ ID NO: 1388411 - RNA, 19 nt, Neisseria meningitidis Z2491
aauccgcccgaauaaaaaa

SEQ ID NO: 1388412 - RNA, 18 nt, Neisseria meningitidis Z2491
aauccgcuauaacagcaa

SEQ ID NO: 1388413 - RNA, 13 nt, Neisseria meningitidis Z2491
aaucccgcaggau

SEQ ID NO: 1388414 - RNA, 19 nt, Neisseria meningitidis Z2491
aauccgccaaaaacggcac

SEQ ID NO: 1388415 - RNA, 12 nt, Neisseria meningitidis Z2491
aauccgcaauau

SEQ ID NO: 1388416 - RNA, 12 nt, Neisseria meningitidis Z2491
aauccgaaucca

SEQ ID NO: 1388417 - RNA, 20 nt, Neisseria meningitidis Z2491
aaucccuuugagcuucgcga

SEQ ID NO: 1388418 - RNA, 15 nt, Neisseria meningitidis Z2491
aaucccgucauuccc

SEQ ID NO: 1388419 - RNA, 17 nt, Neisseria meningitidis Z2491
aaugacgggauuugaga

SEQ ID NO: 1388420 - RNA, 22 nt, Neisseria meningitidis Z2491
aaugacggucgaggguuucugu

SEQ ID NO: 1388421 - RNA, 22 nt, Neisseria meningitidis Z2491
aaugacggucggggguuucugu

SEQ ID NO: 1388422 - RNA, 23 nt, Neisseria meningitidis Z2491
aaugacggauuuuagguuucuga

SEQ ID NO: 1388423 - RNA, 15 nt, Neisseria meningitidis Z2491
aaugacggcagagcg

SEQ ID NO: 1388424 - RNA, 19 nt, Neisseria meningitidis Z2491
aaugacgggauauagguuu

SEQ ID NO: 1388425 - RNA, 23 nt, Neisseria meningitidis Z2491
aaugacgcgaacagaaaccucaa

SEQ ID NO: 1388426 - RNA, 21 nt, Neisseria meningitidis Z2491
aaugagauugagcauaaaauu

SEQ ID NO: 1388427 - RNA, 15 nt, Neisseria meningitidis Z2491
aaugacgaaaaguug

SEQ ID NO: 1388428 - RNA, 15 nt, Neisseria meningitidis Z2491
aaugaccgaaacuca

SEQ ID NO: 1388429 - RNA, 18 nt, Neisseria meningitidis Z2491
aaugaugggcugaaauag

SEQ ID NO: 1388430 - RNA, 14 nt, Neisseria meningitidis Z2491
aaugcaaaaacauc

SEQ ID NO: 1388431 - RNA, 16 nt, Neisseria meningitidis Z2491
aaugcaaaaacaucag

SEQ ID NO: 1388432 - RNA, 19 nt, Neisseria meningitidis Z2491
aaugcaaaaaguccuucac

SEQ ID NO: 1388433 - RNA, 18 nt, Neisseria meningitidis Z2491
aaugcaaaacuuuucuga

SEQ ID NO: 1388434 - RNA, 16 nt, Neisseria meningitidis Z2491
aaucuuauuuucaaaa

SEQ ID NO: 1388435 - RNA, 19 nt, Neisseria meningitidis Z2491
aaucuuauuuucaaaaugc

SEQ ID NO: 1388436 - RNA, 12 nt, Neisseria meningitidis Z2491
aaugaaaauuug

SEQ ID NO: 1388437 - RNA, 19 nt, Neisseria meningitidis Z2491
aaugaaaaugugcauuucu

SEQ ID NO: 1388438 - RNA, 17 nt, Neisseria meningitidis Z2491
aaucuguuaacgaaauu

SEQ ID NO: 1388439 - RNA, 17 nt, Neisseria meningitidis Z2491
aaugccgucugaacacg

SEQ ID NO: 1388440 - RNA, 20 nt, Neisseria meningitidis Z2491
aaugccgucugaacaucuuu

SEQ ID NO: 1388441 - RNA, 22 nt, Neisseria meningitidis Z2491
aaugccgucugaagcccugccu

SEQ ID NO: 1388442 - RNA, 23 nt, Neisseria meningitidis Z2491
aaugccgucugaagcccuuucag

SEQ ID NO: 1388443 - RNA, 19 nt, Neisseria meningitidis Z2491
aaugccgucugaagccuuu

SEQ ID NO: 1388444 - RNA, 18 nt, Neisseria meningitidis Z2491
aaugccgucugaaggcuu

SEQ ID NO: 1388445 - RNA, 21 nt, Neisseria meningitidis Z2491
aaugccgucugaaguuucugc

SEQ ID NO: 1388446 - RNA, 15 nt, Neisseria meningitidis Z2491
aaugccgucauuccc

SEQ ID NO: 1388447 - RNA, 18 nt, Neisseria meningitidis Z2491
aaugccguccgaaagguu

SEQ ID NO: 1388448 - RNA, 19 nt, Neisseria meningitidis Z2491
aaugccgucugaaaacagc

SEQ ID NO: 1388449 - RNA, 18 nt, Neisseria meningitidis Z2491
aaugccgucugaaacccg

SEQ ID NO: 1388450 - RNA, 16 nt, Neisseria meningitidis Z2491
aaugccgucugaaagg

SEQ ID NO: 1388451 - RNA, 16 nt, Neisseria meningitidis Z2491
aaugccgcaaucucaa

SEQ ID NO: 1388452 - RNA, 18 nt, Neisseria meningitidis Z2491
aaugccuuucucuguuuu

SEQ ID NO: 1388453 - RNA, 14 nt, Neisseria meningitidis Z2491
aaugcgccaaaaaa

SEQ ID NO: 1388454 - RNA, 23 nt, Neisseria meningitidis Z2491
aaugccgccugaacauuucagac

SEQ ID NO: 1388455 - RNA, 14 nt, Neisseria meningitidis Z2491
aaugccaaaggcag

SEQ ID NO: 1388456 - RNA, 13 nt, Neisseria meningitidis Z2491
aauggaaaugccg

SEQ ID NO: 1388457 - RNA, 19 nt, Neisseria meningitidis Z2491
aaugcgucggagaaaaaca

SEQ ID NO: 1388458 - RNA, 17 nt, Neisseria meningitidis Z2491
aaugcuuaaucaaaucu

SEQ ID NO: 1388459 - RNA, 14 nt, Neisseria meningitidis Z2491
aauucauagcaaaa

SEQ ID NO: 1388460 - RNA, 15 nt, Neisseria meningitidis Z2491
aauucagguucguuu

SEQ ID NO: 1388461 - RNA, 23 nt, Neisseria meningitidis Z2491
aauucagguucguuuaguuucgg

SEQ ID NO: 1388462 - RNA, 14 nt, Neisseria meningitidis Z2491
aauucauguuuaua

SEQ ID NO: 1388463 - RNA, 11 nt, Neisseria meningitidis Z2491
aauuccagcaa

SEQ ID NO: 1388464 - RNA, 19 nt, Neisseria meningitidis Z2491
aauuccaacauaaccgaaa

SEQ ID NO: 1388465 - RNA, 16 nt, Neisseria meningitidis Z2491
aauuccggaaucagac

SEQ ID NO: 1388466 - RNA, 23 nt, Neisseria meningitidis Z2491
aauucccgccaucuaaaaucucg

SEQ ID NO: 1388467 - RNA, 23 nt, Neisseria meningitidis Z2491
aauucgugauucccgagaaaaca

SEQ ID NO: 1388468 - RNA, 17 nt, Neisseria meningitidis Z2491
aauucugaaacuuuaau

SEQ ID NO: 1388469 - RNA, 14 nt, Neisseria meningitidis Z2491
aauucaaaaaccug

SEQ ID NO: 1388470 - RNA, 22 nt, Neisseria meningitidis Z2491
aauuauugccagcauuaauaua

SEQ ID NO: 1388471 - RNA, 16 nt, Neisseria meningitidis Z2491
aauuauccacagagau

SEQ ID NO: 1388472 - RNA, 12 nt, Neisseria meningitidis Z2491
aauuaacaaaaa

SEQ ID NO: 1388473 - RNA, 14 nt, Neisseria meningitidis Z2491
aauuaaauuuaaac

SEQ ID NO: 1388474 - RNA, 22 nt, Neisseria meningitidis Z2491
aauuaacaaaaaucaggacaag

SEQ ID NO: 1388475 - RNA, 13 nt, Neisseria meningitidis Z2491
aauugaaaucaac

SEQ ID NO: 1388476 - RNA, 13 nt, Neisseria meningitidis Z2491
aauugaaaauuuu

SEQ ID NO: 1388477 - RNA, 13 nt, Neisseria meningitidis Z2491
aauugaaaugccg

SEQ ID NO: 1388478 - RNA, 21 nt, Neisseria meningitidis Z2491
aauugaagcgucccaaauauu

SEQ ID NO: 1388479 - RNA, 14 nt, Neisseria meningitidis Z2491
aauugacaaaaacu

SEQ ID NO: 1388480 - RNA, 19 nt, Neisseria meningitidis Z2491
aauucuugccgcauuaaaa

SEQ ID NO: 1388481 - RNA, 14 nt, Neisseria meningitidis Z2491
aauugccuucauca

SEQ ID NO: 1388482 - RNA, 18 nt, Neisseria meningitidis Z2491
aauugccuucaucagcau

SEQ ID NO: 1388483 - RNA, 16 nt, Neisseria meningitidis Z2491
aauugcuugagauggu

SEQ ID NO: 1388484 - RNA, 16 nt, Neisseria meningitidis Z2491
aauugucuuuucccuu

SEQ ID NO: 1388485 - RNA, 22 nt, Neisseria meningitidis Z2491
aauugucuuuucccuugcaaau

SEQ ID NO: 1388486 - RNA, 14 nt, Neisseria meningitidis Z2491
aauuguccauuuuu

SEQ ID NO: 1388487 - RNA, 16 nt, Neisseria meningitidis Z2491
aauuguccauuuuucu

SEQ ID NO: 1388488 - RNA, 15 nt, Neisseria meningitidis Z2491
aauuuaaacaggcac

SEQ ID NO: 1388489 - RNA, 16 nt, Neisseria meningitidis Z2491
aauuuacagcuuuuac

SEQ ID NO: 1388490 - RNA, 17 nt, Neisseria meningitidis Z2491
aauuuaauccauuauaa

SEQ ID NO: 1388491 - RNA, 17 nt, Neisseria meningitidis Z2491
aauuuaauccacuauaa

SEQ ID NO: 1388492 - RNA, 19 nt, Neisseria meningitidis Z2491
aauuuaauccacuauaaaa

SEQ ID NO: 1388493 - RNA, 21 nt, Neisseria meningitidis Z2491
aauuuaauccacuauaaaauu

SEQ ID NO: 1388494 - RNA, 13 nt, Neisseria meningitidis Z2491
aauuuaugaaaua

SEQ ID NO: 1388495 - RNA, 11 nt, Neisseria meningitidis Z2491
aauuuaucaga

SEQ ID NO: 1388496 - RNA, 21 nt, Neisseria meningitidis Z2491
aauuuauaguggauuaacaaa

SEQ ID NO: 1388497 - RNA, 14 nt, Neisseria meningitidis Z2491
aauuuauaaacaaa

SEQ ID NO: 1388498 - RNA, 16 nt, Neisseria meningitidis Z2491
aauuuauaaacaaaaa

SEQ ID NO: 1388499 - RNA, 15 nt, Neisseria meningitidis Z2491
aauuuaucggaaaaa

SEQ ID NO: 1388500 - RNA, 21 nt, Neisseria meningitidis Z2491
aauuuaucggaaaugacugaa

SEQ ID NO: 1388501 - RNA, 21 nt, Neisseria meningitidis Z2491
aauuuaucgggaaugacugaa

SEQ ID NO: 1388502 - RNA, 13 nt, Neisseria meningitidis Z2491
aauuuauccgaaa

SEQ ID NO: 1388503 - RNA, 17 nt, Neisseria meningitidis Z2491
aauuuauccgaaauaac

SEQ ID NO: 1388504 - RNA, 22 nt, Neisseria meningitidis Z2491
aauuuauccgaagcgacaacaa

SEQ ID NO: 1388505 - RNA, 23 nt, Neisseria meningitidis Z2491
aauuuauccgaagcgacaacaau

SEQ ID NO: 1388506 - RNA, 21 nt, Neisseria meningitidis Z2491
aauuuauucuaaauagcugaa

SEQ ID NO: 1388507 - RNA, 12 nt, Neisseria meningitidis Z2491
aauuuauuuaga

SEQ ID NO: 1388508 - RNA, 15 nt, Neisseria meningitidis Z2491
aauuuauuugaacga

SEQ ID NO: 1388509 - RNA, 14 nt, Neisseria meningitidis Z2491
aagggguaaauccu

SEQ ID NO: 1388510 - RNA, 12 nt, Neisseria meningitidis Z2491
aagggcuucaga

SEQ ID NO: 1388511 - RNA, 19 nt, Neisseria meningitidis Z2491
aaggcggcggcguucaaau

SEQ ID NO: 1388512 - RNA, 17 nt, Neisseria meningitidis Z2491
aaggcgggcaggcagug

SEQ ID NO: 1388513 - RNA, 18 nt, Neisseria meningitidis Z2491
aaggcggggcaacgccgu

SEQ ID NO: 1388514 - RNA, 13 nt, Neisseria meningitidis Z2491
aaggucgucugaa

SEQ ID NO: 1388515 - RNA, 11 nt, Neisseria meningitidis Z2491
aaguaaaucgg

SEQ ID NO: 1388516 - RNA, 16 nt, Neisseria meningitidis Z2491
aaguacucauuuuucg

SEQ ID NO: 1388517 - RNA, 13 nt, Neisseria meningitidis Z2491
aagucauauuaau

SEQ ID NO: 1388518 - RNA, 23 nt, Neisseria meningitidis Z2491
aagucggcuuggcgggaagccag

SEQ ID NO: 1388519 - RNA, 20 nt, Neisseria meningitidis Z2491
aaguccaaacaaaaaugccg

SEQ ID NO: 1388520 - RNA, 12 nt, Neisseria meningitidis Z2491
aagucugauucu

SEQ ID NO: 1388521 - RNA, 16 nt, Neisseria meningitidis Z2491
aagucugauucuaccg

SEQ ID NO: 1388522 - RNA, 17 nt, Neisseria meningitidis Z2491
aagucugauucuaccgc

SEQ ID NO: 1388523 - RNA, 15 nt, Neisseria meningitidis Z2491
aagugcggugaaauc

SEQ ID NO: 1388524 - RNA, 20 nt, Neisseria meningitidis Z2491
aagugcggugaaaucuuaua

SEQ ID NO: 1388525 - RNA, 19 nt, Neisseria meningitidis Z2491
aagugcggucaaaauuuac

SEQ ID NO: 1388526 - RNA, 14 nt, Neisseria meningitidis Z2491
aagugaguaaaaac

SEQ ID NO: 1388527 - RNA, 24 nt, Neisseria meningitidis Z2491
aaguguccggcagccugcucgagc

SEQ ID NO: 1388528 - RNA, 14 nt, Neisseria meningitidis Z2491
aagcucaaaaaacc

SEQ ID NO: 1388529 - RNA, 19 nt, Neisseria meningitidis Z2491
aagcuaacgggcaauuuuc

SEQ ID NO: 1388530 - RNA, 20 nt, Neisseria meningitidis Z2491
aagcgggaauccggaagcga

SEQ ID NO: 1388531 - RNA, 20 nt, Neisseria meningitidis Z2491
aagcgggaguccggaagcgg

SEQ ID NO: 1388532 - RNA, 17 nt, Neisseria meningitidis Z2491
aagccgcagacaguaca

SEQ ID NO: 1388533 - RNA, 12 nt, Neisseria meningitidis Z2491
aagcccugccug

SEQ ID NO: 1388534 - RNA, 14 nt, Neisseria meningitidis Z2491
aagaagugggucag

SEQ ID NO: 1388535 - RNA, 21 nt, Neisseria meningitidis Z2491
aagccuucagacggcauuucc

SEQ ID NO: 1388536 - RNA, 13 nt, Neisseria meningitidis Z2491
aagccuuucagac

SEQ ID NO: 1388537 - RNA, 17 nt, Neisseria meningitidis Z2491
aagccuugcaaaucagg

SEQ ID NO: 1388538 - RNA, 20 nt, Neisseria meningitidis Z2491
aagccuugcaaaucaggcag

SEQ ID NO: 1388539 - RNA, 11 nt, Neisseria meningitidis Z2491
aagcgaugccg

SEQ ID NO: 1388540 - RNA, 15 nt, Neisseria meningitidis Z2491
aagccgccgccgaca

SEQ ID NO: 1388541 - RNA, 21 nt, Neisseria meningitidis Z2491
aagccgguugcggugcugcug

SEQ ID NO: 1388542 - RNA, 17 nt, Neisseria meningitidis Z2491
aagccucgucauuucca

SEQ ID NO: 1388543 - RNA, 23 nt, Neisseria meningitidis Z2491
aagccugcggaaacagagugcgu

SEQ ID NO: 1388544 - RNA, 12 nt, Neisseria meningitidis Z2491
aauauccgacca

SEQ ID NO: 1388545 - RNA, 23 nt, Neisseria meningitidis Z2491
aauauggcggauuaaaauaaaaa

SEQ ID NO: 1388546 - RNA, 19 nt, Neisseria meningitidis Z2491
aauauacuuggcaaaaucu

SEQ ID NO: 1388547 - RNA, 13 nt, Neisseria meningitidis Z2491
aauauaaucaaac

SEQ ID NO: 1388548 - RNA, 16 nt, Neisseria meningitidis Z2491
aauaccaaaccgcgca

SEQ ID NO: 1388549 - RNA, 16 nt, Neisseria meningitidis Z2491
aauacauuuuugauau

SEQ ID NO: 1388550 - RNA, 21 nt, Neisseria meningitidis Z2491
aauacaaaaggccgucugaaa

SEQ ID NO: 1388551 - RNA, 13 nt, Neisseria meningitidis Z2491
aauacgcaaaaca

SEQ ID NO: 1388552 - RNA, 22 nt, Neisseria meningitidis Z2491
aauacgcaaacuaacuuauaca

SEQ ID NO: 1388553 - RNA, 16 nt, Neisseria meningitidis Z2491
aauaccuuguuuuuuc

SEQ ID NO: 1388554 - RNA, 17 nt, Neisseria meningitidis Z2491
aauaccgcaaccugaaa

SEQ ID NO: 1388555 - RNA, 11 nt, Neisseria meningitidis Z2491
aauaccgcgcc

SEQ ID NO: 1388556 - RNA, 19 nt, Neisseria meningitidis Z2491
aauacugaggaaaccaucc

SEQ ID NO: 1388557 - RNA, 18 nt, Neisseria meningitidis Z2491
aauacuguccggcaugau

SEQ ID NO: 1388558 - RNA, 22 nt, Neisseria meningitidis Z2491
aauacuguccggcaugauuuuc

SEQ ID NO: 1388559 - RNA, 22 nt, Neisseria meningitidis Z2491
aauagaaaauauuguuauuccc

SEQ ID NO: 1388560 - RNA, 16 nt, Neisseria meningitidis Z2491
aauagcaugguuaaga

SEQ ID NO: 1388561 - RNA, 21 nt, Neisseria meningitidis Z2491
aauaacgguugcacgguuuuc

SEQ ID NO: 1388562 - RNA, 22 nt, Neisseria meningitidis Z2491
aauaacuauaguggauuaacaa

SEQ ID NO: 1388563 - RNA, 23 nt, Neisseria meningitidis Z2491
aauaaauucugaaacuuuaauuu

SEQ ID NO: 1388564 - RNA, 22 nt, Neisseria meningitidis Z2491
aauaauggaacaaagaaagcag

SEQ ID NO: 1388565 - RNA, 16 nt, Neisseria meningitidis Z2491
aauaauggccuuuucc

SEQ ID NO: 1388566 - RNA, 19 nt, Neisseria meningitidis Z2491
aauaaucgaaccaaauaaa

SEQ ID NO: 1388567 - RNA, 21 nt, Neisseria meningitidis Z2491
aauaagucugcgaaacagaca

SEQ ID NO: 1388568 - RNA, 14 nt, Neisseria meningitidis Z2491
aauaauaaacgcca

SEQ ID NO: 1388569 - RNA, 14 nt, Neisseria meningitidis Z2491
uuggugcuucagca

SEQ ID NO: 1388570 - RNA, 22 nt, Neisseria meningitidis Z2491
uugguuccgugauaaagcggcu

SEQ ID NO: 1388571 - RNA, 23 nt, Neisseria meningitidis Z2491
uugguauauuuuuucuaaauguu

SEQ ID NO: 1388572 - RNA, 14 nt, Neisseria meningitidis Z2491
uugguagagcgcaa

SEQ ID NO: 1388573 - RNA, 20 nt, Neisseria meningitidis Z2491
uugguacacgggguagguaa

SEQ ID NO: 1388574 - RNA, 15 nt, Neisseria meningitidis Z2491
uuggguuuucuguuc

SEQ ID NO: 1388575 - RNA, 12 nt, Neisseria meningitidis Z2491
uugguaaucagu

SEQ ID NO: 1388576 - RNA, 18 nt, Neisseria meningitidis Z2491
uugguaacggaaucaccg

SEQ ID NO: 1388577 - RNA, 13 nt, Neisseria meningitidis Z2491
uuggguucuagau

SEQ ID NO: 1388578 - RNA, 15 nt, Neisseria meningitidis Z2491
uuggggcgaaaacag

SEQ ID NO: 1388579 - RNA, 13 nt, Neisseria meningitidis Z2491
uuggguagaauua

SEQ ID NO: 1388580 - RNA, 13 nt, Neisseria meningitidis Z2491
uugggcguucaga

SEQ ID NO: 1388581 - RNA, 18 nt, Neisseria meningitidis Z2491
uugggcgauggcgcggcg

SEQ ID NO: 1388582 - RNA, 12 nt, Neisseria meningitidis Z2491
uuggcgcauuuu

SEQ ID NO: 1388583 - RNA, 19 nt, Neisseria meningitidis Z2491
uuggcgaggacgcgugcaa

SEQ ID NO: 1388584 - RNA, 21 nt, Neisseria meningitidis Z2491
uuggcggcguguagcguggau

SEQ ID NO: 1388585 - RNA, 22 nt, Neisseria meningitidis Z2491
uuggcgguagguuugcaggaau

SEQ ID NO: 1388586 - RNA, 13 nt, Neisseria meningitidis Z2491
uugggcaacacca

SEQ ID NO: 1388587 - RNA, 14 nt, Neisseria meningitidis Z2491
uugggauauuuucu

SEQ ID NO: 1388588 - RNA, 12 nt, Neisseria meningitidis Z2491
uugggaaaugcg

SEQ ID NO: 1388589 - RNA, 20 nt, Neisseria meningitidis Z2491
uugcguaauuccggcagccu

SEQ ID NO: 1388590 - RNA, 20 nt, Neisseria meningitidis Z2491
uugcguaggaugccuagaug

SEQ ID NO: 1388591 - RNA, 19 nt, Neisseria meningitidis Z2491
uugcuagauauuuagcauu

SEQ ID NO: 1388592 - RNA, 17 nt, Neisseria meningitidis Z2491
uugcuuuucauuucuag

SEQ ID NO: 1388593 - RNA, 21 nt, Neisseria meningitidis Z2491
uugcuguuuuugguuuucuau

SEQ ID NO: 1388594 - RNA, 16 nt, Neisseria meningitidis Z2491
uugcuuauuuguucaa

SEQ ID NO: 1388595 - RNA, 17 nt, Neisseria meningitidis Z2491
uuggcagcacaggcaag

SEQ ID NO: 1388596 - RNA, 16 nt, Neisseria meningitidis Z2491
uuggauuugucuucaa

SEQ ID NO: 1388597 - RNA, 23 nt, Neisseria meningitidis Z2491
uuggacggcggauuucagugcug

SEQ ID NO: 1388598 - RNA, 22 nt, Neisseria meningitidis Z2491
uuggacagcggcaauauucaaa

SEQ ID NO: 1388599 - RNA, 13 nt, Neisseria meningitidis Z2491
uuggacaaaucga

SEQ ID NO: 1388600 - RNA, 12 nt, Neisseria meningitidis Z2491
uuggaauccagu

SEQ ID NO: 1388601 - RNA, 15 nt, Neisseria meningitidis Z2491
uuggaacaaaaaaua

SEQ ID NO: 1388602 - RNA, 17 nt, Neisseria meningitidis Z2491
uuggaaaaguacaaaau

SEQ ID NO: 1388603 - RNA, 17 nt, Neisseria meningitidis Z2491
uugccagcccccuucca

SEQ ID NO: 1388604 - RNA, 21 nt, Neisseria meningitidis Z2491
uugcccaacagcagcauaaca

SEQ ID NO: 1388605 - RNA, 21 nt, Neisseria meningitidis Z2491
uugccguauccauaccaaaca

SEQ ID NO: 1388606 - RNA, 22 nt, Neisseria meningitidis Z2491
uugccguuuuccuuucugacaa

SEQ ID NO: 1388607 - RNA, 16 nt, Neisseria meningitidis Z2491
uugcgaauaagugcgg

SEQ ID NO: 1388608 - RNA, 21 nt, Neisseria meningitidis Z2491
uugcgcggcaggucgaaauau

SEQ ID NO: 1388609 - RNA, 23 nt, Neisseria meningitidis Z2491
uugcggagcggcgguguuugcuu

SEQ ID NO: 1388610 - RNA, 16 nt, Neisseria meningitidis Z2491
uugcggcaaauuuaca

SEQ ID NO: 1388611 - RNA, 23 nt, Neisseria meningitidis Z2491
uugcagcgcgcccgacaaaucgg

SEQ ID NO: 1388612 - RNA, 21 nt, Neisseria meningitidis Z2491
uugcaggaucuuauccauccc

SEQ ID NO: 1388613 - RNA, 17 nt, Neisseria meningitidis Z2491
uugcaguauccggcaag

SEQ ID NO: 1388614 - RNA, 23 nt, Neisseria meningitidis Z2491
uugcaggcauuuaucggauaaaa

SEQ ID NO: 1388615 - RNA, 16 nt, Neisseria meningitidis Z2491
uugcaggcguagucuu

SEQ ID NO: 1388616 - RNA, 21 nt, Neisseria meningitidis Z2491
uugcagccaugcggcaaaaag

SEQ ID NO: 1388617 - RNA, 14 nt, Neisseria meningitidis Z2491
uugcagauaaauuu

SEQ ID NO: 1388618 - RNA, 18 nt, Neisseria meningitidis Z2491
uugauacugcuugaccaa

SEQ ID NO: 1388619 - RNA, 22 nt, Neisseria meningitidis Z2491
uugaugucgugcagauggcugu

SEQ ID NO: 1388620 - RNA, 19 nt, Neisseria meningitidis Z2491
uugaugguuuuccaauacg

SEQ ID NO: 1388621 - RNA, 14 nt, Neisseria meningitidis Z2491
uugauggcgaaagc

SEQ ID NO: 1388622 - RNA, 13 nt, Neisseria meningitidis Z2491
uugauuucuauua

SEQ ID NO: 1388623 - RNA, 22 nt, Neisseria meningitidis Z2491
uugagguagauggggaggcgcg

SEQ ID NO: 1388624 - RNA, 22 nt, Neisseria meningitidis Z2491
uugaguugauaauaugaaacca

SEQ ID NO: 1388625 - RNA, 19 nt, Neisseria meningitidis Z2491
uugagcuggauuuucgcaa

SEQ ID NO: 1388626 - RNA, 14 nt, Neisseria meningitidis Z2491
uugagcuaaggcga

SEQ ID NO: 1388627 - RNA, 12 nt, Neisseria meningitidis Z2491
uugagccuucac

SEQ ID NO: 1388628 - RNA, 17 nt, Neisseria meningitidis Z2491
uucuucuuuccauccau

SEQ ID NO: 1388629 - RNA, 17 nt, Neisseria meningitidis Z2491
uucuucuuugcugacaa

SEQ ID NO: 1388630 - RNA, 17 nt, Neisseria meningitidis Z2491
uuguauuugaugcguuu

SEQ ID NO: 1388631 - RNA, 19 nt, Neisseria meningitidis Z2491
uugucccacagagcgaaca

SEQ ID NO: 1388632 - RNA, 17 nt, Neisseria meningitidis Z2491
uuguccaugauuuuuug

SEQ ID NO: 1388633 - RNA, 22 nt, Neisseria meningitidis Z2491
uuguccgguuccgguuguuuuu

SEQ ID NO: 1388634 - RNA, 16 nt, Neisseria meningitidis Z2491
uugguuuccagauucc

SEQ ID NO: 1388635 - RNA, 22 nt, Neisseria meningitidis Z2491
uugguuuuauaguggauuaaca

SEQ ID NO: 1388636 - RNA, 22 nt, Neisseria meningitidis Z2491
uugguuuucaaaacauccgcaa

SEQ ID NO: 1388637 - RNA, 19 nt, Neisseria meningitidis Z2491
uuguucuaaggucuagauu

SEQ ID NO: 1388638 - RNA, 12 nt, Neisseria meningitidis Z2491
uuguuuggaaau

SEQ ID NO: 1388639 - RNA, 18 nt, Neisseria meningitidis Z2491
uugugggaauccagaccu

SEQ ID NO: 1388640 - RNA, 22 nt, Neisseria meningitidis Z2491
uuguguccgaccguuccgaaac

SEQ ID NO: 1388641 - RNA, 19 nt, Neisseria meningitidis Z2491
uugucgguaaaaauggaaa

SEQ ID NO: 1388642 - RNA, 22 nt, Neisseria meningitidis Z2491
uugugcggcaaaacgccuucuu

SEQ ID NO: 1388643 - RNA, 18 nt, Neisseria meningitidis Z2491
uugugccugcuccauugu

SEQ ID NO: 1388644 - RNA, 16 nt, Neisseria meningitidis Z2491
uugugccagcucuuga

SEQ ID NO: 1388645 - RNA, 13 nt, Neisseria meningitidis Z2491
uuuaaaacagcau

SEQ ID NO: 1388646 - RNA, 17 nt, Neisseria meningitidis Z2491
uuuaacuugucaagaaa

SEQ ID NO: 1388647 - RNA, 12 nt, Neisseria meningitidis Z2491
uuuaaucauguu

SEQ ID NO: 1388648 - RNA, 22 nt, Neisseria meningitidis Z2491
uuuaaucagucggacaaaaugc

SEQ ID NO: 1388649 - RNA, 18 nt, Neisseria meningitidis Z2491
uuuaaucaucguauuuuu

SEQ ID NO: 1388650 - RNA, 14 nt, Neisseria meningitidis Z2491
uuuacccucucccc

SEQ ID NO: 1388651 - RNA, 22 nt, Neisseria meningitidis Z2491
uuuaccguuccgcgccgcaaac

SEQ ID NO: 1388652 - RNA, 14 nt, Neisseria meningitidis Z2491
uuuacguuuauuua

SEQ ID NO: 1388653 - RNA, 21 nt, Neisseria meningitidis Z2491
uuuagacagcaucgccgccgu

SEQ ID NO: 1388654 - RNA, 16 nt, Neisseria meningitidis Z2491
uuuagauugcaggcau

SEQ ID NO: 1388655 - RNA, 14 nt, Neisseria meningitidis Z2491
uuuauauucugauu

SEQ ID NO: 1388656 - RNA, 14 nt, Neisseria meningitidis Z2491
uuuaucagaaauga

SEQ ID NO: 1388657 - RNA, 15 nt, Neisseria meningitidis Z2491
uuuauccgauaaguu

SEQ ID NO: 1388658 - RNA, 22 nt, Neisseria meningitidis Z2491
uuuaucagggcugcaaaauuua

SEQ ID NO: 1388659 - RNA, 10 nt, Neisseria meningitidis Z2491
uuuaucuuuc

SEQ ID NO: 1388660 - RNA, 24 nt, Neisseria meningitidis Z2491
uuuaucuguauaguggauuaaauu

SEQ ID NO: 1388661 - RNA, 22 nt, Neisseria meningitidis Z2491
uuuaucggaaaugacugaaacu

SEQ ID NO: 1388662 - RNA, 14 nt, Neisseria meningitidis Z2491
uuuauuuaaauaaa

SEQ ID NO: 1388663 - RNA, 23 nt, Neisseria meningitidis Z2491
uuuauuuacgauaugcaaaugca

SEQ ID NO: 1388664 - RNA, 16 nt, Neisseria meningitidis Z2491
uuuauuuacguuuauu

SEQ ID NO: 1388665 - RNA, 15 nt, Neisseria meningitidis Z2491
uuuauuuuuucucaa

SEQ ID NO: 1388666 - RNA, 13 nt, Neisseria meningitidis Z2491
uuuauguuucaaa

SEQ ID NO: 1388667 - RNA, 14 nt, Neisseria meningitidis Z2491
uucuagauuccugc

SEQ ID NO: 1388668 - RNA, 16 nt, Neisseria meningitidis Z2491
uucuagauuccugccu

SEQ ID NO: 1388669 - RNA, 13 nt, Neisseria meningitidis Z2491
uucuaaaaauaca

SEQ ID NO: 1388670 - RNA, 23 nt, Neisseria meningitidis Z2491
uucuaaaauaugcagagaccuuu

SEQ ID NO: 1388671 - RNA, 17 nt, Neisseria meningitidis Z2491
uucucaugaucuucuua

SEQ ID NO: 1388672 - RNA, 12 nt, Neisseria meningitidis Z2491
uucuauuuuugu

SEQ ID NO: 1388673 - RNA, 15 nt, Neisseria meningitidis Z2491
uucuggauucccacu

SEQ ID NO: 1388674 - RNA, 15 nt, Neisseria meningitidis Z2491
uucugacagcauuuc

SEQ ID NO: 1388675 - RNA, 23 nt, Neisseria meningitidis Z2491
uucugaauugcuugagaugguca

SEQ ID NO: 1388676 - RNA, 16 nt, Neisseria meningitidis Z2491
uucugaauaaacuucu

SEQ ID NO: 1388677 - RNA, 13 nt, Neisseria meningitidis Z2491
uucugaaaaauau

SEQ ID NO: 1388678 - RNA, 17 nt, Neisseria meningitidis Z2491
uucugaaaaauuuauga

SEQ ID NO: 1388679 - RNA, 14 nt, Neisseria meningitidis Z2491
uucucuuugagcua

SEQ ID NO: 1388680 - RNA, 22 nt, Neisseria meningitidis Z2491
uucuccgucgggauucagaugu

SEQ ID NO: 1388681 - RNA, 17 nt, Neisseria meningitidis Z2491
uucuucgcaaccgacaa

SEQ ID NO: 1388682 - RNA, 21 nt, Neisseria meningitidis Z2491
uucuucgacguugccuucuuc

SEQ ID NO: 1388683 - RNA, 13 nt, Neisseria meningitidis Z2491
uucuucuaaaaau

SEQ ID NO: 1388684 - RNA, 22 nt, Neisseria meningitidis Z2491
uucuucuaaaaauacauauuga

SEQ ID NO: 1388685 - RNA, 15 nt, Neisseria meningitidis Z2491
uucuguuuuugguuu

SEQ ID NO: 1388686 - RNA, 22 nt, Neisseria meningitidis Z2491
uucuguuuuugguuuucuguuu

SEQ ID NO: 1388687 - RNA, 11 nt, Neisseria meningitidis Z2491
uucuguuuggc

SEQ ID NO: 1388688 - RNA, 17 nt, Neisseria meningitidis Z2491
uucuguuuggcuuuuuc

SEQ ID NO: 1388689 - RNA, 19 nt, Neisseria meningitidis Z2491
uucuguuuggcuuuuuucu

SEQ ID NO: 1388690 - RNA, 16 nt, Neisseria meningitidis Z2491
uucuuacccaaugacu

SEQ ID NO: 1388691 - RNA, 19 nt, Neisseria meningitidis Z2491
uucggaucaacguuucuau

SEQ ID NO: 1388692 - RNA, 17 nt, Neisseria meningitidis Z2491
uucggcaaaauccgcaa

SEQ ID NO: 1388693 - RNA, 13 nt, Neisseria meningitidis Z2491
uucggcaauuuga

SEQ ID NO: 1388694 - RNA, 13 nt, Neisseria meningitidis Z2491
uucggcacaagau

SEQ ID NO: 1388695 - RNA, 12 nt, Neisseria meningitidis Z2491
uucggcgcggcu

SEQ ID NO: 1388696 - RNA, 22 nt, Neisseria meningitidis Z2491
uucggcgcguuuuucaccgccc

SEQ ID NO: 1388697 - RNA, 19 nt, Neisseria meningitidis Z2491
uucggcuugguuuugcuuc

SEQ ID NO: 1388698 - RNA, 21 nt, Neisseria meningitidis Z2491
uucggguaagcccuaauucgu

SEQ ID NO: 1388699 - RNA, 16 nt, Neisseria meningitidis Z2491
uucgggcaaaagccag

SEQ ID NO: 1388700 - RNA, 16 nt, Neisseria meningitidis Z2491
uucgggcaacacgccc

SEQ ID NO: 1388701 - RNA, 22 nt, Neisseria meningitidis Z2491
uucgacgcccccgcaggcagca

SEQ ID NO: 1388702 - RNA, 14 nt, Neisseria meningitidis Z2491
uucgaccagcuccc

SEQ ID NO: 1388703 - RNA, 19 nt, Neisseria meningitidis Z2491
uucgacgcgcuugaugucg

SEQ ID NO: 1388704 - RNA, 15 nt, Neisseria meningitidis Z2491
uucgauuucuuugcc

SEQ ID NO: 1388705 - RNA, 16 nt, Neisseria meningitidis Z2491
uucgccccaaauaccu

SEQ ID NO: 1388706 - RNA, 20 nt, Neisseria meningitidis Z2491
uucccccgaagaugggaauc

SEQ ID NO: 1388707 - RNA, 22 nt, Neisseria meningitidis Z2491
uuccccucggggucuuuggcaa

SEQ ID NO: 1388708 - RNA, 23 nt, Neisseria meningitidis Z2491
uuccaaggcacgguaaaccgcca

SEQ ID NO: 1388709 - RNA, 14 nt, Neisseria meningitidis Z2491
uucccgugcaggcg

SEQ ID NO: 1388710 - RNA, 20 nt, Neisseria meningitidis Z2491
uucccgugcaggcgggaauc

SEQ ID NO: 1388711 - RNA, 18 nt, Neisseria meningitidis Z2491
uucccucaaaaacagaaa

SEQ ID NO: 1388712 - RNA, 19 nt, Neisseria meningitidis Z2491
uucccucaaaaacagaaaa

SEQ ID NO: 1388713 - RNA, 20 nt, Neisseria meningitidis Z2491
uucccucaaaaacagaaaac

SEQ ID NO: 1388714 - RNA, 21 nt, Neisseria meningitidis Z2491
uuccgcccgaacggaaauaag

SEQ ID NO: 1388715 - RNA, 13 nt, Neisseria meningitidis Z2491
uucccuucccucc

SEQ ID NO: 1388716 - RNA, 19 nt, Neisseria meningitidis Z2491
uuccgcaccgacagaccua

SEQ ID NO: 1388717 - RNA, 21 nt, Neisseria meningitidis Z2491
uuccgcauaagcgcaaaugcg

SEQ ID NO: 1388718 - RNA, 13 nt, Neisseria meningitidis Z2491
uucccugacaaac

SEQ ID NO: 1388719 - RNA, 13 nt, Neisseria meningitidis Z2491
uuccgugggaaug

SEQ ID NO: 1388720 - RNA, 17 nt, Neisseria meningitidis Z2491
uuccgucaaaaaugccu

SEQ ID NO: 1388721 - RNA, 17 nt, Neisseria meningitidis Z2491
uuccuaauauugagcaa

SEQ ID NO: 1388722 - RNA, 19 nt, Neisseria meningitidis Z2491
uuccuaaaacuuaaaauuu

SEQ ID NO: 1388723 - RNA, 12 nt, Neisseria meningitidis Z2491
uucauuuugucg

SEQ ID NO: 1388724 - RNA, 14 nt, Neisseria meningitidis Z2491
uuccaaaagcguca

SEQ ID NO: 1388725 - RNA, 20 nt, Neisseria meningitidis Z2491
uuccaagccgcauugucccu

SEQ ID NO: 1388726 - RNA, 20 nt, Neisseria meningitidis Z2491
uuccaacuuggcaacgccac

SEQ ID NO: 1388727 - RNA, 13 nt, Neisseria meningitidis Z2491
uuccaacaaggaa

SEQ ID NO: 1388728 - RNA, 15 nt, Neisseria meningitidis Z2491
uuccaaagccuucag

SEQ ID NO: 1388729 - RNA, 16 nt, Neisseria meningitidis Z2491
uucauuucuagauucc

SEQ ID NO: 1388730 - RNA, 20 nt, Neisseria meningitidis Z2491
uucauguucgugcaucauca

SEQ ID NO: 1388731 - RNA, 16 nt, Neisseria meningitidis Z2491
uucaugguguuuccua

SEQ ID NO: 1388732 - RNA, 18 nt, Neisseria meningitidis Z2491
uucaugguguuuccuaau

SEQ ID NO: 1388733 - RNA, 18 nt, Neisseria meningitidis Z2491
uucaucgcuugauuuucg

SEQ ID NO: 1388734 - RNA, 22 nt, Neisseria meningitidis Z2491
uucauaaguuucccgaaauucc

SEQ ID NO: 1388735 - RNA, 20 nt, Neisseria meningitidis Z2491
uucagcuauuuagaauaaau

SEQ ID NO: 1388736 - RNA, 19 nt, Neisseria meningitidis Z2491
uucagcguuacuuugcguu

SEQ ID NO: 1388737 - RNA, 21 nt, Neisseria meningitidis Z2491
uucagcuaaccuuugaauauu

SEQ ID NO: 1388738 - RNA, 16 nt, Neisseria meningitidis Z2491
uucauccaguuucuuu

SEQ ID NO: 1388739 - RNA, 19 nt, Neisseria meningitidis Z2491
uucauccacuauaacagca

SEQ ID NO: 1388740 - RNA, 18 nt, Neisseria meningitidis Z2491
uucauagcaaaauaaaau

SEQ ID NO: 1388741 - RNA, 23 nt, Neisseria meningitidis Z2491
uucacgggaaugacgaaaaguug

SEQ ID NO: 1388742 - RNA, 13 nt, Neisseria meningitidis Z2491
uucaauucaaaau

SEQ ID NO: 1388743 - RNA, 20 nt, Neisseria meningitidis Z2491
uucaauuuaaacacuucuuc

SEQ ID NO: 1388744 - RNA, 16 nt, Neisseria meningitidis Z2491
uucaaggcgguuuuuu

SEQ ID NO: 1388745 - RNA, 22 nt, Neisseria meningitidis Z2491
uucaaugcuaaggcaauuuauc

SEQ ID NO: 1388746 - RNA, 17 nt, Neisseria meningitidis Z2491
uuauucccccgaagaug

SEQ ID NO: 1388747 - RNA, 13 nt, Neisseria meningitidis Z2491
uuauuuccugaag

SEQ ID NO: 1388748 - RNA, 18 nt, Neisseria meningitidis Z2491
uuauuuuccauaaaauac

SEQ ID NO: 1388749 - RNA, 21 nt, Neisseria meningitidis Z2491
uucaaauaaauuugaauagca

SEQ ID NO: 1388750 - RNA, 16 nt, Neisseria meningitidis Z2491
uucaaagauuaucuga

SEQ ID NO: 1388751 - RNA, 17 nt, Neisseria meningitidis Z2491
uucaaauucggaagaca

SEQ ID NO: 1388752 - RNA, 20 nt, Neisseria meningitidis Z2491
uucaaaugccgucugaagcc

SEQ ID NO: 1388753 - RNA, 19 nt, Neisseria meningitidis Z2491
uucaaauuuauuugaacga

SEQ ID NO: 1388754 - RNA, 14 nt, Neisseria meningitidis Z2491
uucaacggcacggc

SEQ ID NO: 1388755 - RNA, 16 nt, Neisseria meningitidis Z2491
uggcaaauugaaaugc

SEQ ID NO: 1388756 - RNA, 15 nt, Neisseria meningitidis Z2491
ugcguugaguuucag

SEQ ID NO: 1388757 - RNA, 11 nt, Neisseria meningitidis Z2491
uggauucccac

SEQ ID NO: 1388758 - RNA, 17 nt, Neisseria meningitidis Z2491
uggcaaccaaaaccgac

SEQ ID NO: 1388759 - RNA, 16 nt, Neisseria meningitidis Z2491
uggcaauuuuuuaaau

SEQ ID NO: 1388760 - RNA, 12 nt, Neisseria meningitidis Z2491
uggcagcaaaac

SEQ ID NO: 1388761 - RNA, 17 nt, Neisseria meningitidis Z2491
uggccgcuuucaacagg

SEQ ID NO: 1388762 - RNA, 19 nt, Neisseria meningitidis Z2491
uggccgcuuucaacagguu

SEQ ID NO: 1388763 - RNA, 14 nt, Neisseria meningitidis Z2491
uggcggcuccuccg

SEQ ID NO: 1388764 - RNA, 18 nt, Neisseria meningitidis Z2491
uggcggcaucccacggga

SEQ ID NO: 1388765 - RNA, 13 nt, Neisseria meningitidis Z2491
uggcggcaacaua

SEQ ID NO: 1388766 - RNA, 15 nt, Neisseria meningitidis Z2491
uggcgggaagccagg

SEQ ID NO: 1388767 - RNA, 18 nt, Neisseria meningitidis Z2491
ugguagggauacaaaucc

SEQ ID NO: 1388768 - RNA, 20 nt, Neisseria meningitidis Z2491
ugguaucuuuaaacagcaua

SEQ ID NO: 1388769 - RNA, 19 nt, Neisseria meningitidis Z2491
ugguaaugucggcauuuuc

SEQ ID NO: 1388770 - RNA, 24 nt, Neisseria meningitidis Z2491
uggguucggggaacugccaugugc

SEQ ID NO: 1388771 - RNA, 17 nt, Neisseria meningitidis Z2491
uggucaaccaauuuguu

SEQ ID NO: 1388772 - RNA, 20 nt, Neisseria meningitidis Z2491
uggcuuugcgcacucacuuu

SEQ ID NO: 1388773 - RNA, 15 nt, Neisseria meningitidis Z2491
uggcuuugaagccga

SEQ ID NO: 1388774 - RNA, 18 nt, Neisseria meningitidis Z2491
ugggauggcgggaaauaa

SEQ ID NO: 1388775 - RNA, 15 nt, Neisseria meningitidis Z2491
uggcuucuaaaaauu

SEQ ID NO: 1388776 - RNA, 23 nt, Neisseria meningitidis Z2491
uggcuucaauauacucaauagga

SEQ ID NO: 1388777 - RNA, 16 nt, Neisseria meningitidis Z2491
uggcgugcgaacaacc

SEQ ID NO: 1388778 - RNA, 13 nt, Neisseria meningitidis Z2491
uggggcgaaaaca

SEQ ID NO: 1388779 - RNA, 15 nt, Neisseria meningitidis Z2491
ugugggaaacuuuuc

SEQ ID NO: 1388780 - RNA, 22 nt, Neisseria meningitidis Z2491
ugugcuaugcaguugaguuuga

SEQ ID NO: 1388781 - RNA, 16 nt, Neisseria meningitidis Z2491
ugugcgguucggcuug

SEQ ID NO: 1388782 - RNA, 17 nt, Neisseria meningitidis Z2491
uguguggcgguuauugu

SEQ ID NO: 1388783 - RNA, 22 nt, Neisseria meningitidis Z2491
uguguggcgguuauugugcuuu

SEQ ID NO: 1388784 - RNA, 18 nt, Neisseria meningitidis Z2491
uguuaauccacuauaaaa

SEQ ID NO: 1388785 - RNA, 21 nt, Neisseria meningitidis Z2491
uguuaauccacuauaauuuuu

SEQ ID NO: 1388786 - RNA, 17 nt, Neisseria meningitidis Z2491
ugucuucaaaaaacaau

SEQ ID NO: 1388787 - RNA, 17 nt, Neisseria meningitidis Z2491
ugucuucaauuccugcg

SEQ ID NO: 1388788 - RNA, 21 nt, Neisseria meningitidis Z2491
ugugcgccacgccauuuguuc

SEQ ID NO: 1388789 - RNA, 23 nt, Neisseria meningitidis Z2491
ugugcggcaaaacgccuucuucg

SEQ ID NO: 1388790 - RNA, 13 nt, Neisseria meningitidis Z2491
ugugcgccgccgg

SEQ ID NO: 1388791 - RNA, 21 nt, Neisseria meningitidis Z2491
ugugcauuucuaauuuuuaua

SEQ ID NO: 1388792 - RNA, 13 nt, Neisseria meningitidis Z2491
ugugcaggcugcc

SEQ ID NO: 1388793 - RNA, 16 nt, Neisseria meningitidis Z2491
ugugcauaaggcacaa

SEQ ID NO: 1388794 - RNA, 14 nt, Neisseria meningitidis Z2491
uguccaaagccucg

SEQ ID NO: 1388795 - RNA, 17 nt, Neisseria meningitidis Z2491
ugucgcgggcggugcgc

SEQ ID NO: 1388796 - RNA, 19 nt, Neisseria meningitidis Z2491
uguaugccgucugaaaccu

SEQ ID NO: 1388797 - RNA, 13 nt, Neisseria meningitidis Z2491
ugucaaccaaaaa

SEQ ID NO: 1388798 - RNA, 15 nt, Neisseria meningitidis Z2491
ugucaaccaaaaaau

SEQ ID NO: 1388799 - RNA, 13 nt, Neisseria meningitidis Z2491
ugucaagaaacac

SEQ ID NO: 1388800 - RNA, 17 nt, Neisseria meningitidis Z2491
uguaggcguuggcauaa

SEQ ID NO: 1388801 - RNA, 20 nt, Neisseria meningitidis Z2491
uguagcggcuaccgaaaugg

SEQ ID NO: 1388802 - RNA, 12 nt, Neisseria meningitidis Z2491
uguauauaaucc

SEQ ID NO: 1388803 - RNA, 19 nt, Neisseria meningitidis Z2491
uguauaguggauuaaauuu

SEQ ID NO: 1388804 - RNA, 21 nt, Neisseria meningitidis Z2491
uguauaguggauuaaauuuaa

SEQ ID NO: 1388805 - RNA, 12 nt, Neisseria meningitidis Z2491
ugguuuugaggc

SEQ ID NO: 1388806 - RNA, 18 nt, Neisseria meningitidis Z2491
uguaaacagauaaaacca

SEQ ID NO: 1388807 - RNA, 19 nt, Neisseria meningitidis Z2491
uguaaacagauaaaaccaa

SEQ ID NO: 1388808 - RNA, 15 nt, Neisseria meningitidis Z2491
uguaacuuccacacc

SEQ ID NO: 1388809 - RNA, 14 nt, Neisseria meningitidis Z2491
uguaccgguuuaaa

SEQ ID NO: 1388810 - RNA, 22 nt, Neisseria meningitidis Z2491
uguacauugugguagcguugca

SEQ ID NO: 1388811 - RNA, 18 nt, Neisseria meningitidis Z2491
uguacgaauccgccggca

SEQ ID NO: 1388812 - RNA, 21 nt, Neisseria meningitidis Z2491
uguugucgcuucggauaaauu

SEQ ID NO: 1388813 - RNA, 18 nt, Neisseria meningitidis Z2491
uguuguauucauaaaaua

SEQ ID NO: 1388814 - RNA, 14 nt, Neisseria meningitidis Z2491
uguugcacaaacag

SEQ ID NO: 1388815 - RNA, 21 nt, Neisseria meningitidis Z2491
uguugaugccgucccugccgg

SEQ ID NO: 1388816 - RNA, 16 nt, Neisseria meningitidis Z2491
uguugaguucgggcgg

SEQ ID NO: 1388817 - RNA, 14 nt, Neisseria meningitidis Z2491
uguugccucgccuu

SEQ ID NO: 1388818 - RNA, 21 nt, Neisseria meningitidis Z2491
uguugcucccgauaaaugccg

SEQ ID NO: 1388819 - RNA, 12 nt, Neisseria meningitidis Z2491
uguuggaaaaac

SEQ ID NO: 1388820 - RNA, 14 nt, Neisseria meningitidis Z2491
uguugcuuuucauu

SEQ ID NO: 1388821 - RNA, 12 nt, Neisseria meningitidis Z2491
uguucuuucaca

SEQ ID NO: 1388822 - RNA, 19 nt, Neisseria meningitidis Z2491
uguucgauauuuuugaaga

SEQ ID NO: 1388823 - RNA, 19 nt, Neisseria meningitidis Z2491
uguuccgauaccaagucgu

SEQ ID NO: 1388824 - RNA, 17 nt, Neisseria meningitidis Z2491
uguuccaaaagccgccc

SEQ ID NO: 1388825 - RNA, 21 nt, Neisseria meningitidis Z2491
uguucauccacuauaacagca

SEQ ID NO: 1388826 - RNA, 14 nt, Neisseria meningitidis Z2491
uguuauuauuuucc

SEQ ID NO: 1388827 - RNA, 21 nt, Neisseria meningitidis Z2491
uguuauuuucacaaaaacaga

SEQ ID NO: 1388828 - RNA, 20 nt, Neisseria meningitidis Z2491
uguucagacggcauuuucua

SEQ ID NO: 1388829 - RNA, 20 nt, Neisseria meningitidis Z2491
uguucagacggcauuuugcc

SEQ ID NO: 1388830 - RNA, 12 nt, Neisseria meningitidis Z2491
uguuuugaaggu

SEQ ID NO: 1388831 - RNA, 23 nt, Neisseria meningitidis Z2491
uguuuuccugcccaaauccagca

SEQ ID NO: 1388832 - RNA, 21 nt, Neisseria meningitidis Z2491
uguuuucgcgcaauuccugca

SEQ ID NO: 1388833 - RNA, 18 nt, Neisseria meningitidis Z2491
uguuuuuuccgauaaauu

SEQ ID NO: 1388834 - RNA, 22 nt, Neisseria meningitidis Z2491
uguuuuuuccgauaaauuccua

SEQ ID NO: 1388835 - RNA, 19 nt, Neisseria meningitidis Z2491
uguuuuauauucugauuua

SEQ ID NO: 1388836 - RNA, 13 nt, Neisseria meningitidis Z2491
uguuuucagcugu

SEQ ID NO: 1388837 - RNA, 23 nt, Neisseria meningitidis Z2491
uguuuccacauugucggauuugu

SEQ ID NO: 1388838 - RNA, 15 nt, Neisseria meningitidis Z2491
uguuuaucuuuucuu

SEQ ID NO: 1388839 - RNA, 14 nt, Neisseria meningitidis Z2491
uguuucaaaauguu

SEQ ID NO: 1388840 - RNA, 22 nt, Neisseria meningitidis Z2491
uguuucaacaccgccgccaaca

SEQ ID NO: 1388841 - RNA, 20 nt, Neisseria meningitidis Z2491
uguuugcagauaaauuuucc

SEQ ID NO: 1388842 - RNA, 15 nt, Neisseria meningitidis Z2491
uguuucggauaaauu

SEQ ID NO: 1388843 - RNA, 16 nt, Neisseria meningitidis Z2491
uguuucggauaaauuu

SEQ ID NO: 1388844 - RNA, 14 nt, Neisseria meningitidis Z2491
uguuucgggcaaaa

SEQ ID NO: 1388845 - RNA, 20 nt, Neisseria meningitidis Z2491
uguuucgggcaaaagccagc

SEQ ID NO: 1388846 - RNA, 14 nt, Neisseria meningitidis Z2491
uuaaaaaacaaaca

SEQ ID NO: 1388847 - RNA, 15 nt, Neisseria meningitidis Z2491
uuaaaaauaccuaaa

SEQ ID NO: 1388848 - RNA, 13 nt, Neisseria meningitidis Z2491
uuaaaacaaaaau

SEQ ID NO: 1388849 - RNA, 18 nt, Neisseria meningitidis Z2491
uuaaaaauuccuguuuuu

SEQ ID NO: 1388850 - RNA, 13 nt, Neisseria meningitidis Z2491
uuaaaacagcauu

SEQ ID NO: 1388851 - RNA, 18 nt, Neisseria meningitidis Z2491
uuaaaauaaaaccgauaa

SEQ ID NO: 1388852 - RNA, 22 nt, Neisseria meningitidis Z2491
uuaaaauaaaaccgauaaacaa

SEQ ID NO: 1388853 - RNA, 23 nt, Neisseria meningitidis Z2491
uuaaacagcacugccucuuuuca

SEQ ID NO: 1388854 - RNA, 20 nt, Neisseria meningitidis Z2491
uuaaaauuuuuauauucaca

SEQ ID NO: 1388855 - RNA, 13 nt, Neisseria meningitidis Z2491
uuaaacucuuaaa

SEQ ID NO: 1388856 - RNA, 18 nt, Neisseria meningitidis Z2491
uuaaacucuuaaaacacg

SEQ ID NO: 1388857 - RNA, 12 nt, Neisseria meningitidis Z2491
uuaacaaaaauc

SEQ ID NO: 1388858 - RNA, 19 nt, Neisseria meningitidis Z2491
uuaacaaaaaucaggacaa

SEQ ID NO: 1388859 - RNA, 15 nt, Neisseria meningitidis Z2491
uuaaauuuaaaccag

SEQ ID NO: 1388860 - RNA, 12 nt, Neisseria meningitidis Z2491
uuaaauuuaauc

SEQ ID NO: 1388861 - RNA, 15 nt, Neisseria meningitidis Z2491
uuaaauuuaauccac

SEQ ID NO: 1388862 - RNA, 20 nt, Neisseria meningitidis Z2491
uuaaauuuaauccauuauaa

SEQ ID NO: 1388863 - RNA, 14 nt, Neisseria meningitidis Z2491
uuaaauuuaauccg

SEQ ID NO: 1388864 - RNA, 18 nt, Neisseria meningitidis Z2491
uuaaauaucugacaaaac

SEQ ID NO: 1388865 - RNA, 21 nt, Neisseria meningitidis Z2491
uuaaaggggugcguuuuauug

SEQ ID NO: 1388866 - RNA, 20 nt, Neisseria meningitidis Z2491
uuaaagugccauuuaaaauc

SEQ ID NO: 1388867 - RNA, 18 nt, Neisseria meningitidis Z2491
uuaaauaaaauuuaauuu

SEQ ID NO: 1388868 - RNA, 12 nt, Neisseria meningitidis Z2491
uuaaaguuucag

SEQ ID NO: 1388869 - RNA, 20 nt, Neisseria meningitidis Z2491
uuaaggugcgggauagaaug

SEQ ID NO: 1388870 - RNA, 21 nt, Neisseria meningitidis Z2491
uuaaggcuuauuucacuucca

SEQ ID NO: 1388871 - RNA, 15 nt, Neisseria meningitidis Z2491
uuaagaugaagucgu

SEQ ID NO: 1388872 - RNA, 21 nt, Neisseria meningitidis Z2491
uuagauugcaggcauuuaucg

SEQ ID NO: 1388873 - RNA, 20 nt, Neisseria meningitidis Z2491
uuagauuccacguucuagau

SEQ ID NO: 1388874 - RNA, 21 nt, Neisseria meningitidis Z2491
uuagauuccacguucuagauu

SEQ ID NO: 1388875 - RNA, 23 nt, Neisseria meningitidis Z2491
uuagaaaaaauauaccaaaaauu

SEQ ID NO: 1388876 - RNA, 19 nt, Neisseria meningitidis Z2491
uuacgccccucccaaauaa

SEQ ID NO: 1388877 - RNA, 16 nt, Neisseria meningitidis Z2491
uuaccguucaauuuca

SEQ ID NO: 1388878 - RNA, 17 nt, Neisseria meningitidis Z2491
uuaccugccguauuuau

SEQ ID NO: 1388879 - RNA, 18 nt, Neisseria meningitidis Z2491
uuacacggcgcggcuuug

SEQ ID NO: 1388880 - RNA, 15 nt, Neisseria meningitidis Z2491
uuacagaaauuuaua

SEQ ID NO: 1388881 - RNA, 13 nt, Neisseria meningitidis Z2491
uuacacaauuccc

SEQ ID NO: 1388882 - RNA, 18 nt, Neisseria meningitidis Z2491
uuaauccacuauaaaaac

SEQ ID NO: 1388883 - RNA, 14 nt, Neisseria meningitidis Z2491
uuaauccacuauau

SEQ ID NO: 1388884 - RNA, 17 nt, Neisseria meningitidis Z2491
uuaaucccgucauuccc

SEQ ID NO: 1388885 - RNA, 12 nt, Neisseria meningitidis Z2491
uuaauuucaaua

SEQ ID NO: 1388886 - RNA, 19 nt, Neisseria meningitidis Z2491
ucuagauucccacuuucgu

SEQ ID NO: 1388887 - RNA, 12 nt, Neisseria meningitidis Z2491
ucuagacauuca

SEQ ID NO: 1388888 - RNA, 18 nt, Neisseria meningitidis Z2491
ucuagacauucaaugcua

SEQ ID NO: 1388889 - RNA, 19 nt, Neisseria meningitidis Z2491
ucuagacauucaaugcuaa

SEQ ID NO: 1388890 - RNA, 14 nt, Neisseria meningitidis Z2491
ucuagauucccacu

SEQ ID NO: 1388891 - RNA, 12 nt, Neisseria meningitidis Z2491
ucuagaaaugaa

SEQ ID NO: 1388892 - RNA, 13 nt, Neisseria meningitidis Z2491
ucuagaaaugaaa

SEQ ID NO: 1388893 - RNA, 18 nt, Neisseria meningitidis Z2491
ucuagaaaugaaaaacga

SEQ ID NO: 1388894 - RNA, 20 nt, Neisseria meningitidis Z2491
ucuagaaacgcaaagcugca

SEQ ID NO: 1388895 - RNA, 20 nt, Neisseria meningitidis Z2491
ucuagaaacucaaagcugca

SEQ ID NO: 1388896 - RNA, 14 nt, Neisseria meningitidis Z2491
ucuagggaaaugcc

SEQ ID NO: 1388897 - RNA, 15 nt, Neisseria meningitidis Z2491
ucuagggaaaugccc

SEQ ID NO: 1388898 - RNA, 14 nt, Neisseria meningitidis Z2491
aaaugcagaauaag

SEQ ID NO: 1388899 - RNA, 17 nt, Neisseria meningitidis Z2491
aaaugcaaaacuuuucu

SEQ ID NO: 1388900 - RNA, 20 nt, Neisseria meningitidis Z2491
aaaugaugggcugaaauaga

SEQ ID NO: 1388901 - RNA, 20 nt, Neisseria meningitidis Z2491
ucuauaguggauuaacaaaa

SEQ ID NO: 1388902 - RNA, 22 nt, Neisseria meningitidis Z2491
ucuauaaagccuaaauacaaaa

SEQ ID NO: 1388903 - RNA, 16 nt, Neisseria meningitidis Z2491
aaaugccgucugaaaa

SEQ ID NO: 1388904 - RNA, 19 nt, Neisseria meningitidis Z2491
aaaugccgucugaaaggcu

SEQ ID NO: 1388905 - RNA, 15 nt, Neisseria meningitidis Z2491
aaaugccgucugaag

SEQ ID NO: 1388906 - RNA, 21 nt, Neisseria meningitidis Z2491
aaaugccgucugaagcccugu

SEQ ID NO: 1388907 - RNA, 22 nt, Neisseria meningitidis Z2491
aaaugccgucugaagccugaaa

SEQ ID NO: 1388908 - RNA, 22 nt, Neisseria meningitidis Z2491
aaaugccgucugaagccuucag

SEQ ID NO: 1388909 - RNA, 23 nt, Neisseria meningitidis Z2491
aaaugccgucuggaacuugaaaa

SEQ ID NO: 1388910 - RNA, 20 nt, Neisseria meningitidis Z2491
aaaugccuuauccagaaaau

SEQ ID NO: 1388911 - RNA, 18 nt, Neisseria meningitidis Z2491
aaaugccgcaaucucaaa

SEQ ID NO: 1388912 - RNA, 15 nt, Neisseria meningitidis Z2491
aaaugccgccagcca

SEQ ID NO: 1388913 - RNA, 17 nt, Neisseria meningitidis Z2491
ucucagggcuggcaaaa

SEQ ID NO: 1388914 - RNA, 15 nt, Neisseria meningitidis Z2491
ucucaaaaaaugccg

SEQ ID NO: 1388915 - RNA, 12 nt, Neisseria meningitidis Z2491
ucucaaaauauu

SEQ ID NO: 1388916 - RNA, 15 nt, Neisseria meningitidis Z2491
ucuauuucccggcaa

SEQ ID NO: 1388917 - RNA, 19 nt, Neisseria meningitidis Z2491
ucuauuuguucgauauuuu

SEQ ID NO: 1388918 - RNA, 14 nt, Neisseria meningitidis Z2491
ucuauuugauuuuc

SEQ ID NO: 1388919 - RNA, 16 nt, Neisseria meningitidis Z2491
aaaugacacaaagccu

SEQ ID NO: 1388920 - RNA, 21 nt, Neisseria meningitidis Z2491
aaaugacggaaacucaaaaaa

SEQ ID NO: 1388921 - RNA, 20 nt, Neisseria meningitidis Z2491
aaaugacugaaacucaaaaa

SEQ ID NO: 1388922 - RNA, 21 nt, Neisseria meningitidis Z2491
aaaugacugaaacucaaaaaa

SEQ ID NO: 1388923 - RNA, 21 nt, Neisseria meningitidis Z2491
aaaugacugaaacucaacgaa

SEQ ID NO: 1388924 - RNA, 19 nt, Neisseria meningitidis Z2491
aaaugacugaaauucaaaa

SEQ ID NO: 1388925 - RNA, 19 nt, Neisseria meningitidis Z2491
ucuaaauagcguuuuaauu

SEQ ID NO: 1388926 - RNA, 15 nt, Neisseria meningitidis Z2491
ucguuuuccuccgca

SEQ ID NO: 1388927 - RNA, 16 nt, Neisseria meningitidis Z2491
ucuaaacgguauucau

SEQ ID NO: 1388928 - RNA, 17 nt, Neisseria meningitidis Z2491
ucuaagauuuacagcga

SEQ ID NO: 1388929 - RNA, 23 nt, Neisseria meningitidis Z2491
aaaucuugccauucucacaaaaa

SEQ ID NO: 1388930 - RNA, 17 nt, Neisseria meningitidis Z2491
ucugcaucgccgcuuca

SEQ ID NO: 1388931 - RNA, 16 nt, Neisseria meningitidis Z2491
ucugcauuauuuggga

SEQ ID NO: 1388932 - RNA, 13 nt, Neisseria meningitidis Z2491
ucuggaaaccaaa

SEQ ID NO: 1388933 - RNA, 18 nt, Neisseria meningitidis Z2491
ucuggaaaccaaaaaaca

SEQ ID NO: 1388934 - RNA, 15 nt, Neisseria meningitidis Z2491
ucuguaacuuccaca

SEQ ID NO: 1388935 - RNA, 16 nt, Neisseria meningitidis Z2491
ucuguauuuguauagu

SEQ ID NO: 1388936 - RNA, 18 nt, Neisseria meningitidis Z2491
ucugucuccgccuguaug

SEQ ID NO: 1388937 - RNA, 16 nt, Neisseria meningitidis Z2491
ucugucucguuaagag

SEQ ID NO: 1388938 - RNA, 21 nt, Neisseria meningitidis Z2491
ucugucgucagcgauacaucu

SEQ ID NO: 1388939 - RNA, 15 nt, Neisseria meningitidis Z2491
ucugugguuuaacuu

SEQ ID NO: 1388940 - RNA, 19 nt, Neisseria meningitidis Z2491
ucuuccgucaaaaaugccu

SEQ ID NO: 1388941 - RNA, 23 nt, Neisseria meningitidis Z2491
ucuuccuaaccgaaaaaauaauu

SEQ ID NO: 1388942 - RNA, 12 nt, Neisseria meningitidis Z2491
ucuguuguuucg

SEQ ID NO: 1388943 - RNA, 22 nt, Neisseria meningitidis Z2491
ucuguuguuucggauaaauuuu

SEQ ID NO: 1388944 - RNA, 16 nt, Neisseria meningitidis Z2491
ucuuacgucauucuuu

SEQ ID NO: 1388945 - RNA, 16 nt, Neisseria meningitidis Z2491
ucugacgcguuuuacc

SEQ ID NO: 1388946 - RNA, 15 nt, Neisseria meningitidis Z2491
ucugaaacuuuaauu

SEQ ID NO: 1388947 - RNA, 13 nt, Neisseria meningitidis Z2491
ucugaaagguuuu

SEQ ID NO: 1388948 - RNA, 18 nt, Neisseria meningitidis Z2491
ucugaaacaaaauguuca

SEQ ID NO: 1388949 - RNA, 20 nt, Neisseria meningitidis Z2491
ucugaaacccgauuccuguu

SEQ ID NO: 1388950 - RNA, 23 nt, Neisseria meningitidis Z2491
ucugaaacccgauuccuguuuuc

SEQ ID NO: 1388951 - RNA, 12 nt, Neisseria meningitidis Z2491
ucugaaaccuga

SEQ ID NO: 1388952 - RNA, 18 nt, Neisseria meningitidis Z2491
ucugaaaccuuuuuuuac

SEQ ID NO: 1388953 - RNA, 14 nt, Neisseria meningitidis Z2491
ucugaaaagaugcc

SEQ ID NO: 1388954 - RNA, 15 nt, Neisseria meningitidis Z2491
ucugauaagcaagca

SEQ ID NO: 1388955 - RNA, 13 nt, Neisseria meningitidis Z2491
ucugcaagcagca

SEQ ID NO: 1388956 - RNA, 14 nt, Neisseria meningitidis Z2491
ucugcaagcagcag

SEQ ID NO: 1388957 - RNA, 15 nt, Neisseria meningitidis Z2491
ucucggacuuucaga

SEQ ID NO: 1388958 - RNA, 18 nt, Neisseria meningitidis Z2491
ucuccugaucuaaaaauu

SEQ ID NO: 1388959 - RNA, 15 nt, Neisseria meningitidis Z2491
ucuccgucauuccca

SEQ ID NO: 1388960 - RNA, 13 nt, Neisseria meningitidis Z2491
ucucgcgcaggcg

SEQ ID NO: 1388961 - RNA, 18 nt, Neisseria meningitidis Z2491
ucuccaaguuccaauaca

SEQ ID NO: 1388962 - RNA, 22 nt, Neisseria meningitidis Z2491
ucucauugguaaacaguuucag

SEQ ID NO: 1388963 - RNA, 22 nt, Neisseria meningitidis Z2491
ucucaugaucuucuuacccaau

SEQ ID NO: 1388964 - RNA, 14 nt, Neisseria meningitidis Z2491
ucguucggcagccu

SEQ ID NO: 1388965 - RNA, 16 nt, Neisseria meningitidis Z2491
ucguuacaaauuuaaa

SEQ ID NO: 1388966 - RNA, 14 nt, Neisseria meningitidis Z2491
ucguuauuuccaca

SEQ ID NO: 1388967 - RNA, 21 nt, Neisseria meningitidis Z2491
ucgucugaaaaauuuucagac

SEQ ID NO: 1388968 - RNA, 11 nt, Neisseria meningitidis Z2491
ucguaugaaac

SEQ ID NO: 1388969 - RNA, 15 nt, Neisseria meningitidis Z2491
ucguauccaaaucgc

SEQ ID NO: 1388970 - RNA, 18 nt, Neisseria meningitidis Z2491
ucguaggcuuuuuccaau

SEQ ID NO: 1388971 - RNA, 21 nt, Neisseria meningitidis Z2491
ucguagccgucgccccaaaaa

SEQ ID NO: 1388972 - RNA, 20 nt, Neisseria meningitidis Z2491
ucguauuuuuaucuuuuaau

SEQ ID NO: 1388973 - RNA, 20 nt, Neisseria meningitidis Z2491
ucguacacguccauacccaa

SEQ ID NO: 1388974 - RNA, 23 nt, Neisseria meningitidis Z2491
ucgucaugcaccugcauaaucag

SEQ ID NO: 1388975 - RNA, 13 nt, Neisseria meningitidis Z2491
ucgucauucccac

SEQ ID NO: 1388976 - RNA, 21 nt, Neisseria meningitidis Z2491
ucgucauucccgcaaaaacaa

SEQ ID NO: 1388977 - RNA, 22 nt, Neisseria meningitidis Z2491
ucggcuugagcgacagcggccg

SEQ ID NO: 1388978 - RNA, 11 nt, Neisseria meningitidis Z2491
ucgggaaaaau

SEQ ID NO: 1388979 - RNA, 14 nt, Neisseria meningitidis Z2491
ucggcguuuuucag

SEQ ID NO: 1388980 - RNA, 16 nt, Neisseria meningitidis Z2491
ucggccugcccugcca

SEQ ID NO: 1388981 - RNA, 11 nt, Neisseria meningitidis Z2491
ucgguuucccg

SEQ ID NO: 1388982 - RNA, 13 nt, Neisseria meningitidis Z2491
ucgguuucuucuu

SEQ ID NO: 1388983 - RNA, 14 nt, Neisseria meningitidis Z2491
ucgguuucuucuuc

SEQ ID NO: 1388984 - RNA, 18 nt, Neisseria meningitidis Z2491
ucgguuuucuauuuugca

SEQ ID NO: 1388985 - RNA, 11 nt, Neisseria meningitidis Z2491
ucggguacaac

SEQ ID NO: 1388986 - RNA, 15 nt, Neisseria meningitidis Z2491
ucgggguucucaucc

SEQ ID NO: 1388987 - RNA, 19 nt, Neisseria meningitidis Z2491
ucggggggggguauuugcu

SEQ ID NO: 1388988 - RNA, 22 nt, Neisseria meningitidis Z2491
ucgggcagcggcaauauucaaa

SEQ ID NO: 1388989 - RNA, 16 nt, Neisseria meningitidis Z2491
ucgggauucagauguu

SEQ ID NO: 1388990 - RNA, 15 nt, Neisseria meningitidis Z2491
ucgggcaaaagccag

SEQ ID NO: 1388991 - RNA, 20 nt, Neisseria meningitidis Z2491
ucgggcaaagcgucugccuc

SEQ ID NO: 1388992 - RNA, 12 nt, Neisseria meningitidis Z2491
ucggcaagaugg

SEQ ID NO: 1388993 - RNA, 22 nt, Neisseria meningitidis Z2491
ucggcaagauggggcaaguguc

SEQ ID NO: 1388994 - RNA, 20 nt, Neisseria meningitidis Z2491
ucggcaaucauuucugucug

SEQ ID NO: 1388995 - RNA, 21 nt, Neisseria meningitidis Z2491
ucggcaauuugacacuucaca

SEQ ID NO: 1388996 - RNA, 15 nt, Neisseria meningitidis Z2491
ucggauaggcaaaaa

SEQ ID NO: 1388997 - RNA, 13 nt, Neisseria meningitidis Z2491
ucggauaaauucc

SEQ ID NO: 1388998 - RNA, 13 nt, Neisseria meningitidis Z2491
ucggauaaauuuu

SEQ ID NO: 1388999 - RNA, 16 nt, Neisseria meningitidis Z2491
ucggauaaauuuugca

SEQ ID NO: 1389000 - RNA, 15 nt, Neisseria meningitidis Z2491
ucggcagucggucug

SEQ ID NO: 1389001 - RNA, 18 nt, Neisseria meningitidis Z2491
ucggcacgcgguuuugcg

SEQ ID NO: 1389002 - RNA, 14 nt, Neisseria meningitidis Z2491
ucggcauggccgac

SEQ ID NO: 1389003 - RNA, 20 nt, Neisseria meningitidis Z2491
ucggcauuuucguccuugcu

SEQ ID NO: 1389004 - RNA, 22 nt, Neisseria meningitidis Z2491
ucggacggcaucguaugaaaca

SEQ ID NO: 1389005 - RNA, 12 nt, Neisseria meningitidis Z2491
ucggacuaaacc

SEQ ID NO: 1389006 - RNA, 17 nt, Neisseria meningitidis Z2491
ucggagagacugugcca

SEQ ID NO: 1389007 - RNA, 20 nt, Neisseria meningitidis Z2491
ucggauaaaacagaaauuaa

SEQ ID NO: 1389008 - RNA, 21 nt, Neisseria meningitidis Z2491
ucggagugauuaucaccaccc

SEQ ID NO: 1389009 - RNA, 14 nt, Neisseria meningitidis Z2491
ucggaacagcauca

SEQ ID NO: 1389010 - RNA, 14 nt, Neisseria meningitidis Z2491
ucggaaaugacuga

SEQ ID NO: 1389011 - RNA, 18 nt, Neisseria meningitidis Z2491
ucggaaaugacugaaacu

SEQ ID NO: 1389012 - RNA, 16 nt, Neisseria meningitidis Z2491
ucgcuugauuuucggc

SEQ ID NO: 1389013 - RNA, 20 nt, Neisseria meningitidis Z2491
ucgcgguuguggaaggcggg

SEQ ID NO: 1389014 - RNA, 16 nt, Neisseria meningitidis Z2491
ucgcucugcgcgcuug

SEQ ID NO: 1389015 - RNA, 15 nt, Neisseria meningitidis Z2491
ucgccauaaucagcc

SEQ ID NO: 1389016 - RNA, 18 nt, Neisseria meningitidis Z2491
ucgccauaaucugcggca

SEQ ID NO: 1389017 - RNA, 12 nt, Neisseria meningitidis Z2491
uccauaccaaac

SEQ ID NO: 1389018 - RNA, 21 nt, Neisseria meningitidis Z2491
ucgccgacaucuucgaggaac

SEQ ID NO: 1389019 - RNA, 16 nt, Neisseria meningitidis Z2491
ucgccgugcgcgaaac

SEQ ID NO: 1389020 - RNA, 17 nt, Neisseria meningitidis Z2491
ucgccgucuuucaggaa

SEQ ID NO: 1389021 - RNA, 18 nt, Neisseria meningitidis Z2491
ucgccguaaccgacgaag

SEQ ID NO: 1389022 - RNA, 20 nt, Neisseria meningitidis Z2491
ucgccgguuucaucggcacg

SEQ ID NO: 1389023 - RNA, 19 nt, Neisseria meningitidis Z2491
ucgccuaucauauuuucag

SEQ ID NO: 1389024 - RNA, 11 nt, Neisseria meningitidis Z2491
ucgccgcuucu

SEQ ID NO: 1389025 - RNA, 12 nt, Neisseria meningitidis Z2491
ucgccgcuucuu

SEQ ID NO: 1389026 - RNA, 19 nt, Neisseria meningitidis Z2491
ucgccgccggaaagcugcc

SEQ ID NO: 1389027 - RNA, 14 nt, Neisseria meningitidis Z2491
ucgcgcccaaggcu

SEQ ID NO: 1389028 - RNA, 19 nt, Neisseria meningitidis Z2491
ucgccuuccgcuucuucca

SEQ ID NO: 1389029 - RNA, 20 nt, Neisseria meningitidis Z2491
ucgccuuccgcuucuuccag

SEQ ID NO: 1389030 - RNA, 13 nt, Neisseria meningitidis Z2491
ucgccuuguccug

SEQ ID NO: 1389031 - RNA, 19 nt, Neisseria meningitidis Z2491
ucgccuuguccugauuuuu

SEQ ID NO: 1389032 - RNA, 18 nt, Neisseria meningitidis Z2491
ugaacauuucagacggca

SEQ ID NO: 1389033 - RNA, 13 nt, Neisseria meningitidis Z2491
ugaaggucgucug

SEQ ID NO: 1389034 - RNA, 20 nt, Neisseria meningitidis Z2491
ugaagccgcuucagacggca

SEQ ID NO: 1389035 - RNA, 21 nt, Neisseria meningitidis Z2491
ugaagauggcugaaauucaaa

SEQ ID NO: 1389036 - RNA, 22 nt, Neisseria meningitidis Z2491
ugaauauuccgccgauguaaac

SEQ ID NO: 1389037 - RNA, 15 nt, Neisseria meningitidis Z2491
ugaauacaucauauu

SEQ ID NO: 1389038 - RNA, 21 nt, Neisseria meningitidis Z2491
ugaacacggguucagacggca

SEQ ID NO: 1389039 - RNA, 18 nt, Neisseria meningitidis Z2491
ugaacauggacaacagcg

SEQ ID NO: 1389040 - RNA, 17 nt, Neisseria meningitidis Z2491
ugaaaugccgucugaaa

SEQ ID NO: 1389041 - RNA, 21 nt, Neisseria meningitidis Z2491
ugaaauaugguucagacggca

SEQ ID NO: 1389042 - RNA, 20 nt, Neisseria meningitidis Z2491
ugaaaucaacagauuacuaa

SEQ ID NO: 1389043 - RNA, 22 nt, Neisseria meningitidis Z2491
ugaaaucaacagauuacuaaaa

SEQ ID NO: 1389044 - RNA, 18 nt, Neisseria meningitidis Z2491
ugaaauguucagacggca

SEQ ID NO: 1389045 - RNA, 21 nt, Neisseria meningitidis Z2491
ugaaauugaagcgucccaaau

SEQ ID NO: 1389046 - RNA, 15 nt, Neisseria meningitidis Z2491
ugaaauucaaaaaac

SEQ ID NO: 1389047 - RNA, 17 nt, Neisseria meningitidis Z2491
ugaaauucgucauuccc

SEQ ID NO: 1389048 - RNA, 21 nt, Neisseria meningitidis Z2491
ucuucgggaacggauuguuug

SEQ ID NO: 1389049 - RNA, 21 nt, Neisseria meningitidis Z2491
ucuucggcgcgcauauugccc

SEQ ID NO: 1389050 - RNA, 16 nt, Neisseria meningitidis Z2491
ucuucgucuuuuccuu

SEQ ID NO: 1389051 - RNA, 23 nt, Neisseria meningitidis Z2491
ugaaaccauaccgccuucaucaa

SEQ ID NO: 1389052 - RNA, 15 nt, Neisseria meningitidis Z2491
ugaaaccauuacaaa

SEQ ID NO: 1389053 - RNA, 20 nt, Neisseria meningitidis Z2491
ugaaaccauuacaaaugcuc

SEQ ID NO: 1389054 - RNA, 22 nt, Neisseria meningitidis Z2491
ugaaaccaaaucggcuuucaga

SEQ ID NO: 1389055 - RNA, 11 nt, Neisseria meningitidis Z2491
ucuucuaaaaa

SEQ ID NO: 1389056 - RNA, 21 nt, Neisseria meningitidis Z2491
ugaaaccggcuucagacggca

SEQ ID NO: 1389057 - RNA, 15 nt, Neisseria meningitidis Z2491
ugaaaccccauccuu

SEQ ID NO: 1389058 - RNA, 18 nt, Neisseria meningitidis Z2491
ugaaaccccuaaaggcuu

SEQ ID NO: 1389059 - RNA, 19 nt, Neisseria meningitidis Z2491
ugaaaccccuaaaggcuuc

SEQ ID NO: 1389060 - RNA, 19 nt, Neisseria meningitidis Z2491
ugaaacccgucauucccac

SEQ ID NO: 1389061 - RNA, 12 nt, Neisseria meningitidis Z2491
ugaaagagaaaa

SEQ ID NO: 1389062 - RNA, 13 nt, Neisseria meningitidis Z2491
ugaaagagaaaag

SEQ ID NO: 1389063 - RNA, 20 nt, Neisseria meningitidis Z2491
ugaaaggcuuucagacggca

SEQ ID NO: 1389064 - RNA, 22 nt, Neisseria meningitidis Z2491
ugaaaggcuuuuucagacggca

SEQ ID NO: 1389065 - RNA, 17 nt, Neisseria meningitidis Z2491
ugaaacuuuaauuuugu

SEQ ID NO: 1389066 - RNA, 17 nt, Neisseria meningitidis Z2491
ugacccacgccaaaccg

SEQ ID NO: 1389067 - RNA, 13 nt, Neisseria meningitidis Z2491
ugacacaaagccu

SEQ ID NO: 1389068 - RNA, 21 nt, Neisseria meningitidis Z2491
ugacaaauucccgccaucuaa

SEQ ID NO: 1389069 - RNA, 14 nt, Neisseria meningitidis Z2491
ugacagcauuucca

SEQ ID NO: 1389070 - RNA, 20 nt, Neisseria meningitidis Z2491
ugaaugucuagauucccgcc

SEQ ID NO: 1389071 - RNA, 19 nt, Neisseria meningitidis Z2491
ugaauuaaaugcuaaauau

SEQ ID NO: 1389072 - RNA, 12 nt, Neisseria meningitidis Z2491
ugaauuaaauuu

SEQ ID NO: 1389073 - RNA, 14 nt, Neisseria meningitidis Z2491
ugaauuaaauuuaa

SEQ ID NO: 1389074 - RNA, 16 nt, Neisseria meningitidis Z2491
ugaaugccuuucucug

SEQ ID NO: 1389075 - RNA, 16 nt, Neisseria meningitidis Z2491
ugaaugcgucggagaa

SEQ ID NO: 1389076 - RNA, 22 nt, Neisseria meningitidis Z2491
ugaaugcgucggagaaaaacaa

SEQ ID NO: 1389077 - RNA, 15 nt, Neisseria meningitidis Z2491
ugaaucugacuugcc

SEQ ID NO: 1389078 - RNA, 17 nt, Neisseria meningitidis Z2491
ugaaucagguugaaaau

SEQ ID NO: 1389079 - RNA, 16 nt, Neisseria meningitidis Z2491
ugauguguuucaacac

SEQ ID NO: 1389080 - RNA, 16 nt, Neisseria meningitidis Z2491
ugauuaaaacaaaaau

SEQ ID NO: 1389081 - RNA, 19 nt, Neisseria meningitidis Z2491
ugauuaaaacaaaaaugag

SEQ ID NO: 1389082 - RNA, 20 nt, Neisseria meningitidis Z2491
ugauucauaaaauauuugca

SEQ ID NO: 1389083 - RNA, 12 nt, Neisseria meningitidis Z2491
ugaugcacuggu

SEQ ID NO: 1389084 - RNA, 20 nt, Neisseria meningitidis Z2491
ugauggcugaugacggcagc

SEQ ID NO: 1389085 - RNA, 18 nt, Neisseria meningitidis Z2491
ugauggcuucuaaaaauu

SEQ ID NO: 1389086 - RNA, 21 nt, Neisseria meningitidis Z2491
ugauggcaacgaugauuacca

SEQ ID NO: 1389087 - RNA, 23 nt, Neisseria meningitidis Z2491
ugauauucccugucuuucaauau

SEQ ID NO: 1389088 - RNA, 19 nt, Neisseria meningitidis Z2491
ugauccaaaccguggaaca

SEQ ID NO: 1389089 - RNA, 14 nt, Neisseria meningitidis Z2491
ugaucauuucagga

SEQ ID NO: 1389090 - RNA, 20 nt, Neisseria meningitidis Z2491
ugaucuaaaaauucuaacuc

SEQ ID NO: 1389091 - RNA, 15 nt, Neisseria meningitidis Z2491
ugauacagccacgcc

SEQ ID NO: 1389092 - RNA, 20 nt, Neisseria meningitidis Z2491
ugauacagccacgccaaaaa

SEQ ID NO: 1389093 - RNA, 20 nt, Neisseria meningitidis Z2491
ugauaaugcccacaaucuga

SEQ ID NO: 1389094 - RNA, 18 nt, Neisseria meningitidis Z2491
ugauaaccgucaaauuga

SEQ ID NO: 1389095 - RNA, 16 nt, Neisseria meningitidis Z2491
ugaggcaauagaagcc

SEQ ID NO: 1389096 - RNA, 22 nt, Neisseria meningitidis Z2491
ugaguagcggugugcgccgccg

SEQ ID NO: 1389097 - RNA, 14 nt, Neisseria meningitidis Z2491
ugaggaugacggua

SEQ ID NO: 1389098 - RNA, 12 nt, Neisseria meningitidis Z2491
ugagcauaaaau

SEQ ID NO: 1389099 - RNA, 20 nt, Neisseria meningitidis Z2491
ugagcauagacgguguaaac

SEQ ID NO: 1389100 - RNA, 18 nt, Neisseria meningitidis Z2491
ugagcgacgaccauuucc

SEQ ID NO: 1389101 - RNA, 18 nt, Neisseria meningitidis Z2491
ugcggcaaaacgccuucu

SEQ ID NO: 1389102 - RNA, 13 nt, Neisseria meningitidis Z2491
ugcggcaaauuua

SEQ ID NO: 1389103 - RNA, 14 nt, Neisseria meningitidis Z2491
ugcgucaaaccagc

SEQ ID NO: 1389104 - RNA, 15 nt, Neisseria meningitidis Z2491
ugcgcccaaagcggu

SEQ ID NO: 1389105 - RNA, 19 nt, Neisseria meningitidis Z2491
ugcgcagguuguuggaaaa

SEQ ID NO: 1389106 - RNA, 12 nt, Neisseria meningitidis Z2491
ugcgcagccugc

SEQ ID NO: 1389107 - RNA, 16 nt, Neisseria meningitidis Z2491
ugccgaguuuuuggua

SEQ ID NO: 1389108 - RNA, 20 nt, Neisseria meningitidis Z2491
ugccgacccgaaucacaaac

SEQ ID NO: 1389109 - RNA, 23 nt, Neisseria meningitidis Z2491
ugcccugccaaaacucaaucaaa

SEQ ID NO: 1389110 - RNA, 16 nt, Neisseria meningitidis Z2491
ugccgcaccaccagcc

SEQ ID NO: 1389111 - RNA, 18 nt, Neisseria meningitidis Z2491
ugccgcaaacggcaggca

SEQ ID NO: 1389112 - RNA, 21 nt, Neisseria meningitidis Z2491
ugccgcauaaaucaacagcag

SEQ ID NO: 1389113 - RNA, 23 nt, Neisseria meningitidis Z2491
ugccgcauaaaucaacagcagaa

SEQ ID NO: 1389114 - RNA, 13 nt, Neisseria meningitidis Z2491
ugccgaugagucc

SEQ ID NO: 1389115 - RNA, 16 nt, Neisseria meningitidis Z2491
ugccgaugucggccaa

SEQ ID NO: 1389116 - RNA, 22 nt, Neisseria meningitidis Z2491
ugccgccaaagugccaaaugua

SEQ ID NO: 1389117 - RNA, 14 nt, Neisseria meningitidis Z2491
ugccgccagccacc

SEQ ID NO: 1389118 - RNA, 22 nt, Neisseria meningitidis Z2491
ugccgccgccaugucgcgggcg

SEQ ID NO: 1389119 - RNA, 23 nt, Neisseria meningitidis Z2491
ugccgccgaaagucgagccaugc

SEQ ID NO: 1389120 - RNA, 14 nt, Neisseria meningitidis Z2491
ugccguccgaacag

SEQ ID NO: 1389121 - RNA, 15 nt, Neisseria meningitidis Z2491
ugccuauuuuuuaau

SEQ ID NO: 1389122 - RNA, 14 nt, Neisseria meningitidis Z2491
ugccuagaggaaug

SEQ ID NO: 1389123 - RNA, 15 nt, Neisseria meningitidis Z2491
ugccuacgccgaugg

SEQ ID NO: 1389124 - RNA, 18 nt, Neisseria meningitidis Z2491
ugccuacgccgaugggca

SEQ ID NO: 1389125 - RNA, 13 nt, Neisseria meningitidis Z2491
ugccguuuuccuu

SEQ ID NO: 1389126 - RNA, 20 nt, Neisseria meningitidis Z2491
ugccguguuggguucuagau

SEQ ID NO: 1389127 - RNA, 22 nt, Neisseria meningitidis Z2491
ugccgugugcgcggacacgguu

SEQ ID NO: 1389128 - RNA, 18 nt, Neisseria meningitidis Z2491
ugccgcuugaccgcagcc

SEQ ID NO: 1389129 - RNA, 14 nt, Neisseria meningitidis Z2491
ugccggaaauaccg

SEQ ID NO: 1389130 - RNA, 21 nt, Neisseria meningitidis Z2491
ugccgcgauuccggcgcggcg

SEQ ID NO: 1389131 - RNA, 18 nt, Neisseria meningitidis Z2491
ugccgccugccuguuuuu

SEQ ID NO: 1389132 - RNA, 23 nt, Neisseria meningitidis Z2491
ugccgccgucuugggaaaugccg

SEQ ID NO: 1389133 - RNA, 18 nt, Neisseria meningitidis Z2491
ugccccacauaaacagca

SEQ ID NO: 1389134 - RNA, 20 nt, Neisseria meningitidis Z2491
ugccccacauaaacagcacg

SEQ ID NO: 1389135 - RNA, 15 nt, Neisseria meningitidis Z2491
ugcccauccgccuuc

SEQ ID NO: 1389136 - RNA, 17 nt, Neisseria meningitidis Z2491
ugcccgcaaucugaaau

SEQ ID NO: 1389137 - RNA, 23 nt, Neisseria meningitidis Z2491
ugcccgaugccgccaucaguucg

SEQ ID NO: 1389138 - RNA, 14 nt, Neisseria meningitidis Z2491
ugcccgacugugcc

SEQ ID NO: 1389139 - RNA, 17 nt, Neisseria meningitidis Z2491
ugcccgccuucaguacg

SEQ ID NO: 1389140 - RNA, 16 nt, Neisseria meningitidis Z2491
ugccagccugcccauc

SEQ ID NO: 1389141 - RNA, 16 nt, Neisseria meningitidis Z2491
ugccagccgccgagca

SEQ ID NO: 1389142 - RNA, 14 nt, Neisseria meningitidis Z2491
ugccagcuccgcca

SEQ ID NO: 1389143 - RNA, 22 nt, Neisseria meningitidis Z2491
ugccagucuuuaaauucaacuu

SEQ ID NO: 1389144 - RNA, 12 nt, Neisseria meningitidis Z2491
ugccaucaggac

SEQ ID NO: 1389145 - RNA, 19 nt, Neisseria meningitidis Z2491
ugcccaacagcagcauaac

SEQ ID NO: 1389146 - RNA, 12 nt, Neisseria meningitidis Z2491
ugcccacacguu

SEQ ID NO: 1389147 - RNA, 20 nt, Neisseria meningitidis Z2491
ugccauucuugcaaaauaga

SEQ ID NO: 1389148 - RNA, 19 nt, Neisseria meningitidis Z2491
ugccauggauuauauuugu

SEQ ID NO: 1389149 - RNA, 17 nt, Neisseria meningitidis Z2491
ugccaugugccuuguuu

SEQ ID NO: 1389150 - RNA, 23 nt, Neisseria meningitidis Z2491
ugccagcacucucuggggcggga

SEQ ID NO: 1389151 - RNA, 12 nt, Neisseria meningitidis Z2491
ugccacuugguc

SEQ ID NO: 1389152 - RNA, 23 nt, Neisseria meningitidis Z2491
ugcauuuuuaauuucuucuauca

SEQ ID NO: 1389153 - RNA, 23 nt, Neisseria meningitidis Z2491
ugccacaauauaaucaaacucac

SEQ ID NO: 1389154 - RNA, 17 nt, Neisseria meningitidis Z2491
ugcaggcguaugccuuu

SEQ ID NO: 1389155 - RNA, 15 nt, Neisseria meningitidis Z2491
ugcaggcugccgcac

SEQ ID NO: 1389156 - RNA, 18 nt, Neisseria meningitidis Z2491
ugcagggugucgcaaggu

SEQ ID NO: 1389157 - RNA, 22 nt, Neisseria meningitidis Z2491
ugcaugaugccgaacaggcguu

SEQ ID NO: 1389158 - RNA, 14 nt, Neisseria meningitidis Z2491
ugcaucgaccaguu

SEQ ID NO: 1389159 - RNA, 21 nt, Neisseria meningitidis Z2491
ugcaucgccgcuucaucuuua

SEQ ID NO: 1389160 - RNA, 15 nt, Neisseria meningitidis Z2491
ugcauccgacaggca

SEQ ID NO: 1389161 - RNA, 12 nt, Neisseria meningitidis Z2491
ugcaucccguca

SEQ ID NO: 1389162 - RNA, 21 nt, Neisseria meningitidis Z2491
ugcagcauauguuugcugcug

SEQ ID NO: 1389163 - RNA, 14 nt, Neisseria meningitidis Z2491
ugcagauaaauuuu

SEQ ID NO: 1389164 - RNA, 22 nt, Neisseria meningitidis Z2491
ugcaggaucuuauccaucccau

SEQ ID NO: 1389165 - RNA, 19 nt, Neisseria meningitidis Z2491
ugcacgcgcuucaaaucgu

SEQ ID NO: 1389166 - RNA, 22 nt, Neisseria meningitidis Z2491
ugcagaaagcuuccaacucggc

SEQ ID NO: 1389167 - RNA, 15 nt, Neisseria meningitidis Z2491
ugcaccgcgucauuc

SEQ ID NO: 1389168 - RNA, 19 nt, Neisseria meningitidis Z2491
ugcaccgcgucauucccac

SEQ ID NO: 1389169 - RNA, 13 nt, Neisseria meningitidis Z2491
uccacaaaaaaca

SEQ ID NO: 1389170 - RNA, 23 nt, Neisseria meningitidis Z2491
uccaaaugaauguggucguucaa

SEQ ID NO: 1389171 - RNA, 20 nt, Neisseria meningitidis Z2491
uccaaagucagggcggacgc

SEQ ID NO: 1389172 - RNA, 14 nt, Neisseria meningitidis Z2491
uccacaucguucaa

SEQ ID NO: 1389173 - RNA, 17 nt, Neisseria meningitidis Z2491
uccacauuuggaaaugu

SEQ ID NO: 1389174 - RNA, 15 nt, Neisseria meningitidis Z2491
uccacuauaaaaaau

SEQ ID NO: 1389175 - RNA, 14 nt, Neisseria meningitidis Z2491
uccacuauaaaagg

SEQ ID NO: 1389176 - RNA, 17 nt, Neisseria meningitidis Z2491
uccacuauaacagcaac

SEQ ID NO: 1389177 - RNA, 19 nt, Neisseria meningitidis Z2491
uccacuauacuauaggaac

SEQ ID NO: 1389178 - RNA, 17 nt, Neisseria meningitidis Z2491
uccacuauaucagacgg

SEQ ID NO: 1389179 - RNA, 14 nt, Neisseria meningitidis Z2491
uccacuauauuuuc

SEQ ID NO: 1389180 - RNA, 21 nt, Neisseria meningitidis Z2491
uccaccugaacggcacaaacg

SEQ ID NO: 1389181 - RNA, 13 nt, Neisseria meningitidis Z2491
ucaucucuucuau

SEQ ID NO: 1389182 - RNA, 20 nt, Neisseria meningitidis Z2491
ucaucguauuuuuaucuuuu

SEQ ID NO: 1389183 - RNA, 15 nt, Neisseria meningitidis Z2491
ucaucuaaauguuua

SEQ ID NO: 1389184 - RNA, 14 nt, Neisseria meningitidis Z2491
ucaucuuauuuauu

SEQ ID NO: 1389185 - RNA, 13 nt, Neisseria meningitidis Z2491
ucaugcccaaaag

SEQ ID NO: 1389186 - RNA, 21 nt, Neisseria meningitidis Z2491
ucaugcggcgggcuuggaaau

SEQ ID NO: 1389187 - RNA, 23 nt, Neisseria meningitidis Z2491
uccaaaacggcggcagccugaaa

SEQ ID NO: 1389188 - RNA, 14 nt, Neisseria meningitidis Z2491
ucauuuuuggcuug

SEQ ID NO: 1389189 - RNA, 15 nt, Neisseria meningitidis Z2491
ucauuuuuggcuuga

SEQ ID NO: 1389190 - RNA, 18 nt, Neisseria meningitidis Z2491
ucauuuuuguauaaauuu

SEQ ID NO: 1389191 - RNA, 16 nt, Neisseria meningitidis Z2491
ucauuuccgauaaauu

SEQ ID NO: 1389192 - RNA, 18 nt, Neisseria meningitidis Z2491
ucauuuccgauaaauucc

SEQ ID NO: 1389193 - RNA, 18 nt, Neisseria meningitidis Z2491
ucauuuccgauaaauucu

SEQ ID NO: 1389194 - RNA, 19 nt, Neisseria meningitidis Z2491
ucauugcuuacaauccgcu

SEQ ID NO: 1389195 - RNA, 21 nt, Neisseria meningitidis Z2491
ucauugguaaacaguuucagc

SEQ ID NO: 1389196 - RNA, 20 nt, Neisseria meningitidis Z2491
ucauugcgggaauagcucag

SEQ ID NO: 1389197 - RNA, 15 nt, Neisseria meningitidis Z2491
ucagcuguuuucagc

SEQ ID NO: 1389198 - RNA, 19 nt, Neisseria meningitidis Z2491
ucagcuauuuagaauaaau

SEQ ID NO: 1389199 - RNA, 16 nt, Neisseria meningitidis Z2491
ucagguugaaaaugcc

SEQ ID NO: 1389200 - RNA, 22 nt, Neisseria meningitidis Z2491
ucaggggauuauuuauuuugaa

SEQ ID NO: 1389201 - RNA, 19 nt, Neisseria meningitidis Z2491
ucagggcugcaaaauuuau

SEQ ID NO: 1389202 - RNA, 16 nt, Neisseria meningitidis Z2491
ucaggcaaauuucagu

SEQ ID NO: 1389203 - RNA, 15 nt, Neisseria meningitidis Z2491
ucaggauguuuucgg

SEQ ID NO: 1389204 - RNA, 22 nt, Neisseria meningitidis Z2491
ucauaaaaucuauuauucgcua

SEQ ID NO: 1389205 - RNA, 21 nt, Neisseria meningitidis Z2491
ucaguauuuuacaaucagaau

SEQ ID NO: 1389206 - RNA, 18 nt, Neisseria meningitidis Z2491
ucagucggacaaaaugcc

SEQ ID NO: 1389207 - RNA, 15 nt, Neisseria meningitidis Z2491
ucauccaccagcccg

SEQ ID NO: 1389208 - RNA, 16 nt, Neisseria meningitidis Z2491
ucauccaccagcccgc

SEQ ID NO: 1389209 - RNA, 14 nt, Neisseria meningitidis Z2491
ucaucauucccaca

SEQ ID NO: 1389210 - RNA, 20 nt, Neisseria meningitidis Z2491
ucaucaucggcguaauaaua

SEQ ID NO: 1389211 - RNA, 20 nt, Neisseria meningitidis Z2491
ucaucagauugauaaaagca

SEQ ID NO: 1389212 - RNA, 17 nt, Neisseria meningitidis Z2491
ucauccugcuuuaauuc

SEQ ID NO: 1389213 - RNA, 15 nt, Neisseria meningitidis Z2491
ucaucccaaacaucg

SEQ ID NO: 1389214 - RNA, 13 nt, Neisseria meningitidis Z2491
ucaucgcgcugcc

SEQ ID NO: 1389215 - RNA, 21 nt, Neisseria meningitidis Z2491
ucaucggaaacagcauccuuu

SEQ ID NO: 1389216 - RNA, 16 nt, Neisseria meningitidis Z2491
ucaucacauaaauccg

SEQ ID NO: 1389217 - RNA, 15 nt, Neisseria meningitidis Z2491
ucauagaaaucagcg

SEQ ID NO: 1389218 - RNA, 17 nt, Neisseria meningitidis Z2491
ucauacauagcaggcau

SEQ ID NO: 1389219 - RNA, 17 nt, Neisseria meningitidis Z2491
ucauacgacucaaaauc

SEQ ID NO: 1389220 - RNA, 18 nt, Neisseria meningitidis Z2491
ucacuaaauugcauuuuu

SEQ ID NO: 1389221 - RNA, 17 nt, Neisseria meningitidis Z2491
ucacgccuuuccccuuc

SEQ ID NO: 1389222 - RNA, 21 nt, Neisseria meningitidis Z2491
ucacgcugccggcaaauucca

SEQ ID NO: 1389223 - RNA, 15 nt, Neisseria meningitidis Z2491
ucacggugaaaaaug

SEQ ID NO: 1389224 - RNA, 16 nt, Neisseria meningitidis Z2491
ucacgacuucagcagu

SEQ ID NO: 1389225 - RNA, 19 nt, Neisseria meningitidis Z2491
ucacgaguccaagacaggc

SEQ ID NO: 1389226 - RNA, 18 nt, Neisseria meningitidis Z2491
ucaccgacaaucaggccg

SEQ ID NO: 1389227 - RNA, 15 nt, Neisseria meningitidis Z2491
ucacacguucgcagg

SEQ ID NO: 1389228 - RNA, 18 nt, Neisseria meningitidis Z2491
ucacacguucgcaggcuu

SEQ ID NO: 1389229 - RNA, 20 nt, Neisseria meningitidis Z2491
ucacauuuucuauuugauuu

SEQ ID NO: 1389230 - RNA, 22 nt, Neisseria meningitidis Z2491
ucacauuuucuauuugauuuuc

SEQ ID NO: 1389231 - RNA, 18 nt, Neisseria meningitidis Z2491
ucacaauauagccgcccc

SEQ ID NO: 1389232 - RNA, 18 nt, Neisseria meningitidis Z2491
ucacaacggcguuuucaa

SEQ ID NO: 1389233 - RNA, 20 nt, Neisseria meningitidis Z2491
ucaaucuuauuuucaaaaug

SEQ ID NO: 1389234 - RNA, 13 nt, Neisseria meningitidis Z2491
ucaaugcuaaggc

SEQ ID NO: 1389235 - RNA, 14 nt, Neisseria meningitidis Z2491
ucaaugaaaauuug

SEQ ID NO: 1389236 - RNA, 16 nt, Neisseria meningitidis Z2491
ucaaucccguugccaa

SEQ ID NO: 1389237 - RNA, 16 nt, Neisseria meningitidis Z2491
ucaagucuuccgguuc

SEQ ID NO: 1389238 - RNA, 13 nt, Neisseria meningitidis Z2491
ucaauauuaggaa

SEQ ID NO: 1389239 - RNA, 11 nt, Neisseria meningitidis Z2491
ucaagcagcaa

SEQ ID NO: 1389240 - RNA, 21 nt, Neisseria meningitidis Z2491
ucaagcacagccuauuuuucu

SEQ ID NO: 1389241 - RNA, 13 nt, Neisseria meningitidis Z2491
ucaagcaaaucua

SEQ ID NO: 1389242 - RNA, 19 nt, Neisseria meningitidis Z2491
ucaagcaaaucuaaauagc

SEQ ID NO: 1389243 - RNA, 17 nt, Neisseria meningitidis Z2491
ucaaaucccgucauucc

SEQ ID NO: 1389244 - RNA, 18 nt, Neisseria meningitidis Z2491
ucaagacaaucaaaguca

SEQ ID NO: 1389245 - RNA, 11 nt, Neisseria meningitidis Z2491
ucaagaacagg

SEQ ID NO: 1389246 - RNA, 16 nt, Neisseria meningitidis Z2491
uauuaccgguauuuuu

SEQ ID NO: 1389247 - RNA, 21 nt, Neisseria meningitidis Z2491
uauuaccgguauuuuuuucuu

SEQ ID NO: 1389248 - RNA, 19 nt, Neisseria meningitidis Z2491
uauuacuguuguucuaagg

SEQ ID NO: 1389249 - RNA, 14 nt, Neisseria meningitidis Z2491
uauccgacugugcc

SEQ ID NO: 1389250 - RNA, 22 nt, Neisseria meningitidis Z2491
uauccgaccagagcggcauuuc

SEQ ID NO: 1389251 - RNA, 14 nt, Neisseria meningitidis Z2491
uauccgaagcgaca

SEQ ID NO: 1389252 - RNA, 14 nt, Neisseria meningitidis Z2491
uauccgaaacaaca

SEQ ID NO: 1389253 - RNA, 15 nt, Neisseria meningitidis Z2491
uauccgaaacaacaa

SEQ ID NO: 1389254 - RNA, 20 nt, Neisseria meningitidis Z2491
uauccgcacacgaacugccu

SEQ ID NO: 1389255 - RNA, 21 nt, Neisseria meningitidis Z2491
uauccgcacacgaacugccuc

SEQ ID NO: 1389256 - RNA, 22 nt, Neisseria meningitidis Z2491
uauuagaaccgaacacagacau

SEQ ID NO: 1389257 - RNA, 15 nt, Neisseria meningitidis Z2491
uauuaggaagguuuu

SEQ ID NO: 1389258 - RNA, 12 nt, Neisseria meningitidis Z2491
uauucggaugua

SEQ ID NO: 1389259 - RNA, 15 nt, Neisseria meningitidis Z2491
uauucgaccagcucc

SEQ ID NO: 1389260 - RNA, 16 nt, Neisseria meningitidis Z2491
uauucacuaaauugca

SEQ ID NO: 1389261 - RNA, 20 nt, Neisseria meningitidis Z2491
uauucaagcaaaucuaaaua

SEQ ID NO: 1389262 - RNA, 16 nt, Neisseria meningitidis Z2491
uauucauacacagcca

SEQ ID NO: 1389263 - RNA, 16 nt, Neisseria meningitidis Z2491
uauucagguaaaacaa

SEQ ID NO: 1389264 - RNA, 23 nt, Neisseria meningitidis Z2491
uauucagguaaaacaaagacauc

SEQ ID NO: 1389265 - RNA, 22 nt, Neisseria meningitidis Z2491
uauugcccaacagcagcauaac

SEQ ID NO: 1389266 - RNA, 18 nt, Neisseria meningitidis Z2491
uauugagaccuuugcaau

SEQ ID NO: 1389267 - RNA, 18 nt, Neisseria meningitidis Z2491
uauuuaaaaauuccuguu

SEQ ID NO: 1389268 - RNA, 18 nt, Neisseria meningitidis Z2491
uauuuaaacagcaaucca

SEQ ID NO: 1389269 - RNA, 12 nt, Neisseria meningitidis Z2491
uauuuaaauaaa

SEQ ID NO: 1389270 - RNA, 14 nt, Neisseria meningitidis Z2491
uauuuaaauaaaau

SEQ ID NO: 1389271 - RNA, 18 nt, Neisseria meningitidis Z2491
uauuuaaagcaucagcac

SEQ ID NO: 1389272 - RNA, 22 nt, Neisseria meningitidis Z2491
uauuuaaagcaucagcacacuu

SEQ ID NO: 1389273 - RNA, 18 nt, Neisseria meningitidis Z2491
uauuuaccagaaaaaaca

SEQ ID NO: 1389274 - RNA, 21 nt, Neisseria meningitidis Z2491
uauuuaccagaaaaaacagaa

SEQ ID NO: 1389275 - RNA, 11 nt, Neisseria meningitidis Z2491
uauuuaugaac

SEQ ID NO: 1389276 - RNA, 15 nt, Neisseria meningitidis Z2491
uauuucuauuuuuua

SEQ ID NO: 1389277 - RNA, 23 nt, Neisseria meningitidis Z2491
uauuucccggcaaacuauaucua

SEQ ID NO: 1389278 - RNA, 14 nt, Neisseria meningitidis Z2491
uauuuccucacugc

SEQ ID NO: 1389279 - RNA, 17 nt, Neisseria meningitidis Z2491
uauuuggggcgaaaaca

SEQ ID NO: 1389280 - RNA, 18 nt, Neisseria meningitidis Z2491
uauuuggggcgaaaacag

SEQ ID NO: 1389281 - RNA, 19 nt, Neisseria meningitidis Z2491
uauuuggggcgaaaacagc

SEQ ID NO: 1389282 - RNA, 23 nt, Neisseria meningitidis Z2491
uauuugccggucggcuggcugua

SEQ ID NO: 1389283 - RNA, 12 nt, Neisseria meningitidis Z2491
uauuugaacgau

SEQ ID NO: 1389284 - RNA, 22 nt, Neisseria meningitidis Z2491
uauuugagugcggcaagcagcg

SEQ ID NO: 1389285 - RNA, 12 nt, Neisseria meningitidis Z2491
uauuuugugcag

SEQ ID NO: 1389286 - RNA, 16 nt, Neisseria meningitidis Z2491
uauuuucgccccaaau

SEQ ID NO: 1389287 - RNA, 17 nt, Neisseria meningitidis Z2491
uauuuuccauaaaauac

SEQ ID NO: 1389288 - RNA, 20 nt, Neisseria meningitidis Z2491
uauuuucacaaaaacagaaa

SEQ ID NO: 1389289 - RNA, 22 nt, Neisseria meningitidis Z2491
uauuuucagauggccuuuacuc

SEQ ID NO: 1389290 - RNA, 16 nt, Neisseria meningitidis Z2491
uauuuguucaaauauc

SEQ ID NO: 1389291 - RNA, 17 nt, Neisseria meningitidis Z2491
uauuuguucgauauuuu

SEQ ID NO: 1389292 - RNA, 18 nt, Neisseria meningitidis Z2491
uauuuguucgauauuuuu

SEQ ID NO: 1389293 - RNA, 20 nt, Neisseria meningitidis Z2491
uauuuuacagcggauuaaaa

SEQ ID NO: 1389294 - RNA, 21 nt, Neisseria meningitidis Z2491
uauuuuacagcggauuaaaau

SEQ ID NO: 1389295 - RNA, 23 nt, Neisseria meningitidis Z2491
ucaaaaaauaaaguaauucggcu

SEQ ID NO: 1389296 - RNA, 10 nt, Neisseria meningitidis Z2491
ucaaaaacac

SEQ ID NO: 1389297 - RNA, 13 nt, Neisseria meningitidis Z2491
ucaaaaacacaaa

SEQ ID NO: 1389298 - RNA, 12 nt, Neisseria meningitidis Z2491
ucaaaaaugccu

SEQ ID NO: 1389299 - RNA, 20 nt, Neisseria meningitidis Z2491
ucaaaacaagcgauuauuuu

SEQ ID NO: 1389300 - RNA, 15 nt, Neisseria meningitidis Z2491
ucaaaagguucaaac

SEQ ID NO: 1389301 - RNA, 21 nt, Neisseria meningitidis Z2491
ucaaaaccgcaccgggcuuca

SEQ ID NO: 1389302 - RNA, 12 nt, Neisseria meningitidis Z2491
uauuuuugcaaa

SEQ ID NO: 1389303 - RNA, 16 nt, Neisseria meningitidis Z2491
uauuuuugaagacauc

SEQ ID NO: 1389304 - RNA, 17 nt, Neisseria meningitidis Z2491
ucaaaccgucgccgaac

SEQ ID NO: 1389305 - RNA, 15 nt, Neisseria meningitidis Z2491
ucaaaccucauucaa

SEQ ID NO: 1389306 - RNA, 21 nt, Neisseria meningitidis Z2491
ucaaacgguacaggaaaguag

SEQ ID NO: 1389307 - RNA, 23 nt, Neisseria meningitidis Z2491
ucaaacccuccgccucugccagc

SEQ ID NO: 1389308 - RNA, 16 nt, Neisseria meningitidis Z2491
ucaaaauauuaaucag

SEQ ID NO: 1389309 - RNA, 17 nt, Neisseria meningitidis Z2491
ucaaauaaauucugaaa

SEQ ID NO: 1389310 - RNA, 18 nt, Neisseria meningitidis Z2491
uacagauaguacugcaag

SEQ ID NO: 1389311 - RNA, 19 nt, Neisseria meningitidis Z2491
uacagauaguacugcaagg

SEQ ID NO: 1389312 - RNA, 22 nt, Neisseria meningitidis Z2491
uacagauaguacugcaaggcga

SEQ ID NO: 1389313 - RNA, 13 nt, Neisseria meningitidis Z2491
uacacuuaaaaau

SEQ ID NO: 1389314 - RNA, 17 nt, Neisseria meningitidis Z2491
uacagaaccgauucacu

SEQ ID NO: 1389315 - RNA, 22 nt, Neisseria meningitidis Z2491
uacagaaauuuauaaacaaaaa

SEQ ID NO: 1389316 - RNA, 14 nt, Neisseria meningitidis Z2491
uacacggcagcacu

SEQ ID NO: 1389317 - RNA, 18 nt, Neisseria meningitidis Z2491
uacacguccauacccaau

SEQ ID NO: 1389318 - RNA, 17 nt, Neisseria meningitidis Z2491
uacacaagguuauuuuc

SEQ ID NO: 1389319 - RNA, 21 nt, Neisseria meningitidis Z2491
uacaaucagaauacugccugu

SEQ ID NO: 1389320 - RNA, 13 nt, Neisseria meningitidis Z2491
uacaaccaaugcg

SEQ ID NO: 1389321 - RNA, 23 nt, Neisseria meningitidis Z2491
uacauauugagaccuuugcaaua

SEQ ID NO: 1389322 - RNA, 18 nt, Neisseria meningitidis Z2491
uacagccacgccaaaaau

SEQ ID NO: 1389323 - RNA, 14 nt, Neisseria meningitidis Z2491
uaauugucuuuucc

SEQ ID NO: 1389324 - RNA, 23 nt, Neisseria meningitidis Z2491
uaauucggcaauuugacacuuca

SEQ ID NO: 1389325 - RNA, 19 nt, Neisseria meningitidis Z2491
uaauucuacccaaauaccc

SEQ ID NO: 1389326 - RNA, 22 nt, Neisseria meningitidis Z2491
uaauuauaguggauuaacaaaa

SEQ ID NO: 1389327 - RNA, 17 nt, Neisseria meningitidis Z2491
uaauucaaaugcgccuu

SEQ ID NO: 1389328 - RNA, 18 nt, Neisseria meningitidis Z2491
uaaucugauuuauuuccu

SEQ ID NO: 1389329 - RNA, 13 nt, Neisseria meningitidis Z2491
uaaucucaaaucc

SEQ ID NO: 1389330 - RNA, 19 nt, Neisseria meningitidis Z2491
uaaucgugugcauacgguu

SEQ ID NO: 1389331 - RNA, 17 nt, Neisseria meningitidis Z2491
uaaucguuuuuucccuu

SEQ ID NO: 1389332 - RNA, 19 nt, Neisseria meningitidis Z2491
uaaucgcgucauucccacg

SEQ ID NO: 1389333 - RNA, 15 nt, Neisseria meningitidis Z2491
uaauccuucagcucu

SEQ ID NO: 1389334 - RNA, 16 nt, Neisseria meningitidis Z2491
uaauccgcuuccaaaa

SEQ ID NO: 1389335 - RNA, 16 nt, Neisseria meningitidis Z2491
uaauccgccugcgcca

SEQ ID NO: 1389336 - RNA, 19 nt, Neisseria meningitidis Z2491
uaauccgcuauaauuuauu

SEQ ID NO: 1389337 - RNA, 16 nt, Neisseria meningitidis Z2491
uaaucuuucagcaaau

SEQ ID NO: 1389338 - RNA, 14 nt, Neisseria meningitidis Z2491
uaaucuuugaauau

SEQ ID NO: 1389339 - RNA, 13 nt, Neisseria meningitidis Z2491
uaaugaaaaugug

SEQ ID NO: 1389340 - RNA, 18 nt, Neisseria meningitidis Z2491
uaaugaaaaugugcauuu

SEQ ID NO: 1389341 - RNA, 16 nt, Neisseria meningitidis Z2491
uaaugcccauucccac

SEQ ID NO: 1389342 - RNA, 17 nt, Neisseria meningitidis Z2491
uaaugcuuucgcuuuuu

SEQ ID NO: 1389343 - RNA, 15 nt, Neisseria meningitidis Z2491
uacuccuguuuuuaa

SEQ ID NO: 1389344 - RNA, 19 nt, Neisseria meningitidis Z2491
uacugguuuuuguuaaucc

SEQ ID NO: 1389345 - RNA, 21 nt, Neisseria meningitidis Z2491
uacugguuuuuguuaauccac

SEQ ID NO: 1389346 - RNA, 22 nt, Neisseria meningitidis Z2491
uacugguuuuuguuaauccgcu

SEQ ID NO: 1389347 - RNA, 15 nt, Neisseria meningitidis Z2491
uacuucauuaaagug

SEQ ID NO: 1389348 - RNA, 19 nt, Neisseria meningitidis Z2491
uagaaaugccgucugaaca

SEQ ID NO: 1389349 - RNA, 22 nt, Neisseria meningitidis Z2491
uagaaacgcaaagcugcaagaa

SEQ ID NO: 1389350 - RNA, 23 nt, Neisseria meningitidis Z2491
uagaaacgcaaagcugcaagaau

SEQ ID NO: 1389351 - RNA, 23 nt, Neisseria meningitidis Z2491
uagaaacucaaagcugcaagaau

SEQ ID NO: 1389352 - RNA, 17 nt, Neisseria meningitidis Z2491
uagagaaucguucucuu

SEQ ID NO: 1389353 - RNA, 14 nt, Neisseria meningitidis Z2491
uagacauucaaugc

SEQ ID NO: 1389354 - RNA, 23 nt, Neisseria meningitidis Z2491
uagacauucaaugcuaaggcaau

SEQ ID NO: 1389355 - RNA, 17 nt, Neisseria meningitidis Z2491
uagaaccucaaacuuuc

SEQ ID NO: 1389356 - RNA, 19 nt, Neisseria meningitidis Z2491
uagaacguggaaucuaaga

SEQ ID NO: 1389357 - RNA, 13 nt, Neisseria meningitidis Z2491
uacggcaaggcga

SEQ ID NO: 1389358 - RNA, 17 nt, Neisseria meningitidis Z2491
uacggcaaggcgaggca

SEQ ID NO: 1389359 - RNA, 11 nt, Neisseria meningitidis Z2491
uacggcagcca

SEQ ID NO: 1389360 - RNA, 16 nt, Neisseria meningitidis Z2491
uacggaaccaauucac

SEQ ID NO: 1389361 - RNA, 18 nt, Neisseria meningitidis Z2491
uacgauuacuuauuuauc

SEQ ID NO: 1389362 - RNA, 14 nt, Neisseria meningitidis Z2491
uacguuuuucucgu

SEQ ID NO: 1389363 - RNA, 13 nt, Neisseria meningitidis Z2491
uacucauuuuucg

SEQ ID NO: 1389364 - RNA, 14 nt, Neisseria meningitidis Z2491
uacuccaaaccuuu

SEQ ID NO: 1389365 - RNA, 17 nt, Neisseria meningitidis Z2491
uaccugaaccuuauagu

SEQ ID NO: 1389366 - RNA, 23 nt, Neisseria meningitidis Z2491
uaccucgccuugccguacuauuu

SEQ ID NO: 1389367 - RNA, 18 nt, Neisseria meningitidis Z2491
uaccgccuucaucaaaau

SEQ ID NO: 1389368 - RNA, 13 nt, Neisseria meningitidis Z2491
uaccgccuuguuc

SEQ ID NO: 1389369 - RNA, 19 nt, Neisseria meningitidis Z2491
uaccgccccgaaggacaga

SEQ ID NO: 1389370 - RNA, 19 nt, Neisseria meningitidis Z2491
uaccgccccuaaaaugccc

SEQ ID NO: 1389371 - RNA, 18 nt, Neisseria meningitidis Z2491
uagaguuucaaaauuuau

SEQ ID NO: 1389372 - RNA, 11 nt, Neisseria meningitidis Z2491
uagauucccac

SEQ ID NO: 1389373 - RNA, 12 nt, Neisseria meningitidis Z2491
uagauucccacu

SEQ ID NO: 1389374 - RNA, 15 nt, Neisseria meningitidis Z2491
uagauucccacuucc

SEQ ID NO: 1389375 - RNA, 15 nt, Neisseria meningitidis Z2491
uagauauuuagcauu

SEQ ID NO: 1389376 - RNA, 16 nt, Neisseria meningitidis Z2491
uagauauuuagcauuu

SEQ ID NO: 1389377 - RNA, 17 nt, Neisseria meningitidis Z2491
uagcaacugaaccguca

SEQ ID NO: 1389378 - RNA, 16 nt, Neisseria meningitidis Z2491
uagcaacugcuuucgc

SEQ ID NO: 1389379 - RNA, 22 nt, Neisseria meningitidis Z2491
uagcaugguuaagagauuggca

SEQ ID NO: 1389380 - RNA, 20 nt, Neisseria meningitidis Z2491
uagcauuuaauucacgacuu

SEQ ID NO: 1389381 - RNA, 14 nt, Neisseria meningitidis Z2491
uagccaaaaaaacc

SEQ ID NO: 1389382 - RNA, 20 nt, Neisseria meningitidis Z2491
uaggauaggucucuuccuaa

SEQ ID NO: 1389383 - RNA, 18 nt, Neisseria meningitidis Z2491
uaggagaaaucagaaaag

SEQ ID NO: 1389384 - RNA, 22 nt, Neisseria meningitidis Z2491
uaggacgcaggguuaagaaaac

SEQ ID NO: 1389385 - RNA, 13 nt, Neisseria meningitidis Z2491
uaggacaaaugcc

SEQ ID NO: 1389386 - RNA, 14 nt, Neisseria meningitidis Z2491
uaggacaaaugccg

SEQ ID NO: 1389387 - RNA, 16 nt, Neisseria meningitidis Z2491
uagcuucgucauuccc

SEQ ID NO: 1389388 - RNA, 23 nt, Neisseria meningitidis Z2491
uagcucaaagagaacaauucucu

SEQ ID NO: 1389389 - RNA, 16 nt, Neisseria meningitidis Z2491
uagcguguauuuuggu

SEQ ID NO: 1389390 - RNA, 13 nt, Neisseria meningitidis Z2491
uagcguuuuaauu

SEQ ID NO: 1389391 - RNA, 14 nt, Neisseria meningitidis Z2491
uagcggaauuuacg

SEQ ID NO: 1389392 - RNA, 19 nt, Neisseria meningitidis Z2491
uauagugaauuaacaaaaa

SEQ ID NO: 1389393 - RNA, 16 nt, Neisseria meningitidis Z2491
uauaguggauuaaauu

SEQ ID NO: 1389394 - RNA, 16 nt, Neisseria meningitidis Z2491
uauaguggauuaacaa

SEQ ID NO: 1389395 - RNA, 18 nt, Neisseria meningitidis Z2491
uauaguggauuaacaaaa

SEQ ID NO: 1389396 - RNA, 20 nt, Neisseria meningitidis Z2491
uauauaauccggagcagaau

SEQ ID NO: 1389397 - RNA, 13 nt, Neisseria meningitidis Z2491
uauauauucugau

SEQ ID NO: 1389398 - RNA, 15 nt, Neisseria meningitidis Z2491
uauaccggggaauua

SEQ ID NO: 1389399 - RNA, 14 nt, Neisseria meningitidis Z2491
uauacuuggcaaaa

SEQ ID NO: 1389400 - RNA, 20 nt, Neisseria meningitidis Z2491
uauaccugcccgacagccgc

SEQ ID NO: 1389401 - RNA, 15 nt, Neisseria meningitidis Z2491
uauccacagagauug

SEQ ID NO: 1389402 - RNA, 16 nt, Neisseria meningitidis Z2491
uauccauaccaaacag

SEQ ID NO: 1389403 - RNA, 16 nt, Neisseria meningitidis Z2491
uauccauagauaaauu

SEQ ID NO: 1389404 - RNA, 23 nt, Neisseria meningitidis Z2491
uaucauugcuuacaauccgcuuu

SEQ ID NO: 1389405 - RNA, 23 nt, Neisseria meningitidis Z2491
uaucagaaaugacggaaacucaa

SEQ ID NO: 1389406 - RNA, 16 nt, Neisseria meningitidis Z2491
uaucagaaaugacuga

SEQ ID NO: 1389407 - RNA, 20 nt, Neisseria meningitidis Z2491
uaucagaaaugacugaaauu

SEQ ID NO: 1389408 - RNA, 18 nt, Neisseria meningitidis Z2491
uaucagggcugcaaaauu

SEQ ID NO: 1389409 - RNA, 23 nt, Neisseria meningitidis Z2491
uaucagggcugcaaaauuuaucc

SEQ ID NO: 1389410 - RNA, 17 nt, Neisseria meningitidis Z2491
uaucaguauuuucuauu

SEQ ID NO: 1389411 - RNA, 18 nt, Neisseria meningitidis Z2491
uaucaaacaagaaaugau

SEQ ID NO: 1389412 - RNA, 23 nt, Neisseria meningitidis Z2491
uaucacgcuccccauauagacug

SEQ ID NO: 1389413 - RNA, 12 nt, Neisseria meningitidis Z2491
uauaucauugcu

SEQ ID NO: 1389414 - RNA, 15 nt, Neisseria meningitidis Z2491
uauauucugauuuaa

SEQ ID NO: 1389415 - RNA, 12 nt, Neisseria meningitidis Z2491
uauauuggcauc

SEQ ID NO: 1389416 - RNA, 16 nt, Neisseria meningitidis Z2491
uagugauuaacaaaaa

SEQ ID NO: 1389417 - RNA, 12 nt, Neisseria meningitidis Z2491
uaguguauuagu

SEQ ID NO: 1389418 - RNA, 22 nt, Neisseria meningitidis Z2491
uaguguauuagugguuggaaca

SEQ ID NO: 1389419 - RNA, 15 nt, Neisseria meningitidis Z2491
uaguucacuauaccg

SEQ ID NO: 1389420 - RNA, 23 nt, Neisseria meningitidis Z2491
uauaaacgccgcagcaaaauaug

SEQ ID NO: 1389421 - RNA, 23 nt, Neisseria meningitidis Z2491
uaggguaauuuauccgaaauaac

SEQ ID NO: 1389422 - RNA, 20 nt, Neisseria meningitidis Z2491
uaggguucugauuuuguuuu

SEQ ID NO: 1389423 - RNA, 18 nt, Neisseria meningitidis Z2491
uagguuucugauuuugau

SEQ ID NO: 1389424 - RNA, 19 nt, Neisseria meningitidis Z2491
uagguuucugauuuugguu

SEQ ID NO: 1389425 - RNA, 22 nt, Neisseria meningitidis Z2491
uaguauaguggauuaacaaaaa

SEQ ID NO: 1389426 - RNA, 23 nt, Neisseria meningitidis Z2491
uaguauaguggauuaacaaaaau

SEQ ID NO: 1389427 - RNA, 21 nt, Neisseria meningitidis Z2491
uaguagauuugaacgacggua

SEQ ID NO: 1389428 - RNA, 22 nt, Neisseria meningitidis Z2491
uaggcggcggcgguuuccugca

SEQ ID NO: 1389429 - RNA, 16 nt, Neisseria meningitidis Z2491
uaggcguaggucagcc

SEQ ID NO: 1389430 - RNA, 16 nt, Neisseria meningitidis Z2491
uaggcaauugaaaaau

SEQ ID NO: 1389431 - RNA, 15 nt, Neisseria meningitidis Z2491
uaggcaauugaaaau

SEQ ID NO: 1389432 - RNA, 21 nt, Neisseria meningitidis Z2491
uaggcaaguuccaagauggcg

SEQ ID NO: 1389433 - RNA, 23 nt, Neisseria meningitidis Z2491
uaggcggcagcgggcgcacuuag

SEQ ID NO: 1389434 - RNA, 15 nt, Neisseria meningitidis Z2491
uaaaugccgucugaa

SEQ ID NO: 1389435 - RNA, 22 nt, Neisseria meningitidis Z2491
uaaaugccaaucucuuaaccau

SEQ ID NO: 1389436 - RNA, 17 nt, Neisseria meningitidis Z2491
uaaauuuaauccacuau

SEQ ID NO: 1389437 - RNA, 11 nt, Neisseria meningitidis Z2491
uaaauuuaaaa

SEQ ID NO: 1389438 - RNA, 17 nt, Neisseria meningitidis Z2491
uaaauuuaaaagggaac

SEQ ID NO: 1389439 - RNA, 14 nt, Neisseria meningitidis Z2491
uaaauuuaauucac

SEQ ID NO: 1389440 - RNA, 15 nt, Neisseria meningitidis Z2491
uaaauuuaauucacu

SEQ ID NO: 1389441 - RNA, 16 nt, Neisseria meningitidis Z2491
uaaccgauggaugaac

SEQ ID NO: 1389442 - RNA, 17 nt, Neisseria meningitidis Z2491
uaaccgcuguuuccguu

SEQ ID NO: 1389443 - RNA, 18 nt, Neisseria meningitidis Z2491
uaaccgcuucaaggcggu

SEQ ID NO: 1389444 - RNA, 16 nt, Neisseria meningitidis Z2491
uaaccuuguuccucca

SEQ ID NO: 1389445 - RNA, 18 nt, Neisseria meningitidis Z2491
uaaccuuguuccuccaaa

SEQ ID NO: 1389446 - RNA, 19 nt, Neisseria meningitidis Z2491
uaacaaucacuauuaaaau

SEQ ID NO: 1389447 - RNA, 23 nt, Neisseria meningitidis Z2491
uaacaaugcccgcaaucugaaau

SEQ ID NO: 1389448 - RNA, 18 nt, Neisseria meningitidis Z2491
uaacagggaaagcagcag

SEQ ID NO: 1389449 - RNA, 20 nt, Neisseria meningitidis Z2491
uaacagggaaagcagcagcc

SEQ ID NO: 1389450 - RNA, 19 nt, Neisseria meningitidis Z2491
uaacaggcaacccgcuuua

SEQ ID NO: 1389451 - RNA, 20 nt, Neisseria meningitidis Z2491
uaacauacuuuguuucaaaa

SEQ ID NO: 1389452 - RNA, 22 nt, Neisseria meningitidis Z2491
uaacauacuuuguuucaaaaug

SEQ ID NO: 1389453 - RNA, 17 nt, Neisseria meningitidis Z2491
uaaaccaguacagcguu

SEQ ID NO: 1389454 - RNA, 20 nt, Neisseria meningitidis Z2491
uaaaccaguacgguguugcc

SEQ ID NO: 1389455 - RNA, 19 nt, Neisseria meningitidis Z2491
uaaacccccgucauucccg

SEQ ID NO: 1389456 - RNA, 17 nt, Neisseria meningitidis Z2491
uaaagaaccggauuccc

SEQ ID NO: 1389457 - RNA, 19 nt, Neisseria meningitidis Z2491
uaaacuucuaacaaauaau

SEQ ID NO: 1389458 - RNA, 13 nt, Neisseria meningitidis Z2491
uaaacaggcacag

SEQ ID NO: 1389459 - RNA, 17 nt, Neisseria meningitidis Z2491
uaaacacggggagcaag

SEQ ID NO: 1389460 - RNA, 21 nt, Neisseria meningitidis Z2491
uaaaauuuuaugcucaaucuc

SEQ ID NO: 1389461 - RNA, 11 nt, Neisseria meningitidis Z2491
uaaaauuuauu

SEQ ID NO: 1389462 - RNA, 22 nt, Neisseria meningitidis Z2491
uaaaauuucaucauucccacaa

SEQ ID NO: 1389463 - RNA, 18 nt, Neisseria meningitidis Z2491
uaaaauuucgucauuccc

SEQ ID NO: 1389464 - RNA, 17 nt, Neisseria meningitidis Z2491
uaaaauucgucauuccc

SEQ ID NO: 1389465 - RNA, 18 nt, Neisseria meningitidis Z2491
uaaaauucgucauuccca

SEQ ID NO: 1389466 - RNA, 20 nt, Neisseria meningitidis Z2491
uaaaauucgucauucccacg

SEQ ID NO: 1389467 - RNA, 19 nt, Neisseria meningitidis Z2491
uaaaggggugcguuuuauu

SEQ ID NO: 1389468 - RNA, 21 nt, Neisseria meningitidis Z2491
uaaagccguccguaagccuuc

SEQ ID NO: 1389469 - RNA, 13 nt, Neisseria meningitidis Z2491
uaaauacccauac

SEQ ID NO: 1389470 - RNA, 18 nt, Neisseria meningitidis Z2491
uaaaaccgauaaacaaca

SEQ ID NO: 1389471 - RNA, 21 nt, Neisseria meningitidis Z2491
uaaaaccauaaggcuuuaagc

SEQ ID NO: 1389472 - RNA, 12 nt, Neisseria meningitidis Z2491
uaaaacaaagac

SEQ ID NO: 1389473 - RNA, 12 nt, Neisseria meningitidis Z2491
uaaaaauuuaau

SEQ ID NO: 1389474 - RNA, 19 nt, Neisseria meningitidis Z2491
uaaaaauggaaaaaccggc

SEQ ID NO: 1389475 - RNA, 11 nt, Neisseria meningitidis Z2491
uaaaaaugccg

SEQ ID NO: 1389476 - RNA, 18 nt, Neisseria meningitidis Z2491
uaaaaaugccgucugaaa

SEQ ID NO: 1389477 - RNA, 23 nt, Neisseria meningitidis Z2491
uaaaaaugccgucugaaaaaccu

SEQ ID NO: 1389478 - RNA, 23 nt, Neisseria meningitidis Z2491
uaaaaauccaacgcugcaaaaau

SEQ ID NO: 1389479 - RNA, 21 nt, Neisseria meningitidis Z2491
uaaaacgcggagaaguaauca

SEQ ID NO: 1389480 - RNA, 21 nt, Neisseria meningitidis Z2491
uaaaagcaucuuguuuuucaa

SEQ ID NO: 1389481 - RNA, 13 nt, Neisseria meningitidis Z2491
uaaaacuuaaaau

SEQ ID NO: 1389482 - RNA, 14 nt, Neisseria meningitidis Z2491
uaaaacuuaaaauu

SEQ ID NO: 1389483 - RNA, 20 nt, Neisseria meningitidis Z2491
uaaaauccgguucauuucag

SEQ ID NO: 1389484 - RNA, 21 nt, Neisseria meningitidis Z2491
uaaaauccgguucauuucagg

SEQ ID NO: 1389485 - RNA, 17 nt, Neisseria meningitidis Z2491
uaaaauccgucauuccc

SEQ ID NO: 1389486 - RNA, 22 nt, Neisseria meningitidis Z2491
uaaaaugccgucugaacucagg

SEQ ID NO: 1389487 - RNA, 23 nt, Neisseria meningitidis Z2491
uaaaaucuauaguggauuaacaa

SEQ ID NO: 1389488 - RNA, 21 nt, Neisseria meningitidis Z2491
uaaaagggaacggcaucggac

SEQ ID NO: 1389489 - RNA, 22 nt, Neisseria meningitidis Z2491
uaaaaggucuuuucuaaaauau

SEQ ID NO: 1389490 - RNA, 23 nt, Neisseria meningitidis Z2491
uaaaaggucuuuucuaaaauaug

SEQ ID NO: 1389491 - RNA, 19 nt, Neisseria meningitidis Z2491
guuuuccuuucugacaaaa

SEQ ID NO: 1389492 - RNA, 14 nt, Neisseria meningitidis Z2491
guuuuccugacaaa

SEQ ID NO: 1389493 - RNA, 16 nt, Neisseria meningitidis Z2491
guuuuccccuguaaac

SEQ ID NO: 1389494 - RNA, 15 nt, Neisseria meningitidis Z2491
guuuucugguuuuua

SEQ ID NO: 1389495 - RNA, 10 nt, Neisseria meningitidis Z2491
guuuucuguu

SEQ ID NO: 1389496 - RNA, 14 nt, Neisseria meningitidis Z2491
guuuuauaguggau

SEQ ID NO: 1389497 - RNA, 20 nt, Neisseria meningitidis Z2491
guuuuauccgauaaguuucc

SEQ ID NO: 1389498 - RNA, 14 nt, Neisseria meningitidis Z2491
guuuuauuacgcaa

SEQ ID NO: 1389499 - RNA, 22 nt, Neisseria meningitidis Z2491
guuuuauuacgcaauggcaaaa

SEQ ID NO: 1389500 - RNA, 14 nt, Neisseria meningitidis Z2491
aaaucauccacagc

SEQ ID NO: 1389501 - RNA, 19 nt, Neisseria meningitidis Z2491
aaaucaucuucaugccaug

SEQ ID NO: 1389502 - RNA, 17 nt, Neisseria meningitidis Z2491
guuugccgccauaugca

SEQ ID NO: 1389503 - RNA, 16 nt, Neisseria meningitidis Z2491
guuugccgcguucgug

SEQ ID NO: 1389504 - RNA, 20 nt, Neisseria meningitidis Z2491
guuugccgcguucgugcaga

SEQ ID NO: 1389505 - RNA, 23 nt, Neisseria meningitidis Z2491
guuuggaugccgucugaaacggc

SEQ ID NO: 1389506 - RNA, 18 nt, Neisseria meningitidis Z2491
guuugcaggacggggcgg

SEQ ID NO: 1389507 - RNA, 16 nt, Neisseria meningitidis Z2491
guuugcagauaaauuu

SEQ ID NO: 1389508 - RNA, 23 nt, Neisseria meningitidis Z2491
guuugauggcgaaguagaagcag

SEQ ID NO: 1389509 - RNA, 12 nt, Neisseria meningitidis Z2491
guuugaugaaac

SEQ ID NO: 1389510 - RNA, 21 nt, Neisseria meningitidis Z2491
guuugaaccggcacaggcuca

SEQ ID NO: 1389511 - RNA, 21 nt, Neisseria meningitidis Z2491
guuucaaaccucauucaaacg

SEQ ID NO: 1389512 - RNA, 20 nt, Neisseria meningitidis Z2491
guuuuacccgauaaguuucc

SEQ ID NO: 1389513 - RNA, 14 nt, Neisseria meningitidis Z2491
aaaucaggacaagg

SEQ ID NO: 1389514 - RNA, 17 nt, Neisseria meningitidis Z2491
guuuuaaccugcaaaac

SEQ ID NO: 1389515 - RNA, 18 nt, Neisseria meningitidis Z2491
guuuggcuuuuuucuguu

SEQ ID NO: 1389516 - RNA, 20 nt, Neisseria meningitidis Z2491
guuugguaaucaguuuuuuc

SEQ ID NO: 1389517 - RNA, 22 nt, Neisseria meningitidis Z2491
guuugguaaucaguuuuuucag

SEQ ID NO: 1389518 - RNA, 13 nt, Neisseria meningitidis Z2491
uaaaaauacauau

SEQ ID NO: 1389519 - RNA, 22 nt, Neisseria meningitidis Z2491
uaaaaaccggauuuauuuuaga

SEQ ID NO: 1389520 - RNA, 14 nt, Neisseria meningitidis Z2491
uaaaaacaaaauag

SEQ ID NO: 1389521 - RNA, 23 nt, Neisseria meningitidis Z2491
uaaaaacaaaaaaucaaaaacag

SEQ ID NO: 1389522 - RNA, 16 nt, Neisseria meningitidis Z2491
guuuuuguuaauccac

SEQ ID NO: 1389523 - RNA, 20 nt, Neisseria meningitidis Z2491
guuuuuuauccggcuuucca

SEQ ID NO: 1389524 - RNA, 12 nt, Neisseria meningitidis Z2491
uaaaaaacaaac

SEQ ID NO: 1389525 - RNA, 14 nt, Neisseria meningitidis Z2491
uaaaaaacaaacag

SEQ ID NO: 1389526 - RNA, 14 nt, Neisseria meningitidis Z2491
guuuuuuuugcaaa

SEQ ID NO: 1389527 - RNA, 13 nt, Neisseria meningitidis Z2491
guugggaaagguu

SEQ ID NO: 1389528 - RNA, 21 nt, Neisseria meningitidis Z2491
guugggaaagguucagcagga

SEQ ID NO: 1389529 - RNA, 13 nt, Neisseria meningitidis Z2491
guuggcagcaaaa

SEQ ID NO: 1389530 - RNA, 18 nt, Neisseria meningitidis Z2491
guuggcaauuuucuuccg

SEQ ID NO: 1389531 - RNA, 21 nt, Neisseria meningitidis Z2491
guugcccuguguagcagccca

SEQ ID NO: 1389532 - RNA, 22 nt, Neisseria meningitidis Z2491
guuuagacggucuggcauauuc

SEQ ID NO: 1389533 - RNA, 15 nt, Neisseria meningitidis Z2491
guuguucagaaaauc

SEQ ID NO: 1389534 - RNA, 14 nt, Neisseria meningitidis Z2491
guuguucaaauaaa

SEQ ID NO: 1389535 - RNA, 21 nt, Neisseria meningitidis Z2491
guuuaaacacgggguuuaucu

SEQ ID NO: 1389536 - RNA, 15 nt, Neisseria meningitidis Z2491
guugauggcguuuuc

SEQ ID NO: 1389537 - RNA, 15 nt, Neisseria meningitidis Z2491
guugaucauuucagg

SEQ ID NO: 1389538 - RNA, 18 nt, Neisseria meningitidis Z2491
guugaaaacggcaguuuc

SEQ ID NO: 1389539 - RNA, 20 nt, Neisseria meningitidis Z2491
guucuuuuuggcgcauuuuu

SEQ ID NO: 1389540 - RNA, 15 nt, Neisseria meningitidis Z2491
guucgugggaaugac

SEQ ID NO: 1389541 - RNA, 16 nt, Neisseria meningitidis Z2491
guucuggauucccacu

SEQ ID NO: 1389542 - RNA, 18 nt, Neisseria meningitidis Z2491
guucauucgacagcagcc

SEQ ID NO: 1389543 - RNA, 18 nt, Neisseria meningitidis Z2491
guuccuccacuaaaaaau

SEQ ID NO: 1389544 - RNA, 23 nt, Neisseria meningitidis Z2491
guuccguacuauuuacacugucu

SEQ ID NO: 1389545 - RNA, 15 nt, Neisseria meningitidis Z2491
guucguaggaaugac

SEQ ID NO: 1389546 - RNA, 19 nt, Neisseria meningitidis Z2491
guucguccagcagcaacac

SEQ ID NO: 1389547 - RNA, 21 nt, Neisseria meningitidis Z2491
guucggacggcauuuuugacg

SEQ ID NO: 1389548 - RNA, 19 nt, Neisseria meningitidis Z2491
guucggcaaaauccgcaaa

SEQ ID NO: 1389549 - RNA, 18 nt, Neisseria meningitidis Z2491
guucggcaagaucggaaa

SEQ ID NO: 1389550 - RNA, 13 nt, Neisseria meningitidis Z2491
guucgauauuuuu

SEQ ID NO: 1389551 - RNA, 14 nt, Neisseria meningitidis Z2491
guucgagcaggaac

SEQ ID NO: 1389552 - RNA, 22 nt, Neisseria meningitidis Z2491
guuauucccgcgagaacagaaa

SEQ ID NO: 1389553 - RNA, 12 nt, Neisseria meningitidis Z2491
guucaaacacau

SEQ ID NO: 1389554 - RNA, 21 nt, Neisseria meningitidis Z2491
guuauuaagugaguaaaaaca

SEQ ID NO: 1389555 - RNA, 14 nt, Neisseria meningitidis Z2491
guuauuauuuucca

SEQ ID NO: 1389556 - RNA, 15 nt, Neisseria meningitidis Z2491
guuauuauuuuccau

SEQ ID NO: 1389557 - RNA, 23 nt, Neisseria meningitidis Z2491
guuacuaaaauuuuaugcucaau

SEQ ID NO: 1389558 - RNA, 17 nt, Neisseria meningitidis Z2491
guguuucaauauggugc

SEQ ID NO: 1389559 - RNA, 19 nt, Neisseria meningitidis Z2491
guguccugaccuuugcaga

SEQ ID NO: 1389560 - RNA, 14 nt, Neisseria meningitidis Z2491
guguccguggagga

SEQ ID NO: 1389561 - RNA, 18 nt, Neisseria meningitidis Z2491
guuaaaucgaaauucgca

SEQ ID NO: 1389562 - RNA, 19 nt, Neisseria meningitidis Z2491
guuaaucacuauaccaaac

SEQ ID NO: 1389563 - RNA, 23 nt, Neisseria meningitidis Z2491
guuaauauggcggauuaaaauaa

SEQ ID NO: 1389564 - RNA, 18 nt, Neisseria meningitidis Z2491
guuacaaaacucuggucg

SEQ ID NO: 1389565 - RNA, 13 nt, Neisseria meningitidis Z2491
guuacaaauuuaa

SEQ ID NO: 1389566 - RNA, 21 nt, Neisseria meningitidis Z2491
guuaauccgcuauaauuuauu

SEQ ID NO: 1389567 - RNA, 19 nt, Neisseria meningitidis Z2491
guuacgccccucccaaaua

SEQ ID NO: 1389568 - RNA, 21 nt, Neisseria meningitidis Z2491
guuacgccccucccaaauaaa

SEQ ID NO: 1389569 - RNA, 13 nt, Neisseria meningitidis Z2491
guguauaguggau

SEQ ID NO: 1389570 - RNA, 20 nt, Neisseria meningitidis Z2491
guggugggaauguauuagaa

SEQ ID NO: 1389571 - RNA, 18 nt, Neisseria meningitidis Z2491
gugcugcaucggcguauu

SEQ ID NO: 1389572 - RNA, 18 nt, Neisseria meningitidis Z2491
gugcuugagcaccuuaga

SEQ ID NO: 1389573 - RNA, 19 nt, Neisseria meningitidis Z2491
gugcgcguuaaaggucagc

SEQ ID NO: 1389574 - RNA, 20 nt, Neisseria meningitidis Z2491
gugcggucgcaucggcggcg

SEQ ID NO: 1389575 - RNA, 13 nt, Neisseria meningitidis Z2491
gugcggcccugcg

SEQ ID NO: 1389576 - RNA, 15 nt, Neisseria meningitidis Z2491
gugauggcuucuaaa

SEQ ID NO: 1389577 - RNA, 18 nt, Neisseria meningitidis Z2491
gugauggcuucuaaaaau

SEQ ID NO: 1389578 - RNA, 13 nt, Neisseria meningitidis Z2491
gugaugccccaau

SEQ ID NO: 1389579 - RNA, 22 nt, Neisseria meningitidis Z2491
gugcagguuuuuuugauucaau

SEQ ID NO: 1389580 - RNA, 17 nt, Neisseria meningitidis Z2491
gugcauccgacaggcaa

SEQ ID NO: 1389581 - RNA, 18 nt, Neisseria meningitidis Z2491
gugcauccgacaggcaaa

SEQ ID NO: 1389582 - RNA, 23 nt, Neisseria meningitidis Z2491
gugcccgguuggaaggcggcggc

SEQ ID NO: 1389583 - RNA, 13 nt, Neisseria meningitidis Z2491
gugccgaaauagu

SEQ ID NO: 1389584 - RNA, 16 nt, Neisseria meningitidis Z2491
gugccgaaguuaaauc

SEQ ID NO: 1389585 - RNA, 21 nt, Neisseria meningitidis Z2491
gugccaaugccgucugaaacc

SEQ ID NO: 1389586 - RNA, 17 nt, Neisseria meningitidis Z2491
gugcauuucuaauuuuu

SEQ ID NO: 1389587 - RNA, 23 nt, Neisseria meningitidis Z2491
gugccgccaaagugccaaaugua

SEQ ID NO: 1389588 - RNA, 17 nt, Neisseria meningitidis Z2491
gugccgcugauuuggaa

SEQ ID NO: 1389589 - RNA, 20 nt, Neisseria meningitidis Z2491
gugcgaccguaugcaaaaac

SEQ ID NO: 1389590 - RNA, 21 nt, Neisseria meningitidis Z2491
gucauuuccgauaaauuccug

SEQ ID NO: 1389591 - RNA, 11 nt, Neisseria meningitidis Z2491
gucauuuccac

SEQ ID NO: 1389592 - RNA, 22 nt, Neisseria meningitidis Z2491
guccaccugaacggcacaaacg

SEQ ID NO: 1389593 - RNA, 14 nt, Neisseria meningitidis Z2491
gucauucccacgga

SEQ ID NO: 1389594 - RNA, 21 nt, Neisseria meningitidis Z2491
gucauucccacggaaguggga

SEQ ID NO: 1389595 - RNA, 18 nt, Neisseria meningitidis Z2491
gucauucccgcaaaagcg

SEQ ID NO: 1389596 - RNA, 16 nt, Neisseria meningitidis Z2491
gucaugcccaaaagca

SEQ ID NO: 1389597 - RNA, 22 nt, Neisseria meningitidis Z2491
gucccuaaauuuaugucgggga

SEQ ID NO: 1389598 - RNA, 12 nt, Neisseria meningitidis Z2491
gucaaccuuaac

SEQ ID NO: 1389599 - RNA, 17 nt, Neisseria meningitidis Z2491
gucguuuuuuuccugcc

SEQ ID NO: 1389600 - RNA, 17 nt, Neisseria meningitidis Z2491
gucuaagccgguauaaa

SEQ ID NO: 1389601 - RNA, 17 nt, Neisseria meningitidis Z2491
gucggcggauuguucaa

SEQ ID NO: 1389602 - RNA, 19 nt, Neisseria meningitidis Z2491
gucggucaaguggggggaa

SEQ ID NO: 1389603 - RNA, 15 nt, Neisseria meningitidis Z2491
gucguaggcuuuuuc

SEQ ID NO: 1389604 - RNA, 14 nt, Neisseria meningitidis Z2491
gucggacauuugac

SEQ ID NO: 1389605 - RNA, 15 nt, Neisseria meningitidis Z2491
gucggacaaaaugcc

SEQ ID NO: 1389606 - RNA, 23 nt, Neisseria meningitidis Z2491
guccggugugcauccgacaggca

SEQ ID NO: 1389607 - RNA, 23 nt, Neisseria meningitidis Z2491
guccgauuaauuccggaaucaga

SEQ ID NO: 1389608 - RNA, 18 nt, Neisseria meningitidis Z2491
guccugaccgcgcugcuc

SEQ ID NO: 1389609 - RNA, 23 nt, Neisseria meningitidis Z2491
gucgaaaccggcuuuggcgauga

SEQ ID NO: 1389610 - RNA, 13 nt, Neisseria meningitidis Z2491
guccuuauuucug

SEQ ID NO: 1389611 - RNA, 15 nt, Neisseria meningitidis Z2491
guccuuauuucugcu

SEQ ID NO: 1389612 - RNA, 15 nt, Neisseria meningitidis Z2491
gucgaacaguucuuu

SEQ ID NO: 1389613 - RNA, 13 nt, Neisseria meningitidis Z2491
gucgcagcugcuc

SEQ ID NO: 1389614 - RNA, 19 nt, Neisseria meningitidis Z2491
gucgagucccaguucgccg

SEQ ID NO: 1389615 - RNA, 13 nt, Neisseria meningitidis Z2491
gucaaccaaaaaa

SEQ ID NO: 1389616 - RNA, 17 nt, Neisseria meningitidis Z2491
gucaaacagaaaaacaa

SEQ ID NO: 1389617 - RNA, 13 nt, Neisseria meningitidis Z2491
gucaaaccagcuu

SEQ ID NO: 1389618 - RNA, 14 nt, Neisseria meningitidis Z2491
gucaaaccagcuuc

SEQ ID NO: 1389619 - RNA, 12 nt, Neisseria meningitidis Z2491
gucaaaaaugcc

SEQ ID NO: 1389620 - RNA, 20 nt, Neisseria meningitidis Z2491
guauugggaugauuuuguuc

SEQ ID NO: 1389621 - RNA, 16 nt, Neisseria meningitidis Z2491
guauuucagacaggau

SEQ ID NO: 1389622 - RNA, 13 nt, Neisseria meningitidis Z2491
guauuuguauagu

SEQ ID NO: 1389623 - RNA, 22 nt, Neisseria meningitidis Z2491
guauuugcugacguaaaaaacu

SEQ ID NO: 1389624 - RNA, 18 nt, Neisseria meningitidis Z2491
guauuuuacaaucagaau

SEQ ID NO: 1389625 - RNA, 15 nt, Neisseria meningitidis Z2491
guauucggaggcgca

SEQ ID NO: 1389626 - RNA, 21 nt, Neisseria meningitidis Z2491
guaugccgucugaaaccugua

SEQ ID NO: 1389627 - RNA, 23 nt, Neisseria meningitidis Z2491
guaugcgaaucugcugcaaaccg

SEQ ID NO: 1389628 - RNA, 15 nt, Neisseria meningitidis Z2491
guaucgauuuucggg

SEQ ID NO: 1389629 - RNA, 23 nt, Neisseria meningitidis Z2491
guauccucaucguucaacagcag

SEQ ID NO: 1389630 - RNA, 13 nt, Neisseria meningitidis Z2491
guaucacaacaca

SEQ ID NO: 1389631 - RNA, 17 nt, Neisseria meningitidis Z2491
guaucacaacacaguag

SEQ ID NO: 1389632 - RNA, 20 nt, Neisseria meningitidis Z2491
guaucaagcccugaaaggga

SEQ ID NO: 1389633 - RNA, 19 nt, Neisseria meningitidis Z2491
guaucauacauagcaggca

SEQ ID NO: 1389634 - RNA, 15 nt, Neisseria meningitidis Z2491
guaucaggcaucaca

SEQ ID NO: 1389635 - RNA, 15 nt, Neisseria meningitidis Z2491
guauccggauuuccu

SEQ ID NO: 1389636 - RNA, 13 nt, Neisseria meningitidis Z2491
guaucccaguugu

SEQ ID NO: 1389637 - RNA, 15 nt, Neisseria meningitidis Z2491
guaucccaguugugc

SEQ ID NO: 1389638 - RNA, 12 nt, Neisseria meningitidis Z2491
guauccauacca

SEQ ID NO: 1389639 - RNA, 16 nt, Neisseria meningitidis Z2491
guauccauaccaaaca

SEQ ID NO: 1389640 - RNA, 16 nt, Neisseria meningitidis Z2491
guaucaaaaaauaaag

SEQ ID NO: 1389641 - RNA, 15 nt, Neisseria meningitidis Z2491
guauagcccaaaucu

SEQ ID NO: 1389642 - RNA, 16 nt, Neisseria meningitidis Z2491
guaguugguuuugaca

SEQ ID NO: 1389643 - RNA, 22 nt, Neisseria meningitidis Z2491
guauaaagauacaagaacuuua

SEQ ID NO: 1389644 - RNA, 18 nt, Neisseria meningitidis Z2491
guagccggccaacaucag

SEQ ID NO: 1389645 - RNA, 12 nt, Neisseria meningitidis Z2491
guagccuucaaa

SEQ ID NO: 1389646 - RNA, 17 nt, Neisseria meningitidis Z2491
guaggcguaggucagcc

SEQ ID NO: 1389647 - RNA, 15 nt, Neisseria meningitidis Z2491
guaggucuucagcuu

SEQ ID NO: 1389648 - RNA, 22 nt, Neisseria meningitidis Z2491
guaggucuucagcuugagcguu

SEQ ID NO: 1389649 - RNA, 19 nt, Neisseria meningitidis Z2491
guagugugguugaagucca

SEQ ID NO: 1389650 - RNA, 16 nt, Neisseria meningitidis Z2491
guacuccuguuuuuaa

SEQ ID NO: 1389651 - RNA, 18 nt, Neisseria meningitidis Z2491
guacuaucuguacugucu

SEQ ID NO: 1389652 - RNA, 20 nt, Neisseria meningitidis Z2491
guacuaucuguacugucugc

SEQ ID NO: 1389653 - RNA, 18 nt, Neisseria meningitidis Z2491
guacugcaaggcgaggca

SEQ ID NO: 1389654 - RNA, 16 nt, Neisseria meningitidis Z2491
guacugguuuuuguua

SEQ ID NO: 1389655 - RNA, 20 nt, Neisseria meningitidis Z2491
guaaagcggcaaugccgucu

SEQ ID NO: 1389656 - RNA, 16 nt, Neisseria meningitidis Z2491
guaaaacgguuucuug

SEQ ID NO: 1389657 - RNA, 15 nt, Neisseria meningitidis Z2491
guaaaaucucaagaa

SEQ ID NO: 1389658 - RNA, 17 nt, Neisseria meningitidis Z2491
guaaacagauaaaacca

SEQ ID NO: 1389659 - RNA, 18 nt, Neisseria meningitidis Z2491
guaaacagauaaaaccaa

SEQ ID NO: 1389660 - RNA, 16 nt, Neisseria meningitidis Z2491
guaaaccgccagccug

SEQ ID NO: 1389661 - RNA, 20 nt, Neisseria meningitidis Z2491
guaacaauaugcggcaggcc

SEQ ID NO: 1389662 - RNA, 22 nt, Neisseria meningitidis Z2491
guaacaauaugcggcaggccaa

SEQ ID NO: 1389663 - RNA, 20 nt, Neisseria meningitidis Z2491
guaaauuguccauuuuucug

SEQ ID NO: 1389664 - RNA, 15 nt, Neisseria meningitidis Z2491
guaacucuaaaccgu

SEQ ID NO: 1389665 - RNA, 13 nt, Neisseria meningitidis Z2491
guaacggauaaag

SEQ ID NO: 1389666 - RNA, 23 nt, Neisseria meningitidis Z2491
guacaaauaguacggcaaggcaa

SEQ ID NO: 1389667 - RNA, 14 nt, Neisseria meningitidis Z2491
guaauuaccgaaac

SEQ ID NO: 1389668 - RNA, 22 nt, Neisseria meningitidis Z2491
guaauuuccgaccaacucccag

SEQ ID NO: 1389669 - RNA, 21 nt, Neisseria meningitidis Z2491
guaauuuauccgaaauaacaa

SEQ ID NO: 1389670 - RNA, 21 nt, Neisseria meningitidis Z2491
guaaugacaugguuugcaguc

SEQ ID NO: 1389671 - RNA, 19 nt, Neisseria meningitidis Z2491
guaaugacccacgccaaac

SEQ ID NO: 1389672 - RNA, 21 nt, Neisseria meningitidis Z2491
guaaugcaaaaaguccuucac

SEQ ID NO: 1389673 - RNA, 13 nt, Neisseria meningitidis Z2491
guaccaaaaccgu

SEQ ID NO: 1389674 - RNA, 14 nt, Neisseria meningitidis Z2491
guaccgggcaggcu

SEQ ID NO: 1389675 - RNA, 22 nt, Neisseria meningitidis Z2491
guacccccauaugguguugaug

SEQ ID NO: 1389676 - RNA, 19 nt, Neisseria meningitidis Z2491
guacgcuucgcgguuggcu

SEQ ID NO: 1389677 - RNA, 15 nt, Neisseria meningitidis Z2491
guacggauuguauau

SEQ ID NO: 1389678 - RNA, 20 nt, Neisseria meningitidis Z2491
guacggcaaggcgaggcaac

SEQ ID NO: 1389679 - RNA, 19 nt, Neisseria meningitidis Z2491
gguggcgaagccggcggcg

SEQ ID NO: 1389680 - RNA, 13 nt, Neisseria meningitidis Z2491
ggugcuucagcac

SEQ ID NO: 1389681 - RNA, 14 nt, Neisseria meningitidis Z2491
ggugagggagaggg

SEQ ID NO: 1389682 - RNA, 17 nt, Neisseria meningitidis Z2491
ggugauuucuguggaga

SEQ ID NO: 1389683 - RNA, 20 nt, Neisseria meningitidis Z2491
gguuuaaaguuaauccacua

SEQ ID NO: 1389684 - RNA, 23 nt, Neisseria meningitidis Z2491
gguuugagcaguuuuuugacuug

SEQ ID NO: 1389685 - RNA, 14 nt, Neisseria meningitidis Z2491
gguuugcggcggca

SEQ ID NO: 1389686 - RNA, 22 nt, Neisseria meningitidis Z2491
gguuuuccucgauuugaaaucu

SEQ ID NO: 1389687 - RNA, 12 nt, Neisseria meningitidis Z2491
guaaaaaacuau

SEQ ID NO: 1389688 - RNA, 17 nt, Neisseria meningitidis Z2491
guaaaaacaaaaaauca

SEQ ID NO: 1389689 - RNA, 15 nt, Neisseria meningitidis Z2491
guaaaaaugccgucu

SEQ ID NO: 1389690 - RNA, 18 nt, Neisseria meningitidis Z2491
guaaaaaugccgucugaa

SEQ ID NO: 1389691 - RNA, 15 nt, Neisseria meningitidis Z2491
gguucugauuuuguu

SEQ ID NO: 1389692 - RNA, 19 nt, Neisseria meningitidis Z2491
gguugaaguccauggaaac

SEQ ID NO: 1389693 - RNA, 22 nt, Neisseria meningitidis Z2491
gguugaaguccauggaaaccaa

SEQ ID NO: 1389694 - RNA, 16 nt, Neisseria meningitidis Z2491
gguugaucauuucagg

SEQ ID NO: 1389695 - RNA, 20 nt, Neisseria meningitidis Z2491
gguugaggucgcgaguucga

SEQ ID NO: 1389696 - RNA, 19 nt, Neisseria meningitidis Z2491
gguugaugcgguaauggau

SEQ ID NO: 1389697 - RNA, 16 nt, Neisseria meningitidis Z2491
gguuguucagaaaauc

SEQ ID NO: 1389698 - RNA, 18 nt, Neisseria meningitidis Z2491
gguugcguaucaaaaaau

SEQ ID NO: 1389699 - RNA, 13 nt, Neisseria meningitidis Z2491
gguugcggugcug

SEQ ID NO: 1389700 - RNA, 17 nt, Neisseria meningitidis Z2491
gguuaagaaaaccugca

SEQ ID NO: 1389701 - RNA, 13 nt, Neisseria meningitidis Z2491
gguguuguagccu

SEQ ID NO: 1389702 - RNA, 23 nt, Neisseria meningitidis Z2491
ggugugccgcugauuuggaauuu

SEQ ID NO: 1389703 - RNA, 13 nt, Neisseria meningitidis Z2491
gguucaaauaugg

SEQ ID NO: 1389704 - RNA, 16 nt, Neisseria meningitidis Z2491
gguucagguacugcuc

SEQ ID NO: 1389705 - RNA, 20 nt, Neisseria meningitidis Z2491
gguucggcuuggaaugcuug

SEQ ID NO: 1389706 - RNA, 14 nt, Neisseria meningitidis Z2491
gccggggcaggcgg

SEQ ID NO: 1389707 - RNA, 15 nt, Neisseria meningitidis Z2491
gccggucguguggaa

SEQ ID NO: 1389708 - RNA, 16 nt, Neisseria meningitidis Z2491
gccgucauucccgcgc

SEQ ID NO: 1389709 - RNA, 17 nt, Neisseria meningitidis Z2491
gccgucauucccgcgca

SEQ ID NO: 1389710 - RNA, 19 nt, Neisseria meningitidis Z2491
gccguagauguggucggca

SEQ ID NO: 1389711 - RNA, 14 nt, Neisseria meningitidis Z2491
gccguacugguuua

SEQ ID NO: 1389712 - RNA, 15 nt, Neisseria meningitidis Z2491
gccguuuugcagugc

SEQ ID NO: 1389713 - RNA, 17 nt, Neisseria meningitidis Z2491
gccguuuuucauggcga

SEQ ID NO: 1389714 - RNA, 11 nt, Neisseria meningitidis Z2491
gccgucugaaa

SEQ ID NO: 1389715 - RNA, 16 nt, Neisseria meningitidis Z2491
gccgucugaaaccugu

SEQ ID NO: 1389716 - RNA, 18 nt, Neisseria meningitidis Z2491
gccgucugaacccgccug

SEQ ID NO: 1389717 - RNA, 23 nt, Neisseria meningitidis Z2491
gccgucugaacgcuucagacggc

SEQ ID NO: 1389718 - RNA, 11 nt, Neisseria meningitidis Z2491
gccgucugaag

SEQ ID NO: 1389719 - RNA, 14 nt, Neisseria meningitidis Z2491
gccgucugaagccu

SEQ ID NO: 1389720 - RNA, 15 nt, Neisseria meningitidis Z2491
gccgucugaagccug

SEQ ID NO: 1389721 - RNA, 21 nt, Neisseria meningitidis Z2491
gccgucugaagccuucagacg

SEQ ID NO: 1389722 - RNA, 15 nt, Neisseria meningitidis Z2491
gccgugccggcggcg

SEQ ID NO: 1389723 - RNA, 20 nt, Neisseria meningitidis Z2491
gccggaagauuccggcggcu

SEQ ID NO: 1389724 - RNA, 20 nt, Neisseria meningitidis Z2491
gccggccuuaaggcggcugu

SEQ ID NO: 1389725 - RNA, 13 nt, Neisseria meningitidis Z2491
gccggcggcgagc

SEQ ID NO: 1389726 - RNA, 19 nt, Neisseria meningitidis Z2491
gccugguugaugucgugca

SEQ ID NO: 1389727 - RNA, 13 nt, Neisseria meningitidis Z2491
gccugugcggcgg

SEQ ID NO: 1389728 - RNA, 15 nt, Neisseria meningitidis Z2491
gccuuaccgaccacc

SEQ ID NO: 1389729 - RNA, 13 nt, Neisseria meningitidis Z2491
gccuucaucagca

SEQ ID NO: 1389730 - RNA, 22 nt, Neisseria meningitidis Z2491
gccuugccguacuaucuguacu

SEQ ID NO: 1389731 - RNA, 13 nt, Neisseria meningitidis Z2491
gccuuguccugau

SEQ ID NO: 1389732 - RNA, 22 nt, Neisseria meningitidis Z2491
gccuugcuguacuaucuguacu

SEQ ID NO: 1389733 - RNA, 17 nt, Neisseria meningitidis Z2491
gccuuccgcuucuucca

SEQ ID NO: 1389734 - RNA, 15 nt, Neisseria meningitidis Z2491
gccuucauccgcaac

SEQ ID NO: 1389735 - RNA, 15 nt, Neisseria meningitidis Z2491
gccugcagcagagcu

SEQ ID NO: 1389736 - RNA, 15 nt, Neisseria meningitidis Z2491
gccugagcaaaugcc

SEQ ID NO: 1389737 - RNA, 17 nt, Neisseria meningitidis Z2491
gccugacgcgcgaugga

SEQ ID NO: 1389738 - RNA, 23 nt, Neisseria meningitidis Z2491
gccuaugcaaugggcgaccagcc

SEQ ID NO: 1389739 - RNA, 17 nt, Neisseria meningitidis Z2491
gccuauuuuucugaaaa

SEQ ID NO: 1389740 - RNA, 20 nt, Neisseria meningitidis Z2491
gccuauuuuucugaaaaauu

SEQ ID NO: 1389741 - RNA, 17 nt, Neisseria meningitidis Z2491
gccucaaucgcggcggc

SEQ ID NO: 1389742 - RNA, 16 nt, Neisseria meningitidis Z2491
gcgagccuugugugcg

SEQ ID NO: 1389743 - RNA, 17 nt, Neisseria meningitidis Z2491
gcgaggcgugccuugcc

SEQ ID NO: 1389744 - RNA, 12 nt, Neisseria meningitidis Z2491
gcgagaugacgg

SEQ ID NO: 1389745 - RNA, 15 nt, Neisseria meningitidis Z2491
gcgacgaagccgcag

SEQ ID NO: 1389746 - RNA, 16 nt, Neisseria meningitidis Z2491
gcgacgaagccgcaga

SEQ ID NO: 1389747 - RNA, 20 nt, Neisseria meningitidis Z2491
gcgaccgaaaugccgucauu

SEQ ID NO: 1389748 - RNA, 17 nt, Neisseria meningitidis Z2491
gcgacagcuugggcgga

SEQ ID NO: 1389749 - RNA, 22 nt, Neisseria meningitidis Z2491
gccgccguaaccgcacccccga

SEQ ID NO: 1389750 - RNA, 12 nt, Neisseria meningitidis Z2491
gccgccugccug

SEQ ID NO: 1389751 - RNA, 20 nt, Neisseria meningitidis Z2491
gccgccugccuguuuuucuu

SEQ ID NO: 1389752 - RNA, 20 nt, Neisseria meningitidis Z2491
gccgccugaugauuuuuuca

SEQ ID NO: 1389753 - RNA, 13 nt, Neisseria meningitidis Z2491
gccgccguccauc

SEQ ID NO: 1389754 - RNA, 22 nt, Neisseria meningitidis Z2491
gccgcgccugcguuugccgcca

SEQ ID NO: 1389755 - RNA, 18 nt, Neisseria meningitidis Z2491
gccgccgaaagucgagcc

SEQ ID NO: 1389756 - RNA, 14 nt, Neisseria meningitidis Z2491
gccgccgaugacga

SEQ ID NO: 1389757 - RNA, 16 nt, Neisseria meningitidis Z2491
gccgcagucaucaggc

SEQ ID NO: 1389758 - RNA, 17 nt, Neisseria meningitidis Z2491
gccgccacaagucuucg

SEQ ID NO: 1389759 - RNA, 20 nt, Neisseria meningitidis Z2491
gccgcauaaaucaacagcag

SEQ ID NO: 1389760 - RNA, 18 nt, Neisseria meningitidis Z2491
gccgccauaucguccgcc

SEQ ID NO: 1389761 - RNA, 15 nt, Neisseria meningitidis Z2491
gccgaugggcaaggc

SEQ ID NO: 1389762 - RNA, 16 nt, Neisseria meningitidis Z2491
gccgauguaaaccuaa

SEQ ID NO: 1389763 - RNA, 16 nt, Neisseria meningitidis Z2491
gccgaugcagcgacgg

SEQ ID NO: 1389764 - RNA, 18 nt, Neisseria meningitidis Z2491
gccgaugaguccgaggcu

SEQ ID NO: 1389765 - RNA, 16 nt, Neisseria meningitidis Z2491
aaagcgggaauccaaa

SEQ ID NO: 1389766 - RNA, 20 nt, Neisseria meningitidis Z2491
gccgaauauccccagugcga

SEQ ID NO: 1389767 - RNA, 19 nt, Neisseria meningitidis Z2491
aaagcuaacgggcaauuuu

SEQ ID NO: 1389768 - RNA, 15 nt, Neisseria meningitidis Z2491
gccgacaucccccag

SEQ ID NO: 1389769 - RNA, 13 nt, Neisseria meningitidis Z2491
gcccugcauggga

SEQ ID NO: 1389770 - RNA, 16 nt, Neisseria meningitidis Z2491
gcccuguugcgcuguu

SEQ ID NO: 1389771 - RNA, 20 nt, Neisseria meningitidis Z2491
gcccucagcuaugccugccg

SEQ ID NO: 1389772 - RNA, 21 nt, Neisseria meningitidis Z2491
gcccucagcuaugccugccga

SEQ ID NO: 1389773 - RNA, 22 nt, Neisseria meningitidis Z2491
gcccucaaacgguaccugauga

SEQ ID NO: 1389774 - RNA, 21 nt, Neisseria meningitidis Z2491
gcccgucccgaugccgcaacc

SEQ ID NO: 1389775 - RNA, 15 nt, Neisseria meningitidis Z2491
gcccgucaacacaaa

SEQ ID NO: 1389776 - RNA, 15 nt, Neisseria meningitidis Z2491
gccauucccgcaaaa

SEQ ID NO: 1389777 - RNA, 18 nt, Neisseria meningitidis Z2491
gccauucccgcaaaagcg

SEQ ID NO: 1389778 - RNA, 17 nt, Neisseria meningitidis Z2491
gccauaaugcccaaacc

SEQ ID NO: 1389779 - RNA, 23 nt, Neisseria meningitidis Z2491
gccauacaaacaggcuucagacg

SEQ ID NO: 1389780 - RNA, 13 nt, Neisseria meningitidis Z2491
gccaucaaaaagg

SEQ ID NO: 1389781 - RNA, 15 nt, Neisseria meningitidis Z2491
gccaucaaaaaggcu

SEQ ID NO: 1389782 - RNA, 18 nt, Neisseria meningitidis Z2491
gccaucacguccgccauu

SEQ ID NO: 1389783 - RNA, 14 nt, Neisseria meningitidis Z2491
gccauccagcaaac

SEQ ID NO: 1389784 - RNA, 17 nt, Neisseria meningitidis Z2491
gccaguccggacgguca

SEQ ID NO: 1389785 - RNA, 19 nt, Neisseria meningitidis Z2491
gccccaauaccaacaccug

SEQ ID NO: 1389786 - RNA, 21 nt, Neisseria meningitidis Z2491
gcccaucgguuugacgcagga

SEQ ID NO: 1389787 - RNA, 20 nt, Neisseria meningitidis Z2491
gcccaauaccguccccgaaa

SEQ ID NO: 1389788 - RNA, 22 nt, Neisseria meningitidis Z2491
gcccgaauugcgccgacagcag

SEQ ID NO: 1389789 - RNA, 16 nt, Neisseria meningitidis Z2491
gcccgaagggaaagcc

SEQ ID NO: 1389790 - RNA, 14 nt, Neisseria meningitidis Z2491
gccacggcauaaca

SEQ ID NO: 1389791 - RNA, 12 nt, Neisseria meningitidis Z2491
gccaagcaagca

SEQ ID NO: 1389792 - RNA, 11 nt, Neisseria meningitidis Z2491
gccaaccugcu

SEQ ID NO: 1389793 - RNA, 12 nt, Neisseria meningitidis Z2491
gccaaccugcug

SEQ ID NO: 1389794 - RNA, 13 nt, Neisseria meningitidis Z2491
gccaacaucagca

SEQ ID NO: 1389795 - RNA, 22 nt, Neisseria meningitidis Z2491
gccaaaccgaugggcuucauca

SEQ ID NO: 1389796 - RNA, 15 nt, Neisseria meningitidis Z2491
gccaaaccgcagcaa

SEQ ID NO: 1389797 - RNA, 20 nt, Neisseria meningitidis Z2491
gcauacggcugauuuccggg

SEQ ID NO: 1389798 - RNA, 18 nt, Neisseria meningitidis Z2491
gcauacgguuuuccgccu

SEQ ID NO: 1389799 - RNA, 21 nt, Neisseria meningitidis Z2491
gcauacucugcggacuuaaga

SEQ ID NO: 1389800 - RNA, 19 nt, Neisseria meningitidis Z2491
gcaucaggaacaucagcac

SEQ ID NO: 1389801 - RNA, 20 nt, Neisseria meningitidis Z2491
gcaucgccgcuucaucuuua

SEQ ID NO: 1389802 - RNA, 17 nt, Neisseria meningitidis Z2491
gcaucggaaacagccag

SEQ ID NO: 1389803 - RNA, 18 nt, Neisseria meningitidis Z2491
gcauuaucaguauuuucu

SEQ ID NO: 1389804 - RNA, 21 nt, Neisseria meningitidis Z2491
gcauuuuuuucggguucagau

SEQ ID NO: 1389805 - RNA, 14 nt, Neisseria meningitidis Z2491
gccaaaaaauuuuc

SEQ ID NO: 1389806 - RNA, 14 nt, Neisseria meningitidis Z2491
gccaaaaacagaaa

SEQ ID NO: 1389807 - RNA, 14 nt, Neisseria meningitidis Z2491
gccaaaaaaaagcc

SEQ ID NO: 1389808 - RNA, 13 nt, Neisseria meningitidis Z2491
gccaaaaaaaccg

SEQ ID NO: 1389809 - RNA, 17 nt, Neisseria meningitidis Z2491
gccaaaaaaaccgaaac

SEQ ID NO: 1389810 - RNA, 19 nt, Neisseria meningitidis Z2491
gcauugaccacuucagggc

SEQ ID NO: 1389811 - RNA, 18 nt, Neisseria meningitidis Z2491
gcaucguccacuucaacc

SEQ ID NO: 1389812 - RNA, 21 nt, Neisseria meningitidis Z2491
gcaugagguuagcggauuuug

SEQ ID NO: 1389813 - RNA, 20 nt, Neisseria meningitidis Z2491
gcagguagcggcugagggcu

SEQ ID NO: 1389814 - RNA, 24 nt, Neisseria meningitidis Z2491
gcagguaggguguauggcguagcu

SEQ ID NO: 1389815 - RNA, 20 nt, Neisseria meningitidis Z2491
gcagggcaaguuugccgccu

SEQ ID NO: 1389816 - RNA, 17 nt, Neisseria meningitidis Z2491
gcaggccaaaccccauu

SEQ ID NO: 1389817 - RNA, 14 nt, Neisseria meningitidis Z2491
gcaggcgggaaucc

SEQ ID NO: 1389818 - RNA, 17 nt, Neisseria meningitidis Z2491
gcaggcgggaauccaga

SEQ ID NO: 1389819 - RNA, 17 nt, Neisseria meningitidis Z2491
gcaggcgggaauccagu

SEQ ID NO: 1389820 - RNA, 18 nt, Neisseria meningitidis Z2491
gcaggcgggaaucuagaa

SEQ ID NO: 1389821 - RNA, 19 nt, Neisseria meningitidis Z2491
gcaggauuuuaagcuguug

SEQ ID NO: 1389822 - RNA, 16 nt, Neisseria meningitidis Z2491
gcaggcaaaaaaaaua

SEQ ID NO: 1389823 - RNA, 12 nt, Neisseria meningitidis Z2491
gcaggcaaauac

SEQ ID NO: 1389824 - RNA, 20 nt, Neisseria meningitidis Z2491
gcaggcagugcaugaauuug

SEQ ID NO: 1389825 - RNA, 19 nt, Neisseria meningitidis Z2491
gcaggcacaaggcggcggc

SEQ ID NO: 1389826 - RNA, 22 nt, Neisseria meningitidis Z2491
gcaggcagcguucgacgaugga

SEQ ID NO: 1389827 - RNA, 18 nt, Neisseria meningitidis Z2491
gcaggaugcugcggaugg

SEQ ID NO: 1389828 - RNA, 13 nt, Neisseria meningitidis Z2491
gcagccggggcag

SEQ ID NO: 1389829 - RNA, 19 nt, Neisseria meningitidis Z2491
gcagccugcucgagcggca

SEQ ID NO: 1389830 - RNA, 19 nt, Neisseria meningitidis Z2491
gcagccugcagcagagcug

SEQ ID NO: 1389831 - RNA, 23 nt, Neisseria meningitidis Z2491
gcagccugcagcagagcugugca

SEQ ID NO: 1389832 - RNA, 22 nt, Neisseria meningitidis Z2491
gcagccuuaacagggaaagcag

SEQ ID NO: 1389833 - RNA, 15 nt, Neisseria meningitidis Z2491
gcagcgacggauguc

SEQ ID NO: 1389834 - RNA, 11 nt, Neisseria meningitidis Z2491
gcagccgagca

SEQ ID NO: 1389835 - RNA, 13 nt, Neisseria meningitidis Z2491
gcagcccucccca

SEQ ID NO: 1389836 - RNA, 17 nt, Neisseria meningitidis Z2491
gcagcccugauaaaaaa

SEQ ID NO: 1389837 - RNA, 20 nt, Neisseria meningitidis Z2491
gcagcacaucgucugcaagc

SEQ ID NO: 1389838 - RNA, 14 nt, Neisseria meningitidis Z2491
gcagcacaggcaag

SEQ ID NO: 1389839 - RNA, 18 nt, Neisseria meningitidis Z2491
gcagcaauacgcaaaaca

SEQ ID NO: 1389840 - RNA, 22 nt, Neisseria meningitidis Z2491
gcagcaccguuuaaaacagcau

SEQ ID NO: 1389841 - RNA, 14 nt, Neisseria meningitidis Z2491
gcagcagagcugug

SEQ ID NO: 1389842 - RNA, 13 nt, Neisseria meningitidis Z2491
gcagccagcaucg

SEQ ID NO: 1389843 - RNA, 15 nt, Neisseria meningitidis Z2491
gcagccauauuuuuu

SEQ ID NO: 1389844 - RNA, 22 nt, Neisseria meningitidis Z2491
gcagcaguuuugccggcgcggu

SEQ ID NO: 1389845 - RNA, 15 nt, Neisseria meningitidis Z2491
gcagcauaacaccuu

SEQ ID NO: 1389846 - RNA, 15 nt, Neisseria meningitidis Z2491
gcagaauaaggcaau

SEQ ID NO: 1389847 - RNA, 19 nt, Neisseria meningitidis Z2491
gcagacaaaccguccccuu

SEQ ID NO: 1389848 - RNA, 17 nt, Neisseria meningitidis Z2491
gcagacaguacaaauag

SEQ ID NO: 1389849 - RNA, 18 nt, Neisseria meningitidis Z2491
gcagacgaacaccagccc

SEQ ID NO: 1389850 - RNA, 17 nt, Neisseria meningitidis Z2491
gcagauguucggcaaga

SEQ ID NO: 1389851 - RNA, 22 nt, Neisseria meningitidis Z2491
gcagauguucggcaagaucgga

SEQ ID NO: 1389852 - RNA, 15 nt, Neisseria meningitidis Z2491
gcagauggcuguguu

SEQ ID NO: 1389853 - RNA, 21 nt, Neisseria meningitidis Z2491
gcagaugaagcugcaacugaa

SEQ ID NO: 1389854 - RNA, 20 nt, Neisseria meningitidis Z2491
gcagauagucgccgagcaga

SEQ ID NO: 1389855 - RNA, 21 nt, Neisseria meningitidis Z2491
gcagauacaacaaacaggaca

SEQ ID NO: 1389856 - RNA, 16 nt, Neisseria meningitidis Z2491
gcacuucaaguccgaa

SEQ ID NO: 1389857 - RNA, 11 nt, Neisseria meningitidis Z2491
gcacuuagccu

SEQ ID NO: 1389858 - RNA, 20 nt, Neisseria meningitidis Z2491
gcacugccucuuuucagaca

SEQ ID NO: 1389859 - RNA, 20 nt, Neisseria meningitidis Z2491
gcacuugccgcauaaaucaa

SEQ ID NO: 1389860 - RNA, 14 nt, Neisseria meningitidis Z2491
gcacugaucagaca

SEQ ID NO: 1389861 - RNA, 19 nt, Neisseria meningitidis Z2491
gcacgguggcaucgucaga

SEQ ID NO: 1389862 - RNA, 16 nt, Neisseria meningitidis Z2491
gcacggcguucaacau

SEQ ID NO: 1389863 - RNA, 24 nt, Neisseria meningitidis Z2491
gcacggcguucaacauccgcagac

SEQ ID NO: 1389864 - RNA, 16 nt, Neisseria meningitidis Z2491
gcacgaaucuuaucca

SEQ ID NO: 1389865 - RNA, 14 nt, Neisseria meningitidis Z2491
gcaccuuagagaau

SEQ ID NO: 1389866 - RNA, 21 nt, Neisseria meningitidis Z2491
gcaccuuagagaaucguucuc

SEQ ID NO: 1389867 - RNA, 20 nt, Neisseria meningitidis Z2491
gcacgauacacaaaaaagcc

SEQ ID NO: 1389868 - RNA, 14 nt, Neisseria meningitidis Z2491
gcacgccgccgugu

SEQ ID NO: 1389869 - RNA, 15 nt, Neisseria meningitidis Z2491
gcaccaauucuucaa

SEQ ID NO: 1389870 - RNA, 18 nt, Neisseria meningitidis Z2491
gcaccacgucauucccac

SEQ ID NO: 1389871 - RNA, 23 nt, Neisseria meningitidis Z2491
gcaccguuaacgauacggcggca

SEQ ID NO: 1389872 - RNA, 13 nt, Neisseria meningitidis Z2491
gcaccguuuucaa

SEQ ID NO: 1389873 - RNA, 14 nt, Neisseria meningitidis Z2491
gcaccguuuuccac

SEQ ID NO: 1389874 - RNA, 16 nt, Neisseria meningitidis Z2491
gcaccugacgcuccag

SEQ ID NO: 1389875 - RNA, 19 nt, Neisseria meningitidis Z2491
gcaccugacgcuccagcuc

SEQ ID NO: 1389876 - RNA, 13 nt, Neisseria meningitidis Z2491
gcaccgggcuuca

SEQ ID NO: 1389877 - RNA, 20 nt, Neisseria meningitidis Z2491
gcaccgccgccccuuaugcc

SEQ ID NO: 1389878 - RNA, 12 nt, Neisseria meningitidis Z2491
gcaccgccgccc

SEQ ID NO: 1389879 - RNA, 20 nt, Neisseria meningitidis Z2491
gcacacguuugccguugaug

SEQ ID NO: 1389880 - RNA, 17 nt, Neisseria meningitidis Z2491
gcacagaaaccugcacc

SEQ ID NO: 1389881 - RNA, 18 nt, Neisseria meningitidis Z2491
gcacaagcccuaaauacg

SEQ ID NO: 1389882 - RNA, 15 nt, Neisseria meningitidis Z2491
gcacaaaugccaaag

SEQ ID NO: 1389883 - RNA, 16 nt, Neisseria meningitidis Z2491
gcacauuuuuuucaua

SEQ ID NO: 1389884 - RNA, 18 nt, Neisseria meningitidis Z2491
gcacagccuauuuuucug

SEQ ID NO: 1389885 - RNA, 19 nt, Neisseria meningitidis Z2491
gcacaggcucaaacagcag

SEQ ID NO: 1389886 - RNA, 23 nt, Neisseria meningitidis Z2491
gcaaugccgucugaacccgccug

SEQ ID NO: 1389887 - RNA, 22 nt, Neisseria meningitidis Z2491
gcaaugcgccuucuucaaauuc

SEQ ID NO: 1389888 - RNA, 19 nt, Neisseria meningitidis Z2491
gcaauuaaauuuagcguaa

SEQ ID NO: 1389889 - RNA, 16 nt, Neisseria meningitidis Z2491
gcaauugaaaaauuuu

SEQ ID NO: 1389890 - RNA, 16 nt, Neisseria meningitidis Z2491
gcaauugaaaauuuuu

SEQ ID NO: 1389891 - RNA, 15 nt, Neisseria meningitidis Z2491
gcaauuuaucgggaa

SEQ ID NO: 1389892 - RNA, 19 nt, Neisseria meningitidis Z2491
gcaaucugaaauuuugcca

SEQ ID NO: 1389893 - RNA, 16 nt, Neisseria meningitidis Z2491
gcaaugcacuacuuca

SEQ ID NO: 1389894 - RNA, 16 nt, Neisseria meningitidis Z2491
gcaauccacgcaauca

SEQ ID NO: 1389895 - RNA, 19 nt, Neisseria meningitidis Z2491
gcaauccacgcaaucaaga

SEQ ID NO: 1389896 - RNA, 12 nt, Neisseria meningitidis Z2491
gcaaucaaaucc

SEQ ID NO: 1389897 - RNA, 15 nt, Neisseria meningitidis Z2491
gcaaucaaaauaaac

SEQ ID NO: 1389898 - RNA, 17 nt, Neisseria meningitidis Z2491
gcaaucaaaauaaacuu

SEQ ID NO: 1389899 - RNA, 15 nt, Neisseria meningitidis Z2491
gcaagccuuucaaca

SEQ ID NO: 1389900 - RNA, 16 nt, Neisseria meningitidis Z2491
gcaagacuuuuucgcg

SEQ ID NO: 1389901 - RNA, 23 nt, Neisseria meningitidis Z2491
gcaagacuuuuucgcgcaccagc

SEQ ID NO: 1389902 - RNA, 23 nt, Neisseria meningitidis Z2491
gcaagacgaagaaauagccgccg

SEQ ID NO: 1389903 - RNA, 15 nt, Neisseria meningitidis Z2491
gcaaggacgggcagg

SEQ ID NO: 1389904 - RNA, 14 nt, Neisseria meningitidis Z2491
gcaagcguguccug

SEQ ID NO: 1389905 - RNA, 14 nt, Neisseria meningitidis Z2491
gcaaggcgccggcg

SEQ ID NO: 1389906 - RNA, 16 nt, Neisseria meningitidis Z2491
gcaaggcgccggcggc

SEQ ID NO: 1389907 - RNA, 13 nt, Neisseria meningitidis Z2491
gcaaggcggcggc

SEQ ID NO: 1389908 - RNA, 23 nt, Neisseria meningitidis Z2491
gcaaggcggcggcguucaaauca

SEQ ID NO: 1389909 - RNA, 17 nt, Neisseria meningitidis Z2491
gcaauacgcaaaacaaa

SEQ ID NO: 1389910 - RNA, 18 nt, Neisseria meningitidis Z2491
gcaauaccgcaaccugaa

SEQ ID NO: 1389911 - RNA, 16 nt, Neisseria meningitidis Z2491
gcaauaucuugccgau

SEQ ID NO: 1389912 - RNA, 14 nt, Neisseria meningitidis Z2491
gcaauauucaaaga

SEQ ID NO: 1389913 - RNA, 23 nt, Neisseria meningitidis Z2491
gcaaggucggcggcggauucggu

SEQ ID NO: 1389914 - RNA, 17 nt, Neisseria meningitidis Z2491
gcaagucaaaggcuucg

SEQ ID NO: 1389915 - RNA, 22 nt, Neisseria meningitidis Z2491
gcaaccuuuccgccgucauucc

SEQ ID NO: 1389916 - RNA, 19 nt, Neisseria meningitidis Z2491
gcaaccuuucgucauuccc

SEQ ID NO: 1389917 - RNA, 17 nt, Neisseria meningitidis Z2491
gcaacgacagcagcagc

SEQ ID NO: 1389918 - RNA, 13 nt, Neisseria meningitidis Z2491
gcaaccgucagua

SEQ ID NO: 1389919 - RNA, 16 nt, Neisseria meningitidis Z2491
gcaaccgguccuucca

SEQ ID NO: 1389920 - RNA, 20 nt, Neisseria meningitidis Z2491
gcaacggcaauauucaaaga

SEQ ID NO: 1389921 - RNA, 22 nt, Neisseria meningitidis Z2491
gcaacgcuugaaucuucauucc

SEQ ID NO: 1389922 - RNA, 16 nt, Neisseria meningitidis Z2491
gcaacgcgcaaacccg

SEQ ID NO: 1389923 - RNA, 21 nt, Neisseria meningitidis Z2491
gcaacucuccgucauucccac

SEQ ID NO: 1389924 - RNA, 19 nt, Neisseria meningitidis Z2491
gcaacugaaccgucauucc

SEQ ID NO: 1389925 - RNA, 21 nt, Neisseria meningitidis Z2491
gcaacuuugcguuucuagauu

SEQ ID NO: 1389926 - RNA, 12 nt, Neisseria meningitidis Z2491
gcaagaauuuau

SEQ ID NO: 1389927 - RNA, 14 nt, Neisseria meningitidis Z2491
gcaagaauuuauca

SEQ ID NO: 1389928 - RNA, 19 nt, Neisseria meningitidis Z2491
gcaagaauuuuuauagugg

SEQ ID NO: 1389929 - RNA, 20 nt, Neisseria meningitidis Z2491
gcaagaccgauaacggcggc

SEQ ID NO: 1389930 - RNA, 18 nt, Neisseria meningitidis Z2491
gcaagaccaaacagaacg

SEQ ID NO: 1389931 - RNA, 17 nt, Neisseria meningitidis Z2491
aaagcggaauacggcaa

SEQ ID NO: 1389932 - RNA, 23 nt, Neisseria meningitidis Z2491
aaagcggaauacggcaacaucau

SEQ ID NO: 1389933 - RNA, 17 nt, Neisseria meningitidis Z2491
gcgcgggaaugacggga

SEQ ID NO: 1389934 - RNA, 15 nt, Neisseria meningitidis Z2491
gcgcguaucggcggc

SEQ ID NO: 1389935 - RNA, 18 nt, Neisseria meningitidis Z2491
gcgcggauucgccaggcg

SEQ ID NO: 1389936 - RNA, 15 nt, Neisseria meningitidis Z2491
gcgcggaggcggagc

SEQ ID NO: 1389937 - RNA, 16 nt, Neisseria meningitidis Z2491
gcggacuuaagaaaca

SEQ ID NO: 1389938 - RNA, 17 nt, Neisseria meningitidis Z2491
gcggacuuaagaaacaa

SEQ ID NO: 1389939 - RNA, 14 nt, Neisseria meningitidis Z2491
gcggacagugcagc

SEQ ID NO: 1389940 - RNA, 16 nt, Neisseria meningitidis Z2491
gcggcacuugccgcau

SEQ ID NO: 1389941 - RNA, 17 nt, Neisseria meningitidis Z2491
gcggcagugguuggcga

SEQ ID NO: 1389942 - RNA, 19 nt, Neisseria meningitidis Z2491
gcggcaggucuucgggcag

SEQ ID NO: 1389943 - RNA, 19 nt, Neisseria meningitidis Z2491
gcggcagggucggcgacgg

SEQ ID NO: 1389944 - RNA, 18 nt, Neisseria meningitidis Z2491
gcggcgagccgcagacgg

SEQ ID NO: 1389945 - RNA, 17 nt, Neisseria meningitidis Z2491
gcguaauuccggcagcc

SEQ ID NO: 1389946 - RNA, 20 nt, Neisseria meningitidis Z2491
gcguaaaacgguguggagag

SEQ ID NO: 1389947 - RNA, 19 nt, Neisseria meningitidis Z2491
gcgguuguggaaggcgggc

SEQ ID NO: 1389948 - RNA, 17 nt, Neisseria meningitidis Z2491
gcggugugcgccgccgg

SEQ ID NO: 1389949 - RNA, 22 nt, Neisseria meningitidis Z2491
gcggugucggacaccagcgcga

SEQ ID NO: 1389950 - RNA, 21 nt, Neisseria meningitidis Z2491
gcgguucagacggcauuuuua

SEQ ID NO: 1389951 - RNA, 13 nt, Neisseria meningitidis Z2491
gcggugcgcggca

SEQ ID NO: 1389952 - RNA, 18 nt, Neisseria meningitidis Z2491
gcggucgcaucggcggcg

SEQ ID NO: 1389953 - RNA, 14 nt, Neisseria meningitidis Z2491
gcgguagccgccuu

SEQ ID NO: 1389954 - RNA, 22 nt, Neisseria meningitidis Z2491
gcggguggcgaagccggcggcg

SEQ ID NO: 1389955 - RNA, 18 nt, Neisseria meningitidis Z2491
gcgggauuacugccgcaa

SEQ ID NO: 1389956 - RNA, 16 nt, Neisseria meningitidis Z2491
gcgggcaggcggcugc

SEQ ID NO: 1389957 - RNA, 15 nt, Neisseria meningitidis Z2491
gcgugacgaaaauuu

SEQ ID NO: 1389958 - RNA, 19 nt, Neisseria meningitidis Z2491
gcgugacgaaaauuuaucc

SEQ ID NO: 1389959 - RNA, 15 nt, Neisseria meningitidis Z2491
gcgugccggucagga

SEQ ID NO: 1389960 - RNA, 13 nt, Neisseria meningitidis Z2491
gcguggaggggca

SEQ ID NO: 1389961 - RNA, 15 nt, Neisseria meningitidis Z2491
gcgucaaaaacgggc

SEQ ID NO: 1389962 - RNA, 14 nt, Neisseria meningitidis Z2491
gcgucaaaccagcu

SEQ ID NO: 1389963 - RNA, 19 nt, Neisseria meningitidis Z2491
gcguaggguugaagaaacc

SEQ ID NO: 1389964 - RNA, 18 nt, Neisseria meningitidis Z2491
gcguagccggccaacauc

SEQ ID NO: 1389965 - RNA, 22 nt, Neisseria meningitidis Z2491
gcgucccaaauauuggcgggcg

SEQ ID NO: 1389966 - RNA, 13 nt, Neisseria meningitidis Z2491
gcuggcagacgua

SEQ ID NO: 1389967 - RNA, 16 nt, Neisseria meningitidis Z2491
gcugcuuugguaaaaa

SEQ ID NO: 1389968 - RNA, 18 nt, Neisseria meningitidis Z2491
gcugcuuugguaaaaaaa

SEQ ID NO: 1389969 - RNA, 13 nt, Neisseria meningitidis Z2491
gcugcuguauuuu

SEQ ID NO: 1389970 - RNA, 15 nt, Neisseria meningitidis Z2491
gcugcuguauuuuuc

SEQ ID NO: 1389971 - RNA, 15 nt, Neisseria meningitidis Z2491
gcugccgaaaccaaa

SEQ ID NO: 1389972 - RNA, 14 nt, Neisseria meningitidis Z2491
gcugcgggaaugac

SEQ ID NO: 1389973 - RNA, 15 nt, Neisseria meningitidis Z2491
gcugcgucgcgggcg

SEQ ID NO: 1389974 - RNA, 21 nt, Neisseria meningitidis Z2491
gcugcgggcgcguuugauuug

SEQ ID NO: 1389975 - RNA, 14 nt, Neisseria meningitidis Z2491
aaagcuggauuccc

SEQ ID NO: 1389976 - RNA, 13 nt, Neisseria meningitidis Z2491
gcugguaucuuua

SEQ ID NO: 1389977 - RNA, 21 nt, Neisseria meningitidis Z2491
gcugguaucuuuaaacagcau

SEQ ID NO: 1389978 - RNA, 22 nt, Neisseria meningitidis Z2491
aaagcugguagggauacaaauc

SEQ ID NO: 1389979 - RNA, 13 nt, Neisseria meningitidis Z2491
gcugggcaugcag

SEQ ID NO: 1389980 - RNA, 12 nt, Neisseria meningitidis Z2491
gcuguacagguu

SEQ ID NO: 1389981 - RNA, 18 nt, Neisseria meningitidis Z2491
gcuguacagguuugagcc

SEQ ID NO: 1389982 - RNA, 24 nt, Neisseria meningitidis Z2491
gcugucguugugcggcaaaacgcc

SEQ ID NO: 1389983 - RNA, 14 nt, Neisseria meningitidis Z2491
gcugucugaaaccu

SEQ ID NO: 1389984 - RNA, 15 nt, Neisseria meningitidis Z2491
gcugucugaaaccug

SEQ ID NO: 1389985 - RNA, 17 nt, Neisseria meningitidis Z2491
gcugacguaaaaaacua

SEQ ID NO: 1389986 - RNA, 16 nt, Neisseria meningitidis Z2491
gcucccgauaaaugcc

SEQ ID NO: 1389987 - RNA, 23 nt, Neisseria meningitidis Z2491
gcucggaggcuuuguuauuuuua

SEQ ID NO: 1389988 - RNA, 14 nt, Neisseria meningitidis Z2491
gcucaaacagcagg

SEQ ID NO: 1389989 - RNA, 13 nt, Neisseria meningitidis Z2491
gcucaaaaaaccg

SEQ ID NO: 1389990 - RNA, 14 nt, Neisseria meningitidis Z2491
gcucaaaaaaccgg

SEQ ID NO: 1389991 - RNA, 17 nt, Neisseria meningitidis Z2491
gcuaugccugccgaccc

SEQ ID NO: 1389992 - RNA, 21 nt, Neisseria meningitidis Z2491
gcucagcccgaaauaggcugc

SEQ ID NO: 1389993 - RNA, 20 nt, Neisseria meningitidis Z2491
gcguucggauucggaugccu

SEQ ID NO: 1389994 - RNA, 17 nt, Neisseria meningitidis Z2491
gcguucaacauccgcag

SEQ ID NO: 1389995 - RNA, 15 nt, Neisseria meningitidis Z2491
gcguuacuuugcguu

SEQ ID NO: 1389996 - RNA, 21 nt, Neisseria meningitidis Z2491
gcguuaccaauaacggcugcu

SEQ ID NO: 1389997 - RNA, 15 nt, Neisseria meningitidis Z2491
gcguguauuuuggua

SEQ ID NO: 1389998 - RNA, 19 nt, Neisseria meningitidis Z2491
gcguguauuuugguagcug

SEQ ID NO: 1389999 - RNA, 20 nt, Neisseria meningitidis Z2491
gcguuucagagcauugcgca

SEQ ID NO: 1390000 - RNA, 22 nt, Neisseria meningitidis Z2491
gcguuuuuuugccguauccaua

SEQ ID NO: 1390001 - RNA, 11 nt, Neisseria meningitidis Z2491
gcguuuuucag

SEQ ID NO: 1390002 - RNA, 14 nt, Neisseria meningitidis Z2491
gcguuuuucagacg

SEQ ID NO: 1390003 - RNA, 12 nt, Neisseria meningitidis Z2491
gcguuuuucggg

SEQ ID NO: 1390004 - RNA, 19 nt, Neisseria meningitidis Z2491
gcguucgucuaagaaaacc

SEQ ID NO: 1390005 - RNA, 18 nt, Neisseria meningitidis Z2491
gcguugccucgccuugcc

SEQ ID NO: 1390006 - RNA, 15 nt, Neisseria meningitidis Z2491
gcuaccgaaauggaa

SEQ ID NO: 1390007 - RNA, 17 nt, Neisseria meningitidis Z2491
gcuaaagcaauuuaucg

SEQ ID NO: 1390008 - RNA, 17 nt, Neisseria meningitidis Z2491
gcuaacguacaaaugcc

SEQ ID NO: 1390009 - RNA, 14 nt, Neisseria meningitidis Z2491
gcuuuucauuucug

SEQ ID NO: 1390010 - RNA, 19 nt, Neisseria meningitidis Z2491
gcuuuuagccuuuuguuuu

SEQ ID NO: 1390011 - RNA, 15 nt, Neisseria meningitidis Z2491
gcuuuugaguuucgg

SEQ ID NO: 1390012 - RNA, 15 nt, Neisseria meningitidis Z2491
gcuuuuuaauccaca

SEQ ID NO: 1390013 - RNA, 18 nt, Neisseria meningitidis Z2491
gcuuuuggcggcuuuuuu

SEQ ID NO: 1390014 - RNA, 12 nt, Neisseria meningitidis Z2491
gcuuuuuccugu

SEQ ID NO: 1390015 - RNA, 18 nt, Neisseria meningitidis Z2491
ggaaaaccguguuucaga

SEQ ID NO: 1390016 - RNA, 22 nt, Neisseria meningitidis Z2491
ggaaaaaucauaagacggauca

SEQ ID NO: 1390017 - RNA, 22 nt, Neisseria meningitidis Z2491
ggaaaaaaggcuucagacggua

SEQ ID NO: 1390018 - RNA, 18 nt, Neisseria meningitidis Z2491
ggaaaaacagcaaccuuu

SEQ ID NO: 1390019 - RNA, 12 nt, Neisseria meningitidis Z2491
gcuuucggggaa

SEQ ID NO: 1390020 - RNA, 14 nt, Neisseria meningitidis Z2491
gcuuuguaagaguu

SEQ ID NO: 1390021 - RNA, 21 nt, Neisseria meningitidis Z2491
gcuuuguaagaguucguccca

SEQ ID NO: 1390022 - RNA, 18 nt, Neisseria meningitidis Z2491
ggaacgcgucaaccuuaa

SEQ ID NO: 1390023 - RNA, 23 nt, Neisseria meningitidis Z2491
ggaaccgauucacuuggugcuuc

SEQ ID NO: 1390024 - RNA, 19 nt, Neisseria meningitidis Z2491
ggaaccguuuuccgcccga

SEQ ID NO: 1390025 - RNA, 16 nt, Neisseria meningitidis Z2491
ggaagauucggcugcu

SEQ ID NO: 1390026 - RNA, 18 nt, Neisseria meningitidis Z2491
ggaauagcucaguuggua

SEQ ID NO: 1390027 - RNA, 13 nt, Neisseria meningitidis Z2491
ggaaggguuuugu

SEQ ID NO: 1390028 - RNA, 23 nt, Neisseria meningitidis Z2491
ggaauaugguugaaacccggcca

SEQ ID NO: 1390029 - RNA, 16 nt, Neisseria meningitidis Z2491
ggaaagguucagcagg

SEQ ID NO: 1390030 - RNA, 20 nt, Neisseria meningitidis Z2491
ggaaaguggguguagcgugg

SEQ ID NO: 1390031 - RNA, 17 nt, Neisseria meningitidis Z2491
ggaaaugucgcccgaca

SEQ ID NO: 1390032 - RNA, 15 nt, Neisseria meningitidis Z2491
ggaaaugacugaaac

SEQ ID NO: 1390033 - RNA, 17 nt, Neisseria meningitidis Z2491
ggaaaugacugaaacuc

SEQ ID NO: 1390034 - RNA, 20 nt, Neisseria meningitidis Z2491
ggaaaugacugaaacucaaa

SEQ ID NO: 1390035 - RNA, 17 nt, Neisseria meningitidis Z2491
ggaaaucguaggucuuc

SEQ ID NO: 1390036 - RNA, 22 nt, Neisseria meningitidis Z2491
ggaaacgaaaagcuaaagcaau

SEQ ID NO: 1390037 - RNA, 18 nt, Neisseria meningitidis Z2491
ggaaacuuuucauaucau

SEQ ID NO: 1390038 - RNA, 22 nt, Neisseria meningitidis Z2491
ggaaacuuuucauaucaugccg

SEQ ID NO: 1390039 - RNA, 17 nt, Neisseria meningitidis Z2491
ggaaaaucaaaaucaga

SEQ ID NO: 1390040 - RNA, 13 nt, Neisseria meningitidis Z2491
ggaaaccaaaaaa

SEQ ID NO: 1390041 - RNA, 19 nt, Neisseria meningitidis Z2491
ggaaacagcauccuuuccu

SEQ ID NO: 1390042 - RNA, 20 nt, Neisseria meningitidis Z2491
ggagucuggcggcaucccac

SEQ ID NO: 1390043 - RNA, 13 nt, Neisseria meningitidis Z2491
ggauaggcugcug

SEQ ID NO: 1390044 - RNA, 21 nt, Neisseria meningitidis Z2491
ggagucgccuucgcaagccaa

SEQ ID NO: 1390045 - RNA, 14 nt, Neisseria meningitidis Z2491
ggagguaacgguuu

SEQ ID NO: 1390046 - RNA, 16 nt, Neisseria meningitidis Z2491
ggaucagacauuaaaa

SEQ ID NO: 1390047 - RNA, 15 nt, Neisseria meningitidis Z2491
ggagccuaucaucag

SEQ ID NO: 1390048 - RNA, 13 nt, Neisseria meningitidis Z2491
ggagcgguuucug

SEQ ID NO: 1390049 - RNA, 14 nt, Neisseria meningitidis Z2491
ggagcgguuucugu

SEQ ID NO: 1390050 - RNA, 21 nt, Neisseria meningitidis Z2491
ggagggauauucccccgcgca

SEQ ID NO: 1390051 - RNA, 21 nt, Neisseria meningitidis Z2491
ggagggacagcgugaaaccuu

SEQ ID NO: 1390052 - RNA, 21 nt, Neisseria meningitidis Z2491
ggacggcggauuucagugcug

SEQ ID NO: 1390053 - RNA, 12 nt, Neisseria meningitidis Z2491
ggacgggaaguu

SEQ ID NO: 1390054 - RNA, 20 nt, Neisseria meningitidis Z2491
ggaaucuggaaaccaaaaaa

SEQ ID NO: 1390055 - RNA, 22 nt, Neisseria meningitidis Z2491
ggaaucuagaaacgcaaagcug

SEQ ID NO: 1390056 - RNA, 19 nt, Neisseria meningitidis Z2491
ggaaucuagaaccucaaac

SEQ ID NO: 1390057 - RNA, 21 nt, Neisseria meningitidis Z2491
ggaaucuagacauucaaugcu

SEQ ID NO: 1390058 - RNA, 21 nt, Neisseria meningitidis Z2491
ggaaugacggcaaccggccgg

SEQ ID NO: 1390059 - RNA, 16 nt, Neisseria meningitidis Z2491
ggaaugacggcagagc

SEQ ID NO: 1390060 - RNA, 19 nt, Neisseria meningitidis Z2491
ggaaugacgggaugcaggu

SEQ ID NO: 1390061 - RNA, 16 nt, Neisseria meningitidis Z2491
ggaaugacugaaacuc

SEQ ID NO: 1390062 - RNA, 21 nt, Neisseria meningitidis Z2491
ggaaucgauucacuuggugcu

SEQ ID NO: 1390063 - RNA, 13 nt, Neisseria meningitidis Z2491
ggaauccagacca

SEQ ID NO: 1390064 - RNA, 15 nt, Neisseria meningitidis Z2491
ggaauccaguuucuu

SEQ ID NO: 1390065 - RNA, 19 nt, Neisseria meningitidis Z2491
aaagggcaguugggaauca

SEQ ID NO: 1390066 - RNA, 18 nt, Neisseria meningitidis Z2491
aaagggcuucagacggca

SEQ ID NO: 1390067 - RNA, 20 nt, Neisseria meningitidis Z2491
ggcaaaugcugucugaaacc

SEQ ID NO: 1390068 - RNA, 13 nt, Neisseria meningitidis Z2491
ggcaaauuucagu

SEQ ID NO: 1390069 - RNA, 20 nt, Neisseria meningitidis Z2491
ggcaaaauccgcaaacggca

SEQ ID NO: 1390070 - RNA, 16 nt, Neisseria meningitidis Z2491
ggcaauauucaaagau

SEQ ID NO: 1390071 - RNA, 18 nt, Neisseria meningitidis Z2491
ggcaauauucaaagauua

SEQ ID NO: 1390072 - RNA, 16 nt, Neisseria meningitidis Z2491
ggcaauaauaaacgcc

SEQ ID NO: 1390073 - RNA, 18 nt, Neisseria meningitidis Z2491
ggcaauaauggcaaccaa

SEQ ID NO: 1390074 - RNA, 17 nt, Neisseria meningitidis Z2491
ggcaaugaggcaauaga

SEQ ID NO: 1390075 - RNA, 13 nt, Neisseria meningitidis Z2491
ggcaaugaaaacc

SEQ ID NO: 1390076 - RNA, 20 nt, Neisseria meningitidis Z2491
ggcaaucguuucugucgcca

SEQ ID NO: 1390077 - RNA, 21 nt, Neisseria meningitidis Z2491
ggcacaggcucaaacagcagg

SEQ ID NO: 1390078 - RNA, 22 nt, Neisseria meningitidis Z2491
ggcacaggcucaaacagcaggu

SEQ ID NO: 1390079 - RNA, 20 nt, Neisseria meningitidis Z2491
ggcaauuuaucgggaaugac

SEQ ID NO: 1390080 - RNA, 19 nt, Neisseria meningitidis Z2491
ggcaauuugacacuucaca

SEQ ID NO: 1390081 - RNA, 17 nt, Neisseria meningitidis Z2491
ggcacaaacgccagcac

SEQ ID NO: 1390082 - RNA, 16 nt, Neisseria meningitidis Z2491
ggcacaaggcggcggc

SEQ ID NO: 1390083 - RNA, 17 nt, Neisseria meningitidis Z2491
ggcacaaggcggcggca

SEQ ID NO: 1390084 - RNA, 21 nt, Neisseria meningitidis Z2491
ggcagccaccucgccgcgcgu

SEQ ID NO: 1390085 - RNA, 13 nt, Neisseria meningitidis Z2491
ggcagcacaggca

SEQ ID NO: 1390086 - RNA, 14 nt, Neisseria meningitidis Z2491
ggcagcacaggcaa

SEQ ID NO: 1390087 - RNA, 22 nt, Neisseria meningitidis Z2491
ggcacggcgcaggcaaacgcga

SEQ ID NO: 1390088 - RNA, 17 nt, Neisseria meningitidis Z2491
ggcaucccaguuuugca

SEQ ID NO: 1390089 - RNA, 13 nt, Neisseria meningitidis Z2491
ggcagcguggagg

SEQ ID NO: 1390090 - RNA, 22 nt, Neisseria meningitidis Z2491
ggcagucccguuugaaaacaau

SEQ ID NO: 1390091 - RNA, 20 nt, Neisseria meningitidis Z2491
ggcaguuuccaauacaacaa

SEQ ID NO: 1390092 - RNA, 22 nt, Neisseria meningitidis Z2491
ggcaguuuccaauacaacaaaa

SEQ ID NO: 1390093 - RNA, 16 nt, Neisseria meningitidis Z2491
ggcagugccguuuugu

SEQ ID NO: 1390094 - RNA, 13 nt, Neisseria meningitidis Z2491
ggcaguuccaaag

SEQ ID NO: 1390095 - RNA, 17 nt, Neisseria meningitidis Z2491
ggcaguuccaaagccuu

SEQ ID NO: 1390096 - RNA, 19 nt, Neisseria meningitidis Z2491
ggcauuucugcgaaagcgg

SEQ ID NO: 1390097 - RNA, 14 nt, Neisseria meningitidis Z2491
ggcauuugcacacg

SEQ ID NO: 1390098 - RNA, 20 nt, Neisseria meningitidis Z2491
ggcauuuugcugccggcagg

SEQ ID NO: 1390099 - RNA, 18 nt, Neisseria meningitidis Z2491
ggcauuuucaacagcagg

SEQ ID NO: 1390100 - RNA, 18 nt, Neisseria meningitidis Z2491
ggcauuuucuauuuuaca

SEQ ID NO: 1390101 - RNA, 22 nt, Neisseria meningitidis Z2491
ggcauuuuuuacacaauuccca

SEQ ID NO: 1390102 - RNA, 21 nt, Neisseria meningitidis Z2491
ggcaugaacuugggccacuuu

SEQ ID NO: 1390103 - RNA, 21 nt, Neisseria meningitidis Z2491
ggccauucccucaaaaacaga

SEQ ID NO: 1390104 - RNA, 23 nt, Neisseria meningitidis Z2491
ggccauucccucaaaaacagaaa

SEQ ID NO: 1390105 - RNA, 16 nt, Neisseria meningitidis Z2491
ggcggcugcgggcgcg

SEQ ID NO: 1390106 - RNA, 19 nt, Neisseria meningitidis Z2491
ggcggcgaagccgcagaca

SEQ ID NO: 1390107 - RNA, 14 nt, Neisseria meningitidis Z2491
ggcggcgguuuccu

SEQ ID NO: 1390108 - RNA, 22 nt, Neisseria meningitidis Z2491
ggcggcuacuccugcugcggcg

SEQ ID NO: 1390109 - RNA, 14 nt, Neisseria meningitidis Z2491
ggcggaaccugcug

SEQ ID NO: 1390110 - RNA, 15 nt, Neisseria meningitidis Z2491
ggcguuggcucgccu

SEQ ID NO: 1390111 - RNA, 23 nt, Neisseria meningitidis Z2491
ggcguuggcucgccuuagcucaa

SEQ ID NO: 1390112 - RNA, 17 nt, Neisseria meningitidis Z2491
ggcgugccgaugagucc

SEQ ID NO: 1390113 - RNA, 15 nt, Neisseria meningitidis Z2491
ggcgcacuuagccug

SEQ ID NO: 1390114 - RNA, 12 nt, Neisseria meningitidis Z2491
ggcgcggcuggu

SEQ ID NO: 1390115 - RNA, 22 nt, Neisseria meningitidis Z2491
aaauacuuauaucgucauuuau

SEQ ID NO: 1390116 - RNA, 17 nt, Neisseria meningitidis Z2491
aaauacugaggaaacca

SEQ ID NO: 1390117 - RNA, 14 nt, Neisseria meningitidis Z2491
aaauaaauucugaa

SEQ ID NO: 1390118 - RNA, 15 nt, Neisseria meningitidis Z2491
aaauaaacucauuga

SEQ ID NO: 1390119 - RNA, 17 nt, Neisseria meningitidis Z2491
aaauaaaaauacuuaua

SEQ ID NO: 1390120 - RNA, 12 nt, Neisseria meningitidis Z2491
aaauaaaaauac

SEQ ID NO: 1390121 - RNA, 13 nt, Neisseria meningitidis Z2491
aaauaaaacaaaa

SEQ ID NO: 1390122 - RNA, 21 nt, Neisseria meningitidis Z2491
ggccgguagugauggcaagcu

SEQ ID NO: 1390123 - RNA, 20 nt, Neisseria meningitidis Z2491
ggccgucugaaacacuguuc

SEQ ID NO: 1390124 - RNA, 20 nt, Neisseria meningitidis Z2491
aaaguuacagaaauuuauaa

SEQ ID NO: 1390125 - RNA, 23 nt, Neisseria meningitidis Z2491
aaaguuauucaauuuaaacacuu

SEQ ID NO: 1390126 - RNA, 19 nt, Neisseria meningitidis Z2491
aaaguggguguagcguggg

SEQ ID NO: 1390127 - RNA, 15 nt, Neisseria meningitidis Z2491
aaaguggaacagaaa

SEQ ID NO: 1390128 - RNA, 19 nt, Neisseria meningitidis Z2491
aaaguggaacagaaagcaa

SEQ ID NO: 1390129 - RNA, 19 nt, Neisseria meningitidis Z2491
aaagugccauuuaaaaucu

SEQ ID NO: 1390130 - RNA, 21 nt, Neisseria meningitidis Z2491
ggccggaaaaccuugccgccc

SEQ ID NO: 1390131 - RNA, 23 nt, Neisseria meningitidis Z2491
ggccggcgcagcuccucccuccc

SEQ ID NO: 1390132 - RNA, 21 nt, Neisseria meningitidis Z2491
gaggcaacgacguacugguuu

SEQ ID NO: 1390133 - RNA, 18 nt, Neisseria meningitidis Z2491
gaggcaacgcuguacugg

SEQ ID NO: 1390134 - RNA, 21 nt, Neisseria meningitidis Z2491
gaggcaacgcuguacugguuu

SEQ ID NO: 1390135 - RNA, 11 nt, Neisseria meningitidis Z2491
gagggaaugac

SEQ ID NO: 1390136 - RNA, 15 nt, Neisseria meningitidis Z2491
gagggaaugacggga

SEQ ID NO: 1390137 - RNA, 23 nt, Neisseria meningitidis Z2491
gagggaaugacgggauuugagau

SEQ ID NO: 1390138 - RNA, 14 nt, Neisseria meningitidis Z2491
gaggcugcauucga

SEQ ID NO: 1390139 - RNA, 21 nt, Neisseria meningitidis Z2491
gaggcaguuuuuuauccggcu

SEQ ID NO: 1390140 - RNA, 17 nt, Neisseria meningitidis Z2491
gagguauuuggggcgaa

SEQ ID NO: 1390141 - RNA, 19 nt, Neisseria meningitidis Z2491
gauaaauugccuuagcauu

SEQ ID NO: 1390142 - RNA, 17 nt, Neisseria meningitidis Z2491
gagucucagggcuggca

SEQ ID NO: 1390143 - RNA, 13 nt, Neisseria meningitidis Z2491
gauauuuucuucc

SEQ ID NO: 1390144 - RNA, 11 nt, Neisseria meningitidis Z2491
gauauuuuuga

SEQ ID NO: 1390145 - RNA, 15 nt, Neisseria meningitidis Z2491
gauauuguucagacg

SEQ ID NO: 1390146 - RNA, 14 nt, Neisseria meningitidis Z2491
gauauaacuuuaau

SEQ ID NO: 1390147 - RNA, 17 nt, Neisseria meningitidis Z2491
gauacggugucuucaau

SEQ ID NO: 1390148 - RNA, 21 nt, Neisseria meningitidis Z2491
gauaauagugccgucaaauua

SEQ ID NO: 1390149 - RNA, 20 nt, Neisseria meningitidis Z2491
gauaaugcccacaaucugaa

SEQ ID NO: 1390150 - RNA, 12 nt, Neisseria meningitidis Z2491
gauacacaaaaa

SEQ ID NO: 1390151 - RNA, 17 nt, Neisseria meningitidis Z2491
gauacacaaaaaagcca

SEQ ID NO: 1390152 - RNA, 20 nt, Neisseria meningitidis Z2491
gauacacaaaaaagccagca

SEQ ID NO: 1390153 - RNA, 16 nt, Neisseria meningitidis Z2491
gauacaagaacuuuau

SEQ ID NO: 1390154 - RNA, 13 nt, Neisseria meningitidis Z2491
gagcaggugcugg

SEQ ID NO: 1390155 - RNA, 18 nt, Neisseria meningitidis Z2491
gagcaggugcuggguggu

SEQ ID NO: 1390156 - RNA, 16 nt, Neisseria meningitidis Z2491
gagcaggguuuucaug

SEQ ID NO: 1390157 - RNA, 16 nt, Neisseria meningitidis Z2491
gagcagaaucaaauau

SEQ ID NO: 1390158 - RNA, 13 nt, Neisseria meningitidis Z2491
gagaugcggugcg

SEQ ID NO: 1390159 - RNA, 14 nt, Neisseria meningitidis Z2491
gagcaauuaaauuu

SEQ ID NO: 1390160 - RNA, 21 nt, Neisseria meningitidis Z2491
gagacggcaucgguuucuucu

SEQ ID NO: 1390161 - RNA, 17 nt, Neisseria meningitidis Z2491
gagacggcggcaacaga

SEQ ID NO: 1390162 - RNA, 10 nt, Neisseria meningitidis Z2491
gagagaauga

SEQ ID NO: 1390163 - RNA, 20 nt, Neisseria meningitidis Z2491
gagaaucguucucuuugagu

SEQ ID NO: 1390164 - RNA, 16 nt, Neisseria meningitidis Z2491
gagaccuuugcaaaaa

SEQ ID NO: 1390165 - RNA, 19 nt, Neisseria meningitidis Z2491
gagaccuuugcaaaaauaa

SEQ ID NO: 1390166 - RNA, 21 nt, Neisseria meningitidis Z2491
gagacaacgccguacugguuu

SEQ ID NO: 1390167 - RNA, 21 nt, Neisseria meningitidis Z2491
gagacaaucaucaucacaaug

SEQ ID NO: 1390168 - RNA, 12 nt, Neisseria meningitidis Z2491
gagaaaacagaa

SEQ ID NO: 1390169 - RNA, 14 nt, Neisseria meningitidis Z2491
gacuuaagaaacaa

SEQ ID NO: 1390170 - RNA, 11 nt, Neisseria meningitidis Z2491
gacuucugaca

SEQ ID NO: 1390171 - RNA, 14 nt, Neisseria meningitidis Z2491
gacuuucagauaau

SEQ ID NO: 1390172 - RNA, 22 nt, Neisseria meningitidis Z2491
gacuuucagauaaucuuugaau

SEQ ID NO: 1390173 - RNA, 12 nt, Neisseria meningitidis Z2491
gacugaaacuca

SEQ ID NO: 1390174 - RNA, 14 nt, Neisseria meningitidis Z2491
gacugaaacucaaa

SEQ ID NO: 1390175 - RNA, 21 nt, Neisseria meningitidis Z2491
gacugaaacucaaaaaaacua

SEQ ID NO: 1390176 - RNA, 23 nt, Neisseria meningitidis Z2491
gacugaaacucaacgaaccugga

SEQ ID NO: 1390177 - RNA, 15 nt, Neisseria meningitidis Z2491
gacucgcuugcuggu

SEQ ID NO: 1390178 - RNA, 17 nt, Neisseria meningitidis Z2491
gacguuuccgcccugcc

SEQ ID NO: 1390179 - RNA, 16 nt, Neisseria meningitidis Z2491
gacguugccuucuucg

SEQ ID NO: 1390180 - RNA, 19 nt, Neisseria meningitidis Z2491
gacuguccgagacagaacc

SEQ ID NO: 1390181 - RNA, 16 nt, Neisseria meningitidis Z2491
gacuguaaagauaaau

SEQ ID NO: 1390182 - RNA, 16 nt, Neisseria meningitidis Z2491
gaccguaucauacaua

SEQ ID NO: 1390183 - RNA, 19 nt, Neisseria meningitidis Z2491
gaccguuccgaaaccaaga

SEQ ID NO: 1390184 - RNA, 20 nt, Neisseria meningitidis Z2491
gaccuuagaacaacaguaau

SEQ ID NO: 1390185 - RNA, 17 nt, Neisseria meningitidis Z2491
gacgaugccgaacagcu

SEQ ID NO: 1390186 - RNA, 15 nt, Neisseria meningitidis Z2491
gacgaccaucgucca

SEQ ID NO: 1390187 - RNA, 16 nt, Neisseria meningitidis Z2491
gacgcggcugcugccu

SEQ ID NO: 1390188 - RNA, 12 nt, Neisseria meningitidis Z2491
gacgguggugcg

SEQ ID NO: 1390189 - RNA, 18 nt, Neisseria meningitidis Z2491
gacgguguuuuauuuuuu

SEQ ID NO: 1390190 - RNA, 14 nt, Neisseria meningitidis Z2491
gacgguacaaauag

SEQ ID NO: 1390191 - RNA, 18 nt, Neisseria meningitidis Z2491
gacguaaaaucuauagug

SEQ ID NO: 1390192 - RNA, 14 nt, Neisseria meningitidis Z2491
gacgguucggacac

SEQ ID NO: 1390193 - RNA, 17 nt, Neisseria meningitidis Z2491
gacggauguucaaacac

SEQ ID NO: 1390194 - RNA, 15 nt, Neisseria meningitidis Z2491
gacggcaauauucaa

SEQ ID NO: 1390195 - RNA, 19 nt, Neisseria meningitidis Z2491
gacggcuuugccguuuuuc

SEQ ID NO: 1390196 - RNA, 15 nt, Neisseria meningitidis Z2491
gacgggaaguuuuuu

SEQ ID NO: 1390197 - RNA, 19 nt, Neisseria meningitidis Z2491
gacggggguuuggcgggaa

SEQ ID NO: 1390198 - RNA, 21 nt, Neisseria meningitidis Z2491
gacaggcaaaugcugucugaa

SEQ ID NO: 1390199 - RNA, 22 nt, Neisseria meningitidis Z2491
gacauaccgccccuaaaaugcc

SEQ ID NO: 1390200 - RNA, 21 nt, Neisseria meningitidis Z2491
gacaggaaauuuccaaauaua

SEQ ID NO: 1390201 - RNA, 18 nt, Neisseria meningitidis Z2491
gacauuaagauguuuuuc

SEQ ID NO: 1390202 - RNA, 21 nt, Neisseria meningitidis Z2491
gacauuaagauguuuuuccac

SEQ ID NO: 1390203 - RNA, 18 nt, Neisseria meningitidis Z2491
gacauagcguguauuuug

SEQ ID NO: 1390204 - RNA, 15 nt, Neisseria meningitidis Z2491
gacacgguucugcac

SEQ ID NO: 1390205 - RNA, 16 nt, Neisseria meningitidis Z2491
gacacggcuuaucuaa

SEQ ID NO: 1390206 - RNA, 15 nt, Neisseria meningitidis Z2491
gacacauagccggcg

SEQ ID NO: 1390207 - RNA, 18 nt, Neisseria meningitidis Z2491
gacacuucacauuuucua

SEQ ID NO: 1390208 - RNA, 13 nt, Neisseria meningitidis Z2491
gacagcagcagcc

SEQ ID NO: 1390209 - RNA, 15 nt, Neisseria meningitidis Z2491
gacagcagcagcccg

SEQ ID NO: 1390210 - RNA, 21 nt, Neisseria meningitidis Z2491
gacagcagccggacagcccau

SEQ ID NO: 1390211 - RNA, 13 nt, Neisseria meningitidis Z2491
gaccagccgccuc

SEQ ID NO: 1390212 - RNA, 18 nt, Neisseria meningitidis Z2491
gaccagccgccuccauca

SEQ ID NO: 1390213 - RNA, 20 nt, Neisseria meningitidis Z2491
gaccaguucccacgcccugu

SEQ ID NO: 1390214 - RNA, 20 nt, Neisseria meningitidis Z2491
gaauuugucggcaaucuucc

SEQ ID NO: 1390215 - RNA, 22 nt, Neisseria meningitidis Z2491
gaauuugcggcaaauuuacagc

SEQ ID NO: 1390216 - RNA, 17 nt, Neisseria meningitidis Z2491
gaauggaaaugccgucu

SEQ ID NO: 1390217 - RNA, 17 nt, Neisseria meningitidis Z2491
gaauggccgauuuuggg

SEQ ID NO: 1390218 - RNA, 15 nt, Neisseria meningitidis Z2491
gacaaaucuggauuc

SEQ ID NO: 1390219 - RNA, 22 nt, Neisseria meningitidis Z2491
gacaaucagaucggcaaacccu

SEQ ID NO: 1390220 - RNA, 13 nt, Neisseria meningitidis Z2491
gacaaucaggaaa

SEQ ID NO: 1390221 - RNA, 14 nt, Neisseria meningitidis Z2491
gacaaucaggaaaa

SEQ ID NO: 1390222 - RNA, 19 nt, Neisseria meningitidis Z2491
gaauauugcuguuguucua

SEQ ID NO: 1390223 - RNA, 19 nt, Neisseria meningitidis Z2491
gaauauuacuguuguucua

SEQ ID NO: 1390224 - RNA, 14 nt, Neisseria meningitidis Z2491
gaaugccacacgca

SEQ ID NO: 1390225 - RNA, 12 nt, Neisseria meningitidis Z2491
gaaucuagaauc

SEQ ID NO: 1390226 - RNA, 14 nt, Neisseria meningitidis Z2491
gaaucuagaauccc

SEQ ID NO: 1390227 - RNA, 14 nt, Neisseria meningitidis Z2491
gaaucuagacauuc

SEQ ID NO: 1390228 - RNA, 16 nt, Neisseria meningitidis Z2491
gaaucuagacauucaa

SEQ ID NO: 1390229 - RNA, 22 nt, Neisseria meningitidis Z2491
gaaucuagacauucaaugcuaa

SEQ ID NO: 1390230 - RNA, 17 nt, Neisseria meningitidis Z2491
gaaucuagaaacgcaaa

SEQ ID NO: 1390231 - RNA, 15 nt, Neisseria meningitidis Z2491
gaaucuagaaacuca

SEQ ID NO: 1390232 - RNA, 21 nt, Neisseria meningitidis Z2491
gaaucuagaaacucaaagcug

SEQ ID NO: 1390233 - RNA, 23 nt, Neisseria meningitidis Z2491
gaaucuagaacguaaaaucucaa

SEQ ID NO: 1390234 - RNA, 15 nt, Neisseria meningitidis Z2491
gaaucgccuccgcac

SEQ ID NO: 1390235 - RNA, 14 nt, Neisseria meningitidis Z2491
gaauccgguuuuuu

SEQ ID NO: 1390236 - RNA, 22 nt, Neisseria meningitidis Z2491
gaaucagaccgaauuuaaucaa

SEQ ID NO: 1390237 - RNA, 18 nt, Neisseria meningitidis Z2491
gaaucacuuggucuuugc

SEQ ID NO: 1390238 - RNA, 21 nt, Neisseria meningitidis Z2491
gaauccggagucucagggcug

SEQ ID NO: 1390239 - RNA, 15 nt, Neisseria meningitidis Z2491
gaauacggcaacauc

SEQ ID NO: 1390240 - RNA, 16 nt, Neisseria meningitidis Z2491
gaauacggcaacauca

SEQ ID NO: 1390241 - RNA, 21 nt, Neisseria meningitidis Z2491
gaauacggcaacaucauagaa

SEQ ID NO: 1390242 - RNA, 13 nt, Neisseria meningitidis Z2491
gaauacaaacauc

SEQ ID NO: 1390243 - RNA, 15 nt, Neisseria meningitidis Z2491
gaauaaugaaaaugu

SEQ ID NO: 1390244 - RNA, 17 nt, Neisseria meningitidis Z2491
gaauaaauuuugaaacu

SEQ ID NO: 1390245 - RNA, 14 nt, Neisseria meningitidis Z2491
gaaggcuaucacgg

SEQ ID NO: 1390246 - RNA, 20 nt, Neisseria meningitidis Z2491
gaagccagccccaccauugu

SEQ ID NO: 1390247 - RNA, 16 nt, Neisseria meningitidis Z2491
gaagcauaagccgcca

SEQ ID NO: 1390248 - RNA, 16 nt, Neisseria meningitidis Z2491
gaagcucaaaaaaccg

SEQ ID NO: 1390249 - RNA, 13 nt, Neisseria meningitidis Z2491
gaagccgcagaca

SEQ ID NO: 1390250 - RNA, 12 nt, Neisseria meningitidis Z2491
gaagaagugcgu

SEQ ID NO: 1390251 - RNA, 13 nt, Neisseria meningitidis Z2491
gaagaucauaccu

SEQ ID NO: 1390252 - RNA, 15 nt, Neisseria meningitidis Z2491
gaaaggcuuuuucag

SEQ ID NO: 1390253 - RNA, 18 nt, Neisseria meningitidis Z2491
gaaaggcuuuuucagacg

SEQ ID NO: 1390254 - RNA, 13 nt, Neisseria meningitidis Z2491
gaaaguggaauug

SEQ ID NO: 1390255 - RNA, 14 nt, Neisseria meningitidis Z2491
gaaagugggaaucc

SEQ ID NO: 1390256 - RNA, 17 nt, Neisseria meningitidis Z2491
gaaagugggaauccaga

SEQ ID NO: 1390257 - RNA, 13 nt, Neisseria meningitidis Z2491
gaaauaggcugcc

SEQ ID NO: 1390258 - RNA, 17 nt, Neisseria meningitidis Z2491
gaaauaugguucagacg

SEQ ID NO: 1390259 - RNA, 13 nt, Neisseria meningitidis Z2491
gaaauaucgucau

SEQ ID NO: 1390260 - RNA, 20 nt, Neisseria meningitidis Z2491
gaaauaaaagcaucuuguuu

SEQ ID NO: 1390261 - RNA, 19 nt, Neisseria meningitidis Z2491
gaaaguuugaaguucuaga

SEQ ID NO: 1390262 - RNA, 19 nt, Neisseria meningitidis Z2491
gaaaguuugagguucuaga

SEQ ID NO: 1390263 - RNA, 16 nt, Neisseria meningitidis Z2491
gaaaguuugccgaccc

SEQ ID NO: 1390264 - RNA, 20 nt, Neisseria meningitidis Z2491
gaaaguuuagagguucuaga

SEQ ID NO: 1390265 - RNA, 19 nt, Neisseria meningitidis Z2491
gaaacggugggucaacauu

SEQ ID NO: 1390266 - RNA, 22 nt, Neisseria meningitidis Z2491
gaaacggcauccuugaucugcg

SEQ ID NO: 1390267 - RNA, 14 nt, Neisseria meningitidis Z2491
gaaacggacaaacc

SEQ ID NO: 1390268 - RNA, 16 nt, Neisseria meningitidis Z2491
gaaacggacaacggca

SEQ ID NO: 1390269 - RNA, 20 nt, Neisseria meningitidis Z2491
gaaacggagauucccguuuc

SEQ ID NO: 1390270 - RNA, 19 nt, Neisseria meningitidis Z2491
gaaacgguuguucaaaucg

SEQ ID NO: 1390271 - RNA, 16 nt, Neisseria meningitidis Z2491
gaaacuuuaaucccgu

SEQ ID NO: 1390272 - RNA, 16 nt, Neisseria meningitidis Z2491
gaaacgcauucagacg

SEQ ID NO: 1390273 - RNA, 22 nt, Neisseria meningitidis Z2491
gaaagccaaaaacagaaaccua

SEQ ID NO: 1390274 - RNA, 18 nt, Neisseria meningitidis Z2491
gaaagagggaaucuagaa

SEQ ID NO: 1390275 - RNA, 19 nt, Neisseria meningitidis Z2491
gaaagagggaaucuagaaa

SEQ ID NO: 1390276 - RNA, 15 nt, Neisseria meningitidis Z2491
gaacaggcggcggca

SEQ ID NO: 1390277 - RNA, 19 nt, Neisseria meningitidis Z2491
gaacaggcggcggcauauc

SEQ ID NO: 1390278 - RNA, 21 nt, Neisseria meningitidis Z2491
gaacagugggaaagauuugca

SEQ ID NO: 1390279 - RNA, 17 nt, Neisseria meningitidis Z2491
gaacaguguuucagacg

SEQ ID NO: 1390280 - RNA, 22 nt, Neisseria meningitidis Z2491
gaacaguguuucagacggccuu

SEQ ID NO: 1390281 - RNA, 21 nt, Neisseria meningitidis Z2491
gaacagaaaaccaaaaacaga

SEQ ID NO: 1390282 - RNA, 22 nt, Neisseria meningitidis Z2491
gaacagaaaaccaaaaacagaa

SEQ ID NO: 1390283 - RNA, 14 nt, Neisseria meningitidis Z2491
gaacagaaaccuca

SEQ ID NO: 1390284 - RNA, 14 nt, Neisseria meningitidis Z2491
gaacacaaaaaacu

SEQ ID NO: 1390285 - RNA, 22 nt, Neisseria meningitidis Z2491
gaaauuuccaaauauaaaaaau

SEQ ID NO: 1390286 - RNA, 12 nt, Neisseria meningitidis Z2491
gaaauuucagac

SEQ ID NO: 1390287 - RNA, 23 nt, Neisseria meningitidis Z2491
gaaauuucagacggcguuuuugu

SEQ ID NO: 1390288 - RNA, 13 nt, Neisseria meningitidis Z2491
gaaaucuauaucu

SEQ ID NO: 1390289 - RNA, 14 nt, Neisseria meningitidis Z2491
gaaauguucagacg

SEQ ID NO: 1390290 - RNA, 16 nt, Neisseria meningitidis Z2491
gaaaugccgucugaac

SEQ ID NO: 1390291 - RNA, 21 nt, Neisseria meningitidis Z2491
gaaaugccgucugaagcccuu

SEQ ID NO: 1390292 - RNA, 22 nt, Neisseria meningitidis Z2491
gaaaugccgucugaagccuguu

SEQ ID NO: 1390293 - RNA, 18 nt, Neisseria meningitidis Z2491
cuuuuggcggcuuuuuug

SEQ ID NO: 1390294 - RNA, 12 nt, Neisseria meningitidis Z2491
cuuuuuaaucca

SEQ ID NO: 1390295 - RNA, 22 nt, Neisseria meningitidis Z2491
cuuuuuaaacaacaaauuuuug

SEQ ID NO: 1390296 - RNA, 23 nt, Neisseria meningitidis Z2491
cuuuuuaaacaacaaauuuuuga

SEQ ID NO: 1390297 - RNA, 17 nt, Neisseria meningitidis Z2491
cuuuuuaugccuguucu

SEQ ID NO: 1390298 - RNA, 21 nt, Neisseria meningitidis Z2491
cuuuuuaugccuguucuuuuu

SEQ ID NO: 1390299 - RNA, 18 nt, Neisseria meningitidis Z2491
gaaaaaaugccgucugaa

SEQ ID NO: 1390300 - RNA, 22 nt, Neisseria meningitidis Z2491
gaaaaacgacgagaauuuauca

SEQ ID NO: 1390301 - RNA, 20 nt, Neisseria meningitidis Z2491
gaaaaacagcaaucaaaaua

SEQ ID NO: 1390302 - RNA, 12 nt, Neisseria meningitidis Z2491
gaaaaaauaauu

SEQ ID NO: 1390303 - RNA, 16 nt, Neisseria meningitidis Z2491
cuuuuuugaauuuuug

SEQ ID NO: 1390304 - RNA, 21 nt, Neisseria meningitidis Z2491
cuuuuugcaggaucuuaucca

SEQ ID NO: 1390305 - RNA, 19 nt, Neisseria meningitidis Z2491
cuuuuuggcgcauuuuuuc

SEQ ID NO: 1390306 - RNA, 17 nt, Neisseria meningitidis Z2491
gaaaccucaaaucccgu

SEQ ID NO: 1390307 - RNA, 19 nt, Neisseria meningitidis Z2491
gaaaccuaaaaucccguca

SEQ ID NO: 1390308 - RNA, 14 nt, Neisseria meningitidis Z2491
gaaaccuaaaauuc

SEQ ID NO: 1390309 - RNA, 18 nt, Neisseria meningitidis Z2491
gaaaccugaaaacagaaa

SEQ ID NO: 1390310 - RNA, 14 nt, Neisseria meningitidis Z2491
gaaacgaaaaugcc

SEQ ID NO: 1390311 - RNA, 12 nt, Neisseria meningitidis Z2491
gaaacccaaaca

SEQ ID NO: 1390312 - RNA, 23 nt, Neisseria meningitidis Z2491
gaaaccccuaaaggcuucagacg

SEQ ID NO: 1390313 - RNA, 16 nt, Neisseria meningitidis Z2491
gaaacccgauuccugu

SEQ ID NO: 1390314 - RNA, 22 nt, Neisseria meningitidis Z2491
gaaaccacacccguuaaggcag

SEQ ID NO: 1390315 - RNA, 21 nt, Neisseria meningitidis Z2491
gaaaccaaaucggcuuucaga

SEQ ID NO: 1390316 - RNA, 18 nt, Neisseria meningitidis Z2491
gaaaccaaaaaacaacag

SEQ ID NO: 1390317 - RNA, 15 nt, Neisseria meningitidis Z2491
gaaacaacugaaacc

SEQ ID NO: 1390318 - RNA, 14 nt, Neisseria meningitidis Z2491
gaaacauagccuuc

SEQ ID NO: 1390319 - RNA, 14 nt, Neisseria meningitidis Z2491
gaaacagaaaccca

SEQ ID NO: 1390320 - RNA, 20 nt, Neisseria meningitidis Z2491
gaaacagacauugcuaaaac

SEQ ID NO: 1390321 - RNA, 22 nt, Neisseria meningitidis Z2491
gaaacagacauugcuaaaacaa

SEQ ID NO: 1390322 - RNA, 18 nt, Neisseria meningitidis Z2491
gaaacagccaggcgcagg

SEQ ID NO: 1390323 - RNA, 23 nt, Neisseria meningitidis Z2491
gaaacagccaggcgcagguuuug

SEQ ID NO: 1390324 - RNA, 18 nt, Neisseria meningitidis Z2491
gaaacagaucgguuuccc

SEQ ID NO: 1390325 - RNA, 20 nt, Neisseria meningitidis Z2491
gaaacagaucgguuucccgu

SEQ ID NO: 1390326 - RNA, 19 nt, Neisseria meningitidis Z2491
gaaaauuucuugauuuuuc

SEQ ID NO: 1390327 - RNA, 22 nt, Neisseria meningitidis Z2491
gaaaauuuaaaaggucuagauu

SEQ ID NO: 1390328 - RNA, 18 nt, Neisseria meningitidis Z2491
gaaaagugcgguaaauuu

SEQ ID NO: 1390329 - RNA, 15 nt, Neisseria meningitidis Z2491
gaaaaggucgucuga

SEQ ID NO: 1390330 - RNA, 14 nt, Neisseria meningitidis Z2491
gaaaagcuaaagca

SEQ ID NO: 1390331 - RNA, 23 nt, Neisseria meningitidis Z2491
gaaaaaugccgucugaagccuuc

SEQ ID NO: 1390332 - RNA, 22 nt, Neisseria meningitidis Z2491
gaaaaaucuguggauaaacauu

SEQ ID NO: 1390333 - RNA, 22 nt, Neisseria meningitidis Z2491
cuuucagacggcauaaaugcgu

SEQ ID NO: 1390334 - RNA, 21 nt, Neisseria meningitidis Z2491
cuuucagacggcaucaaaaug

SEQ ID NO: 1390335 - RNA, 22 nt, Neisseria meningitidis Z2491
cuuucagacggcaucaaaauga

SEQ ID NO: 1390336 - RNA, 20 nt, Neisseria meningitidis Z2491
cuuucagacggcauuucccg

SEQ ID NO: 1390337 - RNA, 20 nt, Neisseria meningitidis Z2491
cuuucagacggcauuuuuuu

SEQ ID NO: 1390338 - RNA, 19 nt, Neisseria meningitidis Z2491
cuuucacgggaaugacgaa

SEQ ID NO: 1390339 - RNA, 22 nt, Neisseria meningitidis Z2491
cuuucaaaagguucaaacacau

SEQ ID NO: 1390340 - RNA, 18 nt, Neisseria meningitidis Z2491
cuuuaagcaaucaucucu

SEQ ID NO: 1390341 - RNA, 14 nt, Neisseria meningitidis Z2491
aaagacauccccca

SEQ ID NO: 1390342 - RNA, 13 nt, Neisseria meningitidis Z2491
cuuucguauccaa

SEQ ID NO: 1390343 - RNA, 15 nt, Neisseria meningitidis Z2491
cuuucguauccaaau

SEQ ID NO: 1390344 - RNA, 23 nt, Neisseria meningitidis Z2491
cuuugaauauugcuguuguucua

SEQ ID NO: 1390345 - RNA, 23 nt, Neisseria meningitidis Z2491
cuuucuguuuuuuccgguaaauu

SEQ ID NO: 1390346 - RNA, 18 nt, Neisseria meningitidis Z2491
cuuucuuacgucauucuu

SEQ ID NO: 1390347 - RNA, 15 nt, Neisseria meningitidis Z2491
cuuucgccauaaucu

SEQ ID NO: 1390348 - RNA, 14 nt, Neisseria meningitidis Z2491
cuuucgccgccugu

SEQ ID NO: 1390349 - RNA, 23 nt, Neisseria meningitidis Z2491
cuuuccguucggaacacaaaaaa

SEQ ID NO: 1390350 - RNA, 16 nt, Neisseria meningitidis Z2491
cuuuccucuuucauca

SEQ ID NO: 1390351 - RNA, 16 nt, Neisseria meningitidis Z2491
cuuuggcaaccgucag

SEQ ID NO: 1390352 - RNA, 21 nt, Neisseria meningitidis Z2491
cuuugggcgacggcaauauuc

SEQ ID NO: 1390353 - RNA, 20 nt, Neisseria meningitidis Z2491
cuuugggcucaaugaaaauu

SEQ ID NO: 1390354 - RNA, 14 nt, Neisseria meningitidis Z2491
cuuugagcuggauu

SEQ ID NO: 1390355 - RNA, 22 nt, Neisseria meningitidis Z2491
cuuugaguucgucaaccgugaa

SEQ ID NO: 1390356 - RNA, 15 nt, Neisseria meningitidis Z2491
cuuuggaacaaaaaa

SEQ ID NO: 1390357 - RNA, 20 nt, Neisseria meningitidis Z2491
cuuuggaaugguucggcuug

SEQ ID NO: 1390358 - RNA, 19 nt, Neisseria meningitidis Z2491
cuuggauaaacauuuuugc

SEQ ID NO: 1390359 - RNA, 16 nt, Neisseria meningitidis Z2491
cuuggcagcagaugaa

SEQ ID NO: 1390360 - RNA, 14 nt, Neisseria meningitidis Z2491
cuugggaaaugccg

SEQ ID NO: 1390361 - RNA, 16 nt, Neisseria meningitidis Z2491
cuuggcgggaagccag

SEQ ID NO: 1390362 - RNA, 17 nt, Neisseria meningitidis Z2491
cuuggcgggaagccagg

SEQ ID NO: 1390363 - RNA, 15 nt, Neisseria meningitidis Z2491
aaacuuuucauauca

SEQ ID NO: 1390364 - RNA, 19 nt, Neisseria meningitidis Z2491
aaacuuuucugauuuuucc

SEQ ID NO: 1390365 - RNA, 15 nt, Neisseria meningitidis Z2491
cuugucaagaaacac

SEQ ID NO: 1390366 - RNA, 15 nt, Neisseria meningitidis Z2491
cuugucaaaccaacc

SEQ ID NO: 1390367 - RNA, 18 nt, Neisseria meningitidis Z2491
cuuggugcuucagcaccu

SEQ ID NO: 1390368 - RNA, 20 nt, Neisseria meningitidis Z2491
cuuggugcuucagcaccuua

SEQ ID NO: 1390369 - RNA, 13 nt, Neisseria meningitidis Z2491
cuuggucaaaaug

SEQ ID NO: 1390370 - RNA, 14 nt, Neisseria meningitidis Z2491
cuugugccugcucc

SEQ ID NO: 1390371 - RNA, 21 nt, Neisseria meningitidis Z2491
cuugugccagcucuugaaaua

SEQ ID NO: 1390372 - RNA, 17 nt, Neisseria meningitidis Z2491
cuugugaaguagacaaa

SEQ ID NO: 1390373 - RNA, 24 nt, Neisseria meningitidis Z2491
cuugucgggauugucgauaguguu

SEQ ID NO: 1390374 - RNA, 16 nt, Neisseria meningitidis Z2491
cuuguccugauuuuug

SEQ ID NO: 1390375 - RNA, 20 nt, Neisseria meningitidis Z2491
cuuguccugauuuuuguuaa

SEQ ID NO: 1390376 - RNA, 13 nt, Neisseria meningitidis Z2491
aaagaaauguaaa

SEQ ID NO: 1390377 - RNA, 15 nt, Neisseria meningitidis Z2491
cuuguucggaaucac

SEQ ID NO: 1390378 - RNA, 17 nt, Neisseria meningitidis Z2491
cuucaaaccccuucaaa

SEQ ID NO: 1390379 - RNA, 23 nt, Neisseria meningitidis Z2491
cuucaggauguuuucggcauggc

SEQ ID NO: 1390380 - RNA, 16 nt, Neisseria meningitidis Z2491
cuucagauggcuuugu

SEQ ID NO: 1390381 - RNA, 15 nt, Neisseria meningitidis Z2491
cuucaucagcauuuc

SEQ ID NO: 1390382 - RNA, 16 nt, Neisseria meningitidis Z2491
cuucgacguugccuuc

SEQ ID NO: 1390383 - RNA, 14 nt, Neisseria meningitidis Z2491
cuucgacgaaggcu

SEQ ID NO: 1390384 - RNA, 22 nt, Neisseria meningitidis Z2491
cuucgcgacgguauugaugucu

SEQ ID NO: 1390385 - RNA, 13 nt, Neisseria meningitidis Z2491
cuucgcgggacau

SEQ ID NO: 1390386 - RNA, 21 nt, Neisseria meningitidis Z2491
cuucgggcgugccggucagga

SEQ ID NO: 1390387 - RNA, 21 nt, Neisseria meningitidis Z2491
cuuccagaccagccgccucca

SEQ ID NO: 1390388 - RNA, 19 nt, Neisseria meningitidis Z2491
cuuccaacccuccgccgca

SEQ ID NO: 1390389 - RNA, 16 nt, Neisseria meningitidis Z2491
cuuccaacgcgcgcag

SEQ ID NO: 1390390 - RNA, 14 nt, Neisseria meningitidis Z2491
cuucccgcgccaau

SEQ ID NO: 1390391 - RNA, 23 nt, Neisseria meningitidis Z2491
cuucccgggucgcuuuauuuugu

SEQ ID NO: 1390392 - RNA, 22 nt, Neisseria meningitidis Z2491
cuuccaguugcgggccuuuggc

SEQ ID NO: 1390393 - RNA, 13 nt, Neisseria meningitidis Z2491
cuuagcucaaaga

SEQ ID NO: 1390394 - RNA, 19 nt, Neisseria meningitidis Z2491
cuuauagucugagacggcg

SEQ ID NO: 1390395 - RNA, 20 nt, Neisseria meningitidis Z2491
cuuauaguggauuaaauuua

SEQ ID NO: 1390396 - RNA, 19 nt, Neisseria meningitidis Z2491
cuuauguauaguaauaaau

SEQ ID NO: 1390397 - RNA, 16 nt, Neisseria meningitidis Z2491
cuuauuucacuuccaa

SEQ ID NO: 1390398 - RNA, 19 nt, Neisseria meningitidis Z2491
cuuaugcuucggucagguu

SEQ ID NO: 1390399 - RNA, 14 nt, Neisseria meningitidis Z2491
cuuaugccuauuuu

SEQ ID NO: 1390400 - RNA, 15 nt, Neisseria meningitidis Z2491
cuuaugccuauuuuu

SEQ ID NO: 1390401 - RNA, 17 nt, Neisseria meningitidis Z2491
cuuaugccuuuuucaaa

SEQ ID NO: 1390402 - RNA, 20 nt, Neisseria meningitidis Z2491
cuuacccgcuuuuuucagau

SEQ ID NO: 1390403 - RNA, 19 nt, Neisseria meningitidis Z2491
cuuacucguucggcagccu

SEQ ID NO: 1390404 - RNA, 13 nt, Neisseria meningitidis Z2491
cuuaaaaaacaaa

SEQ ID NO: 1390405 - RNA, 14 nt, Neisseria meningitidis Z2491
cuuaaaaaacaacu

SEQ ID NO: 1390406 - RNA, 18 nt, Neisseria meningitidis Z2491
cuguuuuuagucuuuuuu

SEQ ID NO: 1390407 - RNA, 18 nt, Neisseria meningitidis Z2491
cuguuuuucaaagcccaa

SEQ ID NO: 1390408 - RNA, 17 nt, Neisseria meningitidis Z2491
cuguuuuugagggaaug

SEQ ID NO: 1390409 - RNA, 14 nt, Neisseria meningitidis Z2491
cuguuucuucaaaa

SEQ ID NO: 1390410 - RNA, 21 nt, Neisseria meningitidis Z2491
cuguuucgguuuucuauuuug

SEQ ID NO: 1390411 - RNA, 13 nt, Neisseria meningitidis Z2491
cuuaauccucucc

SEQ ID NO: 1390412 - RNA, 22 nt, Neisseria meningitidis Z2491
cuuaacagggaaagcagcagcc

SEQ ID NO: 1390413 - RNA, 24 nt, Neisseria meningitidis Z2491
cuuaacagggaaagcagcagcccu

SEQ ID NO: 1390414 - RNA, 17 nt, Neisseria meningitidis Z2491
aaacugcguuacauaau

SEQ ID NO: 1390415 - RNA, 18 nt, Neisseria meningitidis Z2491
cuguuucgggcaaaagcc

SEQ ID NO: 1390416 - RNA, 19 nt, Neisseria meningitidis Z2491
cuguuucgggcaaaagcca

SEQ ID NO: 1390417 - RNA, 13 nt, Neisseria meningitidis Z2491
cuugccccaaaaa

SEQ ID NO: 1390418 - RNA, 16 nt, Neisseria meningitidis Z2491
cuugccccaaaaagcc

SEQ ID NO: 1390419 - RNA, 19 nt, Neisseria meningitidis Z2491
cuugcccgacgacgaccuc

SEQ ID NO: 1390420 - RNA, 22 nt, Neisseria meningitidis Z2491
aaacuuuaaucccgucauuccc

SEQ ID NO: 1390421 - RNA, 22 nt, Neisseria meningitidis Z2491
aaacuuucagauaaucuuugaa

SEQ ID NO: 1390422 - RNA, 17 nt, Neisseria meningitidis Z2491
cuugccgcauuaaaauu

SEQ ID NO: 1390423 - RNA, 16 nt, Neisseria meningitidis Z2491
cuugcagcuuugaguu

SEQ ID NO: 1390424 - RNA, 18 nt, Neisseria meningitidis Z2491
cuugcccacgcacccaaa

SEQ ID NO: 1390425 - RNA, 14 nt, Neisseria meningitidis Z2491
cuugccauucucac

SEQ ID NO: 1390426 - RNA, 13 nt, Neisseria meningitidis Z2491
cuugcaaaccccu

SEQ ID NO: 1390427 - RNA, 14 nt, Neisseria meningitidis Z2491
cuugcaaaauagaa

SEQ ID NO: 1390428 - RNA, 15 nt, Neisseria meningitidis Z2491
cuugcaaaauagaaa

SEQ ID NO: 1390429 - RNA, 19 nt, Neisseria meningitidis Z2491
cuugcaaauaauugaaauc

SEQ ID NO: 1390430 - RNA, 21 nt, Neisseria meningitidis Z2491
cuugcaaauaauugaaaucaa

SEQ ID NO: 1390431 - RNA, 19 nt, Neisseria meningitidis Z2491
cuugcaagcaguugaaauc

SEQ ID NO: 1390432 - RNA, 16 nt, Neisseria meningitidis Z2491
cuugauggcgaaagca

SEQ ID NO: 1390433 - RNA, 14 nt, Neisseria meningitidis Z2491
cuugagauggucaa

SEQ ID NO: 1390434 - RNA, 16 nt, Neisseria meningitidis Z2491
cuugagcguucagacg

SEQ ID NO: 1390435 - RNA, 16 nt, Neisseria meningitidis Z2491
cuugaguuucagucau

SEQ ID NO: 1390436 - RNA, 17 nt, Neisseria meningitidis Z2491
cuugaggucuuugauga

SEQ ID NO: 1390437 - RNA, 16 nt, Neisseria meningitidis Z2491
cuugauauugcggcuu

SEQ ID NO: 1390438 - RNA, 17 nt, Neisseria meningitidis Z2491
cuugaccgcagccgaac

SEQ ID NO: 1390439 - RNA, 17 nt, Neisseria meningitidis Z2491
cuucuuuccauccauca

SEQ ID NO: 1390440 - RNA, 17 nt, Neisseria meningitidis Z2491
cuugaaaacaucggguu

SEQ ID NO: 1390441 - RNA, 18 nt, Neisseria meningitidis Z2491
cuugaaaacaucggguuu

SEQ ID NO: 1390442 - RNA, 13 nt, Neisseria meningitidis Z2491
cuucuucgucuuu

SEQ ID NO: 1390443 - RNA, 17 nt, Neisseria meningitidis Z2491
cuucgucgccuuguccu

SEQ ID NO: 1390444 - RNA, 13 nt, Neisseria meningitidis Z2491
cuucguccgugcc

SEQ ID NO: 1390445 - RNA, 16 nt, Neisseria meningitidis Z2491
cuucgucuuuuccuuc

SEQ ID NO: 1390446 - RNA, 22 nt, Neisseria meningitidis Z2491
cuucgucauucccgugaaaacg

SEQ ID NO: 1390447 - RNA, 23 nt, Neisseria meningitidis Z2491
cuucgguuguauuuuuauuauua

SEQ ID NO: 1390448 - RNA, 16 nt, Neisseria meningitidis Z2491
cuucuaaaaauucuuc

SEQ ID NO: 1390449 - RNA, 19 nt, Neisseria meningitidis Z2491
cuucugacagcauuuccac

SEQ ID NO: 1390450 - RNA, 14 nt, Neisseria meningitidis Z2491
cggguacuguugca

SEQ ID NO: 1390451 - RNA, 17 nt, Neisseria meningitidis Z2491
cgggucuccgagcauca

SEQ ID NO: 1390452 - RNA, 18 nt, Neisseria meningitidis Z2491
cgggucgcggucggacca

SEQ ID NO: 1390453 - RNA, 14 nt, Neisseria meningitidis Z2491
cgguaaauuuugac

SEQ ID NO: 1390454 - RNA, 18 nt, Neisseria meningitidis Z2491
cggguucggauauuuccg

SEQ ID NO: 1390455 - RNA, 18 nt, Neisseria meningitidis Z2491
cggguucagacggcauca

SEQ ID NO: 1390456 - RNA, 19 nt, Neisseria meningitidis Z2491
cggguggcgaagccggcgg

SEQ ID NO: 1390457 - RNA, 17 nt, Neisseria meningitidis Z2491
cgggcuuuucgggaagu

SEQ ID NO: 1390458 - RNA, 20 nt, Neisseria meningitidis Z2491
cgggcugcgucgcgggcggg

SEQ ID NO: 1390459 - RNA, 16 nt, Neisseria meningitidis Z2491
cggggguuuggcggga

SEQ ID NO: 1390460 - RNA, 15 nt, Neisseria meningitidis Z2491
cgggguugcgcggca

SEQ ID NO: 1390461 - RNA, 22 nt, Neisseria meningitidis Z2491
cggguaaaaucacggugaaaaa

SEQ ID NO: 1390462 - RNA, 22 nt, Neisseria meningitidis Z2491
cggggucaagcgcggaaguggg

SEQ ID NO: 1390463 - RNA, 14 nt, Neisseria meningitidis Z2491
aaacuaaaugccaa

SEQ ID NO: 1390464 - RNA, 20 nt, Neisseria meningitidis Z2491
aaacuaaaugccaaucucuu

SEQ ID NO: 1390465 - RNA, 22 nt, Neisseria meningitidis Z2491
cgguauuuggggcgaaaacagc

SEQ ID NO: 1390466 - RNA, 15 nt, Neisseria meningitidis Z2491
cgguauaaaccaaaa

SEQ ID NO: 1390467 - RNA, 14 nt, Neisseria meningitidis Z2491
cgguagguuuugcu

SEQ ID NO: 1390468 - RNA, 19 nt, Neisseria meningitidis Z2491
cgguagggcaguuccaaag

SEQ ID NO: 1390469 - RNA, 17 nt, Neisseria meningitidis Z2491
cgguaaccacgacgcag

SEQ ID NO: 1390470 - RNA, 13 nt, Neisseria meningitidis Z2491
cggucaggcuuuu

SEQ ID NO: 1390471 - RNA, 15 nt, Neisseria meningitidis Z2491
cgguccaacuucaau

SEQ ID NO: 1390472 - RNA, 19 nt, Neisseria meningitidis Z2491
cgguccaacuucaauagug

SEQ ID NO: 1390473 - RNA, 17 nt, Neisseria meningitidis Z2491
cggucgaggaaccagcg

SEQ ID NO: 1390474 - RNA, 13 nt, Neisseria meningitidis Z2491
cgguccguucagu

SEQ ID NO: 1390475 - RNA, 15 nt, Neisseria meningitidis Z2491
cgguccuuccaucac

SEQ ID NO: 1390476 - RNA, 19 nt, Neisseria meningitidis Z2491
cggucgaaacuuuccaccg

SEQ ID NO: 1390477 - RNA, 20 nt, Neisseria meningitidis Z2491
cggucgaaacuuuccaccgc

SEQ ID NO: 1390478 - RNA, 16 nt, Neisseria meningitidis Z2491
cggugaacacuucuuc

SEQ ID NO: 1390479 - RNA, 22 nt, Neisseria meningitidis Z2491
cggugaacacuucuucgggcgu

SEQ ID NO: 1390480 - RNA, 16 nt, Neisseria meningitidis Z2491
cggucgugcagccugc

SEQ ID NO: 1390481 - RNA, 18 nt, Neisseria meningitidis Z2491
cggucguggcaacuucca

SEQ ID NO: 1390482 - RNA, 18 nt, Neisseria meningitidis Z2491
cgggcagucuuccaaccc

SEQ ID NO: 1390483 - RNA, 22 nt, Neisseria meningitidis Z2491
cgggcauuguuaaguauuucua

SEQ ID NO: 1390484 - RNA, 21 nt, Neisseria meningitidis Z2491
cgggcaaugccgacgcgcugc

SEQ ID NO: 1390485 - RNA, 14 nt, Neisseria meningitidis Z2491
cgggauuuuaaagu

SEQ ID NO: 1390486 - RNA, 15 nt, Neisseria meningitidis Z2491
cgggauuuuaaaguu

SEQ ID NO: 1390487 - RNA, 14 nt, Neisseria meningitidis Z2491
cgggauuuuagguu

SEQ ID NO: 1390488 - RNA, 14 nt, Neisseria meningitidis Z2491
cgggcaaaagccag

SEQ ID NO: 1390489 - RNA, 15 nt, Neisseria meningitidis Z2491
cgggcaaaagccagc

SEQ ID NO: 1390490 - RNA, 15 nt, Neisseria meningitidis Z2491
cgggauucagauguu

SEQ ID NO: 1390491 - RNA, 19 nt, Neisseria meningitidis Z2491
cgggcaacucgauuuccgc

SEQ ID NO: 1390492 - RNA, 23 nt, Neisseria meningitidis Z2491
cgggaaugacgagauuuuagguu

SEQ ID NO: 1390493 - RNA, 15 nt, Neisseria meningitidis Z2491
cgggaauacaaacau

SEQ ID NO: 1390494 - RNA, 23 nt, Neisseria meningitidis Z2491
cgggaauacaaacaucugauuuu

SEQ ID NO: 1390495 - RNA, 17 nt, Neisseria meningitidis Z2491
cgggaaucuagaaauga

SEQ ID NO: 1390496 - RNA, 14 nt, Neisseria meningitidis Z2491
cgggaaucuagaca

SEQ ID NO: 1390497 - RNA, 16 nt, Neisseria meningitidis Z2491
cgggaaucuagaccuu

SEQ ID NO: 1390498 - RNA, 19 nt, Neisseria meningitidis Z2491
cgggaauccggaaacgaaa

SEQ ID NO: 1390499 - RNA, 12 nt, Neisseria meningitidis Z2491
cgggaauccaga

SEQ ID NO: 1390500 - RNA, 17 nt, Neisseria meningitidis Z2491
cgggaauccagaccauu

SEQ ID NO: 1390501 - RNA, 15 nt, Neisseria meningitidis Z2491
cgggaauccaggacg

SEQ ID NO: 1390502 - RNA, 19 nt, Neisseria meningitidis Z2491
cgggaauagcucaguuggu

SEQ ID NO: 1390503 - RNA, 16 nt, Neisseria meningitidis Z2491
cgggaugcagguuucu

SEQ ID NO: 1390504 - RNA, 15 nt, Neisseria meningitidis Z2491
cgggcgcguagccgg

SEQ ID NO: 1390505 - RNA, 21 nt, Neisseria meningitidis Z2491
cgggcguucgucuaagaaaac

SEQ ID NO: 1390506 - RNA, 21 nt, Neisseria meningitidis Z2491
cgggcguucagauuccugccg

SEQ ID NO: 1390507 - RNA, 16 nt, Neisseria meningitidis Z2491
cgggcccauugacaac

SEQ ID NO: 1390508 - RNA, 22 nt, Neisseria meningitidis Z2491
cgggcccauugacaacgcagcc

SEQ ID NO: 1390509 - RNA, 15 nt, Neisseria meningitidis Z2491
cggcuacuccugcug

SEQ ID NO: 1390510 - RNA, 17 nt, Neisseria meningitidis Z2491
cggcuacuccugcugcg

SEQ ID NO: 1390511 - RNA, 16 nt, Neisseria meningitidis Z2491
cggcguuggcucgccu

SEQ ID NO: 1390512 - RNA, 17 nt, Neisseria meningitidis Z2491
cggcguucccucgccuu

SEQ ID NO: 1390513 - RNA, 15 nt, Neisseria meningitidis Z2491
cggcguaggcggcgg

SEQ ID NO: 1390514 - RNA, 22 nt, Neisseria meningitidis Z2491
cggcuuugccgccuuguccuga

SEQ ID NO: 1390515 - RNA, 15 nt, Neisseria meningitidis Z2491
cggcuugccgccgcc

SEQ ID NO: 1390516 - RNA, 20 nt, Neisseria meningitidis Z2491
cgggaacuugauucaagguu

SEQ ID NO: 1390517 - RNA, 15 nt, Neisseria meningitidis Z2491
cggcuguggaacgcg

SEQ ID NO: 1390518 - RNA, 16 nt, Neisseria meningitidis Z2491
cggcugucgucauuuc

SEQ ID NO: 1390519 - RNA, 16 nt, Neisseria meningitidis Z2491
cggcugcuucggcuuc

SEQ ID NO: 1390520 - RNA, 19 nt, Neisseria meningitidis Z2491
cggcugccguaccggucag

SEQ ID NO: 1390521 - RNA, 22 nt, Neisseria meningitidis Z2491
cggcugccgaccgcgcacgcca

SEQ ID NO: 1390522 - RNA, 17 nt, Neisseria meningitidis Z2491
cuaaaaacuaaaugcca

SEQ ID NO: 1390523 - RNA, 12 nt, Neisseria meningitidis Z2491
cuaaaaauucua

SEQ ID NO: 1390524 - RNA, 21 nt, Neisseria meningitidis Z2491
cuaaaaauucuucuuuccauc

SEQ ID NO: 1390525 - RNA, 21 nt, Neisseria meningitidis Z2491
cuaaaacacagccaaaauauu

SEQ ID NO: 1390526 - RNA, 18 nt, Neisseria meningitidis Z2491
cguuugaaaacaaucagu

SEQ ID NO: 1390527 - RNA, 15 nt, Neisseria meningitidis Z2491
cuaaagcaauuuauc

SEQ ID NO: 1390528 - RNA, 16 nt, Neisseria meningitidis Z2491
cuaaagcaauuuaucg

SEQ ID NO: 1390529 - RNA, 14 nt, Neisseria meningitidis Z2491
cuaaaaucccguca

SEQ ID NO: 1390530 - RNA, 20 nt, Neisseria meningitidis Z2491
cuaaacgguauucauaccuc

SEQ ID NO: 1390531 - RNA, 16 nt, Neisseria meningitidis Z2491
cuaaaggcuucagacg

SEQ ID NO: 1390532 - RNA, 17 nt, Neisseria meningitidis Z2491
cuaaauagcguuuuaau

SEQ ID NO: 1390533 - RNA, 17 nt, Neisseria meningitidis Z2491
cuaaauagcugaaacuc

SEQ ID NO: 1390534 - RNA, 19 nt, Neisseria meningitidis Z2491
cuaaauagcugaaacucaa

SEQ ID NO: 1390535 - RNA, 20 nt, Neisseria meningitidis Z2491
cuaaauagcugaaacucaac

SEQ ID NO: 1390536 - RNA, 20 nt, Neisseria meningitidis Z2491
cuaaauugcauuuuuaauuu

SEQ ID NO: 1390537 - RNA, 22 nt, Neisseria meningitidis Z2491
cguuggacgguucguccagcag

SEQ ID NO: 1390538 - RNA, 14 nt, Neisseria meningitidis Z2491
cguugccucgccuu

SEQ ID NO: 1390539 - RNA, 19 nt, Neisseria meningitidis Z2491
cguuaaggcagagauaaaa

SEQ ID NO: 1390540 - RNA, 19 nt, Neisseria meningitidis Z2491
cguuccacaaauccgccug

SEQ ID NO: 1390541 - RNA, 19 nt, Neisseria meningitidis Z2491
cguuaacgauacggcggca

SEQ ID NO: 1390542 - RNA, 18 nt, Neisseria meningitidis Z2491
cguuaacagacuauuuuu

SEQ ID NO: 1390543 - RNA, 16 nt, Neisseria meningitidis Z2491
cguucggaacacaaaa

SEQ ID NO: 1390544 - RNA, 13 nt, Neisseria meningitidis Z2491
cguguucuucaug

SEQ ID NO: 1390545 - RNA, 16 nt, Neisseria meningitidis Z2491
cguguggaaaaagucc

SEQ ID NO: 1390546 - RNA, 15 nt, Neisseria meningitidis Z2491
cgugugaaaauuuaa

SEQ ID NO: 1390547 - RNA, 16 nt, Neisseria meningitidis Z2491
cgugugaaaauuuaaa

SEQ ID NO: 1390548 - RNA, 16 nt, Neisseria meningitidis Z2491
cguggugcagguuucu

SEQ ID NO: 1390549 - RNA, 15 nt, Neisseria meningitidis Z2491
cguggagggacagcg

SEQ ID NO: 1390550 - RNA, 23 nt, Neisseria meningitidis Z2491
cguggaaucuaaagaaaccguuu

SEQ ID NO: 1390551 - RNA, 22 nt, Neisseria meningitidis Z2491
cguggaaucuaagaaaccguuu

SEQ ID NO: 1390552 - RNA, 12 nt, Neisseria meningitidis Z2491
cgugggaaugac

SEQ ID NO: 1390553 - RNA, 17 nt, Neisseria meningitidis Z2491
cguggguuugagauaua

SEQ ID NO: 1390554 - RNA, 19 nt, Neisseria meningitidis Z2491
cgugggcgcauucggggca

SEQ ID NO: 1390555 - RNA, 22 nt, Neisseria meningitidis Z2491
cguggcguauccauagauaaau

SEQ ID NO: 1390556 - RNA, 22 nt, Neisseria meningitidis Z2491
cgugcaucgcgcccaauucuuc

SEQ ID NO: 1390557 - RNA, 21 nt, Neisseria meningitidis Z2491
cgugcggucgcaucggcggcg

SEQ ID NO: 1390558 - RNA, 16 nt, Neisseria meningitidis Z2491
cgugcgguguucagca

SEQ ID NO: 1390559 - RNA, 15 nt, Neisseria meningitidis Z2491
cgugcggcacgccgc

SEQ ID NO: 1390560 - RNA, 11 nt, Neisseria meningitidis Z2491
cgucugccuuc

SEQ ID NO: 1390561 - RNA, 13 nt, Neisseria meningitidis Z2491
cgucugccuucuu

SEQ ID NO: 1390562 - RNA, 15 nt, Neisseria meningitidis Z2491
cgucugccuucuucu

SEQ ID NO: 1390563 - RNA, 19 nt, Neisseria meningitidis Z2491
cgucugaaacaaaauguuc

SEQ ID NO: 1390564 - RNA, 13 nt, Neisseria meningitidis Z2491
cgucugaaacagg

SEQ ID NO: 1390565 - RNA, 21 nt, Neisseria meningitidis Z2491
cgucugaaaccaaaucggcuu

SEQ ID NO: 1390566 - RNA, 16 nt, Neisseria meningitidis Z2491
cgucugaaaccggcag

SEQ ID NO: 1390567 - RNA, 12 nt, Neisseria meningitidis Z2491
cgucugaaaccu

SEQ ID NO: 1390568 - RNA, 19 nt, Neisseria meningitidis Z2491
cgucugaaacggcauccuu

SEQ ID NO: 1390569 - RNA, 20 nt, Neisseria meningitidis Z2491
cgucugaaacggcauccuug

SEQ ID NO: 1390570 - RNA, 19 nt, Neisseria meningitidis Z2491
cgucugaacacauugcguu

SEQ ID NO: 1390571 - RNA, 17 nt, Neisseria meningitidis Z2491
cgucugaacagcauuug

SEQ ID NO: 1390572 - RNA, 16 nt, Neisseria meningitidis Z2491
cgucugaacaucgugu

SEQ ID NO: 1390573 - RNA, 18 nt, Neisseria meningitidis Z2491
cgucuuuuccuuccaaaa

SEQ ID NO: 1390574 - RNA, 14 nt, Neisseria meningitidis Z2491
cguaaacgaauuuc

SEQ ID NO: 1390575 - RNA, 12 nt, Neisseria meningitidis Z2491
cgguuuguauuu

SEQ ID NO: 1390576 - RNA, 16 nt, Neisseria meningitidis Z2491
cgguuugguuuucaaa

SEQ ID NO: 1390577 - RNA, 19 nt, Neisseria meningitidis Z2491
cgguuuuccccuguaaaca

SEQ ID NO: 1390578 - RNA, 21 nt, Neisseria meningitidis Z2491
cgguuuuccccuguaaacaga

SEQ ID NO: 1390579 - RNA, 15 nt, Neisseria meningitidis Z2491
cgguuuuuugaguuu

SEQ ID NO: 1390580 - RNA, 15 nt, Neisseria meningitidis Z2491
cguaacccauucacc

SEQ ID NO: 1390581 - RNA, 17 nt, Neisseria meningitidis Z2491
cguaaccgacgaaggca

SEQ ID NO: 1390582 - RNA, 16 nt, Neisseria meningitidis Z2491
cgguucguccagcagc

SEQ ID NO: 1390583 - RNA, 18 nt, Neisseria meningitidis Z2491
cgguuacuggauucccgc

SEQ ID NO: 1390584 - RNA, 16 nt, Neisseria meningitidis Z2491
cgguuacacaaauaua

SEQ ID NO: 1390585 - RNA, 21 nt, Neisseria meningitidis Z2491
cgguuguauuuuuauuauuau

SEQ ID NO: 1390586 - RNA, 18 nt, Neisseria meningitidis Z2491
cgguuucgguuuuuuuug

SEQ ID NO: 1390587 - RNA, 14 nt, Neisseria meningitidis Z2491
cggugcgcggcagc

SEQ ID NO: 1390588 - RNA, 18 nt, Neisseria meningitidis Z2491
cggugcgguagccgccuu

SEQ ID NO: 1390589 - RNA, 22 nt, Neisseria meningitidis Z2491
cggugugcauccgacaggcaaa

SEQ ID NO: 1390590 - RNA, 18 nt, Neisseria meningitidis Z2491
cggugugccgcugauuug

SEQ ID NO: 1390591 - RNA, 15 nt, Neisseria meningitidis Z2491
cggugugcgccgccg

SEQ ID NO: 1390592 - RNA, 16 nt, Neisseria meningitidis Z2491
cggugggcugaagccc

SEQ ID NO: 1390593 - RNA, 23 nt, Neisseria meningitidis Z2491
cguaaucccauuucuuccugacg

SEQ ID NO: 1390594 - RNA, 17 nt, Neisseria meningitidis Z2491
cguaauagccugacaca

SEQ ID NO: 1390595 - RNA, 12 nt, Neisseria meningitidis Z2491
cgucaaaccagc

SEQ ID NO: 1390596 - RNA, 15 nt, Neisseria meningitidis Z2491
cgucaaacaacauca

SEQ ID NO: 1390597 - RNA, 16 nt, Neisseria meningitidis Z2491
cguaugauuuuucggg

SEQ ID NO: 1390598 - RNA, 13 nt, Neisseria meningitidis Z2491
cguaugcaaaaac

SEQ ID NO: 1390599 - RNA, 18 nt, Neisseria meningitidis Z2491
cguccguaccgcgcgcca

SEQ ID NO: 1390600 - RNA, 16 nt, Neisseria meningitidis Z2491
cgucccaaacaauccc

SEQ ID NO: 1390601 - RNA, 18 nt, Neisseria meningitidis Z2491
cgucgaaguggcuggcuu

SEQ ID NO: 1390602 - RNA, 17 nt, Neisseria meningitidis Z2491
cgucgaagaaguggguc

SEQ ID NO: 1390603 - RNA, 16 nt, Neisseria meningitidis Z2491
cucgucauuuccacaa

SEQ ID NO: 1390604 - RNA, 21 nt, Neisseria meningitidis Z2491
cucggcaaacgcuucgcuuuu

SEQ ID NO: 1390605 - RNA, 20 nt, Neisseria meningitidis Z2491
cucugccagcuccgccacgu

SEQ ID NO: 1390606 - RNA, 16 nt, Neisseria meningitidis Z2491
cucugauagccgccca

SEQ ID NO: 1390607 - RNA, 22 nt, Neisseria meningitidis Z2491
cucugaaaccauaccgccuuca

SEQ ID NO: 1390608 - RNA, 12 nt, Neisseria meningitidis Z2491
cucuauuuaaaa

SEQ ID NO: 1390609 - RNA, 20 nt, Neisseria meningitidis Z2491
cucuauuuaaaaauuccugu

SEQ ID NO: 1390610 - RNA, 21 nt, Neisseria meningitidis Z2491
cucuauuuguucgauauuuuu

SEQ ID NO: 1390611 - RNA, 18 nt, Neisseria meningitidis Z2491
cucuauaaaaucccccgc

SEQ ID NO: 1390612 - RNA, 16 nt, Neisseria meningitidis Z2491
cucuccgucauuccca

SEQ ID NO: 1390613 - RNA, 20 nt, Neisseria meningitidis Z2491
cucuccgucauucccacgga

SEQ ID NO: 1390614 - RNA, 17 nt, Neisseria meningitidis Z2491
cuccugaucuaaaaauu

SEQ ID NO: 1390615 - RNA, 20 nt, Neisseria meningitidis Z2491
cuccauaauccaagauuuca

SEQ ID NO: 1390616 - RNA, 19 nt, Neisseria meningitidis Z2491
cuccagcuccggccaaaaa

SEQ ID NO: 1390617 - RNA, 23 nt, Neisseria meningitidis Z2491
cucccucuuuaaauuuaaaaggg

SEQ ID NO: 1390618 - RNA, 14 nt, Neisseria meningitidis Z2491
cuccgccucugcca

SEQ ID NO: 1390619 - RNA, 23 nt, Neisseria meningitidis Z2491
cuccggauuccuguuuucgcggg

SEQ ID NO: 1390620 - RNA, 15 nt, Neisseria meningitidis Z2491
cuccgcaaacaaaau

SEQ ID NO: 1390621 - RNA, 12 nt, Neisseria meningitidis Z2491
cuccgcaaacac

SEQ ID NO: 1390622 - RNA, 14 nt, Neisseria meningitidis Z2491
cuccgcaaacacca

SEQ ID NO: 1390623 - RNA, 18 nt, Neisseria meningitidis Z2491
cuccgcaaacaccagcau

SEQ ID NO: 1390624 - RNA, 13 nt, Neisseria meningitidis Z2491
cucauaagccgcc

SEQ ID NO: 1390625 - RNA, 23 nt, Neisseria meningitidis Z2491
cucaguugguagagcgcaaccuu

SEQ ID NO: 1390626 - RNA, 18 nt, Neisseria meningitidis Z2491
cucauaguuuggacggcg

SEQ ID NO: 1390627 - RNA, 15 nt, Neisseria meningitidis Z2491
cucauauucacuaaa

SEQ ID NO: 1390628 - RNA, 23 nt, Neisseria meningitidis Z2491
cucaucaacgccggggcaaacau

SEQ ID NO: 1390629 - RNA, 18 nt, Neisseria meningitidis Z2491
cucaucaucggcguaaua

SEQ ID NO: 1390630 - RNA, 22 nt, Neisseria meningitidis Z2491
cucaucaucggcguaauaauau

SEQ ID NO: 1390631 - RNA, 14 nt, Neisseria meningitidis Z2491
cucaacacaccauc

SEQ ID NO: 1390632 - RNA, 17 nt, Neisseria meningitidis Z2491
cucaacagcuuaaaauc

SEQ ID NO: 1390633 - RNA, 19 nt, Neisseria meningitidis Z2491
cuauuaccgguauuuuuuu

SEQ ID NO: 1390634 - RNA, 14 nt, Neisseria meningitidis Z2491
cucaaaucccguca

SEQ ID NO: 1390635 - RNA, 14 nt, Neisseria meningitidis Z2491
cucaauauuaggaa

SEQ ID NO: 1390636 - RNA, 17 nt, Neisseria meningitidis Z2491
cucaauauuaggaaggu

SEQ ID NO: 1390637 - RNA, 23 nt, Neisseria meningitidis Z2491
cucaauaagucugcgaaacagac

SEQ ID NO: 1390638 - RNA, 20 nt, Neisseria meningitidis Z2491
cuaucauauagauuuuuaug

SEQ ID NO: 1390639 - RNA, 23 nt, Neisseria meningitidis Z2491
cuaugccgagcaaaaucagcaca

SEQ ID NO: 1390640 - RNA, 18 nt, Neisseria meningitidis Z2491
cuaugcggcaaaaccgga

SEQ ID NO: 1390641 - RNA, 13 nt, Neisseria meningitidis Z2491
cuauaauacaaaa

SEQ ID NO: 1390642 - RNA, 20 nt, Neisseria meningitidis Z2491
cuauaauacauugauuuuua

SEQ ID NO: 1390643 - RNA, 20 nt, Neisseria meningitidis Z2491
cuauaauccaccauauuuga

SEQ ID NO: 1390644 - RNA, 15 nt, Neisseria meningitidis Z2491
cuauaaugauugacu

SEQ ID NO: 1390645 - RNA, 20 nt, Neisseria meningitidis Z2491
cuauacaucaucuuauuuau

SEQ ID NO: 1390646 - RNA, 15 nt, Neisseria meningitidis Z2491
cuauacaucccguca

SEQ ID NO: 1390647 - RNA, 14 nt, Neisseria meningitidis Z2491
cuauacuaaaaccg

SEQ ID NO: 1390648 - RNA, 15 nt, Neisseria meningitidis Z2491
cuauaguauagugga

SEQ ID NO: 1390649 - RNA, 14 nt, Neisseria meningitidis Z2491
cuauaguggauuaa

SEQ ID NO: 1390650 - RNA, 19 nt, Neisseria meningitidis Z2491
cuauaguggauuaacaaaa

SEQ ID NO: 1390651 - RNA, 21 nt, Neisseria meningitidis Z2491
cuauaguggauuaacaaaaau

SEQ ID NO: 1390652 - RNA, 14 nt, Neisseria meningitidis Z2491
cuauauauucugau

SEQ ID NO: 1390653 - RNA, 13 nt, Neisseria meningitidis Z2491
cuauaucuauacu

SEQ ID NO: 1390654 - RNA, 17 nt, Neisseria meningitidis Z2491
cuauaucgguugaaacu

SEQ ID NO: 1390655 - RNA, 14 nt, Neisseria meningitidis Z2491
cuagauucccgccu

SEQ ID NO: 1390656 - RNA, 22 nt, Neisseria meningitidis Z2491
cuagauggcguugguugaacgu

SEQ ID NO: 1390657 - RNA, 22 nt, Neisseria meningitidis Z2491
cuagauaacuagggaaauucaa

SEQ ID NO: 1390658 - RNA, 21 nt, Neisseria meningitidis Z2491
cuacgacucgcuugcugguaa

SEQ ID NO: 1390659 - RNA, 17 nt, Neisseria meningitidis Z2491
cuacuguaaaucgucau

SEQ ID NO: 1390660 - RNA, 14 nt, Neisseria meningitidis Z2491
cugcgcgggaauga

SEQ ID NO: 1390661 - RNA, 19 nt, Neisseria meningitidis Z2491
cugcgcgaacagcgacacc

SEQ ID NO: 1390662 - RNA, 22 nt, Neisseria meningitidis Z2491
cugccuucgggauaaucuuuuc

SEQ ID NO: 1390663 - RNA, 22 nt, Neisseria meningitidis Z2491
cugcgcagguuguuggaaaagu

SEQ ID NO: 1390664 - RNA, 22 nt, Neisseria meningitidis Z2491
cugccagucuuuaaauucaacu

SEQ ID NO: 1390665 - RNA, 17 nt, Neisseria meningitidis Z2491
cugcccaucgccucuuc

SEQ ID NO: 1390666 - RNA, 13 nt, Neisseria meningitidis Z2491
cugccgcacaagc

SEQ ID NO: 1390667 - RNA, 17 nt, Neisseria meningitidis Z2491
cugcccgcuuuugaguu

SEQ ID NO: 1390668 - RNA, 19 nt, Neisseria meningitidis Z2491
cugcccgacugugcccaca

SEQ ID NO: 1390669 - RNA, 22 nt, Neisseria meningitidis Z2491
cugcagguagcggcugagggcu

SEQ ID NO: 1390670 - RNA, 22 nt, Neisseria meningitidis Z2491
cugcaggugcagcggaaauggu

SEQ ID NO: 1390671 - RNA, 18 nt, Neisseria meningitidis Z2491
cugcaguaacuucaaacc

SEQ ID NO: 1390672 - RNA, 23 nt, Neisseria meningitidis Z2491
cugcaaugcacuacuucauuuuu

SEQ ID NO: 1390673 - RNA, 19 nt, Neisseria meningitidis Z2491
cugcaucgccgcuucaucu

SEQ ID NO: 1390674 - RNA, 17 nt, Neisseria meningitidis Z2491
cugcggcucugaaacca

SEQ ID NO: 1390675 - RNA, 19 nt, Neisseria meningitidis Z2491
cugcggcgggacgcgcgcc

SEQ ID NO: 1390676 - RNA, 20 nt, Neisseria meningitidis Z2491
cugcggcgggacgcgcgcca

SEQ ID NO: 1390677 - RNA, 13 nt, Neisseria meningitidis Z2491
aaacucaaaaaac

SEQ ID NO: 1390678 - RNA, 19 nt, Neisseria meningitidis Z2491
cuggcaaauugaaaugccg

SEQ ID NO: 1390679 - RNA, 15 nt, Neisseria meningitidis Z2491
cuggaaaccaaaaaa

SEQ ID NO: 1390680 - RNA, 20 nt, Neisseria meningitidis Z2491
cugcuguuugacaggucgga

SEQ ID NO: 1390681 - RNA, 16 nt, Neisseria meningitidis Z2491
cugcuuuaauucucca

SEQ ID NO: 1390682 - RNA, 17 nt, Neisseria meningitidis Z2491
cugcaagcagcaggcgu

SEQ ID NO: 1390683 - RNA, 22 nt, Neisseria meningitidis Z2491
cugcaagcagcaggcguucgga

SEQ ID NO: 1390684 - RNA, 15 nt, Neisseria meningitidis Z2491
cugcaagaauuuauc

SEQ ID NO: 1390685 - RNA, 23 nt, Neisseria meningitidis Z2491
cugcaagaauuuaucggaaauga

SEQ ID NO: 1390686 - RNA, 15 nt, Neisseria meningitidis Z2491
cugcaaaauuuaucc

SEQ ID NO: 1390687 - RNA, 18 nt, Neisseria meningitidis Z2491
cugaugauuuuuucaaca

SEQ ID NO: 1390688 - RNA, 19 nt, Neisseria meningitidis Z2491
cugaugauuuuuucaacac

SEQ ID NO: 1390689 - RNA, 23 nt, Neisseria meningitidis Z2491
cugcaaaacaucguuugcauucu

SEQ ID NO: 1390690 - RNA, 14 nt, Neisseria meningitidis Z2491
cugauuuaaauuua

SEQ ID NO: 1390691 - RNA, 18 nt, Neisseria meningitidis Z2491
cugauuuaaauuuaaucc

SEQ ID NO: 1390692 - RNA, 22 nt, Neisseria meningitidis Z2491
cugauacgggcggcucucaaaa

SEQ ID NO: 1390693 - RNA, 16 nt, Neisseria meningitidis Z2491
cugacaaucaggaaaa

SEQ ID NO: 1390694 - RNA, 13 nt, Neisseria meningitidis Z2491
cugaaggcuucag

SEQ ID NO: 1390695 - RNA, 15 nt, Neisseria meningitidis Z2491
cugaagcccugccug

SEQ ID NO: 1390696 - RNA, 16 nt, Neisseria meningitidis Z2491
cugaagcccugccugc

SEQ ID NO: 1390697 - RNA, 21 nt, Neisseria meningitidis Z2491
cugaagccgcuucagacggca

SEQ ID NO: 1390698 - RNA, 16 nt, Neisseria meningitidis Z2491
cugaagccuucagacg

SEQ ID NO: 1390699 - RNA, 19 nt, Neisseria meningitidis Z2491
cugaagccuucagacggca

SEQ ID NO: 1390700 - RNA, 18 nt, Neisseria meningitidis Z2491
cugaagcucaaaaaaccg

SEQ ID NO: 1390701 - RNA, 14 nt, Neisseria meningitidis Z2491
cugaagcguauuuc

SEQ ID NO: 1390702 - RNA, 22 nt, Neisseria meningitidis Z2491
cugaccguguuuccaaggcagc

SEQ ID NO: 1390703 - RNA, 14 nt, Neisseria meningitidis Z2491
cugacgaaaccaga

SEQ ID NO: 1390704 - RNA, 16 nt, Neisseria meningitidis Z2491
cugacuagguaauaca

SEQ ID NO: 1390705 - RNA, 19 nt, Neisseria meningitidis Z2491
cugacuagguaauacauaa

SEQ ID NO: 1390706 - RNA, 16 nt, Neisseria meningitidis Z2491
cugagaacuucagacg

SEQ ID NO: 1390707 - RNA, 22 nt, Neisseria meningitidis Z2491
cugaaacgcauucagacggcau

SEQ ID NO: 1390708 - RNA, 21 nt, Neisseria meningitidis Z2491
cugaaaccccuaaaggcuuca

SEQ ID NO: 1390709 - RNA, 20 nt, Neisseria meningitidis Z2491
cugaaacccgauguuuucaa

SEQ ID NO: 1390710 - RNA, 16 nt, Neisseria meningitidis Z2491
cugaaacccggaaaaa

SEQ ID NO: 1390711 - RNA, 16 nt, Neisseria meningitidis Z2491
cugaaacgggaaucuc

SEQ ID NO: 1390712 - RNA, 17 nt, Neisseria meningitidis Z2491
cugaaacuuuaauuuug

SEQ ID NO: 1390713 - RNA, 12 nt, Neisseria meningitidis Z2491
cugaaacucaaa

SEQ ID NO: 1390714 - RNA, 17 nt, Neisseria meningitidis Z2491
cugaaacucaaaaaacu

SEQ ID NO: 1390715 - RNA, 22 nt, Neisseria meningitidis Z2491
cugaaacucaaaaagcuggauu

SEQ ID NO: 1390716 - RNA, 13 nt, Neisseria meningitidis Z2491
cugaaaggcuuca

SEQ ID NO: 1390717 - RNA, 14 nt, Neisseria meningitidis Z2491
cugaaaggcuucag

SEQ ID NO: 1390718 - RNA, 14 nt, Neisseria meningitidis Z2491
cugaaaggcuuuca

SEQ ID NO: 1390719 - RNA, 17 nt, Neisseria meningitidis Z2491
cugaaaaaaugccgucu

SEQ ID NO: 1390720 - RNA, 20 nt, Neisseria meningitidis Z2491
cugaaaacuuggagauucua

SEQ ID NO: 1390721 - RNA, 14 nt, Neisseria meningitidis Z2491
cugaaaaauuuaug

SEQ ID NO: 1390722 - RNA, 20 nt, Neisseria meningitidis Z2491
cugaaaaauuuucagacgac

SEQ ID NO: 1390723 - RNA, 21 nt, Neisseria meningitidis Z2491
cugaaaaauuuucagacgacc

SEQ ID NO: 1390724 - RNA, 14 nt, Neisseria meningitidis Z2491
cugaaaacaggaau

SEQ ID NO: 1390725 - RNA, 11 nt, Neisseria meningitidis Z2491
cugaaaauaau

SEQ ID NO: 1390726 - RNA, 17 nt, Neisseria meningitidis Z2491
cucuuucaucauaugca

SEQ ID NO: 1390727 - RNA, 16 nt, Neisseria meningitidis Z2491
cucuuucaacggcacg

SEQ ID NO: 1390728 - RNA, 14 nt, Neisseria meningitidis Z2491
cugaagcccacccu

SEQ ID NO: 1390729 - RNA, 18 nt, Neisseria meningitidis Z2491
cugaagcccacccuacca

SEQ ID NO: 1390730 - RNA, 16 nt, Neisseria meningitidis Z2491
cugaacucaggcuuca

SEQ ID NO: 1390731 - RNA, 20 nt, Neisseria meningitidis Z2491
cugaacccuuugggcguuca

SEQ ID NO: 1390732 - RNA, 19 nt, Neisseria meningitidis Z2491
cugaacacggguucagacg

SEQ ID NO: 1390733 - RNA, 15 nt, Neisseria meningitidis Z2491
cugaacauaaaugcc

SEQ ID NO: 1390734 - RNA, 19 nt, Neisseria meningitidis Z2491
cugaacaguguuucagacg

SEQ ID NO: 1390735 - RNA, 12 nt, Neisseria meningitidis Z2491
cugaacauuuca

SEQ ID NO: 1390736 - RNA, 14 nt, Neisseria meningitidis Z2491
cugaacauuucaga

SEQ ID NO: 1390737 - RNA, 19 nt, Neisseria meningitidis Z2491
cugaaauaugguucagacg

SEQ ID NO: 1390738 - RNA, 14 nt, Neisseria meningitidis Z2491
cugaaauucaaaaa

SEQ ID NO: 1390739 - RNA, 18 nt, Neisseria meningitidis Z2491
cugaaauucaaaaaaccg

SEQ ID NO: 1390740 - RNA, 17 nt, Neisseria meningitidis Z2491
cugaaauucgucauucc

SEQ ID NO: 1390741 - RNA, 17 nt, Neisseria meningitidis Z2491
cugaaauuucagacggc

SEQ ID NO: 1390742 - RNA, 24 nt, Neisseria meningitidis Z2491
cucuucgcguacuuuauccaccaa

SEQ ID NO: 1390743 - RNA, 21 nt, Neisseria meningitidis Z2491
cucuugaagcggcguccuguc

SEQ ID NO: 1390744 - RNA, 13 nt, Neisseria meningitidis Z2491
cucuuuaaauuua

SEQ ID NO: 1390745 - RNA, 15 nt, Neisseria meningitidis Z2491
cucuuggucaaaaug

SEQ ID NO: 1390746 - RNA, 11 nt, Neisseria meningitidis Z2491
aaaaaacaaac

SEQ ID NO: 1390747 - RNA, 12 nt, Neisseria meningitidis Z2491
aaaaaacaaaca

SEQ ID NO: 1390748 - RNA, 11 nt, Neisseria meningitidis Z2491
aaaaaagccag

SEQ ID NO: 1390749 - RNA, 19 nt, Neisseria meningitidis Z2491
aaaaaagccagcagcagcc

SEQ ID NO: 1390750 - RNA, 21 nt, Neisseria meningitidis Z2491
aaaaacagcguuuucauuucu

SEQ ID NO: 1390751 - RNA, 11 nt, Neisseria meningitidis Z2491
aaaaacagaaa

SEQ ID NO: 1390752 - RNA, 13 nt, Neisseria meningitidis Z2491
aaaaacagaaaac

SEQ ID NO: 1390753 - RNA, 14 nt, Neisseria meningitidis Z2491
aaaaacagaaaacc

SEQ ID NO: 1390754 - RNA, 23 nt, Neisseria meningitidis Z2491
aaaaacagaaaccuaaaauucgu

SEQ ID NO: 1390755 - RNA, 13 nt, Neisseria meningitidis Z2491
aaaaaauccaaaa

SEQ ID NO: 1390756 - RNA, 16 nt, Neisseria meningitidis Z2491
aaaaaauauaccaaaa

SEQ ID NO: 1390757 - RNA, 20 nt, Neisseria meningitidis Z2491
aaaaaaucaaaaacacaaaa

SEQ ID NO: 1390758 - RNA, 16 nt, Neisseria meningitidis Z2491
aaaaaauaaaguaauu

SEQ ID NO: 1390759 - RNA, 18 nt, Neisseria meningitidis Z2491
aaaaacagcaaucaaaau

SEQ ID NO: 1390760 - RNA, 21 nt, Neisseria meningitidis Z2491
aaaaacagcaaucaaaauaaa

SEQ ID NO: 1390761 - RNA, 18 nt, Neisseria meningitidis Z2491
aaaaacagaaaaccaaaa

SEQ ID NO: 1390762 - RNA, 13 nt, Neisseria meningitidis Z2491
aaaaacagaaacc

SEQ ID NO: 1390763 - RNA, 20 nt, Neisseria meningitidis Z2491
aaaaacagaaaccuaaaauu

SEQ ID NO: 1390764 - RNA, 20 nt, Neisseria meningitidis Z2491
aaaaacaacaaugcaaagaa

SEQ ID NO: 1390765 - RNA, 20 nt, Neisseria meningitidis Z2491
aaaaacaacugaaaccgaac

SEQ ID NO: 1390766 - RNA, 14 nt, Neisseria meningitidis Z2491
aaaaacaacugauu

SEQ ID NO: 1390767 - RNA, 15 nt, Neisseria meningitidis Z2491
aaaaacaagaaacgc

SEQ ID NO: 1390768 - RNA, 15 nt, Neisseria meningitidis Z2491
aaaaacaaaaaaaau

SEQ ID NO: 1390769 - RNA, 11 nt, Neisseria meningitidis Z2491
aaaaaaugccg

SEQ ID NO: 1390770 - RNA, 23 nt, Neisseria meningitidis Z2491
aaaaaaugccgucugaaagguuu

SEQ ID NO: 1390771 - RNA, 17 nt, Neisseria meningitidis Z2491
aaaaacaucagccaaac

SEQ ID NO: 1390772 - RNA, 17 nt, Neisseria meningitidis Z2491
aaaaaccgaaguuuaaa

SEQ ID NO: 1390773 - RNA, 19 nt, Neisseria meningitidis Z2491
aaaaauaauugucuuuucc

SEQ ID NO: 1390774 - RNA, 15 nt, Neisseria meningitidis Z2491
aaaaauuuauuuaga

SEQ ID NO: 1390775 - RNA, 21 nt, Neisseria meningitidis Z2491
aaaaauuuauuuagaaacaac

SEQ ID NO: 1390776 - RNA, 15 nt, Neisseria meningitidis Z2491
aaaaccaaaaacaga

SEQ ID NO: 1390777 - RNA, 11 nt, Neisseria meningitidis Z2491
aaaacagaaaa

SEQ ID NO: 1390778 - RNA, 14 nt, Neisseria meningitidis Z2491
aaaacagcaaaaag

SEQ ID NO: 1390779 - RNA, 18 nt, Neisseria meningitidis Z2491
aaaacacgucaaccgucg

SEQ ID NO: 1390780 - RNA, 14 nt, Neisseria meningitidis Z2491
aaaacagaaaacca

SEQ ID NO: 1390781 - RNA, 15 nt, Neisseria meningitidis Z2491
aaaacagaaaaccaa

SEQ ID NO: 1390782 - RNA, 16 nt, Neisseria meningitidis Z2491
aaaacagaaaaccaaa

SEQ ID NO: 1390783 - RNA, 17 nt, Neisseria meningitidis Z2491
aaaacagaaaaccaaaa

SEQ ID NO: 1390784 - RNA, 11 nt, Neisseria meningitidis Z2491
aaaacagaaac

SEQ ID NO: 1390785 - RNA, 16 nt, Neisseria meningitidis Z2491
aaaacagaaaccuaaa

SEQ ID NO: 1390786 - RNA, 17 nt, Neisseria meningitidis Z2491
aaaacagaaaccuaaaa

SEQ ID NO: 1390787 - RNA, 17 nt, Neisseria meningitidis Z2491
aaaacagaaagccaaaa

SEQ ID NO: 1390788 - RNA, 17 nt, Neisseria meningitidis Z2491
aaaacagaaaucccaaa

SEQ ID NO: 1390789 - RNA, 14 nt, Neisseria meningitidis Z2491
aaaacagaaauuaa

SEQ ID NO: 1390790 - RNA, 22 nt, Neisseria meningitidis Z2491
aaaacagaaauucaaaaacaga

SEQ ID NO: 1390791 - RNA, 11 nt, Neisseria meningitidis Z2491
aaaacuuaaaa

SEQ ID NO: 1390792 - RNA, 13 nt, Neisseria meningitidis Z2491
aaaacuuaaaauu

SEQ ID NO: 1390793 - RNA, 14 nt, Neisseria meningitidis Z2491
aaaacuuaaaauuc

SEQ ID NO: 1390794 - RNA, 22 nt, Neisseria meningitidis Z2491
aaaacuucccguccguauuuuc

SEQ ID NO: 1390795 - RNA, 13 nt, Neisseria meningitidis Z2491
aaaacuuuucuga

SEQ ID NO: 1390796 - RNA, 14 nt, Neisseria meningitidis Z2491
aaaacuuuucugau

SEQ ID NO: 1390797 - RNA, 16 nt, Neisseria meningitidis Z2491
aaaacuuuucugauuu

SEQ ID NO: 1390798 - RNA, 17 nt, Neisseria meningitidis Z2491
aaaacuuuucugauuuu

SEQ ID NO: 1390799 - RNA, 18 nt, Neisseria meningitidis Z2491
aaaacuuuucugauuuuu

SEQ ID NO: 1390800 - RNA, 22 nt, Neisseria meningitidis Z2491
aaaacggcaguuuccaauacaa

SEQ ID NO: 1390801 - RNA, 17 nt, Neisseria meningitidis Z2491
aaaacgggaaucuagaa

SEQ ID NO: 1390802 - RNA, 13 nt, Neisseria meningitidis Z2491
aaaagauacacac

SEQ ID NO: 1390803 - RNA, 14 nt, Neisseria meningitidis Z2491
aaaagauacacaca

SEQ ID NO: 1390804 - RNA, 15 nt, Neisseria meningitidis Z2491
aaaagauacacacac

SEQ ID NO: 1390805 - RNA, 21 nt, Neisseria meningitidis Z2491
aaaagcaagacguagcguggg

SEQ ID NO: 1390806 - RNA, 14 nt, Neisseria meningitidis Z2491
aaaagccagcagca

SEQ ID NO: 1390807 - RNA, 15 nt, Neisseria meningitidis Z2491
aaaaguaccgcagcc

SEQ ID NO: 1390808 - RNA, 21 nt, Neisseria meningitidis Z2491
aaaauaaucgaaccaaauaaa

SEQ ID NO: 1390809 - RNA, 20 nt, Neisseria meningitidis Z2491
aaaauaauggccuuuucccu

SEQ ID NO: 1390810 - RNA, 14 nt, Neisseria meningitidis Z2491
aaaauaaacucauu

SEQ ID NO: 1390811 - RNA, 15 nt, Neisseria meningitidis Z2491
aaaauagaaaaccga

SEQ ID NO: 1390812 - RNA, 17 nt, Neisseria meningitidis Z2491
aaaauagaaaaccgaaa

SEQ ID NO: 1390813 - RNA, 18 nt, Neisseria meningitidis Z2491
aaaauagaaaaucaaaaa

SEQ ID NO: 1390814 - RNA, 12 nt, Neisseria meningitidis Z2491
aaaauaccguug

SEQ ID NO: 1390815 - RNA, 14 nt, Neisseria meningitidis Z2491
aaaauaauugccuu

SEQ ID NO: 1390816 - RNA, 20 nt, Neisseria meningitidis Z2491
aaaauaauugucuuuucccu

SEQ ID NO: 1390817 - RNA, 19 nt, Neisseria meningitidis Z2491
aaaauacugaggaaaccau

SEQ ID NO: 1390818 - RNA, 21 nt, Neisseria meningitidis Z2491
aaaauacggacgggaaguuuu

SEQ ID NO: 1390819 - RNA, 14 nt, Neisseria meningitidis Z2491
aaaauccgucauuc

SEQ ID NO: 1390820 - RNA, 20 nt, Neisseria meningitidis Z2491
aaaauccaacgcugcaaaaa

SEQ ID NO: 1390821 - RNA, 22 nt, Neisseria meningitidis Z2491
aaaauauaguggauuaacaaaa

SEQ ID NO: 1390822 - RNA, 23 nt, Neisseria meningitidis Z2491
aaaauauaguggauuaacaaaaa

SEQ ID NO: 1390823 - RNA, 16 nt, Neisseria meningitidis Z2491
aaaaugccgccugaac

SEQ ID NO: 1390824 - RNA, 21 nt, Neisseria meningitidis Z2491
aaaaugccgccugaacauuuc

SEQ ID NO: 1390825 - RNA, 23 nt, Neisseria meningitidis Z2491
aaaaugcgccaaaaaauuuucaa

SEQ ID NO: 1390826 - RNA, 21 nt, Neisseria meningitidis Z2491
aaaaugccgucugaaaaaccu

SEQ ID NO: 1390827 - RNA, 19 nt, Neisseria meningitidis Z2491
aaaaugccgucugaaaaca

SEQ ID NO: 1390828 - RNA, 22 nt, Neisseria meningitidis Z2491
aaaaugccgucugaaaacaguu

SEQ ID NO: 1390829 - RNA, 18 nt, Neisseria meningitidis Z2491
aaaaugccgucugaaaag

SEQ ID NO: 1390830 - RNA, 22 nt, Neisseria meningitidis Z2491
aaaaugccgucugaaaagauau

SEQ ID NO: 1390831 - RNA, 18 nt, Neisseria meningitidis Z2491
aaaaugccgucuggaacu

SEQ ID NO: 1390832 - RNA, 23 nt, Neisseria meningitidis Z2491
aaaaugccgucuggaacuugaaa

SEQ ID NO: 1390833 - RNA, 15 nt, Neisseria meningitidis Z2491
aaaaucuauagugga

SEQ ID NO: 1390834 - RNA, 23 nt, Neisseria meningitidis Z2491
aaaaucuauaguggauuaacaaa

SEQ ID NO: 1390835 - RNA, 15 nt, Neisseria meningitidis Z2491
aaaaugcaaaacuuu

SEQ ID NO: 1390836 - RNA, 23 nt, Neisseria meningitidis Z2491
aaaaugcaaaacuuuucugauuu

SEQ ID NO: 1390837 - RNA, 22 nt, Neisseria meningitidis Z2491
aaaauccugcuuauugcacuaa

SEQ ID NO: 1390838 - RNA, 24 nt, Neisseria meningitidis Z2491
aaaaucggccauucccucaaaaac

SEQ ID NO: 1390839 - RNA, 13 nt, Neisseria meningitidis Z2491
aaaauuccguuau

SEQ ID NO: 1390840 - RNA, 12 nt, Neisseria meningitidis Z2491
aaaauuuaaaag

SEQ ID NO: 1390841 - RNA, 23 nt, Neisseria meningitidis Z2491
aaaauuuggcuguauuuuaauaa

SEQ ID NO: 1390842 - RNA, 22 nt, Neisseria meningitidis Z2491
aaaauuuggcuguguuucaaua

SEQ ID NO: 1390843 - RNA, 21 nt, Neisseria meningitidis Z2491
aaaauuucaucauuccuacaa

SEQ ID NO: 1390844 - RNA, 15 nt, Neisseria meningitidis Z2491
aaaauuucuugauuu

SEQ ID NO: 1390845 - RNA, 20 nt, Neisseria meningitidis Z2491
aaaauuuauccgaaaucaca

SEQ ID NO: 1390846 - RNA, 17 nt, Neisseria meningitidis Z2491
aaaauuuaugaaauaca

SEQ ID NO: 1390847 - RNA, 16 nt, Neisseria meningitidis Z2491
aaaauuuaauuuuugg

SEQ ID NO: 1390848 - RNA, 12 nt, Neisseria meningitidis Z2491
aaacaaaauaaa

SEQ ID NO: 1390849 - RNA, 21 nt, Neisseria meningitidis Z2491
aaacaaaauaaacucauugag

SEQ ID NO: 1390850 - RNA, 19 nt, Neisseria meningitidis Z2491
aaacaaaaaaucaaaaaca

SEQ ID NO: 1390851 - RNA, 10 nt, Neisseria meningitidis Z2491
aaacaaaaau

SEQ ID NO: 1390852 - RNA, 13 nt, Neisseria meningitidis Z2491
aaacaacaaaacc

SEQ ID NO: 1390853 - RNA, 15 nt, Neisseria meningitidis Z2491
aaacaacaaugcaaa

SEQ ID NO: 1390854 - RNA, 16 nt, Neisseria meningitidis Z2491
aaaugccgucauuccc

SEQ ID NO: 1390855 - RNA, 14 nt, Neisseria meningitidis Z2491
aaaugccgucugaa

SEQ ID NO: 1390856 - RNA, 22 nt, Neisseria meningitidis Z2491
aaaugccgucugaaaacagcaa

SEQ ID NO: 1390857 - RNA, 21 nt, Neisseria meningitidis Z2491
aaaugccgucugaaaagauau

SEQ ID NO: 1390858 - RNA, 23 nt, Neisseria meningitidis Z2491
aaaugccgucugaagccuuucag

SEQ ID NO: 1390859 - RNA, 16 nt, Neisseria meningitidis Z2491
aaaugccgcaaucuca

SEQ ID NO: 1390860 - RNA, 19 nt, Neisseria meningitidis Z2491
aaaugcgccaaaaaauuuu

SEQ ID NO: 1390861 - RNA, 18 nt, Neisseria meningitidis Z2491
aaaugcguaugccccaca

SEQ ID NO: 1390862 - RNA, 15 nt, Neisseria meningitidis Z2491
aaaucuuauagggau

SEQ ID NO: 1390863 - RNA, 24 nt, Neisseria meningitidis Z2491
aaaugaugggcugaaauagaaaau

SEQ ID NO: 1390864 - RNA, 21 nt, Neisseria meningitidis Z2491
aaaucuaaauagcguuuuaau

SEQ ID NO: 1390865 - RNA, 21 nt, Neisseria meningitidis Z2491
aaaucugugaaaaucagggga

SEQ ID NO: 1390866 - RNA, 15 nt, Neisseria meningitidis Z2491
aaaucaucccaaaca

SEQ ID NO: 1390867 - RNA, 13 nt, Neisseria meningitidis Z2491
aaaucauccacag

SEQ ID NO: 1390868 - RNA, 21 nt, Neisseria meningitidis Z2491
aaauuacccgaaacccaaaaa

SEQ ID NO: 1390869 - RNA, 22 nt, Neisseria meningitidis Z2491
aaauguuccuauaguauagugg

SEQ ID NO: 1390870 - RNA, 21 nt, Neisseria meningitidis Z2491
aaauuccuguugcuuuucauu

SEQ ID NO: 1390871 - RNA, 21 nt, Neisseria meningitidis Z2491
aaauuccugcugcuuuucauu

SEQ ID NO: 1390872 - RNA, 23 nt, Neisseria meningitidis Z2491
aaauuccugcugcuuuucauuuc

SEQ ID NO: 1390873 - RNA, 12 nt, Neisseria meningitidis Z2491
aaauuccuaaaa

SEQ ID NO: 1390874 - RNA, 17 nt, Neisseria meningitidis Z2491
aaauucuagauuccugc

SEQ ID NO: 1390875 - RNA, 15 nt, Neisseria meningitidis Z2491
aaauucgucauuccc

SEQ ID NO: 1390876 - RNA, 12 nt, Neisseria meningitidis Z2491
aaauucuaacuc

SEQ ID NO: 1390877 - RNA, 22 nt, Neisseria meningitidis Z2491
aaauuauugccagcauuaauau

SEQ ID NO: 1390878 - RNA, 14 nt, Neisseria meningitidis Z2491
aaauaacucaucau

SEQ ID NO: 1390879 - RNA, 12 nt, Neisseria meningitidis Z2491
aaauaaacaagg

SEQ ID NO: 1390880 - RNA, 14 nt, Neisseria meningitidis Z2491
aaauaaacaagguc

SEQ ID NO: 1390881 - RNA, 21 nt, Neisseria meningitidis Z2491
aaauaaauucugaaacuuuaa

SEQ ID NO: 1390882 - RNA, 14 nt, Neisseria meningitidis Z2491
aaauagcugaaacu

SEQ ID NO: 1390883 - RNA, 22 nt, Neisseria meningitidis Z2491
aaauaaucuguuaacgaaauuu

SEQ ID NO: 1390884 - RNA, 19 nt, Neisseria meningitidis Z2491
aaaucaacagauuacuaaa

SEQ ID NO: 1390885 - RNA, 23 nt, Neisseria meningitidis Z2491
aaaucaacagauugucaaaauac

SEQ ID NO: 1390886 - RNA, 12 nt, Neisseria meningitidis Z2491
aaaucagcacaa

SEQ ID NO: 1390887 - RNA, 15 nt, Neisseria meningitidis Z2491
aaaucagaaaaguuu

SEQ ID NO: 1390888 - RNA, 16 nt, Neisseria meningitidis Z2491
aaaucagaaaccuaaa

SEQ ID NO: 1390889 - RNA, 17 nt, Neisseria meningitidis Z2491
aaaucagaaaccuaaaa

SEQ ID NO: 1390890 - RNA, 12 nt, Neisseria meningitidis Z2491
aaaucaggacaa

SEQ ID NO: 1390891 - RNA, 19 nt, Neisseria meningitidis Z2491
aaaucaggggauuauuuau

SEQ ID NO: 1390892 - RNA, 22 nt, Neisseria meningitidis Z2491
aaauaugccgucugaagccuuc

SEQ ID NO: 1390893 - RNA, 17 nt, Neisseria meningitidis Z2491
aaauauucaauugacaa

SEQ ID NO: 1390894 - RNA, 21 nt, Neisseria meningitidis Z2491
aaauauucaauugacaaaaac

SEQ ID NO: 1390895 - RNA, 16 nt, Neisseria meningitidis Z2491
aaauaggcauugguaa

SEQ ID NO: 1390896 - RNA, 21 nt, Neisseria meningitidis Z2491
aaaucaaaaacacaaaacuga

SEQ ID NO: 1390897 - RNA, 19 nt, Neisseria meningitidis Z2491
aaauauuguuauucccccg

SEQ ID NO: 1390898 - RNA, 15 nt, Neisseria meningitidis Z2491
aaagaccgucauucc

SEQ ID NO: 1390899 - RNA, 16 nt, Neisseria meningitidis Z2491
aaagaccgucauuccu

SEQ ID NO: 1390900 - RNA, 14 nt, Neisseria meningitidis Z2491
aaagaccgucugaa

SEQ ID NO: 1390901 - RNA, 22 nt, Neisseria meningitidis Z2491
aaacuuucggauaaucuuugaa

SEQ ID NO: 1390902 - RNA, 15 nt, Neisseria meningitidis Z2491
aaacuuuucugauuu

SEQ ID NO: 1390903 - RNA, 19 nt, Neisseria meningitidis Z2491
aaacuuuucugauuuugag

SEQ ID NO: 1390904 - RNA, 16 nt, Neisseria meningitidis Z2491
aaagcccaaacgagca

SEQ ID NO: 1390905 - RNA, 14 nt, Neisseria meningitidis Z2491
aaagccagcagcag

SEQ ID NO: 1390906 - RNA, 19 nt, Neisseria meningitidis Z2491
aaagccaaaaacagaaacc

SEQ ID NO: 1390907 - RNA, 11 nt, Neisseria meningitidis Z2491
aaagcauuuuu

SEQ ID NO: 1390908 - RNA, 14 nt, Neisseria meningitidis Z2491
aaagauacaagaac

SEQ ID NO: 1390909 - RNA, 18 nt, Neisseria meningitidis Z2491
aaagauuugcaaucgauu

SEQ ID NO: 1390910 - RNA, 13 nt, Neisseria meningitidis Z2491
aaaguaccgcagc

SEQ ID NO: 1390911 - RNA, 16 nt, Neisseria meningitidis Z2491
aaaguacaaaaugccg

SEQ ID NO: 1390912 - RNA, 16 nt, Neisseria meningitidis Z2491
aaaggccgucugaaau

SEQ ID NO: 1390913 - RNA, 18 nt, Neisseria meningitidis Z2491
aaagguugugggaaucca

SEQ ID NO: 1390914 - RNA, 22 nt, Neisseria meningitidis Z2491
aaagguuagcugaagcuuuaga

SEQ ID NO: 1390915 - RNA, 21 nt, Neisseria meningitidis Z2491
aaagccgcagacaguacagau

SEQ ID NO: 1390916 - RNA, 16 nt, Neisseria meningitidis Z2491
aaagccgcccgcccgg

SEQ ID NO: 1390917 - RNA, 12 nt, Neisseria meningitidis Z2491
aaagcuggauuc

SEQ ID NO: 1390918 - RNA, 17 nt, Neisseria meningitidis Z2491
aaagcuggauucccacu

SEQ ID NO: 1390919 - RNA, 19 nt, Neisseria meningitidis Z2491
aaaggaauuuugcaaaggu

SEQ ID NO: 1390920 - RNA, 20 nt, Neisseria meningitidis Z2491
aaaggaauuuugcaaagguc

SEQ ID NO: 1390921 - RNA, 21 nt, Neisseria meningitidis Z2491
aaaggaagucaugcccaaaag

SEQ ID NO: 1390922 - RNA, 22 nt, Neisseria meningitidis Z2491
aaacucucuauaaaaucccccg

SEQ ID NO: 1390923 - RNA, 19 nt, Neisseria meningitidis Z2491
aaacuauaucuauacuaaa

SEQ ID NO: 1390924 - RNA, 14 nt, Neisseria meningitidis Z2491
aaacucaaaaaacu

SEQ ID NO: 1390925 - RNA, 20 nt, Neisseria meningitidis Z2491
aaacuugauugcuguuuuuc

SEQ ID NO: 1390926 - RNA, 24 nt, Neisseria meningitidis Z2491
aaacugcccgaccuguaaaauauc

SEQ ID NO: 1390927 - RNA, 14 nt, Neisseria meningitidis Z2491
aaacuuaaaauucc

SEQ ID NO: 1390928 - RNA, 17 nt, Neisseria meningitidis Z2491
aaacgggaaucuagagc

SEQ ID NO: 1390929 - RNA, 12 nt, Neisseria meningitidis Z2491
aaacggaaaauc

SEQ ID NO: 1390930 - RNA, 17 nt, Neisseria meningitidis Z2491
aaacggcacggcgcagg

SEQ ID NO: 1390931 - RNA, 17 nt, Neisseria meningitidis Z2491
aaacggcaggcaaaaaa

SEQ ID NO: 1390932 - RNA, 13 nt, Neisseria meningitidis Z2491
aaacguuuguuua

SEQ ID NO: 1390933 - RNA, 12 nt, Neisseria meningitidis Z2491
aaacguuucaga

SEQ ID NO: 1390934 - RNA, 13 nt, Neisseria meningitidis Z2491
aaacguuucagac

SEQ ID NO: 1390935 - RNA, 12 nt, Neisseria meningitidis Z2491
aaacgguuucuu

SEQ ID NO: 1390936 - RNA, 18 nt, Neisseria meningitidis Z2491
aaacgucaucgccgcaaa

SEQ ID NO: 1390937 - RNA, 22 nt, Neisseria meningitidis Z2491
aaaccugcaccacgucauuccc

SEQ ID NO: 1390938 - RNA, 22 nt, Neisseria meningitidis Z2491
aaaccugcaccgcgucauuccc

SEQ ID NO: 1390939 - RNA, 22 nt, Neisseria meningitidis Z2491
aaaccugcaucccgucauuccu

SEQ ID NO: 1390940 - RNA, 17 nt, Neisseria meningitidis Z2491
aaaccugaaaacagaaa

SEQ ID NO: 1390941 - RNA, 16 nt, Neisseria meningitidis Z2491
aaacaacugauucaac

SEQ ID NO: 1390942 - RNA, 18 nt, Neisseria meningitidis Z2491
aaacaacugcaauuauaa

SEQ ID NO: 1390943 - RNA, 13 nt, Neisseria meningitidis Z2491
aaaccuuauccau

SEQ ID NO: 1390944 - RNA, 17 nt, Neisseria meningitidis Z2491
aaaccuuauccauaucc

SEQ ID NO: 1390945 - RNA, 18 nt, Neisseria meningitidis Z2491
aaaccuuauccauaucca

SEQ ID NO: 1390946 - RNA, 14 nt, Neisseria meningitidis Z2491
aaaccugacaguaa

SEQ ID NO: 1390947 - RNA, 15 nt, Neisseria meningitidis Z2491
aaacgaacaaacccu

SEQ ID NO: 1390948 - RNA, 16 nt, Neisseria meningitidis Z2491
aaacgaacaaacccuu

SEQ ID NO: 1390949 - RNA, 22 nt, Neisseria meningitidis Z2491
aaacgaaaaugccgucugaaaa

SEQ ID NO: 1390950 - RNA, 13 nt, Neisseria meningitidis Z2491
aaacgagcaauau

SEQ ID NO: 1390951 - RNA, 23 nt, Neisseria meningitidis Z2491
aaacgaauugaaucaugccgcug

SEQ ID NO: 1390952 - RNA, 14 nt, Neisseria meningitidis Z2491
aaacgccgucugaa

SEQ ID NO: 1390953 - RNA, 14 nt, Neisseria meningitidis Z2491
aaacgccagcacaa

SEQ ID NO: 1390954 - RNA, 20 nt, Neisseria meningitidis Z2491
auuuccgauaaauuccugcu

SEQ ID NO: 1390955 - RNA, 18 nt, Neisseria meningitidis Z2491
auuuccgauaaauucuug

SEQ ID NO: 1390956 - RNA, 16 nt, Neisseria meningitidis Z2491
auuucccgucugccca

SEQ ID NO: 1390957 - RNA, 22 nt, Neisseria meningitidis Z2491
auuuccgucaggcacgaagccc

SEQ ID NO: 1390958 - RNA, 20 nt, Neisseria meningitidis Z2491
auuucgggcgaggguuugga

SEQ ID NO: 1390959 - RNA, 16 nt, Neisseria meningitidis Z2491
auuucggcaguuuuca

SEQ ID NO: 1390960 - RNA, 15 nt, Neisseria meningitidis Z2491
auuugaaccauuucc

SEQ ID NO: 1390961 - RNA, 12 nt, Neisseria meningitidis Z2491
auuucuugauuu

SEQ ID NO: 1390962 - RNA, 13 nt, Neisseria meningitidis Z2491
auuucuuauguuu

SEQ ID NO: 1390963 - RNA, 18 nt, Neisseria meningitidis Z2491
auuuauuuuagaaugaau

SEQ ID NO: 1390964 - RNA, 19 nt, Neisseria meningitidis Z2491
auuuauuuuagaaugaaua

SEQ ID NO: 1390965 - RNA, 19 nt, Neisseria meningitidis Z2491
auuuauuuugaaaauggua

SEQ ID NO: 1390966 - RNA, 16 nt, Neisseria meningitidis Z2491
auuucaauacgcaaac

SEQ ID NO: 1390967 - RNA, 23 nt, Neisseria meningitidis Z2491
auuuauaguggauuaacaaaaac

SEQ ID NO: 1390968 - RNA, 15 nt, Neisseria meningitidis Z2491
auuuaucagaaauga

SEQ ID NO: 1390969 - RNA, 16 nt, Neisseria meningitidis Z2491
auuuaucagaaaugac

SEQ ID NO: 1390970 - RNA, 19 nt, Neisseria meningitidis Z2491
auuuauccgaaacaacaga

SEQ ID NO: 1390971 - RNA, 17 nt, Neisseria meningitidis Z2491
auuuauccgaaauaaca

SEQ ID NO: 1390972 - RNA, 19 nt, Neisseria meningitidis Z2491
auuuaucgggaaugacuga

SEQ ID NO: 1390973 - RNA, 22 nt, Neisseria meningitidis Z2491
auuuaucgggaaugacugaaac

SEQ ID NO: 1390974 - RNA, 13 nt, Neisseria meningitidis Z2491
auuuaucggaaaa

SEQ ID NO: 1390975 - RNA, 21 nt, Neisseria meningitidis Z2491
auuuaucggaaaugacugaaa

SEQ ID NO: 1390976 - RNA, 22 nt, Neisseria meningitidis Z2491
auuuaucggauaaaacagaaau

SEQ ID NO: 1390977 - RNA, 15 nt, Neisseria meningitidis Z2491
auuugagccgcacgc

SEQ ID NO: 1390978 - RNA, 14 nt, Neisseria meningitidis Z2491
auuuucacaaaaac

SEQ ID NO: 1390979 - RNA, 17 nt, Neisseria meningitidis Z2491
auuuucacaaaaacaga

SEQ ID NO: 1390980 - RNA, 13 nt, Neisseria meningitidis Z2491
auuuucaaacauu

SEQ ID NO: 1390981 - RNA, 14 nt, Neisseria meningitidis Z2491
auuuucaaacauua

SEQ ID NO: 1390982 - RNA, 18 nt, Neisseria meningitidis Z2491
auuuuauaguggauuaaa

SEQ ID NO: 1390983 - RNA, 22 nt, Neisseria meningitidis Z2491
auuuuauaguggauuaaauuua

SEQ ID NO: 1390984 - RNA, 20 nt, Neisseria meningitidis Z2491
auuuuggagcaguaaaauuu

SEQ ID NO: 1390985 - RNA, 22 nt, Neisseria meningitidis Z2491
auuuuggagcaguaaaauuuau

SEQ ID NO: 1390986 - RNA, 21 nt, Neisseria meningitidis Z2491
auuuugcuuuggucgcugccu

SEQ ID NO: 1390987 - RNA, 15 nt, Neisseria meningitidis Z2491
auuuuucauaucauu

SEQ ID NO: 1390988 - RNA, 13 nt, Neisseria meningitidis Z2491
auuuuuaaaaccg

SEQ ID NO: 1390989 - RNA, 14 nt, Neisseria meningitidis Z2491
caaaaaaaccgaaa

SEQ ID NO: 1390990 - RNA, 17 nt, Neisseria meningitidis Z2491
caaaaaaaaaccuaaaa

SEQ ID NO: 1390991 - RNA, 18 nt, Neisseria meningitidis Z2491
auuuuucugaaaaauuua

SEQ ID NO: 1390992 - RNA, 22 nt, Neisseria meningitidis Z2491
auugggaagucgugcauucagc

SEQ ID NO: 1390993 - RNA, 17 nt, Neisseria meningitidis Z2491
auuguuaaguauuucua

SEQ ID NO: 1390994 - RNA, 19 nt, Neisseria meningitidis Z2491
auuguuaaguauuucuauu

SEQ ID NO: 1390995 - RNA, 12 nt, Neisseria meningitidis Z2491
auuuaaauuuaa

SEQ ID NO: 1390996 - RNA, 18 nt, Neisseria meningitidis Z2491
auugccgccggcuauaca

SEQ ID NO: 1390997 - RNA, 15 nt, Neisseria meningitidis Z2491
auugcccaacagcag

SEQ ID NO: 1390998 - RNA, 17 nt, Neisseria meningitidis Z2491
auugccacgccgaaccc

SEQ ID NO: 1390999 - RNA, 19 nt, Neisseria meningitidis Z2491
auugccacgccgaacccga

SEQ ID NO: 1391000 - RNA, 14 nt, Neisseria meningitidis Z2491
auugccaaauagaa

SEQ ID NO: 1391001 - RNA, 14 nt, Neisseria meningitidis Z2491
auugcggcuuuuuc

SEQ ID NO: 1391002 - RNA, 22 nt, Neisseria meningitidis Z2491
auugcugccgugaugccccaau

SEQ ID NO: 1391003 - RNA, 18 nt, Neisseria meningitidis Z2491
auugccucuauuuaaaaa

SEQ ID NO: 1391004 - RNA, 23 nt, Neisseria meningitidis Z2491
auugccucuauuuaaaaauuccu

SEQ ID NO: 1391005 - RNA, 17 nt, Neisseria meningitidis Z2491
auugccguuuuccuuuc

SEQ ID NO: 1391006 - RNA, 23 nt, Neisseria meningitidis Z2491
auugccuuuucccugacaaacag

SEQ ID NO: 1391007 - RNA, 20 nt, Neisseria meningitidis Z2491
auugccuuuauugugcuaug

SEQ ID NO: 1391008 - RNA, 17 nt, Neisseria meningitidis Z2491
auugaaaauuuuuuggc

SEQ ID NO: 1391009 - RNA, 17 nt, Neisseria meningitidis Z2491
auugaaaaauuuuuggc

SEQ ID NO: 1391010 - RNA, 14 nt, Neisseria meningitidis Z2491
auugcacuaaaacu

SEQ ID NO: 1391011 - RNA, 16 nt, Neisseria meningitidis Z2491
auucuucgaucaucca

SEQ ID NO: 1391012 - RNA, 22 nt, Neisseria meningitidis Z2491
auucuucgaucauccauuuaaa

SEQ ID NO: 1391013 - RNA, 19 nt, Neisseria meningitidis Z2491
auucuugcaaaauagaaaa

SEQ ID NO: 1391014 - RNA, 22 nt, Neisseria meningitidis Z2491
auucuugaggcauugaaauucc

SEQ ID NO: 1391015 - RNA, 19 nt, Neisseria meningitidis Z2491
auucugaugaaacgaugac

SEQ ID NO: 1391016 - RNA, 15 nt, Neisseria meningitidis Z2491
auucucacaaaaaca

SEQ ID NO: 1391017 - RNA, 16 nt, Neisseria meningitidis Z2491
auucgccuuaaaaaac

SEQ ID NO: 1391018 - RNA, 18 nt, Neisseria meningitidis Z2491
auucgccuuaaaaaacaa

SEQ ID NO: 1391019 - RNA, 19 nt, Neisseria meningitidis Z2491
auucgccuuaaaaaacaaa

SEQ ID NO: 1391020 - RNA, 14 nt, Neisseria meningitidis Z2491
auucguggaugcuu

SEQ ID NO: 1391021 - RNA, 21 nt, Neisseria meningitidis Z2491
auucgugggcgcauucggggc

SEQ ID NO: 1391022 - RNA, 17 nt, Neisseria meningitidis Z2491
auuccuacgaaaacagg

SEQ ID NO: 1391023 - RNA, 18 nt, Neisseria meningitidis Z2491
auuccuacgaaaacagga

SEQ ID NO: 1391024 - RNA, 14 nt, Neisseria meningitidis Z2491
auuccucaaaaaca

SEQ ID NO: 1391025 - RNA, 19 nt, Neisseria meningitidis Z2491
auuccuguugcuuuucauu

SEQ ID NO: 1391026 - RNA, 12 nt, Neisseria meningitidis Z2491
auuccuguuuuu

SEQ ID NO: 1391027 - RNA, 14 nt, Neisseria meningitidis Z2491
auucccgcgaaaaa

SEQ ID NO: 1391028 - RNA, 21 nt, Neisseria meningitidis Z2491
auucccgcgaaaaauagaaaa

SEQ ID NO: 1391029 - RNA, 16 nt, Neisseria meningitidis Z2491
auucccgcgagaacag

SEQ ID NO: 1391030 - RNA, 16 nt, Neisseria meningitidis Z2491
auucccgcgcagauga

SEQ ID NO: 1391031 - RNA, 15 nt, Neisseria meningitidis Z2491
auucccgcaaaagcg

SEQ ID NO: 1391032 - RNA, 15 nt, Neisseria meningitidis Z2491
auucccgcaaccuuu

SEQ ID NO: 1391033 - RNA, 15 nt, Neisseria meningitidis Z2491
auucccacaaccuuu

SEQ ID NO: 1391034 - RNA, 20 nt, Neisseria meningitidis Z2491
auucccguccggcaaacauc

SEQ ID NO: 1391035 - RNA, 16 nt, Neisseria meningitidis Z2491
auuccacguucuagau

SEQ ID NO: 1391036 - RNA, 24 nt, Neisseria meningitidis Z2491
auuccacguucuagauucccgccu

SEQ ID NO: 1391037 - RNA, 23 nt, Neisseria meningitidis Z2491
auuccacagugauggcuucuaaa

SEQ ID NO: 1391038 - RNA, 20 nt, Neisseria meningitidis Z2491
auuccaacucgacauuuucc

SEQ ID NO: 1391039 - RNA, 21 nt, Neisseria meningitidis Z2491
auuccaacucgacauuuucca

SEQ ID NO: 1391040 - RNA, 14 nt, Neisseria meningitidis Z2491
auucaucacauaaa

SEQ ID NO: 1391041 - RNA, 17 nt, Neisseria meningitidis Z2491
auucaucgcgcugccgu

SEQ ID NO: 1391042 - RNA, 19 nt, Neisseria meningitidis Z2491
aaaagcgggaauccggaaa

SEQ ID NO: 1391043 - RNA, 22 nt, Neisseria meningitidis Z2491
aaaagcgggaaucuagaaacuc

SEQ ID NO: 1391044 - RNA, 17 nt, Neisseria meningitidis Z2491
auuagaaccgaacacag

SEQ ID NO: 1391045 - RNA, 22 nt, Neisseria meningitidis Z2491
auuacugcugcggcucugaaac

SEQ ID NO: 1391046 - RNA, 14 nt, Neisseria meningitidis Z2491
auuacuaaaacaca

SEQ ID NO: 1391047 - RNA, 18 nt, Neisseria meningitidis Z2491
auuauaguggauuaaauu

SEQ ID NO: 1391048 - RNA, 14 nt, Neisseria meningitidis Z2491
aaaagcuaaagcaa

SEQ ID NO: 1391049 - RNA, 19 nt, Neisseria meningitidis Z2491
auuagugguuggaacagau

SEQ ID NO: 1391050 - RNA, 23 nt, Neisseria meningitidis Z2491
auuaucggucagcucuuugagcc

SEQ ID NO: 1391051 - RNA, 16 nt, Neisseria meningitidis Z2491
auuaucugaaaguuug

SEQ ID NO: 1391052 - RNA, 16 nt, Neisseria meningitidis Z2491
auucaagcagcaauac

SEQ ID NO: 1391053 - RNA, 17 nt, Neisseria meningitidis Z2491
auucaaaaaccugcuug

SEQ ID NO: 1391054 - RNA, 19 nt, Neisseria meningitidis Z2491
auucaaacggcggcgggca

SEQ ID NO: 1391055 - RNA, 22 nt, Neisseria meningitidis Z2491
auuauuuucacaaaaacagaaa

SEQ ID NO: 1391056 - RNA, 15 nt, Neisseria meningitidis Z2491
auuaagaaaaacagc

SEQ ID NO: 1391057 - RNA, 19 nt, Neisseria meningitidis Z2491
auuaagaaaaacagcaauc

SEQ ID NO: 1391058 - RNA, 22 nt, Neisseria meningitidis Z2491
auuaacggcggaaccugcugcc

SEQ ID NO: 1391059 - RNA, 17 nt, Neisseria meningitidis Z2491
auuaacgggguuaaaua

SEQ ID NO: 1391060 - RNA, 17 nt, Neisseria meningitidis Z2491
auuaagauguuuuucca

SEQ ID NO: 1391061 - RNA, 18 nt, Neisseria meningitidis Z2491
auuaagauguuuuuccac

SEQ ID NO: 1391062 - RNA, 13 nt, Neisseria meningitidis Z2491
auuaaaacaaaaa

SEQ ID NO: 1391063 - RNA, 22 nt, Neisseria meningitidis Z2491
auguuugcugcuguauuuuucc

SEQ ID NO: 1391064 - RNA, 23 nt, Neisseria meningitidis Z2491
auguuugcugcuguauuuuucca

SEQ ID NO: 1391065 - RNA, 16 nt, Neisseria meningitidis Z2491
auguuuucgucugccc

SEQ ID NO: 1391066 - RNA, 15 nt, Neisseria meningitidis Z2491
auguucgugcaucau

SEQ ID NO: 1391067 - RNA, 17 nt, Neisseria meningitidis Z2491
auguucgugcaucauca

SEQ ID NO: 1391068 - RNA, 22 nt, Neisseria meningitidis Z2491
auguuaugugcugucagaauug

SEQ ID NO: 1391069 - RNA, 13 nt, Neisseria meningitidis Z2491
augugcuggcugc

SEQ ID NO: 1391070 - RNA, 23 nt, Neisseria meningitidis Z2491
auguguugcccugauucggaagg

SEQ ID NO: 1391071 - RNA, 16 nt, Neisseria meningitidis Z2491
auguguucgcauuuug

SEQ ID NO: 1391072 - RNA, 16 nt, Neisseria meningitidis Z2491
augugguagagaaaau

SEQ ID NO: 1391073 - RNA, 12 nt, Neisseria meningitidis Z2491
augucugccuga

SEQ ID NO: 1391074 - RNA, 21 nt, Neisseria meningitidis Z2491
augucugccugauacagccac

SEQ ID NO: 1391075 - RNA, 13 nt, Neisseria meningitidis Z2491
augucggggaauc

SEQ ID NO: 1391076 - RNA, 19 nt, Neisseria meningitidis Z2491
augucggccaauuugcuuu

SEQ ID NO: 1391077 - RNA, 22 nt, Neisseria meningitidis Z2491
augucgaggaugucggacauuu

SEQ ID NO: 1391078 - RNA, 15 nt, Neisseria meningitidis Z2491
augucgaaggcgcgg

SEQ ID NO: 1391079 - RNA, 15 nt, Neisseria meningitidis Z2491
auguaccaagcgguu

SEQ ID NO: 1391080 - RNA, 20 nt, Neisseria meningitidis Z2491
augguucagacggcauuuuu

SEQ ID NO: 1391081 - RNA, 20 nt, Neisseria meningitidis Z2491
auguaaaccuaagauauaac

SEQ ID NO: 1391082 - RNA, 20 nt, Neisseria meningitidis Z2491
augguguccgucgccuucua

SEQ ID NO: 1391083 - RNA, 21 nt, Neisseria meningitidis Z2491
auggugcgccgucuuaucaga

SEQ ID NO: 1391084 - RNA, 13 nt, Neisseria meningitidis Z2491
auggggaggcgcg

SEQ ID NO: 1391085 - RNA, 18 nt, Neisseria meningitidis Z2491
auggcguugguugaacgu

SEQ ID NO: 1391086 - RNA, 23 nt, Neisseria meningitidis Z2491
auggcguuaccaauaacggcugc

SEQ ID NO: 1391087 - RNA, 13 nt, Neisseria meningitidis Z2491
auggaggcaguuu

SEQ ID NO: 1391088 - RNA, 17 nt, Neisseria meningitidis Z2491
auggaggcaguuuuuua

SEQ ID NO: 1391089 - RNA, 20 nt, Neisseria meningitidis Z2491
augcugcguuuggagaaaau

SEQ ID NO: 1391090 - RNA, 15 nt, Neisseria meningitidis Z2491
augcugucugaaacc

SEQ ID NO: 1391091 - RNA, 16 nt, Neisseria meningitidis Z2491
augcugucugaaaccu

SEQ ID NO: 1391092 - RNA, 18 nt, Neisseria meningitidis Z2491
augcugucugaaaccuga

SEQ ID NO: 1391093 - RNA, 21 nt, Neisseria meningitidis Z2491
augcagcauauguuugcugcu

SEQ ID NO: 1391094 - RNA, 19 nt, Neisseria meningitidis Z2491
augcagagaccuuugcaau

SEQ ID NO: 1391095 - RNA, 16 nt, Neisseria meningitidis Z2491
augccgccagccacca

SEQ ID NO: 1391096 - RNA, 18 nt, Neisseria meningitidis Z2491
augccauacugccugccg

SEQ ID NO: 1391097 - RNA, 22 nt, Neisseria meningitidis Z2491
augcccuuucuuuaugcuuuuu

SEQ ID NO: 1391098 - RNA, 20 nt, Neisseria meningitidis Z2491
augcgccugcauaucggcaa

SEQ ID NO: 1391099 - RNA, 16 nt, Neisseria meningitidis Z2491
augcgaaucugcugca

SEQ ID NO: 1391100 - RNA, 14 nt, Neisseria meningitidis Z2491
augcgccaaaaaau

SEQ ID NO: 1391101 - RNA, 16 nt, Neisseria meningitidis Z2491
augccuagaggaauga

SEQ ID NO: 1391102 - RNA, 19 nt, Neisseria meningitidis Z2491
augagauugagcauaaaau

SEQ ID NO: 1391103 - RNA, 21 nt, Neisseria meningitidis Z2491
augagauugagcauaaaauuu

SEQ ID NO: 1391104 - RNA, 11 nt, Neisseria meningitidis Z2491
augaugcccuc

SEQ ID NO: 1391105 - RNA, 16 nt, Neisseria meningitidis Z2491
augauguguuucaaca

SEQ ID NO: 1391106 - RNA, 21 nt, Neisseria meningitidis Z2491
augaugggauuuaggguucug

SEQ ID NO: 1391107 - RNA, 18 nt, Neisseria meningitidis Z2491
augauugacuauuuuuua

SEQ ID NO: 1391108 - RNA, 14 nt, Neisseria meningitidis Z2491
augauucauaaaau

SEQ ID NO: 1391109 - RNA, 17 nt, Neisseria meningitidis Z2491
augauucauaaaauauu

SEQ ID NO: 1391110 - RNA, 19 nt, Neisseria meningitidis Z2491
augauucgcuuuuguggau

SEQ ID NO: 1391111 - RNA, 17 nt, Neisseria meningitidis Z2491
augauuuucuuuuugau

SEQ ID NO: 1391112 - RNA, 19 nt, Neisseria meningitidis Z2491
augauuuuuucaacaccaa

SEQ ID NO: 1391113 - RNA, 15 nt, Neisseria meningitidis Z2491
augcaaaaacaaccc

SEQ ID NO: 1391114 - RNA, 14 nt, Neisseria meningitidis Z2491
caaugcucgggcaa

SEQ ID NO: 1391115 - RNA, 18 nt, Neisseria meningitidis Z2491
caaugacugcgggcuuug

SEQ ID NO: 1391116 - RNA, 16 nt, Neisseria meningitidis Z2491
caaugcuaaggcaauu

SEQ ID NO: 1391117 - RNA, 21 nt, Neisseria meningitidis Z2491
caaucuuauuuucaaaaugca

SEQ ID NO: 1391118 - RNA, 16 nt, Neisseria meningitidis Z2491
caauuuccacaauuca

SEQ ID NO: 1391119 - RNA, 21 nt, Neisseria meningitidis Z2491
caauuuaucgggaaugacuga

SEQ ID NO: 1391120 - RNA, 23 nt, Neisseria meningitidis Z2491
caauucgcguucguucucguaca

SEQ ID NO: 1391121 - RNA, 19 nt, Neisseria meningitidis Z2491
cacaaccgcccuauauuug

SEQ ID NO: 1391122 - RNA, 21 nt, Neisseria meningitidis Z2491
cacaaccgcccuauauuugcc

SEQ ID NO: 1391123 - RNA, 22 nt, Neisseria meningitidis Z2491
cacaagcccgcacauuccauca

SEQ ID NO: 1391124 - RNA, 18 nt, Neisseria meningitidis Z2491
cacaagccgccgaugcgg

SEQ ID NO: 1391125 - RNA, 19 nt, Neisseria meningitidis Z2491
cacaacuuuucccauuauc

SEQ ID NO: 1391126 - RNA, 17 nt, Neisseria meningitidis Z2491
cacaagguuauuuucuu

SEQ ID NO: 1391127 - RNA, 18 nt, Neisseria meningitidis Z2491
cacaagguuauuuucuug

SEQ ID NO: 1391128 - RNA, 19 nt, Neisseria meningitidis Z2491
cacaagguuauuuucuuga

SEQ ID NO: 1391129 - RNA, 23 nt, Neisseria meningitidis Z2491
cacagccaaaaaaaagccguccg

SEQ ID NO: 1391130 - RNA, 12 nt, Neisseria meningitidis Z2491
cacaaucugaaa

SEQ ID NO: 1391131 - RNA, 14 nt, Neisseria meningitidis Z2491
cacacgaacugccu

SEQ ID NO: 1391132 - RNA, 16 nt, Neisseria meningitidis Z2491
cacacgguuuucacau

SEQ ID NO: 1391133 - RNA, 21 nt, Neisseria meningitidis Z2491
aaaauaaaaccgauaaacaac

SEQ ID NO: 1391134 - RNA, 12 nt, Neisseria meningitidis Z2491
aaaauaaaaaua

SEQ ID NO: 1391135 - RNA, 13 nt, Neisseria meningitidis Z2491
aaaauaaaaauac

SEQ ID NO: 1391136 - RNA, 12 nt, Neisseria meningitidis Z2491
caccagcaucug

SEQ ID NO: 1391137 - RNA, 13 nt, Neisseria meningitidis Z2491
caccagcaucuga

SEQ ID NO: 1391138 - RNA, 18 nt, Neisseria meningitidis Z2491
cacauuuucuauuugauu

SEQ ID NO: 1391139 - RNA, 13 nt, Neisseria meningitidis Z2491
cacauuccaucaa

SEQ ID NO: 1391140 - RNA, 14 nt, Neisseria meningitidis Z2491
cacgaacccacauc

SEQ ID NO: 1391141 - RNA, 21 nt, Neisseria meningitidis Z2491
cacgaaagugggaauccagaa

SEQ ID NO: 1391142 - RNA, 17 nt, Neisseria meningitidis Z2491
cacgaaucuuauccaca

SEQ ID NO: 1391143 - RNA, 13 nt, Neisseria meningitidis Z2491
aaaauagaaauac

SEQ ID NO: 1391144 - RNA, 19 nt, Neisseria meningitidis Z2491
aaaauagaaauacuuaaca

SEQ ID NO: 1391145 - RNA, 20 nt, Neisseria meningitidis Z2491
aaaauagaaauacuuaacaa

SEQ ID NO: 1391146 - RNA, 13 nt, Neisseria meningitidis Z2491
aaaauagaaaacc

SEQ ID NO: 1391147 - RNA, 14 nt, Neisseria meningitidis Z2491
aaaauagaaaaccg

SEQ ID NO: 1391148 - RNA, 17 nt, Neisseria meningitidis Z2491
aaaauagaaaaucaaaa

SEQ ID NO: 1391149 - RNA, 20 nt, Neisseria meningitidis Z2491
aaaauaccgucugaaaggcu

SEQ ID NO: 1391150 - RNA, 20 nt, Neisseria meningitidis Z2491
aaaauaaucuuccuucugaa

SEQ ID NO: 1391151 - RNA, 19 nt, Neisseria meningitidis Z2491
aaaauacauccuaaaaauu

SEQ ID NO: 1391152 - RNA, 20 nt, Neisseria meningitidis Z2491
aaaauaauugccuuuucccu

SEQ ID NO: 1391153 - RNA, 13 nt, Neisseria meningitidis Z2491
cacgcaauaccaa

SEQ ID NO: 1391154 - RNA, 21 nt, Neisseria meningitidis Z2491
cacgccguguuucaaggcggc

SEQ ID NO: 1391155 - RNA, 21 nt, Neisseria meningitidis Z2491
cacgcccuuccacgcgcaccu

SEQ ID NO: 1391156 - RNA, 22 nt, Neisseria meningitidis Z2491
cacgcgguuuugcguccaaccc

SEQ ID NO: 1391157 - RNA, 15 nt, Neisseria meningitidis Z2491
cacggccggcgcagc

SEQ ID NO: 1391158 - RNA, 13 nt, Neisseria meningitidis Z2491
aaaauaguacaau

SEQ ID NO: 1391159 - RNA, 22 nt, Neisseria meningitidis Z2491
cacggcuuugucgguaaaaaug

SEQ ID NO: 1391160 - RNA, 18 nt, Neisseria meningitidis Z2491
caccguuauggaaauguc

SEQ ID NO: 1391161 - RNA, 17 nt, Neisseria meningitidis Z2491
caccguuuaaaacagca

SEQ ID NO: 1391162 - RNA, 19 nt, Neisseria meningitidis Z2491
cacccuuaagauuuguggc

SEQ ID NO: 1391163 - RNA, 22 nt, Neisseria meningitidis Z2491
caaagccucgucauuuccacaa

SEQ ID NO: 1391164 - RNA, 12 nt, Neisseria meningitidis Z2491
caaagccuucag

SEQ ID NO: 1391165 - RNA, 23 nt, Neisseria meningitidis Z2491
caaaggagugaauguucgccaac

SEQ ID NO: 1391166 - RNA, 19 nt, Neisseria meningitidis Z2491
caaagacaucccccaacca

SEQ ID NO: 1391167 - RNA, 23 nt, Neisseria meningitidis Z2491
caaagaaaauauuacgguaaaca

SEQ ID NO: 1391168 - RNA, 16 nt, Neisseria meningitidis Z2491
caaagaaagcagaaau

SEQ ID NO: 1391169 - RNA, 15 nt, Neisseria meningitidis Z2491
caaagaaauguaaau

SEQ ID NO: 1391170 - RNA, 20 nt, Neisseria meningitidis Z2491
caaagaaauguaaauuuuua

SEQ ID NO: 1391171 - RNA, 17 nt, Neisseria meningitidis Z2491
caaacguccgauuaauu

SEQ ID NO: 1391172 - RNA, 17 nt, Neisseria meningitidis Z2491
caaacgguaccugauga

SEQ ID NO: 1391173 - RNA, 21 nt, Neisseria meningitidis Z2491
caaacaaaauaucguuuucca

SEQ ID NO: 1391174 - RNA, 13 nt, Neisseria meningitidis Z2491
caaacauuuugau

SEQ ID NO: 1391175 - RNA, 23 nt, Neisseria meningitidis Z2491
caaaccggcauucugcacgccga

SEQ ID NO: 1391176 - RNA, 14 nt, Neisseria meningitidis Z2491
caaaccguccccuu

SEQ ID NO: 1391177 - RNA, 11 nt, Neisseria meningitidis Z2491
caaaccucauu

SEQ ID NO: 1391178 - RNA, 15 nt, Neisseria meningitidis Z2491
caaaauagaaaaccg

SEQ ID NO: 1391179 - RNA, 19 nt, Neisseria meningitidis Z2491
caaaauguccguuuucuuc

SEQ ID NO: 1391180 - RNA, 16 nt, Neisseria meningitidis Z2491
caaaagccgugugaaa

SEQ ID NO: 1391181 - RNA, 15 nt, Neisseria meningitidis Z2491
caaaagcgggaaucc

SEQ ID NO: 1391182 - RNA, 17 nt, Neisseria meningitidis Z2491
caaaagcgggaauccaa

SEQ ID NO: 1391183 - RNA, 19 nt, Neisseria meningitidis Z2491
caaaagcgggaauccaaac

SEQ ID NO: 1391184 - RNA, 16 nt, Neisseria meningitidis Z2491
caaaagcgggaaucua

SEQ ID NO: 1391185 - RNA, 21 nt, Neisseria meningitidis Z2491
caaaagcgggaaucuagaaac

SEQ ID NO: 1391186 - RNA, 16 nt, Neisseria meningitidis Z2491
caaaaggccgucugaa

SEQ ID NO: 1391187 - RNA, 17 nt, Neisseria meningitidis Z2491
caaaaggccgucugaaa

SEQ ID NO: 1391188 - RNA, 17 nt, Neisseria meningitidis Z2491
caaaagguucaaacaca

SEQ ID NO: 1391189 - RNA, 19 nt, Neisseria meningitidis Z2491
caaaagucggacuaaaccg

SEQ ID NO: 1391190 - RNA, 16 nt, Neisseria meningitidis Z2491
caaaauacccgaaaga

SEQ ID NO: 1391191 - RNA, 14 nt, Neisseria meningitidis Z2491
caaaauaccgucug

SEQ ID NO: 1391192 - RNA, 17 nt, Neisseria meningitidis Z2491
caaaauaccgucugaaa

SEQ ID NO: 1391193 - RNA, 17 nt, Neisseria meningitidis Z2491
caaaacgccgcuguuac

SEQ ID NO: 1391194 - RNA, 13 nt, Neisseria meningitidis Z2491
caaaaacucgaaa

SEQ ID NO: 1391195 - RNA, 18 nt, Neisseria meningitidis Z2491
caaaaacggcacggcgca

SEQ ID NO: 1391196 - RNA, 12 nt, Neisseria meningitidis Z2491
caaaacuuuucu

SEQ ID NO: 1391197 - RNA, 15 nt, Neisseria meningitidis Z2491
caaaacuuuucugau

SEQ ID NO: 1391198 - RNA, 16 nt, Neisseria meningitidis Z2491
caaaacuuuucugauu

SEQ ID NO: 1391199 - RNA, 19 nt, Neisseria meningitidis Z2491
caaaacuuuucugauuuuu

SEQ ID NO: 1391200 - RNA, 22 nt, Neisseria meningitidis Z2491
caaaacuuuucugauuuuuccu

SEQ ID NO: 1391201 - RNA, 23 nt, Neisseria meningitidis Z2491
caaaacuuuucugauuuuuccua

SEQ ID NO: 1391202 - RNA, 20 nt, Neisseria meningitidis Z2491
caaaagaccgucugaacagu

SEQ ID NO: 1391203 - RNA, 14 nt, Neisseria meningitidis Z2491
caacaaauuuuuga

SEQ ID NO: 1391204 - RNA, 15 nt, Neisseria meningitidis Z2491
caacaaacaggacag

SEQ ID NO: 1391205 - RNA, 17 nt, Neisseria meningitidis Z2491
caacaaaccaaaagccg

SEQ ID NO: 1391206 - RNA, 21 nt, Neisseria meningitidis Z2491
caacaucguacugguuuaaau

SEQ ID NO: 1391207 - RNA, 23 nt, Neisseria meningitidis Z2491
caacaucagcauagggacgaaaa

SEQ ID NO: 1391208 - RNA, 18 nt, Neisseria meningitidis Z2491
caacaucagcucgggcug

SEQ ID NO: 1391209 - RNA, 17 nt, Neisseria meningitidis Z2491
caacaucauagaaauca

SEQ ID NO: 1391210 - RNA, 15 nt, Neisseria meningitidis Z2491
caacaguaauauuca

SEQ ID NO: 1391211 - RNA, 20 nt, Neisseria meningitidis Z2491
caacaguaauauucaaaggu

SEQ ID NO: 1391212 - RNA, 17 nt, Neisseria meningitidis Z2491
caaccggauaccaucuu

SEQ ID NO: 1391213 - RNA, 14 nt, Neisseria meningitidis Z2491
caaaucuaaauagc

SEQ ID NO: 1391214 - RNA, 15 nt, Neisseria meningitidis Z2491
caaaucuggauuccc

SEQ ID NO: 1391215 - RNA, 21 nt, Neisseria meningitidis Z2491
caaaugcacgguuacacaaau

SEQ ID NO: 1391216 - RNA, 13 nt, Neisseria meningitidis Z2491
caaaugcagaaua

SEQ ID NO: 1391217 - RNA, 17 nt, Neisseria meningitidis Z2491
caaaugaugggcugaaa

SEQ ID NO: 1391218 - RNA, 18 nt, Neisseria meningitidis Z2491
caaaugaugggcugaaau

SEQ ID NO: 1391219 - RNA, 23 nt, Neisseria meningitidis Z2491
caaaugaauguggucguucaaau

SEQ ID NO: 1391220 - RNA, 11 nt, Neisseria meningitidis Z2491
caaauuucagu

SEQ ID NO: 1391221 - RNA, 16 nt, Neisseria meningitidis Z2491
caaauuccgucagcac

SEQ ID NO: 1391222 - RNA, 13 nt, Neisseria meningitidis Z2491
caaauuccuaaaa

SEQ ID NO: 1391223 - RNA, 14 nt, Neisseria meningitidis Z2491
caaauuccuaaaac

SEQ ID NO: 1391224 - RNA, 23 nt, Neisseria meningitidis Z2491
caaauuccagcaaugcgucuucc

SEQ ID NO: 1391225 - RNA, 13 nt, Neisseria meningitidis Z2491
caaauuaaaauaa

SEQ ID NO: 1391226 - RNA, 14 nt, Neisseria meningitidis Z2491
caaauuaaaauaaa

SEQ ID NO: 1391227 - RNA, 15 nt, Neisseria meningitidis Z2491
caaauuaaaauaaaa

SEQ ID NO: 1391228 - RNA, 14 nt, Neisseria meningitidis Z2491
caaauauaaaaaau

SEQ ID NO: 1391229 - RNA, 13 nt, Neisseria meningitidis Z2491
caaauauuuccug

SEQ ID NO: 1391230 - RNA, 16 nt, Neisseria meningitidis Z2491
caaaucccgucauucc

SEQ ID NO: 1391231 - RNA, 21 nt, Neisseria meningitidis Z2491
caaauccgugcgccguccgua

SEQ ID NO: 1391232 - RNA, 17 nt, Neisseria meningitidis Z2491
caaauccugaucgauac

SEQ ID NO: 1391233 - RNA, 15 nt, Neisseria meningitidis Z2491
caaaucgacaguuuc

SEQ ID NO: 1391234 - RNA, 20 nt, Neisseria meningitidis Z2491
caaaucggauaggcaaaaac

SEQ ID NO: 1391235 - RNA, 21 nt, Neisseria meningitidis Z2491
caaaucggauaggcaaaaacc

SEQ ID NO: 1391236 - RNA, 22 nt, Neisseria meningitidis Z2491
caaaucgcccguuaccagcagu

SEQ ID NO: 1391237 - RNA, 20 nt, Neisseria meningitidis Z2491
caaaucacgcccaaaucuug

SEQ ID NO: 1391238 - RNA, 12 nt, Neisseria meningitidis Z2491
caaaucauacgu

SEQ ID NO: 1391239 - RNA, 20 nt, Neisseria meningitidis Z2491
caaaucauauuccagcgugc

SEQ ID NO: 1391240 - RNA, 20 nt, Neisseria meningitidis Z2491
caaccggguauucauacaca

SEQ ID NO: 1391241 - RNA, 16 nt, Neisseria meningitidis Z2491
caaccgguccuuccau

SEQ ID NO: 1391242 - RNA, 15 nt, Neisseria meningitidis Z2491
caaccguccacacau

SEQ ID NO: 1391243 - RNA, 22 nt, Neisseria meningitidis Z2491
caacuuacgcaacccuaaaaac

SEQ ID NO: 1391244 - RNA, 23 nt, Neisseria meningitidis Z2491
caacuauuaccgguauuuuuuuc

SEQ ID NO: 1391245 - RNA, 18 nt, Neisseria meningitidis Z2491
caacguuucuauuuuccc

SEQ ID NO: 1391246 - RNA, 18 nt, Neisseria meningitidis Z2491
caagccaagauaugcgua

SEQ ID NO: 1391247 - RNA, 16 nt, Neisseria meningitidis Z2491
caagccgacuucuuuu

SEQ ID NO: 1391248 - RNA, 17 nt, Neisseria meningitidis Z2491
caagccgacuuuuucca

SEQ ID NO: 1391249 - RNA, 20 nt, Neisseria meningitidis Z2491
caagccgacuuuuuccagca

SEQ ID NO: 1391250 - RNA, 21 nt, Neisseria meningitidis Z2491
caagccggagccguucaaagu

SEQ ID NO: 1391251 - RNA, 13 nt, Neisseria meningitidis Z2491
caagcaguugaaa

SEQ ID NO: 1391252 - RNA, 17 nt, Neisseria meningitidis Z2491
caagcaguugaaaucaa

SEQ ID NO: 1391253 - RNA, 20 nt, Neisseria meningitidis Z2491
caagccuucccguuccacaa

SEQ ID NO: 1391254 - RNA, 13 nt, Neisseria meningitidis Z2491
caagcuacggcuc

SEQ ID NO: 1391255 - RNA, 21 nt, Neisseria meningitidis Z2491
caagacaaucaaagucaucac

SEQ ID NO: 1391256 - RNA, 16 nt, Neisseria meningitidis Z2491
caagaauuuaucaaaa

SEQ ID NO: 1391257 - RNA, 19 nt, Neisseria meningitidis Z2491
caagaauuuaucaaaaaug

SEQ ID NO: 1391258 - RNA, 21 nt, Neisseria meningitidis Z2491
caagaauuuaucaaaaaugac

SEQ ID NO: 1391259 - RNA, 15 nt, Neisseria meningitidis Z2491
caagaauuuuuauag

SEQ ID NO: 1391260 - RNA, 16 nt, Neisseria meningitidis Z2491
caacuuccagcgcgaa

SEQ ID NO: 1391261 - RNA, 21 nt, Neisseria meningitidis Z2491
caagaagcggcggcaucccag

SEQ ID NO: 1391262 - RNA, 19 nt, Neisseria meningitidis Z2491
caagacuuuuucgcgcacc

SEQ ID NO: 1391263 - RNA, 17 nt, Neisseria meningitidis Z2491
caauaccuuguuuuuuc

SEQ ID NO: 1391264 - RNA, 14 nt, Neisseria meningitidis Z2491
caauacgcaaaaca

SEQ ID NO: 1391265 - RNA, 21 nt, Neisseria meningitidis Z2491
caauauauugggcaacaccau

SEQ ID NO: 1391266 - RNA, 22 nt, Neisseria meningitidis Z2491
caaucacgucaggcacgcgcug

SEQ ID NO: 1391267 - RNA, 13 nt, Neisseria meningitidis Z2491
caaucaaaauaaa

SEQ ID NO: 1391268 - RNA, 22 nt, Neisseria meningitidis Z2491
caaucgagauaaguguuggaca

SEQ ID NO: 1391269 - RNA, 15 nt, Neisseria meningitidis Z2491
caaucccgcaacucu

SEQ ID NO: 1391270 - RNA, 18 nt, Neisseria meningitidis Z2491
caaucccgcaggauuuua

SEQ ID NO: 1391271 - RNA, 12 nt, Neisseria meningitidis Z2491
caaucugcaucg

SEQ ID NO: 1391272 - RNA, 17 nt, Neisseria meningitidis Z2491
caaucagaucggcaaac

SEQ ID NO: 1391273 - RNA, 11 nt, Neisseria meningitidis Z2491
caaucagauug

SEQ ID NO: 1391274 - RNA, 23 nt, Neisseria meningitidis Z2491
caaucagauugggaagucgugca

SEQ ID NO: 1391275 - RNA, 23 nt, Neisseria meningitidis Z2491
caauacacaagguuauuuucuug

SEQ ID NO: 1391276 - RNA, 13 nt, Neisseria meningitidis Z2491
caauacaacaaaa

SEQ ID NO: 1391277 - RNA, 16 nt, Neisseria meningitidis Z2491
caagucaaaggcuucg

SEQ ID NO: 1391278 - RNA, 12 nt, Neisseria meningitidis Z2491
caaggcaggcag

SEQ ID NO: 1391279 - RNA, 11 nt, Neisseria meningitidis Z2491
caaggcagcaa

SEQ ID NO: 1391280 - RNA, 18 nt, Neisseria meningitidis Z2491
caaggcagcaacgacagc

SEQ ID NO: 1391281 - RNA, 13 nt, Neisseria meningitidis Z2491
aaaacgguuuuuc

SEQ ID NO: 1391282 - RNA, 14 nt, Neisseria meningitidis Z2491
aucaguauuuuaca

SEQ ID NO: 1391283 - RNA, 15 nt, Neisseria meningitidis Z2491
aucaguauuuuacaa

SEQ ID NO: 1391284 - RNA, 12 nt, Neisseria meningitidis Z2491
aucagaaaugac

SEQ ID NO: 1391285 - RNA, 13 nt, Neisseria meningitidis Z2491
aucagaaaugacu

SEQ ID NO: 1391286 - RNA, 16 nt, Neisseria meningitidis Z2491
aucagaaaugacugaa

SEQ ID NO: 1391287 - RNA, 19 nt, Neisseria meningitidis Z2491
aucagaaaugacugaaauu

SEQ ID NO: 1391288 - RNA, 20 nt, Neisseria meningitidis Z2491
aucagaaaugacugaaauuc

SEQ ID NO: 1391289 - RNA, 13 nt, Neisseria meningitidis Z2491
aucagcacaaaug

SEQ ID NO: 1391290 - RNA, 14 nt, Neisseria meningitidis Z2491
aucagcacaaaugc

SEQ ID NO: 1391291 - RNA, 18 nt, Neisseria meningitidis Z2491
aucagcacaaaugccaaa

SEQ ID NO: 1391292 - RNA, 13 nt, Neisseria meningitidis Z2491
aucagaauacugc

SEQ ID NO: 1391293 - RNA, 22 nt, Neisseria meningitidis Z2491
aucagcaguucguucugcauau

SEQ ID NO: 1391294 - RNA, 12 nt, Neisseria meningitidis Z2491
aucacguucuga

SEQ ID NO: 1391295 - RNA, 15 nt, Neisseria meningitidis Z2491
aucacguucugaaaa

SEQ ID NO: 1391296 - RNA, 14 nt, Neisseria meningitidis Z2491
aucacguuuuccaa

SEQ ID NO: 1391297 - RNA, 18 nt, Neisseria meningitidis Z2491
aucaccaucgagcugccu

SEQ ID NO: 1391298 - RNA, 20 nt, Neisseria meningitidis Z2491
aucaccgcaacauuaaauuu

SEQ ID NO: 1391299 - RNA, 18 nt, Neisseria meningitidis Z2491
aucacaauauagccgccc

SEQ ID NO: 1391300 - RNA, 19 nt, Neisseria meningitidis Z2491
aucacauaaugcccgagca

SEQ ID NO: 1391301 - RNA, 16 nt, Neisseria meningitidis Z2491
auauggcggauuaaaa

SEQ ID NO: 1391302 - RNA, 23 nt, Neisseria meningitidis Z2491
auauggcugcuuugguaaaaaaa

SEQ ID NO: 1391303 - RNA, 16 nt, Neisseria meningitidis Z2491
auaugguguugaugcc

SEQ ID NO: 1391304 - RNA, 15 nt, Neisseria meningitidis Z2491
auauguuuuuuccug

SEQ ID NO: 1391305 - RNA, 13 nt, Neisseria meningitidis Z2491
auauguuucaaca

SEQ ID NO: 1391306 - RNA, 13 nt, Neisseria meningitidis Z2491
auaugcggcaggc

SEQ ID NO: 1391307 - RNA, 13 nt, Neisseria meningitidis Z2491
auauggaaaaauc

SEQ ID NO: 1391308 - RNA, 19 nt, Neisseria meningitidis Z2491
auaugcaggucgugcgccg

SEQ ID NO: 1391309 - RNA, 21 nt, Neisseria meningitidis Z2491
auauuccgccgauguaaaccu

SEQ ID NO: 1391310 - RNA, 17 nt, Neisseria meningitidis Z2491
auauuaagaaaaacagc

SEQ ID NO: 1391311 - RNA, 20 nt, Neisseria meningitidis Z2491
auauuaaugauuaucauaaa

SEQ ID NO: 1391312 - RNA, 12 nt, Neisseria meningitidis Z2491
aucaaauauuaa

SEQ ID NO: 1391313 - RNA, 13 nt, Neisseria meningitidis Z2491
aucaaauauuaaa

SEQ ID NO: 1391314 - RNA, 14 nt, Neisseria meningitidis Z2491
aucaaauauuaaaa

SEQ ID NO: 1391315 - RNA, 14 nt, Neisseria meningitidis Z2491
auauuuagcauuua

SEQ ID NO: 1391316 - RNA, 22 nt, Neisseria meningitidis Z2491
auauucugauuuaaaaccauaa

SEQ ID NO: 1391317 - RNA, 21 nt, Neisseria meningitidis Z2491
auauuuuugaagacaucguuu

SEQ ID NO: 1391318 - RNA, 22 nt, Neisseria meningitidis Z2491
auauuugaaccugaccgaagca

SEQ ID NO: 1391319 - RNA, 14 nt, Neisseria meningitidis Z2491
aucaaaaacacaaa

SEQ ID NO: 1391320 - RNA, 12 nt, Neisseria meningitidis Z2491
aucaaaaaauaa

SEQ ID NO: 1391321 - RNA, 19 nt, Neisseria meningitidis Z2491
auauagccgagcaucacga

SEQ ID NO: 1391322 - RNA, 13 nt, Neisseria meningitidis Z2491
auauagugguuuu

SEQ ID NO: 1391323 - RNA, 20 nt, Neisseria meningitidis Z2491
auauaguggauuaaauuuaa

SEQ ID NO: 1391324 - RNA, 20 nt, Neisseria meningitidis Z2491
auauaguggauuaaauuuau

SEQ ID NO: 1391325 - RNA, 23 nt, Neisseria meningitidis Z2491
auauaacgacuguaaagauaaau

SEQ ID NO: 1391326 - RNA, 15 nt, Neisseria meningitidis Z2491
auauccggcgcggca

SEQ ID NO: 1391327 - RNA, 21 nt, Neisseria meningitidis Z2491
auauccggcgcggcaaaagua

SEQ ID NO: 1391328 - RNA, 17 nt, Neisseria meningitidis Z2491
auauccggcuccuaucc

SEQ ID NO: 1391329 - RNA, 13 nt, Neisseria meningitidis Z2491
auauccaaacgca

SEQ ID NO: 1391330 - RNA, 20 nt, Neisseria meningitidis Z2491
auaucauugcuuacaauccg

SEQ ID NO: 1391331 - RNA, 16 nt, Neisseria meningitidis Z2491
auauauucugauuuaa

SEQ ID NO: 1391332 - RNA, 18 nt, Neisseria meningitidis Z2491
auagguugaccagaauca

SEQ ID NO: 1391333 - RNA, 14 nt, Neisseria meningitidis Z2491
auagguuacuaaaa

SEQ ID NO: 1391334 - RNA, 18 nt, Neisseria meningitidis Z2491
auagguuacuaaaauuuu

SEQ ID NO: 1391335 - RNA, 22 nt, Neisseria meningitidis Z2491
auagguuacuaaaauuuuaugc

SEQ ID NO: 1391336 - RNA, 16 nt, Neisseria meningitidis Z2491
auaguaauaaauuaau

SEQ ID NO: 1391337 - RNA, 19 nt, Neisseria meningitidis Z2491
auaguacggcaaggcaagg

SEQ ID NO: 1391338 - RNA, 22 nt, Neisseria meningitidis Z2491
auaguacggcaaggcgaggcaa

SEQ ID NO: 1391339 - RNA, 23 nt, Neisseria meningitidis Z2491
auagucaggcugccuuauguaua

SEQ ID NO: 1391340 - RNA, 17 nt, Neisseria meningitidis Z2491
auagcuucgucauuccc

SEQ ID NO: 1391341 - RNA, 13 nt, Neisseria meningitidis Z2491
auagcuguuugca

SEQ ID NO: 1391342 - RNA, 16 nt, Neisseria meningitidis Z2491
auaggaacauuuagaa

SEQ ID NO: 1391343 - RNA, 14 nt, Neisseria meningitidis Z2491
auagccgccccaau

SEQ ID NO: 1391344 - RNA, 21 nt, Neisseria meningitidis Z2491
auagccgccgccgaaggggcu

SEQ ID NO: 1391345 - RNA, 11 nt, Neisseria meningitidis Z2491
auagccgccgg

SEQ ID NO: 1391346 - RNA, 12 nt, Neisseria meningitidis Z2491
auaccaaaccgc

SEQ ID NO: 1391347 - RNA, 12 nt, Neisseria meningitidis Z2491
auacccucucaa

SEQ ID NO: 1391348 - RNA, 14 nt, Neisseria meningitidis Z2491
auaccauaaauuuu

SEQ ID NO: 1391349 - RNA, 21 nt, Neisseria meningitidis Z2491
auaccauaaauuuuaaauaaa

SEQ ID NO: 1391350 - RNA, 14 nt, Neisseria meningitidis Z2491
auaauucauacaaa

SEQ ID NO: 1391351 - RNA, 22 nt, Neisseria meningitidis Z2491
auacauaggguuaauaucagau

SEQ ID NO: 1391352 - RNA, 16 nt, Neisseria meningitidis Z2491
auacaucccgucauuc

SEQ ID NO: 1391353 - RNA, 21 nt, Neisseria meningitidis Z2491
auacauauugagaccuuugca

SEQ ID NO: 1391354 - RNA, 18 nt, Neisseria meningitidis Z2491
auacauaucgagguuguu

SEQ ID NO: 1391355 - RNA, 17 nt, Neisseria meningitidis Z2491
auacaucgcgcccaucg

SEQ ID NO: 1391356 - RNA, 16 nt, Neisseria meningitidis Z2491
auacaucaucuuauuu

SEQ ID NO: 1391357 - RNA, 15 nt, Neisseria meningitidis Z2491
auacauccuaaaaau

SEQ ID NO: 1391358 - RNA, 20 nt, Neisseria meningitidis Z2491
auacaucuugaguugauaau

SEQ ID NO: 1391359 - RNA, 13 nt, Neisseria meningitidis Z2491
auagacauuuuuu

SEQ ID NO: 1391360 - RNA, 22 nt, Neisseria meningitidis Z2491
auagaaagggaauccuuucugu

SEQ ID NO: 1391361 - RNA, 12 nt, Neisseria meningitidis Z2491
auacuuaacaau

SEQ ID NO: 1391362 - RNA, 21 nt, Neisseria meningitidis Z2491
auacggacgggaaguuuuuug

SEQ ID NO: 1391363 - RNA, 20 nt, Neisseria meningitidis Z2491
auacggcggcauucggcagu

SEQ ID NO: 1391364 - RNA, 14 nt, Neisseria meningitidis Z2491
auaccgucugaaac

SEQ ID NO: 1391365 - RNA, 15 nt, Neisseria meningitidis Z2491
auaccgcaaccugaa

SEQ ID NO: 1391366 - RNA, 13 nt, Neisseria meningitidis Z2491
auaccguucaaac

SEQ ID NO: 1391367 - RNA, 18 nt, Neisseria meningitidis Z2491
auacuacgcggcugaaaa

SEQ ID NO: 1391368 - RNA, 22 nt, Neisseria meningitidis Z2491
auacguuuuucucgugcauaug

SEQ ID NO: 1391369 - RNA, 22 nt, Neisseria meningitidis Z2491
augaacuugggccacuuuuugc

SEQ ID NO: 1391370 - RNA, 12 nt, Neisseria meningitidis Z2491
augaaaauuugg

SEQ ID NO: 1391371 - RNA, 15 nt, Neisseria meningitidis Z2491
augaaaccauuacaa

SEQ ID NO: 1391372 - RNA, 19 nt, Neisseria meningitidis Z2491
augaaaccauuacaaaugc

SEQ ID NO: 1391373 - RNA, 17 nt, Neisseria meningitidis Z2491
augaaacucaauauaac

SEQ ID NO: 1391374 - RNA, 16 nt, Neisseria meningitidis Z2491
augaaaaugugcauuu

SEQ ID NO: 1391375 - RNA, 15 nt, Neisseria meningitidis Z2491
augacaacccugucc

SEQ ID NO: 1391376 - RNA, 15 nt, Neisseria meningitidis Z2491
augacgaagccgaac

SEQ ID NO: 1391377 - RNA, 13 nt, Neisseria meningitidis Z2491
augacgaaagguu

SEQ ID NO: 1391378 - RNA, 16 nt, Neisseria meningitidis Z2491
augacgaugaaaagau

SEQ ID NO: 1391379 - RNA, 14 nt, Neisseria meningitidis Z2491
augacggucaggaa

SEQ ID NO: 1391380 - RNA, 20 nt, Neisseria meningitidis Z2491
augacggaaacucaaaaaac

SEQ ID NO: 1391381 - RNA, 21 nt, Neisseria meningitidis Z2491
augacacaaagccuucuucua

SEQ ID NO: 1391382 - RNA, 16 nt, Neisseria meningitidis Z2491
augacaagcuacggcu

SEQ ID NO: 1391383 - RNA, 15 nt, Neisseria meningitidis Z2491
aucuuguuuuucaau

SEQ ID NO: 1391384 - RNA, 22 nt, Neisseria meningitidis Z2491
aucuuugaauauugcuguuguu

SEQ ID NO: 1391385 - RNA, 13 nt, Neisseria meningitidis Z2491
aucuuuacuuguu

SEQ ID NO: 1391386 - RNA, 14 nt, Neisseria meningitidis Z2491
aucuugcaaacccc

SEQ ID NO: 1391387 - RNA, 14 nt, Neisseria meningitidis Z2491
aucuugccauucuc

SEQ ID NO: 1391388 - RNA, 17 nt, Neisseria meningitidis Z2491
aucuugccauucucaca

SEQ ID NO: 1391389 - RNA, 13 nt, Neisseria meningitidis Z2491
aucuugccagccu

SEQ ID NO: 1391390 - RNA, 22 nt, Neisseria meningitidis Z2491
aucugcaugaaaucgccaaaca

SEQ ID NO: 1391391 - RNA, 22 nt, Neisseria meningitidis Z2491
aucugauuuauuuccugaagcg

SEQ ID NO: 1391392 - RNA, 15 nt, Neisseria meningitidis Z2491
aucugcaccccaaaa

SEQ ID NO: 1391393 - RNA, 13 nt, Neisseria meningitidis Z2491
aucugauuuuucu

SEQ ID NO: 1391394 - RNA, 21 nt, Neisseria meningitidis Z2491
aucugauacaccgguuugcuu

SEQ ID NO: 1391395 - RNA, 21 nt, Neisseria meningitidis Z2491
aucugagaccuuugcaaaaau

SEQ ID NO: 1391396 - RNA, 22 nt, Neisseria meningitidis Z2491
aucugagaccuuugcaaaaaua

SEQ ID NO: 1391397 - RNA, 16 nt, Neisseria meningitidis Z2491
aucugcugcaaaccgu

SEQ ID NO: 1391398 - RNA, 20 nt, Neisseria meningitidis Z2491
aucugcugcgucaaaccagc

SEQ ID NO: 1391399 - RNA, 19 nt, Neisseria meningitidis Z2491
aucugcauuauuugggaua

SEQ ID NO: 1391400 - RNA, 14 nt, Neisseria meningitidis Z2491
aucuggaaaccaaa

SEQ ID NO: 1391401 - RNA, 16 nt, Neisseria meningitidis Z2491
aucuggaaaccaaaaa

SEQ ID NO: 1391402 - RNA, 22 nt, Neisseria meningitidis Z2491
aucucaagaaaccguuuuaccc

SEQ ID NO: 1391403 - RNA, 17 nt, Neisseria meningitidis Z2491
aucucgucccaaacaau

SEQ ID NO: 1391404 - RNA, 23 nt, Neisseria meningitidis Z2491
aucucgucccaaacaaucccacc

SEQ ID NO: 1391405 - RNA, 15 nt, Neisseria meningitidis Z2491
aucucguuauuucca

SEQ ID NO: 1391406 - RNA, 20 nt, Neisseria meningitidis Z2491
aucucguuauuuccacaaaa

SEQ ID NO: 1391407 - RNA, 17 nt, Neisseria meningitidis Z2491
aucguucucuuugaguu

SEQ ID NO: 1391408 - RNA, 21 nt, Neisseria meningitidis Z2491
aucguuucugucgccagcauc

SEQ ID NO: 1391409 - RNA, 13 nt, Neisseria meningitidis Z2491
aucuagaaaugaa

SEQ ID NO: 1391410 - RNA, 21 nt, Neisseria meningitidis Z2491
aucuagaaacgcaaagcugca

SEQ ID NO: 1391411 - RNA, 21 nt, Neisseria meningitidis Z2491
aucguccgccauaaugcccaa

SEQ ID NO: 1391412 - RNA, 18 nt, Neisseria meningitidis Z2491
aucggcaaaguuauucaa

SEQ ID NO: 1391413 - RNA, 18 nt, Neisseria meningitidis Z2491
aucguuacaaauuuaaac

SEQ ID NO: 1391414 - RNA, 13 nt, Neisseria meningitidis Z2491
aucguguaggcag

SEQ ID NO: 1391415 - RNA, 20 nt, Neisseria meningitidis Z2491
aucgauguuuuugcguucag

SEQ ID NO: 1391416 - RNA, 17 nt, Neisseria meningitidis Z2491
aucgaaaaagccgccgg

SEQ ID NO: 1391417 - RNA, 11 nt, Neisseria meningitidis Z2491
aucgagcugcc

SEQ ID NO: 1391418 - RNA, 22 nt, Neisseria meningitidis Z2491
aucgccguaaccgacgaaggca

SEQ ID NO: 1391419 - RNA, 16 nt, Neisseria meningitidis Z2491
aucgcgucuucaaaau

SEQ ID NO: 1391420 - RNA, 15 nt, Neisseria meningitidis Z2491
aucgcuguaauaaac

SEQ ID NO: 1391421 - RNA, 18 nt, Neisseria meningitidis Z2491
aucgcuguaauaaacagc

SEQ ID NO: 1391422 - RNA, 20 nt, Neisseria meningitidis Z2491
auccucggcagacaaaccgu

SEQ ID NO: 1391423 - RNA, 16 nt, Neisseria meningitidis Z2491
auccuccaccauuucu

SEQ ID NO: 1391424 - RNA, 22 nt, Neisseria meningitidis Z2491
auccucaucguucaacagcagc

SEQ ID NO: 1391425 - RNA, 17 nt, Neisseria meningitidis Z2491
auccuuaucggcaaaaa

SEQ ID NO: 1391426 - RNA, 17 nt, Neisseria meningitidis Z2491
aucccgcaggauuuuaa

SEQ ID NO: 1391427 - RNA, 23 nt, Neisseria meningitidis Z2491
aucccgcaaaaacgcagccagca

SEQ ID NO: 1391428 - RNA, 13 nt, Neisseria meningitidis Z2491
aucccaaacccuc

SEQ ID NO: 1391429 - RNA, 22 nt, Neisseria meningitidis Z2491
aucccaaacccucggcauuccc

SEQ ID NO: 1391430 - RNA, 11 nt, Neisseria meningitidis Z2491
aucccaacaag

SEQ ID NO: 1391431 - RNA, 18 nt, Neisseria meningitidis Z2491
aucccaacaagcucaaac

SEQ ID NO: 1391432 - RNA, 22 nt, Neisseria meningitidis Z2491
aucccauuauuuucacaaaaac

SEQ ID NO: 1391433 - RNA, 22 nt, Neisseria meningitidis Z2491
auccagugcguugaguuucagc

SEQ ID NO: 1391434 - RNA, 24 nt, Neisseria meningitidis Z2491
auccagugcguugaguuucagcua

SEQ ID NO: 1391435 - RNA, 16 nt, Neisseria meningitidis Z2491
auccauagauaaauuu

SEQ ID NO: 1391436 - RNA, 15 nt, Neisseria meningitidis Z2491
auccaucacaaugag

SEQ ID NO: 1391437 - RNA, 14 nt, Neisseria meningitidis Z2491
auccacgcucaaac

SEQ ID NO: 1391438 - RNA, 23 nt, Neisseria meningitidis Z2491
auccacuauaauccaccauauuu

SEQ ID NO: 1391439 - RNA, 21 nt, Neisseria meningitidis Z2491
aucauugcuuacaauccgcuu

SEQ ID NO: 1391440 - RNA, 21 nt, Neisseria meningitidis Z2491
aucauugcgggaauagcucag

SEQ ID NO: 1391441 - RNA, 19 nt, Neisseria meningitidis Z2491
auccacgauauuacgaaca

SEQ ID NO: 1391442 - RNA, 15 nt, Neisseria meningitidis Z2491
auccacaguuuuucc

SEQ ID NO: 1391443 - RNA, 19 nt, Neisseria meningitidis Z2491
auccacagagauuguuucc

SEQ ID NO: 1391444 - RNA, 16 nt, Neisseria meningitidis Z2491
aaaacugccuacacga

SEQ ID NO: 1391445 - RNA, 12 nt, Neisseria meningitidis Z2491
aaaacuuaaaau

SEQ ID NO: 1391446 - RNA, 19 nt, Neisseria meningitidis Z2491
aaaacucuccugaucuaaa

SEQ ID NO: 1391447 - RNA, 22 nt, Neisseria meningitidis Z2491
aaaacucuccugaucuaaaaau

SEQ ID NO: 1391448 - RNA, 18 nt, Neisseria meningitidis Z2491
aucaucggcguaauaaua

SEQ ID NO: 1391449 - RNA, 22 nt, Neisseria meningitidis Z2491
aucauaccuaccgccuaucacu

SEQ ID NO: 1391450 - RNA, 12 nt, Neisseria meningitidis Z2491
auaaauuccuaa

SEQ ID NO: 1391451 - RNA, 17 nt, Neisseria meningitidis Z2491
auaaauuccuaaaacuu

SEQ ID NO: 1391452 - RNA, 21 nt, Neisseria meningitidis Z2491
auaaauuccuaaaacuuaaaa

SEQ ID NO: 1391453 - RNA, 18 nt, Neisseria meningitidis Z2491
auaaauucuugcaacuuu

SEQ ID NO: 1391454 - RNA, 23 nt, Neisseria meningitidis Z2491
auaaauucuugcaacuuugcguu

SEQ ID NO: 1391455 - RNA, 20 nt, Neisseria meningitidis Z2491
auaaauucugaaacuuuaau

SEQ ID NO: 1391456 - RNA, 20 nt, Neisseria meningitidis Z2491
auaaauuccugcugcuuuuc

SEQ ID NO: 1391457 - RNA, 10 nt, Neisseria meningitidis Z2491
auaaaugccg

SEQ ID NO: 1391458 - RNA, 13 nt, Neisseria meningitidis Z2491
auaaaucaccgca

SEQ ID NO: 1391459 - RNA, 18 nt, Neisseria meningitidis Z2491
auaaaucaacagcagaau

SEQ ID NO: 1391460 - RNA, 11 nt, Neisseria meningitidis Z2491
auaaacagcac

SEQ ID NO: 1391461 - RNA, 20 nt, Neisseria meningitidis Z2491
auaaacagcacgauacacaa

SEQ ID NO: 1391462 - RNA, 13 nt, Neisseria meningitidis Z2491
auaaacucauuga

SEQ ID NO: 1391463 - RNA, 16 nt, Neisseria meningitidis Z2491
auaaacgccauaauca

SEQ ID NO: 1391464 - RNA, 18 nt, Neisseria meningitidis Z2491
auaaagauacaagaacuu

SEQ ID NO: 1391465 - RNA, 16 nt, Neisseria meningitidis Z2491
aguugguuuugacaua

SEQ ID NO: 1391466 - RNA, 20 nt, Neisseria meningitidis Z2491
aguuuuuccaguuugaaauc

SEQ ID NO: 1391467 - RNA, 22 nt, Neisseria meningitidis Z2491
aguuuuuuauccggcuuuccau

SEQ ID NO: 1391468 - RNA, 16 nt, Neisseria meningitidis Z2491
aguuuuuuuugcaaag

SEQ ID NO: 1391469 - RNA, 20 nt, Neisseria meningitidis Z2491
aguuuuuuguguuccgaacg

SEQ ID NO: 1391470 - RNA, 15 nt, Neisseria meningitidis Z2491
auaaaagacauugcc

SEQ ID NO: 1391471 - RNA, 17 nt, Neisseria meningitidis Z2491
auaaaaggucuuuucua

SEQ ID NO: 1391472 - RNA, 12 nt, Neisseria meningitidis Z2491
auaaaacagaaa

SEQ ID NO: 1391473 - RNA, 18 nt, Neisseria meningitidis Z2491
auaagcaagcaauaccgc

SEQ ID NO: 1391474 - RNA, 22 nt, Neisseria meningitidis Z2491
auaaggcgcguccaacacgcag

SEQ ID NO: 1391475 - RNA, 16 nt, Neisseria meningitidis Z2491
auaaggcuuuaagcaa

SEQ ID NO: 1391476 - RNA, 22 nt, Neisseria meningitidis Z2491
auaagcuguuugcgcuguugca

SEQ ID NO: 1391477 - RNA, 17 nt, Neisseria meningitidis Z2491
auaagcgguuuuccccu

SEQ ID NO: 1391478 - RNA, 16 nt, Neisseria meningitidis Z2491
auaacuuccugauuga

SEQ ID NO: 1391479 - RNA, 22 nt, Neisseria meningitidis Z2491
auaacgccgccguccaucacga

SEQ ID NO: 1391480 - RNA, 21 nt, Neisseria meningitidis Z2491
auaacgacuguaaagauaaau

SEQ ID NO: 1391481 - RNA, 13 nt, Neisseria meningitidis Z2491
auaaauuuuaaau

SEQ ID NO: 1391482 - RNA, 15 nt, Neisseria meningitidis Z2491
auaaauuuuaaauaa

SEQ ID NO: 1391483 - RNA, 21 nt, Neisseria meningitidis Z2491
auaaucaaacucacccugcaa

SEQ ID NO: 1391484 - RNA, 13 nt, Neisseria meningitidis Z2491
auaauccaagauu

SEQ ID NO: 1391485 - RNA, 16 nt, Neisseria meningitidis Z2491
auaauccaagauuuca

SEQ ID NO: 1391486 - RNA, 21 nt, Neisseria meningitidis Z2491
auaauaugaaaccauuacaaa

SEQ ID NO: 1391487 - RNA, 12 nt, Neisseria meningitidis Z2491
auaagguuuuug

SEQ ID NO: 1391488 - RNA, 17 nt, Neisseria meningitidis Z2491
auaagguuugagcaguu

SEQ ID NO: 1391489 - RNA, 18 nt, Neisseria meningitidis Z2491
auaaugcgguguaucuuu

SEQ ID NO: 1391490 - RNA, 19 nt, Neisseria meningitidis Z2491
auaaugcgguguaucuuuu

SEQ ID NO: 1391491 - RNA, 22 nt, Neisseria meningitidis Z2491
auaaugcgguguaucuuuuugc

SEQ ID NO: 1391492 - RNA, 16 nt, Neisseria meningitidis Z2491
aguuccgcaaacgccu

SEQ ID NO: 1391493 - RNA, 13 nt, Neisseria meningitidis Z2491
aguugaaaucaac

SEQ ID NO: 1391494 - RNA, 16 nt, Neisseria meningitidis Z2491
aguuggcaaggaaugc

SEQ ID NO: 1391495 - RNA, 16 nt, Neisseria meningitidis Z2491
agugugguugaagucc

SEQ ID NO: 1391496 - RNA, 15 nt, Neisseria meningitidis Z2491
aguggaacagaaagc

SEQ ID NO: 1391497 - RNA, 16 nt, Neisseria meningitidis Z2491
aguggaacagaaagca

SEQ ID NO: 1391498 - RNA, 18 nt, Neisseria meningitidis Z2491
aguggcgggguuucaacc

SEQ ID NO: 1391499 - RNA, 16 nt, Neisseria meningitidis Z2491
aguccuuguuucacca

SEQ ID NO: 1391500 - RNA, 17 nt, Neisseria meningitidis Z2491
aguccuuguuucaccaa

SEQ ID NO: 1391501 - RNA, 14 nt, Neisseria meningitidis Z2491
aguccgaccgccgc

SEQ ID NO: 1391502 - RNA, 23 nt, Neisseria meningitidis Z2491
agucuaucaguucuacacccaaa

SEQ ID NO: 1391503 - RNA, 14 nt, Neisseria meningitidis Z2491
agucuucggcaaga

SEQ ID NO: 1391504 - RNA, 18 nt, Neisseria meningitidis Z2491
agucaugcccaaaagcag

SEQ ID NO: 1391505 - RNA, 17 nt, Neisseria meningitidis Z2491
aguccauggaaaccaag

SEQ ID NO: 1391506 - RNA, 12 nt, Neisseria meningitidis Z2491
agucauuuuuga

SEQ ID NO: 1391507 - RNA, 18 nt, Neisseria meningitidis Z2491
aguacugcaaggcgaggc

SEQ ID NO: 1391508 - RNA, 12 nt, Neisseria meningitidis Z2491
agucaauguuuu

SEQ ID NO: 1391509 - RNA, 22 nt, Neisseria meningitidis Z2491
aggucuugcagguggaauucuu

SEQ ID NO: 1391510 - RNA, 21 nt, Neisseria meningitidis Z2491
aggucgaaauauugccagccc

SEQ ID NO: 1391511 - RNA, 21 nt, Neisseria meningitidis Z2491
aggucgagcaggaugcugcgg

SEQ ID NO: 1391512 - RNA, 15 nt, Neisseria meningitidis Z2491
agguauuuugcgccg

SEQ ID NO: 1391513 - RNA, 16 nt, Neisseria meningitidis Z2491
agguguuggaaucagg

SEQ ID NO: 1391514 - RNA, 16 nt, Neisseria meningitidis Z2491
agguuauggggauuua

SEQ ID NO: 1391515 - RNA, 18 nt, Neisseria meningitidis Z2491
agguuaauuaaaauacga

SEQ ID NO: 1391516 - RNA, 17 nt, Neisseria meningitidis Z2491
agguuacuuugacuuuu

SEQ ID NO: 1391517 - RNA, 17 nt, Neisseria meningitidis Z2491
aggugggucaaugggug

SEQ ID NO: 1391518 - RNA, 13 nt, Neisseria meningitidis Z2491
aguacaaauagua

SEQ ID NO: 1391519 - RNA, 19 nt, Neisseria meningitidis Z2491
aguacaaauaguacagaac

SEQ ID NO: 1391520 - RNA, 12 nt, Neisseria meningitidis Z2491
aguacgcgggca

SEQ ID NO: 1391521 - RNA, 15 nt, Neisseria meningitidis Z2491
aguacggcaaggcga

SEQ ID NO: 1391522 - RNA, 20 nt, Neisseria meningitidis Z2491
aguacggaaccgauucacuu

SEQ ID NO: 1391523 - RNA, 20 nt, Neisseria meningitidis Z2491
aguacggaaucgauucacuu

SEQ ID NO: 1391524 - RNA, 20 nt, Neisseria meningitidis Z2491
aguacgguaaggcgaggcaa

SEQ ID NO: 1391525 - RNA, 16 nt, Neisseria meningitidis Z2491
agguuuucgucuauuu

SEQ ID NO: 1391526 - RNA, 15 nt, Neisseria meningitidis Z2491
agggcaguuccaaag

SEQ ID NO: 1391527 - RNA, 16 nt, Neisseria meningitidis Z2491
agggcaguugggaauc

SEQ ID NO: 1391528 - RNA, 18 nt, Neisseria meningitidis Z2491
agggcaguugggaaucaa

SEQ ID NO: 1391529 - RNA, 15 nt, Neisseria meningitidis Z2491
agggcgcaccgcgca

SEQ ID NO: 1391530 - RNA, 17 nt, Neisseria meningitidis Z2491
aggcuucagacggcauc

SEQ ID NO: 1391531 - RNA, 20 nt, Neisseria meningitidis Z2491
aggcuucagacgguauucuu

SEQ ID NO: 1391532 - RNA, 14 nt, Neisseria meningitidis Z2491
aggcuguggagcau

SEQ ID NO: 1391533 - RNA, 15 nt, Neisseria meningitidis Z2491
aggguuaagaaaacc

SEQ ID NO: 1391534 - RNA, 16 nt, Neisseria meningitidis Z2491
aggguguuugccggga

SEQ ID NO: 1391535 - RNA, 19 nt, Neisseria meningitidis Z2491
aggguuccgaaaucaucca

SEQ ID NO: 1391536 - RNA, 23 nt, Neisseria meningitidis Z2491
aggguucggacggcauuaaaauu

SEQ ID NO: 1391537 - RNA, 16 nt, Neisseria meningitidis Z2491
aggguuuucuucgccg

SEQ ID NO: 1391538 - RNA, 19 nt, Neisseria meningitidis Z2491
aggggguauuuggguagaa

SEQ ID NO: 1391539 - RNA, 16 nt, Neisseria meningitidis Z2491
agggcuuuugccagcg

SEQ ID NO: 1391540 - RNA, 15 nt, Neisseria meningitidis Z2491
agggcggauugcaga

SEQ ID NO: 1391541 - RNA, 15 nt, Neisseria meningitidis Z2491
aggcgggaauccaga

SEQ ID NO: 1391542 - RNA, 15 nt, Neisseria meningitidis Z2491
aggcgggaauccagg

SEQ ID NO: 1391543 - RNA, 15 nt, Neisseria meningitidis Z2491
aggcgggaauccagu

SEQ ID NO: 1391544 - RNA, 18 nt, Neisseria meningitidis Z2491
aggcgggaaucuagaccu

SEQ ID NO: 1391545 - RNA, 20 nt, Neisseria meningitidis Z2491
aggcgggaaucuagaccuua

SEQ ID NO: 1391546 - RNA, 16 nt, Neisseria meningitidis Z2491
aggcgguaggaugugg

SEQ ID NO: 1391547 - RNA, 19 nt, Neisseria meningitidis Z2491
aggcgggcaggcagugcau

SEQ ID NO: 1391548 - RNA, 21 nt, Neisseria meningitidis Z2491
aggcggcgagccgcagacggu

SEQ ID NO: 1391549 - RNA, 15 nt, Neisseria meningitidis Z2491
aggcuggaaaacagc

SEQ ID NO: 1391550 - RNA, 17 nt, Neisseria meningitidis Z2491
aggcuggaaaacagcug

SEQ ID NO: 1391551 - RNA, 20 nt, Neisseria meningitidis Z2491
aggcuguaugccgucugaaa

SEQ ID NO: 1391552 - RNA, 15 nt, Neisseria meningitidis Z2491
aggcugccuuaugua

SEQ ID NO: 1391553 - RNA, 20 nt, Neisseria meningitidis Z2491
aggcugcggcaacgggagga

SEQ ID NO: 1391554 - RNA, 18 nt, Neisseria meningitidis Z2491
aggcugcauucgagcagg

SEQ ID NO: 1391555 - RNA, 16 nt, Neisseria meningitidis Z2491
aggaugccuagauggc

SEQ ID NO: 1391556 - RNA, 14 nt, Neisseria meningitidis Z2491
aggcaaauuucagu

SEQ ID NO: 1391557 - RNA, 20 nt, Neisseria meningitidis Z2491
aggcagcaacgacagcagca

SEQ ID NO: 1391558 - RNA, 23 nt, Neisseria meningitidis Z2491
aggcagcaacgacagcagcagcc

SEQ ID NO: 1391559 - RNA, 19 nt, Neisseria meningitidis Z2491
aggcacaacgagcguaaga

SEQ ID NO: 1391560 - RNA, 20 nt, Neisseria meningitidis Z2491
aggcagggaaacgccuucag

SEQ ID NO: 1391561 - RNA, 9 nt, Neisseria meningitidis Z2491
aggcagccu

SEQ ID NO: 1391562 - RNA, 16 nt, Neisseria meningitidis Z2491
aggccgcugguaucuu

SEQ ID NO: 1391563 - RNA, 16 nt, Neisseria meningitidis Z2491
aggaucuuauccaucc

SEQ ID NO: 1391564 - RNA, 20 nt, Neisseria meningitidis Z2491
aggacguagucggugcuuug

SEQ ID NO: 1391565 - RNA, 23 nt, Neisseria meningitidis Z2491
aggaaugacuguccgagacagaa

SEQ ID NO: 1391566 - RNA, 18 nt, Neisseria meningitidis Z2491
aggaaucggguuucagac

SEQ ID NO: 1391567 - RNA, 14 nt, Neisseria meningitidis Z2491
aggacggcuuugaa

SEQ ID NO: 1391568 - RNA, 15 nt, Neisseria meningitidis Z2491
aggacgggcagggca

SEQ ID NO: 1391569 - RNA, 15 nt, Neisseria meningitidis Z2491
aggacggaaauguuc

SEQ ID NO: 1391570 - RNA, 23 nt, Neisseria meningitidis Z2491
agcuuuuugugaucgcgcugaau

SEQ ID NO: 1391571 - RNA, 22 nt, Neisseria meningitidis Z2491
agcugcaagaauuuaucaaaaa

SEQ ID NO: 1391572 - RNA, 14 nt, Neisseria meningitidis Z2491
agcugcagacagua

SEQ ID NO: 1391573 - RNA, 19 nt, Neisseria meningitidis Z2491
agcugguagggauacaaau

SEQ ID NO: 1391574 - RNA, 22 nt, Neisseria meningitidis Z2491
agcugguagggauacaaaucca

SEQ ID NO: 1391575 - RNA, 16 nt, Neisseria meningitidis Z2491
agcugaaaacagcuga

SEQ ID NO: 1391576 - RNA, 19 nt, Neisseria meningitidis Z2491
agcucuguucgaccacaua

SEQ ID NO: 1391577 - RNA, 15 nt, Neisseria meningitidis Z2491
agcuccgaaccgaaa

SEQ ID NO: 1391578 - RNA, 16 nt, Neisseria meningitidis Z2491
agcuccggccaaaaaa

SEQ ID NO: 1391579 - RNA, 19 nt, Neisseria meningitidis Z2491
agcuccggccaaaaaaacg

SEQ ID NO: 1391580 - RNA, 20 nt, Neisseria meningitidis Z2491
agcuccggccaaaaaaacgu

SEQ ID NO: 1391581 - RNA, 12 nt, Neisseria meningitidis Z2491
accgaaaugccg

SEQ ID NO: 1391582 - RNA, 13 nt, Neisseria meningitidis Z2491
accgaaacggcgc

SEQ ID NO: 1391583 - RNA, 18 nt, Neisseria meningitidis Z2491
accgaaacagaaacccaa

SEQ ID NO: 1391584 - RNA, 16 nt, Neisseria meningitidis Z2491
acccuuugggcguuca

SEQ ID NO: 1391585 - RNA, 12 nt, Neisseria meningitidis Z2491
accgaaaaauaa

SEQ ID NO: 1391586 - RNA, 17 nt, Neisseria meningitidis Z2491
accgaagcucuguucga

SEQ ID NO: 1391587 - RNA, 15 nt, Neisseria meningitidis Z2491
accgaaguuuaaaga

SEQ ID NO: 1391588 - RNA, 17 nt, Neisseria meningitidis Z2491
accgacaauacggcggc

SEQ ID NO: 1391589 - RNA, 19 nt, Neisseria meningitidis Z2491
acccugccgucauucccgc

SEQ ID NO: 1391590 - RNA, 20 nt, Neisseria meningitidis Z2491
acccugccgucugaaaccgg

SEQ ID NO: 1391591 - RNA, 17 nt, Neisseria meningitidis Z2491
acccugcaaggcggcgg

SEQ ID NO: 1391592 - RNA, 18 nt, Neisseria meningitidis Z2491
acccuuaucccaauauua

SEQ ID NO: 1391593 - RNA, 20 nt, Neisseria meningitidis Z2491
acccuuaucccaauauuaag

SEQ ID NO: 1391594 - RNA, 19 nt, Neisseria meningitidis Z2491
acccgguuuugcgccucgc

SEQ ID NO: 1391595 - RNA, 17 nt, Neisseria meningitidis Z2491
acccuaccauuguuucu

SEQ ID NO: 1391596 - RNA, 23 nt, Neisseria meningitidis Z2491
accccuaaaggcuucagacggca

SEQ ID NO: 1391597 - RNA, 18 nt, Neisseria meningitidis Z2491
accccguucccuguacca

SEQ ID NO: 1391598 - RNA, 19 nt, Neisseria meningitidis Z2491
acccgaaucacaaacaucg

SEQ ID NO: 1391599 - RNA, 20 nt, Neisseria meningitidis Z2491
acccgcaaccaaaaucauca

SEQ ID NO: 1391600 - RNA, 20 nt, Neisseria meningitidis Z2491
acccauucugacaaggccga

SEQ ID NO: 1391601 - RNA, 21 nt, Neisseria meningitidis Z2491
acccauuuggagucgccuucg

SEQ ID NO: 1391602 - RNA, 19 nt, Neisseria meningitidis Z2491
acccccgaaugacaacccu

SEQ ID NO: 1391603 - RNA, 17 nt, Neisseria meningitidis Z2491
acccccgucauucccuc

SEQ ID NO: 1391604 - RNA, 19 nt, Neisseria meningitidis Z2491
accaucguccaaccuuccc

SEQ ID NO: 1391605 - RNA, 19 nt, Neisseria meningitidis Z2491
accaucuucuucaacaccu

SEQ ID NO: 1391606 - RNA, 21 nt, Neisseria meningitidis Z2491
accaucuacauaaacaggcgc

SEQ ID NO: 1391607 - RNA, 16 nt, Neisseria meningitidis Z2491
accaguucccacgccc

SEQ ID NO: 1391608 - RNA, 23 nt, Neisseria meningitidis Z2491
accaguacggcguucccucgccu

SEQ ID NO: 1391609 - RNA, 18 nt, Neisseria meningitidis Z2491
accaguacgguguugccu

SEQ ID NO: 1391610 - RNA, 18 nt, Neisseria meningitidis Z2491
accaucggcaaaguuauu

SEQ ID NO: 1391611 - RNA, 13 nt, Neisseria meningitidis Z2491
accauaaagagca

SEQ ID NO: 1391612 - RNA, 15 nt, Neisseria meningitidis Z2491
accagaccgaugccg

SEQ ID NO: 1391613 - RNA, 13 nt, Neisseria meningitidis Z2491
accagaaucacuu

SEQ ID NO: 1391614 - RNA, 15 nt, Neisseria meningitidis Z2491
accaagcccaauccc

SEQ ID NO: 1391615 - RNA, 18 nt, Neisseria meningitidis Z2491
accagcagugccgcacca

SEQ ID NO: 1391616 - RNA, 20 nt, Neisseria meningitidis Z2491
accagcgcgaugucgcugcc

SEQ ID NO: 1391617 - RNA, 21 nt, Neisseria meningitidis Z2491
accgauucacuuggugcuuca

SEQ ID NO: 1391618 - RNA, 20 nt, Neisseria meningitidis Z2491
accgauucacuuggugcuug

SEQ ID NO: 1391619 - RNA, 19 nt, Neisseria meningitidis Z2491
accgauucacuuggugcuu

SEQ ID NO: 1391620 - RNA, 15 nt, Neisseria meningitidis Z2491
accgaugggcuucau

SEQ ID NO: 1391621 - RNA, 20 nt, Neisseria meningitidis Z2491
accgcuccgccgucauuccc

SEQ ID NO: 1391622 - RNA, 22 nt, Neisseria meningitidis Z2491
accgcuuuguccaaaucggcaa

SEQ ID NO: 1391623 - RNA, 19 nt, Neisseria meningitidis Z2491
accgcuugacgcuaccgca

SEQ ID NO: 1391624 - RNA, 14 nt, Neisseria meningitidis Z2491
accguauauuuccc

SEQ ID NO: 1391625 - RNA, 15 nt, Neisseria meningitidis Z2491
accguaucaaacaag

SEQ ID NO: 1391626 - RNA, 18 nt, Neisseria meningitidis Z2491
accguaucaaacaagaaa

SEQ ID NO: 1391627 - RNA, 14 nt, Neisseria meningitidis Z2491
accgguccuuccau

SEQ ID NO: 1391628 - RNA, 19 nt, Neisseria meningitidis Z2491
accgguuugguuuucaaaa

SEQ ID NO: 1391629 - RNA, 16 nt, Neisseria meningitidis Z2491
accguacugguuuaaa

SEQ ID NO: 1391630 - RNA, 11 nt, Neisseria meningitidis Z2491
accgggcaggc

SEQ ID NO: 1391631 - RNA, 12 nt, Neisseria meningitidis Z2491
accuaccgccua

SEQ ID NO: 1391632 - RNA, 20 nt, Neisseria meningitidis Z2491
accgucguuuuuuuccugcc

SEQ ID NO: 1391633 - RNA, 16 nt, Neisseria meningitidis Z2491
accgucugaaaccugc

SEQ ID NO: 1391634 - RNA, 18 nt, Neisseria meningitidis Z2491
accgucugaacaucgugu

SEQ ID NO: 1391635 - RNA, 16 nt, Neisseria meningitidis Z2491
accguucaauuucaac

SEQ ID NO: 1391636 - RNA, 21 nt, Neisseria meningitidis Z2491
accguugcagccaugcggcaa

SEQ ID NO: 1391637 - RNA, 23 nt, Neisseria meningitidis Z2491
accguugcgugucuucgccgacc

SEQ ID NO: 1391638 - RNA, 16 nt, Neisseria meningitidis Z2491
accguuuaauuuuguu

SEQ ID NO: 1391639 - RNA, 18 nt, Neisseria meningitidis Z2491
accguuuaaaacagcauu

SEQ ID NO: 1391640 - RNA, 14 nt, Neisseria meningitidis Z2491
accguuauggaaau

SEQ ID NO: 1391641 - RNA, 17 nt, Neisseria meningitidis Z2491
accguuauggaaauguc

SEQ ID NO: 1391642 - RNA, 20 nt, Neisseria meningitidis Z2491
accgugcgcugucaaacccu

SEQ ID NO: 1391643 - RNA, 20 nt, Neisseria meningitidis Z2491
accgugcggcacgccgccgu

SEQ ID NO: 1391644 - RNA, 21 nt, Neisseria meningitidis Z2491
acgaccaacgccgccgacauc

SEQ ID NO: 1391645 - RNA, 15 nt, Neisseria meningitidis Z2491
acgacagcagcagcc

SEQ ID NO: 1391646 - RNA, 22 nt, Neisseria meningitidis Z2491
acgaaagugggaaucuagaaau

SEQ ID NO: 1391647 - RNA, 18 nt, Neisseria meningitidis Z2491
acgaaucuuauccacaga

SEQ ID NO: 1391648 - RNA, 17 nt, Neisseria meningitidis Z2491
acgaaaaguugcaagaa

SEQ ID NO: 1391649 - RNA, 18 nt, Neisseria meningitidis Z2491
acgaaaaguugcaagaau

SEQ ID NO: 1391650 - RNA, 20 nt, Neisseria meningitidis Z2491
acgaaaaguugcaagaauga

SEQ ID NO: 1391651 - RNA, 18 nt, Neisseria meningitidis Z2491
accuuugggcggcggcaa

SEQ ID NO: 1391652 - RNA, 23 nt, Neisseria meningitidis Z2491
accuuugggcggcggcaauauuc

SEQ ID NO: 1391653 - RNA, 14 nt, Neisseria meningitidis Z2491
accuuugcaaaaau

SEQ ID NO: 1391654 - RNA, 14 nt, Neisseria meningitidis Z2491
accuuuggcggcgu

SEQ ID NO: 1391655 - RNA, 16 nt, Neisseria meningitidis Z2491
acgaccuuugcuuuuc

SEQ ID NO: 1391656 - RNA, 18 nt, Neisseria meningitidis Z2491
acgacgcggcugcugccu

SEQ ID NO: 1391657 - RNA, 19 nt, Neisseria meningitidis Z2491
acgaguuccgcaaacgccu

SEQ ID NO: 1391658 - RNA, 19 nt, Neisseria meningitidis Z2491
acgaguccaagacaggcgg

SEQ ID NO: 1391659 - RNA, 12 nt, Neisseria meningitidis Z2491
acgagauuuuag

SEQ ID NO: 1391660 - RNA, 14 nt, Neisseria meningitidis Z2491
acgagccguaaccg

SEQ ID NO: 1391661 - RNA, 13 nt, Neisseria meningitidis Z2491
accuguaaaauau

SEQ ID NO: 1391662 - RNA, 20 nt, Neisseria meningitidis Z2491
accugcccgacagccgcaaa

SEQ ID NO: 1391663 - RNA, 20 nt, Neisseria meningitidis Z2491
accugcaucacgucauuccu

SEQ ID NO: 1391664 - RNA, 15 nt, Neisseria meningitidis Z2491
accucccaauccugc

SEQ ID NO: 1391665 - RNA, 13 nt, Neisseria meningitidis Z2491
accuccagcacca

SEQ ID NO: 1391666 - RNA, 21 nt, Neisseria meningitidis Z2491
accugcugcccaugaagagga

SEQ ID NO: 1391667 - RNA, 15 nt, Neisseria meningitidis Z2491
acggcaucaaaaacu

SEQ ID NO: 1391668 - RNA, 22 nt, Neisseria meningitidis Z2491
acggcauaucccgacagaacag

SEQ ID NO: 1391669 - RNA, 13 nt, Neisseria meningitidis Z2491
acggcauauguuu

SEQ ID NO: 1391670 - RNA, 20 nt, Neisseria meningitidis Z2491
acggcagguaaaaaauagaa

SEQ ID NO: 1391671 - RNA, 22 nt, Neisseria meningitidis Z2491
acggcauuuuguuuuuaagaag

SEQ ID NO: 1391672 - RNA, 13 nt, Neisseria meningitidis Z2491
acggcauuuuuaa

SEQ ID NO: 1391673 - RNA, 20 nt, Neisseria meningitidis Z2491
acggcauuuuuauugcuuca

SEQ ID NO: 1391674 - RNA, 17 nt, Neisseria meningitidis Z2491
acggcauuuccggcauc

SEQ ID NO: 1391675 - RNA, 21 nt, Neisseria meningitidis Z2491
acggcauuucuuauguuuaau

SEQ ID NO: 1391676 - RNA, 20 nt, Neisseria meningitidis Z2491
acggcauuuuagauuuggca

SEQ ID NO: 1391677 - RNA, 21 nt, Neisseria meningitidis Z2491
acggcauuuucaacagcagga

SEQ ID NO: 1391678 - RNA, 16 nt, Neisseria meningitidis Z2491
acggcauuuucgcaac

SEQ ID NO: 1391679 - RNA, 19 nt, Neisseria meningitidis Z2491
acggcauuuucgcaaccgu

SEQ ID NO: 1391680 - RNA, 18 nt, Neisseria meningitidis Z2491
acggcacaaacgccagca

SEQ ID NO: 1391681 - RNA, 18 nt, Neisseria meningitidis Z2491
acgcuguaccgguuuaaa

SEQ ID NO: 1391682 - RNA, 20 nt, Neisseria meningitidis Z2491
acggcacggcgcaggcaaac

SEQ ID NO: 1391683 - RNA, 18 nt, Neisseria meningitidis Z2491
acggucgaaacuuuccac

SEQ ID NO: 1391684 - RNA, 19 nt, Neisseria meningitidis Z2491
acggucggggguuucuguu

SEQ ID NO: 1391685 - RNA, 15 nt, Neisseria meningitidis Z2491
acgguauucauaccu

SEQ ID NO: 1391686 - RNA, 15 nt, Neisseria meningitidis Z2491
acggggaggaaaguc

SEQ ID NO: 1391687 - RNA, 16 nt, Neisseria meningitidis Z2491
acggcgggcaggcggc

SEQ ID NO: 1391688 - RNA, 19 nt, Neisseria meningitidis Z2491
acggcggcagggucggcga

SEQ ID NO: 1391689 - RNA, 14 nt, Neisseria meningitidis Z2491
acgggaaugacgaa

SEQ ID NO: 1391690 - RNA, 15 nt, Neisseria meningitidis Z2491
acggcggggggauuu

SEQ ID NO: 1391691 - RNA, 16 nt, Neisseria meningitidis Z2491
acggcgggggggauuu

SEQ ID NO: 1391692 - RNA, 19 nt, Neisseria meningitidis Z2491
acgggacuuugcggcugug

SEQ ID NO: 1391693 - RNA, 23 nt, Neisseria meningitidis Z2491
acgggcaaccuuauuuccgucag

SEQ ID NO: 1391694 - RNA, 12 nt, Neisseria meningitidis Z2491
acgggauuuuag

SEQ ID NO: 1391695 - RNA, 15 nt, Neisseria meningitidis Z2491
acgggcaauuuucaa

SEQ ID NO: 1391696 - RNA, 19 nt, Neisseria meningitidis Z2491
acggugugccgaaguuaaa

SEQ ID NO: 1391697 - RNA, 15 nt, Neisseria meningitidis Z2491
acgguuacacaaaua

SEQ ID NO: 1391698 - RNA, 16 nt, Neisseria meningitidis Z2491
acguaucggauaaaac

SEQ ID NO: 1391699 - RNA, 17 nt, Neisseria meningitidis Z2491
acguccgccauuuccaa

SEQ ID NO: 1391700 - RNA, 18 nt, Neisseria meningitidis Z2491
acguccgccauuuccaaa

SEQ ID NO: 1391701 - RNA, 18 nt, Neisseria meningitidis Z2491
acguccaaaugccgcaaa

SEQ ID NO: 1391702 - RNA, 13 nt, Neisseria meningitidis Z2491
acguggucggcgu

SEQ ID NO: 1391703 - RNA, 20 nt, Neisseria meningitidis Z2491
acguggguuugagauauagu

SEQ ID NO: 1391704 - RNA, 23 nt, Neisseria meningitidis Z2491
acgugcaauacacuguuuccaag

SEQ ID NO: 1391705 - RNA, 20 nt, Neisseria meningitidis Z2491
acgcgcccaucgucuagagg

SEQ ID NO: 1391706 - RNA, 18 nt, Neisseria meningitidis Z2491
acgcgcgccguccaaaaa

SEQ ID NO: 1391707 - RNA, 15 nt, Neisseria meningitidis Z2491
acgcgcugcggcauc

SEQ ID NO: 1391708 - RNA, 14 nt, Neisseria meningitidis Z2491
acgcggugguuggu

SEQ ID NO: 1391709 - RNA, 14 nt, Neisseria meningitidis Z2491
acgcgugcaggcgc

SEQ ID NO: 1391710 - RNA, 13 nt, Neisseria meningitidis Z2491
acgccccucccaa

SEQ ID NO: 1391711 - RNA, 21 nt, Neisseria meningitidis Z2491
acgauauuacgaacaaugcaa

SEQ ID NO: 1391712 - RNA, 15 nt, Neisseria meningitidis Z2491
acgccauuuguucgc

SEQ ID NO: 1391713 - RNA, 12 nt, Neisseria meningitidis Z2491
acgccuucuucg

SEQ ID NO: 1391714 - RNA, 20 nt, Neisseria meningitidis Z2491
acgccguguuucaaggcggc

SEQ ID NO: 1391715 - RNA, 16 nt, Neisseria meningitidis Z2491
acgccgccguccauca

SEQ ID NO: 1391716 - RNA, 18 nt, Neisseria meningitidis Z2491
acgccgccgcgccccaag

SEQ ID NO: 1391717 - RNA, 14 nt, Neisseria meningitidis Z2491
acgccgucugaaau

SEQ ID NO: 1391718 - RNA, 15 nt, Neisseria meningitidis Z2491
acgccgucugaaauu

SEQ ID NO: 1391719 - RNA, 18 nt, Neisseria meningitidis Z2491
acgccgggcaagacgaag

SEQ ID NO: 1391720 - RNA, 14 nt, Neisseria meningitidis Z2491
acuuaagaaacaaa

SEQ ID NO: 1391721 - RNA, 15 nt, Neisseria meningitidis Z2491
acuuaagaaacaaag

SEQ ID NO: 1391722 - RNA, 22 nt, Neisseria meningitidis Z2491
acuuaagaaacaaagcuuuaaa

SEQ ID NO: 1391723 - RNA, 23 nt, Neisseria meningitidis Z2491
acuuaagaaacaaagcuuuaaac

SEQ ID NO: 1391724 - RNA, 12 nt, Neisseria meningitidis Z2491
acugugccauug

SEQ ID NO: 1391725 - RNA, 16 nt, Neisseria meningitidis Z2491
acuguccgagacagaa

SEQ ID NO: 1391726 - RNA, 11 nt, Neisseria meningitidis Z2491
acugguuuaaa

SEQ ID NO: 1391727 - RNA, 13 nt, Neisseria meningitidis Z2491
acugguuuaaauu

SEQ ID NO: 1391728 - RNA, 19 nt, Neisseria meningitidis Z2491
acugguugagugcgaccug

SEQ ID NO: 1391729 - RNA, 21 nt, Neisseria meningitidis Z2491
acuguaaagauaaaucuaugu

SEQ ID NO: 1391730 - RNA, 20 nt, Neisseria meningitidis Z2491
acugggcauacagcucgucc

SEQ ID NO: 1391731 - RNA, 13 nt, Neisseria meningitidis Z2491
acugaagcucaaa

SEQ ID NO: 1391732 - RNA, 21 nt, Neisseria meningitidis Z2491
acugagaccuuugcaauaaca

SEQ ID NO: 1391733 - RNA, 17 nt, Neisseria meningitidis Z2491
acugcaguaacuucaaa

SEQ ID NO: 1391734 - RNA, 11 nt, Neisseria meningitidis Z2491
acugccgccgc

SEQ ID NO: 1391735 - RNA, 16 nt, Neisseria meningitidis Z2491
acugccgccgcgccug

SEQ ID NO: 1391736 - RNA, 21 nt, Neisseria meningitidis Z2491
acugccgcaaacggcaggcaa

SEQ ID NO: 1391737 - RNA, 19 nt, Neisseria meningitidis Z2491
acugcuguugcaaagccug

SEQ ID NO: 1391738 - RNA, 20 nt, Neisseria meningitidis Z2491
acuccgccucgccuuucgua

SEQ ID NO: 1391739 - RNA, 15 nt, Neisseria meningitidis Z2491
acuccugcugcggcg

SEQ ID NO: 1391740 - RNA, 17 nt, Neisseria meningitidis Z2491
acuccaaagagaaagaa

SEQ ID NO: 1391741 - RNA, 16 nt, Neisseria meningitidis Z2491
acuccaaaccuuuggc

SEQ ID NO: 1391742 - RNA, 15 nt, Neisseria meningitidis Z2491
acucauucaauccuc

SEQ ID NO: 1391743 - RNA, 16 nt, Neisseria meningitidis Z2491
acucauucaauccuca

SEQ ID NO: 1391744 - RNA, 13 nt, Neisseria meningitidis Z2491
acucacuuuaauc

SEQ ID NO: 1391745 - RNA, 21 nt, Neisseria meningitidis Z2491
acucacuuuaaucaauccgaa

SEQ ID NO: 1391746 - RNA, 17 nt, Neisseria meningitidis Z2491
acucaaagcugcaagaa

SEQ ID NO: 1391747 - RNA, 13 nt, Neisseria meningitidis Z2491
acuaguguauuag

SEQ ID NO: 1391748 - RNA, 14 nt, Neisseria meningitidis Z2491
acuacgcggcugaa

SEQ ID NO: 1391749 - RNA, 23 nt, Neisseria meningitidis Z2491
acuacgcggcugaaaaaaugccg

SEQ ID NO: 1391750 - RNA, 23 nt, Neisseria meningitidis Z2491
agcaacuuuuccgcgucauuccc

SEQ ID NO: 1391751 - RNA, 19 nt, Neisseria meningitidis Z2491
agcaacugaaccgucauuc

SEQ ID NO: 1391752 - RNA, 21 nt, Neisseria meningitidis Z2491
agcaacugaaccgucauuccc

SEQ ID NO: 1391753 - RNA, 22 nt, Neisseria meningitidis Z2491
agcaacugaaccgucauuccca

SEQ ID NO: 1391754 - RNA, 16 nt, Neisseria meningitidis Z2491
agcaauccauucccuc

SEQ ID NO: 1391755 - RNA, 12 nt, Neisseria meningitidis Z2491
agcaauccugcc

SEQ ID NO: 1391756 - RNA, 12 nt, Neisseria meningitidis Z2491
agcaauaaaaua

SEQ ID NO: 1391757 - RNA, 15 nt, Neisseria meningitidis Z2491
agcaauaaaauaaag

SEQ ID NO: 1391758 - RNA, 14 nt, Neisseria meningitidis Z2491
agcacaaacagcau

SEQ ID NO: 1391759 - RNA, 15 nt, Neisseria meningitidis Z2491
agcacaaaugccaaa

SEQ ID NO: 1391760 - RNA, 14 nt, Neisseria meningitidis Z2491
agcagaaucaaaua

SEQ ID NO: 1391761 - RNA, 16 nt, Neisseria meningitidis Z2491
agcagaaucaaauauu

SEQ ID NO: 1391762 - RNA, 18 nt, Neisseria meningitidis Z2491
agcagaaucaaauauuaa

SEQ ID NO: 1391763 - RNA, 21 nt, Neisseria meningitidis Z2491
agcacugccucuuuucagaca

SEQ ID NO: 1391764 - RNA, 15 nt, Neisseria meningitidis Z2491
agcacgcggugcugc

SEQ ID NO: 1391765 - RNA, 19 nt, Neisseria meningitidis Z2491
agcacgauacacaaaaaag

SEQ ID NO: 1391766 - RNA, 22 nt, Neisseria meningitidis Z2491
agcacgauacacaaaaaagcca

SEQ ID NO: 1391767 - RNA, 23 nt, Neisseria meningitidis Z2491
agcacgauacacaaaaaagccag

SEQ ID NO: 1391768 - RNA, 18 nt, Neisseria meningitidis Z2491
agcaccaaguaaaucggu

SEQ ID NO: 1391769 - RNA, 12 nt, Neisseria meningitidis Z2491
agcacaggcaag

SEQ ID NO: 1391770 - RNA, 12 nt, Neisseria meningitidis Z2491
agcaccaguucg

SEQ ID NO: 1391771 - RNA, 24 nt, Neisseria meningitidis Z2491
agcauuuaauucacgacuucagca

SEQ ID NO: 1391772 - RNA, 23 nt, Neisseria meningitidis Z2491
agcaugguuaagagauuggcauu

SEQ ID NO: 1391773 - RNA, 19 nt, Neisseria meningitidis Z2491
agccaaaccgcagcaacgu

SEQ ID NO: 1391774 - RNA, 19 nt, Neisseria meningitidis Z2491
agcauaagccgccaucaaa

SEQ ID NO: 1391775 - RNA, 22 nt, Neisseria meningitidis Z2491
agcauauaacaccuuucaauca

SEQ ID NO: 1391776 - RNA, 11 nt, Neisseria meningitidis Z2491
agcaguuuuuc

SEQ ID NO: 1391777 - RNA, 16 nt, Neisseria meningitidis Z2491
agcaguuuuuugacuu

SEQ ID NO: 1391778 - RNA, 15 nt, Neisseria meningitidis Z2491
agcauaaaauuuuag

SEQ ID NO: 1391779 - RNA, 14 nt, Neisseria meningitidis Z2491
agcaggaaggcggc

SEQ ID NO: 1391780 - RNA, 21 nt, Neisseria meningitidis Z2491
agcagcuuuugcgccacggca

SEQ ID NO: 1391781 - RNA, 14 nt, Neisseria meningitidis Z2491
agcaggguuuucau

SEQ ID NO: 1391782 - RNA, 17 nt, Neisseria meningitidis Z2491
aaaaccucgggaauaaa

SEQ ID NO: 1391783 - RNA, 13 nt, Neisseria meningitidis Z2491
agcggaaauccag

SEQ ID NO: 1391784 - RNA, 16 nt, Neisseria meningitidis Z2491
agcggauucuguugcu

SEQ ID NO: 1391785 - RNA, 22 nt, Neisseria meningitidis Z2491
agcggauuguucggaucggcag

SEQ ID NO: 1391786 - RNA, 17 nt, Neisseria meningitidis Z2491
agcggacgauuucccug

SEQ ID NO: 1391787 - RNA, 18 nt, Neisseria meningitidis Z2491
agcggacgauuucccugu

SEQ ID NO: 1391788 - RNA, 16 nt, Neisseria meningitidis Z2491
agcggcaauauucaaa

SEQ ID NO: 1391789 - RNA, 13 nt, Neisseria meningitidis Z2491
agcggcagagcaa

SEQ ID NO: 1391790 - RNA, 17 nt, Neisseria meningitidis Z2491
agcggcagagcaaguca

SEQ ID NO: 1391791 - RNA, 16 nt, Neisseria meningitidis Z2491
agcggcaggaauuuau

SEQ ID NO: 1391792 - RNA, 14 nt, Neisseria meningitidis Z2491
agccuaaaacauca

SEQ ID NO: 1391793 - RNA, 15 nt, Neisseria meningitidis Z2491
agccuaaaacaucaa

SEQ ID NO: 1391794 - RNA, 18 nt, Neisseria meningitidis Z2491
agccuaauguacuucugg

SEQ ID NO: 1391795 - RNA, 13 nt, Neisseria meningitidis Z2491
agccuaucaucag

SEQ ID NO: 1391796 - RNA, 14 nt, Neisseria meningitidis Z2491
agccuaucaucaga

SEQ ID NO: 1391797 - RNA, 15 nt, Neisseria meningitidis Z2491
agccuaucaucagau

SEQ ID NO: 1391798 - RNA, 13 nt, Neisseria meningitidis Z2491
agccuauccauuc

SEQ ID NO: 1391799 - RNA, 18 nt, Neisseria meningitidis Z2491
agccgucgccccaaaaag

SEQ ID NO: 1391800 - RNA, 16 nt, Neisseria meningitidis Z2491
agccguagacaguaca

SEQ ID NO: 1391801 - RNA, 13 nt, Neisseria meningitidis Z2491
agccggggcaggc

SEQ ID NO: 1391802 - RNA, 19 nt, Neisseria meningitidis Z2491
agccggcggcaacaaugcc

SEQ ID NO: 1391803 - RNA, 18 nt, Neisseria meningitidis Z2491
agccuucuucuaaaaaua

SEQ ID NO: 1391804 - RNA, 17 nt, Neisseria meningitidis Z2491
agccuucauccgcaacg

SEQ ID NO: 1391805 - RNA, 16 nt, Neisseria meningitidis Z2491
agccuucagacggcau

SEQ ID NO: 1391806 - RNA, 16 nt, Neisseria meningitidis Z2491
agccucgucauuucca

SEQ ID NO: 1391807 - RNA, 17 nt, Neisseria meningitidis Z2491
agccuccgacugcucgg

SEQ ID NO: 1391808 - RNA, 18 nt, Neisseria meningitidis Z2491
agccuccugccaaugccu

SEQ ID NO: 1391809 - RNA, 21 nt, Neisseria meningitidis Z2491
agccuauuuuucugaaaaauu

SEQ ID NO: 1391810 - RNA, 16 nt, Neisseria meningitidis Z2491
agccggccaacaucag

SEQ ID NO: 1391811 - RNA, 21 nt, Neisseria meningitidis Z2491
agcccugauaaaaaauauggc

SEQ ID NO: 1391812 - RNA, 18 nt, Neisseria meningitidis Z2491
agccgaaugauucauaaa

SEQ ID NO: 1391813 - RNA, 22 nt, Neisseria meningitidis Z2491
agccgaaugauucauaaaauau

SEQ ID NO: 1391814 - RNA, 15 nt, Neisseria meningitidis Z2491
acuuggugcuucagc

SEQ ID NO: 1391815 - RNA, 17 nt, Neisseria meningitidis Z2491
acuuggugcuucagcac

SEQ ID NO: 1391816 - RNA, 15 nt, Neisseria meningitidis Z2491
acuugucaagaaaca

SEQ ID NO: 1391817 - RNA, 21 nt, Neisseria meningitidis Z2491
acuugucgcagcugcucagac

SEQ ID NO: 1391818 - RNA, 22 nt, Neisseria meningitidis Z2491
acuugccgcauaaaucaacagc

SEQ ID NO: 1391819 - RNA, 15 nt, Neisseria meningitidis Z2491
acuugcugcaggugc

SEQ ID NO: 1391820 - RNA, 13 nt, Neisseria meningitidis Z2491
acuuuaauuuugu

SEQ ID NO: 1391821 - RNA, 20 nt, Neisseria meningitidis Z2491
acuuuaucugacgcguuuua

SEQ ID NO: 1391822 - RNA, 15 nt, Neisseria meningitidis Z2491
acuuucaucgcuuga

SEQ ID NO: 1391823 - RNA, 17 nt, Neisseria meningitidis Z2491
acuuucagauaaucuuu

SEQ ID NO: 1391824 - RNA, 17 nt, Neisseria meningitidis Z2491
acuuugcggcagauaca

SEQ ID NO: 1391825 - RNA, 13 nt, Neisseria meningitidis Z2491
acuuugcguucac

SEQ ID NO: 1391826 - RNA, 13 nt, Neisseria meningitidis Z2491
acuuuggaacaaa

SEQ ID NO: 1391827 - RNA, 14 nt, Neisseria meningitidis Z2491
acuuuggaacaaaa

SEQ ID NO: 1391828 - RNA, 15 nt, Neisseria meningitidis Z2491
acuuuggaacaaaaa

SEQ ID NO: 1391829 - RNA, 16 nt, Neisseria meningitidis Z2491
acuuuggaacaaaaaa

SEQ ID NO: 1391830 - RNA, 18 nt, Neisseria meningitidis Z2491
acuuugacuuuuuuaccu

SEQ ID NO: 1391831 - RNA, 16 nt, Neisseria meningitidis Z2491
acuuuguuucaaaaug

SEQ ID NO: 1391832 - RNA, 17 nt, Neisseria meningitidis Z2491
acuuuucugauuuuucc

SEQ ID NO: 1391833 - RNA, 16 nt, Neisseria meningitidis Z2491
acuuuuuucaagccuu

SEQ ID NO: 1391834 - RNA, 13 nt, Neisseria meningitidis Z2491
agaaaaacagcaa

SEQ ID NO: 1391835 - RNA, 14 nt, Neisseria meningitidis Z2491
agaaaaacaucccg

SEQ ID NO: 1391836 - RNA, 17 nt, Neisseria meningitidis Z2491
agaaacaaagcuuuaaa

SEQ ID NO: 1391837 - RNA, 19 nt, Neisseria meningitidis Z2491
agaaaaucggacggacgca

SEQ ID NO: 1391838 - RNA, 19 nt, Neisseria meningitidis Z2491
agaaaaucaaaaacagaaa

SEQ ID NO: 1391839 - RNA, 20 nt, Neisseria meningitidis Z2491
agaauggcaaaauuucagau

SEQ ID NO: 1391840 - RNA, 23 nt, Neisseria meningitidis Z2491
agaaugccgguuaacggccgggc

SEQ ID NO: 1391841 - RNA, 16 nt, Neisseria meningitidis Z2491
agaaugccgucugaag

SEQ ID NO: 1391842 - RNA, 15 nt, Neisseria meningitidis Z2491
agaaucguucucuuu

SEQ ID NO: 1391843 - RNA, 13 nt, Neisseria meningitidis Z2491
agaaucaaauauu

SEQ ID NO: 1391844 - RNA, 17 nt, Neisseria meningitidis Z2491
agaaucaaauauuaaaa

SEQ ID NO: 1391845 - RNA, 13 nt, Neisseria meningitidis Z2491
agaagccaaaaua

SEQ ID NO: 1391846 - RNA, 12 nt, Neisseria meningitidis Z2491
agaagccuugcg

SEQ ID NO: 1391847 - RNA, 22 nt, Neisseria meningitidis Z2491
agaaguuacucgaaacuuaaaa

SEQ ID NO: 1391848 - RNA, 16 nt, Neisseria meningitidis Z2491
agaaguuucugcaacc

SEQ ID NO: 1391849 - RNA, 12 nt, Neisseria meningitidis Z2491
agaauaaggcaa

SEQ ID NO: 1391850 - RNA, 22 nt, Neisseria meningitidis Z2491
agaauacugccuguaaaaccaa

SEQ ID NO: 1391851 - RNA, 15 nt, Neisseria meningitidis Z2491
agaaaucagaaaagu

SEQ ID NO: 1391852 - RNA, 17 nt, Neisseria meningitidis Z2491
agaaaucagaaaaguuu

SEQ ID NO: 1391853 - RNA, 15 nt, Neisseria meningitidis Z2491
agaaaugacugaaac

SEQ ID NO: 1391854 - RNA, 21 nt, Neisseria meningitidis Z2491
agaaaugacugaaacucaaaa

SEQ ID NO: 1391855 - RNA, 15 nt, Neisseria meningitidis Z2491
agaaaugacugaaau

SEQ ID NO: 1391856 - RNA, 18 nt, Neisseria meningitidis Z2491
agaaaucugugaaaauca

SEQ ID NO: 1391857 - RNA, 14 nt, Neisseria meningitidis Z2491
agaaauguaaauuu

SEQ ID NO: 1391858 - RNA, 20 nt, Neisseria meningitidis Z2491
agaaauuuauaaacaaaaaa

SEQ ID NO: 1391859 - RNA, 14 nt, Neisseria meningitidis Z2491
agaaaccuaaaauu

SEQ ID NO: 1391860 - RNA, 13 nt, Neisseria meningitidis Z2491
agaaaauugaaau

SEQ ID NO: 1391861 - RNA, 18 nt, Neisseria meningitidis Z2491
aaaacagaaaaccaaaaa

SEQ ID NO: 1391862 - RNA, 22 nt, Neisseria meningitidis Z2491
aaaacagaaaaucaaaaacaga

SEQ ID NO: 1391863 - RNA, 14 nt, Neisseria meningitidis Z2491
aaaacagaaaccua

SEQ ID NO: 1391864 - RNA, 11 nt, Neisseria meningitidis Z2491
aaaacagaaag

SEQ ID NO: 1391865 - RNA, 22 nt, Neisseria meningitidis Z2491
aaaacagaaagccaaaaacaga

SEQ ID NO: 1391866 - RNA, 12 nt, Neisseria meningitidis Z2491
agaacgguuucu

SEQ ID NO: 1391867 - RNA, 13 nt, Neisseria meningitidis Z2491
agaacaacaguaa

SEQ ID NO: 1391868 - RNA, 21 nt, Neisseria meningitidis Z2491
agauauaacuuuaaucagucg

SEQ ID NO: 1391869 - RNA, 17 nt, Neisseria meningitidis Z2491
agauacaagaacuuuau

SEQ ID NO: 1391870 - RNA, 20 nt, Neisseria meningitidis Z2491
agauacacacaccggcaaac

SEQ ID NO: 1391871 - RNA, 22 nt, Neisseria meningitidis Z2491
agauagcugaacugcuugaauu

SEQ ID NO: 1391872 - RNA, 13 nt, Neisseria meningitidis Z2491
agaguuucaaaau

SEQ ID NO: 1391873 - RNA, 18 nt, Neisseria meningitidis Z2491
agauaaaaccaaccgggu

SEQ ID NO: 1391874 - RNA, 15 nt, Neisseria meningitidis Z2491
agauaaauuucagau

SEQ ID NO: 1391875 - RNA, 14 nt, Neisseria meningitidis Z2491
agauggggaggcgc

SEQ ID NO: 1391876 - RNA, 17 nt, Neisseria meningitidis Z2491
agagaaucguucucuuu

SEQ ID NO: 1391877 - RNA, 20 nt, Neisseria meningitidis Z2491
agagaaucguucucuuugag

SEQ ID NO: 1391878 - RNA, 21 nt, Neisseria meningitidis Z2491
agagaaucguucucuuugagc

SEQ ID NO: 1391879 - RNA, 15 nt, Neisseria meningitidis Z2491
agagcggauucuguu

SEQ ID NO: 1391880 - RNA, 13 nt, Neisseria meningitidis Z2491
aaaaccaaaauca

SEQ ID NO: 1391881 - RNA, 21 nt, Neisseria meningitidis Z2491
agacggagauuuuguuuagac

SEQ ID NO: 1391882 - RNA, 14 nt, Neisseria meningitidis Z2491
agacggcauuucau

SEQ ID NO: 1391883 - RNA, 15 nt, Neisseria meningitidis Z2491
agacggcauuucauu

SEQ ID NO: 1391884 - RNA, 14 nt, Neisseria meningitidis Z2491
agacggcauuucgu

SEQ ID NO: 1391885 - RNA, 15 nt, Neisseria meningitidis Z2491
agacggcauuucuua

SEQ ID NO: 1391886 - RNA, 15 nt, Neisseria meningitidis Z2491
agacggcauuugacu

SEQ ID NO: 1391887 - RNA, 15 nt, Neisseria meningitidis Z2491
agacggcauuuucaa

SEQ ID NO: 1391888 - RNA, 15 nt, Neisseria meningitidis Z2491
agacggcauuuucgc

SEQ ID NO: 1391889 - RNA, 15 nt, Neisseria meningitidis Z2491
agacggcauuuucua

SEQ ID NO: 1391890 - RNA, 23 nt, Neisseria meningitidis Z2491
agacggcauuuuucauuuuucac

SEQ ID NO: 1391891 - RNA, 15 nt, Neisseria meningitidis Z2491
agacggcauuuuugu

SEQ ID NO: 1391892 - RNA, 15 nt, Neisseria meningitidis Z2491
agacggcauuuuuuc

SEQ ID NO: 1391893 - RNA, 14 nt, Neisseria meningitidis Z2491
agacggccaaacac

SEQ ID NO: 1391894 - RNA, 17 nt, Neisseria meningitidis Z2491
agacggccaaacacauu

SEQ ID NO: 1391895 - RNA, 14 nt, Neisseria meningitidis Z2491
agacggcaucagua

SEQ ID NO: 1391896 - RNA, 15 nt, Neisseria meningitidis Z2491
agacggcaucgguuu

SEQ ID NO: 1391897 - RNA, 22 nt, Neisseria meningitidis Z2491
agacggcaucguauugcuaaau

SEQ ID NO: 1391898 - RNA, 14 nt, Neisseria meningitidis Z2491
agacggccuuugga

SEQ ID NO: 1391899 - RNA, 22 nt, Neisseria meningitidis Z2491
agacggccuuuggaaugguucg

SEQ ID NO: 1391900 - RNA, 22 nt, Neisseria meningitidis Z2491
agacggccuuuuugcuuuuaga

SEQ ID NO: 1391901 - RNA, 21 nt, Neisseria meningitidis Z2491
agacggcggcaacagaaauaa

SEQ ID NO: 1391902 - RNA, 17 nt, Neisseria meningitidis Z2491
agaccuuugcaauaaca

SEQ ID NO: 1391903 - RNA, 16 nt, Neisseria meningitidis Z2491
acacgguucugcaccg

SEQ ID NO: 1391904 - RNA, 18 nt, Neisseria meningitidis Z2491
acagccugucccccaccg

SEQ ID NO: 1391905 - RNA, 18 nt, Neisseria meningitidis Z2491
acagggaaagcagcagcc

SEQ ID NO: 1391906 - RNA, 19 nt, Neisseria meningitidis Z2491
acagggaaagcagcagccc

SEQ ID NO: 1391907 - RNA, 12 nt, Neisseria meningitidis Z2491
acaggcuucaga

SEQ ID NO: 1391908 - RNA, 14 nt, Neisseria meningitidis Z2491
acaggcuccguauc

SEQ ID NO: 1391909 - RNA, 19 nt, Neisseria meningitidis Z2491
acaggcguuguucggauuu

SEQ ID NO: 1391910 - RNA, 17 nt, Neisseria meningitidis Z2491
acaggcggauggcguuu

SEQ ID NO: 1391911 - RNA, 19 nt, Neisseria meningitidis Z2491
acagccuacuugcccgccu

SEQ ID NO: 1391912 - RNA, 17 nt, Neisseria meningitidis Z2491
acagcguugccucgccu

SEQ ID NO: 1391913 - RNA, 22 nt, Neisseria meningitidis Z2491
acagugauggcuucuaaaaauu

SEQ ID NO: 1391914 - RNA, 16 nt, Neisseria meningitidis Z2491
acaguucuuugauguu

SEQ ID NO: 1391915 - RNA, 15 nt, Neisseria meningitidis Z2491
acaguuuaaucccuu

SEQ ID NO: 1391916 - RNA, 21 nt, Neisseria meningitidis Z2491
acauaaacagcacgauacaca

SEQ ID NO: 1391917 - RNA, 13 nt, Neisseria meningitidis Z2491
acauaaaaugccg

SEQ ID NO: 1391918 - RNA, 12 nt, Neisseria meningitidis Z2491
acauaaaugccg

SEQ ID NO: 1391919 - RNA, 21 nt, Neisseria meningitidis Z2491
acaguacaaauaguacggcaa

SEQ ID NO: 1391920 - RNA, 12 nt, Neisseria meningitidis Z2491
acaggguuuuua

SEQ ID NO: 1391921 - RNA, 16 nt, Neisseria meningitidis Z2491
acagguucaaacacau

SEQ ID NO: 1391922 - RNA, 23 nt, Neisseria meningitidis Z2491
acagguucaaacacaucgcuuuc

SEQ ID NO: 1391923 - RNA, 17 nt, Neisseria meningitidis Z2491
acaucgcucaaauucug

SEQ ID NO: 1391924 - RNA, 22 nt, Neisseria meningitidis Z2491
acaucaucuuauuuauuuuuuc

SEQ ID NO: 1391925 - RNA, 18 nt, Neisseria meningitidis Z2491
acauaaugcccgagcaaa

SEQ ID NO: 1391926 - RNA, 13 nt, Neisseria meningitidis Z2491
acaucugauuuuu

SEQ ID NO: 1391927 - RNA, 16 nt, Neisseria meningitidis Z2491
accaaagcauuuuucg

SEQ ID NO: 1391928 - RNA, 14 nt, Neisseria meningitidis Z2491
accaaaaauuaaau

SEQ ID NO: 1391929 - RNA, 14 nt, Neisseria meningitidis Z2491
accaaaaacagaaa

SEQ ID NO: 1391930 - RNA, 12 nt, Neisseria meningitidis Z2491
accaaaaacagc

SEQ ID NO: 1391931 - RNA, 19 nt, Neisseria meningitidis Z2491
accaaaaacagcaaccuga

SEQ ID NO: 1391932 - RNA, 18 nt, Neisseria meningitidis Z2491
accaaaacagaaaccuaa

SEQ ID NO: 1391933 - RNA, 13 nt, Neisseria meningitidis Z2491
acauuacugaaau

SEQ ID NO: 1391934 - RNA, 20 nt, Neisseria meningitidis Z2491
acauuuguuccaauuccugu

SEQ ID NO: 1391935 - RNA, 21 nt, Neisseria meningitidis Z2491
acauuuugcucauucacguaa

SEQ ID NO: 1391936 - RNA, 18 nt, Neisseria meningitidis Z2491
acauuuucuauuugauuu

SEQ ID NO: 1391937 - RNA, 20 nt, Neisseria meningitidis Z2491
acauuuucuugcuguuggaa

SEQ ID NO: 1391938 - RNA, 13 nt, Neisseria meningitidis Z2491
acaaaaucaguau

SEQ ID NO: 1391939 - RNA, 19 nt, Neisseria meningitidis Z2491
acaaaaugccgucugaaaa

SEQ ID NO: 1391940 - RNA, 21 nt, Neisseria meningitidis Z2491
acaaaaugccgucugaaaacc

SEQ ID NO: 1391941 - RNA, 19 nt, Neisseria meningitidis Z2491
acaaaaggccgucugaaau

SEQ ID NO: 1391942 - RNA, 16 nt, Neisseria meningitidis Z2491
acaaaagauacacaca

SEQ ID NO: 1391943 - RNA, 14 nt, Neisseria meningitidis Z2491
acaaaaacuuuucu

SEQ ID NO: 1391944 - RNA, 11 nt, Neisseria meningitidis Z2491
acaaaaacaga

SEQ ID NO: 1391945 - RNA, 13 nt, Neisseria meningitidis Z2491
acaaaaacagaaa

SEQ ID NO: 1391946 - RNA, 14 nt, Neisseria meningitidis Z2491
acaaaaacagaaaa

SEQ ID NO: 1391947 - RNA, 18 nt, Neisseria meningitidis Z2491
acaaaaacagaaaaccaa

SEQ ID NO: 1391948 - RNA, 11 nt, Neisseria meningitidis Z2491
acaaaaaccag

SEQ ID NO: 1391949 - RNA, 13 nt, Neisseria meningitidis Z2491
acaaaaaccagua

SEQ ID NO: 1391950 - RNA, 22 nt, Neisseria meningitidis Z2491
aauuuauaguggauuaacaaaa

SEQ ID NO: 1391951 - RNA, 23 nt, Neisseria meningitidis Z2491
aauuuauaguggauuaacaaaaa

SEQ ID NO: 1391952 - RNA, 16 nt, Neisseria meningitidis Z2491
acaaaaaauauagugg

SEQ ID NO: 1391953 - RNA, 14 nt, Neisseria meningitidis Z2491
acaaaaaaucaaaa

SEQ ID NO: 1391954 - RNA, 13 nt, Neisseria meningitidis Z2491
acaaaaaagccag

SEQ ID NO: 1391955 - RNA, 18 nt, Neisseria meningitidis Z2491
acaaaaaacagaaacccg

SEQ ID NO: 1391956 - RNA, 15 nt, Neisseria meningitidis Z2491
acaaacaucugauuu

SEQ ID NO: 1391957 - RNA, 11 nt, Neisseria meningitidis Z2491
acaaacaggca

SEQ ID NO: 1391958 - RNA, 22 nt, Neisseria meningitidis Z2491
acaaacaggcagccuaaaacau

SEQ ID NO: 1391959 - RNA, 13 nt, Neisseria meningitidis Z2491
acaaacaggcuuc

SEQ ID NO: 1391960 - RNA, 19 nt, Neisseria meningitidis Z2491
acaaacagauuuuuugccu

SEQ ID NO: 1391961 - RNA, 20 nt, Neisseria meningitidis Z2491
acaaaauuaaaguuucagaa

SEQ ID NO: 1391962 - RNA, 16 nt, Neisseria meningitidis Z2491
acaaacgccagcacaa

SEQ ID NO: 1391963 - RNA, 21 nt, Neisseria meningitidis Z2491
acaaacgccagcacaaacagc

SEQ ID NO: 1391964 - RNA, 13 nt, Neisseria meningitidis Z2491
acaaacccuuuca

SEQ ID NO: 1391965 - RNA, 15 nt, Neisseria meningitidis Z2491
acaaaccgccauucc

SEQ ID NO: 1391966 - RNA, 19 nt, Neisseria meningitidis Z2491
acaaagaaagcagaaauaa

SEQ ID NO: 1391967 - RNA, 18 nt, Neisseria meningitidis Z2491
acaaagacagaaaaccaa

SEQ ID NO: 1391968 - RNA, 20 nt, Neisseria meningitidis Z2491
acaaagccgcagacaguaca

SEQ ID NO: 1391969 - RNA, 18 nt, Neisseria meningitidis Z2491
acaaagccuucuucuaaa

SEQ ID NO: 1391970 - RNA, 16 nt, Neisseria meningitidis Z2491
acaaagcuuuaaacua

SEQ ID NO: 1391971 - RNA, 22 nt, Neisseria meningitidis Z2491
acaaaguuggcaaggaaugcca

SEQ ID NO: 1391972 - RNA, 15 nt, Neisseria meningitidis Z2491
acaaauaguacggaa

SEQ ID NO: 1391973 - RNA, 21 nt, Neisseria meningitidis Z2491
acaaauaguacggcaaggcaa

SEQ ID NO: 1391974 - RNA, 19 nt, Neisseria meningitidis Z2491
acaaauagcacggaaucga

SEQ ID NO: 1391975 - RNA, 17 nt, Neisseria meningitidis Z2491
acaaauccacuuugucg

SEQ ID NO: 1391976 - RNA, 21 nt, Neisseria meningitidis Z2491
acaaauuccuaaaacuuaaaa

SEQ ID NO: 1391977 - RNA, 14 nt, Neisseria meningitidis Z2491
acaaauuaaaauaa

SEQ ID NO: 1391978 - RNA, 16 nt, Neisseria meningitidis Z2491
acaacaaugcaaagaa

SEQ ID NO: 1391979 - RNA, 12 nt, Neisseria meningitidis Z2491
acaacaggaauu

SEQ ID NO: 1391980 - RNA, 16 nt, Neisseria meningitidis Z2491
acaacaaauuuuugau

SEQ ID NO: 1391981 - RNA, 14 nt, Neisseria meningitidis Z2491
acacccgccccgcc

SEQ ID NO: 1391982 - RNA, 18 nt, Neisseria meningitidis Z2491
acacaagguuauuuucuu

SEQ ID NO: 1391983 - RNA, 14 nt, Neisseria meningitidis Z2491
acacaaaaaagcca

SEQ ID NO: 1391984 - RNA, 22 nt, Neisseria meningitidis Z2491
acacgcccuuccacgcgcaccu

SEQ ID NO: 1391985 - RNA, 20 nt, Neisseria meningitidis Z2491
acacgcagccgagcagcagu

SEQ ID NO: 1391986 - RNA, 20 nt, Neisseria meningitidis Z2491
acacggcggcacuugccgca

SEQ ID NO: 1391987 - RNA, 18 nt, Neisseria meningitidis Z2491
acacgggugauuuaagga

SEQ ID NO: 1391988 - RNA, 20 nt, Neisseria meningitidis Z2491
acacggguucagacggcauc

SEQ ID NO: 1391989 - RNA, 12 nt, Neisseria meningitidis Z2491
acacggcaaaaa

SEQ ID NO: 1391990 - RNA, 16 nt, Neisseria meningitidis Z2491
acacggcaaaaauuua

SEQ ID NO: 1391991 - RNA, 17 nt, Neisseria meningitidis Z2491
acacggcaaaaauuuau

SEQ ID NO: 1391992 - RNA, 14 nt, Neisseria meningitidis Z2491
acacgaacugccuc

SEQ ID NO: 1391993 - RNA, 17 nt, Neisseria meningitidis Z2491
acaagcgauuauuuuuu

SEQ ID NO: 1391994 - RNA, 19 nt, Neisseria meningitidis Z2491
acaagcgauuauuuuuuag

SEQ ID NO: 1391995 - RNA, 20 nt, Neisseria meningitidis Z2491
acaagcuacggcucguuuaa

SEQ ID NO: 1391996 - RNA, 13 nt, Neisseria meningitidis Z2491
acaagcuaaaauc

SEQ ID NO: 1391997 - RNA, 17 nt, Neisseria meningitidis Z2491
acaaggacagaaaacca

SEQ ID NO: 1391998 - RNA, 18 nt, Neisseria meningitidis Z2491
acaaggacagaaaaccaa

SEQ ID NO: 1391999 - RNA, 12 nt, Neisseria meningitidis Z2491
acaagguuuuug

SEQ ID NO: 1392000 - RNA, 12 nt, Neisseria meningitidis Z2491
acaaucaggaaa

SEQ ID NO: 1392001 - RNA, 22 nt, Neisseria meningitidis Z2491
acaauccgcccgaauaaaaaau

SEQ ID NO: 1392002 - RNA, 24 nt, Neisseria meningitidis Z2491
acaaucggcucgccgccuuugcga

SEQ ID NO: 1392003 - RNA, 12 nt, Neisseria meningitidis Z2491
acaauucccacc

SEQ ID NO: 1392004 - RNA, 18 nt, Neisseria meningitidis Z2491
acaauucccaccguuucc

SEQ ID NO: 1392005 - RNA, 22 nt, Neisseria meningitidis Z2491
acaauucccaccguuucccauc

SEQ ID NO: 1392006 - RNA, 20 nt, Neisseria meningitidis Z2491
acaaugaggucgaacugccu

SEQ ID NO: 1392007 - RNA, 15 nt, Neisseria meningitidis Z2491
acaaugcaaaaacau

SEQ ID NO: 1392008 - RNA, 18 nt, Neisseria meningitidis Z2491
acaaugcaaaaacaucag

SEQ ID NO: 1392009 - RNA, 13 nt, Neisseria meningitidis Z2491
aauccauccauac

SEQ ID NO: 1392010 - RNA, 21 nt, Neisseria meningitidis Z2491
aauccauccauacggaaaccu

SEQ ID NO: 1392011 - RNA, 18 nt, Neisseria meningitidis Z2491
aauccauucccucucccg

SEQ ID NO: 1392012 - RNA, 17 nt, Neisseria meningitidis Z2491
aauccauucgccgacuu

SEQ ID NO: 1392013 - RNA, 21 nt, Neisseria meningitidis Z2491
aauccacuauaaaaaaucccu

SEQ ID NO: 1392014 - RNA, 17 nt, Neisseria meningitidis Z2491
aauccacuauaauacau

SEQ ID NO: 1392015 - RNA, 19 nt, Neisseria meningitidis Z2491
aauccacuauaauacauug

SEQ ID NO: 1392016 - RNA, 17 nt, Neisseria meningitidis Z2491
aauccacuauacuauag

SEQ ID NO: 1392017 - RNA, 14 nt, Neisseria meningitidis Z2491
aauccacuauacug

SEQ ID NO: 1392018 - RNA, 17 nt, Neisseria meningitidis Z2491
aauccacgcucaaacac

SEQ ID NO: 1392019 - RNA, 16 nt, Neisseria meningitidis Z2491
aaucauuucugucugu

SEQ ID NO: 1392020 - RNA, 17 nt, Neisseria meningitidis Z2491
aaucagcacaaaugcca

SEQ ID NO: 1392021 - RNA, 18 nt, Neisseria meningitidis Z2491
aaucagcacaaaugccaa

SEQ ID NO: 1392022 - RNA, 19 nt, Neisseria meningitidis Z2491
aaucagaucggcaaacccu

SEQ ID NO: 1392023 - RNA, 15 nt, Neisseria meningitidis Z2491
aauccuauuuucaga

SEQ ID NO: 1392024 - RNA, 22 nt, Neisseria meningitidis Z2491
aauccgcccgaauaaaaaauau

SEQ ID NO: 1392025 - RNA, 15 nt, Neisseria meningitidis Z2491
aaucccguugccaaa

SEQ ID NO: 1392026 - RNA, 15 nt, Neisseria meningitidis Z2491
aauccgccugcgcca

SEQ ID NO: 1392027 - RNA, 19 nt, Neisseria meningitidis Z2491
aauccgcuauaacagcaac

SEQ ID NO: 1392028 - RNA, 15 nt, Neisseria meningitidis Z2491
aauccgcuauauauu

SEQ ID NO: 1392029 - RNA, 17 nt, Neisseria meningitidis Z2491
aauccgcuauauauucu

SEQ ID NO: 1392030 - RNA, 15 nt, Neisseria meningitidis Z2491
aauccgcuauauucc

SEQ ID NO: 1392031 - RNA, 16 nt, Neisseria meningitidis Z2491
aauccgggauuuuaaa

SEQ ID NO: 1392032 - RNA, 18 nt, Neisseria meningitidis Z2491
aauccgccggcaauauug

SEQ ID NO: 1392033 - RNA, 14 nt, Neisseria meningitidis Z2491
aauccgucauuccc

SEQ ID NO: 1392034 - RNA, 15 nt, Neisseria meningitidis Z2491
aauccgguucauuuc

SEQ ID NO: 1392035 - RNA, 13 nt, Neisseria meningitidis Z2491
aaucuagaaacuc

SEQ ID NO: 1392036 - RNA, 17 nt, Neisseria meningitidis Z2491
aaucuagaaacucaaag

SEQ ID NO: 1392037 - RNA, 11 nt, Neisseria meningitidis Z2491
aaucuagaaau

SEQ ID NO: 1392038 - RNA, 18 nt, Neisseria meningitidis Z2491
aaucuagaaaugaaaaac

SEQ ID NO: 1392039 - RNA, 14 nt, Neisseria meningitidis Z2491
aaucuagaaauuua

SEQ ID NO: 1392040 - RNA, 22 nt, Neisseria meningitidis Z2491
aaucuagaaccucuaaacuuuc

SEQ ID NO: 1392041 - RNA, 21 nt, Neisseria meningitidis Z2491
aaucuagaacguaaaaucuca

SEQ ID NO: 1392042 - RNA, 16 nt, Neisseria meningitidis Z2491
aaucuagaacguggaa

SEQ ID NO: 1392043 - RNA, 15 nt, Neisseria meningitidis Z2491
aaaaauucuucuuuc

SEQ ID NO: 1392044 - RNA, 15 nt, Neisseria meningitidis Z2491
aaucgccaaacauuu

SEQ ID NO: 1392045 - RNA, 19 nt, Neisseria meningitidis Z2491
aaucgccaaacauuuugau

SEQ ID NO: 1392046 - RNA, 16 nt, Neisseria meningitidis Z2491
aaaaauuuauuuagaa

SEQ ID NO: 1392047 - RNA, 24 nt, Neisseria meningitidis Z2491
aaaaauuuauuuagaaacaacuga

SEQ ID NO: 1392048 - RNA, 11 nt, Neisseria meningitidis Z2491
aaucugcugca

SEQ ID NO: 1392049 - RNA, 21 nt, Neisseria meningitidis Z2491
aaucuggaaaccaaaaaacaa

SEQ ID NO: 1392050 - RNA, 23 nt, Neisseria meningitidis Z2491
aaucuggaaaccaaaaaacaaca

SEQ ID NO: 1392051 - RNA, 13 nt, Neisseria meningitidis Z2491
aaucuucauuccg

SEQ ID NO: 1392052 - RNA, 21 nt, Neisseria meningitidis Z2491
aaucuucccgggucgcuuuau

SEQ ID NO: 1392053 - RNA, 18 nt, Neisseria meningitidis Z2491
aaucuuauuuucaaaaug

SEQ ID NO: 1392054 - RNA, 17 nt, Neisseria meningitidis Z2491
aaucuguggauaaacau

SEQ ID NO: 1392055 - RNA, 14 nt, Neisseria meningitidis Z2491
aaucugugaaaauc

SEQ ID NO: 1392056 - RNA, 13 nt, Neisseria meningitidis Z2491
aaucaauuaaaaa

SEQ ID NO: 1392057 - RNA, 14 nt, Neisseria meningitidis Z2491
aaucaauuaaaaac

SEQ ID NO: 1392058 - RNA, 18 nt, Neisseria meningitidis Z2491
aaucaauuaaaaacaaaa

SEQ ID NO: 1392059 - RNA, 14 nt, Neisseria meningitidis Z2491
aaucacaaacaucg

SEQ ID NO: 1392060 - RNA, 12 nt, Neisseria meningitidis Z2491
aaucaaguuuau

SEQ ID NO: 1392061 - RNA, 22 nt, Neisseria meningitidis Z2491
aaucaaagagcgcacaguuccc

SEQ ID NO: 1392062 - RNA, 14 nt, Neisseria meningitidis Z2491
aaucaaaaucagaa

SEQ ID NO: 1392063 - RNA, 23 nt, Neisseria meningitidis Z2491
aaucaaaaacacaaaacugaaau

SEQ ID NO: 1392064 - RNA, 14 nt, Neisseria meningitidis Z2491
aaucacuauaccaa

SEQ ID NO: 1392065 - RNA, 16 nt, Neisseria meningitidis Z2491
aaucacuauaccaaac

SEQ ID NO: 1392066 - RNA, 20 nt, Neisseria meningitidis Z2491
aaucagaccgaauuuaauca

SEQ ID NO: 1392067 - RNA, 17 nt, Neisseria meningitidis Z2491
aaucacuauuaaaaugc

SEQ ID NO: 1392068 - RNA, 19 nt, Neisseria meningitidis Z2491
aaucaccgcaacauuaaau

SEQ ID NO: 1392069 - RNA, 17 nt, Neisseria meningitidis Z2491
aauaugccgucauuccc

SEQ ID NO: 1392070 - RNA, 20 nt, Neisseria meningitidis Z2491
aauaugccgucugaagccuu

SEQ ID NO: 1392071 - RNA, 14 nt, Neisseria meningitidis Z2491
aauauuaggaaggu

SEQ ID NO: 1392072 - RNA, 14 nt, Neisseria meningitidis Z2491
aauauuaaucagcg

SEQ ID NO: 1392073 - RNA, 18 nt, Neisseria meningitidis Z2491
aauauuaaugauuaucau

SEQ ID NO: 1392074 - RNA, 13 nt, Neisseria meningitidis Z2491
aauauuaagaaaa

SEQ ID NO: 1392075 - RNA, 22 nt, Neisseria meningitidis Z2491
aauauggcugcuuugguaaaaa

SEQ ID NO: 1392076 - RNA, 20 nt, Neisseria meningitidis Z2491
aauauggcggauuaaaauaa

SEQ ID NO: 1392077 - RNA, 18 nt, Neisseria meningitidis Z2491
aauauggaucagacauua

SEQ ID NO: 1392078 - RNA, 14 nt, Neisseria meningitidis Z2491
aauauuuccucacu

SEQ ID NO: 1392079 - RNA, 15 nt, Neisseria meningitidis Z2491
aauauugagcaaaaa

SEQ ID NO: 1392080 - RNA, 17 nt, Neisseria meningitidis Z2491
aauauugcuguuguucu

SEQ ID NO: 1392081 - RNA, 18 nt, Neisseria meningitidis Z2491
aauauugcuguuguucua

SEQ ID NO: 1392082 - RNA, 17 nt, Neisseria meningitidis Z2491
aauauucauacuguggg

SEQ ID NO: 1392083 - RNA, 15 nt, Neisseria meningitidis Z2491
aauauucaacuuuga

SEQ ID NO: 1392084 - RNA, 16 nt, Neisseria meningitidis Z2491
aauugccuucaucagc

SEQ ID NO: 1392085 - RNA, 14 nt, Neisseria meningitidis Z2491
aauugcauuuuuaa

SEQ ID NO: 1392086 - RNA, 22 nt, Neisseria meningitidis Z2491
aauugcauuuuuaauuucuucu

SEQ ID NO: 1392087 - RNA, 21 nt, Neisseria meningitidis Z2491
aauugccuuuucccugacaaa

SEQ ID NO: 1392088 - RNA, 15 nt, Neisseria meningitidis Z2491
aauugaaaauuuuuu

SEQ ID NO: 1392089 - RNA, 16 nt, Neisseria meningitidis Z2491
aauugaaaucaacaga

SEQ ID NO: 1392090 - RNA, 14 nt, Neisseria meningitidis Z2491
aauugaaaaauuuu

SEQ ID NO: 1392091 - RNA, 16 nt, Neisseria meningitidis Z2491
aauugaaaaauuuuug

SEQ ID NO: 1392092 - RNA, 23 nt, Neisseria meningitidis Z2491
aaaacaaagacaucccccaacca

SEQ ID NO: 1392093 - RNA, 17 nt, Neisseria meningitidis Z2491
aaaacaaacaggcagcc

SEQ ID NO: 1392094 - RNA, 22 nt, Neisseria meningitidis Z2491
aaaacaaaauaguacaauauuc

SEQ ID NO: 1392095 - RNA, 21 nt, Neisseria meningitidis Z2491
aaaacaagcgauuauuuuuua

SEQ ID NO: 1392096 - RNA, 17 nt, Neisseria meningitidis Z2491
aaaacaacaggaauuua

SEQ ID NO: 1392097 - RNA, 19 nt, Neisseria meningitidis Z2491
aaaacaacaggaauuuauc

SEQ ID NO: 1392098 - RNA, 18 nt, Neisseria meningitidis Z2491
aauuuaauccacuauaaa

SEQ ID NO: 1392099 - RNA, 15 nt, Neisseria meningitidis Z2491
aauuuacagcuuuua

SEQ ID NO: 1392100 - RNA, 19 nt, Neisseria meningitidis Z2491
aauuuaaacacuucuucau

SEQ ID NO: 1392101 - RNA, 21 nt, Neisseria meningitidis Z2491
aauuuaaacacuucuucauua

SEQ ID NO: 1392102 - RNA, 15 nt, Neisseria meningitidis Z2491
aauuuaaaagggaac

SEQ ID NO: 1392103 - RNA, 13 nt, Neisseria meningitidis Z2491
aauucuacccaaa

SEQ ID NO: 1392104 - RNA, 17 nt, Neisseria meningitidis Z2491
aauucuacccaaauacc

SEQ ID NO: 1392105 - RNA, 14 nt, Neisseria meningitidis Z2491
aauuccuuucccuc

SEQ ID NO: 1392106 - RNA, 20 nt, Neisseria meningitidis Z2491
aauucccaccguuucccauc

SEQ ID NO: 1392107 - RNA, 21 nt, Neisseria meningitidis Z2491
aauuauaguggauuaacaaaa

SEQ ID NO: 1392108 - RNA, 15 nt, Neisseria meningitidis Z2491
aaugucggcauuuuc

SEQ ID NO: 1392109 - RNA, 15 nt, Neisseria meningitidis Z2491
aaugucuucauacga

SEQ ID NO: 1392110 - RNA, 23 nt, Neisseria meningitidis Z2491
aaugucuucauacgacucaaaau

SEQ ID NO: 1392111 - RNA, 15 nt, Neisseria meningitidis Z2491
aauguguuuugaagg

SEQ ID NO: 1392112 - RNA, 18 nt, Neisseria meningitidis Z2491
aauguguugauuaaauau

SEQ ID NO: 1392113 - RNA, 22 nt, Neisseria meningitidis Z2491
aaugugcgccacgccauuuguu

SEQ ID NO: 1392114 - RNA, 23 nt, Neisseria meningitidis Z2491
aaugugcauuucuaauuuuuaua

SEQ ID NO: 1392115 - RNA, 14 nt, Neisseria meningitidis Z2491
aauuaaaaacaaaa

SEQ ID NO: 1392116 - RNA, 19 nt, Neisseria meningitidis Z2491
aauuaaaaacaaaauagua

SEQ ID NO: 1392117 - RNA, 18 nt, Neisseria meningitidis Z2491
aauuaaaguuucagaauu

SEQ ID NO: 1392118 - RNA, 12 nt, Neisseria meningitidis Z2491
aauuaaauuuaa

SEQ ID NO: 1392119 - RNA, 13 nt, Neisseria meningitidis Z2491
aauuaacaaaaau

SEQ ID NO: 1392120 - RNA, 15 nt, Neisseria meningitidis Z2491
aaugcaaaaacauca

SEQ ID NO: 1392121 - RNA, 14 nt, Neisseria meningitidis Z2491
aaugcaaaaagucc

SEQ ID NO: 1392122 - RNA, 21 nt, Neisseria meningitidis Z2491
aaugcaaaacuuuucugauuu

SEQ ID NO: 1392123 - RNA, 23 nt, Neisseria meningitidis Z2491
aaugcacgguuacacaaauauau

SEQ ID NO: 1392124 - RNA, 14 nt, Neisseria meningitidis Z2491
aaugcacuacuuca

SEQ ID NO: 1392125 - RNA, 22 nt, Neisseria meningitidis Z2491
aaugccaaucucuuaaccaugc

SEQ ID NO: 1392126 - RNA, 20 nt, Neisseria meningitidis Z2491
aaugccuuucucuguuuuuc

SEQ ID NO: 1392127 - RNA, 12 nt, Neisseria meningitidis Z2491
aaugcccaaacc

SEQ ID NO: 1392128 - RNA, 18 nt, Neisseria meningitidis Z2491
aaugcgccaaaaaauuuu

SEQ ID NO: 1392129 - RNA, 17 nt, Neisseria meningitidis Z2491
aaugcgcgacggcggca

SEQ ID NO: 1392130 - RNA, 18 nt, Neisseria meningitidis Z2491
aaugcugucugaaaccug

SEQ ID NO: 1392131 - RNA, 20 nt, Neisseria meningitidis Z2491
aaugcggcacggcagggaca

SEQ ID NO: 1392132 - RNA, 17 nt, Neisseria meningitidis Z2491
aauggauaaaaccgcuc

SEQ ID NO: 1392133 - RNA, 23 nt, Neisseria meningitidis Z2491
aauggccgauuuuggguuucugu

SEQ ID NO: 1392134 - RNA, 17 nt, Neisseria meningitidis Z2491
aacagcaaucaaaauaa

SEQ ID NO: 1392135 - RNA, 17 nt, Neisseria meningitidis Z2491
aacagauuacuaaaaca

SEQ ID NO: 1392136 - RNA, 14 nt, Neisseria meningitidis Z2491
aacagcaacccugu

SEQ ID NO: 1392137 - RNA, 13 nt, Neisseria meningitidis Z2491
aacagauuuuuug

SEQ ID NO: 1392138 - RNA, 17 nt, Neisseria meningitidis Z2491
aacagcaucaaaccaua

SEQ ID NO: 1392139 - RNA, 13 nt, Neisseria meningitidis Z2491
aacagcagcagag

SEQ ID NO: 1392140 - RNA, 12 nt, Neisseria meningitidis Z2491
aacagccaggcg

SEQ ID NO: 1392141 - RNA, 16 nt, Neisseria meningitidis Z2491
aacagauaaaaccaac

SEQ ID NO: 1392142 - RNA, 20 nt, Neisseria meningitidis Z2491
aacagacauugcuaaaacaa

SEQ ID NO: 1392143 - RNA, 21 nt, Neisseria meningitidis Z2491
aacagacuauuuuugcaaagg

SEQ ID NO: 1392144 - RNA, 13 nt, Neisseria meningitidis Z2491
aacagaaaaacaa

SEQ ID NO: 1392145 - RNA, 12 nt, Neisseria meningitidis Z2491
aacagaaaacca

SEQ ID NO: 1392146 - RNA, 23 nt, Neisseria meningitidis Z2491
aacagaaaaccaaaaacagaaac

SEQ ID NO: 1392147 - RNA, 15 nt, Neisseria meningitidis Z2491
aacagaaacccgaaa

SEQ ID NO: 1392148 - RNA, 18 nt, Neisseria meningitidis Z2491
aacagaaaccgcucugcc

SEQ ID NO: 1392149 - RNA, 17 nt, Neisseria meningitidis Z2491
aacagaaaccuaaaauu

SEQ ID NO: 1392150 - RNA, 23 nt, Neisseria meningitidis Z2491
aacagaaagccaaaaacagaaac

SEQ ID NO: 1392151 - RNA, 16 nt, Neisseria meningitidis Z2491
aacacgcaaaacacaa

SEQ ID NO: 1392152 - RNA, 21 nt, Neisseria meningitidis Z2491
aacacgucguaggcuuuuucc

SEQ ID NO: 1392153 - RNA, 20 nt, Neisseria meningitidis Z2491
aacacggcaaaaauuuaucc

SEQ ID NO: 1392154 - RNA, 16 nt, Neisseria meningitidis Z2491
aacaccaugaugccua

SEQ ID NO: 1392155 - RNA, 19 nt, Neisseria meningitidis Z2491
aacacccugauucucauga

SEQ ID NO: 1392156 - RNA, 20 nt, Neisseria meningitidis Z2491
aacacauugcguucagacgg

SEQ ID NO: 1392157 - RNA, 12 nt, Neisseria meningitidis Z2491
aacaccaaaucg

SEQ ID NO: 1392158 - RNA, 14 nt, Neisseria meningitidis Z2491
aaaaaguccagcau

SEQ ID NO: 1392159 - RNA, 18 nt, Neisseria meningitidis Z2491
aaaaagguuuucagacgg

SEQ ID NO: 1392160 - RNA, 12 nt, Neisseria meningitidis Z2491
aacacaucgcuu

SEQ ID NO: 1392161 - RNA, 18 nt, Neisseria meningitidis Z2491
aacacagguuuucagcug

SEQ ID NO: 1392162 - RNA, 16 nt, Neisseria meningitidis Z2491
aacacagguuuucguc

SEQ ID NO: 1392163 - RNA, 13 nt, Neisseria meningitidis Z2491
aacacaaaauaaa

SEQ ID NO: 1392164 - RNA, 21 nt, Neisseria meningitidis Z2491
aacacaaaaaacuucccgucc

SEQ ID NO: 1392165 - RNA, 15 nt, Neisseria meningitidis Z2491
aaauucugaaacuuu

SEQ ID NO: 1392166 - RNA, 21 nt, Neisseria meningitidis Z2491
aaauucuugcagcuuugaguu

SEQ ID NO: 1392167 - RNA, 20 nt, Neisseria meningitidis Z2491
aacaauauaucgaacagccu

SEQ ID NO: 1392168 - RNA, 23 nt, Neisseria meningitidis Z2491
aacaauauaucgaacagccuguc

SEQ ID NO: 1392169 - RNA, 13 nt, Neisseria meningitidis Z2491
aacaaugcaaaga

SEQ ID NO: 1392170 - RNA, 19 nt, Neisseria meningitidis Z2491
aacaaugcccgcaaucuga

SEQ ID NO: 1392171 - RNA, 14 nt, Neisseria meningitidis Z2491
aaccacguuuccga

SEQ ID NO: 1392172 - RNA, 23 nt, Neisseria meningitidis Z2491
aaccauauggaaaaaucugugga

SEQ ID NO: 1392173 - RNA, 12 nt, Neisseria meningitidis Z2491
aacccaaagccu

SEQ ID NO: 1392174 - RNA, 19 nt, Neisseria meningitidis Z2491
aacccaaaccgucauuccc

SEQ ID NO: 1392175 - RNA, 21 nt, Neisseria meningitidis Z2491
aacccaaaccgucauucccgc

SEQ ID NO: 1392176 - RNA, 15 nt, Neisseria meningitidis Z2491
aaccgccauucccgc

SEQ ID NO: 1392177 - RNA, 16 nt, Neisseria meningitidis Z2491
aaccgcgcagcaguuu

SEQ ID NO: 1392178 - RNA, 14 nt, Neisseria meningitidis Z2491
aaccgccggcagug

SEQ ID NO: 1392179 - RNA, 15 nt, Neisseria meningitidis Z2491
aaccgcgcucauuuu

SEQ ID NO: 1392180 - RNA, 18 nt, Neisseria meningitidis Z2491
aacccugaacauaaaugc

SEQ ID NO: 1392181 - RNA, 20 nt, Neisseria meningitidis Z2491
aacccugaacauaaaugccg

SEQ ID NO: 1392182 - RNA, 19 nt, Neisseria meningitidis Z2491
aacccuccgccucugccag

SEQ ID NO: 1392183 - RNA, 19 nt, Neisseria meningitidis Z2491
aacccuaaaaacuaaaugc

SEQ ID NO: 1392184 - RNA, 14 nt, Neisseria meningitidis Z2491
aacccguuuggcaa

SEQ ID NO: 1392185 - RNA, 13 nt, Neisseria meningitidis Z2491
aaccgacgaaggc

SEQ ID NO: 1392186 - RNA, 18 nt, Neisseria meningitidis Z2491
aaccgaaguuuaaagaac

SEQ ID NO: 1392187 - RNA, 15 nt, Neisseria meningitidis Z2491
aaccgaaaacaaagg

SEQ ID NO: 1392188 - RNA, 12 nt, Neisseria meningitidis Z2491
aaccgaaaauaa

SEQ ID NO: 1392189 - RNA, 15 nt, Neisseria meningitidis Z2491
aaccgaaacagaaac

SEQ ID NO: 1392190 - RNA, 12 nt, Neisseria meningitidis Z2491
aaccgaacacag

SEQ ID NO: 1392191 - RNA, 16 nt, Neisseria meningitidis Z2491
aaccgaacacagacau

SEQ ID NO: 1392192 - RNA, 14 nt, Neisseria meningitidis Z2491
aaccaacgaaacac

SEQ ID NO: 1392193 - RNA, 15 nt, Neisseria meningitidis Z2491
aaccaacgaaacacu

SEQ ID NO: 1392194 - RNA, 12 nt, Neisseria meningitidis Z2491
aaccaaaucggc

SEQ ID NO: 1392195 - RNA, 21 nt, Neisseria meningitidis Z2491
aacauuaacgggguuaaauaa

SEQ ID NO: 1392196 - RNA, 22 nt, Neisseria meningitidis Z2491
aacauccgcaacgcgcaaaccc

SEQ ID NO: 1392197 - RNA, 15 nt, Neisseria meningitidis Z2491
aacagccgaaaaccu

SEQ ID NO: 1392198 - RNA, 14 nt, Neisseria meningitidis Z2491
aagaagauuuuugu

SEQ ID NO: 1392199 - RNA, 16 nt, Neisseria meningitidis Z2491
aagaacuuuaucccca

SEQ ID NO: 1392200 - RNA, 22 nt, Neisseria meningitidis Z2491
aagaacccaaaccgucauuccc

SEQ ID NO: 1392201 - RNA, 12 nt, Neisseria meningitidis Z2491
aagaaaaacagc

SEQ ID NO: 1392202 - RNA, 13 nt, Neisseria meningitidis Z2491
aacuugauucaag

SEQ ID NO: 1392203 - RNA, 21 nt, Neisseria meningitidis Z2491
aacuugguggucggcauucaa

SEQ ID NO: 1392204 - RNA, 14 nt, Neisseria meningitidis Z2491
aacuuauacacacg

SEQ ID NO: 1392205 - RNA, 21 nt, Neisseria meningitidis Z2491
aacuuaaaauuucaucauucc

SEQ ID NO: 1392206 - RNA, 15 nt, Neisseria meningitidis Z2491
aacuucaauaguggg

SEQ ID NO: 1392207 - RNA, 13 nt, Neisseria meningitidis Z2491
aacuucaaacccc

SEQ ID NO: 1392208 - RNA, 13 nt, Neisseria meningitidis Z2491
aacucaaaaaacc

SEQ ID NO: 1392209 - RNA, 13 nt, Neisseria meningitidis Z2491
aacucaaaaaacu

SEQ ID NO: 1392210 - RNA, 18 nt, Neisseria meningitidis Z2491
aacugcaagaacagcagc

SEQ ID NO: 1392211 - RNA, 20 nt, Neisseria meningitidis Z2491
aacugauuguuuuucagaga

SEQ ID NO: 1392212 - RNA, 23 nt, Neisseria meningitidis Z2491
aacugauuguuuuucagagaaau

SEQ ID NO: 1392213 - RNA, 21 nt, Neisseria meningitidis Z2491
aacugcgguucggacggcaua

SEQ ID NO: 1392214 - RNA, 15 nt, Neisseria meningitidis Z2491
aacugcuaugcggca

SEQ ID NO: 1392215 - RNA, 15 nt, Neisseria meningitidis Z2491
aacguauucgccgua

SEQ ID NO: 1392216 - RNA, 16 nt, Neisseria meningitidis Z2491
aacguauucaagcagc

SEQ ID NO: 1392217 - RNA, 17 nt, Neisseria meningitidis Z2491
aacguauucaagcagca

SEQ ID NO: 1392218 - RNA, 18 nt, Neisseria meningitidis Z2491
aacguauucaagcagcaa

SEQ ID NO: 1392219 - RNA, 15 nt, Neisseria meningitidis Z2491
aacggucgaaacuuu

SEQ ID NO: 1392220 - RNA, 15 nt, Neisseria meningitidis Z2491
aacguacaaaugccg

SEQ ID NO: 1392221 - RNA, 22 nt, Neisseria meningitidis Z2491
aacguucaguucauucgacagc

SEQ ID NO: 1392222 - RNA, 23 nt, Neisseria meningitidis Z2491
aacguuucagacgguauuuuuua

SEQ ID NO: 1392223 - RNA, 13 nt, Neisseria meningitidis Z2491
aacuaacuuauac

SEQ ID NO: 1392224 - RNA, 14 nt, Neisseria meningitidis Z2491
aacggacaaaccgc

SEQ ID NO: 1392225 - RNA, 20 nt, Neisseria meningitidis Z2491
aacggucaaaaaaacagcgu

SEQ ID NO: 1392226 - RNA, 11 nt, Neisseria meningitidis Z2491
aacgguuuuuu

SEQ ID NO: 1392227 - RNA, 20 nt, Neisseria meningitidis Z2491
aacgccguacugguuuuugu

SEQ ID NO: 1392228 - RNA, 17 nt, Neisseria meningitidis Z2491
aacgcugcaaaaauuua

SEQ ID NO: 1392229 - RNA, 23 nt, Neisseria meningitidis Z2491
aacgccucuuccgucaaaaaugc

SEQ ID NO: 1392230 - RNA, 14 nt, Neisseria meningitidis Z2491
aaccgcuucaaggc

SEQ ID NO: 1392231 - RNA, 16 nt, Neisseria meningitidis Z2491
aacgcaaugcgccuuc

SEQ ID NO: 1392232 - RNA, 20 nt, Neisseria meningitidis Z2491
aagcugcagacaguacaaau

SEQ ID NO: 1392233 - RNA, 20 nt, Neisseria meningitidis Z2491
aagcugccccgugauuuugc

SEQ ID NO: 1392234 - RNA, 14 nt, Neisseria meningitidis Z2491
aagcuaacgggcaa

SEQ ID NO: 1392235 - RNA, 20 nt, Neisseria meningitidis Z2491
aagcguucacgccagcaaca

SEQ ID NO: 1392236 - RNA, 18 nt, Neisseria meningitidis Z2491
aagccgcagacaguacaa

SEQ ID NO: 1392237 - RNA, 15 nt, Neisseria meningitidis Z2491
aagccgcauuguccc

SEQ ID NO: 1392238 - RNA, 23 nt, Neisseria meningitidis Z2491
aagcguaaagccgcguccagcuu

SEQ ID NO: 1392239 - RNA, 18 nt, Neisseria meningitidis Z2491
aagcggacgauuucccug

SEQ ID NO: 1392240 - RNA, 14 nt, Neisseria meningitidis Z2491
aaggcaaaauugcu

SEQ ID NO: 1392241 - RNA, 23 nt, Neisseria meningitidis Z2491
aaggcaaacccgaaccaaaccgu

SEQ ID NO: 1392242 - RNA, 14 nt, Neisseria meningitidis Z2491
aaggcgaggcaacg

SEQ ID NO: 1392243 - RNA, 16 nt, Neisseria meningitidis Z2491
aaggcggcgagccgca

SEQ ID NO: 1392244 - RNA, 21 nt, Neisseria meningitidis Z2491
aaggcggcggcguucaaauca

SEQ ID NO: 1392245 - RNA, 17 nt, Neisseria meningitidis Z2491
aaggucgaggaaauucu

SEQ ID NO: 1392246 - RNA, 14 nt, Neisseria meningitidis Z2491
aaggucucuauuug

SEQ ID NO: 1392247 - RNA, 15 nt, Neisseria meningitidis Z2491
aaggucgucugaaaa

SEQ ID NO: 1392248 - RNA, 16 nt, Neisseria meningitidis Z2491
aaggucuagauucccg

SEQ ID NO: 1392249 - RNA, 20 nt, Neisseria meningitidis Z2491
aagguguuauaugcuaucuu

SEQ ID NO: 1392250 - RNA, 21 nt, Neisseria meningitidis Z2491
aaggugggaaucuggaaacca

SEQ ID NO: 1392251 - RNA, 17 nt, Neisseria meningitidis Z2491
aagguugucugaaaacu

SEQ ID NO: 1392252 - RNA, 19 nt, Neisseria meningitidis Z2491
aagguugucugaaaacuug

SEQ ID NO: 1392253 - RNA, 14 nt, Neisseria meningitidis Z2491
aagguuaauuaaaa

SEQ ID NO: 1392254 - RNA, 21 nt, Neisseria meningitidis Z2491
aagguuauuuucuugaguuuc

SEQ ID NO: 1392255 - RNA, 15 nt, Neisseria meningitidis Z2491
aagguucaaacacau

SEQ ID NO: 1392256 - RNA, 21 nt, Neisseria meningitidis Z2491
aagguugcgucugccuucuuc

SEQ ID NO: 1392257 - RNA, 16 nt, Neisseria meningitidis Z2491
aagguuuauuugagca

SEQ ID NO: 1392258 - RNA, 16 nt, Neisseria meningitidis Z2491
aagguuugagcaguuu

SEQ ID NO: 1392259 - RNA, 15 nt, Neisseria meningitidis Z2491
aagccagcagcagcc

SEQ ID NO: 1392260 - RNA, 20 nt, Neisseria meningitidis Z2491
aagcccugccugccauuccc

SEQ ID NO: 1392261 - RNA, 22 nt, Neisseria meningitidis Z2491
aagcccgcacauuccaucaaca

SEQ ID NO: 1392262 - RNA, 12 nt, Neisseria meningitidis Z2491
aagcccaugucg

SEQ ID NO: 1392263 - RNA, 15 nt, Neisseria meningitidis Z2491
aagcagcucggcaau

SEQ ID NO: 1392264 - RNA, 19 nt, Neisseria meningitidis Z2491
aagcagcagcccuccccag

SEQ ID NO: 1392265 - RNA, 18 nt, Neisseria meningitidis Z2491
aagcaggcguuuuucaga

SEQ ID NO: 1392266 - RNA, 19 nt, Neisseria meningitidis Z2491
aagcaggcguuuuucagac

SEQ ID NO: 1392267 - RNA, 14 nt, Neisseria meningitidis Z2491
aagcauacggcuga

SEQ ID NO: 1392268 - RNA, 20 nt, Neisseria meningitidis Z2491
aagcaauaccgcaaccugaa

SEQ ID NO: 1392269 - RNA, 15 nt, Neisseria meningitidis Z2491
aagcaccaagugaau

SEQ ID NO: 1392270 - RNA, 18 nt, Neisseria meningitidis Z2491
aagcaccaagugaaucgg

SEQ ID NO: 1392271 - RNA, 22 nt, Neisseria meningitidis Z2491
aagcaccaagugaaucgguucc

SEQ ID NO: 1392272 - RNA, 15 nt, Neisseria meningitidis Z2491
aagcacaaauuaaaa

SEQ ID NO: 1392273 - RNA, 20 nt, Neisseria meningitidis Z2491
aagcacaaauuaaaauaaaa

SEQ ID NO: 1392274 - RNA, 22 nt, Neisseria meningitidis Z2491
aagauuuguggcggauuuccca

SEQ ID NO: 1392275 - RNA, 18 nt, Neisseria meningitidis Z2491
aagauuauccgaaaguuu

SEQ ID NO: 1392276 - RNA, 18 nt, Neisseria meningitidis Z2491
aagauuaucugaaaguuu

SEQ ID NO: 1392277 - RNA, 17 nt, Neisseria meningitidis Z2491
aauacggcaacaucaua

SEQ ID NO: 1392278 - RNA, 23 nt, Neisseria meningitidis Z2491
aauacggcaacaucauagaaauc

SEQ ID NO: 1392279 - RNA, 22 nt, Neisseria meningitidis Z2491
aauacgcaaaacaaacccacgc

SEQ ID NO: 1392280 - RNA, 13 nt, Neisseria meningitidis Z2491
aauacgauaaagu

SEQ ID NO: 1392281 - RNA, 19 nt, Neisseria meningitidis Z2491
aauacauaggguuaauauc

SEQ ID NO: 1392282 - RNA, 16 nt, Neisseria meningitidis Z2491
aauacauccuaaaaau

SEQ ID NO: 1392283 - RNA, 18 nt, Neisseria meningitidis Z2491
aauacauccuaaaaauuu

SEQ ID NO: 1392284 - RNA, 23 nt, Neisseria meningitidis Z2491
aauaccgucugaaaccugcaacg

SEQ ID NO: 1392285 - RNA, 20 nt, Neisseria meningitidis Z2491
aauagaaaaccgaaacagaa

SEQ ID NO: 1392286 - RNA, 19 nt, Neisseria meningitidis Z2491
aauagaaaauacugauaau

SEQ ID NO: 1392287 - RNA, 20 nt, Neisseria meningitidis Z2491
aauacugccuguaaaaccaa

SEQ ID NO: 1392288 - RNA, 20 nt, Neisseria meningitidis Z2491
aaaaauacuuauaucgucau

SEQ ID NO: 1392289 - RNA, 14 nt, Neisseria meningitidis Z2491
aaaaaucaaaaaca

SEQ ID NO: 1392290 - RNA, 21 nt, Neisseria meningitidis Z2491
aauaacuauaguggauuaaca

SEQ ID NO: 1392291 - RNA, 16 nt, Neisseria meningitidis Z2491
aaaaauaauugucuuu

SEQ ID NO: 1392292 - RNA, 16 nt, Neisseria meningitidis Z2491
aauaacguucaguuca

SEQ ID NO: 1392293 - RNA, 23 nt, Neisseria meningitidis Z2491
aauaacgguugcacgguuuuccu

SEQ ID NO: 1392294 - RNA, 20 nt, Neisseria meningitidis Z2491
aauaauguguugauuaaaua

SEQ ID NO: 1392295 - RNA, 11 nt, Neisseria meningitidis Z2491
aauaaugaaaa

SEQ ID NO: 1392296 - RNA, 13 nt, Neisseria meningitidis Z2491
aauaaugaaaaug

SEQ ID NO: 1392297 - RNA, 12 nt, Neisseria meningitidis Z2491
aauacaaacauc

SEQ ID NO: 1392298 - RNA, 21 nt, Neisseria meningitidis Z2491
aauacaaacaucugauuuuuc

SEQ ID NO: 1392299 - RNA, 16 nt, Neisseria meningitidis Z2491
aauaauugucuuuucc

SEQ ID NO: 1392300 - RNA, 13 nt, Neisseria meningitidis Z2491
aauacaacaaaau

SEQ ID NO: 1392301 - RNA, 13 nt, Neisseria meningitidis Z2491
aauaauugaaauc

SEQ ID NO: 1392302 - RNA, 16 nt, Neisseria meningitidis Z2491
aauaauugaaaucaac

SEQ ID NO: 1392303 - RNA, 14 nt, Neisseria meningitidis Z2491
aauaauugccuuuu

SEQ ID NO: 1392304 - RNA, 20 nt, Neisseria meningitidis Z2491
aagucugauucuaccgcccc

SEQ ID NO: 1392305 - RNA, 13 nt, Neisseria meningitidis Z2491
aaguaaaucgguu

SEQ ID NO: 1392306 - RNA, 22 nt, Neisseria meningitidis Z2491
aagugggaaucuagaaauuuaa

SEQ ID NO: 1392307 - RNA, 13 nt, Neisseria meningitidis Z2491
aagucuuucagac

SEQ ID NO: 1392308 - RNA, 24 nt, Neisseria meningitidis Z2491
aagugauucaauaggauaggcugc

SEQ ID NO: 1392309 - RNA, 15 nt, Neisseria meningitidis Z2491
aauaaaaccgauaaa

SEQ ID NO: 1392310 - RNA, 16 nt, Neisseria meningitidis Z2491
aauaaaagcaucuugu

SEQ ID NO: 1392311 - RNA, 17 nt, Neisseria meningitidis Z2491
aauaaaacgcgugcagg

SEQ ID NO: 1392312 - RNA, 17 nt, Neisseria meningitidis Z2491
aauaaaaguaccgcagc

SEQ ID NO: 1392313 - RNA, 21 nt, Neisseria meningitidis Z2491
aauaaacagccgauaagguuu

SEQ ID NO: 1392314 - RNA, 19 nt, Neisseria meningitidis Z2491
aauaaauuaaucuccuuuu

SEQ ID NO: 1392315 - RNA, 22 nt, Neisseria meningitidis Z2491
aauaaaguccggcauaaauccu

SEQ ID NO: 1392316 - RNA, 22 nt, Neisseria meningitidis Z2491
aauaaaggcguugggaaagguu

SEQ ID NO: 1392317 - RNA, 23 nt, Neisseria meningitidis Z2491
aauaaacuugauugcuguuuuuc

SEQ ID NO: 1392318 - RNA, 20 nt, Neisseria meningitidis Z2491
cggaggaauaagucagcgug

SEQ ID NO: 1392319 - RNA, 16 nt, Neisseria meningitidis Z2491
cggauaggcaaaaacc

SEQ ID NO: 1392320 - RNA, 14 nt, Neisseria meningitidis Z2491
cggaugaauuuaaa

SEQ ID NO: 1392321 - RNA, 23 nt, Neisseria meningitidis Z2491
cggaugaauuuaaacaggcacag

SEQ ID NO: 1392322 - RNA, 23 nt, Neisseria meningitidis Z2491
cggauuagagcguggauuuuuuu

SEQ ID NO: 1392323 - RNA, 14 nt, Neisseria meningitidis Z2491
cggauguccgacca

SEQ ID NO: 1392324 - RNA, 15 nt, Neisseria meningitidis Z2491
cggauguucaaacac

SEQ ID NO: 1392325 - RNA, 20 nt, Neisseria meningitidis Z2491
cggcaacaucauagaaauca

SEQ ID NO: 1392326 - RNA, 18 nt, Neisseria meningitidis Z2491
cggcaacauaaacaaagc

SEQ ID NO: 1392327 - RNA, 14 nt, Neisseria meningitidis Z2491
cggcaaacuuuccg

SEQ ID NO: 1392328 - RNA, 19 nt, Neisseria meningitidis Z2491
cggcaaaguuauucaauuu

SEQ ID NO: 1392329 - RNA, 20 nt, Neisseria meningitidis Z2491
cggcaaaaguaucaggcauc

SEQ ID NO: 1392330 - RNA, 16 nt, Neisseria meningitidis Z2491
cggauuguuuggaaau

SEQ ID NO: 1392331 - RNA, 24 nt, Neisseria meningitidis Z2491
cggcaaucuucccgggucgcuuua

SEQ ID NO: 1392332 - RNA, 22 nt, Neisseria meningitidis Z2491
cggcaaugcgcccgauguaguc

SEQ ID NO: 1392333 - RNA, 16 nt, Neisseria meningitidis Z2491
cggcacaaccgcccua

SEQ ID NO: 1392334 - RNA, 21 nt, Neisseria meningitidis Z2491
cggcacaaccgcccuauauuu

SEQ ID NO: 1392335 - RNA, 16 nt, Neisseria meningitidis Z2491
cggcacuagccaaaaa

SEQ ID NO: 1392336 - RNA, 13 nt, Neisseria meningitidis Z2491
cggacaagggaaa

SEQ ID NO: 1392337 - RNA, 15 nt, Neisseria meningitidis Z2491
cggacaaaucuggau

SEQ ID NO: 1392338 - RNA, 16 nt, Neisseria meningitidis Z2491
cggagaaguaaucaca

SEQ ID NO: 1392339 - RNA, 16 nt, Neisseria meningitidis Z2491
cggacggcauuuuuga

SEQ ID NO: 1392340 - RNA, 21 nt, Neisseria meningitidis Z2491
cggagcaagaccaaacagaac

SEQ ID NO: 1392341 - RNA, 18 nt, Neisseria meningitidis Z2491
cggagaggcuuucagacg

SEQ ID NO: 1392342 - RNA, 22 nt, Neisseria meningitidis Z2491
cggagaggcuuucagacggccu

SEQ ID NO: 1392343 - RNA, 17 nt, Neisseria meningitidis Z2491
cggagcagaaucaaaua

SEQ ID NO: 1392344 - RNA, 24 nt, Neisseria meningitidis Z2491
cggaaaugacugaaacucaacgaa

SEQ ID NO: 1392345 - RNA, 15 nt, Neisseria meningitidis Z2491
cggaaacagccaggc

SEQ ID NO: 1392346 - RNA, 15 nt, Neisseria meningitidis Z2491
cggaaacucaaaaaa

SEQ ID NO: 1392347 - RNA, 18 nt, Neisseria meningitidis Z2491
cggaaacucaaaaaaccg

SEQ ID NO: 1392348 - RNA, 19 nt, Neisseria meningitidis Z2491
cggaaaucguaggucuuca

SEQ ID NO: 1392349 - RNA, 18 nt, Neisseria meningitidis Z2491
cggaaguacucauuuuuc

SEQ ID NO: 1392350 - RNA, 16 nt, Neisseria meningitidis Z2491
cggaagugggaaucua

SEQ ID NO: 1392351 - RNA, 19 nt, Neisseria meningitidis Z2491
cggaagugggaaucuagaa

SEQ ID NO: 1392352 - RNA, 16 nt, Neisseria meningitidis Z2491
cgcuuucacgggaaug

SEQ ID NO: 1392353 - RNA, 15 nt, Neisseria meningitidis Z2491
cggcgcaaccgccgg

SEQ ID NO: 1392354 - RNA, 20 nt, Neisseria meningitidis Z2491
cggcauuuucaacagcagga

SEQ ID NO: 1392355 - RNA, 17 nt, Neisseria meningitidis Z2491
cggccaaaaaaacguca

SEQ ID NO: 1392356 - RNA, 19 nt, Neisseria meningitidis Z2491
cggccaaaaaaacgucauc

SEQ ID NO: 1392357 - RNA, 20 nt, Neisseria meningitidis Z2491
cggcauuuuuauugcuucau

SEQ ID NO: 1392358 - RNA, 16 nt, Neisseria meningitidis Z2491
cggcauuuuucauuuu

SEQ ID NO: 1392359 - RNA, 14 nt, Neisseria meningitidis Z2491
cggcauuuuuucac

SEQ ID NO: 1392360 - RNA, 18 nt, Neisseria meningitidis Z2491
cggcauuuuuuccgacag

SEQ ID NO: 1392361 - RNA, 19 nt, Neisseria meningitidis Z2491
cggcauuuuguugccgucg

SEQ ID NO: 1392362 - RNA, 14 nt, Neisseria meningitidis Z2491
cggcauuuuguuua

SEQ ID NO: 1392363 - RNA, 14 nt, Neisseria meningitidis Z2491
cggcauuucauuau

SEQ ID NO: 1392364 - RNA, 17 nt, Neisseria meningitidis Z2491
cggcauuggguuuucug

SEQ ID NO: 1392365 - RNA, 18 nt, Neisseria meningitidis Z2491
cggcauuguuuuucguua

SEQ ID NO: 1392366 - RNA, 23 nt, Neisseria meningitidis Z2491
cgagugugggguagccuucaaac

SEQ ID NO: 1392367 - RNA, 15 nt, Neisseria meningitidis Z2491
cgaguucuuuuaaag

SEQ ID NO: 1392368 - RNA, 18 nt, Neisseria meningitidis Z2491
cgauacacaaaaaagcca

SEQ ID NO: 1392369 - RNA, 12 nt, Neisseria meningitidis Z2491
cgauaaauuccu

SEQ ID NO: 1392370 - RNA, 14 nt, Neisseria meningitidis Z2491
cgagggcgcgggcg

SEQ ID NO: 1392371 - RNA, 11 nt, Neisseria meningitidis Z2491
cgacuggaugg

SEQ ID NO: 1392372 - RNA, 17 nt, Neisseria meningitidis Z2491
cgacugccgccgcgccu

SEQ ID NO: 1392373 - RNA, 14 nt, Neisseria meningitidis Z2491
cgagaaaacagaaa

SEQ ID NO: 1392374 - RNA, 13 nt, Neisseria meningitidis Z2491
cgacugugcccac

SEQ ID NO: 1392375 - RNA, 22 nt, Neisseria meningitidis Z2491
cgacuuccagcaccaguucguc

SEQ ID NO: 1392376 - RNA, 18 nt, Neisseria meningitidis Z2491
cgacuucugacagcauuu

SEQ ID NO: 1392377 - RNA, 13 nt, Neisseria meningitidis Z2491
cgagaauuuauca

SEQ ID NO: 1392378 - RNA, 20 nt, Neisseria meningitidis Z2491
cgagaauuuaucagaaauga

SEQ ID NO: 1392379 - RNA, 20 nt, Neisseria meningitidis Z2491
cgagcaggguuugcaggcgu

SEQ ID NO: 1392380 - RNA, 16 nt, Neisseria meningitidis Z2491
cgagcauaccguucaa

SEQ ID NO: 1392381 - RNA, 21 nt, Neisseria meningitidis Z2491
cgagcaauauuggcacgggcg

SEQ ID NO: 1392382 - RNA, 21 nt, Neisseria meningitidis Z2491
cgagcagcagucccaucccgc

SEQ ID NO: 1392383 - RNA, 18 nt, Neisseria meningitidis Z2491
cgagccaauagccgccgg

SEQ ID NO: 1392384 - RNA, 14 nt, Neisseria meningitidis Z2491
cgagccgcagacag

SEQ ID NO: 1392385 - RNA, 14 nt, Neisseria meningitidis Z2491
aaacgcgugcaggc

SEQ ID NO: 1392386 - RNA, 19 nt, Neisseria meningitidis Z2491
cgccacauaauucaaaugc

SEQ ID NO: 1392387 - RNA, 17 nt, Neisseria meningitidis Z2491
cgccaauccugccuuca

SEQ ID NO: 1392388 - RNA, 14 nt, Neisseria meningitidis Z2491
cgccaaggcuuuca

SEQ ID NO: 1392389 - RNA, 23 nt, Neisseria meningitidis Z2491
cgccaacguaccguccaaacuuc

SEQ ID NO: 1392390 - RNA, 20 nt, Neisseria meningitidis Z2491
cgccaaacccucgucauucu

SEQ ID NO: 1392391 - RNA, 14 nt, Neisseria meningitidis Z2491
cgcauuuuuaugcg

SEQ ID NO: 1392392 - RNA, 14 nt, Neisseria meningitidis Z2491
cgccaaaaaauuuu

SEQ ID NO: 1392393 - RNA, 18 nt, Neisseria meningitidis Z2491
cgcauuuuuucugccauu

SEQ ID NO: 1392394 - RNA, 15 nt, Neisseria meningitidis Z2491
cgcauuguuggaaau

SEQ ID NO: 1392395 - RNA, 19 nt, Neisseria meningitidis Z2491
cgcauggcuucuuugcugg

SEQ ID NO: 1392396 - RNA, 18 nt, Neisseria meningitidis Z2491
cgcauaguuuccggcaag

SEQ ID NO: 1392397 - RNA, 22 nt, Neisseria meningitidis Z2491
aaacggcaggaacacggcggca

SEQ ID NO: 1392398 - RNA, 12 nt, Neisseria meningitidis Z2491
aaacggcagcag

SEQ ID NO: 1392399 - RNA, 22 nt, Neisseria meningitidis Z2491
aaacggcagcagcuccgaaccg

SEQ ID NO: 1392400 - RNA, 23 nt, Neisseria meningitidis Z2491
aaacggguucggacggcauuuuu

SEQ ID NO: 1392401 - RNA, 13 nt, Neisseria meningitidis Z2491
aaacgggaauccg

SEQ ID NO: 1392402 - RNA, 13 nt, Neisseria meningitidis Z2491
aaacgggaaucua

SEQ ID NO: 1392403 - RNA, 13 nt, Neisseria meningitidis Z2491
aaacgggaaucuc

SEQ ID NO: 1392404 - RNA, 22 nt, Neisseria meningitidis Z2491
cgcaucguaaaaaugccgucug

SEQ ID NO: 1392405 - RNA, 18 nt, Neisseria meningitidis Z2491
cgcaggcgguggcgagcc

SEQ ID NO: 1392406 - RNA, 18 nt, Neisseria meningitidis Z2491
cgcaggcgggaauacaaa

SEQ ID NO: 1392407 - RNA, 16 nt, Neisseria meningitidis Z2491
cgcaggcgggaaucca

SEQ ID NO: 1392408 - RNA, 11 nt, Neisseria meningitidis Z2491
cgcaggcuucg

SEQ ID NO: 1392409 - RNA, 22 nt, Neisseria meningitidis Z2491
cgcaaccaaaaucaucacgccg

SEQ ID NO: 1392410 - RNA, 15 nt, Neisseria meningitidis Z2491
cgcaaaucggcuuca

SEQ ID NO: 1392411 - RNA, 19 nt, Neisseria meningitidis Z2491
cgcaaagucauauuaauua

SEQ ID NO: 1392412 - RNA, 12 nt, Neisseria meningitidis Z2491
cgcacaagcccu

SEQ ID NO: 1392413 - RNA, 13 nt, Neisseria meningitidis Z2491
cgcacaagcccua

SEQ ID NO: 1392414 - RNA, 21 nt, Neisseria meningitidis Z2491
cgcacucugaaagccagcggg

SEQ ID NO: 1392415 - RNA, 13 nt, Neisseria meningitidis Z2491
cgaugggcaaggc

SEQ ID NO: 1392416 - RNA, 23 nt, Neisseria meningitidis Z2491
cgaugggcaaggcgccggcggcu

SEQ ID NO: 1392417 - RNA, 18 nt, Neisseria meningitidis Z2491
cgaugcguuccugccaga

SEQ ID NO: 1392418 - RNA, 14 nt, Neisseria meningitidis Z2491
cgaugcuggcgggg

SEQ ID NO: 1392419 - RNA, 16 nt, Neisseria meningitidis Z2491
cgaugcggauggagga

SEQ ID NO: 1392420 - RNA, 19 nt, Neisseria meningitidis Z2491
cgauauucagguaaaacaa

SEQ ID NO: 1392421 - RNA, 18 nt, Neisseria meningitidis Z2491
cgaugauguguuucaaca

SEQ ID NO: 1392422 - RNA, 23 nt, Neisseria meningitidis Z2491
cgaugccgucauucccgcgcagg

SEQ ID NO: 1392423 - RNA, 14 nt, Neisseria meningitidis Z2491
cgcaaaagcgggaa

SEQ ID NO: 1392424 - RNA, 14 nt, Neisseria meningitidis Z2491
cgcaaaagcgggag

SEQ ID NO: 1392425 - RNA, 16 nt, Neisseria meningitidis Z2491
cgauuugguugucagg

SEQ ID NO: 1392426 - RNA, 19 nt, Neisseria meningitidis Z2491
cgccgcuguauuugcgccg

SEQ ID NO: 1392427 - RNA, 15 nt, Neisseria meningitidis Z2491
aaacgucguacagau

SEQ ID NO: 1392428 - RNA, 23 nt, Neisseria meningitidis Z2491
cgccgggaccgacgggcaggccc

SEQ ID NO: 1392429 - RNA, 19 nt, Neisseria meningitidis Z2491
cgccggccuuaaggcggcu

SEQ ID NO: 1392430 - RNA, 21 nt, Neisseria meningitidis Z2491
cgccggaagauuccggcggcu

SEQ ID NO: 1392431 - RNA, 18 nt, Neisseria meningitidis Z2491
cgccgccaugucgcgggc

SEQ ID NO: 1392432 - RNA, 14 nt, Neisseria meningitidis Z2491
cgcccgacaaccgc

SEQ ID NO: 1392433 - RNA, 20 nt, Neisseria meningitidis Z2491
cgcccgauuuccucuuucaa

SEQ ID NO: 1392434 - RNA, 16 nt, Neisseria meningitidis Z2491
cgcggccuuugcaaaa

SEQ ID NO: 1392435 - RNA, 14 nt, Neisseria meningitidis Z2491
cgcggcgggcggcu

SEQ ID NO: 1392436 - RNA, 17 nt, Neisseria meningitidis Z2491
cgcgguuggcggcggcg

SEQ ID NO: 1392437 - RNA, 20 nt, Neisseria meningitidis Z2491
cgcgguuguggaaggcgggc

SEQ ID NO: 1392438 - RNA, 16 nt, Neisseria meningitidis Z2491
cgcgcaaacccgccug

SEQ ID NO: 1392439 - RNA, 19 nt, Neisseria meningitidis Z2491
cgcgauuccggcgcggcgc

SEQ ID NO: 1392440 - RNA, 20 nt, Neisseria meningitidis Z2491
cgcgcaggcgggaaucuaga

SEQ ID NO: 1392441 - RNA, 15 nt, Neisseria meningitidis Z2491
cgcgccguccaaaaa

SEQ ID NO: 1392442 - RNA, 12 nt, Neisseria meningitidis Z2491
cgccuuaaaaaa

SEQ ID NO: 1392443 - RNA, 18 nt, Neisseria meningitidis Z2491
cgccuugugccugcucca

SEQ ID NO: 1392444 - RNA, 19 nt, Neisseria meningitidis Z2491
cgccuuugccaccaauacc

SEQ ID NO: 1392445 - RNA, 12 nt, Neisseria meningitidis Z2491
cgccgucugaaa

SEQ ID NO: 1392446 - RNA, 20 nt, Neisseria meningitidis Z2491
cgcgaaagcgggaaucuagu

SEQ ID NO: 1392447 - RNA, 17 nt, Neisseria meningitidis Z2491
cgcgauaaggcgcgucc

SEQ ID NO: 1392448 - RNA, 14 nt, Neisseria meningitidis Z2491
cgcgauauucaggu

SEQ ID NO: 1392449 - RNA, 14 nt, Neisseria meningitidis Z2491
cgcgaguucgagac

SEQ ID NO: 1392450 - RNA, 21 nt, Neisseria meningitidis Z2491
ccgucauucccgugcaggcgg

SEQ ID NO: 1392451 - RNA, 21 nt, Neisseria meningitidis Z2491
ccgucauuccucaaaaacaga

SEQ ID NO: 1392452 - RNA, 20 nt, Neisseria meningitidis Z2491
ccgucauuccuguaaaaaca

SEQ ID NO: 1392453 - RNA, 12 nt, Neisseria meningitidis Z2491
aaaccuuaucca

SEQ ID NO: 1392454 - RNA, 21 nt, Neisseria meningitidis Z2491
aaaccuuauccauauccaaac

SEQ ID NO: 1392455 - RNA, 17 nt, Neisseria meningitidis Z2491
aaacgaacaaacccuuu

SEQ ID NO: 1392456 - RNA, 19 nt, Neisseria meningitidis Z2491
ccgucuguuuucgacgccc

SEQ ID NO: 1392457 - RNA, 14 nt, Neisseria meningitidis Z2491
ccgucgggauucag

SEQ ID NO: 1392458 - RNA, 18 nt, Neisseria meningitidis Z2491
ccgucgggcaucugcagc

SEQ ID NO: 1392459 - RNA, 15 nt, Neisseria meningitidis Z2491
ccgugaaauugcguu

SEQ ID NO: 1392460 - RNA, 16 nt, Neisseria meningitidis Z2491
ccgucgccauaaucag

SEQ ID NO: 1392461 - RNA, 20 nt, Neisseria meningitidis Z2491
ccgucgccauaaucagcccg

SEQ ID NO: 1392462 - RNA, 13 nt, Neisseria meningitidis Z2491
ccguccguaagcc

SEQ ID NO: 1392463 - RNA, 20 nt, Neisseria meningitidis Z2491
ccguacugguuuuuguuaau

SEQ ID NO: 1392464 - RNA, 18 nt, Neisseria meningitidis Z2491
ccguaccgggcaggcuga

SEQ ID NO: 1392465 - RNA, 13 nt, Neisseria meningitidis Z2491
ccgguuuguauuu

SEQ ID NO: 1392466 - RNA, 17 nt, Neisseria meningitidis Z2491
ccguaucccaguugugc

SEQ ID NO: 1392467 - RNA, 19 nt, Neisseria meningitidis Z2491
ccguaugcaaaaacaaccc

SEQ ID NO: 1392468 - RNA, 19 nt, Neisseria meningitidis Z2491
ccguaugcgaaucugcugc

SEQ ID NO: 1392469 - RNA, 12 nt, Neisseria meningitidis Z2491
ccguauuuuuua

SEQ ID NO: 1392470 - RNA, 19 nt, Neisseria meningitidis Z2491
ccgucaaacagaaaaacaa

SEQ ID NO: 1392471 - RNA, 16 nt, Neisseria meningitidis Z2491
ccgggguuuaucagaa

SEQ ID NO: 1392472 - RNA, 21 nt, Neisseria meningitidis Z2491
ccggugcgaccguaugcaaaa

SEQ ID NO: 1392473 - RNA, 15 nt, Neisseria meningitidis Z2491
ccggucuuggcagca

SEQ ID NO: 1392474 - RNA, 17 nt, Neisseria meningitidis Z2491
aaaccguauucccgccu

SEQ ID NO: 1392475 - RNA, 18 nt, Neisseria meningitidis Z2491
aaaccguauucccgccug

SEQ ID NO: 1392476 - RNA, 16 nt, Neisseria meningitidis Z2491
aaaccguauauuuccc

SEQ ID NO: 1392477 - RNA, 19 nt, Neisseria meningitidis Z2491
ccggcggcaacaaugccgu

SEQ ID NO: 1392478 - RNA, 14 nt, Neisseria meningitidis Z2491
aaaccgcucccccu

SEQ ID NO: 1392479 - RNA, 15 nt, Neisseria meningitidis Z2491
aaaccgcucccccuc

SEQ ID NO: 1392480 - RNA, 20 nt, Neisseria meningitidis Z2491
aaaccggauuccuacgaaaa

SEQ ID NO: 1392481 - RNA, 19 nt, Neisseria meningitidis Z2491
aaaccggcauucugcacgc

SEQ ID NO: 1392482 - RNA, 20 nt, Neisseria meningitidis Z2491
aaaccggccggaaaaccuug

SEQ ID NO: 1392483 - RNA, 22 nt, Neisseria meningitidis Z2491
aaaccugcaucacgucauuccu

SEQ ID NO: 1392484 - RNA, 14 nt, Neisseria meningitidis Z2491
ccgcugcugggggc

SEQ ID NO: 1392485 - RNA, 21 nt, Neisseria meningitidis Z2491
ccgcucgcguauccagccgcc

SEQ ID NO: 1392486 - RNA, 10 nt, Neisseria meningitidis Z2491
ccgcugaaaa

SEQ ID NO: 1392487 - RNA, 19 nt, Neisseria meningitidis Z2491
ccggagcagaaucaaauau

SEQ ID NO: 1392488 - RNA, 19 nt, Neisseria meningitidis Z2491
ccgcuugaccgcagccgaa

SEQ ID NO: 1392489 - RNA, 17 nt, Neisseria meningitidis Z2491
ccgcuucuuucgccgcc

SEQ ID NO: 1392490 - RNA, 12 nt, Neisseria meningitidis Z2491
ccgcuucuucca

SEQ ID NO: 1392491 - RNA, 14 nt, Neisseria meningitidis Z2491
ccgcguguccgcgc

SEQ ID NO: 1392492 - RNA, 14 nt, Neisseria meningitidis Z2491
ccgcuauauauucu

SEQ ID NO: 1392493 - RNA, 20 nt, Neisseria meningitidis Z2491
ccgcuauauauucugauuua

SEQ ID NO: 1392494 - RNA, 16 nt, Neisseria meningitidis Z2491
ccgcguaugcguucaa

SEQ ID NO: 1392495 - RNA, 23 nt, Neisseria meningitidis Z2491
aaaccgccgugcagauucuuguc

SEQ ID NO: 1392496 - RNA, 14 nt, Neisseria meningitidis Z2491
aaaccgaacggacu

SEQ ID NO: 1392497 - RNA, 23 nt, Neisseria meningitidis Z2491
aaaccgccauucccgcaaaagcg

SEQ ID NO: 1392498 - RNA, 22 nt, Neisseria meningitidis Z2491
aaaccgaaugccacacgcaggc

SEQ ID NO: 1392499 - RNA, 19 nt, Neisseria meningitidis Z2491
aaaccgaugggcuucauca

SEQ ID NO: 1392500 - RNA, 15 nt, Neisseria meningitidis Z2491
ccgcgcgucagcccg

SEQ ID NO: 1392501 - RNA, 15 nt, Neisseria meningitidis Z2491
aaaccgaaaccgaac

SEQ ID NO: 1392502 - RNA, 19 nt, Neisseria meningitidis Z2491
ccgcgccgauguuuuccug

SEQ ID NO: 1392503 - RNA, 16 nt, Neisseria meningitidis Z2491
ccgcgaaaaauagaaa

SEQ ID NO: 1392504 - RNA, 14 nt, Neisseria meningitidis Z2491
ccgccugcaaaggc

SEQ ID NO: 1392505 - RNA, 20 nt, Neisseria meningitidis Z2491
ccgccugaugauuuuuucaa

SEQ ID NO: 1392506 - RNA, 20 nt, Neisseria meningitidis Z2491
ccgcagccggggcaggcggu

SEQ ID NO: 1392507 - RNA, 16 nt, Neisseria meningitidis Z2491
ccgcgauaaggcgcgu

SEQ ID NO: 1392508 - RNA, 15 nt, Neisseria meningitidis Z2491
ccgcgagaacagaaa

SEQ ID NO: 1392509 - RNA, 12 nt, Neisseria meningitidis Z2491
ccgcgcaggcgg

SEQ ID NO: 1392510 - RNA, 17 nt, Neisseria meningitidis Z2491
ccgcgccaauuccuuca

SEQ ID NO: 1392511 - RNA, 18 nt, Neisseria meningitidis Z2491
ccucgucauuuccacaaa

SEQ ID NO: 1392512 - RNA, 20 nt, Neisseria meningitidis Z2491
ccucgucauuuccacaaaaa

SEQ ID NO: 1392513 - RNA, 21 nt, Neisseria meningitidis Z2491
ccucuauuuaaaaauuccugu

SEQ ID NO: 1392514 - RNA, 21 nt, Neisseria meningitidis Z2491
ccucuccccgacccuccccca

SEQ ID NO: 1392515 - RNA, 14 nt, Neisseria meningitidis Z2491
ccucugccagcucc

SEQ ID NO: 1392516 - RNA, 15 nt, Neisseria meningitidis Z2491
ccucugccagcuccg

SEQ ID NO: 1392517 - RNA, 15 nt, Neisseria meningitidis Z2491
ccuccucgccgucuu

SEQ ID NO: 1392518 - RNA, 22 nt, Neisseria meningitidis Z2491
ccucgauuugaaaucugauuuc

SEQ ID NO: 1392519 - RNA, 15 nt, Neisseria meningitidis Z2491
aaacgccgucugaaa

SEQ ID NO: 1392520 - RNA, 16 nt, Neisseria meningitidis Z2491
aaacgccgucugaaau

SEQ ID NO: 1392521 - RNA, 22 nt, Neisseria meningitidis Z2491
aaacgccgucugaaauuucaga

SEQ ID NO: 1392522 - RNA, 23 nt, Neisseria meningitidis Z2491
aaacgccgucugaaauuucagac

SEQ ID NO: 1392523 - RNA, 19 nt, Neisseria meningitidis Z2491
aaacgccgcagcaaaauau

SEQ ID NO: 1392524 - RNA, 23 nt, Neisseria meningitidis Z2491
ccucauugccgcccguuuaaaca

SEQ ID NO: 1392525 - RNA, 14 nt, Neisseria meningitidis Z2491
ccuccgcaaacacc

SEQ ID NO: 1392526 - RNA, 15 nt, Neisseria meningitidis Z2491
ccucacugccgccaa

SEQ ID NO: 1392527 - RNA, 20 nt, Neisseria meningitidis Z2491
ccucacugccgccaauccug

SEQ ID NO: 1392528 - RNA, 17 nt, Neisseria meningitidis Z2491
ccucaacacaccauccu

SEQ ID NO: 1392529 - RNA, 12 nt, Neisseria meningitidis Z2491
ccugauuuuugu

SEQ ID NO: 1392530 - RNA, 19 nt, Neisseria meningitidis Z2491
ccugauuuuuguuaauuca

SEQ ID NO: 1392531 - RNA, 14 nt, Neisseria meningitidis Z2491
ccugauuucgcuuu

SEQ ID NO: 1392532 - RNA, 22 nt, Neisseria meningitidis Z2491
ccugcaaugcacuacuucauuu

SEQ ID NO: 1392533 - RNA, 15 nt, Neisseria meningitidis Z2491
ccugcagcagagcug

SEQ ID NO: 1392534 - RNA, 23 nt, Neisseria meningitidis Z2491
ccugauggcugaugacggcagcc

SEQ ID NO: 1392535 - RNA, 20 nt, Neisseria meningitidis Z2491
ccugauugaccgaaaaauaa

SEQ ID NO: 1392536 - RNA, 22 nt, Neisseria meningitidis Z2491
ccugauucucaugaucuucuua

SEQ ID NO: 1392537 - RNA, 14 nt, Neisseria meningitidis Z2491
ccugauccaaaccg

SEQ ID NO: 1392538 - RNA, 21 nt, Neisseria meningitidis Z2491
ccugaucuaaaaauucuaacu

SEQ ID NO: 1392539 - RNA, 14 nt, Neisseria meningitidis Z2491
ccugaaaacagaaa

SEQ ID NO: 1392540 - RNA, 19 nt, Neisseria meningitidis Z2491
ccugaaaacagaaaccuaa

SEQ ID NO: 1392541 - RNA, 17 nt, Neisseria meningitidis Z2491
ccugaacauaaaugccg

SEQ ID NO: 1392542 - RNA, 18 nt, Neisseria meningitidis Z2491
ccugaaccuuauagugga

SEQ ID NO: 1392543 - RNA, 22 nt, Neisseria meningitidis Z2491
ccucuuggauaaacauuuuugc

SEQ ID NO: 1392544 - RNA, 13 nt, Neisseria meningitidis Z2491
ccugagcaaaugc

SEQ ID NO: 1392545 - RNA, 17 nt, Neisseria meningitidis Z2491
ccugauaaaaaauaugg

SEQ ID NO: 1392546 - RNA, 17 nt, Neisseria meningitidis Z2491
ccugacgcuccagcucc

SEQ ID NO: 1392547 - RNA, 14 nt, Neisseria meningitidis Z2491
cgaagccgaagaca

SEQ ID NO: 1392548 - RNA, 16 nt, Neisseria meningitidis Z2491
cgaacggagccagccc

SEQ ID NO: 1392549 - RNA, 23 nt, Neisseria meningitidis Z2491
cgaagacuuuaaucauguugccg

SEQ ID NO: 1392550 - RNA, 13 nt, Neisseria meningitidis Z2491
cgaagacaggcag

SEQ ID NO: 1392551 - RNA, 14 nt, Neisseria meningitidis Z2491
cgaagacaguacag

SEQ ID NO: 1392552 - RNA, 15 nt, Neisseria meningitidis Z2491
cgaagggaaacuggu

SEQ ID NO: 1392553 - RNA, 19 nt, Neisseria meningitidis Z2491
cgaaggcgcggcugccgac

SEQ ID NO: 1392554 - RNA, 22 nt, Neisseria meningitidis Z2491
cgaaggcgcggcugccgaccgc

SEQ ID NO: 1392555 - RNA, 21 nt, Neisseria meningitidis Z2491
cgaaggcgcgguagguuuugc

SEQ ID NO: 1392556 - RNA, 21 nt, Neisseria meningitidis Z2491
cgaacagaccggauucccgca

SEQ ID NO: 1392557 - RNA, 14 nt, Neisseria meningitidis Z2491
cgaaauuccaacau

SEQ ID NO: 1392558 - RNA, 17 nt, Neisseria meningitidis Z2491
cgaaccgaaacggcgca

SEQ ID NO: 1392559 - RNA, 17 nt, Neisseria meningitidis Z2491
cgaaagguugugggaau

SEQ ID NO: 1392560 - RNA, 16 nt, Neisseria meningitidis Z2491
cgaaaguuggaaucca

SEQ ID NO: 1392561 - RNA, 13 nt, Neisseria meningitidis Z2491
cgaaauaucggca

SEQ ID NO: 1392562 - RNA, 23 nt, Neisseria meningitidis Z2491
cgaaagcgggaauccggaagcga

SEQ ID NO: 1392563 - RNA, 15 nt, Neisseria meningitidis Z2491
cgaaaucauccacag

SEQ ID NO: 1392564 - RNA, 14 nt, Neisseria meningitidis Z2491
cgaaaugccgucug

SEQ ID NO: 1392565 - RNA, 23 nt, Neisseria meningitidis Z2491
cgaaagauacagcguauugagca

SEQ ID NO: 1392566 - RNA, 13 nt, Neisseria meningitidis Z2491
cgaaaccaaaagc

SEQ ID NO: 1392567 - RNA, 11 nt, Neisseria meningitidis Z2491
cgaaacagaaa

SEQ ID NO: 1392568 - RNA, 15 nt, Neisseria meningitidis Z2491
cgaaacagaaaccca

SEQ ID NO: 1392569 - RNA, 16 nt, Neisseria meningitidis Z2491
cgaaacagaaacccaa

SEQ ID NO: 1392570 - RNA, 18 nt, Neisseria meningitidis Z2491
cgaaacagaaacccaaaa

SEQ ID NO: 1392571 - RNA, 21 nt, Neisseria meningitidis Z2491
cgaaacagacauugcuaaaac

SEQ ID NO: 1392572 - RNA, 15 nt, Neisseria meningitidis Z2491
cgaaaaccuguguuu

SEQ ID NO: 1392573 - RNA, 16 nt, Neisseria meningitidis Z2491
cgaaaacaggaauccg

SEQ ID NO: 1392574 - RNA, 17 nt, Neisseria meningitidis Z2491
cgaaaaauagaaaauca

SEQ ID NO: 1392575 - RNA, 11 nt, Neisseria meningitidis Z2491
ccuuuucccuu

SEQ ID NO: 1392576 - RNA, 12 nt, Neisseria meningitidis Z2491
ccuuagcucaaa

SEQ ID NO: 1392577 - RNA, 20 nt, Neisseria meningitidis Z2491
ccuuaaccguaucaaacaag

SEQ ID NO: 1392578 - RNA, 23 nt, Neisseria meningitidis Z2491
ccuuacggauggcauagccgcgu

SEQ ID NO: 1392579 - RNA, 18 nt, Neisseria meningitidis Z2491
ccuguuuucgcgggaauc

SEQ ID NO: 1392580 - RNA, 16 nt, Neisseria meningitidis Z2491
ccuuauaguggauuaa

SEQ ID NO: 1392581 - RNA, 13 nt, Neisseria meningitidis Z2491
ccuuccaaaagcg

SEQ ID NO: 1392582 - RNA, 21 nt, Neisseria meningitidis Z2491
ccuuccgcauaauaaaaauaa

SEQ ID NO: 1392583 - RNA, 16 nt, Neisseria meningitidis Z2491
ccuugcaaaucaggca

SEQ ID NO: 1392584 - RNA, 13 nt, Neisseria meningitidis Z2491
ccuugcaacccca

SEQ ID NO: 1392585 - RNA, 19 nt, Neisseria meningitidis Z2491
ccuugcaagcaguugaaau

SEQ ID NO: 1392586 - RNA, 22 nt, Neisseria meningitidis Z2491
ccuguugcuuuucauuucuaga

SEQ ID NO: 1392587 - RNA, 15 nt, Neisseria meningitidis Z2491
ccuguuuuucaaagc

SEQ ID NO: 1392588 - RNA, 16 nt, Neisseria meningitidis Z2491
ccuguuuuucaaagcc

SEQ ID NO: 1392589 - RNA, 13 nt, Neisseria meningitidis Z2491
ccuuaaaaaacaa

SEQ ID NO: 1392590 - RNA, 15 nt, Neisseria meningitidis Z2491
ccuguuuaaauucau

SEQ ID NO: 1392591 - RNA, 18 nt, Neisseria meningitidis Z2491
ccuguuucgggcaaaagc

SEQ ID NO: 1392592 - RNA, 20 nt, Neisseria meningitidis Z2491
ccuguuucgggcaaaagcca

SEQ ID NO: 1392593 - RNA, 21 nt, Neisseria meningitidis Z2491
ccuguguccuuauuucugcuu

SEQ ID NO: 1392594 - RNA, 17 nt, Neisseria meningitidis Z2491
ccuguguuuauugagaa

SEQ ID NO: 1392595 - RNA, 16 nt, Neisseria meningitidis Z2491
ccugugcggcggacau

SEQ ID NO: 1392596 - RNA, 17 nt, Neisseria meningitidis Z2491
ccugcucggccugcccu

SEQ ID NO: 1392597 - RNA, 17 nt, Neisseria meningitidis Z2491
ccugcguuugccgccau

SEQ ID NO: 1392598 - RNA, 13 nt, Neisseria meningitidis Z2491
ccuguaaaaccaa

SEQ ID NO: 1392599 - RNA, 20 nt, Neisseria meningitidis Z2491
ccuguaaacagauaaaacca

SEQ ID NO: 1392600 - RNA, 12 nt, Neisseria meningitidis Z2491
aaacauuuugau

SEQ ID NO: 1392601 - RNA, 15 nt, Neisseria meningitidis Z2491
aaacauuuugauugu

SEQ ID NO: 1392602 - RNA, 14 nt, Neisseria meningitidis Z2491
aaaccaaaagccaa

SEQ ID NO: 1392603 - RNA, 20 nt, Neisseria meningitidis Z2491
aaaccaaaaucagaaaccua

SEQ ID NO: 1392604 - RNA, 18 nt, Neisseria meningitidis Z2491
aaaccaaaaacagcaacc

SEQ ID NO: 1392605 - RNA, 13 nt, Neisseria meningitidis Z2491
aaaccaaaaaaca

SEQ ID NO: 1392606 - RNA, 20 nt, Neisseria meningitidis Z2491
aaaccaaaaaacaacaggaa

SEQ ID NO: 1392607 - RNA, 17 nt, Neisseria meningitidis Z2491
ccgacaaccgcccagcc

SEQ ID NO: 1392608 - RNA, 19 nt, Neisseria meningitidis Z2491
ccgacaaucaggccggcgg

SEQ ID NO: 1392609 - RNA, 22 nt, Neisseria meningitidis Z2491
ccgacaauuucuccgccagccu

SEQ ID NO: 1392610 - RNA, 22 nt, Neisseria meningitidis Z2491
ccgaaugaugccgugccggcgg

SEQ ID NO: 1392611 - RNA, 18 nt, Neisseria meningitidis Z2491
ccgaaugauucauaaaau

SEQ ID NO: 1392612 - RNA, 20 nt, Neisseria meningitidis Z2491
ccgacaaaucgguacgcagc

SEQ ID NO: 1392613 - RNA, 20 nt, Neisseria meningitidis Z2491
ccgaagguaugcgaugcgcc

SEQ ID NO: 1392614 - RNA, 14 nt, Neisseria meningitidis Z2491
ccgaaguuuaaaga

SEQ ID NO: 1392615 - RNA, 17 nt, Neisseria meningitidis Z2491
aaacaucugauuuuucu

SEQ ID NO: 1392616 - RNA, 22 nt, Neisseria meningitidis Z2491
aaacauaaaaugccgucugaaa

SEQ ID NO: 1392617 - RNA, 13 nt, Neisseria meningitidis Z2491
ccgaaaucaucca

SEQ ID NO: 1392618 - RNA, 16 nt, Neisseria meningitidis Z2491
ccgaaaucauccacag

SEQ ID NO: 1392619 - RNA, 18 nt, Neisseria meningitidis Z2491
ccgaaaucauccacagcc

SEQ ID NO: 1392620 - RNA, 15 nt, Neisseria meningitidis Z2491
ccgaacaccagugcg

SEQ ID NO: 1392621 - RNA, 16 nt, Neisseria meningitidis Z2491
ccgaacaccagugcga

SEQ ID NO: 1392622 - RNA, 16 nt, Neisseria meningitidis Z2491
cccuuuuguaaaggaa

SEQ ID NO: 1392623 - RNA, 21 nt, Neisseria meningitidis Z2491
aaacagacauugcuaaaacaa

SEQ ID NO: 1392624 - RNA, 20 nt, Neisseria meningitidis Z2491
cccuguuucgggcaaaagcc

SEQ ID NO: 1392625 - RNA, 23 nt, Neisseria meningitidis Z2491
cccuguuucgggcaaaagccagc

SEQ ID NO: 1392626 - RNA, 16 nt, Neisseria meningitidis Z2491
cccuugcaaauaauug

SEQ ID NO: 1392627 - RNA, 18 nt, Neisseria meningitidis Z2491
aaacagaaacccaaaauc

SEQ ID NO: 1392628 - RNA, 20 nt, Neisseria meningitidis Z2491
aaacagaaacccaaaaucgg

SEQ ID NO: 1392629 - RNA, 17 nt, Neisseria meningitidis Z2491
aaacagaaaaacaaugc

SEQ ID NO: 1392630 - RNA, 13 nt, Neisseria meningitidis Z2491
aaacacuguucag

SEQ ID NO: 1392631 - RNA, 19 nt, Neisseria meningitidis Z2491
ccgacggcguaauccgccu

SEQ ID NO: 1392632 - RNA, 23 nt, Neisseria meningitidis Z2491
ccgacggcguaauccgccugcgc

SEQ ID NO: 1392633 - RNA, 21 nt, Neisseria meningitidis Z2491
ccgacuggauggcgcguuuga

SEQ ID NO: 1392634 - RNA, 19 nt, Neisseria meningitidis Z2491
ccgauaaauuccuaaaacu

SEQ ID NO: 1392635 - RNA, 23 nt, Neisseria meningitidis Z2491
ccgauaauaauccuucagcucuc

SEQ ID NO: 1392636 - RNA, 16 nt, Neisseria meningitidis Z2491
ccgaggcuguggagca

SEQ ID NO: 1392637 - RNA, 15 nt, Neisseria meningitidis Z2491
ccgauggauuuuuuu

SEQ ID NO: 1392638 - RNA, 18 nt, Neisseria meningitidis Z2491
ccgcaaagucauauuaau

SEQ ID NO: 1392639 - RNA, 20 nt, Neisseria meningitidis Z2491
ccgcaacgguuuuaccgcuu

SEQ ID NO: 1392640 - RNA, 15 nt, Neisseria meningitidis Z2491
ccgcagcaaaauaug

SEQ ID NO: 1392641 - RNA, 23 nt, Neisseria meningitidis Z2491
ccgauacgcucggcguuuuucag

SEQ ID NO: 1392642 - RNA, 13 nt, Neisseria meningitidis Z2491
cccgcgcaggcgg

SEQ ID NO: 1392643 - RNA, 21 nt, Neisseria meningitidis Z2491
cccgcgcaggcgggaauccag

SEQ ID NO: 1392644 - RNA, 23 nt, Neisseria meningitidis Z2491
cccgcgcaggcgguggcgagcca

SEQ ID NO: 1392645 - RNA, 17 nt, Neisseria meningitidis Z2491
cccgcgagaacagaaaa

SEQ ID NO: 1392646 - RNA, 16 nt, Neisseria meningitidis Z2491
cccgcuuuugcgggaa

SEQ ID NO: 1392647 - RNA, 11 nt, Neisseria meningitidis Z2491
cccccgcgcag

SEQ ID NO: 1392648 - RNA, 15 nt, Neisseria meningitidis Z2491
cccauugccacgccg

SEQ ID NO: 1392649 - RNA, 19 nt, Neisseria meningitidis Z2491
ccccacugccagccgccga

SEQ ID NO: 1392650 - RNA, 16 nt, Neisseria meningitidis Z2491
cccgcgaaagcgggaa

SEQ ID NO: 1392651 - RNA, 18 nt, Neisseria meningitidis Z2491
cccgcgaaagcgggaauc

SEQ ID NO: 1392652 - RNA, 16 nt, Neisseria meningitidis Z2491
cccgccugcgcgggaa

SEQ ID NO: 1392653 - RNA, 16 nt, Neisseria meningitidis Z2491
cccgccuacgcgggaa

SEQ ID NO: 1392654 - RNA, 15 nt, Neisseria meningitidis Z2491
ccccucaacacacca

SEQ ID NO: 1392655 - RNA, 15 nt, Neisseria meningitidis Z2491
cccgaaccaaaccgu

SEQ ID NO: 1392656 - RNA, 19 nt, Neisseria meningitidis Z2491
ccccuuaugccuuuuucaa

SEQ ID NO: 1392657 - RNA, 22 nt, Neisseria meningitidis Z2491
ccccuguaaacagauaaaacca

SEQ ID NO: 1392658 - RNA, 18 nt, Neisseria meningitidis Z2491
ccccguuaacggcgcaac

SEQ ID NO: 1392659 - RNA, 11 nt, Neisseria meningitidis Z2491
ccccguucccu

SEQ ID NO: 1392660 - RNA, 17 nt, Neisseria meningitidis Z2491
ccccguucccuguacca

SEQ ID NO: 1392661 - RNA, 17 nt, Neisseria meningitidis Z2491
cccgagaaaacagaaag

SEQ ID NO: 1392662 - RNA, 16 nt, Neisseria meningitidis Z2491
cccgagauuacagaaa

SEQ ID NO: 1392663 - RNA, 21 nt, Neisseria meningitidis Z2491
cccgaauccacgcucaaacac

SEQ ID NO: 1392664 - RNA, 18 nt, Neisseria meningitidis Z2491
cccgacgcuugucccaca

SEQ ID NO: 1392665 - RNA, 16 nt, Neisseria meningitidis Z2491
cccgacaaaauaccgu

SEQ ID NO: 1392666 - RNA, 22 nt, Neisseria meningitidis Z2491
ccauuauuuucacaaaaacaga

SEQ ID NO: 1392667 - RNA, 18 nt, Neisseria meningitidis Z2491
ccauugacaacgcagccc

SEQ ID NO: 1392668 - RNA, 20 nt, Neisseria meningitidis Z2491
ccauuguguuuuccuugugu

SEQ ID NO: 1392669 - RNA, 11 nt, Neisseria meningitidis Z2491
ccauuguuucu

SEQ ID NO: 1392670 - RNA, 13 nt, Neisseria meningitidis Z2491
ccauuguuucuga

SEQ ID NO: 1392671 - RNA, 19 nt, Neisseria meningitidis Z2491
cccaaugacugcccguccc

SEQ ID NO: 1392672 - RNA, 17 nt, Neisseria meningitidis Z2491
cccaaugccgucugaau

SEQ ID NO: 1392673 - RNA, 20 nt, Neisseria meningitidis Z2491
cccaaugcggcggacgcggc

SEQ ID NO: 1392674 - RNA, 17 nt, Neisseria meningitidis Z2491
cccaaugcuucaaccac

SEQ ID NO: 1392675 - RNA, 17 nt, Neisseria meningitidis Z2491
cccacaaauccugcugc

SEQ ID NO: 1392676 - RNA, 22 nt, Neisseria meningitidis Z2491
cccaauguuucaacgccucgcc

SEQ ID NO: 1392677 - RNA, 23 nt, Neisseria meningitidis Z2491
cccaaacaucgcucaaauucugu

SEQ ID NO: 1392678 - RNA, 11 nt, Neisseria meningitidis Z2491
cccaaacacag

SEQ ID NO: 1392679 - RNA, 15 nt, Neisseria meningitidis Z2491
ccauuuccaaaccca

SEQ ID NO: 1392680 - RNA, 16 nt, Neisseria meningitidis Z2491
cccacgcaggcgggaa

SEQ ID NO: 1392681 - RNA, 18 nt, Neisseria meningitidis Z2491
cccacuuccgugggaaug

SEQ ID NO: 1392682 - RNA, 15 nt, Neisseria meningitidis Z2491
cccaccguuucccau

SEQ ID NO: 1392683 - RNA, 20 nt, Neisseria meningitidis Z2491
cccaccguuucccauccuuc

SEQ ID NO: 1392684 - RNA, 16 nt, Neisseria meningitidis Z2491
cccacgaaagugggaa

SEQ ID NO: 1392685 - RNA, 15 nt, Neisseria meningitidis Z2491
ccaucccaaaaacga

SEQ ID NO: 1392686 - RNA, 21 nt, Neisseria meningitidis Z2491
ccaucccauauuccacaguga

SEQ ID NO: 1392687 - RNA, 19 nt, Neisseria meningitidis Z2491
aaacaagcgauuauuuuuu

SEQ ID NO: 1392688 - RNA, 21 nt, Neisseria meningitidis Z2491
aaacaagcgauuauuuuuuag

SEQ ID NO: 1392689 - RNA, 13 nt, Neisseria meningitidis Z2491
ccaucagcacgcc

SEQ ID NO: 1392690 - RNA, 17 nt, Neisseria meningitidis Z2491
ccaucgagcugccuuuu

SEQ ID NO: 1392691 - RNA, 18 nt, Neisseria meningitidis Z2491
ccaucuacaaaauaaucu

SEQ ID NO: 1392692 - RNA, 22 nt, Neisseria meningitidis Z2491
ccaguuuguucaggaaggacug

SEQ ID NO: 1392693 - RNA, 23 nt, Neisseria meningitidis Z2491
ccauaaggcuuuaagcaaucauc

SEQ ID NO: 1392694 - RNA, 19 nt, Neisseria meningitidis Z2491
ccauagauaaauuucagau

SEQ ID NO: 1392695 - RNA, 23 nt, Neisseria meningitidis Z2491
ccauacuacgcggcugaaaaaau

SEQ ID NO: 1392696 - RNA, 20 nt, Neisseria meningitidis Z2491
ccagcgcgaugucgcugccc

SEQ ID NO: 1392697 - RNA, 19 nt, Neisseria meningitidis Z2491
ccagcgugcggacguucaa

SEQ ID NO: 1392698 - RNA, 22 nt, Neisseria meningitidis Z2491
ccagcgcaccguuuucaagccu

SEQ ID NO: 1392699 - RNA, 16 nt, Neisseria meningitidis Z2491
ccagcuuuaaggcuuc

SEQ ID NO: 1392700 - RNA, 20 nt, Neisseria meningitidis Z2491
cauuucuggauucccacuuu

SEQ ID NO: 1392701 - RNA, 10 nt, Neisseria meningitidis Z2491
cauuucugau

SEQ ID NO: 1392702 - RNA, 13 nt, Neisseria meningitidis Z2491
cauuucugauaaa

SEQ ID NO: 1392703 - RNA, 22 nt, Neisseria meningitidis Z2491
cauuucugauaaacccccguca

SEQ ID NO: 1392704 - RNA, 16 nt, Neisseria meningitidis Z2491
cauuucuaauuuuuau

SEQ ID NO: 1392705 - RNA, 23 nt, Neisseria meningitidis Z2491
cauuucuagauucccacuuuugu

SEQ ID NO: 1392706 - RNA, 14 nt, Neisseria meningitidis Z2491
cauuugagccgcac

SEQ ID NO: 1392707 - RNA, 20 nt, Neisseria meningitidis Z2491
cauuugacuugaaggcgugu

SEQ ID NO: 1392708 - RNA, 19 nt, Neisseria meningitidis Z2491
cauuugcacacguuugccg

SEQ ID NO: 1392709 - RNA, 13 nt, Neisseria meningitidis Z2491
cauuuggcagcug

SEQ ID NO: 1392710 - RNA, 15 nt, Neisseria meningitidis Z2491
cauuuguuccaauuc

SEQ ID NO: 1392711 - RNA, 15 nt, Neisseria meningitidis Z2491
cauuuccacaaaaaa

SEQ ID NO: 1392712 - RNA, 18 nt, Neisseria meningitidis Z2491
cauuuccacaucguucaa

SEQ ID NO: 1392713 - RNA, 23 nt, Neisseria meningitidis Z2491
cauuuccaaacccaaugcuucaa

SEQ ID NO: 1392714 - RNA, 19 nt, Neisseria meningitidis Z2491
cauuucauuauccgcccgu

SEQ ID NO: 1392715 - RNA, 18 nt, Neisseria meningitidis Z2491
cauuucauuuauuucuug

SEQ ID NO: 1392716 - RNA, 19 nt, Neisseria meningitidis Z2491
cauuuccgauaaauuccug

SEQ ID NO: 1392717 - RNA, 17 nt, Neisseria meningitidis Z2491
cauuuccgauaaauucu

SEQ ID NO: 1392718 - RNA, 18 nt, Neisseria meningitidis Z2491
cauuuaucggaaaagcag

SEQ ID NO: 1392719 - RNA, 22 nt, Neisseria meningitidis Z2491
cauuuaucgggagcaacagaaa

SEQ ID NO: 1392720 - RNA, 22 nt, Neisseria meningitidis Z2491
cauuuauaguggauuaacaaaa

SEQ ID NO: 1392721 - RNA, 23 nt, Neisseria meningitidis Z2491
cauuuauaguggauuaacaaaaa

SEQ ID NO: 1392722 - RNA, 16 nt, Neisseria meningitidis Z2491
cauuguuaaguauuuc

SEQ ID NO: 1392723 - RNA, 23 nt, Neisseria meningitidis Z2491
cauuguuaaguauuucuauuuuu

SEQ ID NO: 1392724 - RNA, 18 nt, Neisseria meningitidis Z2491
cauuguuggaaauggagu

SEQ ID NO: 1392725 - RNA, 15 nt, Neisseria meningitidis Z2491
cauuguuguuuuuug

SEQ ID NO: 1392726 - RNA, 15 nt, Neisseria meningitidis Z2491
cauuguuuccgcuuc

SEQ ID NO: 1392727 - RNA, 13 nt, Neisseria meningitidis Z2491
cauugccacgccg

SEQ ID NO: 1392728 - RNA, 16 nt, Neisseria meningitidis Z2491
cauugcgggaauagcu

SEQ ID NO: 1392729 - RNA, 18 nt, Neisseria meningitidis Z2491
cauugcgggaauagcuca

SEQ ID NO: 1392730 - RNA, 21 nt, Neisseria meningitidis Z2491
cauugccgcccguuuaaacac

SEQ ID NO: 1392731 - RNA, 21 nt, Neisseria meningitidis Z2491
cauuggacagcggcaauauuc

SEQ ID NO: 1392732 - RNA, 20 nt, Neisseria meningitidis Z2491
cauuggaagaagauuuuugu

SEQ ID NO: 1392733 - RNA, 16 nt, Neisseria meningitidis Z2491
cauuccuguaaaaaca

SEQ ID NO: 1392734 - RNA, 17 nt, Neisseria meningitidis Z2491
cauuccuguaaaaacaa

SEQ ID NO: 1392735 - RNA, 20 nt, Neisseria meningitidis Z2491
cauuccuguaaaaacaaaaa

SEQ ID NO: 1392736 - RNA, 22 nt, Neisseria meningitidis Z2491
cauuccguuaucccauaaaaac

SEQ ID NO: 1392737 - RNA, 23 nt, Neisseria meningitidis Z2491
cauuauuuuucauuuuuggcuug

SEQ ID NO: 1392738 - RNA, 21 nt, Neisseria meningitidis Z2491
cauuacugaaauggguaaguc

SEQ ID NO: 1392739 - RNA, 23 nt, Neisseria meningitidis Z2491
caugucgcgggcggugcgcggca

SEQ ID NO: 1392740 - RNA, 23 nt, Neisseria meningitidis Z2491
caucuucgaggaacaaaaugccg

SEQ ID NO: 1392741 - RNA, 21 nt, Neisseria meningitidis Z2491
caugcuuaaacagcacugccu

SEQ ID NO: 1392742 - RNA, 23 nt, Neisseria meningitidis Z2491
caugcuuaaacagcacugccucu

SEQ ID NO: 1392743 - RNA, 17 nt, Neisseria meningitidis Z2491
cauggacauucucuugg

SEQ ID NO: 1392744 - RNA, 21 nt, Neisseria meningitidis Z2491
cauggacauucucuuggucaa

SEQ ID NO: 1392745 - RNA, 23 nt, Neisseria meningitidis Z2491
cauggcuucuuugcuggaagcau

SEQ ID NO: 1392746 - RNA, 17 nt, Neisseria meningitidis Z2491
cauggcguucaacacgu

SEQ ID NO: 1392747 - RNA, 23 nt, Neisseria meningitidis Z2491
caugucggguucggauauuuccg

SEQ ID NO: 1392748 - RNA, 12 nt, Neisseria meningitidis Z2491
ccacggaagugg

SEQ ID NO: 1392749 - RNA, 13 nt, Neisseria meningitidis Z2491
ccacgcucaaaca

SEQ ID NO: 1392750 - RNA, 17 nt, Neisseria meningitidis Z2491
ccacgcccgcaucuuuu

SEQ ID NO: 1392751 - RNA, 19 nt, Neisseria meningitidis Z2491
ccacgcccucggcggcggc

SEQ ID NO: 1392752 - RNA, 18 nt, Neisseria meningitidis Z2491
ccacgccgacugccgccg

SEQ ID NO: 1392753 - RNA, 13 nt, Neisseria meningitidis Z2491
ccacuauaacagc

SEQ ID NO: 1392754 - RNA, 22 nt, Neisseria meningitidis Z2491
ccacuauacaucccgucauucc

SEQ ID NO: 1392755 - RNA, 15 nt, Neisseria meningitidis Z2491
ccacuauacuguaau

SEQ ID NO: 1392756 - RNA, 23 nt, Neisseria meningitidis Z2491
ccacggggugcggguggcgaagc

SEQ ID NO: 1392757 - RNA, 22 nt, Neisseria meningitidis Z2491
ccaccauuguuuccgcuuccau

SEQ ID NO: 1392758 - RNA, 22 nt, Neisseria meningitidis Z2491
ccaccugaacggcacaaacgcc

SEQ ID NO: 1392759 - RNA, 23 nt, Neisseria meningitidis Z2491
ccaccugaacggcacaaacgcca

SEQ ID NO: 1392760 - RNA, 17 nt, Neisseria meningitidis Z2491
ccaccgccaucaggaau

SEQ ID NO: 1392761 - RNA, 13 nt, Neisseria meningitidis Z2491
ccaaugcuucaac

SEQ ID NO: 1392762 - RNA, 15 nt, Neisseria meningitidis Z2491
ccaaugcuucaacca

SEQ ID NO: 1392763 - RNA, 15 nt, Neisseria meningitidis Z2491
ccaaucucuuaacca

SEQ ID NO: 1392764 - RNA, 13 nt, Neisseria meningitidis Z2491
ccaauauucauac

SEQ ID NO: 1392765 - RNA, 17 nt, Neisseria meningitidis Z2491
ccaauacggcgguauug

SEQ ID NO: 1392766 - RNA, 14 nt, Neisseria meningitidis Z2491
ccaauacggcgaga

SEQ ID NO: 1392767 - RNA, 15 nt, Neisseria meningitidis Z2491
ccaauaccaacaccu

SEQ ID NO: 1392768 - RNA, 22 nt, Neisseria meningitidis Z2491
ccaacgccgccgacauccccca

SEQ ID NO: 1392769 - RNA, 18 nt, Neisseria meningitidis Z2491
cauuuucaaaaugcaaaa

SEQ ID NO: 1392770 - RNA, 21 nt, Neisseria meningitidis Z2491
cauuuucaacagcaggaacga

SEQ ID NO: 1392771 - RNA, 22 nt, Neisseria meningitidis Z2491
ccaaaucaggguaaacagggcu

SEQ ID NO: 1392772 - RNA, 16 nt, Neisseria meningitidis Z2491
ccaaauauuuccugca

SEQ ID NO: 1392773 - RNA, 13 nt, Neisseria meningitidis Z2491
ccaaagugccaaa

SEQ ID NO: 1392774 - RNA, 17 nt, Neisseria meningitidis Z2491
ccaaaucggcaaugcgc

SEQ ID NO: 1392775 - RNA, 17 nt, Neisseria meningitidis Z2491
ccaaaucggcuuucaga

SEQ ID NO: 1392776 - RNA, 20 nt, Neisseria meningitidis Z2491
ccaacaauauaucgaacagc

SEQ ID NO: 1392777 - RNA, 15 nt, Neisseria meningitidis Z2491
ccaacaggcgggcgu

SEQ ID NO: 1392778 - RNA, 17 nt, Neisseria meningitidis Z2491
ccaacaggguuccgaaa

SEQ ID NO: 1392779 - RNA, 13 nt, Neisseria meningitidis Z2491
caucuucaaagga

SEQ ID NO: 1392780 - RNA, 22 nt, Neisseria meningitidis Z2491
caucucuggcaaugucuucaua

SEQ ID NO: 1392781 - RNA, 21 nt, Neisseria meningitidis Z2491
caucguauuggggcaaagcgg

SEQ ID NO: 1392782 - RNA, 22 nt, Neisseria meningitidis Z2491
caucguaugaaacaauccgccc

SEQ ID NO: 1392783 - RNA, 12 nt, Neisseria meningitidis Z2491
caucguaaggcu

SEQ ID NO: 1392784 - RNA, 23 nt, Neisseria meningitidis Z2491
caucguaaaaaugccgucugaaa

SEQ ID NO: 1392785 - RNA, 13 nt, Neisseria meningitidis Z2491
caucuaaauguuu

SEQ ID NO: 1392786 - RNA, 19 nt, Neisseria meningitidis Z2491
cauccgggcugcuuuuuag

SEQ ID NO: 1392787 - RNA, 15 nt, Neisseria meningitidis Z2491
cauccuaaaaauuua

SEQ ID NO: 1392788 - RNA, 12 nt, Neisseria meningitidis Z2491
caucauucccac

SEQ ID NO: 1392789 - RNA, 18 nt, Neisseria meningitidis Z2491
cauccgcuuaaaaaacaa

SEQ ID NO: 1392790 - RNA, 14 nt, Neisseria meningitidis Z2491
cauccgacaggcaa

SEQ ID NO: 1392791 - RNA, 16 nt, Neisseria meningitidis Z2491
caucgccgcuucaucu

SEQ ID NO: 1392792 - RNA, 18 nt, Neisseria meningitidis Z2491
caucgccgcaccccgacc

SEQ ID NO: 1392793 - RNA, 20 nt, Neisseria meningitidis Z2491
caucaggcggcguucuucuu

SEQ ID NO: 1392794 - RNA, 21 nt, Neisseria meningitidis Z2491
caucauccugcuuuaauucuc

SEQ ID NO: 1392795 - RNA, 13 nt, Neisseria meningitidis Z2491
caucaucacgcug

SEQ ID NO: 1392796 - RNA, 15 nt, Neisseria meningitidis Z2491
caucaggaaugcaaa

SEQ ID NO: 1392797 - RNA, 16 nt, Neisseria meningitidis Z2491
caucaaaaaggcuuug

SEQ ID NO: 1392798 - RNA, 12 nt, Neisseria meningitidis Z2491
caucaaaaugac

SEQ ID NO: 1392799 - RNA, 15 nt, Neisseria meningitidis Z2491
cauaugccgucugaa

SEQ ID NO: 1392800 - RNA, 17 nt, Neisseria meningitidis Z2491
cauaugccgucugaaga

SEQ ID NO: 1392801 - RNA, 18 nt, Neisseria meningitidis Z2491
cauaucgucgggcugcca

SEQ ID NO: 1392802 - RNA, 11 nt, Neisseria meningitidis Z2491
cauaucauuua

SEQ ID NO: 1392803 - RNA, 21 nt, Neisseria meningitidis Z2491
cauaagccgccaucaaagccc

SEQ ID NO: 1392804 - RNA, 15 nt, Neisseria meningitidis Z2491
cauaaccgaaaccug

SEQ ID NO: 1392805 - RNA, 17 nt, Neisseria meningitidis Z2491
cauaaauuuuaaauaaa

SEQ ID NO: 1392806 - RNA, 18 nt, Neisseria meningitidis Z2491
cauaaauuuuaaauaaau

SEQ ID NO: 1392807 - RNA, 13 nt, Neisseria meningitidis Z2491
cauaacacaccca

SEQ ID NO: 1392808 - RNA, 15 nt, Neisseria meningitidis Z2491
cauaaagagcaggac

SEQ ID NO: 1392809 - RNA, 20 nt, Neisseria meningitidis Z2491
cauaaaauaugccgucugaa

SEQ ID NO: 1392810 - RNA, 21 nt, Neisseria meningitidis Z2491
cauaaaaaugcgccaaaaaau

SEQ ID NO: 1392811 - RNA, 22 nt, Neisseria meningitidis Z2491
cauaaaugcguuuugacaaaau

SEQ ID NO: 1392812 - RNA, 17 nt, Neisseria meningitidis Z2491
cauaaaugccgucugaa

SEQ ID NO: 1392813 - RNA, 16 nt, Neisseria meningitidis Z2491
cauaaaucaacagcag

SEQ ID NO: 1392814 - RNA, 19 nt, Neisseria meningitidis Z2491
cauaaaucaacagcagaau

SEQ ID NO: 1392815 - RNA, 14 nt, Neisseria meningitidis Z2491
cauaaauccuucac

SEQ ID NO: 1392816 - RNA, 22 nt, Neisseria meningitidis Z2491
cauaaguuucccgaaauuccaa

SEQ ID NO: 1392817 - RNA, 12 nt, Neisseria meningitidis Z2491
cauaauaaaaau

SEQ ID NO: 1392818 - RNA, 18 nt, Neisseria meningitidis Z2491
cauaaucaauuaaaaaca

SEQ ID NO: 1392819 - RNA, 19 nt, Neisseria meningitidis Z2491
cauaaucaauuaaaaacaa

SEQ ID NO: 1392820 - RNA, 20 nt, Neisseria meningitidis Z2491
cauaaucaauuaaaaacaaa

SEQ ID NO: 1392821 - RNA, 22 nt, Neisseria meningitidis Z2491
cauaaucaauuaaaaacaaaau

SEQ ID NO: 1392822 - RNA, 20 nt, Neisseria meningitidis Z2491
cauaaucagcccgaaauaac

SEQ ID NO: 1392823 - RNA, 24 nt, Neisseria meningitidis Z2491
cauaaucagcccgaaauaacucau

SEQ ID NO: 1392824 - RNA, 21 nt, Neisseria meningitidis Z2491
cauacaaacaggcuucagacg

SEQ ID NO: 1392825 - RNA, 22 nt, Neisseria meningitidis Z2491
cauaaucugcggcaguuuuucu

SEQ ID NO: 1392826 - RNA, 17 nt, Neisseria meningitidis Z2491
cauacacagccaaaaaa

SEQ ID NO: 1392827 - RNA, 19 nt, Neisseria meningitidis Z2491
cauaccucccaauccugca

SEQ ID NO: 1392828 - RNA, 20 nt, Neisseria meningitidis Z2491
cauaccguugcgugucuucg

SEQ ID NO: 1392829 - RNA, 16 nt, Neisseria meningitidis Z2491
cauaccccacugccag

SEQ ID NO: 1392830 - RNA, 20 nt, Neisseria meningitidis Z2491
cauaccgccccuaaaaugcc

SEQ ID NO: 1392831 - RNA, 21 nt, Neisseria meningitidis Z2491
cauaccgccccuaaaaugccc

SEQ ID NO: 1392832 - RNA, 15 nt, Neisseria meningitidis Z2491
cauaccgaccgcaag

SEQ ID NO: 1392833 - RNA, 17 nt, Neisseria meningitidis Z2491
caguuucuugaguuuca

SEQ ID NO: 1392834 - RNA, 12 nt, Neisseria meningitidis Z2491
caguuuuugucu

SEQ ID NO: 1392835 - RNA, 22 nt, Neisseria meningitidis Z2491
caguuuuugucuuggucaacca

SEQ ID NO: 1392836 - RNA, 16 nt, Neisseria meningitidis Z2491
caguuuuuucagcggc

SEQ ID NO: 1392837 - RNA, 18 nt, Neisseria meningitidis Z2491
caguugggaaucaaauac

SEQ ID NO: 1392838 - RNA, 22 nt, Neisseria meningitidis Z2491
caguugguuugaaccagggauu

SEQ ID NO: 1392839 - RNA, 20 nt, Neisseria meningitidis Z2491
caguuucagagccucuucgc

SEQ ID NO: 1392840 - RNA, 16 nt, Neisseria meningitidis Z2491
caguuuccaauacaac

SEQ ID NO: 1392841 - RNA, 19 nt, Neisseria meningitidis Z2491
caguuuccaauacaacaaa

SEQ ID NO: 1392842 - RNA, 19 nt, Neisseria meningitidis Z2491
caguuucggucauuuccga

SEQ ID NO: 1392843 - RNA, 16 nt, Neisseria meningitidis Z2491
caguuccaucgcgucu

SEQ ID NO: 1392844 - RNA, 21 nt, Neisseria meningitidis Z2491
caguucuacacccaaauccgc

SEQ ID NO: 1392845 - RNA, 17 nt, Neisseria meningitidis Z2491
caguucgucgaaacggc

SEQ ID NO: 1392846 - RNA, 20 nt, Neisseria meningitidis Z2491
caguucuuugauguugugua

SEQ ID NO: 1392847 - RNA, 12 nt, Neisseria meningitidis Z2491
caguuggaacag

SEQ ID NO: 1392848 - RNA, 13 nt, Neisseria meningitidis Z2491
caguuggaacagc

SEQ ID NO: 1392849 - RNA, 16 nt, Neisseria meningitidis Z2491
caguuccaaagccuuc

SEQ ID NO: 1392850 - RNA, 22 nt, Neisseria meningitidis Z2491
caguguugcgucgaaguggcug

SEQ ID NO: 1392851 - RNA, 18 nt, Neisseria meningitidis Z2491
caguguuucagacggccu

SEQ ID NO: 1392852 - RNA, 18 nt, Neisseria meningitidis Z2491
cagugccagcgucaacac

SEQ ID NO: 1392853 - RNA, 19 nt, Neisseria meningitidis Z2491
cagugccgcaccaccagcc

SEQ ID NO: 1392854 - RNA, 14 nt, Neisseria meningitidis Z2491
cagcaauaaaauaa

SEQ ID NO: 1392855 - RNA, 15 nt, Neisseria meningitidis Z2491
cagcaauaaaauaaa

SEQ ID NO: 1392856 - RNA, 19 nt, Neisseria meningitidis Z2491
cagcaauaaaauaaagucc

SEQ ID NO: 1392857 - RNA, 20 nt, Neisseria meningitidis Z2491
aaaaugccguccgaaagguu

SEQ ID NO: 1392858 - RNA, 18 nt, Neisseria meningitidis Z2491
aaaaugccguccgaacag

SEQ ID NO: 1392859 - RNA, 13 nt, Neisseria meningitidis Z2491
aaaaugccgucug

SEQ ID NO: 1392860 - RNA, 15 nt, Neisseria meningitidis Z2491
aaaaugccgucugaa

SEQ ID NO: 1392861 - RNA, 16 nt, Neisseria meningitidis Z2491
aaaaugccgucugaaa

SEQ ID NO: 1392862 - RNA, 20 nt, Neisseria meningitidis Z2491
aaaaugccgucugaaaaccu

SEQ ID NO: 1392863 - RNA, 22 nt, Neisseria meningitidis Z2491
aaaaugccgucugaaacgcauu

SEQ ID NO: 1392864 - RNA, 21 nt, Neisseria meningitidis Z2491
aaaaugacugaagcucaaaaa

SEQ ID NO: 1392865 - RNA, 14 nt, Neisseria meningitidis Z2491
aaaaugcaaaacuu

SEQ ID NO: 1392866 - RNA, 14 nt, Neisseria meningitidis Z2491
aaaaucuauagugg

SEQ ID NO: 1392867 - RNA, 16 nt, Neisseria meningitidis Z2491
aaaaucucaagaaacc

SEQ ID NO: 1392868 - RNA, 15 nt, Neisseria meningitidis Z2491
cagauugauaaaagc

SEQ ID NO: 1392869 - RNA, 12 nt, Neisseria meningitidis Z2491
cagauugaggau

SEQ ID NO: 1392870 - RNA, 17 nt, Neisseria meningitidis Z2491
cagauuuuggagcagua

SEQ ID NO: 1392871 - RNA, 16 nt, Neisseria meningitidis Z2491
cagcagcagcccgaac

SEQ ID NO: 1392872 - RNA, 12 nt, Neisseria meningitidis Z2491
cagcagcagccc

SEQ ID NO: 1392873 - RNA, 22 nt, Neisseria meningitidis Z2491
cagcagcaacacauugccaccg

SEQ ID NO: 1392874 - RNA, 19 nt, Neisseria meningitidis Z2491
cagcagaucgaccgcuucc

SEQ ID NO: 1392875 - RNA, 22 nt, Neisseria meningitidis Z2491
cagcacguguuccaaacgccgc

SEQ ID NO: 1392876 - RNA, 13 nt, Neisseria meningitidis Z2491
cagcaccacaccu

SEQ ID NO: 1392877 - RNA, 20 nt, Neisseria meningitidis Z2491
cagcaccguuuaaaacagca

SEQ ID NO: 1392878 - RNA, 13 nt, Neisseria meningitidis Z2491
cagauagcugaac

SEQ ID NO: 1392879 - RNA, 17 nt, Neisseria meningitidis Z2491
cagauagcgcggacggc

SEQ ID NO: 1392880 - RNA, 22 nt, Neisseria meningitidis Z2491
aaaaucacggugaaaaaugaaa

SEQ ID NO: 1392881 - RNA, 18 nt, Neisseria meningitidis Z2491
aaaaucagaaaccuaaaa

SEQ ID NO: 1392882 - RNA, 19 nt, Neisseria meningitidis Z2491
cagagggaaagugauuuug

SEQ ID NO: 1392883 - RNA, 19 nt, Neisseria meningitidis Z2491
cagagcgguuucuguuuuu

SEQ ID NO: 1392884 - RNA, 21 nt, Neisseria meningitidis Z2491
cagacauuaaaaaauacauug

SEQ ID NO: 1392885 - RNA, 18 nt, Neisseria meningitidis Z2491
cagacauugcuaaaacaa

SEQ ID NO: 1392886 - RNA, 19 nt, Neisseria meningitidis Z2491
cagacauugcuaaaacaac

SEQ ID NO: 1392887 - RNA, 17 nt, Neisseria meningitidis Z2491
cagaaucuguugcggcc

SEQ ID NO: 1392888 - RNA, 16 nt, Neisseria meningitidis Z2491
cagaaugauaacccaa

SEQ ID NO: 1392889 - RNA, 18 nt, Neisseria meningitidis Z2491
cagacggccuuuuugcuu

SEQ ID NO: 1392890 - RNA, 15 nt, Neisseria meningitidis Z2491
cagacggcauauuuu

SEQ ID NO: 1392891 - RNA, 18 nt, Neisseria meningitidis Z2491
cagacggcaucaaaaacu

SEQ ID NO: 1392892 - RNA, 14 nt, Neisseria meningitidis Z2491
cagacggcauuucc

SEQ ID NO: 1392893 - RNA, 18 nt, Neisseria meningitidis Z2491
cagacggcauuugaccca

SEQ ID NO: 1392894 - RNA, 23 nt, Neisseria meningitidis Z2491
cagacggcauuugacccauuacu

SEQ ID NO: 1392895 - RNA, 20 nt, Neisseria meningitidis Z2491
cagacggcauuugacuuuca

SEQ ID NO: 1392896 - RNA, 16 nt, Neisseria meningitidis Z2491
cagacggcauuuuccu

SEQ ID NO: 1392897 - RNA, 17 nt, Neisseria meningitidis Z2491
cagacggcauuuuccuu

SEQ ID NO: 1392898 - RNA, 16 nt, Neisseria meningitidis Z2491
cagacggcauuuuugc

SEQ ID NO: 1392899 - RNA, 16 nt, Neisseria meningitidis Z2491
cagacggcauuuuugu

SEQ ID NO: 1392900 - RNA, 20 nt, Neisseria meningitidis Z2491
cagacggcauuuuugugugg

SEQ ID NO: 1392901 - RNA, 18 nt, Neisseria meningitidis Z2491
cagacggcauuuuuuaca

SEQ ID NO: 1392902 - RNA, 12 nt, Neisseria meningitidis Z2491
cagacggccaaa

SEQ ID NO: 1392903 - RNA, 12 nt, Neisseria meningitidis Z2491
cagaccgaugcc

SEQ ID NO: 1392904 - RNA, 14 nt, Neisseria meningitidis Z2491
aaaauauucaauug

SEQ ID NO: 1392905 - RNA, 22 nt, Neisseria meningitidis Z2491
aaaauauucaauugacaaaaac

SEQ ID NO: 1392906 - RNA, 23 nt, Neisseria meningitidis Z2491
aaaauauggcugcuuugguaaaa

SEQ ID NO: 1392907 - RNA, 18 nt, Neisseria meningitidis Z2491
cagaaagcaaaaccgccg

SEQ ID NO: 1392908 - RNA, 18 nt, Neisseria meningitidis Z2491
cagaaaacgccgucugaa

SEQ ID NO: 1392909 - RNA, 15 nt, Neisseria meningitidis Z2491
cagaaaaccaaaaac

SEQ ID NO: 1392910 - RNA, 16 nt, Neisseria meningitidis Z2491
cagaaaaccaaaaaca

SEQ ID NO: 1392911 - RNA, 21 nt, Neisseria meningitidis Z2491
cacuuugcggcagauacaaca

SEQ ID NO: 1392912 - RNA, 19 nt, Neisseria meningitidis Z2491
cagaacguaaaaucugaag

SEQ ID NO: 1392913 - RNA, 21 nt, Neisseria meningitidis Z2491
cagaacguaaaaucugaagaa

SEQ ID NO: 1392914 - RNA, 22 nt, Neisseria meningitidis Z2491
cagaaccuacagauuccgaagg

SEQ ID NO: 1392915 - RNA, 20 nt, Neisseria meningitidis Z2491
cagaacccggcuuaccgccu

SEQ ID NO: 1392916 - RNA, 18 nt, Neisseria meningitidis Z2491
cagaaggggcggaaugcg

SEQ ID NO: 1392917 - RNA, 16 nt, Neisseria meningitidis Z2491
cacuucacauuuucua

SEQ ID NO: 1392918 - RNA, 17 nt, Neisseria meningitidis Z2491
cacuuggaauaugaaua

SEQ ID NO: 1392919 - RNA, 19 nt, Neisseria meningitidis Z2491
cacuuggaauaugaauacg

SEQ ID NO: 1392920 - RNA, 19 nt, Neisseria meningitidis Z2491
cacuuggugcuucagcacc

SEQ ID NO: 1392921 - RNA, 20 nt, Neisseria meningitidis Z2491
cacuuggugcuucagcaccu

SEQ ID NO: 1392922 - RNA, 24 nt, Neisseria meningitidis Z2491
cacuugccgcauaaaucaacagca

SEQ ID NO: 1392923 - RNA, 13 nt, Neisseria meningitidis Z2491
cacugucugcggc

SEQ ID NO: 1392924 - RNA, 12 nt, Neisseria meningitidis Z2491
cacuuaaaaaua

SEQ ID NO: 1392925 - RNA, 20 nt, Neisseria meningitidis Z2491
cacuauaaaaggucuuuucu

SEQ ID NO: 1392926 - RNA, 23 nt, Neisseria meningitidis Z2491
cacuauaauacauugauuuuuau

SEQ ID NO: 1392927 - RNA, 22 nt, Neisseria meningitidis Z2491
cacuauaaugauugacuauuuu

SEQ ID NO: 1392928 - RNA, 14 nt, Neisseria meningitidis Z2491
cacuauaauuuauu

SEQ ID NO: 1392929 - RNA, 14 nt, Neisseria meningitidis Z2491
cacuauacugcuga

SEQ ID NO: 1392930 - RNA, 20 nt, Neisseria meningitidis Z2491
cacuauauuaaggcugcggc

SEQ ID NO: 1392931 - RNA, 16 nt, Neisseria meningitidis Z2491
cacuagccaaaaaaac

SEQ ID NO: 1392932 - RNA, 19 nt, Neisseria meningitidis Z2491
cacuagccaaaaaaaccga

SEQ ID NO: 1392933 - RNA, 15 nt, Neisseria meningitidis Z2491
cacuaguguauuagu

SEQ ID NO: 1392934 - RNA, 16 nt, Neisseria meningitidis Z2491
cacuacuucauuuuuu

SEQ ID NO: 1392935 - RNA, 12 nt, Neisseria meningitidis Z2491
cacucacuuuaa

SEQ ID NO: 1392936 - RNA, 14 nt, Neisseria meningitidis Z2491
cacucacuuuaauc

SEQ ID NO: 1392937 - RNA, 12 nt, Neisseria meningitidis Z2491
cacuaaaaaauc

SEQ ID NO: 1392938 - RNA, 21 nt, Neisseria meningitidis Z2491
cacguuugaguacgucgccuu

SEQ ID NO: 1392939 - RNA, 18 nt, Neisseria meningitidis Z2491
cacguuugccaaggcggc

SEQ ID NO: 1392940 - RNA, 13 nt, Neisseria meningitidis Z2491
cacugcccuuuca

SEQ ID NO: 1392941 - RNA, 18 nt, Neisseria meningitidis Z2491
cagcgugaaaccuuugau

SEQ ID NO: 1392942 - RNA, 16 nt, Neisseria meningitidis Z2491
aaaauuccguuauucc

SEQ ID NO: 1392943 - RNA, 16 nt, Neisseria meningitidis Z2491
cagcguugccucgccu

SEQ ID NO: 1392944 - RNA, 14 nt, Neisseria meningitidis Z2491
aaaauucgucauuc

SEQ ID NO: 1392945 - RNA, 15 nt, Neisseria meningitidis Z2491
aaaauucgucauucc

SEQ ID NO: 1392946 - RNA, 21 nt, Neisseria meningitidis Z2491
cagcggguaggcgggacggcc

SEQ ID NO: 1392947 - RNA, 16 nt, Neisseria meningitidis Z2491
aaaauuaaaguuucag

SEQ ID NO: 1392948 - RNA, 13 nt, Neisseria meningitidis Z2491
cagcccgaaauag

SEQ ID NO: 1392949 - RNA, 15 nt, Neisseria meningitidis Z2491
cagcccgccgcgccc

SEQ ID NO: 1392950 - RNA, 15 nt, Neisseria meningitidis Z2491
cagccaaaauauuca

SEQ ID NO: 1392951 - RNA, 17 nt, Neisseria meningitidis Z2491
cagcagcccuugcccca

SEQ ID NO: 1392952 - RNA, 15 nt, Neisseria meningitidis Z2491
cagcagcccucccca

SEQ ID NO: 1392953 - RNA, 19 nt, Neisseria meningitidis Z2491
cagccaguccggacgguca

SEQ ID NO: 1392954 - RNA, 19 nt, Neisseria meningitidis Z2491
cagccuuucaacacgcccu

SEQ ID NO: 1392955 - RNA, 22 nt, Neisseria meningitidis Z2491
cagccuuaacagggaaagcagc

SEQ ID NO: 1392956 - RNA, 22 nt, Neisseria meningitidis Z2491
cagccuauuuuucugaaaaauu

SEQ ID NO: 1392957 - RNA, 15 nt, Neisseria meningitidis Z2491
caggguuaagaaaac

SEQ ID NO: 1392958 - RNA, 15 nt, Neisseria meningitidis Z2491
caggguuaaggcuua

SEQ ID NO: 1392959 - RNA, 18 nt, Neisseria meningitidis Z2491
cagguaacuuccaaaccg

SEQ ID NO: 1392960 - RNA, 16 nt, Neisseria meningitidis Z2491
cagguagcggcugagg

SEQ ID NO: 1392961 - RNA, 21 nt, Neisseria meningitidis Z2491
aaacaaaaaaaaucaaaaaca

SEQ ID NO: 1392962 - RNA, 12 nt, Neisseria meningitidis Z2491
aaacaaaaaaca

SEQ ID NO: 1392963 - RNA, 12 nt, Neisseria meningitidis Z2491
aaacaaaaauga

SEQ ID NO: 1392964 - RNA, 18 nt, Neisseria meningitidis Z2491
caggggauugccgccccu

SEQ ID NO: 1392965 - RNA, 14 nt, Neisseria meningitidis Z2491
cagggcugcaaaau

SEQ ID NO: 1392966 - RNA, 23 nt, Neisseria meningitidis Z2491
cagggcugcgccuuaugugcggc

SEQ ID NO: 1392967 - RNA, 14 nt, Neisseria meningitidis Z2491
caggcguuuuucag

SEQ ID NO: 1392968 - RNA, 17 nt, Neisseria meningitidis Z2491
caggcguuuuucagacg

SEQ ID NO: 1392969 - RNA, 15 nt, Neisseria meningitidis Z2491
caggcgggaauccaa

SEQ ID NO: 1392970 - RNA, 19 nt, Neisseria meningitidis Z2491
caggcgggaauccagacca

SEQ ID NO: 1392971 - RNA, 21 nt, Neisseria meningitidis Z2491
caggcgggaauccaguccguu

SEQ ID NO: 1392972 - RNA, 14 nt, Neisseria meningitidis Z2491
caggcgggaauccg

SEQ ID NO: 1392973 - RNA, 18 nt, Neisseria meningitidis Z2491
caggcgggaaucuagaca

SEQ ID NO: 1392974 - RNA, 15 nt, Neisseria meningitidis Z2491
cagggaaagcagcag

SEQ ID NO: 1392975 - RNA, 16 nt, Neisseria meningitidis Z2491
cagggaaagcagcagc

SEQ ID NO: 1392976 - RNA, 17 nt, Neisseria meningitidis Z2491
cagggaaagcagcagcc

SEQ ID NO: 1392977 - RNA, 18 nt, Neisseria meningitidis Z2491
cagggaaagcagcagccc

SEQ ID NO: 1392978 - RNA, 15 nt, Neisseria meningitidis Z2491
caggcuuucaccgac

SEQ ID NO: 1392979 - RNA, 16 nt, Neisseria meningitidis Z2491
caggcgcgcaauccgc

SEQ ID NO: 1392980 - RNA, 16 nt, Neisseria meningitidis Z2491
caggcagccuaaaaca

SEQ ID NO: 1392981 - RNA, 18 nt, Neisseria meningitidis Z2491
caggcagggaaacgccuu

SEQ ID NO: 1392982 - RNA, 19 nt, Neisseria meningitidis Z2491
caggcaguuugauaggcaa

SEQ ID NO: 1392983 - RNA, 14 nt, Neisseria meningitidis Z2491
caggauuuucaaau

SEQ ID NO: 1392984 - RNA, 22 nt, Neisseria meningitidis Z2491
caggcaaaugcugucugaaacc

SEQ ID NO: 1392985 - RNA, 21 nt, Neisseria meningitidis Z2491
caggcaaaaaaaauaaccgcu

SEQ ID NO: 1392986 - RNA, 15 nt, Neisseria meningitidis Z2491
caggcacgaagcccu

SEQ ID NO: 1392987 - RNA, 21 nt, Neisseria meningitidis Z2491
caggcacaaggcggcggcaga

SEQ ID NO: 1392988 - RNA, 16 nt, Neisseria meningitidis Z2491
aaaauuuauuuagaaa

SEQ ID NO: 1392989 - RNA, 21 nt, Neisseria meningitidis Z2491
aaaauuuauuuagaaacaacu

SEQ ID NO: 1392990 - RNA, 15 nt, Neisseria meningitidis Z2491
aaaauuucaucauuc

SEQ ID NO: 1392991 - RNA, 15 nt, Neisseria meningitidis Z2491
caggacaaggcaacg

SEQ ID NO: 1392992 - RNA, 14 nt, Neisseria meningitidis Z2491
caggacaaggcgac

SEQ ID NO: 1392993 - RNA, 22 nt, Neisseria meningitidis Z2491
caggacagccccuaaauuuaaa

SEQ ID NO: 1392994 - RNA, 13 nt, Neisseria meningitidis Z2491
caggaauuuaucc

SEQ ID NO: 1392995 - RNA, 23 nt, Neisseria meningitidis Z2491
caggacaaaguuggcaaggaaug

SEQ ID NO: 1392996 - RNA, 15 nt, Neisseria meningitidis Z2491
caggauguuuucggc

SEQ ID NO: 1392997 - RNA, 14 nt, Neisseria meningitidis Z2491
cagcuucgucgccu

SEQ ID NO: 1392998 - RNA, 20 nt, Neisseria meningitidis Z2491
cagcuucgucgccuuguccu

SEQ ID NO: 1392999 - RNA, 10 nt, Neisseria meningitidis Z2491
caggaaucuu

SEQ ID NO: 1393000 - RNA, 22 nt, Neisseria meningitidis Z2491
cagcugaaaacagcugaaaacc

SEQ ID NO: 1393001 - RNA, 15 nt, Neisseria meningitidis Z2491
aaaauugaaauucgu

SEQ ID NO: 1393002 - RNA, 13 nt, Human
uuagaaacacaac

SEQ ID NO: 1393003 - RNA, 21 nt, Human
ugaacuagaguuuagcuggaa

SEQ ID NO: 1393004 - RNA, 15 nt, Human
uccagcugccccggg

SEQ ID NO: 1393005 - RNA, 15 nt, Human
uccagcuggccggga

SEQ ID NO: 1393006 - RNA, 14 nt, Human
ugaaggggcggcgg

SEQ ID NO: 1393007 - RNA, 13 nt, Human
ugaacugcagcga

SEQ ID NO: 1393008 - RNA, 19 nt, Human
uccagggcuacgcgcgcuc

SEQ ID NO: 1393009 - RNA, 14 nt, Human
ucagcccugguggg

SEQ ID NO: 1393010 - RNA, 14 nt, Human
ugcgcgccgcgcuc

SEQ ID NO: 1393011 - RNA, 12 nt, Human
ugcggccugguc

SEQ ID NO: 1393012 - RNA, 22 nt, Human
ugcugguggcgcuggcugcgcu

SEQ ID NO: 1393013 - RNA, 18 nt, Human
ugcucauggaauuggagc

SEQ ID NO: 1393014 - RNA, 15 nt, Human
ugcucgcccacuucc

SEQ ID NO: 1393015 - RNA, 21 nt, Human
ugcagcgaguacuucccgcug

SEQ ID NO: 1393016 - RNA, 11 nt, Human
ugcacaucaaa

SEQ ID NO: 1393017 - RNA, 19 nt, Human
ugcagagaugaggccgcca

SEQ ID NO: 1393018 - RNA, 13 nt, Human
ugccccggggagg

SEQ ID NO: 1393019 - RNA, 22 nt, Human
ugccccggggaggggcgcucgc

SEQ ID NO: 1393020 - RNA, 13 nt, Human
ugccagcuggccu

SEQ ID NO: 1393021 - RNA, 12 nt, Human
uggccuucggcc

SEQ ID NO: 1393022 - RNA, 23 nt, Human
uggcaccgcuguacgcgagcgcg

SEQ ID NO: 1393023 - RNA, 17 nt, Human
uggcugcgcucggccug

SEQ ID NO: 1393024 - RNA, 23 nt, Human
uggcugcgcucggccugcucgcc

SEQ ID NO: 1393025 - RNA, 16 nt, Human
uguuuagaaacacaac

SEQ ID NO: 1393026 - RNA, 19 nt, Human
uggcgcuggcugcgcucgg

SEQ ID NO: 1393027 - RNA, 20 nt, Human
uggcgcuggcugcgcucggc

SEQ ID NO: 1393028 - RNA, 17 nt, Human
uggcgugcagcaucagc

SEQ ID NO: 1393029 - RNA, 14 nt, Human
uggaauuggagcuc

SEQ ID NO: 1393030 - RNA, 16 nt, Human
gccuacuaaaugcuca

SEQ ID NO: 1393031 - RNA, 20 nt, Human
gccuccagcugccccgggga

SEQ ID NO: 1393032 - RNA, 13 nt, Human
gccugcucgccca

SEQ ID NO: 1393033 - RNA, 23 nt, Human
gccugcucgcccacuuccucccg

SEQ ID NO: 1393034 - RNA, 17 nt, Human
gccuaggcauagcccug

SEQ ID NO: 1393035 - RNA, 13 nt, Human
gccggagccucca

SEQ ID NO: 1393036 - RNA, 15 nt, Human
gccggagccuccagc

SEQ ID NO: 1393037 - RNA, 19 nt, Human
gccgggaaagaagagccgg

SEQ ID NO: 1393038 - RNA, 20 nt, Human
gccgggaaagaagagccgga

SEQ ID NO: 1393039 - RNA, 15 nt, Human
gccgacggagccggg

SEQ ID NO: 1393040 - RNA, 16 nt, Human
gccgacggagccggga

SEQ ID NO: 1393041 - RNA, 14 nt, Human
gccgcgcuccucgg

SEQ ID NO: 1393042 - RNA, 19 nt, Human
gccgcgcuccucggacggc

SEQ ID NO: 1393043 - RNA, 13 nt, Human
gccgcgcugcgcg

SEQ ID NO: 1393044 - RNA, 20 nt, Human
gccgcgcugcgcgccgcgcu

SEQ ID NO: 1393045 - RNA, 21 nt, Human
gcgaguacuucccgcuguucc

SEQ ID NO: 1393046 - RNA, 16 nt, Human
gcgcccucuggcugcu

SEQ ID NO: 1393047 - RNA, 19 nt, Human
gcgcccucuggcugcuggu

SEQ ID NO: 1393048 - RNA, 19 nt, Human
gcgccuccgcuacuuccag

SEQ ID NO: 1393049 - RNA, 14 nt, Human
gccuucggccucca

SEQ ID NO: 1393050 - RNA, 22 nt, Human
gcggccuggucuaccuguucgc

SEQ ID NO: 1393051 - RNA, 22 nt, Human
gcgcgcucaucccacccgccca

SEQ ID NO: 1393052 - RNA, 16 nt, Human
gcgcgcuccgcgcagc

SEQ ID NO: 1393053 - RNA, 23 nt, Human
gcgcggcgggagggcgcggggcg

SEQ ID NO: 1393054 - RNA, 16 nt, Human
gcgcucaucccacccg

SEQ ID NO: 1393055 - RNA, 18 nt, Human
gcgcucaucccacccgcc

SEQ ID NO: 1393056 - RNA, 14 nt, Human
gcgcugcgcgccgc

SEQ ID NO: 1393057 - RNA, 20 nt, Human
gcucaucccacccgcccacc

SEQ ID NO: 1393058 - RNA, 21 nt, Human
gcucaucccacccgcccaccg

SEQ ID NO: 1393059 - RNA, 23 nt, Human
gcucaucccacccgcccaccgca

SEQ ID NO: 1393060 - RNA, 15 nt, Human
gcucagcccuggugg

SEQ ID NO: 1393061 - RNA, 13 nt, Human
gcuccagcuggcc

SEQ ID NO: 1393062 - RNA, 22 nt, Human
gcucauggaauuggagcucgug

SEQ ID NO: 1393063 - RNA, 16 nt, Human
gcucugggucgccggc

SEQ ID NO: 1393064 - RNA, 17 nt, Human
gcucugggucgccggca

SEQ ID NO: 1393065 - RNA, 15 nt, Human
gcucucuggccuucg

SEQ ID NO: 1393066 - RNA, 19 nt, Human
gcuccggacgcugcugccg

SEQ ID NO: 1393067 - RNA, 21 nt, Human
gcuccggacgcugcugccgug

SEQ ID NO: 1393068 - RNA, 17 nt, Human
gcuccucggacggcucc

SEQ ID NO: 1393069 - RNA, 14 nt, Human
gcucggccugcucg

SEQ ID NO: 1393070 - RNA, 18 nt, Human
gcucggccugcucgccca

SEQ ID NO: 1393071 - RNA, 13 nt, Human
gcugccccgggga

SEQ ID NO: 1393072 - RNA, 20 nt, Human
gcugccccggggaggggcgc

SEQ ID NO: 1393073 - RNA, 24 nt, Human
gcugccccggggaggggcgcucgc

SEQ ID NO: 1393074 - RNA, 14 nt, Human
guucugcagauaaa

SEQ ID NO: 1393075 - RNA, 14 nt, Human
uaggcauagcccug

SEQ ID NO: 1393076 - RNA, 14 nt, Human
uaguauggcaaacu

SEQ ID NO: 1393077 - RNA, 14 nt, Human
uagagaauuuccuu

SEQ ID NO: 1393078 - RNA, 20 nt, Human
uacuucccgcuguuccucgc

SEQ ID NO: 1393079 - RNA, 17 nt, Human
uaaaguaaaggcaaacu

SEQ ID NO: 1393080 - RNA, 14 nt, Human
ccggacgcugcugc

SEQ ID NO: 1393081 - RNA, 17 nt, Human
ccggagccuccagcugc

SEQ ID NO: 1393082 - RNA, 11 nt, Human
ccggccgcgcu

SEQ ID NO: 1393083 - RNA, 13 nt, Human
ccggccgcgcugc

SEQ ID NO: 1393084 - RNA, 17 nt, Human
ccggccgcgcugcgcgc

SEQ ID NO: 1393085 - RNA, 19 nt, Human
ccggccgcgcugcgcgccg

SEQ ID NO: 1393086 - RNA, 12 nt, Human
ccggccggcgcg

SEQ ID NO: 1393087 - RNA, 14 nt, Human
ccggccggcgcgcu

SEQ ID NO: 1393088 - RNA, 23 nt, Human
ccgggaaagaagagccggagccu

SEQ ID NO: 1393089 - RNA, 13 nt, Human
ccgggaggcagag

SEQ ID NO: 1393090 - RNA, 17 nt, Human
ccgcuguacgcgagcgc

SEQ ID NO: 1393091 - RNA, 20 nt, Human
ccgcuguuccucgccacgcu

SEQ ID NO: 1393092 - RNA, 19 nt, Human
ccgggccgacggagccggg

SEQ ID NO: 1393093 - RNA, 20 nt, Human
ccgggccgacggagccggga

SEQ ID NO: 1393094 - RNA, 21 nt, Human
ccgggccgacggagccgggaa

SEQ ID NO: 1393095 - RNA, 16 nt, Human
cccuugaugaagaagu

SEQ ID NO: 1393096 - RNA, 15 nt, Human
ccgacggagccggga

SEQ ID NO: 1393097 - RNA, 15 nt, Human
ccgcccaccgcaggg

SEQ ID NO: 1393098 - RNA, 17 nt, Human
ccgcgcagcucaggcug

SEQ ID NO: 1393099 - RNA, 13 nt, Human
ccgcgcuccucgg

SEQ ID NO: 1393100 - RNA, 13 nt, Human
ccgcgcugcgcgc

SEQ ID NO: 1393101 - RNA, 23 nt, Human
ccgcgcugcgcgccgcgcuccuc

SEQ ID NO: 1393102 - RNA, 14 nt, Human
ccgcuacuuccagg

SEQ ID NO: 1393103 - RNA, 24 nt, Human
ccucaagcuaugugagcucaccag

SEQ ID NO: 1393104 - RNA, 17 nt, Human
ccguugaacgucacauc

SEQ ID NO: 1393105 - RNA, 15 nt, Human
ccggggaggggcgcu

SEQ ID NO: 1393106 - RNA, 16 nt, Human
ccuccagcugccccgg

SEQ ID NO: 1393107 - RNA, 19 nt, Human
ccucauggaauuggagcuc

SEQ ID NO: 1393108 - RNA, 22 nt, Human
ccucauggaauuggagcucgug

SEQ ID NO: 1393109 - RNA, 23 nt, Human
ccuccuuggagacagggcccugu

SEQ ID NO: 1393110 - RNA, 22 nt, Human
ccucccggccgcgcugcgcgcc

SEQ ID NO: 1393111 - RNA, 15 nt, Human
ccugccccugagccc

SEQ ID NO: 1393112 - RNA, 9 nt, Human
ccugagccc

SEQ ID NO: 1393113 - RNA, 18 nt, Human
ccugagcccauggcacuc

SEQ ID NO: 1393114 - RNA, 19 nt, Human
ccucuggcuccagcuggcc

SEQ ID NO: 1393115 - RNA, 22 nt, Human
ccucuggcugcugguggcgcug

SEQ ID NO: 1393116 - RNA, 23 nt, Human
ccuucggccuccauccugaggcu

SEQ ID NO: 1393117 - RNA, 13 nt, Human
ccuuggggguggu

SEQ ID NO: 1393118 - RNA, 13 nt, Human
ccugcucgcccac

SEQ ID NO: 1393119 - RNA, 14 nt, Human
cgagcgcgcgcgcc

SEQ ID NO: 1393120 - RNA, 15 nt, Human
cgagcgcgcgcgccc

SEQ ID NO: 1393121 - RNA, 20 nt, Human
uuacagagacagaaagcaga

SEQ ID NO: 1393122 - RNA, 12 nt, Human
uuagcuggaaaa

SEQ ID NO: 1393123 - RNA, 21 nt, Human
uuagaugcaguucugaagaag

SEQ ID NO: 1393124 - RNA, 19 nt, Human
uucaugaaggggcggcggc

SEQ ID NO: 1393125 - RNA, 16 nt, Human
cccucuggcuccagcu

SEQ ID NO: 1393126 - RNA, 17 nt, Human
cccugcaaagcccagcu

SEQ ID NO: 1393127 - RNA, 21 nt, Human
cccgggccgacggagccggga

SEQ ID NO: 1393128 - RNA, 13 nt, Human
cccggggaggggc

SEQ ID NO: 1393129 - RNA, 12 nt, Human
uucgcgcgccuc

SEQ ID NO: 1393130 - RNA, 20 nt, Human
uucggccuccauccugaggc

SEQ ID NO: 1393131 - RNA, 13 nt, Human
uucuagugaccga

SEQ ID NO: 1393132 - RNA, 17 nt, Human
uuccagggcuacgcgcg

SEQ ID NO: 1393133 - RNA, 19 nt, Human
uuccagggcuacgcgcgcu

SEQ ID NO: 1393134 - RNA, 12 nt, Human
uugagccaccaa

SEQ ID NO: 1393135 - RNA, 23 nt, Human
cguugagccaccaagcugguggc

SEQ ID NO: 1393136 - RNA, 16 nt, Human
cuaccuguucgcgcgc

SEQ ID NO: 1393137 - RNA, 18 nt, Human
cuaccuguucgcgcgccu

SEQ ID NO: 1393138 - RNA, 22 nt, Human
cuaccuguucgcgcgccuccgc

SEQ ID NO: 1393139 - RNA, 16 nt, Human
cuacuuccagggcuac

SEQ ID NO: 1393140 - RNA, 16 nt, Human
cggcggcccugugcgg

SEQ ID NO: 1393141 - RNA, 18 nt, Human
cggcggcccugugcggcc

SEQ ID NO: 1393142 - RNA, 20 nt, Human
cggcggcccugugcggccug

SEQ ID NO: 1393143 - RNA, 19 nt, Human
cggcgggagggcgcggggc

SEQ ID NO: 1393144 - RNA, 20 nt, Human
cggcgggagggcgcggggcg

SEQ ID NO: 1393145 - RNA, 16 nt, Human
cgggaaagaagagccg

SEQ ID NO: 1393146 - RNA, 13 nt, Human
cgggagggcgcgg

SEQ ID NO: 1393147 - RNA, 18 nt, Human
cgugcuugucccugugga

SEQ ID NO: 1393148 - RNA, 20 nt, Human
cggugagcuacaaaugcauu

SEQ ID NO: 1393149 - RNA, 11 nt, Human
cgggccgacgg

SEQ ID NO: 1393150 - RNA, 12 nt, Human
cgggccgacgga

SEQ ID NO: 1393151 - RNA, 15 nt, Human
cgggccgacggagcc

SEQ ID NO: 1393152 - RNA, 16 nt, Human
cggggaggggcgcucg

SEQ ID NO: 1393153 - RNA, 14 nt, Human
cgcccacuuccucc

SEQ ID NO: 1393154 - RNA, 18 nt, Human
cgcccacuuccucccggc

SEQ ID NO: 1393155 - RNA, 23 nt, Human
cgcccacuuccucccggccgcgc

SEQ ID NO: 1393156 - RNA, 17 nt, Human
cgcagcucaggcuggca

SEQ ID NO: 1393157 - RNA, 19 nt, Human
cgcagcucaggcuggcacc

SEQ ID NO: 1393158 - RNA, 17 nt, Human
cgcgcgccuccgcuacu

SEQ ID NO: 1393159 - RNA, 15 nt, Human
cgcgcgcuccgcgca

SEQ ID NO: 1393160 - RNA, 18 nt, Human
cgcgcucaucccacccgc

SEQ ID NO: 1393161 - RNA, 15 nt, Human
cgcgcuccgcgcagc

SEQ ID NO: 1393162 - RNA, 17 nt, Human
cgcgcuccgcgcagcuc

SEQ ID NO: 1393163 - RNA, 16 nt, Human
cgcgcuccucggacgg

SEQ ID NO: 1393164 - RNA, 17 nt, Human
cgcgcugcgcgccgcgc

SEQ ID NO: 1393165 - RNA, 19 nt, Human
cgcggcgggagggcgcggg

SEQ ID NO: 1393166 - RNA, 15 nt, Human
cgcggggcggggagc

SEQ ID NO: 1393167 - RNA, 23 nt, Human
cgcggggcggggagcgagcccca

SEQ ID NO: 1393168 - RNA, 15 nt, Human
cgcuccucggacggc

SEQ ID NO: 1393169 - RNA, 14 nt, Human
cgcucgcuuccgca

SEQ ID NO: 1393170 - RNA, 15 nt, Human
cgcucgcuuccgcau

SEQ ID NO: 1393171 - RNA, 16 nt, Human
cgcucgcuuccgcauc

SEQ ID NO: 1393172 - RNA, 17 nt, Human
cgcucgcuuccgcaucc

SEQ ID NO: 1393173 - RNA, 16 nt, Human
cgcucggccugcucgc

SEQ ID NO: 1393174 - RNA, 18 nt, Human
cgcucggccugcucgccc

SEQ ID NO: 1393175 - RNA, 15 nt, Human
cggagccuccagcug

SEQ ID NO: 1393176 - RNA, 18 nt, Human
cggagccuccagcugccc

SEQ ID NO: 1393177 - RNA, 16 nt, Human
cggacgcugcugccgu

SEQ ID NO: 1393178 - RNA, 20 nt, Human
cggacgcugcugccgugggc

SEQ ID NO: 1393179 - RNA, 21 nt, Human
cggcccugugcggccuggucu

SEQ ID NO: 1393180 - RNA, 13 nt, Human
cggccgcgcugcg

SEQ ID NO: 1393181 - RNA, 19 nt, Human
cggccgcgcugcgcgccgc

SEQ ID NO: 1393182 - RNA, 14 nt, Human
cggccggcgcgcuc

SEQ ID NO: 1393183 - RNA, 13 nt, Human
cgcgcccucuggc

SEQ ID NO: 1393184 - RNA, 18 nt, Human
cgcgcccucuggcugcug

SEQ ID NO: 1393185 - RNA, 18 nt, Human
cgcgccgcgcuccucgga

SEQ ID NO: 1393186 - RNA, 12 nt, Human
cgcccucuggcu

SEQ ID NO: 1393187 - RNA, 16 nt, Human
cgccgcgcuccucgga

SEQ ID NO: 1393188 - RNA, 15 nt, Human
cgcgagcgcgcgcgc

SEQ ID NO: 1393189 - RNA, 14 nt, Human
cgcgcagcucaggc

SEQ ID NO: 1393190 - RNA, 19 nt, Human
cgcgcagcucaggcuggca

SEQ ID NO: 1393191 - RNA, 19 nt, Human
cgcucucuggccuucggcc

SEQ ID NO: 1393192 - RNA, 22 nt, Human
cgcucucuggccuucggccucc

SEQ ID NO: 1393193 - RNA, 18 nt, Human
cgcucugggucgccggca

SEQ ID NO: 1393194 - RNA, 19 nt, Human
cgcuggcugcgcucggccu

SEQ ID NO: 1393195 - RNA, 20 nt, Human
cgcuggcugcgcucggccug

SEQ ID NO: 1393196 - RNA, 18 nt, Human
cgcuguacgcgagcgcgc

SEQ ID NO: 1393197 - RNA, 20 nt, Human
cgcuguacgcgagcgcgcgc

SEQ ID NO: 1393198 - RNA, 16 nt, Human
cgcuguuccucgccac

SEQ ID NO: 1393199 - RNA, 16 nt, Human
cucuggcuccagcugg

SEQ ID NO: 1393200 - RNA, 20 nt, Human
cucgcccacuuccucccggc

SEQ ID NO: 1393201 - RNA, 22 nt, Human
cucgcuuccgcauccuagucuc

SEQ ID NO: 1393202 - RNA, 14 nt, Human
cucucuggccuucg

SEQ ID NO: 1393203 - RNA, 20 nt, Human
cucugcagcuuccaggcugg

SEQ ID NO: 1393204 - RNA, 16 nt, Human
cucuggacaggcacua

SEQ ID NO: 1393205 - RNA, 16 nt, Human
cucuuaagaagacugc

SEQ ID NO: 1393206 - RNA, 13 nt, Human
cuccagcugcccc

SEQ ID NO: 1393207 - RNA, 23 nt, Human
cucauggaauuggagcucgugga

SEQ ID NO: 1393208 - RNA, 17 nt, Human
cuccauccugaggcucc

SEQ ID NO: 1393209 - RNA, 14 nt, Human
cuccgcgcagcuca

SEQ ID NO: 1393210 - RNA, 12 nt, Human
cucaccaguccc

SEQ ID NO: 1393211 - RNA, 21 nt, Human
cuauguagaauauauuuccuu

SEQ ID NO: 1393212 - RNA, 20 nt, Human
cucaauaaaguacaagagcu

SEQ ID NO: 1393213 - RNA, 20 nt, Human
gcaccucucuggguugaagg

SEQ ID NO: 1393214 - RNA, 20 nt, Human
gcagacacaugugcuggcca

SEQ ID NO: 1393215 - RNA, 22 nt, Human
gcagcgaguacuucccgcuguu

SEQ ID NO: 1393216 - RNA, 22 nt, Human
gcaggaccaucccggccggcgc

SEQ ID NO: 1393217 - RNA, 18 nt, Human
gcaucuccucaacucuga

SEQ ID NO: 1393218 - RNA, 16 nt, Human
gcaguguucccugggg

SEQ ID NO: 1393219 - RNA, 14 nt, Human
gccaugggacaggg

SEQ ID NO: 1393220 - RNA, 17 nt, Human
gccaugugcagccacca

SEQ ID NO: 1393221 - RNA, 13 nt, Human
gccaugugcagcc

SEQ ID NO: 1393222 - RNA, 19 nt, Human
gccaacggggugaaacccu

SEQ ID NO: 1393223 - RNA, 18 nt, Human
gcauuguuggcuguuccu

SEQ ID NO: 1393224 - RNA, 18 nt, Human
gccaaaacaucaaccugc

SEQ ID NO: 1393225 - RNA, 22 nt, Human
gccacgcucugggucgccggca

SEQ ID NO: 1393226 - RNA, 23 nt, Human
gccacgcucugggucgccggcau

SEQ ID NO: 1393227 - RNA, 15 nt, Human
gccaccaagcuggug

SEQ ID NO: 1393228 - RNA, 21 nt, Human
gccaccaagcugguggcucug

SEQ ID NO: 1393229 - RNA, 20 nt, Human
gccagacaucaacagauaaa

SEQ ID NO: 1393230 - RNA, 15 nt, Human
gccccccagcccucc

SEQ ID NO: 1393231 - RNA, 20 nt, Human
gcccccgggccgacggagcc

SEQ ID NO: 1393232 - RNA, 24 nt, Human
gccccaaguggaacgagacaagca

SEQ ID NO: 1393233 - RNA, 18 nt, Human
gcccauaccccuggccaa

SEQ ID NO: 1393234 - RNA, 22 nt, Human
gcccacuagacccacuggacuc

SEQ ID NO: 1393235 - RNA, 20 nt, Human
gcccacuuccucccggccgc

SEQ ID NO: 1393236 - RNA, 14 nt, Human
gcccugugcggccu

SEQ ID NO: 1393237 - RNA, 18 nt, Human
gcccugugcggccugguc

SEQ ID NO: 1393238 - RNA, 19 nt, Human
gcccugugcggccuggucu

SEQ ID NO: 1393239 - RNA, 13 nt, Human
gcccuuagcccuu

SEQ ID NO: 1393240 - RNA, 23 nt, Human
gaggcauuuaggccaugggacag

SEQ ID NO: 1393241 - RNA, 15 nt, Human
gagcgcgcgcgcccu

SEQ ID NO: 1393242 - RNA, 15 nt, Human
gagccggagccucca

SEQ ID NO: 1393243 - RNA, 17 nt, Human
gagccggagccuccagc

SEQ ID NO: 1393244 - RNA, 18 nt, Human
gagccggagccuccagcu

SEQ ID NO: 1393245 - RNA, 20 nt, Human
gagccggagccuccagcugc

SEQ ID NO: 1393246 - RNA, 17 nt, Human
gagccgggaaagaagag

SEQ ID NO: 1393247 - RNA, 18 nt, Human
gagaaucacuugaacccg

SEQ ID NO: 1393248 - RNA, 20 nt, Human
gagccaccaagcugguggcu

SEQ ID NO: 1393249 - RNA, 12 nt, Human
gaggggcgcucg

SEQ ID NO: 1393250 - RNA, 22 nt, Human
gagugaacaaauuuacagagac

SEQ ID NO: 1393251 - RNA, 16 nt, Human
gaucaccugcccugcu

SEQ ID NO: 1393252 - RNA, 16 nt, Human
gaugcuagaacucccu

SEQ ID NO: 1393253 - RNA, 13 nt, Human
gaugccccguccc

SEQ ID NO: 1393254 - RNA, 23 nt, Human
gauguugaaaaaguucugcagau

SEQ ID NO: 1393255 - RNA, 14 nt, Human
cugggucgccggca

SEQ ID NO: 1393256 - RNA, 15 nt, Human
cugggucgccggcau

SEQ ID NO: 1393257 - RNA, 22 nt, Human
cuggcugcgcucggccugcucg

SEQ ID NO: 1393258 - RNA, 21 nt, Human
cuggucuaccuguucgcgcgc

SEQ ID NO: 1393259 - RNA, 22 nt, Human
cugccaaaacaucaaccugcca

SEQ ID NO: 1393260 - RNA, 14 nt, Human
cugccagcuggccu

SEQ ID NO: 1393261 - RNA, 22 nt, Human
cugccccggggaggggcgcucg

SEQ ID NO: 1393262 - RNA, 14 nt, Human
cugcugccgugggc

SEQ ID NO: 1393263 - RNA, 14 nt, Human
cugcugguggcgcu

SEQ ID NO: 1393264 - RNA, 13 nt, Human
cugcgcgccgcgc

SEQ ID NO: 1393265 - RNA, 20 nt, Human
cugcgcgccgcgcuccucgg

SEQ ID NO: 1393266 - RNA, 14 nt, Human
cugcgcucggccug

SEQ ID NO: 1393267 - RNA, 18 nt, Human
cugcgcucggccugcucg

SEQ ID NO: 1393268 - RNA, 19 nt, Human
cugcgcucggccugcucgc

SEQ ID NO: 1393269 - RNA, 21 nt, Human
cuggagacauugaggcaggca

SEQ ID NO: 1393270 - RNA, 22 nt, Human
cugcucgcccacuuccucccgg

SEQ ID NO: 1393271 - RNA, 17 nt, Human
cuucggccuccauccug

SEQ ID NO: 1393272 - RNA, 14 nt, Human
cuuccucccggccg

SEQ ID NO: 1393273 - RNA, 18 nt, Human
cuugucaauaaaauccau

SEQ ID NO: 1393274 - RNA, 17 nt, Human
cuuuaaaacuuauccuc

SEQ ID NO: 1393275 - RNA, 12 nt, Human
cuguugauggaa

SEQ ID NO: 1393276 - RNA, 21 nt, Human
cuuccagauccuggaaaucag

SEQ ID NO: 1393277 - RNA, 17 nt, Human
cuuccagggcuacgcgc

SEQ ID NO: 1393278 - RNA, 19 nt, Human
cuuccagggcuacgcgcgc

SEQ ID NO: 1393279 - RNA, 23 nt, Human
cuuccagggcuacgcgcgcuccg

SEQ ID NO: 1393280 - RNA, 14 nt, Human
gacagggaggacgc

SEQ ID NO: 1393281 - RNA, 19 nt, Human
gaccaacaucgcagacaca

SEQ ID NO: 1393282 - RNA, 14 nt, Human
gacagaaagcagaa

SEQ ID NO: 1393283 - RNA, 11 nt, Human
gacagaaagca

SEQ ID NO: 1393284 - RNA, 15 nt, Human
gacacaugugcuggc

SEQ ID NO: 1393285 - RNA, 14 nt, Human
gacacacugaagaa

SEQ ID NO: 1393286 - RNA, 14 nt, Human
gacgcugcugccgu

SEQ ID NO: 1393287 - RNA, 20 nt, Human
gacggcuccggacgcugcug

SEQ ID NO: 1393288 - RNA, 16 nt, Human
gacccaaaaggcagaa

SEQ ID NO: 1393289 - RNA, 12 nt, Human
gaccaucccggc

SEQ ID NO: 1393290 - RNA, 22 nt, Human
gaccaaggcccccgggccgacg

SEQ ID NO: 1393291 - RNA, 20 nt, Human
gaccacugcagaagacagua

SEQ ID NO: 1393292 - RNA, 14 nt, Human
gaaagaagagccgg

SEQ ID NO: 1393293 - RNA, 18 nt, Human
gaauaaccaacacccuga

SEQ ID NO: 1393294 - RNA, 18 nt, Human
gaagaagcaccaaucaug

SEQ ID NO: 1393295 - RNA, 13 nt, Human
gaaaacaaggaug

SEQ ID NO: 1393296 - RNA, 14 nt, Human
gaaaugaaagcagg

SEQ ID NO: 1393297 - RNA, 12 nt, Human
aaaaccugagcc

SEQ ID NO: 1393298 - RNA, 15 nt, Human
aaccaacacccugag

SEQ ID NO: 1393299 - RNA, 23 nt, Human
aacugcagcgaguacuucccgcu

SEQ ID NO: 1393300 - RNA, 19 nt, Human
aagccagaucuaugccaca

SEQ ID NO: 1393301 - RNA, 16 nt, Human
guccauugggcaggca

SEQ ID NO: 1393302 - RNA, 15 nt, Human
gucccaggcugagcc

SEQ ID NO: 1393303 - RNA, 12 nt, Human
gucucagcuuca

SEQ ID NO: 1393304 - RNA, 19 nt, Human
gucucagcuucacccugag

SEQ ID NO: 1393305 - RNA, 17 nt, Human
guccgggucgcaggacc

SEQ ID NO: 1393306 - RNA, 23 nt, Human
gucgcaggaccaucccggccggc

SEQ ID NO: 1393307 - RNA, 14 nt, Human
guaccuccaaggac

SEQ ID NO: 1393308 - RNA, 13 nt, Human
guacgcgagcgcg

SEQ ID NO: 1393309 - RNA, 23 nt, Human
ggaggacgcucucuggccuucgg

SEQ ID NO: 1393310 - RNA, 13 nt, Human
ggagccuccagcu

SEQ ID NO: 1393311 - RNA, 19 nt, Human
ggagccuccagcugccccg

SEQ ID NO: 1393312 - RNA, 19 nt, Human
ggagcgagccccaggcggg

SEQ ID NO: 1393313 - RNA, 19 nt, Human
ggacgcucucuggccuucg

SEQ ID NO: 1393314 - RNA, 23 nt, Human
ggacgcucucuggccuucggccu

SEQ ID NO: 1393315 - RNA, 16 nt, Human
uauuguuugcuaagca

SEQ ID NO: 1393316 - RNA, 13 nt, Human
uccagcuggccgg

SEQ ID NO: 1393317 - RNA, 16 nt, Human
uaggccaugggacagg

SEQ ID NO: 1393318 - RNA, 20 nt, Human
uaggccaugggacagggagg

SEQ ID NO: 1393319 - RNA, 12 nt, Human
ugagccuuggga

SEQ ID NO: 1393320 - RNA, 20 nt, Human
ugcgcgccgcgcuccucgga

SEQ ID NO: 1393321 - RNA, 15 nt, Human
ugcugguggcgcugg

SEQ ID NO: 1393322 - RNA, 15 nt, Human
ugcuaguaauuggaa

SEQ ID NO: 1393323 - RNA, 19 nt, Human
ugagagaacagggcugaag

SEQ ID NO: 1393324 - RNA, 14 nt, Human
ugacagagucaagg

SEQ ID NO: 1393325 - RNA, 15 nt, Human
ugaaggggcggcggc

SEQ ID NO: 1393326 - RNA, 15 nt, Human
ucccggccgcgcugc

SEQ ID NO: 1393327 - RNA, 18 nt, Human
ucccggccgcgcugcgcg

SEQ ID NO: 1393328 - RNA, 14 nt, Human
ucccaggcugagcc

SEQ ID NO: 1393329 - RNA, 16 nt, Human
ucccugccccccagcc

SEQ ID NO: 1393330 - RNA, 17 nt, Human
ucccugccccccagccc

SEQ ID NO: 1393331 - RNA, 17 nt, Human
ucccuuuguccacaagu

SEQ ID NO: 1393332 - RNA, 22 nt, Human
ugaaagcagggacuugaaccca

SEQ ID NO: 1393333 - RNA, 14 nt, Human
uguugauggaaaua

SEQ ID NO: 1393334 - RNA, 14 nt, Human
ugugcagccaccag

SEQ ID NO: 1393335 - RNA, 16 nt, Human
ugugaggagcuggaaa

SEQ ID NO: 1393336 - RNA, 23 nt, Human
uggugggcagagagguagggaug

SEQ ID NO: 1393337 - RNA, 14 nt, Human
uggucugugagaug

SEQ ID NO: 1393338 - RNA, 19 nt, Human
ugggcaggcagauguuccu

SEQ ID NO: 1393339 - RNA, 17 nt, Human
ugggacagggaggacgc

SEQ ID NO: 1393340 - RNA, 15 nt, Human
ugggacagucaccuc

SEQ ID NO: 1393341 - RNA, 15 nt, Human
uggcuccagcuggcc

SEQ ID NO: 1393342 - RNA, 11 nt, Human
uggcuguuccu

SEQ ID NO: 1393343 - RNA, 15 nt, Human
uggcuguuccugcag

SEQ ID NO: 1393344 - RNA, 22 nt, Human
cuggguuccuuccucugagccu

SEQ ID NO: 1393345 - RNA, 12 nt, Human
cugguggcgcug

SEQ ID NO: 1393346 - RNA, 13 nt, Human
cugguggcgcugg

SEQ ID NO: 1393347 - RNA, 19 nt, Human
cuggccuucggccuccauc

SEQ ID NO: 1393348 - RNA, 16 nt, Human
cuggccuucggccucc

SEQ ID NO: 1393349 - RNA, 16 nt, Human
cuggccaccugcugag

SEQ ID NO: 1393350 - RNA, 13 nt, Human
cugggucgccggc

SEQ ID NO: 1393351 - RNA, 16 nt, Human
cuggguuaggccuugc

SEQ ID NO: 1393352 - RNA, 13 nt, Human
cuggcgugcagca

SEQ ID NO: 1393353 - RNA, 22 nt, Human
cuggcuaauuagcauggccaca

SEQ ID NO: 1393354 - RNA, 18 nt, Human
cuggcugcgcucggccug

SEQ ID NO: 1393355 - RNA, 19 nt, Human
cuggcugcgcucggccugc

SEQ ID NO: 1393356 - RNA, 18 nt, Human
cuggcugcugguggcgcu

SEQ ID NO: 1393357 - RNA, 19 nt, Human
gaagagccggagccuccag

SEQ ID NO: 1393358 - RNA, 19 nt, Human
gaaggcaccucucuggguu

SEQ ID NO: 1393359 - RNA, 15 nt, Human
gaaggggcggcggcc

SEQ ID NO: 1393360 - RNA, 22 nt, Human
cuuccucccggccgcgcugcgc

SEQ ID NO: 1393361 - RNA, 21 nt, Human
cuuccaggcuggcgugcagca

SEQ ID NO: 1393362 - RNA, 24 nt, Human
cuuccagggcuacgcgcgcuccgc

SEQ ID NO: 1393363 - RNA, 15 nt, Human
cuucccgcuguuccu

SEQ ID NO: 1393364 - RNA, 11 nt, Human
cuucuguuccg

SEQ ID NO: 1393365 - RNA, 21 nt, Human
cuugccuaggcauagcccugc

SEQ ID NO: 1393366 - RNA, 17 nt, Human
cuaccuguucgcgcgcc

SEQ ID NO: 1393367 - RNA, 13 nt, Human
cuacgcgcgcucc

SEQ ID NO: 1393368 - RNA, 16 nt, Human
cuacgcgcgcuccgcg

SEQ ID NO: 1393369 - RNA, 15 nt, Human
cugccgugggccuga

SEQ ID NO: 1393370 - RNA, 21 nt, Human
cugccucaagcuaugugagcu

SEQ ID NO: 1393371 - RNA, 15 nt, Human
cugcgcucggccugc

SEQ ID NO: 1393372 - RNA, 16 nt, Human
cgggagggcgcggggc

SEQ ID NO: 1393373 - RNA, 16 nt, Human
cgggccgacggagccg

SEQ ID NO: 1393374 - RNA, 17 nt, Human
cgggccgacggagccgg

SEQ ID NO: 1393375 - RNA, 12 nt, Human
cggggagcgagc

SEQ ID NO: 1393376 - RNA, 15 nt, Human
cggguccgggucgca

SEQ ID NO: 1393377 - RNA, 13 nt, Human
cggccugcucgcc

SEQ ID NO: 1393378 - RNA, 14 nt, Human
cggccugcucgccc

SEQ ID NO: 1393379 - RNA, 21 nt, Human
cggcgcgcucaucccacccgc

SEQ ID NO: 1393380 - RNA, 21 nt, Human
cggcggcccugugcggccugg

SEQ ID NO: 1393381 - RNA, 16 nt, Human
cggcgggagggcgcgg

SEQ ID NO: 1393382 - RNA, 17 nt, Human
cggcgggagggcgcggg

SEQ ID NO: 1393383 - RNA, 18 nt, Human
cggcuccggacgcugcug

SEQ ID NO: 1393384 - RNA, 19 nt, Human
cggcuccggacgcugcugc

SEQ ID NO: 1393385 - RNA, 21 nt, Human
cggcuccggacgcugcugccg

SEQ ID NO: 1393386 - RNA, 18 nt, Human
cggcccugugcggccugg

SEQ ID NO: 1393387 - RNA, 15 nt, Human
cggccgcgcugcgcg

SEQ ID NO: 1393388 - RNA, 17 nt, Human
cggccgcgcugcgcgcc

SEQ ID NO: 1393389 - RNA, 18 nt, Human
cggccgcgcugcgcgccg

SEQ ID NO: 1393390 - RNA, 21 nt, Human
cggccgcgcugcgcgccgcgc

SEQ ID NO: 1393391 - RNA, 12 nt, Human
cggccggcgcgc

SEQ ID NO: 1393392 - RNA, 13 nt, Human
cggccggcgcgcu

SEQ ID NO: 1393393 - RNA, 15 nt, Human
cggccggcgcgcuca

SEQ ID NO: 1393394 - RNA, 14 nt, Human
cgcgcgcuccgcgc

SEQ ID NO: 1393395 - RNA, 12 nt, Human
cgcgcucauccc

SEQ ID NO: 1393396 - RNA, 13 nt, Human
cgcgcuccgcgca

SEQ ID NO: 1393397 - RNA, 16 nt, Human
cgcgcugcgcgccgcg

SEQ ID NO: 1393398 - RNA, 23 nt, Human
cgcggcgggagggcgcggggcgg

SEQ ID NO: 1393399 - RNA, 22 nt, Human
cgcucaucccacccgcccaccg

SEQ ID NO: 1393400 - RNA, 18 nt, Human
cgcuccucggacggcucc

SEQ ID NO: 1393401 - RNA, 13 nt, Human
cgcucgcuuccgc

SEQ ID NO: 1393402 - RNA, 23 nt, Human
cgcgcccucuggcugcugguggc

SEQ ID NO: 1393403 - RNA, 13 nt, Human
cgcgccgcgcucc

SEQ ID NO: 1393404 - RNA, 16 nt, Human
cgcgccgcgcuccucg

SEQ ID NO: 1393405 - RNA, 19 nt, Human
cgcgccgcgcuccucggac

SEQ ID NO: 1393406 - RNA, 15 nt, Human
cgcucucuggccuuc

SEQ ID NO: 1393407 - RNA, 21 nt, Human
cgcucucuggccuucggccuc

SEQ ID NO: 1393408 - RNA, 19 nt, Human
cgcuguuccucgccacgcu

SEQ ID NO: 1393409 - RNA, 23 nt, Human
cggacgcugcugccgugggccug

SEQ ID NO: 1393410 - RNA, 14 nt, Human
cggagccuccagcu

SEQ ID NO: 1393411 - RNA, 16 nt, Human
cggagccuccagcugc

SEQ ID NO: 1393412 - RNA, 20 nt, Human
cggagccuccagcugccccg

SEQ ID NO: 1393413 - RNA, 14 nt, Human
cgcucugggucgcc

SEQ ID NO: 1393414 - RNA, 17 nt, Human
cgcucugggucgccggc

SEQ ID NO: 1393415 - RNA, 12 nt, Human
cgcugcgcgccg

SEQ ID NO: 1393416 - RNA, 14 nt, Human
cgcugcgcgccgcg

SEQ ID NO: 1393417 - RNA, 15 nt, Human
cgcugcgcgccgcgc

SEQ ID NO: 1393418 - RNA, 13 nt, Human
cgcuggcugcgcu

SEQ ID NO: 1393419 - RNA, 16 nt, Human
cgcuggcugcgcucgg

SEQ ID NO: 1393420 - RNA, 21 nt, Human
cgcuggcugcgcucggccugc

SEQ ID NO: 1393421 - RNA, 13 nt, Human
cgcuguuccucgc

SEQ ID NO: 1393422 - RNA, 14 nt, Human
cgcuguuccucgcc

SEQ ID NO: 1393423 - RNA, 15 nt, Human
cgcuguuccucgcca

SEQ ID NO: 1393424 - RNA, 14 nt, Human
gccgugggccugag

SEQ ID NO: 1393425 - RNA, 23 nt, Human
gccgugggccugagaccaaggcc

SEQ ID NO: 1393426 - RNA, 21 nt, Human
gccuccauccugaggcuccac

SEQ ID NO: 1393427 - RNA, 20 nt, Human
gccuccgcuacuuccagggc

SEQ ID NO: 1393428 - RNA, 16 nt, Human
gccucagucucccucc

SEQ ID NO: 1393429 - RNA, 15 nt, Human
gccgcgcugcgcgcc

SEQ ID NO: 1393430 - RNA, 16 nt, Human
gccgcgcugcgcgccg

SEQ ID NO: 1393431 - RNA, 14 nt, Human
gccgacggagccgg

SEQ ID NO: 1393432 - RNA, 19 nt, Human
gccgagauugugccccugc

SEQ ID NO: 1393433 - RNA, 22 nt, Human
gccggagccuccagcugccccg

SEQ ID NO: 1393434 - RNA, 23 nt, Human
gccggcgcgcucaucccacccgc

SEQ ID NO: 1393435 - RNA, 16 nt, Human
gccgggaaagaagagc

SEQ ID NO: 1393436 - RNA, 21 nt, Human
gccgggaaagaagagccggag

SEQ ID NO: 1393437 - RNA, 22 nt, Human
gccgggagccugaucaccugcc

SEQ ID NO: 1393438 - RNA, 19 nt, Human
gcccuuccccucugcagcu

SEQ ID NO: 1393439 - RNA, 14 nt, Human
gcucugggucgccg

SEQ ID NO: 1393440 - RNA, 16 nt, Human
gcucugugugcucuga

SEQ ID NO: 1393441 - RNA, 21 nt, Human
gcucucuggccuucggccucc

SEQ ID NO: 1393442 - RNA, 16 nt, Human
gcucugcccauccugc

SEQ ID NO: 1393443 - RNA, 13 nt, Human
gcucucuggccuu

SEQ ID NO: 1393444 - RNA, 21 nt, Human
gccugcucgcccacuuccucc

SEQ ID NO: 1393445 - RNA, 16 nt, Human
gccugagaccaaggcc

SEQ ID NO: 1393446 - RNA, 14 nt, Human
gcugcgcgccgcgc

SEQ ID NO: 1393447 - RNA, 17 nt, Human
gcuguacgcgagcgcgc

SEQ ID NO: 1393448 - RNA, 22 nt, Human
gcuggcaccgcuguacgcgagc

SEQ ID NO: 1393449 - RNA, 14 nt, Human
gcuggcgugcagca

SEQ ID NO: 1393450 - RNA, 14 nt, Human
gcugccccggggag

SEQ ID NO: 1393451 - RNA, 19 nt, Human
gcugccccggggaggggcg

SEQ ID NO: 1393452 - RNA, 13 nt, Human
gcuggagcucugc

SEQ ID NO: 1393453 - RNA, 15 nt, Human
gcuggcugcgcucgg

SEQ ID NO: 1393454 - RNA, 18 nt, Human
gcuggcugcgcucggccu

SEQ ID NO: 1393455 - RNA, 18 nt, Human
ggaaacgaagcaccauca

SEQ ID NO: 1393456 - RNA, 17 nt, Human
ggaccaucccggccggc

SEQ ID NO: 1393457 - RNA, 12 nt, Human
gcuucuguuccg

SEQ ID NO: 1393458 - RNA, 16 nt, Human
gcccccgggccgacgg

SEQ ID NO: 1393459 - RNA, 19 nt, Human
gccccggggaggggcgcuc

SEQ ID NO: 1393460 - RNA, 21 nt, Human
gccccggggaggggcgcucgc

SEQ ID NO: 1393461 - RNA, 16 nt, Human
gcccauaccccuggcc

SEQ ID NO: 1393462 - RNA, 21 nt, Human
gcccacuuccucccggccgcg

SEQ ID NO: 1393463 - RNA, 22 nt, Human
gcccacuuccucccggccgcgc

SEQ ID NO: 1393464 - RNA, 23 nt, Human
gcccacuuccucccggccgcgcu

SEQ ID NO: 1393465 - RNA, 19 nt, Human
gaucccuuuguccacaagu

SEQ ID NO: 1393466 - RNA, 16 nt, Human
gaucuggcucuggaca

SEQ ID NO: 1393467 - RNA, 18 nt, Human
gacacaugugcuggccac

SEQ ID NO: 1393468 - RNA, 19 nt, Human
gacaggcacuaucuggguu

SEQ ID NO: 1393469 - RNA, 17 nt, Human
gacagggaggacgcucu

SEQ ID NO: 1393470 - RNA, 18 nt, Human
gacagggaggacgcucuc

SEQ ID NO: 1393471 - RNA, 15 nt, Human
gagcgacagugagac

SEQ ID NO: 1393472 - RNA, 16 nt, Human
gagcgagccccaggcg

SEQ ID NO: 1393473 - RNA, 13 nt, Human
gagcgcgcgcgcc

SEQ ID NO: 1393474 - RNA, 15 nt, Human
gagcucagcccuggu

SEQ ID NO: 1393475 - RNA, 21 nt, Human
gagccggagccuccagcugcc

SEQ ID NO: 1393476 - RNA, 21 nt, Human
gagccgggaaagaagagccgg

SEQ ID NO: 1393477 - RNA, 13 nt, Human
gagccuccagcug

SEQ ID NO: 1393478 - RNA, 16 nt, Human
gagccuccagcugccc

SEQ ID NO: 1393479 - RNA, 14 nt, Human
cagccaccagucca

SEQ ID NO: 1393480 - RNA, 14 nt, Human
cacacugaagaagc

SEQ ID NO: 1393481 - RNA, 20 nt, Human
caaggcccccgggccgacgg

SEQ ID NO: 1393482 - RNA, 15 nt, Human
caaugaaugaaugaa

SEQ ID NO: 1393483 - RNA, 23 nt, Human
caacuaucucauuuccaagcaag

SEQ ID NO: 1393484 - RNA, 19 nt, Human
caagacccaaaaggcagaa

SEQ ID NO: 1393485 - RNA, 12 nt, Human
ccaacacccuga

SEQ ID NO: 1393486 - RNA, 23 nt, Human
ccaaggaccggccuuugcaccuc

SEQ ID NO: 1393487 - RNA, 18 nt, Human
caugaaggggcggcggcc

SEQ ID NO: 1393488 - RNA, 17 nt, Human
caugaaguccaagcauu

SEQ ID NO: 1393489 - RNA, 21 nt, Human
caugcccauaccccuggccaa

SEQ ID NO: 1393490 - RNA, 13 nt, Human
caugggacaggga

SEQ ID NO: 1393491 - RNA, 16 nt, Human
caugggacagggagga

SEQ ID NO: 1393492 - RNA, 20 nt, Human
caugggacagggaggacgcu

SEQ ID NO: 1393493 - RNA, 16 nt, Human
caugguuuagaaagcu

SEQ ID NO: 1393494 - RNA, 13 nt, Human
caucccggccggc

SEQ ID NO: 1393495 - RNA, 14 nt, Human
caucccggccggcg

SEQ ID NO: 1393496 - RNA, 16 nt, Human
caucccggccggcgcg

SEQ ID NO: 1393497 - RNA, 17 nt, Human
caucccggccggcgcgc

SEQ ID NO: 1393498 - RNA, 14 nt, Human
cauccuacaagaca

SEQ ID NO: 1393499 - RNA, 23 nt, Human
cagcuggccuugugaggagcugg

SEQ ID NO: 1393500 - RNA, 19 nt, Human
cagcuacuugggaggcuga

SEQ ID NO: 1393501 - RNA, 20 nt, Human
cagccugaaagaggaaugaa

SEQ ID NO: 1393502 - RNA, 15 nt, Human
cagcuucacccugag

SEQ ID NO: 1393503 - RNA, 11 nt, Human
cagcuuccagg

SEQ ID NO: 1393504 - RNA, 16 nt, Human
caggaccaucccggcc

SEQ ID NO: 1393505 - RNA, 17 nt, Human
caggaccaucccggccg

SEQ ID NO: 1393506 - RNA, 15 nt, Human
ccgcuguuccucgcc

SEQ ID NO: 1393507 - RNA, 16 nt, Human
ccgcuguuccucgcca

SEQ ID NO: 1393508 - RNA, 19 nt, Human
ccgcuguuccucgccacgc

SEQ ID NO: 1393509 - RNA, 15 nt, Human
ccggacgcugcugcc

SEQ ID NO: 1393510 - RNA, 11 nt, Human
ccgggccgacg

SEQ ID NO: 1393511 - RNA, 15 nt, Human
ccgcuguacgcgagc

SEQ ID NO: 1393512 - RNA, 20 nt, Human
ccgcuguacgcgagcgcgcg

SEQ ID NO: 1393513 - RNA, 16 nt, Human
ccggggaggggcgcuc

SEQ ID NO: 1393514 - RNA, 22 nt, Human
ccgggucgcaggaccaucccgg

SEQ ID NO: 1393515 - RNA, 12 nt, Human
ccuccagcugcc

SEQ ID NO: 1393516 - RNA, 13 nt, Human
ccuccagcugccc

SEQ ID NO: 1393517 - RNA, 15 nt, Human
ccuccagcugccccg

SEQ ID NO: 1393518 - RNA, 17 nt, Human
ccuccagcugccccggg

SEQ ID NO: 1393519 - RNA, 24 nt, Human
ccuccauggaaacgaagcaccauc

SEQ ID NO: 1393520 - RNA, 20 nt, Human
ccucccggccgcgcugcgcg

SEQ ID NO: 1393521 - RNA, 13 nt, Human
ccuggccaaggaa

SEQ ID NO: 1393522 - RNA, 15 nt, Human
ccugccagcuggccu

SEQ ID NO: 1393523 - RNA, 14 nt, Human
ccugugcggccugg

SEQ ID NO: 1393524 - RNA, 14 nt, Human
ccuguucgcgcgcc

SEQ ID NO: 1393525 - RNA, 15 nt, Human
ccuguucgcgcgccu

SEQ ID NO: 1393526 - RNA, 14 nt, Human
ccuugaugaagaag

SEQ ID NO: 1393527 - RNA, 15 nt, Human
ccuuccucugagccu

SEQ ID NO: 1393528 - RNA, 20 nt, Human
ccuggaaaucaggguuagua

SEQ ID NO: 1393529 - RNA, 17 nt, Human
ccuuggggcugaugcag

SEQ ID NO: 1393530 - RNA, 22 nt, Human
ccuugccauaauuacuauguca

SEQ ID NO: 1393531 - RNA, 13 nt, Human
cgacggagccggg

SEQ ID NO: 1393532 - RNA, 15 nt, Human
cgacggagccgggaa

SEQ ID NO: 1393533 - RNA, 21 nt, Human
cgagauugugccccugcacuc

SEQ ID NO: 1393534 - RNA, 22 nt, Human
cgagccccaggcggguccgggu

SEQ ID NO: 1393535 - RNA, 23 nt, Human
cgcaaugugacuuaaugccacua

SEQ ID NO: 1393536 - RNA, 13 nt, Human
cgcgagcgcgcgc

SEQ ID NO: 1393537 - RNA, 19 nt, Human
cgcccacuagacccacugg

SEQ ID NO: 1393538 - RNA, 22 nt, Human
cgcccacuuccucccggccgcg

SEQ ID NO: 1393539 - RNA, 16 nt, Human
cgcccucuggcugcug

SEQ ID NO: 1393540 - RNA, 14 nt, Human
cgccgcgcuccucg

SEQ ID NO: 1393541 - RNA, 20 nt, Human
cgcaggaccaucccggccgg

SEQ ID NO: 1393542 - RNA, 21 nt, Human
cgcaggaccaucccggccggc

SEQ ID NO: 1393543 - RNA, 17 nt, Human
cgcauccuagucucuau

SEQ ID NO: 1393544 - RNA, 21 nt, Human
cgccacgcucugggucgccgg

SEQ ID NO: 1393545 - RNA, 22 nt, Human
cgccacgcucugggucgccggc

SEQ ID NO: 1393546 - RNA, 14 nt, Human
cgcccaccgcaggg

SEQ ID NO: 1393547 - RNA, 18 nt, Human
ccccucuggcuccagcug

SEQ ID NO: 1393548 - RNA, 19 nt, Human
ccccggggaggggcgcucg

SEQ ID NO: 1393549 - RNA, 12 nt, Human
ccccucuggcuc

SEQ ID NO: 1393550 - RNA, 19 nt, Human
cccgggccgacggagccgg

SEQ ID NO: 1393551 - RNA, 15 nt, Human
cccggggaggggcgc

SEQ ID NO: 1393552 - RNA, 15 nt, Human
cccuccuuggagaca

SEQ ID NO: 1393553 - RNA, 15 nt, Human
cccucuggcugcugg

SEQ ID NO: 1393554 - RNA, 22 nt, Human
cccucuguucugcacacagcac

SEQ ID NO: 1393555 - RNA, 20 nt, Human
cccauccugccccugagccc

SEQ ID NO: 1393556 - RNA, 16 nt, Human
cccaugaccaacaucg

SEQ ID NO: 1393557 - RNA, 14 nt, Human
ccccaagccuggca

SEQ ID NO: 1393558 - RNA, 22 nt, Human
cccccucuggcuccagcuggcc

SEQ ID NO: 1393559 - RNA, 22 nt, Human
ccccuuccuaauuccacagcug

SEQ ID NO: 1393560 - RNA, 16 nt, Human
cccgcuguuccucgcc

SEQ ID NO: 1393561 - RNA, 19 nt, Human
cccgcuguuccucgccacg

SEQ ID NO: 1393562 - RNA, 21 nt, Human
cccgcuguuccucgccacgcu

SEQ ID NO: 1393563 - RNA, 14 nt, Human
cccggccgcgcugc

SEQ ID NO: 1393564 - RNA, 21 nt, Human
cccggccgcgcugcgcgccgc

SEQ ID NO: 1393565 - RNA, 14 nt, Human
cccggccggcgcgc

SEQ ID NO: 1393566 - RNA, 19 nt, Human
cccggccggcgcgcucauc

SEQ ID NO: 1393567 - RNA, 14 nt, Human
cccugugcggccug

SEQ ID NO: 1393568 - RNA, 16 nt, Human
cccugagcccauggca

SEQ ID NO: 1393569 - RNA, 14 nt, Human
cccugcaaagccca

SEQ ID NO: 1393570 - RNA, 23 nt, Human
ccgcgcagcucaggcuggcaccg

SEQ ID NO: 1393571 - RNA, 16 nt, Human
ccgcgcugcgcgccgc

SEQ ID NO: 1393572 - RNA, 17 nt, Human
ccgacggagccgggaaa

SEQ ID NO: 1393573 - RNA, 19 nt, Human
ccgacggagccgggaaaga

SEQ ID NO: 1393574 - RNA, 16 nt, Human
ccggagccuccagcug

SEQ ID NO: 1393575 - RNA, 18 nt, Human
ccggagccuccagcugcc

SEQ ID NO: 1393576 - RNA, 16 nt, Human
ccggccgcgcugcgcg

SEQ ID NO: 1393577 - RNA, 13 nt, Human
ccggccggcgcgc

SEQ ID NO: 1393578 - RNA, 18 nt, Human
ccggccuuugcaccucca

SEQ ID NO: 1393579 - RNA, 19 nt, Human
ccggcgcgcucaucccacc

SEQ ID NO: 1393580 - RNA, 19 nt, Human
ccgggaaagaagagccgga

SEQ ID NO: 1393581 - RNA, 22 nt, Human
ccgggaaagaagagccggagcc

SEQ ID NO: 1393582 - RNA, 16 nt, Human
ccaucccggccggcgc

SEQ ID NO: 1393583 - RNA, 13 nt, Human
cccaggcgggucc

SEQ ID NO: 1393584 - RNA, 14 nt, Human
cccaggcugagccu

SEQ ID NO: 1393585 - RNA, 15 nt, Human
ccaccugcugagccc

SEQ ID NO: 1393586 - RNA, 21 nt, Human
ccacgcucugggucgccggca

SEQ ID NO: 1393587 - RNA, 14 nt, Human
ccacaucugagccc

SEQ ID NO: 1393588 - RNA, 23 nt, Human
ccacaaguaaaaggaaaugcucc

SEQ ID NO: 1393589 - RNA, 19 nt, Human
ccaggcggguccgggucgc

SEQ ID NO: 1393590 - RNA, 21 nt, Human
ccaggcuggcgugcagcauca

SEQ ID NO: 1393591 - RNA, 17 nt, Human
ccagggcuacgcgcgcu

SEQ ID NO: 1393592 - RNA, 14 nt, Human
accugcccugcuga

SEQ ID NO: 1393593 - RNA, 13 nt, Human
acacauguucccc

SEQ ID NO: 1393594 - RNA, 16 nt, Human
acacaugugcuggcca

SEQ ID NO: 1393595 - RNA, 17 nt, Human
acacaugugcuggccac

SEQ ID NO: 1393596 - RNA, 14 nt, Human
acaauacaucccuu

SEQ ID NO: 1393597 - RNA, 15 nt, Human
acuccagccugagcg

SEQ ID NO: 1393598 - RNA, 12 nt, Human
acggagccggga

SEQ ID NO: 1393599 - RNA, 21 nt, Human
acggcuccggacgcugcugcc

SEQ ID NO: 1393600 - RNA, 19 nt, Human
acgcgcgcuccgcgcagcu

SEQ ID NO: 1393601 - RNA, 21 nt, Human
acgcucucuggccuucggccu

SEQ ID NO: 1393602 - RNA, 23 nt, Human
aagagccggagccuccagcugcc

SEQ ID NO: 1393603 - RNA, 15 nt, Human
aacgauaaaagacag

SEQ ID NO: 1393604 - RNA, 15 nt, Human
aucaccaaggagcca

SEQ ID NO: 1393605 - RNA, 12 nt, Human
aucaccaaggag

SEQ ID NO: 1393606 - RNA, 21 nt, Human
augcuagaacucccuuucaac

SEQ ID NO: 1393607 - RNA, 17 nt, Human
auggcuuccuggcaaua

SEQ ID NO: 1393608 - RNA, 15 nt, Human
aucccggccggcgcg

SEQ ID NO: 1393609 - RNA, 16 nt, Human
aucccggccggcgcgc

SEQ ID NO: 1393610 - RNA, 11 nt, Human
agucccaggcu

SEQ ID NO: 1393611 - RNA, 16 nt, Human
aggugagcaucaucuu

SEQ ID NO: 1393612 - RNA, 18 nt, Human
agucucccucccuugggg

SEQ ID NO: 1393613 - RNA, 12 nt, Human
agugcagccccg

SEQ ID NO: 1393614 - RNA, 18 nt, Human
agacauugaggcaggcac

SEQ ID NO: 1393615 - RNA, 19 nt, Human
agagccggagccuccagcu

SEQ ID NO: 1393616 - RNA, 17 nt, Human
agaugcuagaacucccu

SEQ ID NO: 1393617 - RNA, 21 nt, Human
agcacagccucuuagaugcag

SEQ ID NO: 1393618 - RNA, 15 nt, Human
agcaccaaucaugaa

SEQ ID NO: 1393619 - RNA, 18 nt, Human
agggcuacgcgcgcuccg

SEQ ID NO: 1393620 - RNA, 13 nt, Human
agaagagccggag

SEQ ID NO: 1393621 - RNA, 14 nt, Human
agaaaauaacgaua

SEQ ID NO: 1393622 - RNA, 15 nt, Human
acuugggaggcugag

SEQ ID NO: 1393623 - RNA, 22 nt, Human
acuuccucccggccgcgcugcg

SEQ ID NO: 1393624 - RNA, 14 nt, Human
uuucccaacuccag

SEQ ID NO: 1393625 - RNA, 18 nt, Human
ugggccugagaccaaggc

SEQ ID NO: 1393626 - RNA, 22 nt, Human
uggggccuaugcagagguccac

SEQ ID NO: 1393627 - RNA, 17 nt, Human
uggggcugaugcaguug

SEQ ID NO: 1393628 - RNA, 20 nt, Human
uggggcuuuaacuccugcua

SEQ ID NO: 1393629 - RNA, 20 nt, Human
uccuuggagacagggcccug

SEQ ID NO: 1393630 - RNA, 16 nt, Human
ucggccugcucgccca

SEQ ID NO: 1393631 - RNA, 19 nt, Human
ucgcuuccgcauccuaguc

SEQ ID NO: 1393632 - RNA, 18 nt, Human
ucgcaggaccaucccggc

SEQ ID NO: 1393633 - RNA, 20 nt, Human
ucgcaggaccaucccggccg

SEQ ID NO: 1393634 - RNA, 23 nt, Human
ucgccacgcucugggucgccggc

SEQ ID NO: 1393635 - RNA, 22 nt, Human
ucgcccacuuccucccggccgc

SEQ ID NO: 1393636 - RNA, 12 nt, Human
ucuagugagcag

SEQ ID NO: 1393637 - RNA, 15 nt, Human
ucuggccuucggccu

SEQ ID NO: 1393638 - RNA, 17 nt, Human
ucuggcugcugguggcg

SEQ ID NO: 1393639 - RNA, 16 nt, Human
ucugugagaugcuaga

SEQ ID NO: 1393640 - RNA, 18 nt, Human
uucccgcuguuccucgcc

SEQ ID NO: 1393641 - RNA, 18 nt, Human
uucccuugaugaagaagu

SEQ ID NO: 1393642 - RNA, 12 nt, Human
uucugaagaaga

SEQ ID NO: 1393643 - RNA, 20 nt, Human
ggucuaccuguucgcgcgcc

SEQ ID NO: 1393644 - RNA, 19 nt, Human
guacgcgagcgcgcgcgcc

SEQ ID NO: 1393645 - RNA, 21 nt, Human
guacgcgagcgcgcgcgcccu

SEQ ID NO: 1393646 - RNA, 18 nt, Human
ggugugaccacugcagaa

SEQ ID NO: 1393647 - RNA, 18 nt, Human
gggcaggcagauguuccu

SEQ ID NO: 1393648 - RNA, 14 nt, Human
gggcaguguucccu

SEQ ID NO: 1393649 - RNA, 14 nt, Human
ggggcgcucgcuuc

SEQ ID NO: 1393650 - RNA, 15 nt, Human
gggcuuuaacuccug

SEQ ID NO: 1393651 - RNA, 11 nt, Human
gggguggugga

SEQ ID NO: 1393652 - RNA, 20 nt, Human
ggucgcaggaccaucccggc

SEQ ID NO: 1393653 - RNA, 23 nt, Human
ggucgcaggaccaucccggccgg

SEQ ID NO: 1393654 - RNA, 16 nt, Human
ggcuacgcgcgcuccg

SEQ ID NO: 1393655 - RNA, 20 nt, Human
ggcuacgcgcgcuccgcgca

SEQ ID NO: 1393656 - RNA, 12 nt, Human
ggcgugcagcau

SEQ ID NO: 1393657 - RNA, 13 nt, Human
ggcgcucgcuucc

SEQ ID NO: 1393658 - RNA, 20 nt, Human
ggcgcuggcugcgcucggcc

SEQ ID NO: 1393659 - RNA, 16 nt, Human
ggcccccgggccgacg

SEQ ID NO: 1393660 - RNA, 14 nt, Human
ggcccugugcggcc

SEQ ID NO: 1393661 - RNA, 18 nt, Human
ggcccugugcggccuggu

SEQ ID NO: 1393662 - RNA, 19 nt, Human
ggccgacggagccgggaaa

SEQ ID NO: 1393663 - RNA, 16 nt, Human
ggccgcgcugcgcgcc

SEQ ID NO: 1393664 - RNA, 21 nt, Human
ggccugcucgcccacuuccuc

SEQ ID NO: 1393665 - RNA, 17 nt, Human
ggcugcgcucggccugc

SEQ ID NO: 1393666 - RNA, 18 nt, Human
ggcugcgcucggccugcu

SEQ ID NO: 1393667 - RNA, 21 nt, Human
ggcugcgcucggccugcucgc

SEQ ID NO: 1393668 - RNA, 14 nt, Human
ggcugcugguggcg

SEQ ID NO: 1393669 - RNA, 14 nt, Human
ggcuggcaccgcug

SEQ ID NO: 1393670 - RNA, 16 nt, Human
ggcuggcaccgcugua

SEQ ID NO: 1393671 - RNA, 17 nt, Human
ggcuggcaccgcuguac

SEQ ID NO: 1393672 - RNA, 16 nt, Human
ggcuccagcuggccgg

SEQ ID NO: 1393673 - RNA, 21 nt, Human
ggcuguggauuuaauguggaa

SEQ ID NO: 1393674 - RNA, 20 nt, Human
gcuugcagagaugaggccgc

SEQ ID NO: 1393675 - RNA, 18 nt, Human
gcuguuccucgccacgcu

SEQ ID NO: 1393676 - RNA, 13 nt, Human
gcuucuguuccgu

SEQ ID NO: 1393677 - RNA, 12 nt, Human
gcugguggcgcu

SEQ ID NO: 1393678 - RNA, 19 nt, Human
gcugguggcgcuggcugcg

SEQ ID NO: 1393679 - RNA, 14 nt, Human
gcuguacgcgagcg

SEQ ID NO: 1393680 - RNA, 14 nt, Human
ccccugagcuugca

SEQ ID NO: 1393681 - RNA, 12 nt, Human
gcugcgcgccgc

SEQ ID NO: 1393682 - RNA, 16 nt, Human
gcugcgcucggccugc

SEQ ID NO: 1393683 - RNA, 17 nt, Human
gcugcgcucggccugcu

SEQ ID NO: 1393684 - RNA, 12 nt, Human
gcuggcugcgcu

SEQ ID NO: 1393685 - RNA, 17 nt, Human
ccccgggccgacggagc

SEQ ID NO: 1393686 - RNA, 20 nt, Human
ccccggggaggggcgcucgc

SEQ ID NO: 1393687 - RNA, 13 nt, Human
cccgcccaccgca

SEQ ID NO: 1393688 - RNA, 15 nt, Human
cccgcuguuccucgc

SEQ ID NO: 1393689 - RNA, 17 nt, Human
cccgcuguuccucgcca

SEQ ID NO: 1393690 - RNA, 22 nt, Human
cccggccgcgcugcgcgccgcg

SEQ ID NO: 1393691 - RNA, 12 nt, Human
cccggccggcgc

SEQ ID NO: 1393692 - RNA, 13 nt, Human
cccgggccgacgg

SEQ ID NO: 1393693 - RNA, 14 nt, Human
cccgggccgacgga

SEQ ID NO: 1393694 - RNA, 18 nt, Human
cccgggccgacggagccg

SEQ ID NO: 1393695 - RNA, 13 nt, Human
ggacagggaggac

SEQ ID NO: 1393696 - RNA, 17 nt, Human
ggacauuugcucaugga

SEQ ID NO: 1393697 - RNA, 18 nt, Human
ggacagucaccucaugga

SEQ ID NO: 1393698 - RNA, 22 nt, Human
ggacgcucucuggccuucggcc

SEQ ID NO: 1393699 - RNA, 13 nt, Human
ggacggcuccgga

SEQ ID NO: 1393700 - RNA, 15 nt, Human
ggaccaucccggccg

SEQ ID NO: 1393701 - RNA, 18 nt, Human
ggaccaucccggccggcg

SEQ ID NO: 1393702 - RNA, 23 nt, Human
ggaccaucccggccggcgcgcuc

SEQ ID NO: 1393703 - RNA, 21 nt, Human
ggaccggccuuugcaccucca

SEQ ID NO: 1393704 - RNA, 16 nt, Human
ggacgcucucuggccu

SEQ ID NO: 1393705 - RNA, 19 nt, Human
ggagacauugaggcaggca

SEQ ID NO: 1393706 - RNA, 15 nt, Human
ggcaggcacugccaa

SEQ ID NO: 1393707 - RNA, 13 nt, Human
ggaggggcgcucg

SEQ ID NO: 1393708 - RNA, 16 nt, Human
ggagccuccagcugcc

SEQ ID NO: 1393709 - RNA, 22 nt, Human
uccuaauuccacagcugcucaa

SEQ ID NO: 1393710 - RNA, 19 nt, Human
uccgcgcagcucaggcugg

SEQ ID NO: 1393711 - RNA, 16 nt, Human
uccgugcuugucccug

SEQ ID NO: 1393712 - RNA, 21 nt, Human
uccucccggccgcgcugcgcg

SEQ ID NO: 1393713 - RNA, 13 nt, Human
uccugaggcucca

SEQ ID NO: 1393714 - RNA, 15 nt, Human
uccccaagccuggca

SEQ ID NO: 1393715 - RNA, 13 nt, Human
ucccacccgccca

SEQ ID NO: 1393716 - RNA, 20 nt, Human
ucccgcuguuccucgccacg

SEQ ID NO: 1393717 - RNA, 13 nt, Human
ucccggccggcgc

SEQ ID NO: 1393718 - RNA, 17 nt, Human
ucccggccggcgcgcuc

SEQ ID NO: 1393719 - RNA, 13 nt, Human
uaccuccaaggac

SEQ ID NO: 1393720 - RNA, 16 nt, Human
uaccuguucgcgcgcc

SEQ ID NO: 1393721 - RNA, 17 nt, Human
uaccuguucgcgcgccu

SEQ ID NO: 1393722 - RNA, 13 nt, Human
uacgcgcgcuccg

SEQ ID NO: 1393723 - RNA, 16 nt, Human
uacgcgcgcuccgcgc

SEQ ID NO: 1393724 - RNA, 15 nt, Human
uaaugauaacuggaa

SEQ ID NO: 1393725 - RNA, 16 nt, Human
guccgggucgcaggac

SEQ ID NO: 1393726 - RNA, 14 nt, Human
gucugcuggagaca

SEQ ID NO: 1393727 - RNA, 19 nt, Human
gucaagggugugugcagca

SEQ ID NO: 1393728 - RNA, 22 nt, Human
gucaagggugugugcagcauug

SEQ ID NO: 1393729 - RNA, 19 nt, Human
guccuuggugccuggagcc

SEQ ID NO: 1393730 - RNA, 22 nt, Human
gucgcaggaccaucccggccgg

SEQ ID NO: 1393731 - RNA, 13 nt, Human
cacaucugagccc

SEQ ID NO: 1393732 - RNA, 23 nt, Human
caccugcccugcugagucccagg

SEQ ID NO: 1393733 - RNA, 19 nt, Human
cacccugaggugagcauca

SEQ ID NO: 1393734 - RNA, 14 nt, Human
caccgcuguacgcg

SEQ ID NO: 1393735 - RNA, 15 nt, Human
cacgcucugggucgc

SEQ ID NO: 1393736 - RNA, 22 nt, Human
cacugccaaaacaucaaccugc

SEQ ID NO: 1393737 - RNA, 16 nt, Human
auuuaauguggaaaug

SEQ ID NO: 1393738 - RNA, 21 nt, Human
augaagaaguugauaugccuu

SEQ ID NO: 1393739 - RNA, 17 nt, Human
aucccggccggcgcgcu

SEQ ID NO: 1393740 - RNA, 16 nt, Human
auccugccccugagcc

SEQ ID NO: 1393741 - RNA, 16 nt, Human
auugaggcaggcacug

SEQ ID NO: 1393742 - RNA, 18 nt, Human
augagcacgcauggaaaa

SEQ ID NO: 1393743 - RNA, 13 nt, Human
aggaagaucccuu

SEQ ID NO: 1393744 - RNA, 19 nt, Human
agcugccccggggaggggc

SEQ ID NO: 1393745 - RNA, 22 nt, Human
agcugccccggggaggggcgcu

SEQ ID NO: 1393746 - RNA, 21 nt, Human
agcuggccuugugaggagcug

SEQ ID NO: 1393747 - RNA, 18 nt, Human
agcucuaucaccaaggag

SEQ ID NO: 1393748 - RNA, 15 nt, Human
aggcacuaucugggu

SEQ ID NO: 1393749 - RNA, 22 nt, Human
aggcacugccaaaacaucaacc

SEQ ID NO: 1393750 - RNA, 14 nt, Human
aggagcuggaaaca

SEQ ID NO: 1393751 - RNA, 17 nt, Human
aggcacagaaacuccug

SEQ ID NO: 1393752 - RNA, 16 nt, Human
aggacgcucucuggcc

SEQ ID NO: 1393753 - RNA, 13 nt, Human
aguuaggaacugg

SEQ ID NO: 1393754 - RNA, 15 nt, Human
aguucuagugaccga

SEQ ID NO: 1393755 - RNA, 14 nt, Human
agcucaggcuggca

SEQ ID NO: 1393756 - RNA, 19 nt, Human
agcucaugaguaacugauu

SEQ ID NO: 1393757 - RNA, 13 nt, Human
agcucguggaaca

SEQ ID NO: 1393758 - RNA, 18 nt, Human
agcgaguacuucccgcug

SEQ ID NO: 1393759 - RNA, 20 nt, Human
agcccuccuuaucaaaggac

SEQ ID NO: 1393760 - RNA, 15 nt, Human
agccuccagcugccc

SEQ ID NO: 1393761 - RNA, 15 nt, Human
accccugagcuugca

SEQ ID NO: 1393762 - RNA, 19 nt, Human
acagcuacuugggaggcug

SEQ ID NO: 1393763 - RNA, 20 nt, Human
acagcacgggggccaaggau

SEQ ID NO: 1393764 - RNA, 23 nt, Human
acaggaugguucccuugaugaag

SEQ ID NO: 1393765 - RNA, 12 nt, Human
accaaggcugau

SEQ ID NO: 1393766 - RNA, 16 nt, Human
accaucccggccggcg

SEQ ID NO: 1393767 - RNA, 19 nt, Human
acccccugcaaagcccagc

SEQ ID NO: 1393768 - RNA, 10 nt, Human
aauggucaau

SEQ ID NO: 1393769 - RNA, 22 nt, Human
acaucaaccugccagcuggccu

SEQ ID NO: 1393770 - RNA, 14 nt, Human
accaacacccugag

SEQ ID NO: 1393771 - RNA, 14 nt, Human
aaacaauaacgaua

SEQ ID NO: 1393772 - RNA, 15 nt, Human
aaggggcggcggccc

SEQ ID NO: 1393773 - RNA, 18 nt, Human
aaggcccccgggccgacg

SEQ ID NO: 1393774 - RNA, 13 nt, Human
aaggugaucuggc

SEQ ID NO: 1393775 - RNA, 22 nt, Human
accgcuguacgcgagcgcgcgc

SEQ ID NO: 1393776 - RNA, 15 nt, Human
accuccauggaaacg

SEQ ID NO: 1393777 - RNA, 10 nt, Human
accugagccc

SEQ ID NO: 1393778 - RNA, 16 nt, Human
accccuggccaaggaa

SEQ ID NO: 1393779 - RNA, 19 nt, Human
acccgggaggcagagguug

SEQ ID NO: 1393780 - RNA, 15 nt, Human
accaucccggccggc

SEQ ID NO: 1393781 - RNA, 19 nt, Human
accaaggcccccgggccga

SEQ ID NO: 1393782 - RNA, 22 nt, Human
accaaggcccccgggccgacgg

SEQ ID NO: 1393783 - RNA, 21 nt, Human
acuuccagggcuacgcgcgcu

SEQ ID NO: 1393784 - RNA, 14 nt, Human
acuuccucccggcc

SEQ ID NO: 1393785 - RNA, 17 nt, Human
acuuccucccggccgcg

SEQ ID NO: 1393786 - RNA, 17 nt, Human
acgcucugggucgccgg

SEQ ID NO: 1393787 - RNA, 20 nt, Human
acgcucugggucgccggcau

SEQ ID NO: 1393788 - RNA, 13 nt, Human
acgcucucuggcc

SEQ ID NO: 1393789 - RNA, 18 nt, Human
acgcgcgcuccgcgcagc

SEQ ID NO: 1393790 - RNA, 19 nt, Human
acgcucucuggccuucggc

SEQ ID NO: 1393791 - RNA, 16 nt, Human
acgggggccaaggaug

SEQ ID NO: 1393792 - RNA, 17 nt, Human
acuccagugagacagcu

SEQ ID NO: 1393793 - RNA, 16 nt, Human
acguucuuacuaguuu

SEQ ID NO: 1393794 - RNA, 13 nt, Human
aagugcagccccg

SEQ ID NO: 1393795 - RNA, 12 nt, Human
aaugcagccccc

SEQ ID NO: 1393796 - RNA, 13 nt, Human
cucugcagcuucc

SEQ ID NO: 1393797 - RNA, 21 nt, Human
cucgcccacuuccucccggcc

SEQ ID NO: 1393798 - RNA, 22 nt, Human
cucgcccacuuccucccggccg

SEQ ID NO: 1393799 - RNA, 16 nt, Human
cucggccugcucgccc

SEQ ID NO: 1393800 - RNA, 17 nt, Human
cucccggccgcgcugcg

SEQ ID NO: 1393801 - RNA, 21 nt, Human
cuccauggaaacgaagcacca

SEQ ID NO: 1393802 - RNA, 15 nt, Human
cucccuuggggccua

SEQ ID NO: 1393803 - RNA, 13 nt, Human
cucccuuucaaca

SEQ ID NO: 1393804 - RNA, 15 nt, Human
cucuggccuucggcc

SEQ ID NO: 1393805 - RNA, 16 nt, Human
cucugcccauccugcc

SEQ ID NO: 1393806 - RNA, 17 nt, Human
cucuggccuucggccuc

SEQ ID NO: 1393807 - RNA, 21 nt, Human
cugagaccaaggcccccgggc

SEQ ID NO: 1393808 - RNA, 23 nt, Human
cugagaccaaggcccccgggccg

SEQ ID NO: 1393809 - RNA, 14 nt, Human
cugaguaaugcauu

SEQ ID NO: 1393810 - RNA, 20 nt, Human
cugcagcgaguacuucccgc

SEQ ID NO: 1393811 - RNA, 17 nt, Human
cugccagcuggccuugu

SEQ ID NO: 1393812 - RNA, 18 nt, Human
agagccggagccuccagc

SEQ ID NO: 1393813 - RNA, 15 nt, Human
agaggguuuggaagc

SEQ ID NO: 1393814 - RNA, 18 nt, Human
agcacgggggccaaggau

SEQ ID NO: 1393815 - RNA, 14 nt, Human
agcaugggaaguga

SEQ ID NO: 1393816 - RNA, 14 nt, Human
agauccuggaaauc

SEQ ID NO: 1393817 - RNA, 14 nt, Human
agaugaggccgcca

SEQ ID NO: 1393818 - RNA, 15 nt, Human
cagggcugaagcugu

SEQ ID NO: 1393819 - RNA, 20 nt, Human
cagggcugaagcuguguccu

SEQ ID NO: 1393820 - RNA, 20 nt, Human
caggggccacaccaaccuuc

SEQ ID NO: 1393821 - RNA, 18 nt, Human
caguccauugggcaggca

SEQ ID NO: 1393822 - RNA, 20 nt, Human
caguccauugggcaggcaga

SEQ ID NO: 1393823 - RNA, 23 nt, Human
caguagaaugggggcagcaccuc

SEQ ID NO: 1393824 - RNA, 22 nt, Human
cacuugaacccgggaggcagag

SEQ ID NO: 1393825 - RNA, 19 nt, Human
cacuuguguuuugcaagcc

SEQ ID NO: 1393826 - RNA, 13 nt, Human
caggcuggcaccg

SEQ ID NO: 1393827 - RNA, 15 nt, Human
caggcuggcaccgcu

SEQ ID NO: 1393828 - RNA, 20 nt, Human
caggcuggcgugcagcauca

SEQ ID NO: 1393829 - RNA, 18 nt, Human
caggcggguccgggucgc

SEQ ID NO: 1393830 - RNA, 11 nt, Human
caguguucccu

SEQ ID NO: 1393831 - RNA, 19 nt, Human
cagugucaaugcagccccc

SEQ ID NO: 1393832 - RNA, 14 nt, Human
cauaccccuggcca

SEQ ID NO: 1393833 - RNA, 14 nt, Human
cucaucccacccgc

SEQ ID NO: 1393834 - RNA, 16 nt, Human
cucagcuucacccuga

SEQ ID NO: 1393835 - RNA, 23 nt, Human
cucauggaauuggagcucguggg

SEQ ID NO: 1393836 - RNA, 21 nt, Human
cuccagcuggccgggagccug

SEQ ID NO: 1393837 - RNA, 18 nt, Human
cuccacuuggucugugag

SEQ ID NO: 1393838 - RNA, 23 nt, Human
gaaagccaugugcagccaccagu

SEQ ID NO: 1393839 - RNA, 17 nt, Human
gaaagaagagccggagc

SEQ ID NO: 1393840 - RNA, 19 nt, Human
gacccaaaaggcagaagca

SEQ ID NO: 1393841 - RNA, 14 nt, Human
gacggcuccggacg

SEQ ID NO: 1393842 - RNA, 17 nt, Human
gacggcuccggacgcug

SEQ ID NO: 1393843 - RNA, 13 nt, Human
gacggagccggga

SEQ ID NO: 1393844 - RNA, 15 nt, Human
gacgcucucuggccu

SEQ ID NO: 1393845 - RNA, 17 nt, Human
gaccaucccggccggcg

SEQ ID NO: 1393846 - RNA, 20 nt, Human
gaccaucccggccggcgcgc

SEQ ID NO: 1393847 - RNA, 21 nt, Human
gaccaucccggccggcgcgcu

SEQ ID NO: 1393848 - RNA, 23 nt, Human
gaccaaggcccccgggccgacgg

SEQ ID NO: 1393849 - RNA, 16 nt, Human
cugccccggggagggg

SEQ ID NO: 1393850 - RNA, 20 nt, Human
cugccccggggaggggcgcu

SEQ ID NO: 1393851 - RNA, 22 nt, Human
cuuugugcagauucuuuacccc

SEQ ID NO: 1393852 - RNA, 17 nt, Human
gcacgggggccaaggau

SEQ ID NO: 1393853 - RNA, 18 nt, Human
gcagggugaacugcagcg

SEQ ID NO: 1393854 - RNA, 23 nt, Human
gcaguagaaugggggcagcaccu

SEQ ID NO: 1393855 - RNA, 18 nt, Human
gcagcuuccaggcuggcg

SEQ ID NO: 1393856 - RNA, 20 nt, Human
gcagcuuccaggcuggcgug

SEQ ID NO: 1393857 - RNA, 17 nt, Human
gcaggaccaucccggcc

SEQ ID NO: 1393858 - RNA, 21 nt, Human
gcaggaccaucccggccggcg

SEQ ID NO: 1393859 - RNA, 22 nt, Human
gcagcccccauuguggucacag

SEQ ID NO: 1393860 - RNA, 14 nt, Human
gcagcucaggcugg

SEQ ID NO: 1393861 - RNA, 16 nt, Human
gcagcucaggcuggca

SEQ ID NO: 1393862 - RNA, 14 nt, Human
gcaguucugaagaa

SEQ ID NO: 1393863 - RNA, 21 nt, Human
gcaagcucuaucaccaaggag

SEQ ID NO: 1393864 - RNA, 16 nt, Human
gaugaggccgccaugu

SEQ ID NO: 1393865 - RNA, 17 nt, Human
gaugcaguucugaagaa

SEQ ID NO: 1393866 - RNA, 19 nt, Human
gagccaccaagcugguggc

SEQ ID NO: 1393867 - RNA, 13 nt, Human
gagacagcucugc

SEQ ID NO: 1393868 - RNA, 16 nt, Human
gagaccaaggcccccg

SEQ ID NO: 1393869 - RNA, 18 nt, Human
gagagacacacugaagaa

SEQ ID NO: 1393870 - RNA, 19 nt, Human
ucugcagcuuccaggcugg

SEQ ID NO: 1393871 - RNA, 20 nt, Human
ugcacacagcacgggggcca

SEQ ID NO: 1393872 - RNA, 13 nt, Human
ucauuuccaagca

SEQ ID NO: 1393873 - RNA, 19 nt, Human
ucgcagacacaugugcugg

SEQ ID NO: 1393874 - RNA, 21 nt, Human
ucgcaggaccaucccggccgg

SEQ ID NO: 1393875 - RNA, 13 nt, Human
ucgccacgcucug

SEQ ID NO: 1393876 - RNA, 15 nt, Human
ucgccacgcucuggg

SEQ ID NO: 1393877 - RNA, 21 nt, Human
ucgcccacuuccucccggccg

SEQ ID NO: 1393878 - RNA, 20 nt, Human
ucaccucauggaauuggagc

SEQ ID NO: 1393879 - RNA, 13 nt, Human
ucaugagggcugg

SEQ ID NO: 1393880 - RNA, 14 nt, Human
ucaucccacccgcc

SEQ ID NO: 1393881 - RNA, 15 nt, Human
ucaucccacccgccc

SEQ ID NO: 1393882 - RNA, 14 nt, Human
ucuaugccacaaga

SEQ ID NO: 1393883 - RNA, 20 nt, Human
guugagguaccuccaaggac

SEQ ID NO: 1393884 - RNA, 22 nt, Human
uaccuguucgcgcgccuccgcu

SEQ ID NO: 1393885 - RNA, 18 nt, Human
uaccacaggaaccacaag

SEQ ID NO: 1393886 - RNA, 14 nt, Human
uacgcgagcgcgcg

SEQ ID NO: 1393887 - RNA, 20 nt, Human
ucacuugaacccgggaggca

SEQ ID NO: 1393888 - RNA, 21 nt, Human
ucaaccugccagcuggccuug

SEQ ID NO: 1393889 - RNA, 15 nt, Human
gcuccggacgcugcu

SEQ ID NO: 1393890 - RNA, 24 nt, Human
gcuccggacgcugcugccgugggc

SEQ ID NO: 1393891 - RNA, 14 nt, Human
gcucgcccacuucc

SEQ ID NO: 1393892 - RNA, 21 nt, Human
gcucgcccacuuccucccggc

SEQ ID NO: 1393893 - RNA, 22 nt, Human
gcucgcccacuuccucccggcc

SEQ ID NO: 1393894 - RNA, 14 nt, Human
gcucgcuuccgcau

SEQ ID NO: 1393895 - RNA, 19 nt, Human
gcucauggaauuggagcuc

SEQ ID NO: 1393896 - RNA, 18 nt, Human
gcuccgcgcagcucaggc

SEQ ID NO: 1393897 - RNA, 13 nt, Human
gcucagcccuggu

SEQ ID NO: 1393898 - RNA, 20 nt, Human
gcucaggcuggcaccgcugu

SEQ ID NO: 1393899 - RNA, 17 nt, Human
ggcccugugcggccugg

SEQ ID NO: 1393900 - RNA, 14 nt, Human
ggccgacggagccg

SEQ ID NO: 1393901 - RNA, 18 nt, Human
ggccgacggagccgggaa

SEQ ID NO: 1393902 - RNA, 15 nt, Human
ggccgcgcugcgcgc

SEQ ID NO: 1393903 - RNA, 21 nt, Human
ggccugagaccaaggcccccg

SEQ ID NO: 1393904 - RNA, 15 nt, Human
ggccugcucgcccac

SEQ ID NO: 1393905 - RNA, 23 nt, Human
ggcgcuggcugcgcucggccugc

SEQ ID NO: 1393906 - RNA, 21 nt, Human
ggcggguccgggucgcaggac

SEQ ID NO: 1393907 - RNA, 22 nt, Human
ggcgcggggcggggagcgagcc

SEQ ID NO: 1393908 - RNA, 18 nt, Human
gccacgcucugggucgcc

SEQ ID NO: 1393909 - RNA, 19 nt, Human
gccacgcucugggucgccg

SEQ ID NO: 1393910 - RNA, 20 nt, Human
gccacgcucugggucgccgg

SEQ ID NO: 1393911 - RNA, 21 nt, Human
gccacgcucugggucgccggc

SEQ ID NO: 1393912 - RNA, 14 nt, Human
gccagcuggccuug

SEQ ID NO: 1393913 - RNA, 16 nt, Human
gcgagccccaggcggg

SEQ ID NO: 1393914 - RNA, 19 nt, Human
gcgagcgcgcgcgcccucu

SEQ ID NO: 1393915 - RNA, 15 nt, Human
gcuacuugggaggcu

SEQ ID NO: 1393916 - RNA, 15 nt, Human
gcuagaaccaccugc

SEQ ID NO: 1393917 - RNA, 17 nt, Human
gcggcccugugcggccu

SEQ ID NO: 1393918 - RNA, 18 nt, Human
gcuacgcgcgcuccgcgc

SEQ ID NO: 1393919 - RNA, 21 nt, Human
gcuacgcgcgcuccgcgcagc

SEQ ID NO: 1393920 - RNA, 15 nt, Human
gcgcgcgcgcccucu

SEQ ID NO: 1393921 - RNA, 21 nt, Human
gcgcucaucccacccgcccac

SEQ ID NO: 1393922 - RNA, 12 nt, Human
gcgcuccgcgca

SEQ ID NO: 1393923 - RNA, 18 nt, Human
gcgcucgcuuccgcaucc

SEQ ID NO: 1393924 - RNA, 17 nt, Human
gcgcugcgcgccgcgcu

SEQ ID NO: 1393925 - RNA, 16 nt, Human
gcgcuggcugcgcucg

SEQ ID NO: 1393926 - RNA, 23 nt, Human
gcgcccucuggcugcugguggcg

SEQ ID NO: 1393927 - RNA, 13 nt, Human
gcgccgcgcuccu

SEQ ID NO: 1393928 - RNA, 17 nt, Human
gcgccuccgcuacuucc

SEQ ID NO: 1393929 - RNA, 18 nt, Human
gcgcgcccucuggcugcu

SEQ ID NO: 1393930 - RNA, 20 nt, Human
gcgcgcccucuggcugcugg

SEQ ID NO: 1393931 - RNA, 15 nt, Human
ggcaccgcuguacgc

SEQ ID NO: 1393932 - RNA, 22 nt, Human
gggaccccugagcuugcagaga

SEQ ID NO: 1393933 - RNA, 19 nt, Human
gggccgacggagccgggaa

SEQ ID NO: 1393934 - RNA, 11 nt, Human
gggcggcggcc

SEQ ID NO: 1393935 - RNA, 13 nt, Human
gggcuacgcgcgc

SEQ ID NO: 1393936 - RNA, 13 nt, Human
ggcuggcaccgcu

SEQ ID NO: 1393937 - RNA, 17 nt, Human
ggugaacugcagcgagu

SEQ ID NO: 1393938 - RNA, 12 nt, Human
gguggcgcuggc

SEQ ID NO: 1393939 - RNA, 14 nt, Human
gguggcgcuggcug

SEQ ID NO: 1393940 - RNA, 22 nt, Human
gguggcgcuggcugcgcucggc

SEQ ID NO: 1393941 - RNA, 12 nt, Human
ggugggcagaga

SEQ ID NO: 1393942 - RNA, 17 nt, Human
ggggcgcucgcuuccgc

SEQ ID NO: 1393943 - RNA, 11 nt, Human
gggugaacugc

SEQ ID NO: 1393944 - RNA, 19 nt, Human
gguccgggucgcaggacca

SEQ ID NO: 1393945 - RNA, 13 nt, Human
ggucgcaggacca

SEQ ID NO: 1393946 - RNA, 18 nt, Human
ggucgcaggaccaucccg

SEQ ID NO: 1393947 - RNA, 20 nt, Human
guguugcagugucugcugga

SEQ ID NO: 1393948 - RNA, 23 nt, Human
guggcgcuggcugcgcucggccu

SEQ ID NO: 1393949 - RNA, 16 nt, Human
guggaacaguuaccuc

SEQ ID NO: 1393950 - RNA, 21 nt, Human
gguucuucuuggucucagugu

SEQ ID NO: 1393951 - RNA, 14 nt, Human
ggugugugcagcau

SEQ ID NO: 1393952 - RNA, 12 nt, Human
uuugugaagcaa

SEQ ID NO: 1393953 - RNA, 11 nt, Human
agccccaggcg

SEQ ID NO: 1393954 - RNA, 22 nt, Human
agccccaggcggguccgggucg

SEQ ID NO: 1393955 - RNA, 21 nt, Human
agccgggaaagaagagccgga

SEQ ID NO: 1393956 - RNA, 16 nt, Human
agccuccagcugcccc

SEQ ID NO: 1393957 - RNA, 17 nt, Human
agccuccagcugccccg

SEQ ID NO: 1393958 - RNA, 16 nt, Human
agccggagccuccagc

SEQ ID NO: 1393959 - RNA, 17 nt, Human
agccggagccuccagcu

SEQ ID NO: 1393960 - RNA, 18 nt, Human
agccggagccuccagcug

SEQ ID NO: 1393961 - RNA, 13 nt, Human
agccgggaaagaa

SEQ ID NO: 1393962 - RNA, 17 nt, Human
ugcagugucugcuggag

SEQ ID NO: 1393963 - RNA, 16 nt, Human
ugcaguucugaagaag

SEQ ID NO: 1393964 - RNA, 20 nt, Human
ugccccggggaggggcgcuc

SEQ ID NO: 1393965 - RNA, 23 nt, Human
ugccccggggaggggcgcucgcu

SEQ ID NO: 1393966 - RNA, 16 nt, Human
ugcccauaccccuggc

SEQ ID NO: 1393967 - RNA, 18 nt, Human
ugcccauaccccuggcca

SEQ ID NO: 1393968 - RNA, 19 nt, Human
uuucaugaaggggcggcgg

SEQ ID NO: 1393969 - RNA, 14 nt, Human
aggguuuggaagcc

SEQ ID NO: 1393970 - RNA, 15 nt, Human
aggcuggcaccgcug

SEQ ID NO: 1393971 - RNA, 13 nt, Human
aggggcgcucgcu

SEQ ID NO: 1393972 - RNA, 17 nt, Human
aggggcgcucgcuuccg

SEQ ID NO: 1393973 - RNA, 21 nt, Human
agggaggacgcucucuggccu

SEQ ID NO: 1393974 - RNA, 15 nt, Human
agucaccucauggaa

SEQ ID NO: 1393975 - RNA, 23 nt, Human
agucucuaucauuaaaguucuag

SEQ ID NO: 1393976 - RNA, 18 nt, Human
aguccauugggcaggcag

SEQ ID NO: 1393977 - RNA, 19 nt, Human
aguggaacgagacaagcag

SEQ ID NO: 1393978 - RNA, 13 nt, Human
aguguucccuggg

SEQ ID NO: 1393979 - RNA, 15 nt, Human
agcugccccggggag

SEQ ID NO: 1393980 - RNA, 16 nt, Human
agcucaggcuggcacc

SEQ ID NO: 1393981 - RNA, 16 nt, Human
agcucagggggguggu

SEQ ID NO: 1393982 - RNA, 13 nt, Human
agcucgugggaca

SEQ ID NO: 1393983 - RNA, 16 nt, Human
agcuuccaggcuggcg

SEQ ID NO: 1393984 - RNA, 18 nt, Human
aggaaaugcuccuccagg

SEQ ID NO: 1393985 - RNA, 21 nt, Human
aggaaaugcuccuccagggag

SEQ ID NO: 1393986 - RNA, 15 nt, Human
aggacgcucucuggc

SEQ ID NO: 1393987 - RNA, 13 nt, Human
aggagcuggaaac

SEQ ID NO: 1393988 - RNA, 19 nt, Human
aggaacuggugucuucagg

SEQ ID NO: 1393989 - RNA, 15 nt, Human
aggcaccucucuggg

SEQ ID NO: 1393990 - RNA, 13 nt, Human
aggcaucgcaaug

SEQ ID NO: 1393991 - RNA, 13 nt, Human
aggccaugggaca

SEQ ID NO: 1393992 - RNA, 14 nt, Human
aggccaugggacag

SEQ ID NO: 1393993 - RNA, 20 nt, Human
aggcccccgggccgacggag

SEQ ID NO: 1393994 - RNA, 21 nt, Human
aggccuugccuaggcauagcc

SEQ ID NO: 1393995 - RNA, 20 nt, Human
aggcggguccgggucgcagg

SEQ ID NO: 1393996 - RNA, 16 nt, Human
auuauagucacuaguu

SEQ ID NO: 1393997 - RNA, 21 nt, Human
auguuuacagauccccaagcc

SEQ ID NO: 1393998 - RNA, 21 nt, Human
augggacauuugcucauggaa

SEQ ID NO: 1393999 - RNA, 12 nt, Human
augugcuggcca

SEQ ID NO: 1394000 - RNA, 23 nt, Human
aucgcagacacaugugcuggcca

SEQ ID NO: 1394001 - RNA, 15 nt, Human
auccuacaagacaca

SEQ ID NO: 1394002 - RNA, 13 nt, Human
augaauaucaguu

SEQ ID NO: 1394003 - RNA, 14 nt, Human
augaggccgccaug

SEQ ID NO: 1394004 - RNA, 20 nt, Human
aucaaccugccagcuggccu

SEQ ID NO: 1394005 - RNA, 21 nt, Human
aucagccuaguugaucagcuu

SEQ ID NO: 1394006 - RNA, 18 nt, Human
auaccccuggccaaggaa

SEQ ID NO: 1394007 - RNA, 14 nt, Human
cacaugauccugca

SEQ ID NO: 1394008 - RNA, 20 nt, Human
caccgcuguacgcgagcgcg

SEQ ID NO: 1394009 - RNA, 22 nt, Human
cacaucugagccccgaaucuga

SEQ ID NO: 1394010 - RNA, 13 nt, Human
cacacugaagaag

SEQ ID NO: 1394011 - RNA, 17 nt, Human
caagggugugugcagca

SEQ ID NO: 1394012 - RNA, 19 nt, Human
cagacacaugugcuggcca

SEQ ID NO: 1394013 - RNA, 18 nt, Human
cagaagcuccagguagag

SEQ ID NO: 1394014 - RNA, 20 nt, Human
cagaucuaugccacaagaac

SEQ ID NO: 1394015 - RNA, 18 nt, Human
cacuuccucccggccgcg

SEQ ID NO: 1394016 - RNA, 20 nt, Human
cacuuccucccggccgcgcu

SEQ ID NO: 1394017 - RNA, 12 nt, Human
cacuugucaaua

SEQ ID NO: 1394018 - RNA, 22 nt, Human
cacucuauguucuaagaaguga

SEQ ID NO: 1394019 - RNA, 22 nt, Human
cacugcagaagacaguauggca

SEQ ID NO: 1394020 - RNA, 14 nt, Human
auuccacagcugcu

SEQ ID NO: 1394021 - RNA, 13 nt, Human
caaccugccagcu

SEQ ID NO: 1394022 - RNA, 14 nt, Human
cagggaggacgcuc

SEQ ID NO: 1394023 - RNA, 19 nt, Human
cagggcuacgcgcgcuccg

SEQ ID NO: 1394024 - RNA, 18 nt, Human
cagcucuaaaugucaauc

SEQ ID NO: 1394025 - RNA, 19 nt, Human
cagcucaggcuggcaccgc

SEQ ID NO: 1394026 - RNA, 20 nt, Human
cagccucuuagaugcaguuc

SEQ ID NO: 1394027 - RNA, 15 nt, Human
cagcugccccgggga

SEQ ID NO: 1394028 - RNA, 21 nt, Human
cagcugccccggggaggggcg

SEQ ID NO: 1394029 - RNA, 14 nt, Human
cagcuucacccuga

SEQ ID NO: 1394030 - RNA, 18 nt, Human
caggaaccacaagacugc

SEQ ID NO: 1394031 - RNA, 18 nt, Human
caggaccaucccggccgg

SEQ ID NO: 1394032 - RNA, 20 nt, Human
caggaccaucccggccggcg

SEQ ID NO: 1394033 - RNA, 14 nt, Human
cagugucugcugga

SEQ ID NO: 1394034 - RNA, 13 nt, Human
cauagcccugccu

SEQ ID NO: 1394035 - RNA, 15 nt, Human
caguucugaagaaga

SEQ ID NO: 1394036 - RNA, 21 nt, Human
caucaaccugccagcuggccu

SEQ ID NO: 1394037 - RNA, 15 nt, Human
cauccugaggcucca

SEQ ID NO: 1394038 - RNA, 17 nt, Human
cauugaggcaggcacug

SEQ ID NO: 1394039 - RNA, 15 nt, Human
caugugcuggccacc

SEQ ID NO: 1394040 - RNA, 15 nt, Human
caugggacagggagg

SEQ ID NO: 1394041 - RNA, 17 nt, Human
ccaugggacagggagga

SEQ ID NO: 1394042 - RNA, 12 nt, Human
ccaucccggccg

SEQ ID NO: 1394043 - RNA, 21 nt, Human
ccauccugaggcuccacuugg

SEQ ID NO: 1394044 - RNA, 18 nt, Human
ccacgcucugggucgccg

SEQ ID NO: 1394045 - RNA, 19 nt, Human
ccacgcucugggucgccgg

SEQ ID NO: 1394046 - RNA, 20 nt, Human
ccaagcauuuagauguauag

SEQ ID NO: 1394047 - RNA, 15 nt, Human
ccacccgcccaccgc

SEQ ID NO: 1394048 - RNA, 20 nt, Human
ccaggcggguccgggucgca

SEQ ID NO: 1394049 - RNA, 13 nt, Human
ccaggcugagccu

SEQ ID NO: 1394050 - RNA, 23 nt, Human
ccagggcuacgcgcgcuccgcgc

SEQ ID NO: 1394051 - RNA, 16 nt, Human
ccacuuccucccggcc

SEQ ID NO: 1394052 - RNA, 17 nt, Human
ccacuuccucccggccg

SEQ ID NO: 1394053 - RNA, 15 nt, Human
cuucucuucacaguc

SEQ ID NO: 1394054 - RNA, 16 nt, Human
uaaauaaaaauaaucc

SEQ ID NO: 1394055 - RNA, 22 nt, Human
uaagaauucuguugauggaaau

SEQ ID NO: 1394056 - RNA, 18 nt, Human
acaaauccaaugaaauga

SEQ ID NO: 1394057 - RNA, 20 nt, Human
gaccauacuaauuauacccc

SEQ ID NO: 1394058 - RNA, 15 nt, Human
auuucuaugaaauau

SEQ ID NO: 1394059 - RNA, 22 nt, Human
ccgggagccugaucaccugccc

SEQ ID NO: 1394060 - RNA, 16 nt, Human
ucccugccccccagcc

SEQ ID NO: 1394061 - RNA, 15 nt, Human
acauccuacaagaca

SEQ ID NO: 1394062 - RNA, 18 nt, Human
ucaagggugugugcagca

SEQ ID NO: 1394063 - RNA, 16 nt, Human
ggcauggguuuuauua

SEQ ID NO: 1394064 - RNA, 21 nt, Human
acagcccuucuuuccacagaa

SEQ ID NO: 1394065 - RNA, 21 nt, Human
caacacacagauuugagcuca

SEQ ID NO: 1394066 - RNA, 21 nt, Human
ccuuuuuuugaaaaaaagcuu

SEQ ID NO: 1394067 - RNA, 16 nt, Human
cccuuuacccccauga

SEQ ID NO: 1394068 - RNA, 19 nt, Human
ugaaaccaaaccagagccu

SEQ ID NO: 1394069 - RNA, 13 nt, Human
auuuuaaaagaau

SEQ ID NO: 1394070 - RNA, 15 nt, Human
agguguguugcagug

SEQ ID NO: 1394071 - RNA, 16 nt, Human
ggagccuccagcugcc

SEQ ID NO: 1394072 - RNA, 15 nt, Human
gugaacuugguuuua

SEQ ID NO: 1394073 - RNA, 13 nt, Human
cucugcagcuucc

SEQ ID NO: 1394074 - RNA, 15 nt, Human
gcccacuagacccac

SEQ ID NO: 1394075 - RNA, 14 nt, Human
uaaaagacaaggaa

SEQ ID NO: 1394076 - RNA, 14 nt, Human
acugccaucauuua

SEQ ID NO: 1394077 - RNA, 23 nt, Human
aaugcuccuccagggagucucag

SEQ ID NO: 1394078 - RNA, 18 nt, Human
uacauaaaguaugugcau

SEQ ID NO: 1394079 - RNA, 17 nt, Human
cugaucaccugcccugc

SEQ ID NO: 1394080 - RNA, 12 nt, Human
cucccugccccc

SEQ ID NO: 1394081 - RNA, 19 nt, Human
augugcauauuuuauuaua

SEQ ID NO: 1394082 - RNA, 18 nt, Human
aagucuuucacauuuaaa

SEQ ID NO: 1394083 - RNA, 17 nt, Human
aaucuuucacaggggac

SEQ ID NO: 1394084 - RNA, 13 nt, Human
auauauauuuuuu

SEQ ID NO: 1394085 - RNA, 19 nt, Human
uccagaaagugacaagcuc

SEQ ID NO: 1394086 - RNA, 15 nt, Human
ccucccggccgcgcu

SEQ ID NO: 1394087 - RNA, 20 nt, Human
agcuucacuguaaaauaaua

SEQ ID NO: 1394088 - RNA, 14 nt, Human
cuucacccugaggu

SEQ ID NO: 1394089 - RNA, 14 nt, Human
caagaaggaaagau

SEQ ID NO: 1394090 - RNA, 17 nt, Human
augcagagguccacaac

SEQ ID NO: 1394091 - RNA, 11 nt, Human
gcauccuaguc

SEQ ID NO: 1394092 - RNA, 15 nt, Human
aagccuccuuuuaaa

SEQ ID NO: 1394093 - RNA, 19 nt, Human
gcugccccggggaggggcg

SEQ ID NO: 1394094 - RNA, 21 nt, Human
ccaaggaugccccgucccccu

SEQ ID NO: 1394095 - RNA, 23 nt, Human
cccacuggacucaccucccccau

SEQ ID NO: 1394096 - RNA, 15 nt, Human
auccugccccugagc

SEQ ID NO: 1394097 - RNA, 14 nt, Human
cacaagaaaugaaa

SEQ ID NO: 1394098 - RNA, 12 nt, Human
uauauuuccuua

SEQ ID NO: 1394099 - RNA, 16 nt, Human
acaccaaccuucugag

SEQ ID NO: 1394100 - RNA, 16 nt, Human
caaaaggauaaugaau

SEQ ID NO: 1394101 - RNA, 15 nt, Human
auuauuuuuuaaaaa

SEQ ID NO: 1394102 - RNA, 20 nt, Human
guucugcagauaaacaguag

SEQ ID NO: 1394103 - RNA, 20 nt, Human
cacuagacccacuggacuca

SEQ ID NO: 1394104 - RNA, 23 nt, Human
caccucauggaauuggagcucgu

SEQ ID NO: 1394105 - RNA, 21 nt, Human
ccaguccauugggcaggcaga

SEQ ID NO: 1394106 - RNA, 16 nt, Human
augcuguauuuuaaaa

SEQ ID NO: 1394107 - RNA, 22 nt, Human
uuguaacaagccuccuuuuaaa

SEQ ID NO: 1394108 - RNA, 22 nt, Human
auauuuacaaaugggaaacaaa

SEQ ID NO: 1394109 - RNA, 15 nt, Human
augauaacuggaaac

SEQ ID NO: 1394110 - RNA, 18 nt, Human
ugcuauuuauuaaguauu

SEQ ID NO: 1394111 - RNA, 15 nt, Human
aaacauaugaauuau

SEQ ID NO: 1394112 - RNA, 21 nt, Human
ccauccugccccugagcccau

SEQ ID NO: 1394113 - RNA, 20 nt, Human
acaccuuaucuauguagaau

SEQ ID NO: 1394114 - RNA, 19 nt, Human
guaguccuguaauggaagc

SEQ ID NO: 1394115 - RNA, 20 nt, Human
aggcugagaugggagaauca

SEQ ID NO: 1394116 - RNA, 16 nt, Human
gaauauaaauuuauca

SEQ ID NO: 1394117 - RNA, 18 nt, Human
aucuuauaauuuaaaaua

SEQ ID NO: 1394118 - RNA, 19 nt, Human
cuuccuaauuccacagcug

SEQ ID NO: 1394119 - RNA, 15 nt, Human
gaucuggcucuggac

SEQ ID NO: 1394120 - RNA, 12 nt, Human
ucuauguagaau

SEQ ID NO: 1394121 - RNA, 17 nt, Human
caagccuccuuuuaaag

SEQ ID NO: 1394122 - RNA, 14 nt, Human
gacaagaaggaaag

SEQ ID NO: 1394123 - RNA, 18 nt, Human
aaaucuuauaauuuaaaa

SEQ ID NO: 1394124 - RNA, 17 nt, Human
aaagcuccauuuuuagu

SEQ ID NO: 1394125 - RNA, 17 nt, Human
ugugcauauuuuauuau

SEQ ID NO: 1394126 - RNA, 12 nt, Human
aaaauaacaaua

SEQ ID NO: 1394127 - RNA, 17 nt, Human
gcagcauuguuggcugu

SEQ ID NO: 1394128 - RNA, 22 nt, Human
ugaaaaaguucugcagauaaac

SEQ ID NO: 1394129 - RNA, 22 nt, Human
cuggagacauugaggcaggcac

SEQ ID NO: 1394130 - RNA, 21 nt, Human
cccacuggacucaccuccccc

SEQ ID NO: 1394131 - RNA, 21 nt, Human
gaagagccggagccuccagcu

SEQ ID NO: 1394132 - RNA, 19 nt, Human
cuccagcuggccgggagcc

SEQ ID NO: 1394133 - RNA, 19 nt, Human
cuuggggccuaugcagagg

SEQ ID NO: 1394134 - RNA, 17 nt, Human
uaaaagacagugaaaga

SEQ ID NO: 1394135 - RNA, 23 nt, Human
gccggcgcgcucaucccacccgc

SEQ ID NO: 1394136 - RNA, 17 nt, Human
caggcuggcgugcagca

SEQ ID NO: 1394137 - RNA, 18 nt, Human
auuuaggccaugggacag

SEQ ID NO: 1394138 - RNA, 21 nt, Human
gcccauccugccccugagccc

SEQ ID NO: 1394139 - RNA, 14 nt, Human
cggggaggggcgcu

SEQ ID NO: 1394140 - RNA, 15 nt, Human
guguugcagugucug

SEQ ID NO: 1394141 - RNA, 12 nt, Human
uagcauuucucc

SEQ ID NO: 1394142 - RNA, 12 nt, Human
aguuauaaaaau

SEQ ID NO: 1394143 - RNA, 22 nt, Human
ggaaaugauguuucauaagaau

SEQ ID NO: 1394144 - RNA, 12 nt, Human
uuauuauaguca

SEQ ID NO: 1394145 - RNA, 14 nt, Human
cuugagguaaaagc

SEQ ID NO: 1394146 - RNA, 23 nt, Human
uaacgauaaaagacagugaaaga

SEQ ID NO: 1394147 - RNA, 17 nt, Human
cuucacuguaaaauaau

SEQ ID NO: 1394148 - RNA, 20 nt, Human
guuccuuccucugagccuug

SEQ ID NO: 1394149 - RNA, 17 nt, Human
cacaccaaccuucugag

SEQ ID NO: 1394150 - RNA, 13 nt, Human
cuccagcugcccc

SEQ ID NO: 1394151 - RNA, 16 nt, Human
acaaauccaaugaaau

SEQ ID NO: 1394152 - RNA, 18 nt, Human
cugagaccaaggcccccg

SEQ ID NO: 1394153 - RNA, 19 nt, Human
uaccccuggccaaggaaga

SEQ ID NO: 1394154 - RNA, 18 nt, Human
ucuauguagaauauauuu

SEQ ID NO: 1394155 - RNA, 20 nt, Human
ucagaauuucuaaaaguuua

SEQ ID NO: 1394156 - RNA, 18 nt, Human
ggcuccggacgcugcugc

SEQ ID NO: 1394157 - RNA, 12 nt, Human
uaaauauauauu

SEQ ID NO: 1394158 - RNA, 20 nt, Human
gcggggcggggagcgagccc

SEQ ID NO: 1394159 - RNA, 20 nt, Human
ggcuccggacgcugcugccg

SEQ ID NO: 1394160 - RNA, 16 nt, Human
auuccuuaagauauua

SEQ ID NO: 1394161 - RNA, 12 nt, Human
uaguacacacuu

SEQ ID NO: 1394162 - RNA, 16 nt, Human
gagaaacuggaacucu

SEQ ID NO: 1394163 - RNA, 17 nt, Human
aggcuggcgugcagcau

SEQ ID NO: 1394164 - RNA, 13 nt, Human
uccuacuuccccu

SEQ ID NO: 1394165 - RNA, 23 nt, Human
uggaaauguuuacagauccccaa

SEQ ID NO: 1394166 - RNA, 17 nt, Human
aguuuauauagaaaugu

SEQ ID NO: 1394167 - RNA, 12 nt, Human
gaaaauaacaau

SEQ ID NO: 1394168 - RNA, 20 nt, Human
gacaggcacuaucuggguuu

SEQ ID NO: 1394169 - RNA, 15 nt, Human
cacuuggucugugag

SEQ ID NO: 1394170 - RNA, 14 nt, Human
uucuggaauaaucc

SEQ ID NO: 1394171 - RNA, 18 nt, Human
aggcauagcccugccuca

SEQ ID NO: 1394172 - RNA, 13 nt, Human
ccugagcuugcag

SEQ ID NO: 1394173 - RNA, 17 nt, Human
gcucggccugcucgccc

SEQ ID NO: 1394174 - RNA, 20 nt, Human
ucaauaaaauccauacauuu

SEQ ID NO: 1394175 - RNA, 16 nt, Human
auuuuuagugaaauau

SEQ ID NO: 1394176 - RNA, 13 nt, Human
uuauguuuaauuc

SEQ ID NO: 1394177 - RNA, 20 nt, Human
uaucauuuaguuauaaaaau

SEQ ID NO: 1394178 - RNA, 11 nt, Human
gcaugguuuag

SEQ ID NO: 1394179 - RNA, 19 nt, Human
cccugccucaagcuaugug

SEQ ID NO: 1394180 - RNA, 23 nt, Human
agcucugcccauccugccccuga

SEQ ID NO: 1394181 - RNA, 18 nt, Human
gacauuugcucauggaau

SEQ ID NO: 1394182 - RNA, 22 nt, Human
gcuccuccagggagucucagcu

SEQ ID NO: 1394183 - RNA, 18 nt, Human
gacccacuggacucaccu

SEQ ID NO: 1394184 - RNA, 18 nt, Human
cucuggccuucggccucc

SEQ ID NO: 1394185 - RNA, 22 nt, Human
ucaacuccaaacugacucuuaa

SEQ ID NO: 1394186 - RNA, 18 nt, Human
gaaaugaaagcagggacu

SEQ ID NO: 1394187 - RNA, 13 nt, Human
ccaggcugagccu

SEQ ID NO: 1394188 - RNA, 16 nt, Human
ucuugagguaaaagca

SEQ ID NO: 1394189 - RNA, 19 nt, Human
cucuguucugcacacagca

SEQ ID NO: 1394190 - RNA, 21 nt, Human
gcgcucaucccacccgcccac

SEQ ID NO: 1394191 - RNA, 20 nt, Human
gaaacgaggauugggaaaaa

SEQ ID NO: 1394192 - RNA, 16 nt, Human
ugcaaauugucacagg

SEQ ID NO: 1394193 - RNA, 16 nt, Human
cgcgcgcuccgcgcag

SEQ ID NO: 1394194 - RNA, 20 nt, Human
ccccuauccuacuuccccuu

SEQ ID NO: 1394195 - RNA, 21 nt, Human
gggagccugaucaccugcccu

SEQ ID NO: 1394196 - RNA, 21 nt, Human
aaugaauggcuaagcaaaaug

SEQ ID NO: 1394197 - RNA, 14 nt, Human
cagagguugcagug

SEQ ID NO: 1394198 - RNA, 16 nt, Human
cgcuguuccucgccac

SEQ ID NO: 1394199 - RNA, 16 nt, Human
ccacuuauaggaauug

SEQ ID NO: 1394200 - RNA, 17 nt, Human
auuucuaaaaguuuaag

SEQ ID NO: 1394201 - RNA, 16 nt, Human
aaauauaaauaaaaau

SEQ ID NO: 1394202 - RNA, 23 nt, Human
gggaaagaagagccggagccucc

SEQ ID NO: 1394203 - RNA, 17 nt, Human
gccuaagugcagccccg

SEQ ID NO: 1394204 - RNA, 19 nt, Human
ggacucaccucccccaucu

SEQ ID NO: 1394205 - RNA, 16 nt, Human
ccugcaaagcccagcu

SEQ ID NO: 1394206 - RNA, 12 nt, Human
aauauauuuccu

SEQ ID NO: 1394207 - RNA, 20 nt, Human
auaauccuaaacauaugaau

SEQ ID NO: 1394208 - RNA, 17 nt, Human
acaaaugcauuucuaaa

SEQ ID NO: 1394209 - RNA, 22 nt, Human
auuacuguaagaaaauaucacu

SEQ ID NO: 1394210 - RNA, 22 nt, Human
gcuauuugcuguuauuuuaucu

SEQ ID NO: 1394211 - RNA, 18 nt, Human
uucugauauuggacagua

SEQ ID NO: 1394212 - RNA, 19 nt, Human
cccauggcacucuauguuc

SEQ ID NO: 1394213 - RNA, 23 nt, Human
uguagguagaucuggucuuuaga

SEQ ID NO: 1394214 - RNA, 17 nt, Human
caucgcagacacaugug

SEQ ID NO: 1394215 - RNA, 18 nt, Human
uaaauugacacuuaaaaa

SEQ ID NO: 1394216 - RNA, 17 nt, Human
agucuucagcagagaag

SEQ ID NO: 1394217 - RNA, 18 nt, Human
ccucuggcuccagcuggc

SEQ ID NO: 1394218 - RNA, 17 nt, Human
caagacccaaaaggcag

SEQ ID NO: 1394219 - RNA, 12 nt, Human
gucccaggcuga

SEQ ID NO: 1394220 - RNA, 18 nt, Human
ucaaggguacacugccuu

SEQ ID NO: 1394221 - RNA, 23 nt, Human
uuuguauaaaauaauuuuuauau

SEQ ID NO: 1394222 - RNA, 21 nt, Human
uagaugagagaacagggcuga

SEQ ID NO: 1394223 - RNA, 17 nt, Human
ggcccugugcggccugg

SEQ ID NO: 1394224 - RNA, 21 nt, Human
uaauaggcguaacuaauuuua

SEQ ID NO: 1394225 - RNA, 16 nt, Human
caauguucccccucuc

SEQ ID NO: 1394226 - RNA, 13 nt, Human
gaagaacugaaau

SEQ ID NO: 1394227 - RNA, 14 nt, Human
agcucaccaguccc

SEQ ID NO: 1394228 - RNA, 20 nt, Human
uggaauaauccuaaacauau

SEQ ID NO: 1394229 - RNA, 16 nt, Human
auuauacccccugcaa

SEQ ID NO: 1394230 - RNA, 21 nt, Human
cacaugaacuuguaaaggaau

SEQ ID NO: 1394231 - RNA, 16 nt, Human
ccacuuggucugugag

SEQ ID NO: 1394232 - RNA, 21 nt, Human
ucuucaacucccugcccccca

SEQ ID NO: 1394233 - RNA, 16 nt, Human
ucuuggggaauauguu

SEQ ID NO: 1394234 - RNA, 12 nt, Human
cuccauuuuuag

SEQ ID NO: 1394235 - RNA, 15 nt, Human
gaaaugauguuucau

SEQ ID NO: 1394236 - RNA, 14 nt, Human
cugccccccagccc

SEQ ID NO: 1394237 - RNA, 19 nt, Human
cugcgcgccgcgcuccucg

SEQ ID NO: 1394238 - RNA, 13 nt, Human
aggaaaaaauaac

SEQ ID NO: 1394239 - RNA, 14 nt, Human
uugacccacaagaa

SEQ ID NO: 1394240 - RNA, 16 nt, Human
auaacuggaaacuuca

SEQ ID NO: 1394241 - RNA, 21 nt, Human
ccggggaggggcgcucgcuuc

SEQ ID NO: 1394242 - RNA, 20 nt, Human
gcuugcagagaugaggccgc

SEQ ID NO: 1394243 - RNA, 17 nt, Human
caauucgauccccuguc

SEQ ID NO: 1394244 - RNA, 15 nt, Human
ggccaccugcugagc

SEQ ID NO: 1394245 - RNA, 17 nt, Human
cuagaaaacaggcaaau

SEQ ID NO: 1394246 - RNA, 19 nt, Human
uuaaauggaaguaaauguu

SEQ ID NO: 1394247 - RNA, 18 nt, Human
gaauaauccuaaacauau

SEQ ID NO: 1394248 - RNA, 20 nt, Human
uuugccgcuuaagcuuucag

SEQ ID NO: 1394249 - RNA, 15 nt, Human
gaaaugaaagcaggg

SEQ ID NO: 1394250 - RNA, 16 nt, Human
gccucagucucccucc

SEQ ID NO: 1394251 - RNA, 21 nt, Human
agcccuuccccucugcagcuu

SEQ ID NO: 1394252 - RNA, 18 nt, Human
caagcuaugugagcucac

SEQ ID NO: 1394253 - RNA, 14 nt, Human
ugagcucaccaguc

SEQ ID NO: 1394254 - RNA, 19 nt, Human
augaaguacucauacaugu

SEQ ID NO: 1394255 - RNA, 19 nt, Human
agcguugagccaccaagcu

SEQ ID NO: 1394256 - RNA, 20 nt, Human
acuccagugagacagcucug

SEQ ID NO: 1394257 - RNA, 20 nt, Human
accuacacgagauacagaau

SEQ ID NO: 1394258 - RNA, 18 nt, Human
ccaagcugguggcucugu

SEQ ID NO: 1394259 - RNA, 19 nt, Human
cugcaaagcccagcuugaa

SEQ ID NO: 1394260 - RNA, 14 nt, Human
ucccuugaugaaga

SEQ ID NO: 1394261 - RNA, 23 nt, Human
ccgcagggugaacugcagcgagu

SEQ ID NO: 1394262 - RNA, 15 nt, Human
aggguuuggaagcca

SEQ ID NO: 1394263 - RNA, 15 nt, Human
gcucgcuuccgcauc

SEQ ID NO: 1394264 - RNA, 22 nt, Human
ggcugcugguggcgcuggcugc

SEQ ID NO: 1394265 - RNA, 22 nt, Human
agcgcgcgcgcccucuggcugc

SEQ ID NO: 1394266 - RNA, 15 nt, Human
cuuuaaaacuuaucc

SEQ ID NO: 1394267 - RNA, 14 nt, Human
aaucucaauauuuc

SEQ ID NO: 1394268 - RNA, 18 nt, Human
ugugcuggccaccugcug

SEQ ID NO: 1394269 - RNA, 12 nt, Human
cgcucggccugc

SEQ ID NO: 1394270 - RNA, 18 nt, Human
auccuucagccugaaaga

SEQ ID NO: 1394271 - RNA, 19 nt, Human
aaaguucuagugaccgaga

SEQ ID NO: 1394272 - RNA, 18 nt, Human
cuccagccugagcgacag

SEQ ID NO: 1394273 - RNA, 16 nt, Human
acaugugcuggccacc

SEQ ID NO: 1394274 - RNA, 16 nt, Human
ccacaagaacccccuu

SEQ ID NO: 1394275 - RNA, 16 nt, Human
ccuaugcagaggucca

SEQ ID NO: 1394276 - RNA, 20 nt, Human
caggcugagccucagucucc

SEQ ID NO: 1394277 - RNA, 15 nt, Human
aaauauuuauuuuaa

SEQ ID NO: 1394278 - RNA, 17 nt, Human
uuagauagaugaagaag

SEQ ID NO: 1394279 - RNA, 20 nt, Human
auuuccuuauucagaauuuc

SEQ ID NO: 1394280 - RNA, 17 nt, Human
caugagggcuggaugcu

SEQ ID NO: 1394281 - RNA, 20 nt, Human
gaagagccggagccuccagc

SEQ ID NO: 1394282 - RNA, 16 nt, Human
ccucauuaucagucca

SEQ ID NO: 1394283 - RNA, 18 nt, Human
uuuauguuuaauucugaa

SEQ ID NO: 1394284 - RNA, 21 nt, Human
gccggcgcgcucaucccaccc

SEQ ID NO: 1394285 - RNA, 15 nt, Human
acuuuauaaaggauu

SEQ ID NO: 1394286 - RNA, 22 nt, Human
cgcgcuccgcgcagcucaggcu

SEQ ID NO: 1394287 - RNA, 21 nt, Human
ugggaggcugagaugggagaa

SEQ ID NO: 1394288 - RNA, 17 nt, Human
ugucuucaggggccaca

SEQ ID NO: 1394289 - RNA, 16 nt, Human
aggguguguaaguaga

SEQ ID NO: 1394290 - RNA, 15 nt, Human
gcacagccucuuaga

SEQ ID NO: 1394291 - RNA, 16 nt, Human
augagcacgcauggaa

SEQ ID NO: 1394292 - RNA, 16 nt, Human
ggcuaauaucuuaucu

SEQ ID NO: 1394293 - RNA, 23 nt, Human
cugaaaucauacuucuuaggguu

SEQ ID NO: 1394294 - RNA, 23 nt, Human
uauguuaaaacugggacagggga

SEQ ID NO: 1394295 - RNA, 19 nt, Human
auccuacaagacacaguga

SEQ ID NO: 1394296 - RNA, 14 nt, Human
agguugcagugagc

SEQ ID NO: 1394297 - RNA, 19 nt, Human
uuguacucugaaaguuuug

SEQ ID NO: 1394298 - RNA, 19 nt, Human
auuuaguuauaaaaauaua

SEQ ID NO: 1394299 - RNA, 14 nt, Human
caucaucuucuggg

SEQ ID NO: 1394300 - RNA, 15 nt, Human
augcccauaccccug

SEQ ID NO: 1394301 - RNA, 16 nt, Human
agguacuucaaauccu

SEQ ID NO: 1394302 - RNA, 18 nt, Human
cugcagcgaguacuuccc

SEQ ID NO: 1394303 - RNA, 21 nt, Human
agacaagaaggaaagauuuug

SEQ ID NO: 1394304 - RNA, 14 nt, Human
aaccagagccugag

SEQ ID NO: 1394305 - RNA, 13 nt, Human
uaguuuuuaaagu

SEQ ID NO: 1394306 - RNA, 23 nt, Human
acuggcuaauuagcauggccaca

SEQ ID NO: 1394307 - RNA, 18 nt, Human
cugagucccaggcugagc

SEQ ID NO: 1394308 - RNA, 18 nt, Human
acuuuaugcuaagugaaa

SEQ ID NO: 1394309 - RNA, 19 nt, Human
uauauuuccaagaaauauu

SEQ ID NO: 1394310 - RNA, 15 nt, Human
cgaagcaccaucauu

SEQ ID NO: 1394311 - RNA, 18 nt, Human
agguccacaacacacaga

SEQ ID NO: 1394312 - RNA, 17 nt, Human
acuccugcuagaacagu

SEQ ID NO: 1394313 - RNA, 20 nt, Human
uggauuuaauguggaaauga

SEQ ID NO: 1394314 - RNA, 17 nt, Human
gcgcgcuccgcgcagcu

SEQ ID NO: 1394315 - RNA, 14 nt, Human
cuaagucuuauaua

SEQ ID NO: 1394316 - RNA, 21 nt, Human
agagccggagccuccagcugc

SEQ ID NO: 1394317 - RNA, 16 nt, Human
aauuuuuaauuauaug

SEQ ID NO: 1394318 - RNA, 23 nt, Human
uccacaaguaaaaggaaaugcuc

SEQ ID NO: 1394319 - RNA, 19 nt, Human
aguuauuuuuaaacuguaa

SEQ ID NO: 1394320 - RNA, 16 nt, Human
ccugagcgacagugag

SEQ ID NO: 1394321 - RNA, 14 nt, Human
ggagccuccagcug

SEQ ID NO: 1394322 - RNA, 20 nt, Human
aauucuugccaaauauaaau

SEQ ID NO: 1394323 - RNA, 17 nt, Human
uaugcuaagugaaauaa

SEQ ID NO: 1394324 - RNA, 19 nt, Human
ugcacacagcacgggggcc

SEQ ID NO: 1394325 - RNA, 12 nt, Human
cuuuaucuuuuu

SEQ ID NO: 1394326 - RNA, 23 nt, Human
aguaauuggaaaggcagcucuaa

SEQ ID NO: 1394327 - RNA, 22 nt, Human
aauuacauuuguauaaaauaau

SEQ ID NO: 1394328 - RNA, 19 nt, Human
uguuggacgagaaaacaau

SEQ ID NO: 1394329 - RNA, 19 nt, Human
uauauuuuuuguuaaauga

SEQ ID NO: 1394330 - RNA, 14 nt, Human
cucccucccuuggg

SEQ ID NO: 1394331 - RNA, 11 nt, Human
gguuuuauuau

SEQ ID NO: 1394332 - RNA, 16 nt, Human
uucccaacuccagaaa

SEQ ID NO: 1394333 - RNA, 22 nt, Human
aaugauguuucauaagaauucu

SEQ ID NO: 1394334 - RNA, 11 nt, Human
ccggccgcgcu

SEQ ID NO: 1394335 - RNA, 17 nt, Human
ugaaauaagccagacau

SEQ ID NO: 1394336 - RNA, 17 nt, Human
ucuuucacauuuaaaua

SEQ ID NO: 1394337 - RNA, 14 nt, Human
acaaauccaaugaa

SEQ ID NO: 1394338 - RNA, 15 nt, Human
ccacaagaaaugaaa

SEQ ID NO: 1394339 - RNA, 23 nt, Human
cuacacgagauacagaauuuuau

SEQ ID NO: 1394340 - RNA, 19 nt, Human
cuagaguuuagcuggaaaa

SEQ ID NO: 1394341 - RNA, 20 nt, Human
uuuagacauucuuuaucuuu

SEQ ID NO: 1394342 - RNA, 18 nt, Human
uaucaaaagaaagaaaau

SEQ ID NO: 1394343 - RNA, 19 nt, Human
cuggggcuuuaacuccugc

SEQ ID NO: 1394344 - RNA, 17 nt, Human
cccaucucagguguguu

SEQ ID NO: 1394345 - RNA, 19 nt, Human
augaauuacauuuguauaa

SEQ ID NO: 1394346 - RNA, 19 nt, Human
accauuuuggcaagcucua

SEQ ID NO: 1394347 - RNA, 13 nt, Human
ucuaagaagugaa

SEQ ID NO: 1394348 - RNA, 21 nt, Human
ucauucacucaacaaacauaa

SEQ ID NO: 1394349 - RNA, 16 nt, Human
gucuucaggggccaca

SEQ ID NO: 1394350 - RNA, 19 nt, Human
aaaauaacgauaaaagaca

SEQ ID NO: 1394351 - RNA, 13 nt, Human
auugaggcaggca

SEQ ID NO: 1394352 - RNA, 14 nt, Human
cucccggccgcgcu

SEQ ID NO: 1394353 - RNA, 19 nt, Human
uguauacugugugcuaaaa

SEQ ID NO: 1394354 - RNA, 14 nt, Human
uaaaauccauacau

SEQ ID NO: 1394355 - RNA, 14 nt, Human
agaauucauucacu

SEQ ID NO: 1394356 - RNA, 22 nt, Human
aguauguuagugcaaauuguca

SEQ ID NO: 1394357 - RNA, 19 nt, Human
ucuucacuuuuauaagaaa

SEQ ID NO: 1394358 - RNA, 21 nt, Human
uacaugagguacugagaguga

SEQ ID NO: 1394359 - RNA, 23 nt, Human
gcuguggauuuaauguggaaaug

SEQ ID NO: 1394360 - RNA, 18 nt, Human
uccagcuggccgggagcc

SEQ ID NO: 1394361 - RNA, 22 nt, Human
uuugaugcuacaggauuugaaa

SEQ ID NO: 1394362 - RNA, 15 nt, Human
ccacaggaaccacaa

SEQ ID NO: 1394363 - RNA, 13 nt, Human
ucucccucccuug

SEQ ID NO: 1394364 - RNA, 16 nt, Human
gacauugaggcaggca

SEQ ID NO: 1394365 - RNA, 18 nt, Human
acagaaagcagaacagug

SEQ ID NO: 1394366 - RNA, 21 nt, Human
gaaagcagggacuugaaccca

SEQ ID NO: 1394367 - RNA, 19 nt, Human
acaaauuuacagagacaga

SEQ ID NO: 1394368 - RNA, 20 nt, Human
cacuguggguagacacacau

SEQ ID NO: 1394369 - RNA, 15 nt, Human
agcuaaauauauauu

SEQ ID NO: 1394370 - RNA, 19 nt, Human
cugccccccagcccuccuu

SEQ ID NO: 1394371 - RNA, 13 nt, Human
aaaugaaagcagg

SEQ ID NO: 1394372 - RNA, 20 nt, Human
cucgcuuccgcauccuaguc

SEQ ID NO: 1394373 - RNA, 20 nt, Human
aguuuuuuuuuaaaaaagaa

SEQ ID NO: 1394374 - RNA, 17 nt, Human
ggaaauauuuauuuuaa

SEQ ID NO: 1394375 - RNA, 14 nt, Human
cagauccccaagcc

SEQ ID NO: 1394376 - RNA, 18 nt, Human
auguuagagaauuuccuu

SEQ ID NO: 1394377 - RNA, 16 nt, Human
cggggagcgagcccca

SEQ ID NO: 1394378 - RNA, 16 nt, Human
uaggauguugaaaaag

SEQ ID NO: 1394379 - RNA, 16 nt, Human
aaaauccauacauuug

SEQ ID NO: 1394380 - RNA, 22 nt, Human
caucgcaauguaagacucggga

SEQ ID NO: 1394381 - RNA, 16 nt, Human
aacaauaaaagacaag

SEQ ID NO: 1394382 - RNA, 11 nt, Human
aauuuaaauau

SEQ ID NO: 1394383 - RNA, 22 nt, Human
cggagccuccagcugccccggg

SEQ ID NO: 1394384 - RNA, 20 nt, Human
accggccuuugcaccuccau

SEQ ID NO: 1394385 - RNA, 13 nt, Human
agcuaaauauaua

SEQ ID NO: 1394386 - RNA, 23 nt, Human
aggugaucuggcucuggacaggc

SEQ ID NO: 1394387 - RNA, 19 nt, Human
caauucuugccaaauauaa

SEQ ID NO: 1394388 - RNA, 22 nt, Human
cugccaaaacaucaaccugcca

SEQ ID NO: 1394389 - RNA, 22 nt, Human
ugcuggagacauugaggcaggc

SEQ ID NO: 1394390 - RNA, 12 nt, Human
gcugaugcaguu

SEQ ID NO: 1394391 - RNA, 15 nt, Human
ccaggcggguccggg

SEQ ID NO: 1394392 - RNA, 13 nt, Human
auuggacaguaaa

SEQ ID NO: 1394393 - RNA, 15 nt, Human
uacaaaugcauuucu

SEQ ID NO: 1394394 - RNA, 13 nt, Human
ugccagcuggccu

SEQ ID NO: 1394395 - RNA, 21 nt, Human
auaugcucuaaacauguuuau

SEQ ID NO: 1394396 - RNA, 19 nt, Human
gugaacuugguuuuaauua

SEQ ID NO: 1394397 - RNA, 17 nt, Human
aaaaauccuacuuucau

SEQ ID NO: 1394398 - RNA, 17 nt, Human
gccggagccuccagcug

SEQ ID NO: 1394399 - RNA, 12 nt, Human
uaagaaggcacc

SEQ ID NO: 1394400 - RNA, 21 nt, Human
auggcagcuuuccucaaaacu

SEQ ID NO: 1394401 - RNA, 19 nt, Human
aaacaaaaggauaaugaau

SEQ ID NO: 1394402 - RNA, 13 nt, Human
gcggccuggucua

SEQ ID NO: 1394403 - RNA, 15 nt, Human
caaauccaaugaaau

SEQ ID NO: 1394404 - RNA, 17 nt, Human
ccuauccuacuuccccu

SEQ ID NO: 1394405 - RNA, 17 nt, Human
accugcugagccccaag

SEQ ID NO: 1394406 - RNA, 21 nt, Human
ccaugugcagccaccagucca

SEQ ID NO: 1394407 - RNA, 20 nt, Human
ccaacacccugagguugugu

SEQ ID NO: 1394408 - RNA, 16 nt, Human
ccuccuuuuaaaguaa

SEQ ID NO: 1394409 - RNA, 21 nt, Human
cagacacaugugcuggccacc

SEQ ID NO: 1394410 - RNA, 23 nt, Human
aggcuuuaaaacuuauccuccau

SEQ ID NO: 1394411 - RNA, 15 nt, Human
accucccccaucucu

SEQ ID NO: 1394412 - RNA, 20 nt, Human
auaaauggcuuccuggcaau

SEQ ID NO: 1394413 - RNA, 20 nt, Human
ccagugagacagcucugcau

SEQ ID NO: 1394414 - RNA, 21 nt, Human
auaguuguaccgcaaugugac

SEQ ID NO: 1394415 - RNA, 21 nt, Human
ucgcccacuuccucccggccg

SEQ ID NO: 1394416 - RNA, 19 nt, Human
uguucaugcccauaccccu

SEQ ID NO: 1394417 - RNA, 19 nt, Human
guccaggucuaccaaaaau

SEQ ID NO: 1394418 - RNA, 14 nt, Human
agaaaugaaagcag

SEQ ID NO: 1394419 - RNA, 21 nt, Human
aaaaaguucugcagauaaaca

SEQ ID NO: 1394420 - RNA, 20 nt, Human
aucuauguagaauauauuuc

SEQ ID NO: 1394421 - RNA, 18 nt, Human
gaauuuccuuacucuuga

SEQ ID NO: 1394422 - RNA, 19 nt, Human
aguuguaauuuuuuugugg

SEQ ID NO: 1394423 - RNA, 15 nt, Human
aaaaacguauugcau

SEQ ID NO: 1394424 - RNA, 19 nt, Human
ggcgggagggcgcggggcg

SEQ ID NO: 1394425 - RNA, 18 nt, Human
uuuuauaucaauuuaaaa

SEQ ID NO: 1394426 - RNA, 19 nt, Human
gcugcugguggcgcuggcu

SEQ ID NO: 1394427 - RNA, 22 nt, Human
gggccugagaccaaggcccccg

SEQ ID NO: 1394428 - RNA, 20 nt, Human
aauucugguagcuaaauaua

SEQ ID NO: 1394429 - RNA, 14 nt, Human
aaagagaacuucca

SEQ ID NO: 1394430 - RNA, 17 nt, Human
ucccuccccaaaugcuu

SEQ ID NO: 1394431 - RNA, 18 nt, Human
gccugagcgacagugaga

SEQ ID NO: 1394432 - RNA, 16 nt, Human
gaaagaagagccggag

SEQ ID NO: 1394433 - RNA, 12 nt, Human
aaaaaaacguau

SEQ ID NO: 1394434 - RNA, 13 nt, Human
caacaucuaguga

SEQ ID NO: 1394435 - RNA, 12 nt, Human
acacugaagaag

SEQ ID NO: 1394436 - RNA, 16 nt, Human
cuagaacucccuuuca

SEQ ID NO: 1394437 - RNA, 16 nt, Human
aacuugguuuuaauua

SEQ ID NO: 1394438 - RNA, 17 nt, Human
cccaggcugagccucag

SEQ ID NO: 1394439 - RNA, 20 nt, Human
cagcugccccggggaggggc

SEQ ID NO: 1394440 - RNA, 14 nt, Human
caaggaaaaaauaa

SEQ ID NO: 1394441 - RNA, 18 nt, Human
auguuccuaauaaagcuu

SEQ ID NO: 1394442 - RNA, 21 nt, Human
uggaaacguauucaaacaauu

SEQ ID NO: 1394443 - RNA, 14 nt, Human
cuaagcauuccaac

SEQ ID NO: 1394444 - RNA, 15 nt, Human
aauaacgauaaaaga

SEQ ID NO: 1394445 - RNA, 17 nt, Human
uuuuauaugcuauuuau

SEQ ID NO: 1394446 - RNA, 19 nt, Human
auagugaggagcuuugaaa

SEQ ID NO: 1394447 - RNA, 23 nt, Human
gaaaacaauaacgauaaaagaca

SEQ ID NO: 1394448 - RNA, 22 nt, Human
uaauaucuuaucuuccuauaau

SEQ ID NO: 1394449 - RNA, 13 nt, Human
aaaguguuugaaa

SEQ ID NO: 1394450 - RNA, 14 nt, Human
agagacagaaagca

SEQ ID NO: 1394451 - RNA, 15 nt, Human
uaucuucacuuuuau

SEQ ID NO: 1394452 - RNA, 14 nt, Human
uuauuauauuuaca

SEQ ID NO: 1394453 - RNA, 14 nt, Human
uccacaacacacag

SEQ ID NO: 1394454 - RNA, 16 nt, Human
uaucaaaagaaagaaa

SEQ ID NO: 1394455 - RNA, 20 nt, Human
cuuccaggcuggcgugcagc

SEQ ID NO: 1394456 - RNA, 16 nt, Human
ucuaaaaguuuaaguu

SEQ ID NO: 1394457 - RNA, 15 nt, Human
cucccugccccccag

SEQ ID NO: 1394458 - RNA, 19 nt, Human
cucaccucccccaucucuu

SEQ ID NO: 1394459 - RNA, 11 nt, Human
gagguaaaagc

SEQ ID NO: 1394460 - RNA, 16 nt, Human
gccuaagugcagcccc

SEQ ID NO: 1394461 - RNA, 20 nt, Human
uaugcuucuguuuuauaauu

SEQ ID NO: 1394462 - RNA, 17 nt, Human
agcugccccggggaggg

SEQ ID NO: 1394463 - RNA, 19 nt, Human
uccauccugaggcuccacu

SEQ ID NO: 1394464 - RNA, 16 nt, Human
augccccgucccccuc

SEQ ID NO: 1394465 - RNA, 14 nt, Human
cuccagugagacag

SEQ ID NO: 1394466 - RNA, 23 nt, Human
cauccucgaggcccuagcauuuc

SEQ ID NO: 1394467 - RNA, 15 nt, Human
aaggguacacugccu

SEQ ID NO: 1394468 - RNA, 22 nt, Human
caaaugggaaacaaaaggauaa

SEQ ID NO: 1394469 - RNA, 14 nt, Human
cucccugcccccca

SEQ ID NO: 1394470 - RNA, 23 nt, Human
uuguaaagguccuggcaaagaug

SEQ ID NO: 1394471 - RNA, 13 nt, Human
gcgcucggccugc

SEQ ID NO: 1394472 - RNA, 20 nt, Human
uacaucccuuaccugggaaa

SEQ ID NO: 1394473 - RNA, 16 nt, Human
cgcauggaaaaguuuc

SEQ ID NO: 1394474 - RNA, 17 nt, Human
auggcuaguaucaaaag

SEQ ID NO: 1394475 - RNA, 21 nt, Human
cuccagcuggccgggagccug

SEQ ID NO: 1394476 - RNA, 15 nt, Human
ugcagauaaacagua

SEQ ID NO: 1394477 - RNA, 11 nt, Human
ugcagugagcc

SEQ ID NO: 1394478 - RNA, 14 nt, Human
ucuaggaaauauuu

SEQ ID NO: 1394479 - RNA, 14 nt, Human
aaagaggaaugaag

SEQ ID NO: 1394480 - RNA, 22 nt, Human
cccccugcaaagcccagcuuga

SEQ ID NO: 1394481 - RNA, 15 nt, Human
aagugaaaaucuaca

SEQ ID NO: 1394482 - RNA, 21 nt, Human
uccuacaagacacagugacca

SEQ ID NO: 1394483 - RNA, 13 nt, Human
cccugcacuccag

SEQ ID NO: 1394484 - RNA, 18 nt, Human
ggcgcuggcugcgcucgg

SEQ ID NO: 1394485 - RNA, 19 nt, Human
acuaucucauuuccaagca

SEQ ID NO: 1394486 - RNA, 18 nt, Human
ccuucggccuccauccug

SEQ ID NO: 1394487 - RNA, 21 nt, Human
cgaaguauccuucagccugaa

SEQ ID NO: 1394488 - RNA, 12 nt, Human
acagagacagaa

SEQ ID NO: 1394489 - RNA, 19 nt, Human
uuauauauauauauuuuuu

SEQ ID NO: 1394490 - RNA, 15 nt, Human
uauauauauauauuu

SEQ ID NO: 1394491 - RNA, 14 nt, Human
uauauauuuuagau

SEQ ID NO: 1394492 - RNA, 12 nt, Human
uauaauuuaaaa

SEQ ID NO: 1394493 - RNA, 16 nt, Human
aaauauuuauuuuaau

SEQ ID NO: 1394494 - RNA, 19 nt, Human
agaaaauaacgauaaaaga

SEQ ID NO: 1394495 - RNA, 20 nt, Human
uuacaaauccaaugaaauga

SEQ ID NO: 1394496 - RNA, 19 nt, Human
aauauuauguuaaaacugg

SEQ ID NO: 1394497 - RNA, 14 nt, Human
gcaaagcccagcuu

SEQ ID NO: 1394498 - RNA, 12 nt, Human
uuuugaaaccaa

SEQ ID NO: 1394499 - RNA, 14 nt, Human
ccaugaccaacauc

SEQ ID NO: 1394500 - RNA, 22 nt, Human
uucaauaucuuuuuuuuaauaa

SEQ ID NO: 1394501 - RNA, 20 nt, Human
ccaaauguucaucaaugaau

SEQ ID NO: 1394502 - RNA, 19 nt, Human
acuucagcgguuuauauaa

SEQ ID NO: 1394503 - RNA, 16 nt, Human
accuguucgcgcgccu

SEQ ID NO: 1394504 - RNA, 18 nt, Human
ugccauaauuacuauguc

SEQ ID NO: 1394505 - RNA, 22 nt, Human
uggcgcuggcugcgcucggccu

SEQ ID NO: 1394506 - RNA, 20 nt, Human
uggggcuuuaacuccugcua

SEQ ID NO: 1394507 - RNA, 21 nt, Human
uucagcucagcuaaugaagug

SEQ ID NO: 1394508 - RNA, 22 nt, Human
cuaagcuucacuguaaaauaau

SEQ ID NO: 1394509 - RNA, 13 nt, Human
augauuccaccua

SEQ ID NO: 1394510 - RNA, 14 nt, Human
gagagugaacaaau

SEQ ID NO: 1394511 - RNA, 14 nt, Human
agucugacuguuuc

SEQ ID NO: 1394512 - RNA, 16 nt, Human
uauaucaauuuaaaaa

SEQ ID NO: 1394513 - RNA, 12 nt, Human
acucccugcccc

SEQ ID NO: 1394514 - RNA, 14 nt, Human
uaaaggaauuuaaa

SEQ ID NO: 1394515 - RNA, 21 nt, Human
ccucccuuggggccuaugcag

SEQ ID NO: 1394516 - RNA, 23 nt, Human
cgcaggaccaucccggccggcgc

SEQ ID NO: 1394517 - RNA, 15 nt, Human
ucucagaaggaaaga

SEQ ID NO: 1394518 - RNA, 22 nt, Human
ccucccuuggggccuaugcaga

SEQ ID NO: 1394519 - RNA, 11 nt, Human
ucaccuccccc

SEQ ID NO: 1394520 - RNA, 15 nt, Human
auauaaauaaaaaua

SEQ ID NO: 1394521 - RNA, 22 nt, Human
augcagagguccacaacacaca

SEQ ID NO: 1394522 - RNA, 13 nt, Human
guuauuuuuaaac

SEQ ID NO: 1394523 - RNA, 14 nt, Human
uauuugcuguuauu

SEQ ID NO: 1394524 - RNA, 14 nt, Human
guaacuaauuuuaa

SEQ ID NO: 1394525 - RNA, 22 nt, Human
aucaucaagucuuucacauuua

SEQ ID NO: 1394526 - RNA, 17 nt, Human
cauuaaaguucuaguga

SEQ ID NO: 1394527 - RNA, 23 nt, Human
agccccaaguggaacgagacaag

SEQ ID NO: 1394528 - RNA, 20 nt, Human
ucugaaaguuuuggaaacgu

SEQ ID NO: 1394529 - RNA, 14 nt, Human
ugaucaccugcccu

SEQ ID NO: 1394530 - RNA, 14 nt, Human
cuguaaucacagcu

SEQ ID NO: 1394531 - RNA, 13 nt, Human
ccacaacacacag

SEQ ID NO: 1394532 - RNA, 19 nt, Human
aaguugcauagguuuaaua

SEQ ID NO: 1394533 - RNA, 19 nt, Human
agaugagagaacagggcug

SEQ ID NO: 1394534 - RNA, 18 nt, Human
uguauuauuuuuuaaaaa

SEQ ID NO: 1394535 - RNA, 13 nt, Human
ccucuggcuccag

SEQ ID NO: 1394536 - RNA, 12 nt, Human
cagaacagugau

SEQ ID NO: 1394537 - RNA, 24 nt, Human
cauucuggaauaauccuaaacaua

SEQ ID NO: 1394538 - RNA, 16 nt, Human
uguaguccuguaaugg

SEQ ID NO: 1394539 - RNA, 23 nt, Human
cuugauaaauggcuuccuggcaa

SEQ ID NO: 1394540 - RNA, 19 nt, Human
ucagugucaaugcagcccc

SEQ ID NO: 1394541 - RNA, 17 nt, Human
gcaaauugucacaggac

SEQ ID NO: 1394542 - RNA, 18 nt, Human
auucugguagcuaaauau

SEQ ID NO: 1394543 - RNA, 22 nt, Human
agcacagccucuuagaugcagu

SEQ ID NO: 1394544 - RNA, 17 nt, Human
cucuuuugggauuuuug

SEQ ID NO: 1394545 - RNA, 19 nt, Human
agagccggagccuccagcu

SEQ ID NO: 1394546 - RNA, 21 nt, Human
gaaaacaauaacgauaaaaga

SEQ ID NO: 1394547 - RNA, 22 nt, Human
ccgggaggcagagguugcagug

SEQ ID NO: 1394548 - RNA, 15 nt, Human
ccuguucgcgcgccu

SEQ ID NO: 1394549 - RNA, 16 nt, Human
uagagaauuuccuuac

SEQ ID NO: 1394550 - RNA, 12 nt, Human
agcuuucuuccu

SEQ ID NO: 1394551 - RNA, 15 nt, Human
gauccugcaauucca

SEQ ID NO: 1394552 - RNA, 20 nt, Human
aaagagugaaggauuuaugu

SEQ ID NO: 1394553 - RNA, 15 nt, Human
uugcucauggaauug

SEQ ID NO: 1394554 - RNA, 17 nt, Human
ugcagcgaguacuuccc

SEQ ID NO: 1394555 - RNA, 21 nt, Human
cgacagugagacucugucuca

SEQ ID NO: 1394556 - RNA, 19 nt, Human
cucaagcuaugugagcuca

SEQ ID NO: 1394557 - RNA, 16 nt, Human
uauuuuugugauuuug

SEQ ID NO: 1394558 - RNA, 22 nt, Human
aggcuccacuuggucugugaga

SEQ ID NO: 1394559 - RNA, 15 nt, Human
aaacaauuugaauau

SEQ ID NO: 1394560 - RNA, 22 nt, Human
caaauuuacagagacagaaagc

SEQ ID NO: 1394561 - RNA, 14 nt, Human
agcaaguauuagaa

SEQ ID NO: 1394562 - RNA, 22 nt, Human
ucucagcuucacccugagguga

SEQ ID NO: 1394563 - RNA, 12 nt, Human
aaggaugccccg

SEQ ID NO: 1394564 - RNA, 22 nt, Human
gaugguucccuugaugaagaag

SEQ ID NO: 1394565 - RNA, 20 nt, Human
acuucuuaggguuaugauua

SEQ ID NO: 1394566 - RNA, 19 nt, Human
cuucuuacaaugcauucug

SEQ ID NO: 1394567 - RNA, 23 nt, Human
ucccgcuguuccucgccacgcuc

SEQ ID NO: 1394568 - RNA, 18 nt, Human
ggccuugugaggagcugg

SEQ ID NO: 1394569 - RNA, 16 nt, Human
agaugagagaacaggg

SEQ ID NO: 1394570 - RNA, 13 nt, Human
cacuguaaaauaa

SEQ ID NO: 1394571 - RNA, 22 nt, Human
uaaaacaagcacuaaacaaaga

SEQ ID NO: 1394572 - RNA, 13 nt, Human
acacacaugaagu

SEQ ID NO: 1394573 - RNA, 15 nt, Human
ggcaagcucuaucac

SEQ ID NO: 1394574 - RNA, 14 nt, Human
aaaacuucagacau

SEQ ID NO: 1394575 - RNA, 16 nt, Human
cacuggacucaccucc

SEQ ID NO: 1394576 - RNA, 12 nt, Human
uaauuccacagc

SEQ ID NO: 1394577 - RNA, 19 nt, Human
uccacaaguaaaaggaaau

SEQ ID NO: 1394578 - RNA, 19 nt, Human
gugacuuaaugccacuaaa

SEQ ID NO: 1394579 - RNA, 16 nt, Human
gccaugugcuaguaau

SEQ ID NO: 1394580 - RNA, 15 nt, Human
ucaaaggacaccauu

SEQ ID NO: 1394581 - RNA, 23 nt, Human
ucuuagaugcaguucugaagaag

SEQ ID NO: 1394582 - RNA, 22 nt, Human
ugggcacuguggguagacacac

SEQ ID NO: 1394583 - RNA, 17 nt, Human
cugugcggccuggucua

SEQ ID NO: 1394584 - RNA, 16 nt, Human
ugcagugucugcugga

SEQ ID NO: 1394585 - RNA, 14 nt, Human
ugcuggagcucugc

SEQ ID NO: 1394586 - RNA, 16 nt, Human
acuaaacaaagaguga

SEQ ID NO: 1394587 - RNA, 22 nt, Human
ggguuccuuccucugagccuug

SEQ ID NO: 1394588 - RNA, 20 nt, Human
aucccggccggcgcgcucau

SEQ ID NO: 1394589 - RNA, 22 nt, Human
aagagccuuuuuuugaaaaaaa

SEQ ID NO: 1394590 - RNA, 21 nt, Human
ccuuccccucugcagcuucca

SEQ ID NO: 1394591 - RNA, 13 nt, Human
cuucuuucaugaa

SEQ ID NO: 1394592 - RNA, 13 nt, Human
uacuuuauuuucu

SEQ ID NO: 1394593 - RNA, 15 nt, Human
cuucugaggagcugu

SEQ ID NO: 1394594 - RNA, 12 nt, Human
cuugguuuuaau

SEQ ID NO: 1394595 - RNA, 20 nt, Human
ucugguagcuaaauauauau

SEQ ID NO: 1394596 - RNA, 17 nt, Human
cuggcugcugguggcgc

SEQ ID NO: 1394597 - RNA, 14 nt, Human
gcucgcccacuucc

SEQ ID NO: 1394598 - RNA, 15 nt, Human
ugcuugucccugugg

SEQ ID NO: 1394599 - RNA, 19 nt, Human
auuaaguuuuuuuuuaaaa

SEQ ID NO: 1394600 - RNA, 13 nt, Human
gugagcaucaucu

SEQ ID NO: 1394601 - RNA, 19 nt, Human
agaugcuagaacucccuuu

SEQ ID NO: 1394602 - RNA, 21 nt, Human
aggaagaucccuuuguccaca

SEQ ID NO: 1394603 - RNA, 18 nt, Human
cagugaaagaaaauaaca

SEQ ID NO: 1394604 - RNA, 13 nt, Human
uguccacaaguaa

SEQ ID NO: 1394605 - RNA, 19 nt, Human
cagcacgggggccaaggau

SEQ ID NO: 1394606 - RNA, 18 nt, Human
ccugcaaagcccagcuug

SEQ ID NO: 1394607 - RNA, 11 nt, Human
gccaugggaca

SEQ ID NO: 1394608 - RNA, 15 nt, Human
agggaagacaagaag

SEQ ID NO: 1394609 - RNA, 23 nt, Human
aagagccuuuuuuugaaaaaaag

SEQ ID NO: 1394610 - RNA, 14 nt, Human
auuugaaauuguau

SEQ ID NO: 1394611 - RNA, 22 nt, Human
uaccucugcuauuugcuguuau

SEQ ID NO: 1394612 - RNA, 22 nt, Human
uuuauaagaaauaggaaauauu

SEQ ID NO: 1394613 - RNA, 19 nt, Human
uaguuuaugauuccaccua

SEQ ID NO: 1394614 - RNA, 19 nt, Human
guuguauuauuuuuuaaaa

SEQ ID NO: 1394615 - RNA, 20 nt, Human
cuucaacucccugcccccca

SEQ ID NO: 1394616 - RNA, 17 nt, Human
uccucacuuugaagagu

SEQ ID NO: 1394617 - RNA, 14 nt, Human
uugggaaaaaguaa

SEQ ID NO: 1394618 - RNA, 13 nt, Human
aacucccugcccc

SEQ ID NO: 1394619 - RNA, 14 nt, Human
ccucggacggcucc

SEQ ID NO: 1394620 - RNA, 17 nt, Human
cagucucuugaggcaca

SEQ ID NO: 1394621 - RNA, 14 nt, Human
auugaggcaggcac

SEQ ID NO: 1394622 - RNA, 14 nt, Human
uaaauuuaucauuu

SEQ ID NO: 1394623 - RNA, 22 nt, Human
cggggagcgagccccaggcggg

SEQ ID NO: 1394624 - RNA, 18 nt, Human
ccgggccgacggagccgg

SEQ ID NO: 1394625 - RNA, 14 nt, Human
aaaggaauuuaaaa

SEQ ID NO: 1394626 - RNA, 22 nt, Human
gucacaggaaguagaggaggcc

SEQ ID NO: 1394627 - RNA, 16 nt, Human
agugaaauauuauuuu

SEQ ID NO: 1394628 - RNA, 21 nt, Human
gacugcuaguuuauauagaaa

SEQ ID NO: 1394629 - RNA, 16 nt, Human
cuggaugcucucguug

SEQ ID NO: 1394630 - RNA, 15 nt, Human
ucuaugaaauauuau

SEQ ID NO: 1394631 - RNA, 19 nt, Human
uggugagugccuguaauca

SEQ ID NO: 1394632 - RNA, 13 nt, Human
uaguuuauauaga

SEQ ID NO: 1394633 - RNA, 23 nt, Human
aaguauccuucagccugaaagag

SEQ ID NO: 1394634 - RNA, 13 nt, Human
agcccagcuugaa

SEQ ID NO: 1394635 - RNA, 23 nt, Human
uguugagguaccuccaaggaccg

SEQ ID NO: 1394636 - RNA, 12 nt, Human
uauucacaagac

SEQ ID NO: 1394637 - RNA, 21 nt, Human
aaaauuuuuucucuaggaaau

SEQ ID NO: 1394638 - RNA, 22 nt, Human
agaaugagagacacacugaaga

SEQ ID NO: 1394639 - RNA, 16 nt, Human
aauuucuucaacuccc

SEQ ID NO: 1394640 - RNA, 16 nt, Human
cagggacuugaaccca

SEQ ID NO: 1394641 - RNA, 16 nt, Human
caggaaguagaggagg

SEQ ID NO: 1394642 - RNA, 17 nt, Human
uuucccuccuuggagac

SEQ ID NO: 1394643 - RNA, 18 nt, Human
ggaccaucccggccggcg

SEQ ID NO: 1394644 - RNA, 18 nt, Human
uauauuuccuuauucaga

SEQ ID NO: 1394645 - RNA, 18 nt, Human
aaauauaaauaaaaauaa

SEQ ID NO: 1394646 - RNA, 22 nt, Human
gcuugcagagaugaggccgcca

SEQ ID NO: 1394647 - RNA, 16 nt, Human
cuucacuguaaaauaa

SEQ ID NO: 1394648 - RNA, 14 nt, Human
gaaugauuaugaau

SEQ ID NO: 1394649 - RNA, 20 nt, Human
acagcccuucuuuccacaga

SEQ ID NO: 1394650 - RNA, 18 nt, Human
uccaggcuggcgugcagc

SEQ ID NO: 1394651 - RNA, 20 nt, Human
ugccccccagcccuccuuau

SEQ ID NO: 1394652 - RNA, 15 nt, Human
aacgauaaaagacag

SEQ ID NO: 1394653 - RNA, 14 nt, Human
acccgggaggcaga

SEQ ID NO: 1394654 - RNA, 16 nt, Human
cuucuggguuccuucc

SEQ ID NO: 1394655 - RNA, 15 nt, Human
uuaguuuuuaaagua

SEQ ID NO: 1394656 - RNA, 12 nt, Human
cauguuccccuu

SEQ ID NO: 1394657 - RNA, 19 nt, Human
cggccuccauccugaggcu

SEQ ID NO: 1394658 - RNA, 15 nt, Human
gccucagucucccuc

SEQ ID NO: 1394659 - RNA, 14 nt, Human
aaccugagccccaa

SEQ ID NO: 1394660 - RNA, 21 nt, Human
aauaauccucaguuuuuguga

SEQ ID NO: 1394661 - RNA, 22 nt, Human
ugaauggcuaagcaaaauguga

SEQ ID NO: 1394662 - RNA, 18 nt, Human
cuuccucugagccuuggg

SEQ ID NO: 1394663 - RNA, 21 nt, Human
acaugagguacugagagugaa

SEQ ID NO: 1394664 - RNA, 13 nt, Human
aacgucacaucuu

SEQ ID NO: 1394665 - RNA, 12 nt, Human
acaccuuaucua

SEQ ID NO: 1394666 - RNA, 21 nt, Human
caagacugcacaucaaaauau

SEQ ID NO: 1394667 - RNA, 21 nt, Human
caucucagguguguugcagug

SEQ ID NO: 1394668 - RNA, 14 nt, Human
guauuuuaaaagaa

SEQ ID NO: 1394669 - RNA, 23 nt, Human
aaauuuacagagacagaaagcag

SEQ ID NO: 1394670 - RNA, 21 nt, Human
aauuuguuuucccuucuuaca

SEQ ID NO: 1394671 - RNA, 13 nt, Human
gcuguacgcgagc

SEQ ID NO: 1394672 - RNA, 14 nt, Human
aguacuucccgcug

SEQ ID NO: 1394673 - RNA, 17 nt, Human
cuaccuguucgcgcgcc

SEQ ID NO: 1394674 - RNA, 18 nt, Human
uguggucacaggaaguag

SEQ ID NO: 1394675 - RNA, 13 nt, Human
uuuaaaaauccua

SEQ ID NO: 1394676 - RNA, 15 nt, Human
acaggguuuauguuu

SEQ ID NO: 1394677 - RNA, 18 nt, Human
uuacuguaagaaaauauc

SEQ ID NO: 1394678 - RNA, 21 nt, Human
uuauguuuaauucugaaagca

SEQ ID NO: 1394679 - RNA, 19 nt, Human
cagauucuuuacccccugg

SEQ ID NO: 1394680 - RNA, 21 nt, Human
gaaggaaagaauaaccaacac

SEQ ID NO: 1394681 - RNA, 21 nt, Human
ucuggguugaagggcaguguu

SEQ ID NO: 1394682 - RNA, 17 nt, Human
acccacuggacucaccu

SEQ ID NO: 1394683 - RNA, 13 nt, Human
cuuuccaugaguu

SEQ ID NO: 1394684 - RNA, 17 nt, Human
acacuaagagagaauga

SEQ ID NO: 1394685 - RNA, 22 nt, Human
acagauuugagcucagcccugg

SEQ ID NO: 1394686 - RNA, 17 nt, Human
gcgcucaucccacccgc

SEQ ID NO: 1394687 - RNA, 19 nt, Human
uauuuaauuauuucacuuu

SEQ ID NO: 1394688 - RNA, 12 nt, Human
aucguguccccu

SEQ ID NO: 1394689 - RNA, 16 nt, Human
gcauccuagucucuau

SEQ ID NO: 1394690 - RNA, 16 nt, Human
ucaaaagaaagaaaau

SEQ ID NO: 1394691 - RNA, 13 nt, Human
caguuauuauauu

SEQ ID NO: 1394692 - RNA, 14 nt, Human
aacgauaaaagaca

SEQ ID NO: 1394693 - RNA, 19 nt, Human
auagcuacuaauuuuaaaa

SEQ ID NO: 1394694 - RNA, 10 nt, Human
ccugagcccc

SEQ ID NO: 1394695 - RNA, 13 nt, Human
auugucuagugaa

SEQ ID NO: 1394696 - RNA, 22 nt, Human
ugauugugggauacuauuuaau

SEQ ID NO: 1394697 - RNA, 13 nt, Human
uuggacgagaaaa

SEQ ID NO: 1394698 - RNA, 19 nt, Human
ugaaauuguauuacaaauc

SEQ ID NO: 1394699 - RNA, 22 nt, Human
gaugcaguucugaagaagaugg

SEQ ID NO: 1394700 - RNA, 21 nt, Human
cuggcugcgcucggccugcuc

SEQ ID NO: 1394701 - RNA, 15 nt, Human
acucaccucccccau

SEQ ID NO: 1394702 - RNA, 18 nt, Human
uuuauggcacuaguauuu

SEQ ID NO: 1394703 - RNA, 23 nt, Human
ggaggcagagguugcagugagcc

SEQ ID NO: 1394704 - RNA, 22 nt, Human
uucugguagcuaaauauauauu

SEQ ID NO: 1394705 - RNA, 14 nt, Human
ugcuguauuuuaaa

SEQ ID NO: 1394706 - RNA, 13 nt, Human
cgcccucuggcug

SEQ ID NO: 1394707 - RNA, 23 nt, Human
uaggauggcuaguaucaaaagaa

SEQ ID NO: 1394708 - RNA, 16 nt, Human
aaaagcuccauuuuua

SEQ ID NO: 1394709 - RNA, 13 nt, Human
aguguuugaaagc

SEQ ID NO: 1394710 - RNA, 20 nt, Human
uauacugugugcuaaaacaa

SEQ ID NO: 1394711 - RNA, 18 nt, Human
ugaacuugguuuuaauua

SEQ ID NO: 1394712 - RNA, 14 nt, Human
uucagccugaaaga

SEQ ID NO: 1394713 - RNA, 17 nt, Human
uuuaaaaaaaaaacgua

SEQ ID NO: 1394714 - RNA, 19 nt, Human
cgcccacuagacccacugg

SEQ ID NO: 1394715 - RNA, 15 nt, Human
gagccuccagcugcc

SEQ ID NO: 1394716 - RNA, 17 nt, Human
gacagucaccucaugga

SEQ ID NO: 1394717 - RNA, 12 nt, Human
ccagucccuccc

SEQ ID NO: 1394718 - RNA, 21 nt, Human
cugguagcuaaauauauauuu

SEQ ID NO: 1394719 - RNA, 23 nt, Human
agccuugggaccccugagcuugc

SEQ ID NO: 1394720 - RNA, 14 nt, Human
uauauauauauuuu

SEQ ID NO: 1394721 - RNA, 15 nt, Human
ucccccaucucuucu

SEQ ID NO: 1394722 - RNA, 13 nt, Human
ccccagcccuccu

SEQ ID NO: 1394723 - RNA, 17 nt, Human
cuauccuacuuccccuu

SEQ ID NO: 1394724 - RNA, 13 nt, Human
gcgcgccuccgcu

SEQ ID NO: 1394725 - RNA, 14 nt, Human
uaguuucccuugca

SEQ ID NO: 1394726 - RNA, 22 nt, Human
cccaggcggguccgggucgcag

SEQ ID NO: 1394727 - RNA, 14 nt, Human
ccucugcagcuucc

SEQ ID NO: 1394728 - RNA, 15 nt, Human
ucacaggacagcccu

SEQ ID NO: 1394729 - RNA, 23 nt, Human
uacaaaugggaaacaaaaggaua

SEQ ID NO: 1394730 - RNA, 14 nt, Human
gucccaggcugagc

SEQ ID NO: 1394731 - RNA, 14 nt, Human
auccaaugaaauga

SEQ ID NO: 1394732 - RNA, 23 nt, Human
aucgcagacacaugugcuggcca

SEQ ID NO: 1394733 - RNA, 20 nt, Human
agcuuauugucuagugaaac

SEQ ID NO: 1394734 - RNA, 18 nt, Human
uuuugugggaaauccaca

SEQ ID NO: 1394735 - RNA, 19 nt, Human
gagccucagucucccuccc

SEQ ID NO: 1394736 - RNA, 12 nt, Human
acacuuaaaaau

SEQ ID NO: 1394737 - RNA, 14 nt, Human
aacuuugauuuuau

SEQ ID NO: 1394738 - RNA, 23 nt, Human
aauacacuguuaucuucacuuuu

SEQ ID NO: 1394739 - RNA, 22 nt, Human
uagacacacaugaaguccaagc

SEQ ID NO: 1394740 - RNA, 14 nt, Human
acccgcccaccgca

SEQ ID NO: 1394741 - RNA, 20 nt, Human
acuauagugugagccaggaa

SEQ ID NO: 1394742 - RNA, 12 nt, Human
cccucugcagcu

SEQ ID NO: 1394743 - RNA, 18 nt, Human
acagucucuugaggcaca

SEQ ID NO: 1394744 - RNA, 21 nt, Human
gaagcuagaaaacaggcaaau

SEQ ID NO: 1394745 - RNA, 16 nt, Human
gcuguuaaucuuucaa

SEQ ID NO: 1394746 - RNA, 14 nt, Human
cauagaaguaaaaa

SEQ ID NO: 1394747 - RNA, 13 nt, Human
auugggcaggcag

SEQ ID NO: 1394748 - RNA, 16 nt, Human
cuuccucccuggaauc

SEQ ID NO: 1394749 - RNA, 17 nt, Human
cucaggcuggcaccgcu

SEQ ID NO: 1394750 - RNA, 18 nt, Human
uggccaccugcugagccc

SEQ ID NO: 1394751 - RNA, 13 nt, Human
aaaauaacgauaa

SEQ ID NO: 1394752 - RNA, 15 nt, Human
uccaagccucauguc

SEQ ID NO: 1394753 - RNA, 17 nt, Human
gcccuuccccucugcag

SEQ ID NO: 1394754 - RNA, 17 nt, Human
uauauuguagauaauac

SEQ ID NO: 1394755 - RNA, 16 nt, Human
aagaaauauuccuuaa

SEQ ID NO: 1394756 - RNA, 12 nt, Human
aguguuugaaag

SEQ ID NO: 1394757 - RNA, 10 nt, Human
aaacacaugu

SEQ ID NO: 1394758 - RNA, 23 nt, Human
ggagcaucuccucaacucugagu

SEQ ID NO: 1394759 - RNA, 18 nt, Human
ccuuccuaauuccacagc

SEQ ID NO: 1394760 - RNA, 14 nt, Human
cguguccccuaucc

SEQ ID NO: 1394761 - RNA, 11 nt, Human
augggacaggg

SEQ ID NO: 1394762 - RNA, 20 nt, Human
uccagccugagcgacaguga

SEQ ID NO: 1394763 - RNA, 19 nt, Human
gcuuguauuccuuuuucuc

SEQ ID NO: 1394764 - RNA, 23 nt, Human
ugcauagguuuaauaauuuuuaa

SEQ ID NO: 1394765 - RNA, 23 nt, Human
ugccccggggaggggcgcucgcu

SEQ ID NO: 1394766 - RNA, 15 nt, Human
ugucaauaaaaucca

SEQ ID NO: 1394767 - RNA, 19 nt, Human
gucaaucagccuaguugau

SEQ ID NO: 1394768 - RNA, 18 nt, Human
uaggugacuauuauauuu

SEQ ID NO: 1394769 - RNA, 15 nt, Human
ccaucucaggugugu

SEQ ID NO: 1394770 - RNA, 15 nt, Human
ugggacagggaggac

SEQ ID NO: 1394771 - RNA, 14 nt, Human
ccccugagcuugca

SEQ ID NO: 1394772 - RNA, 15 nt, Human
agaauaccacaggaa

SEQ ID NO: 1394773 - RNA, 13 nt, Human
aaaaaugguuuaa

SEQ ID NO: 1394774 - RNA, 13 nt, Human
uuuuauaugcuau

SEQ ID NO: 1394775 - RNA, 17 nt, Human
uccacaacacacagauu

SEQ ID NO: 1394776 - RNA, 19 nt, Human
acucugucucaguccauga

SEQ ID NO: 1394777 - RNA, 17 nt, Human
gaagaccucauuuugaa

SEQ ID NO: 1394778 - RNA, 22 nt, Human
ggccggcgcgcucaucccaccc

SEQ ID NO: 1394779 - RNA, 19 nt, Human
accccugagcuugcagaga

SEQ ID NO: 1394780 - RNA, 17 nt, Human
aagacagugaaagaaaa

SEQ ID NO: 1394781 - RNA, 15 nt, Human
aaugaauggcuaagc

SEQ ID NO: 1394782 - RNA, 17 nt, Human
agugagacagcucugca

SEQ ID NO: 1394783 - RNA, 21 nt, Human
gcagcauuguuggcuguuccu

SEQ ID NO: 1394784 - RNA, 18 nt, Human
uagaauauauuuccuuau

SEQ ID NO: 1394785 - RNA, 12 nt, Human
gcgagcgcgcgc

SEQ ID NO: 1394786 - RNA, 17 nt, Human
ucuuauaauuuaaaaua

SEQ ID NO: 1394787 - RNA, 15 nt, Human
cagugucugcuggag

SEQ ID NO: 1394788 - RNA, 21 nt, Human
ccucuguucugcacacagcac

SEQ ID NO: 1394789 - RNA, 13 nt, Human
uaccccuggccaa

SEQ ID NO: 1394790 - RNA, 15 nt, Human
aauuauuucacuuua

SEQ ID NO: 1394791 - RNA, 18 nt, Human
uccucgccacgcucuggg

SEQ ID NO: 1394792 - RNA, 19 nt, Human
ccuuagcccuuccccucug

SEQ ID NO: 1394793 - RNA, 19 nt, Human
gcccuuccccucugcagcu

SEQ ID NO: 1394794 - RNA, 15 nt, Human
acaagacccaaaagg

SEQ ID NO: 1394795 - RNA, 16 nt, Human
aauauaaauaaaaaua

SEQ ID NO: 1394796 - RNA, 13 nt, Human
aauuauuucacuu

SEQ ID NO: 1394797 - RNA, 23 nt, Human
gaaaaucuuauaauuuaaaauau

SEQ ID NO: 1394798 - RNA, 15 nt, Human
ccaugugcagccacc

SEQ ID NO: 1394799 - RNA, 18 nt, Human
aauaucaguuauuuuuaa

SEQ ID NO: 1394800 - RNA, 18 nt, Human
uuguacucugaaaguuuu

SEQ ID NO: 1394801 - RNA, 13 nt, Human
aguguuuagcaua

SEQ ID NO: 1394802 - RNA, 15 nt, Human
cccugcaaagcccag

SEQ ID NO: 1394803 - RNA, 14 nt, Human
cgcgcugcgcgccg

SEQ ID NO: 1394804 - RNA, 22 nt, Human
uugacccacaagaaaugaaagc

SEQ ID NO: 1394805 - RNA, 15 nt, Human
uuuagugaaauauua

SEQ ID NO: 1394806 - RNA, 13 nt, Human
cacaacacacaga

SEQ ID NO: 1394807 - RNA, 21 nt, Human
aagcuccauuuuuagugaaau

SEQ ID NO: 1394808 - RNA, 13 nt, Human
cucagaaaacaag

SEQ ID NO: 1394809 - RNA, 21 nt, Human
guuuguuuauuuguuuuucca

SEQ ID NO: 1394810 - RNA, 20 nt, Human
aauuaaguuuuuuuuuaaaa

SEQ ID NO: 1394811 - RNA, 14 nt, Human
aagcucuaucacca

SEQ ID NO: 1394812 - RNA, 20 nt, Human
uaggaauugacccacaagaa

SEQ ID NO: 1394813 - RNA, 22 nt, Human
agacucugucucaguccaugaa

SEQ ID NO: 1394814 - RNA, 21 nt, Human
gaaaaguauguuagugcaaau

SEQ ID NO: 1394815 - RNA, 23 nt, Human
uaaguuuuuuuuuaaaaaagaaa

SEQ ID NO: 1394816 - RNA, 19 nt, Human
uggcaagcucuaucaccaa

SEQ ID NO: 1394817 - RNA, 13 nt, Human
cucugagccuugg

SEQ ID NO: 1394818 - RNA, 15 nt, Human
aucuuauaauuuaaa

SEQ ID NO: 1394819 - RNA, 13 nt, Human
agccucagucucc

SEQ ID NO: 1394820 - RNA, 17 nt, Human
uaugugcauauuuuauu

SEQ ID NO: 1394821 - RNA, 19 nt, Human
auuuugugaagcaaaauuu

SEQ ID NO: 1394822 - RNA, 17 nt, Human
cgcgcugcgcgccgcgc

SEQ ID NO: 1394823 - RNA, 14 nt, Human
uguauucuuuuagu

SEQ ID NO: 1394824 - RNA, 21 nt, Human
cuaaauugacacuuaaaaaug

SEQ ID NO: 1394825 - RNA, 15 nt, Human
agucaccucauggaa

SEQ ID NO: 1394826 - RNA, 16 nt, Human
auuuaguuauaaaaau

SEQ ID NO: 1394827 - RNA, 22 nt, Human
cagcccuggugggcagagaggu

SEQ ID NO: 1394828 - RNA, 18 nt, Human
uacuuuauuuucuauaau

SEQ ID NO: 1394829 - RNA, 19 nt, Human
auuguaggugacuauuaua

SEQ ID NO: 1394830 - RNA, 13 nt, Human
uggacgagaaaac

SEQ ID NO: 1394831 - RNA, 15 nt, Human
ccucagucucccucc

SEQ ID NO: 1394832 - RNA, 18 nt, Human
ggaaagaauaaccaacac

SEQ ID NO: 1394833 - RNA, 23 nt, Human
cagcugccccggggaggggcgcu

SEQ ID NO: 1394834 - RNA, 22 nt, Human
ucuacuaaaaauacaaaaaaaa

SEQ ID NO: 1394835 - RNA, 18 nt, Human
aaaguaacccuacaaaac

SEQ ID NO: 1394836 - RNA, 20 nt, Human
aacagucucuugaggcacag

SEQ ID NO: 1394837 - RNA, 20 nt, Human
agggcaguguucccuggggc

SEQ ID NO: 1394838 - RNA, 14 nt, Human
cucuggcuccagcu

SEQ ID NO: 1394839 - RNA, 15 nt, Human
auaaauaaaaauaau

SEQ ID NO: 1394840 - RNA, 22 nt, Human
agagccggagccuccagcugcc

SEQ ID NO: 1394841 - RNA, 16 nt, Human
ggcugagccucagucu

SEQ ID NO: 1394842 - RNA, 14 nt, Human
gcugguggcucugu

SEQ ID NO: 1394843 - RNA, 13 nt, Human
ccagcacagccuc

SEQ ID NO: 1394844 - RNA, 21 nt, Human
caucuagcaugucgucaaagc

SEQ ID NO: 1394845 - RNA, 20 nt, Human
cagagaaguuuucuggaggu

SEQ ID NO: 1394846 - RNA, 13 nt, Human
auguagaauauau

SEQ ID NO: 1394847 - RNA, 11 nt, Human
accauuuuuac

SEQ ID NO: 1394848 - RNA, 21 nt, Human
aagauauuaacugagaaggcu

SEQ ID NO: 1394849 - RNA, 16 nt, Human
ggcagagagguaggga

SEQ ID NO: 1394850 - RNA, 20 nt, Human
ugagagacacacugaagaag

SEQ ID NO: 1394851 - RNA, 21 nt, Human
gcauggccacaucugagcccc

SEQ ID NO: 1394852 - RNA, 16 nt, Human
uauucagaauuucuaa

SEQ ID NO: 1394853 - RNA, 11 nt, Human
ggucacaggaa

SEQ ID NO: 1394854 - RNA, 16 nt, Human
aggccaugggacaggg

SEQ ID NO: 1394855 - RNA, 21 nt, Human
aaugugacuuaaugccacuaa

SEQ ID NO: 1394856 - RNA, 14 nt, Human
ugcuucuguuuuau

SEQ ID NO: 1394857 - RNA, 17 nt, Human
agcuucacuguaaaaua

SEQ ID NO: 1394858 - RNA, 17 nt, Human
cggccgcgcugcgcgcc

SEQ ID NO: 1394859 - RNA, 14 nt, Human
ggcaauagucaaau

SEQ ID NO: 1394860 - RNA, 15 nt, Human
aauauauauuuuaga

SEQ ID NO: 1394861 - RNA, 21 nt, Human
ugagaaggcuguggauuuaau

SEQ ID NO: 1394862 - RNA, 18 nt, Human
agcauuguuggcuguucc

SEQ ID NO: 1394863 - RNA, 15 nt, Human
cgcccacuuccuccc

SEQ ID NO: 1394864 - RNA, 21 nt, Human
uauuauuuuauagcuacuaau

SEQ ID NO: 1394865 - RNA, 22 nt, Human
aaagacagugaaagaaaauaac

SEQ ID NO: 1394866 - RNA, 17 nt, Human
guugcugggggggauug

SEQ ID NO: 1394867 - RNA, 12 nt, Human
aucauuuacuuu

SEQ ID NO: 1394868 - RNA, 17 nt, Human
aauucuugccaaauaua

SEQ ID NO: 1394869 - RNA, 13 nt, Human
aagacagugaaag

SEQ ID NO: 1394870 - RNA, 18 nt, Human
auagaauuaacacaugau

SEQ ID NO: 1394871 - RNA, 19 nt, Human
ugaaauggacuuuuguaca

SEQ ID NO: 1394872 - RNA, 19 nt, Human
cccuuccccucugcagcuu

SEQ ID NO: 1394873 - RNA, 17 nt, Human
uucucuaggaaauauuu

SEQ ID NO: 1394874 - RNA, 21 nt, Human
ggcaccgcuguacgcgagcgc

SEQ ID NO: 1394875 - RNA, 18 nt, Human
gcgcgcccucuggcugcu

SEQ ID NO: 1394876 - RNA, 23 nt, Human
caugcugucuacacuaagagaga

SEQ ID NO: 1394877 - RNA, 15 nt, Human
ugccgugggccugag

SEQ ID NO: 1394878 - RNA, 17 nt, Human
gauaaaagacagugaaa

SEQ ID NO: 1394879 - RNA, 23 nt, Human
ggcugcgcucggccugcucgccc

SEQ ID NO: 1394880 - RNA, 16 nt, Human
auaucaguuauuuuua

SEQ ID NO: 1394881 - RNA, 22 nt, Human
accuuaucuauguagaauauau

SEQ ID NO: 1394882 - RNA, 21 nt, Human
ugaaauggacuuuuguacaua

SEQ ID NO: 1394883 - RNA, 14 nt, Human
cucaccagucccuc

SEQ ID NO: 1394884 - RNA, 20 nt, Human
augcaguuguugcccacagc

SEQ ID NO: 1394885 - RNA, 16 nt, Human
uucuauaauuuaaaua

SEQ ID NO: 1394886 - RNA, 11 nt, Human
uuauauuuauu

SEQ ID NO: 1394887 - RNA, 23 nt, Human
ccccggggaggggcgcucgcuuc

SEQ ID NO: 1394888 - RNA, 23 nt, Human
gaccccugagcuugcagagauga

SEQ ID NO: 1394889 - RNA, 18 nt, Human
auggcuugaguuuaaauu

SEQ ID NO: 1394890 - RNA, 17 nt, Human
caccugcugagccccaa

SEQ ID NO: 1394891 - RNA, 21 nt, Human
aaucaccaaggcugauuaaac

SEQ ID NO: 1394892 - RNA, 16 nt, Human
acaugaaguccaagca

SEQ ID NO: 1394893 - RNA, 15 nt, Human
cugacucuuaagaag

SEQ ID NO: 1394894 - RNA, 15 nt, Human
ucugucucaguccau

SEQ ID NO: 1394895 - RNA, 12 nt, Human
auucugaaagca

SEQ ID NO: 1394896 - RNA, 13 nt, Human
uuucuaaaaguuu

SEQ ID NO: 1394897 - RNA, 13 nt, Human
caucccacccgcc

SEQ ID NO: 1394898 - RNA, 17 nt, Human
acuguaaagcuuugugc

SEQ ID NO: 1394899 - RNA, 19 nt, Human
guacugagagugaacaaau

SEQ ID NO: 1394900 - RNA, 16 nt, Human
uuccuuacucuugauu

SEQ ID NO: 1394901 - RNA, 13 nt, Human
guuguguguggaa

SEQ ID NO: 1394902 - RNA, 21 nt, Human
aagucuuucacauuuaaauaa

SEQ ID NO: 1394903 - RNA, 18 nt, Human
auuauuuuuuaaaaaaau

SEQ ID NO: 1394904 - RNA, 20 nt, Human
aauaucuuuuuuuuaauaaa

SEQ ID NO: 1394905 - RNA, 17 nt, Human
auaaguacaugauaagc

SEQ ID NO: 1394906 - RNA, 15 nt, Human
auuuuaaaagaauga

SEQ ID NO: 1394907 - RNA, 18 nt, Human
uaggaaauauuuuaaugu

SEQ ID NO: 1394908 - RNA, 20 nt, Human
ugaaaaucuuauaauuuaaa

SEQ ID NO: 1394909 - RNA, 22 nt, Human
ugaccauacuaauuauaccccc

SEQ ID NO: 1394910 - RNA, 15 nt, Human
cauguccacugguuc

SEQ ID NO: 1394911 - RNA, 23 nt, Human
cuagucuguuuucccuccuugga

SEQ ID NO: 1394912 - RNA, 18 nt, Human
acaaaugggaaacaaaag

SEQ ID NO: 1394913 - RNA, 17 nt, Human
uaacgauaaaagacagu

SEQ ID NO: 1394914 - RNA, 22 nt, Human
aaacauccuacaagacacagug

SEQ ID NO: 1394915 - RNA, 23 nt, Human
gggagccugaucaccugcccugc

SEQ ID NO: 1394916 - RNA, 14 nt, Human
aauauaaauaaaaa

SEQ ID NO: 1394917 - RNA, 12 nt, Human
ccuucagccuga

SEQ ID NO: 1394918 - RNA, 17 nt, Human
uaugccacaagaacccc

SEQ ID NO: 1394919 - RNA, 21 nt, Human
cuggccuucggccuccauccu

SEQ ID NO: 1394920 - RNA, 13 nt, Human
uauuuauuuuaau

SEQ ID NO: 1394921 - RNA, 23 nt, Human
ucuaccaaaaaucucaauauuuc

SEQ ID NO: 1394922 - RNA, 22 nt, Human
ugguagcuaaauauauauuuua

SEQ ID NO: 1394923 - RNA, 19 nt, Human
cuggccuucggccuccauc

SEQ ID NO: 1394924 - RNA, 16 nt, Human
guugagguaccuccaa

SEQ ID NO: 1394925 - RNA, 19 nt, Human
ugcucgcccacuuccuccc

SEQ ID NO: 1394926 - RNA, 13 nt, Human
uaaacauguuuau

SEQ ID NO: 1394927 - RNA, 16 nt, Human
aucaaaagaaagaaaa

SEQ ID NO: 1394928 - RNA, 16 nt, Human
auaaugaauacuuuau

SEQ ID NO: 1394929 - RNA, 22 nt, Human
uggaagccagaucuaugccaca

SEQ ID NO: 1394930 - RNA, 18 nt, Human
acuggacucaccuccccc

SEQ ID NO: 1394931 - RNA, 13 nt, Human
uuaaauuguaaua

SEQ ID NO: 1394932 - RNA, 17 nt, Human
caccucccccaucucuu

SEQ ID NO: 1394933 - RNA, 19 nt, Human
aaucuacacuccagugaga

SEQ ID NO: 1394934 - RNA, 23 nt, Human
ugaauuacauuuguauaaaauaa

SEQ ID NO: 1394935 - RNA, 17 nt, Human
gugccuguaaucacagc

SEQ ID NO: 1394936 - RNA, 20 nt, Human
gaaaauaacaauaaaagaca

SEQ ID NO: 1394937 - RNA, 17 nt, Human
cauaguaccucugcuau

SEQ ID NO: 1394938 - RNA, 17 nt, Human
agucccaggcugagccu

SEQ ID NO: 1394939 - RNA, 19 nt, Human
agcagcuuauucacaagac

SEQ ID NO: 1394940 - RNA, 20 nt, Human
acggagccgggaaagaagag

SEQ ID NO: 1394941 - RNA, 20 nt, Human
auccucgaggcccuagcauu

SEQ ID NO: 1394942 - RNA, 17 nt, Human
uugugaagcaaaauuuu

SEQ ID NO: 1394943 - RNA, 14 nt, Human
ugcagcuuccaggc

SEQ ID NO: 1394944 - RNA, 14 nt, Human
ggaccaucccggcc

SEQ ID NO: 1394945 - RNA, 23 nt, Human
auuccugacugcuaguuuauaua

SEQ ID NO: 1394946 - RNA, 23 nt, Human
acugucuuguuggacgagaaaac

SEQ ID NO: 1394947 - RNA, 17 nt, Human
aaagacaaggaaaaaau

SEQ ID NO: 1394948 - RNA, 23 nt, Human
ggccugagaccaaggcccccggg

SEQ ID NO: 1394949 - RNA, 19 nt, Human
auugaggacacugauaugg

SEQ ID NO: 1394950 - RNA, 23 nt, Human
cucauguccacugguucuucuug

SEQ ID NO: 1394951 - RNA, 15 nt, Human
aauucugaaagcaac

SEQ ID NO: 1394952 - RNA, 17 nt, Human
guucgcgcgccuccgcu

SEQ ID NO: 1394953 - RNA, 13 nt, Human
uccagcugccccg

SEQ ID NO: 1394954 - RNA, 15 nt, Human
ucugcagauaaacag

SEQ ID NO: 1394955 - RNA, 15 nt, Human
ugagcucagcccugg

SEQ ID NO: 1394956 - RNA, 18 nt, Human
ccggggaggggcgcucgc

SEQ ID NO: 1394957 - RNA, 22 nt, Human
acaccuuguacuuuauuuucua

SEQ ID NO: 1394958 - RNA, 20 nt, Human
cuuccccucugcagcuucca

SEQ ID NO: 1394959 - RNA, 16 nt, Human
gacuauuauauuucca

SEQ ID NO: 1394960 - RNA, 17 nt, Human
agccgggaaagaagagc

SEQ ID NO: 1394961 - RNA, 21 nt, Human
auauuuccuuauucagaauuu

SEQ ID NO: 1394962 - RNA, 20 nt, Human
gcgcugcgcgccgcgcuccu

SEQ ID NO: 1394963 - RNA, 15 nt, Human
uccagauccuggaaa

SEQ ID NO: 1394964 - RNA, 13 nt, Human
cggccggcgcgcu

SEQ ID NO: 1394965 - RNA, 21 nt, Human
auuuguauaaaauaauuuuua

SEQ ID NO: 1394966 - RNA, 20 nt, Human
cugagccucagucucccucc

SEQ ID NO: 1394967 - RNA, 22 nt, Human
uacugagagugaacaaauuuac

SEQ ID NO: 1394968 - RNA, 13 nt, Human
caucgcagacaca

SEQ ID NO: 1394969 - RNA, 22 nt, Human
uauaagaaauaggaaauauuuu

SEQ ID NO: 1394970 - RNA, 17 nt, Human
ugcccauaccccuggcc

SEQ ID NO: 1394971 - RNA, 16 nt, Human
ccugaucaccugcccu

SEQ ID NO: 1394972 - RNA, 17 nt, Human
guuuaauaauuuuuaau

SEQ ID NO: 1394973 - RNA, 15 nt, Human
cucccuuggggccua

SEQ ID NO: 1394974 - RNA, 21 nt, Human
gcaaaauuuuuucucuaggaa

SEQ ID NO: 1394975 - RNA, 17 nt, Human
uucugagcauuuaauau

SEQ ID NO: 1394976 - RNA, 23 nt, Human
cuaguaauuggaaaggcagcucu

SEQ ID NO: 1394977 - RNA, 17 nt, Human
aaccuucugaggagcug

SEQ ID NO: 1394978 - RNA, 14 nt, Human
auguagaauauauu

SEQ ID NO: 1394979 - RNA, 17 nt, Human
cccacuagacccacugg

SEQ ID NO: 1394980 - RNA, 18 nt, Human
cuuugagcgcccacuaga

SEQ ID NO: 1394981 - RNA, 18 nt, Human
aaagaaaaucaggcuggc

SEQ ID NO: 1394982 - RNA, 19 nt, Human
auuuucuauaauuuaaaua

SEQ ID NO: 1394983 - RNA, 18 nt, Human
ccugaaagaggaaugaag

SEQ ID NO: 1394984 - RNA, 16 nt, Human
ggaggggcgcucgcuu

SEQ ID NO: 1394985 - RNA, 22 nt, Human
uggaaaguuuaugguuguauua

SEQ ID NO: 1394986 - RNA, 18 nt, Human
aauuuuuuugugggaaau

SEQ ID NO: 1394987 - RNA, 20 nt, Human
cagugaaagaaaauaacgau

SEQ ID NO: 1394988 - RNA, 13 nt, Human
gacaaggaaaaaa

SEQ ID NO: 1394989 - RNA, 21 nt, Human
guuguaauuuuuuugugggaa

SEQ ID NO: 1394990 - RNA, 17 nt, Human
uguucuaagaagugaaa

SEQ ID NO: 1394991 - RNA, 18 nt, Human
cagcugcucaauaaagua

SEQ ID NO: 1394992 - RNA, 21 nt, Human
acagugauuaccagggacuga

SEQ ID NO: 1394993 - RNA, 20 nt, Human
uaauaaguugcauagguuua

SEQ ID NO: 1394994 - RNA, 23 nt, Human
cugagaaggcuguggauuuaaug

SEQ ID NO: 1394995 - RNA, 13 nt, Human
aagcuucuguucc

SEQ ID NO: 1394996 - RNA, 12 nt, Human
cuccaaggaccg

SEQ ID NO: 1394997 - RNA, 14 nt, Human
ugcuaagucuuaua

SEQ ID NO: 1394998 - RNA, 22 nt, Human
ugugagcucaccagucccuccc

SEQ ID NO: 1394999 - RNA, 14 nt, Human
auuuauguuuaauu

SEQ ID NO: 1395000 - RNA, 17 nt, Human
caucagcaucccuagaa

SEQ ID NO: 1395001 - RNA, 14 nt, Human
uccacuuggucugu

SEQ ID NO: 1395002 - RNA, 16 nt, Human
agaauauauuuccuua

SEQ ID NO: 1395003 - RNA, 13 nt, Human
ggugugugcagca

SEQ ID NO: 1395004 - RNA, 17 nt, Human
guuagagaauuuccuua

SEQ ID NO: 1395005 - RNA, 16 nt, Human
cuuggagacagggccc

SEQ ID NO: 1395006 - RNA, 22 nt, Human
gcggguccgggucgcaggacca

SEQ ID NO: 1395007 - RNA, 16 nt, Human
aagcuucacuguaaaa

SEQ ID NO: 1395008 - RNA, 18 nt, Human
uggucaauuuuguuaugu

SEQ ID NO: 1395009 - RNA, 23 nt, Human
ggucuaucuuugagcgcccacua

SEQ ID NO: 1395010 - RNA, 23 nt, Human
caaagcugaaauggacuuuugua

SEQ ID NO: 1395011 - RNA, 19 nt, Human
auuuucaguuauuauauuu

SEQ ID NO: 1395012 - RNA, 23 nt, Human
auucaauaucuuuuuuuuaauaa

SEQ ID NO: 1395013 - RNA, 16 nt, Human
uugucaauaaaaucca

SEQ ID NO: 1395014 - RNA, 23 nt, Human
gaaaaaguucugcagauaaacag

SEQ ID NO: 1395015 - RNA, 21 nt, Human
cugauauuggacaguaaaauc

SEQ ID NO: 1395016 - RNA, 20 nt, Human
aaagacaaggaaaaaauaac

SEQ ID NO: 1395017 - RNA, 23 nt, Human
aaaauaucacuugucaauaaaau

SEQ ID NO: 1395018 - RNA, 18 nt, Human
ggcccugugcggccuggu

SEQ ID NO: 1395019 - RNA, 15 nt, Human
agggcucacagaauu

SEQ ID NO: 1395020 - RNA, 18 nt, Human
acuguuaucuucacuuuu

SEQ ID NO: 1395021 - RNA, 16 nt, Human
ccaugugcagccacca

SEQ ID NO: 1395022 - RNA, 20 nt, Human
aagaugguaccaccagucug

SEQ ID NO: 1395023 - RNA, 20 nt, Human
caagagccuuuuuuugaaaa

SEQ ID NO: 1395024 - RNA, 11 nt, Human
aaccugagccc

SEQ ID NO: 1395025 - RNA, 20 nt, Human
caaauauaaauaaaaauaau

SEQ ID NO: 1395026 - RNA, 14 nt, Human
uacuaauuuuaaaa

SEQ ID NO: 1395027 - RNA, 16 nt, Human
aacgagacaagcagcc

SEQ ID NO: 1395028 - RNA, 22 nt, Human
ccauacuaauuauacccccugc

SEQ ID NO: 1395029 - RNA, 22 nt, Human
cugcucaauaaaguacaagagc

SEQ ID NO: 1395030 - RNA, 15 nt, Human
uucugcacacagcac

SEQ ID NO: 1395031 - RNA, 20 nt, Human
cgcauccuagucucuaucau

SEQ ID NO: 1395032 - RNA, 18 nt, Human
aguccauugggcaggcag

SEQ ID NO: 1395033 - RNA, 19 nt, Human
cucacauuuauauuuuugu

SEQ ID NO: 1395034 - RNA, 17 nt, Human
cuaagcuucacuguaaa

SEQ ID NO: 1395035 - RNA, 17 nt, Human
uuacagagacagaaagc

SEQ ID NO: 1395036 - RNA, 16 nt, Human
ccagggcuacgcgcgc

SEQ ID NO: 1395037 - RNA, 19 nt, Human
uacuucuuaggguuaugau

SEQ ID NO: 1395038 - RNA, 13 nt, Human
aagugcagccccg

SEQ ID NO: 1395039 - RNA, 16 nt, Human
gaagauguagaggaga

SEQ ID NO: 1395040 - RNA, 16 nt, Human
ccauuuuuagugaaau

SEQ ID NO: 1395041 - RNA, 15 nt, Human
uuccaagaaauauuc

SEQ ID NO: 1395042 - RNA, 17 nt, Human
cucccuggaaucuugua

SEQ ID NO: 1395043 - RNA, 14 nt, Human
uucacauuuaaaua

SEQ ID NO: 1395044 - RNA, 22 nt, Human
agaaaacaauaacgauaaaaga

SEQ ID NO: 1395045 - RNA, 18 nt, Human
caagccucauguccacug

SEQ ID NO: 1395046 - RNA, 22 nt, Human
aggaugccccgucccccucugg

SEQ ID NO: 1395047 - RNA, 15 nt, Human
aaauguauucuuuua

SEQ ID NO: 1395048 - RNA, 14 nt, Human
ccugccccugagcc

SEQ ID NO: 1395049 - RNA, 14 nt, Human
auuuauuuuaauaa

SEQ ID NO: 1395050 - RNA, 23 nt, Human
uuauagcuacuaauuuuaaaaug

SEQ ID NO: 1395051 - RNA, 21 nt, Human
agccucuuagaugcaguucug

SEQ ID NO: 1395052 - RNA, 17 nt, Human
ucugguagcuaaauaua

SEQ ID NO: 1395053 - RNA, 17 nt, Human
aagacaaggaaaaaaua

SEQ ID NO: 1395054 - RNA, 16 nt, Human
aaauauuccuuaagau

SEQ ID NO: 1395055 - RNA, 14 nt, Human
agagguccacaaca

SEQ ID NO: 1395056 - RNA, 22 nt, Human
cauuuaaauaaaguguuugaaa

SEQ ID NO: 1395057 - RNA, 15 nt, Human
caagcucacagaccu

SEQ ID NO: 1395058 - RNA, 16 nt, Human
agugaaagaaaauaac

SEQ ID NO: 1395059 - RNA, 19 nt, Human
guaaagcuuugugcagauu

SEQ ID NO: 1395060 - RNA, 23 nt, Human
ugaaaaucuuauaauuuaaaaua

SEQ ID NO: 1395061 - RNA, 16 nt, Human
uuacccccugggagcc

SEQ ID NO: 1395062 - RNA, 20 nt, Human
cagcuuccaggcuggcgugc

SEQ ID NO: 1395063 - RNA, 14 nt, Human
ccuuaucaaaggac

SEQ ID NO: 1395064 - RNA, 13 nt, Human
cgcgcugcgcgcc

SEQ ID NO: 1395065 - RNA, 17 nt, Human
gaaagccaugugcagcc

SEQ ID NO: 1395066 - RNA, 13 nt, Human
agaaguaaaaaca

SEQ ID NO: 1395067 - RNA, 14 nt, Human
agagaauuuccuua

SEQ ID NO: 1395068 - RNA, 21 nt, Human
cucagugucaaugcagccccc

SEQ ID NO: 1395069 - RNA, 16 nt, Human
ugcuaagucuuauaua

SEQ ID NO: 1395070 - RNA, 18 nt, Human
gcaaagcccagcuugaaa

SEQ ID NO: 1395071 - RNA, 16 nt, Human
ugccucaccccuugcc

SEQ ID NO: 1395072 - RNA, 23 nt, Human
agaguuuagcuggaaaaguaugu

SEQ ID NO: 1395073 - RNA, 17 nt, Human
agaacucccuuucaaca

SEQ ID NO: 1395074 - RNA, 18 nt, Human
cugagccuugggaccccu

SEQ ID NO: 1395075 - RNA, 15 nt, Human
cuacaagacacagug

SEQ ID NO: 1395076 - RNA, 19 nt, Human
uguaguguuggagaagaac

SEQ ID NO: 1395077 - RNA, 12 nt, Human
uaguuuuuaaag

SEQ ID NO: 1395078 - RNA, 17 nt, Human
cuggagggaagccuugg

SEQ ID NO: 1395079 - RNA, 22 nt, Human
gagccucagucucccucccuug

SEQ ID NO: 1395080 - RNA, 12 nt, Human
accccugagcuu

SEQ ID NO: 1395081 - RNA, 17 nt, Human
uuaauaauuuuuaauua

SEQ ID NO: 1395082 - RNA, 12 nt, Human
ggcagcaccucc

SEQ ID NO: 1395083 - RNA, 14 nt, Human
ccucagucucccuc

SEQ ID NO: 1395084 - RNA, 22 nt, Human
agcagcauaaauguugacaugg

SEQ ID NO: 1395085 - RNA, 19 nt, Human
gcuggccuugugaggagcu

SEQ ID NO: 1395086 - RNA, 16 nt, Human
ccuaagugcagccccg

SEQ ID NO: 1395087 - RNA, 16 nt, Human
ccaggcugagccucag

SEQ ID NO: 1395088 - RNA, 14 nt, Human
auacaaaaaaaaaa

SEQ ID NO: 1395089 - RNA, 12 nt, Human
uaaaugcucaau

SEQ ID NO: 1395090 - RNA, 17 nt, Human
uuuuuaauuauauggcu

SEQ ID NO: 1395091 - RNA, 22 nt, Human
agucuuucacauuuaaauaaag

SEQ ID NO: 1395092 - RNA, 16 nt, Human
auugucuagugaaacu

SEQ ID NO: 1395093 - RNA, 18 nt, Human
cuuuccacagaagcucca

SEQ ID NO: 1395094 - RNA, 17 nt, Human
aaauaacaauaaaagac

SEQ ID NO: 1395095 - RNA, 18 nt, Human
cuucucacauuuauauuu

SEQ ID NO: 1395096 - RNA, 17 nt, Human
aguauuucuaugaaaua

SEQ ID NO: 1395097 - RNA, 15 nt, Human
cgcauccuagucucu

SEQ ID NO: 1395098 - RNA, 13 nt, Human
cagaaacuccugu

SEQ ID NO: 1395099 - RNA, 22 nt, Human
cuccugccuaagugcagccccg

SEQ ID NO: 1395100 - RNA, 15 nt, Human
ucccuuuguccacaa

SEQ ID NO: 1395101 - RNA, 17 nt, Human
cuaguuguaauuuuuuu

SEQ ID NO: 1395102 - RNA, 20 nt, Human
aucaaccugccagcuggccu

SEQ ID NO: 1395103 - RNA, 19 nt, Human
uccuagucucuaucauuaa

SEQ ID NO: 1395104 - RNA, 13 nt, Human
agcuucuguuccg

SEQ ID NO: 1395105 - RNA, 15 nt, Human
gugaccacugcagaa

SEQ ID NO: 1395106 - RNA, 14 nt, Human
aagagugaaggauu

SEQ ID NO: 1395107 - RNA, 11 nt, Human
gccuccagcug

SEQ ID NO: 1395108 - RNA, 23 nt, Human
aggaugguucccuugaugaagaa

SEQ ID NO: 1395109 - RNA, 14 nt, Human
ccaaauauaaauaa

SEQ ID NO: 1395110 - RNA, 18 nt, Human
cugcucaauaaaguacaa

SEQ ID NO: 1395111 - RNA, 22 nt, Human
uuaaaaaaaaaacguauugcau

SEQ ID NO: 1395112 - RNA, 12 nt, Human
cgcgccuccgcu

SEQ ID NO: 1395113 - RNA, 22 nt, Human
gaaauaagccagacaucaacag

SEQ ID NO: 1395114 - RNA, 23 nt, Human
aacuccugcuagaacagucucuu

SEQ ID NO: 1395115 - RNA, 21 nt, Human
agucucccucccuuggggccu

SEQ ID NO: 1395116 - RNA, 19 nt, Human
ccaaggcccccgggccgac

SEQ ID NO: 1395117 - RNA, 14 nt, Human
cagauuugagcuca

SEQ ID NO: 1395118 - RNA, 19 nt, Human
gagccugaucaccugcccu

SEQ ID NO: 1395119 - RNA, 22 nt, Human
uuaccucugccucagaaaacaa

SEQ ID NO: 1395120 - RNA, 17 nt, Human
aaucuuauaauuuaaaa

SEQ ID NO: 1395121 - RNA, 18 nt, Human
ugugcauauuuuauuaua

SEQ ID NO: 1395122 - RNA, 16 nt, Human
cuaggcauagcccugc

SEQ ID NO: 1395123 - RNA, 22 nt, Human
gaauuaaguuuuuuuuuaaaaa

SEQ ID NO: 1395124 - RNA, 19 nt, Human
ugcuauuugcuguuauuuu

SEQ ID NO: 1395125 - RNA, 18 nt, Human
gaagcaaaauuuuuucuc

SEQ ID NO: 1395126 - RNA, 15 nt, Human
caguuauuuuuaaac

SEQ ID NO: 1395127 - RNA, 14 nt, Human
acauauauaacaau

SEQ ID NO: 1395128 - RNA, 16 nt, Human
cucaauaaaguacaag

SEQ ID NO: 1395129 - RNA, 17 nt, Human
gcaugguuuagaaagcu

SEQ ID NO: 1395130 - RNA, 12 nt, Human
acaagaaaugaa

SEQ ID NO: 1395131 - RNA, 23 nt, Human
aucauuaaaguucuagugaccga

SEQ ID NO: 1395132 - RNA, 14 nt, Human
cugcugagucccag

SEQ ID NO: 1395133 - RNA, 13 nt, Human
ccucauggaauug

SEQ ID NO: 1395134 - RNA, 20 nt, Human
gcgcggggcggggagcgagc

SEQ ID NO: 1395135 - RNA, 12 nt, Human
gggaaagaagag

SEQ ID NO: 1395136 - RNA, 21 nt, Human
ucccuggggcuuuaacuccug

SEQ ID NO: 1395137 - RNA, 20 nt, Human
ccauacuaauuauacccccu

SEQ ID NO: 1395138 - RNA, 16 nt, Human
agcuaaauauauauuu

SEQ ID NO: 1395139 - RNA, 15 nt, Human
uggacucaccucccc

SEQ ID NO: 1395140 - RNA, 16 nt, Human
auacuauuuaauuauu

SEQ ID NO: 1395141 - RNA, 23 nt, Human
uagauguauagguugaugguggu

SEQ ID NO: 1395142 - RNA, 19 nt, Human
cuagucuguuuucccuccu

SEQ ID NO: 1395143 - RNA, 18 nt, Human
gccccugcacuccagccu

SEQ ID NO: 1395144 - RNA, 16 nt, Human
acuguauguccuuggu

SEQ ID NO: 1395145 - RNA, 18 nt, Human
gcugcugccgugggccug

SEQ ID NO: 1395146 - RNA, 16 nt, Human
auccuccaugaauauc

SEQ ID NO: 1395147 - RNA, 22 nt, Human
aauaugccccauucaacaucua

SEQ ID NO: 1395148 - RNA, 16 nt, Human
uaggaaauauuuuaau

SEQ ID NO: 1395149 - RNA, 22 nt, Human
ugaagcaaaauuuuuucucuag

SEQ ID NO: 1395150 - RNA, 18 nt, Human
gaaaauaucacuugucaa

SEQ ID NO: 1395151 - RNA, 16 nt, Human
cugagcgacagugaga

SEQ ID NO: 1395152 - RNA, 13 nt, Human
ucuacuaaaaaua

SEQ ID NO: 1395153 - RNA, 13 nt, Human
cuauuauauuucc

SEQ ID NO: 1395154 - RNA, 15 nt, Human
uccauugggcaggca

SEQ ID NO: 1395155 - RNA, 18 nt, Human
auuuguauaaaauaauuu

SEQ ID NO: 1395156 - RNA, 13 nt, Human
uuuaacuccugcu

SEQ ID NO: 1395157 - RNA, 15 nt, Human
ucagucucccucccu

SEQ ID NO: 1395158 - RNA, 21 nt, Human
uuguaauuuuuuugugggaaa

SEQ ID NO: 1395159 - RNA, 19 nt, Human
ggcaccgcuguacgcgagc

SEQ ID NO: 1395160 - RNA, 15 nt, Human
cagcuggccuuguga

SEQ ID NO: 1395161 - RNA, 13 nt, Human
uacagagacagaa

SEQ ID NO: 1395162 - RNA, 18 nt, Human
cucccuuggggccuaugc

SEQ ID NO: 1395163 - RNA, 20 nt, Human
gccuaauuuguuuucccuuc

SEQ ID NO: 1395164 - RNA, 18 nt, Human
cuccauccugaggcucca

SEQ ID NO: 1395165 - RNA, 13 nt, Human
cgcuuccgcaucc

SEQ ID NO: 1395166 - RNA, 15 nt, Human
aaaauacaaaaaaaa

SEQ ID NO: 1395167 - RNA, 20 nt, Human
ccuguucgcgcgccuccgcu

SEQ ID NO: 1395168 - RNA, 21 nt, Human
gaacagucucuugaggcacag

SEQ ID NO: 1395169 - RNA, 16 nt, Human
auaauccuaaacauau

SEQ ID NO: 1395170 - RNA, 18 nt, Human
auuuuuagugaaauauua

SEQ ID NO: 1395171 - RNA, 24 nt, Human
uggccgggagccugaucaccugcc

SEQ ID NO: 1395172 - RNA, 15 nt, Human
gaccacugcagaaga

SEQ ID NO: 1395173 - RNA, 19 nt, Human
agccuccagcugccccggg

SEQ ID NO: 1395174 - RNA, 13 nt, Human
uuuugaaucauca

SEQ ID NO: 1395175 - RNA, 19 nt, Human
uucuuuaucuuuuuaguau

SEQ ID NO: 1395176 - RNA, 12 nt, Human
caagaaggaaag

SEQ ID NO: 1395177 - RNA, 14 nt, Human
aaaagaaacauuug

SEQ ID NO: 1395178 - RNA, 18 nt, Human
gaggcuccacuuggucug

SEQ ID NO: 1395179 - RNA, 15 nt, Human
agccucagucucccu

SEQ ID NO: 1395180 - RNA, 16 nt, Human
gagcucgugggacagu

SEQ ID NO: 1395181 - RNA, 19 nt, Human
uggaaguaaauguuguuuu

SEQ ID NO: 1395182 - RNA, 20 nt, Human
auuacuguaagaaaauauca

SEQ ID NO: 1395183 - RNA, 14 nt, Human
ccaugggacaggga

SEQ ID NO: 1395184 - RNA, 14 nt, Human
gacggagccgggaa

SEQ ID NO: 1395185 - RNA, 23 nt, Human
gaaugagagacacacugaagaag

SEQ ID NO: 1395186 - RNA, 15 nt, Human
cgggagccugaucac

SEQ ID NO: 1395187 - RNA, 15 nt, Human
auguuagagaauuuc

SEQ ID NO: 1395188 - RNA, 16 nt, Human
gcuucuguuccgugcu

SEQ ID NO: 1395189 - RNA, 23 nt, Human
ggccuccauccugaggcuccacu

SEQ ID NO: 1395190 - RNA, 22 nt, Human
ccuuccccucugcagcuuccag

SEQ ID NO: 1395191 - RNA, 17 nt, Human
ugaaauauuauuuuaua

SEQ ID NO: 1395192 - RNA, 22 nt, Human
uugccuaggcauagcccugccu

SEQ ID NO: 1395193 - RNA, 19 nt, Human
aagcauuccaacuaucuca

SEQ ID NO: 1395194 - RNA, 23 nt, Human
gcgcuggcugcgcucggccugcu

SEQ ID NO: 1395195 - RNA, 22 nt, Human
agugagcagucaggaaagagaa
